United States Patent 6,812,339 (POLYMORPHISMS IN KNOWN GENES ASSOCIATED WITH HUMAN DISEASE, METHODS OF DETECTION AND USES THEREOF) - sequence listing, part 88

SEQ ID NO: 45477 - DNA, 601 bp, Human
ttcccctttcctactaaacgatgcccagagttctgggcacaggccttttgggcaggctctggccccagcatgctttgggctccctctcctatttgctccatgctcaccatacccagaaacaccccccacctccttgttctacagaggctgttctctctccttctcagctactcaaccttctctcaatccatgtcaacaagacgcctcctctttttttgctaggcatggtgactcacacctgtaatctcagcactttgggaggccaaggcaggagaatcacttgagcctaggagttcaagaycagcctgggcaacacagcaagaccccttgtctacaaaaaaaaattaaaaacagaaacctcctcttccaccctgtgcctgctggagactttgtatctttaccagcccaaggtgcttggtgtcagatccccagactctggaatcttgaatccgctgctcgcagatctgactggtcacttaaaccccactgtgcttctgtgaccactgaatgggggaccaggacgcacctacacctcacagggtcgctgtgataagtcgctgaggccgtctcagccccacaccctgcagcaggccagcaagct

SEQ ID NO: 45478 - DNA, 601 bp, Human
gtggaagccccaaacctcagtgcttgtgactgtcagagagctgggaaagccacggaacacacagagcctcccggctcggcgacaatgccctggctgttcccccggcccccaccccctaacaatgctccttttttcttgggcactgaccctcacttatcagggctctgtcctcagaagagcctgcaggcccaggcagctggaccagggaggccctggaaggctgttcccctgctccctgggtggctcctgctctgagccaggccagtcccaatccctggggcctacacaggaagccccggarccacagcaattctccctgccaaccctctgaccccgggacaatggcatctccatgccccttgcatggtcaacagggcagtgttgataggaaaagaggagaccagcatttctcagcctaggacgtcagatcctgcctgcatttcaccatgggtgtgtgtgggtgtgtgtctgcctttctttcaaacagatggtcaaggtcaaactcactgaaaattcaaaatttggtaagagttattaaaggtatttcaaggaatgtgacggttgggtttcactgctggaataaacagcagccactggctga

SEQ ID NO: 45479 - DNA, 601 bp, Human
caggggaggatgcagcccccagaacttggaaatgccaagaaaaatccccccagagcagagcagagaagggctgagagatgctgacagctgccaaaaagggacctacctgctgtcaaggggtggaagccccaaacctcagtgcttgtgactgtcagagagctgggaaagccacggaacacacagagcctcccggctcggcgacaatgccctggctgttcccccggcccccaccccctaacaatgctccttttttcttgggcactgaccctcacttatcagggctctgtcctcagaagagccygcaggcccaggcagctggaccagggaggccctggaaggctgttcccctgctccctgggtggctcctgctctgagccaggccagtcccaatccctggggcctacacaggaagccccggagccacagcaattctccctgccaaccctctgaccccgggacaatggcatctccatgccccttgcatggtcaacagggcagtgttgataggaaaagaggagaccagcatttctcagcctaggacgtcagatcctgcctgcatttcaccatgggtgtgtgtgggtgtgtgtctgcctttctttca

SEQ ID NO: 45480 - DNA, 601 bp, Human
gctctggaaaacctaccctgaccagaggcaaagtgactgggctcacaaaatgcaaaaaggctcctgagtctcttgattctgacccagaaaactcttctgggggccctacaggcctcctcagagggcgactccggcccctctgcccagtctgtgccttcactcctgtatttctgtgcttttcctctccaagaatagaatggggaggcgggctccaccacagctggcccccactgggctgggagatctgtctgctctgctccccactagagggcaggccagcctgagctgcctgggggccccygggacctcccacatcctgcatgaaggtggggactcagtgaaagcctatggctaagtgggcacataatgacccaccaagcaagggagaagcagacactgagatggaagcggcagctgtgcccactgagggagggtgaagaagccagtttagcagcggagaaggctggcatggccccagcacacacgggcagtgggcagtgggcagtgccagtgcccaggggctatgccctgtgtgggcctgcaccacagggccgaggattcagtggttccctccaacctgaggtcctggccctcccatcac

SEQ ID NO: 45481 - DNA, 601 bp, Human
cgggtgcagtggctcacgcctgtcatcccagcactttaggaggctggggcgggcggatcacttggggtcaggagtttgcaaccagcctgggcaacacagtgaaaccccatctctactaaaagtgcaaaaattagctgggcatggtggtgcatgcctgcaatcccagctactcggaaggctgaggcaggagaatcacttgaacccaggaggcggaggttgcagtgagccgagattacgccactgcactccaggctgggcgacagagcgagactccatctcaaataataataataataataaaaaagcattaacaaccttttaaacatcacatgaaaaggggaagttcagtactcaaaatcatttgcaaagactcggttgcgtcaagctaagcagcagcagaagctttcctgcaggacttctcagatactttaatatgttcacttgcacagagatttgcagagaggaagaagctgacactgaaacccttgcatactcacttgggagaattccagagaatgctgccaggtcacagaaatttactgacccacatctgacctgccccaccctcaatgggaggaagtcccccagggaccacatacac

SEQ ID NO: 45482 - DNA, 601 bp, Human
actcctcccttccacaccctggcttccggcctgggatgtttatttttgctgacaataaaaaacatatttcaatgtttgctttatctccatgttccccctagaatggcaactggcagccccggccacaagtggcaaagaattctccaagtcaaaaaaattttctatgcatcctttttaacaataaggagggaaactctgactcaaactcctacaaagcctgcatagattattatttaagccctgaagctgtactctttctatattcattgctttccaatccgaagagagcattccttgaggsagttttccaaactggtatttgatataatagtaacaaagcagccgggtgcagtggctcacgcctgtcatcccagcactttaggaggctggggcgggcggatcacttggggtcaggagtttgcaaccagcctgggcaacacagtgaaaccccatctctactaaaagtgcaaaaattagctgggcatggtggtgcatgcctgcaatcccagctactcggaaggctgaggcaggagaatcacttgaacccaggaggcggaggttgcagtgagccgagattacgccactgcactccaggctgggc

SEQ ID NO: 45483 - DNA, 601 bp, Human
ggaactgagggtgtgagagcggcaccccgcatttacactcagtagagctgactggggaatgtgcaaaaataaaatgaggtgacacgtcccacttgacaaatgctgaaaacatcaagaatgcagtcacagccacccttcttgcttctgccctttatccaaaatgtaaataaaagagaaaccgttactgcttcatgaatcacacacaaaagcctgttctttactctcctctggttttctcaaagcctcagtttgtgtgagtgatgcatgggaaagacaacaggacttgttttcttttctttcwttcattcattcattcattcattcatgcactcattcattgagtaattaagtgaacagagtaagtttgtgcctagcattgctcaagctctgaagatgcaacgtgaagatgaccgccaggtccctgtcctcagtgctcatactcacagcctagtgtgggagacagacaacaaacaagcaaaggaagcgactggaggcaccaccgagggctgcaacatcaatgaagtgcagagggcatgataggaaaggggggcactcgtcagagaaggcctggtacaggctaaactgtgtccccaaaaaacgg

SEQ ID NO: 45484 - DNA, 601 bp, Human
gcacccagcccaactctacgcacttcacatgaactatctcacttaatcatctcaatgaccccatgaggcagagccaattattattcccattgtacagatggggacaccaaggcaactcgccttcatccacacagctaatgatgaaggagctgggagggggccagggaggcagactctgggctagacaactggagaaccacactccagatgttccaacacagggacacgtctacaacatgtgcacgcacgtggacaactgtgtacacgtgcctcaggactcctctgcagatctcagagcccrtgcactagtcactgagtaagcaagacagtcatcaacagaaaacagaaatgatttctgctgctgtccaactggtgcccccattcccaccaaatggcacacgtgacaacctcagtctcacccagggccacctgacccagctgctttggctgagcacaaggggctcactgaaaacccttccctgctctcagtgcccaaggaatcctggctctcctctctccaacctctgccctgaggcttcagtactttccaagtcacccagagagcagtgggaaaaaaaggggctggtccttggctttctgc

SEQ ID NO: 45485 - DNA, 601 bp, Human
gtttggagtctgagagtcagacaggcttagattcaaatccagccaataactaacatccatcgagcacctctgtgcacccagcccaactctacgcacttcacatgaactatctcacttaatcatctcaatgaccccatgaggcagagccaattattattcccattgtacagatggggacaccaaggcaactcgccttcatccacacagctaatgatgaaggagctgggagggggccagggaggcagactctgggctagacaactggagaaccacactccagatgttccaacacagggacacrtctacaacatgtgcacgcacgtggacaactgtgtacacgtgcctcaggactcctctgcagatctcagagcccgtgcactagtcactgagtaagcaagacagtcatcaacagaaaacagaaatgatttctgctgctgtccaactggtgcccccattcccaccaaatggcacacgtgacaacctcagtctcacccagggccacctgacccagctgctttggctgagcacaaggggctcactgaaaacccttccctgctctcagtgcccaaggaatcctggctctcctctctccaacctctgc

SEQ ID NO: 45486 - DNA, 601 bp, Human
ggtggggagtcagaagccacgtaacaaagcctgaccgccctgtgtgtgttgcggggagagcggagaggatcccacacatgaacctcctgttgccaggcctggaggaaggaactcgcggaatcctcttgcccacagcactcctccatggctggccagtgctcttcttcccaagccacctcaagcacagaggtgctccctccccaggcagaaggatgcccaggggttagagggcaggggctgagcctccagctgtgcagcctggggaagggcacatccctcccctccccaagcctgcttcctygcctgtggagtgagggtaaagaaatatccttcctatagtcgcgatgagcacacagccagggccagccatcgattacctccctctgtgactagagctgaccatgctgtacaggtgtcagcaaataggactttcttcctcacatgaggctggatgttctctggcctcagcggaggcctttctggccttctttggctttccaccagcatgattctgataatcacctccaccagaactaccgggacccttatattccaggtgctgcagtgagcaaatgacagacctaatctccttagcacataa

SEQ ID NO: 45487 - DNA, 601 bp, Human
tactgtggaaaaggctgataagaaaacccagaatatgaaaataaaaggactgtgggtatagcagccccttttctgtttttgcttgtttgtttgtttgttttgtagagatgtgctgggtttcaccatgtttggccaggctggtcttgaactcctgatctcatgtgatctgcccgccttggcctcccaaaatgctgggattacaggtgtgagccaccgcacacggcctatcagccccttttctggacacaaggcaggactgcacttcctgattccctggtaaatgggtgatcatgtgactcgwtctggccaatgagctgtgagtgaaaacagaacatgccgtttcctgggcagagcatgtaactgcaggagtaaggtctccagagccctctctcccctctggtgcaggaccagcaaccttccagatggggctgctcagttttagatctctgagtgaataagatggacagagcccccagctggccctgtggacatgtggcatgagtgcggaataacccacggttttcagctaagattctgaggctgttggttaatacagcacaaccaaatctgtcctcataaaatagctggtccccctacccca

SEQ ID NO: 45488 - DNA, 601 bp, Human
ctaggggtggtgacagctctcagggcttgttagcaccggggaactttgtcctgtgctggctctcgggcctgcccacaccctgtgatggtcccttactaaactcctctccgttgcacccccggaacgcagcagctcttgtctgctggtgtctttaactcctctttcttactgtttgccaggaaagatgttaagggatttcccctatatagaaaaaaaaaatatcctttagacctcacaataagaaactactaaggaatgctgttccctccccatggtgacaggcctgtgtacaaaacaacayaaaataaaaccaaaaccaggctagctgagaagctgcccatctctggggctcttgggtgaggaaggggaagggaaagacacttcccaatatctcctgagacttggcgccggctcatcctcacggcaagcccaggggccggggaagacgctccctgctgcaaagaccaggacaccaacggcccaggaaggaaaatgaccaagcaaggccatgcaggtgaagcggccaggatggaggctgtgcagcaatgcccatgtgtcagtctccatgagcagcccgctgacctgggctcaccatcccctg

SEQ ID NO: 45489 - DNA, 601 bp, Human
ttgcagcatcctcacgcccccaccccctgccatatttctggcagcagtcacagcccccatggagcagggcagcccctctctcaacactaccgcctcccctatggctccaggtacatttttggtcccctagtcccctcaggcctaggggtggtgacagctctcagggcttgttagcaccggggaactttgtcctgtgctggctctcgggcctgcccacaccctgtgatggtcccttactaaactcctctccgttgcacccccggaacgcagcagctcttgtctgctggtgtctttaactcctctttcttactgtttgccaggaaagatgttaagggatttcccctatatagaaaaaaaaaatatcctttagacctcacaataagaaactactaaggaatgctgttccctccccatggtgacaggcctgtgtacaaaacaacataaaataaaaccaaaaccaggctagctgagaagctgcccatctctggggctcttgggtgaggaaggggaagggaaagacacttcccaatatctcctgagacttggcgccggctcatcctcacggcaagcccaggggccggggaagacgctccctgctgca

SEQ ID NO: 45490 - DNA, 601 bp, Human
agccaagggactcagcaagatacctcaggccatgctcaaaggtgagtacccaggtcaaagtaatgggcagaggcagggttctccaccaaggcaggactcagttcaaaggccctcgggggtcccctttaccaagtgcagcagaagggttccatcccttgtgcctacctgagccaggggaaagggttgcacatgcctgtgctgaggacgtggaggccacactggaactcagcgatgcctcatcagtaaaccgtgtctacacagccagggggtggagacggcccaaccatgccctggttcagtycccacgctacacccgaggacactgacgccgcacagaagtacctgcccacgagcccatgtcttgccagtggcagagccatttctccagactatacctccagagagctgctaccgccctaaatacacacacggccattccagggcctcccctcctcctcctgaaaatgccacagccaagggctgcatggtcctcactcacctggaacctgtgcaccagctccagggactggctatcattctggtcggcttcaaggatgacgtcagtcagcttgtggatgatgacgtccagggggccctgctc

SEQ ID NO: 45491 - DNA, 601 bp, Human
agagaacacaggacaagtcagtagccagcatgagaaccccagggcagtgggcaggtcactgtgcgatcaggacctgggaggccgctggggaagtggtgtggggagagggaagcagccaagggactcagcaagatacctcaggccatgctcaaaggtgagtacccaggtcaaagtaatgggcagaggcagggttctccaccaaggcaggactcagttcaaaggccctcgggggtcccctttaccaagtgcagcagaagggttccatcccttgtgcctacctgagccaggggaaagggttgcrcatgcctgtgctgaggacgtggaggccacactggaactcagcgatgcctcatcagtaaaccgtgtctacacagccagggggtggagacggcccaaccatgccctggttcagtccccacgctacacccgaggacactgacgccgcacagaagtacctgcccacgagcccatgtcttgccagtggcagagccatttctccagactatacctccagagagctgctaccgccctaaatacacacacggccattccagggcctcccctcctcctcctgaaaatgccacagccaagggctgcatgg

SEQ ID NO: 45492 - DNA, 601 bp, Human
ggcctctctcttgccaattatatctgatcatatcaccgccatccccgccccaccctccctgcaggatagagtccaagctgcacagcctggcatgaaaaagccctcaagctccggccttgctgctccctctccaacctcgctgacacctggagacatcgccgcacatgcccatcaggcagcgccatctgcctcattaacgctcctggcctcctccctccccgctccaagcagcccagcagagccacgtcctccctccgcaaggccatcagggcaccccatgaaaggccgccccagcgcatgmccagcactgggcatgcgccgccacccaaacacttaggcactgcaggcggcaatgggaacaccagctgctgggagcagacacaatccctgccgcagtgaagggacagacaatagccactgataaagaattacgaacttccgaagggcatgaaggaaaagtgcaaagttggcagggcctgggacgagagatgtgtcattaatcagctcacgagggaggacatttcttgggaaggggcactgagctgacggaacagcttgtgcaaaggcgctgaggtggacacacatcagagcctgggcagct

SEQ ID NO: 45493 - DNA, 601 bp, Human
caggagcttccttcccagatccactttagatgattacacactgagaggagccaggaggtgagtgcaactttgtcctgtgtaggctgggcaaggctcaagctgctcagaggccagccttcatggcagcggagggaggggatgctcaggaccacatgcaggggcacctggggctgaggatgggcacaacactgagcctggggccatgagctccttcttcaacttggacgcacctgggctccaaagagtaaacagtgtcctcagctgctcagagttcatcttgcactggcaatctccccttccwagcagggcctctctcttgccaattatatctgatcatatcaccgccatccccgccccaccctccctgcaggatagagtccaagctgcacagcctggcatgaaaaagccctcaagctccggccttgctgctccctctccaacctcgctgacacctggagacatcgccgcacatgcccatcaggcagcgccatctgcctcattaacgctcctggcctcctccctccccgctccaagcagcccagcagagccacgtcctccctccgcaaggccatcagggcaccccatgaaaggccgccccagc

SEQ ID NO: 45494 - DNA, 601 bp, Human
ggcggactagcagggagggccccaaacatcaccccctcccaccagctcccagccctactcacttcctgtcccctcaggaggatggtggggtcggggaggcactactgaaggctacacatggtttccttccagggacaacatgagaagaaccagtgtggccaagtgtgcattctcttccggcatccttcggggcaggagcttccttcccagatccactttagatgattacacactgagaggagccaggaggtgagtgcaactttgtcctgtgtaggctgggcaaggctcaagctgctcagasgccagccttcatggcagcggagggaggggatgctcaggaccacatgcaggggcacctggggctgaggatgggcacaacactgagcctggggccatgagctccttcttcaacttggacgcacctgggctccaaagagtaaacagtgtcctcagctgctcagagttcatcttgcactggcaatctccccttccaagcagggcctctctcttgccaattatatctgatcatatcaccgccatccccgccccaccctccctgcaggatagagtccaagctgcacagcctggcatgaaaaagccc

SEQ ID NO: 45495 - DNA, 601 bp, Human
aagactgtctctgttcagtcccacagaaccccctggaaaggctccaggccactggaactgatggctgccccccaagatgggaagcggctggctgagcagcagagggactctgttcacaaacttgttccaaatgcatgtgccagctcgttcaggactgctgagagccgagcagtggtgcgcagggcaagccacacttaggatccatcagactcacagtccatgtgcaagctggtcaaactcggtgtcccaggcccaacaaggggtaggggaaacgctggagccctgggaagggctggggaagcttccctggagcagacgccaacaacaacccatcccctccctggtgaacagaatgaatatagaataagggattcaaagcaaccaggctccagcctccagggtgaatgaactgtacatgattctccatttcagattgggggaaggcattaaaaggggctgtgtggggcggagcagggcaggggcccgagcacgcaaatggggcaccctgaatgtgattctgcatgcagaccccactgtgtctcctgtggcctgcaggtcacaggcacacccatcctgaaggtgggtgctacccacaatggtc

SEQ ID NO: 45496 - DNA, 601 bp, Human
gcagccacattctccccaccctcccagaggctcctaagtggcggccatgtggctgagcaaaggagaggcgtggggctgaccagcaataaaggagcagaggagtgtgggtgcggggggcacagggttgggggctggggaggagcctgctgaggttggtgatgtcaaccacaaagggccacaggcatgggccaggggagaaagggtactccaagcagaggggacagcaaaagcagaggtctggggtgagggagtccagcacattcacgggcctgctgggggcctggcagggctggggcggacrgcagtctcaacatgaaaagtgaggacaaggtagagagcaggagacggaccagctgaggagtttggacttgaccctaaagcaacagggtcctgagctgggaagtgacaaggacagctatgggttatggagtgaccagtccagcagcctgcaaggccacaggatggagctggggatggatgcggtcttggtggtgtgtcagatgtggtgctggccttaggggtatgtgtgctggacctcactgttcaggaagaactgatgggctgccttcatcttttatacagtgatctctgtgatttggta

SEQ ID NO: 45497 - DNA, 601 bp, Human
acctattcagctatagagcagccacattctccccaccctcccagaggctcctaagtggcggccatgtggctgagcaaaggagaggcgtggggctgaccagcaataaaggagcagaggagtgtgggtgcggggggcacagggttgggggctggggaggagcctgctgaggttggtgatgtcaaccacaaagggccacaggcatgggccaggggagaaagggtactccaagcagaggggacagcaaaagcagaggtctggggtgagggagtccagcacattcacgggcctgctgggggcctgrcagggctggggcggacggcagtctcaacatgaaaagtgaggacaaggtagagagcaggagacggaccagctgaggagtttggacttgaccctaaagcaacagggtcctgagctgggaagtgacaaggacagctatgggttatggagtgaccagtccagcagcctgcaaggccacaggatggagctggggatggatgcggtcttggtggtgtgtcagatgtggtgctggccttaggggtatgtgtgctggacctcactgttcaggaagaactgatgggctgccttcatcttttatacagtg

SEQ ID NO: 45498 - DNA, 601 bp, Human
gagcttgtgagtgagtgcgtgtgtgtgtatgagtgtgagagcatatgtgtgtgtgtgtgagaatgagtgtgagagcatatgagtgtgtgtgtgtgcgtgcgtgtgtggtgatggatgtcacctattcagctatagagcagccacattctccccaccctcccagaggctcctaagtggcggccatgtggctgagcaaaggagaggcgtggggctgaccagcaataaaggagcagaggagtgtgggtgcggggggcacagggttgggggctggggaggagcctgctgaggttggtgatgtcaaccacaaagggccacaggcatgggccaggggagaaagggtactccaagcagaggggacagcaaaagcagaggtctggggtgagggagtccagcacattcacgggcctgctgggggcctggcagggctggggcggacggcagtctcaacatgaaaagtgaggacaaggtagagagcaggagacggaccagctgaggagtttggacttgaccctaaagcaacagggtcctgagctgggaagtgacaaggacagctatgggttatggagtgaccagtccagcagcctgcaaggccacaggatgg

SEQ ID NO: 45499 - DNA, 601 bp, Human
ctgaggcctcccagacagtacgagagcagaaagagtgacagcctctgagaagcacgtgtatgtgggagcttgtgagtgagtgcgtgtgtgtgtatgagtgtgagagcatatgtgtgtgtgtgtgagaatgagtgtgagagcatatgagtgtgtgtgtgtgcgtgcgtgtgtggtgatggatgtcacctattcagctatagagcagccacattctccccaccctcccagaggctcctaagtggcggccatgtggctgagcaaaggagaggcgtggggctgaccagcaataaaggagcagagragtgtgggtgcggggggcacagggttgggggctggggaggagcctgctgaggttggtgatgtcaaccacaaagggccacaggcatgggccaggggagaaagggtactccaagcagaggggacagcaaaagcagaggtctggggtgagggagtccagcacattcacgggcctgctgggggcctggcagggctggggcggacggcagtctcaacatgaaaagtgaggacaaggtagagagcaggagacggaccagctgaggagtttggacttgaccctaaagcaacagggtcctgagctggg

SEQ ID NO: 45500 - DNA, 601 bp, Human
gctgggcagcgtgcaacctatgtaacagtcctgacagtcagccaaggcttctgcctgcccatcactgtcagataatcttttgcagcccagctacacctggctaacttaacccgagcgcgtgggtcctggggcactgtgcaagttgaaacaaatgcagagtcaagaaacttgggttacaagtcctagaactgccattcactttatgtgtgtttctgaaagtcacttaagttatctgtatctcagtttcccatctgtaagatgtgtgggctagaataattcatttataacatcctttctgccycttaagttctagattatttgattctgtgatgtgacgaacaaaccaaaaacagagctgttaggcccctgaacggagccagatgcctcccaggcccagagacattcaaacgcaggagccagggcctgctgtcctcagagcacacccacggcatggtcactgcacgcatcccagtcgcctgcaagccagcgagatccatgcccaccacaggtgagggagggaggccagcaggaggcacaccctggtgggcagtggacagctgtgcattggcgacaggcaccgaccaccagcccaagcaaagct

SEQ ID NO: 45501 - DNA, 601 bp, Human
cctaggtgcaacagaatgtgccaggtggccaggctggcatagggttggagttggagatgcatgcaggtaaaccttggaggtgggctctcaagagccaaaaggaggttgcagcagcatccactgtacgctgggacaggaccaccaagcctagctacccagggtgccattcacaaagcctaccactgggctgggcagcgtgcaacctatgtaacagtcctgacagtcagccaaggcttctgcctgcccatcactgtcagataatcttttgcagcccagctacacctggctaacttaacccgarcgcgtgggtcctggggcactgtgcaagttgaaacaaatgcagagtcaagaaacttgggttacaagtcctagaactgccattcactttatgtgtgtttctgaaagtcacttaagttatctgtatctcagtttcccatctgtaagatgtgtgggctagaataattcatttataacatcctttctgcctcttaagttctagattatttgattctgtgatgtgacgaacaaaccaaaaacagagctgttaggcccctgaacggagccagatgcctcccaggcccagagacattcaaacgcagga

SEQ ID NO: 45502 - DNA, 601 bp, Human
catttcaggaaaaagggaagcctttctcatgttcactaccccaaggcgaggccaccagcctgacagtccagggaggccgggtgtgttccatttggggtctgcatgaggtagagcatccaagaaaaaaaatagtagatccagtttgcgatttcctttcccagagggaaaggcaaagatggtcagaactagcaaaacccagatggacccttcatccagcccccatctttttggaaaggggaaaggcagtggtagcgaggccaaggtcgcaagggagagtggcagagctgagactgcagctccmtttccactgttcctcccaacccatggtcctcactggttgtttgttctctcaaagccacagctggaccagaggctctgcatctcttcccagccctggagcaagacagatgaaagcaaatgaagacacacaccccttaggacagtaaatacatgacataactgaaggccacagtccacagggcctctgtgaggagggtccgcgtggcgcagggggaagagcgtgtcagggccagcactgcacttatgcacaggagggctcccaaggcagctgctgaatggagtggcccctgcagggggagga

SEQ ID NO: 45503 - DNA, 601 bp, Human
gggcacaattccgtcacctcccccatggccacagcagcatcagctggggatgacaacagcctcctgtactgaacccaacaggattctagaatcctgatcaccacctggctccagaaggagataggtgtcagcaccaaggcgaacccagcgtgccacacccagaggaaacttcccagccgactctaggatccactgcatcagggcctgtgtgttcagttaacactcagctaccccactaacaccagtgattctacccttgacagaagaactgaaattacttccttatggctgttaaaagtaytcacaggggctttcatgggaaaggaagcgaccctgggctcactcagcacaatttcactcccctggctcctcctgagagcacagccaggcccagctgagggccacaaggcctggcctttccaccagctcctccgtacccagcgccgggtgaaaccctggaagtctctggttcctgaagccttggcatcttgacgggggtcctgccaagattccagggtgagttataaacatgctcaccacgcacgggtcacagacctatacaccttgcaggaatggacatgtttccccctcaaaacaaccc

SEQ ID NO: 45504 - DNA, 601 bp, Human
ccgctgtgaacatacgtgtataaatttttgtgtcaacatacgttttcacttctcttgggtgtataaattgaaatgaaaatacaaaagaccccaggatttggctcctcaggcatggatgttttaaatcatagtcataatgatccaccacagtatacaagtgtagcacttttctggttcaacaagggcagtgacacaaaatattgcatttgattctcagagcagccccatggtttacagagcaaaacgtctctgtttttattcccattttataaataaagaaaccaagtttctgagaggcaaygtgactggctcaaggtcaaacacaaccagctggggggctttgccaggattcaaaatcagccattccagtgtcaaacgccaggccactgcagtgcacctggtcacctacagaaacaggctctgtgactgaactgttgtgcatctccagaaaggctagggagcacctgaaagctaaacgttagtgaactcgacatatcactgtggctcgcggtggcttgcgcctgtaatcccagcactttgggaggctgaggcaggtggatcacctgaggtcaggagtttgaaaccagactggccaacatag

SEQ ID NO: 45505 - DNA, 601 bp, Human
tcagtaatcatttaaaaataaaggcagtggccacttacctgggacttgctatatgcacactgcttctttcaatataaaaacgctattgggtaaaagcccaaactataaaacttttagaagaaaacacggtcataaatcttcgtgaccttggattaaacaacagtttcttaaatgtgaccccaaaagcacaagacagaaaaagaaacagataaagtggacatcatggaaactggaaacctctgtgagttccagcccccatctgccctaggcctgtgctctgaggagagcctgtgcgtgaccygcctggcagaggcccaggggcccggactgacccctaagccagcagggacggctgcgcacaaggcaagtcctggcaggtctcgcagcaccttcccgtatttgcgggtcccccacagcacagagagggtggcagggtttctccccatttttctcaggaccctgagactctgagaggttttggtcagagacaaagtcccgggctccggccctgcccgtcctaacagcttgctccttccttcactcaggacccaggggctgaaattctgcccactgggctgcatggcctgagcgccgagcgggt

SEQ ID NO: 45506 - DNA, 601 bp, Human
gcacatgttccctcgcagggcctgccagctaaaggacaccaagagtgggatcctggagctaacaagggcagcctggctctaggcagaaacattcagcccctgccaggatgagggctggaacacacctggggcagagcgtcacggtgcccacctacagcgcaagctctctcagggttttcagaggccccaagcccatggaatgatgccaacagagacaactggccctttgctaagctgccactgagaatctgagcagaatgagatgaacgtcagagatactctttcctcctcgatcctcacrggcaggaaatgagcagggagtgagacacagggatttgctccttctaatggaaaatgctgtcagagtcctgagtccagattctgcctctgacattgattctgtgtctggagttaaccctctgagactcatcctgggtaaggtccattctgaataaagcctaccggaggcagctgctgtgggcatcatggagatcatggatgcaaaaggagtttgtagacacaaaaatgaaaggattctcattaccctgcaacacctgggctcctagggctaaacctgacgcaaggtttctgggctcaccct

SEQ ID NO: 45507 - DNA, 601 bp, Human
gaaaccaaaggggaaaacatctgacaagcaggcgtcaactagcttttgactggggatgaaagcatcagcattaacagaagaattcttcctaaacacgatctcttctgggatgggaacagagagggcaaagaatttttccagtcacctcactatccacaagcggactttgtgccaagctttccagcttacctattatactgagggcctcgtgtatttttcacaagtctcttagaattaccaatctgctgggtgggtgagcttccgtaccattttatcaccactcagaggaagaagggcagcrccgtctccatggcaaattgtaagcacatgttccctcgcagggcctgccagctaaaggacaccaagagtgggatcctggagctaacaagggcagcctggctctaggcagaaacattcagcccctgccaggatgagggctggaacacacctggggcagagcgtcacggtgcccacctacagcgcaagctctctcagggttttcagaggccccaagcccatggaatgatgccaacagagacaactggccctttgctaagctgccactgagaatctgagcagaatgagatgaacgtcagagata

SEQ ID NO: 45508 - DNA, 601 bp, Human
ccaacccgagctgacatagcgaaggagcccacccttgctcccaacctccatgattctaaggacaaaactggaatgctggtgtgatgtgggggtctcagggaaaaagctggcctgaagaaggcctcaaccagctgctgcgggttgaattgtgtcctctcaagtcttaacccttcagcatttgtgaacgtggccttatttataaggaaacagggtctttgtggatggaacagagttaggactccatatgggtggaccacaccatatgggtgggcctgaatcccctggctggatttcttaggaragaaatctgaacacagacgcagggaggaggccgtgtggagacagacaactgcagtgacacacctacaagccaaggagggtggaaggtgcccaccaccaccaccactgggagccgggagaggggcagggaagcttcgccctcagggcctccggagggagccactgctgacgccctgactggagctgttggccccctgggctgggagattcctgcagcgttaaaagcctccctgtttgtgatacttggttgtgagagccgggggcagcagacatgccagcgtgattcctccgcccagccagc

SEQ ID NO: 45509 - DNA, 601 bp, Human
ggagcgggtccaggacgatggtctcagggtgggcatcgatgtactcctgaaagggaagcatgctgctctggttagagcaggggtagggccaggtagcaactcacccctcgcgccctctgcacgtccatccgttcctgtcctatcctccagccctagctttggtggagggtggtgcattccagcactgggacatttcgagcagtcacctggagatctgagagagaggcttgactaggccaaactcagaaatagagcaccacacagaagacagagaggaaactgcaaccaggctcagggcagsccgcctgactccagataaaacctcacccggaagcagatccactccaggcactggctcctctgggagtggcggccccatgccccgcactgataaggactctgaggcaggggcgggagagtgggatgaggccaggagtcatcagagggtctgcgggaaggtgtggtggagagaaacacgccacagggtgggcaccagccacccaacactcctcaagtactccacttctgtacctactagctttggggtaggcacgaaggaaatgcaagagaaaccgtgacaaaaaccagtctctaaggaact

SEQ ID NO: 45510 - DNA, 601 bp, Human
agaactcaaatgactgatttgtccgagaccacgtggctaacaagagcccagacaggaacccacatgccagagcctgtgcttttggctccaaaaggcccttcagcggcacctcctcgaatcccacccaaacccatcactcttcgaatggacttgtccgggacatgagatgtggctgctggtctgccaccttcttctgctagctgggccttctcatgttctaatacagcctcctgctcttcacacaggcagtgtccaacaagcacaccttctggaaagaggctgattccctttcccaaatttkaccaaaccttcacccatggcagactgagatgaaggtgaccccaggagggaacatacagctctttcttcccatctgggattctggatggatccaggaagacagtgcaaagggagatgaagtgcacagcagaggccaatcactccaggcctagcaaataaaggctgctggcatgtgctaagaaagcctgcctacatggggcaccagcatgacacccccattctctgcacccagcggtgtgtcaggcattcagggaaagaggcctcgggagcccttccaggacagccaaatccagcagccagc

SEQ ID NO: 45511 - DNA, 601 bp, Human
attatctgagggaacttcaagggtaattatggccatttacagtacgcctgaaagggctgagtgcctccaggaacagcaggcagttgaggaggggggcccagggtgtgcttcccaggaaggctctctgcctctgcagctggtgggggcatgcagcagggacccacccagcgatgctggtgaatggacagccactgggggtcaggaaagggctccaggaagtcccagcctctgaccgccctcctggaagaatacaagcccaggctcggcgtgcacgataaggaaaacccagcgtgcaacattyatggcccacccaccctacacttcctgctgatctagaaccaagcatgcgttagggtttggtcaacagctctccctggacctgttgaggacggggccctctcctggaacacccacagctctccccttatgggtagctcctaaactttctaatctcccagtgaactaggacacaccctgcttaaaattcctgacctgattcctaactgcctccaggagaggcccaattccaagccaggcgagcgggcaacagaggtacctcctgggccttcctctcaccatgtgacttcctacggtccacctc

SEQ ID NO: 45512 - DNA, 601 bp, Human
tgctggttgctacaaagaggggactgctgctgaggtcacaggccgaggccaaacccccagccagaggagaaattccaaggttgttctgccatgggaaagttgggtcctcaggcagggacccatgtcttggaagactgctaatgctcccctaaaactcgttctagcccttcttccatggtgataaaacccgaattgtagctgggcatgtggctgctcagaacaaggactcaatttcctgactcccttgcagcttaggatgtgactaattctggccaaagtcccttctcccagcacaaaaacrtgtcactggattgctttcagaacccctccttaaaagagaactaggccttcttctcatttgcttcctttttcttgatcttcctctccatcctaatgtctagatcttggatgtgagggctggaaatacagccatcacccaggaccagatgggcagaccacagaagaataaggagctagaaggagccagggtcccagcccctgtgcccgtgctggatggccttcctctgggcttttacatcagagagaaaggaagttctgtcgcatttaagccaccatgattttaggtctgctgttaaagcaa

SEQ ID NO: 45513 - DNA, 601 bp, Human
gtttgaattgaatccaggctcaacgctgcctgtgcctctgcctagggggtgcgggtgtggggagggacatgggtatgggtataggcatggctgcctcccagaagcagtcatctatgagggaaaggtagggccctggcatgctggggtgggtcattctgcaagcctccaggatgctggttgctacaaagaggggactgctgctgaggtcacaggccgaggccaaacccccagccagaggagaaattccaaggttgttctgccatgggaaagttgggtcctcaggcagggacccatgtcttgsaagactgctaatgctcccctaaaactcgttctagcccttcttccatggtgataaaacccgaattgtagctgggcatgtggctgctcagaacaaggactcaatttcctgactcccttgcagcttaggatgtgactaattctggccaaagtcccttctcccagcacaaaaacatgtcactggattgctttcagaacccctccttaaaagagaactaggccttcttctcatttgcttcctttttcttgatcttcctctccatcctaatgtctagatcttggatgtgagggctggaaatacagc

SEQ ID NO: 45514 - DNA, 601 bp, Human
tggaggggtggcggtggcaatgggcagggtctgaggccttgactccaagtccccacccctctgcagctccccgagggttgagagccagttcctgcctctgggagcagctccccaccaatcacaaacacccacccccaaggcaaaagctttttggggaattatttctccaggctctaaggaatgttactttctctttgctttgtatccagactactcaatttcaacccaggtttcaaatggcctctaagatgagccctaattaaattcccgtaaaaccacaggcagaagcattcaatctgcrgtatgcaccccccatccccagggaggcctgggatcccaaacaggccatctgtcacccccagagcagacacatgggaacttctaagagaagaagaacaggagagccacccatcaccccaaagcagtcagggctttcaaggatctctccagcctgttgcccaatggtctgagacctgctgtccctgaagacagggacacaaacccacgccatgcaattacggcccaggtgccttctcatacatggtgccttctcagccagtttgggagccagctagagccgtgcccagaatcgctcacccta

SEQ ID NO: 45515 - DNA, 601 bp, Human
aggggaaaggaattttgggtgagagccagagtcccaaagacaaacagtctgttcaccaactggcctaggatcagcagcagtgccctagaaaagtgatcggagccagctgatgtcattgggagagtacctcctagaggaggggtgcctgtgggttgagaggggacagaggttttcagaaagctctgcaggaaggcctggggcaggcccacctggaccaagtggggtatctcgtccagaagccactgagctggagggcgctggaggggttggtgggctgtgggtggaggggccttcttgttttgctggggagcgggtccctgccatggtcttaaaggctcagcaaggttaagctctgagtgaacagacaggaacattcttccctagatgaaggtgcatctctcctgcagggtgccagccagtcgccatgagagctcagtccactcctttgagtctctcctgggagcctccagaccagtgccctgggcaggagggacagagggcagcaaatgcctggcagggtctgttctcatgggggtcactgcaagcctaccatcaggatgccaggggctgctgccctgtccacagtgcccacagctgtgga

SEQ ID NO: 45516 - DNA, 601 bp, Human
ggcgccaggggctgctgcctttagcactaaatgcaagttgagaaacacaggactcacagggtcacagcacacagggtgtggtctgaaactcacaatgcactgtctgccaggagagctcccatctattgaggaatccttacaacaacctatgaggaaggtgccaccaacattacctccctccccattttacagataggaaagctggggctcaatgcagttaaataacctgcctaaatgcacacagctgggtgtttaggagaggatctgaacccaggcagtctgactttagattcactatggygctgcttctgaaaagacccctgcagagatgtgggtcccatggagacagcactggactgagagtcggaaaggtgctgagtggtcctgggtcagccatgcaaccactctgggcctctattctcattgttgaggatgtggagaagagcagtttttgtagggcttccagaactcaagatctctttcagctggaaaaacactaagtgagctataaattcacactaaagtgtaaatggctgctgttggataccttctgaccaatctgaccaacaaggaggttttgagtacccatgtaccctgctta

SEQ ID NO: 45517 - DNA, 601 bp, Human
gaatatgaagtatcagtgcatcttacaatcggtaatgaaattcaacactgcccccagactaaagattcatattaacacattactaaggctctgagaagtcctgcagcaaagaaacatgtaatcctgattctccaacatatctgacacttttctcttttccttattttgcctttccctttgttcacacgtgagattatgctgacactccacaaggtgccacctggtgccctgtggatgtctgcaaagctgcaaggggatcctgtcacttctagggcaactggggtggttgggacacagttcytataattctgtatgatgactgttcggtaaataccacagtaacaatggcaacacccatccacggatgctacaagagaagggcaaacatatgagagacagtctgcaaagaatcctcttagaaggttcttgccaactacaaaggaaaaaatagaaatttagagtggaaaagcctggtggactttaaccaaataactgctgctgagcagacagaagacatcgttgtcctcatgcacctcctgatatgacgcactagggagggactggcactgctgggtggtgttcctgctgaaaatgtatgacc

SEQ ID NO: 45518 - DNA, 601 bp, Human
taatgaaaaaataatactaaaagtgcacatgtatctctacatgtatgaataggaagggtctagaaagataagttccaaactatgaacagtggctgcctcagggaagtgaggctggagttaaacagattcgagaagcaccagcaatgagggccccacacactaatacagggaactcaagaacagacctgtgcagggccggaagtgagggcggccagaaggcacccagtcagggaattcctgagtgtgttgagtgcaacagtctctcaagagaagcctcaaagagaggaggggactctatagwtaactggatggaaaaggctaaattctgcagaacttcactgattctatggcatgtttttcatattttccatctctgaaattgagatgtgtctcataattgatatttcacaacttacttaggatttttttcttttttatagaatatgaagtatcagtgcatcttacaatcggtaatgaaattcaacactgcccccagactaaagattcatattaacacattactaaggctctgagaagtcctgcagcaaagaaacatgtaatcctgattctccaacatatctgacacttttctcttttcctt

SEQ ID NO: 45519 - DNA, 601 bp, Human
ggccaagggtcaagaggggtgcccctggggttcggcttggctgcagtgtggagtgcaggggcagtatgacaggagacgccacccaggagagggaatgggcaggggcgacatgccccaagacacccagcacaggtgacagggcctggagagatgcaatgatagcaattaaattccattgaacttataagtatgcaagggaaaaccattgtattactcagtgtggcaggcagaatctaagtcaaccccaagatccctgtggccgggcaacaccctgcatgatcgccagaactgcatgcatgayggatgggttctcctctgtgactcggttctgttgcattgctgccctcaaaacagggagatggtctgggtaactcttagggcatcacacacagagcttcttctctgaagaggaagctggagattcaaagcacaaggagactggccagctgtggccgccttgcaagtagaggggcaccgtgagaagaaacacaggacctgtaggagctgctggccagcaagggtggggacctcagtcctacagccaccaggaactggattctgtcaatgagagttagcttggaggtggatgtttcctcagggc

SEQ ID NO: 45520 - DNA, 601 bp, Human
ccaccccatgccccaaaacaagaaaggctctcaccaagagggaccatctctattcctggtgataacttggcctttcttacctgcctggcctttgtctgtgctgtatctgccactggaatgccctcccttctcatctctgcctgttgaaatggaatctttatcactgaagccctgggatttggcccaggctggggacttattactattgggggcctacaaagggtccctctctcatagtttgtttgtttatttgtttgttttgagatggagtctcactctgttgcccaggctagagtgcagyggtgcgatcttggttcactataacctccgcctcccaggttcaagcaattctcctgcttcagcctcccaagttcaagcaattctcctgcctcagcctccgaagtagctgggactacaggcacgtgccaccatgcccagctaatttttgtatttttagtagaaacaaggtttcactatattggtcaggctggtcttgagctcttgacctcaggtgatccacccaccttggcctcccaaaatgctgggattacaggcatgagccaccgcacccggcctctcttgtagtttttcttggccgccg

SEQ ID NO: 45521 - DNA, 601 bp, Human
atcctcgtgtttaaaatacaaggctggatctggggctgtcagttgccagaacaagtccagagaaaacacaaagagaacaccacccagccctgacaatgttcttggctgagccagagcccctgaggcagccgagtgaactccatgacagaaacttctctgaaggcttgagaggaggggagaaaggtggagggctctggcccatgacaaggccaacaagtccactccaagccaggtggagggggcctgtaccaccccatgccccaaaacaagaaaggctctcaccaagagggaccatctctaytcctggtgataacttggcctttcttacctgcctggcctttgtctgtgctgtatctgccactggaatgccctcccttctcatctctgcctgttgaaatggaatctttatcactgaagccctgggatttggcccaggctggggacttattactattgggggcctacaaagggtccctctctcatagtttgtttgtttatttgtttgttttgagatggagtctcactctgttgcccaggctagagtgcagtggtgcgatcttggttcactataacctccgcctcccaggttcaagcaattctc

SEQ ID NO: 45522 - DNA, 601 bp, Human
aagacatgcctacttcccctttgccttccgccatgattgtaagtttcctgaggcctccctggccatattttttgtacagcctgcaaaaccgtgagtcaattaaacctcttcataatttcttcataaattacccactctcaggtaggttttttttaatcccttttttttttttggagacagagtctcactctgtcactcaggctggtatgcagtgtgtgatctcagctcactgcagcctcagcctcctaagtagctgtgattacaggcgcacatcaccacgcctggctaatttttgtatttytagtagagacggggttttcccatgttggccaggctggtctggaactcctgacgtcaaacgatccacccgcctcagcctctcaaagtgctgggtttacaggtgtgagccaccatgacaggcctcaagtagttatttatagcagtgtgataacagactatacaccagccccagaggagcactgaggcctggatcatctttgggcagaacacacagcttcgatgcaggatcctcgtgtttaaaatacaaggctggatctggggctgtcagttgccagaacaagtccagagaaaacacaaagag

SEQ ID NO: 45523 - DNA, 601 bp, Human
gcagtgtgagaatgacctaatacagactataacttacaccaccagctctcctaggtctcaagtctccagttagcagatagcagattgtgggacttctcagtctctatttcttacatgcttctttccattatgaagtagaccctaaatgctgttcccttgaatgtgaactggccctagagcctcacagataaatagaatatggactctggaagcaaggccagagaggctgtctttctcgggacacacccctgggtccctgagctgccaagtcagtagtctggctactctgtcaccatcatgmtaaactgccatgcaagactgcatgggagaaccacccagctgagcccagccaagctgcagattcatgagcacaagaaacaccattatcattttggatttccatctaacagacaaccaaaatgaaggctcatagagatgacatgtgttgggcacttaacacagcatatgcagggcttaatgtcaacaataaccagacaagcaatgcagtgtgctctgcgccatcaacaagcacttgcaggcatcaacttgtgtcatctttatagcaatgccatagcacggatcactatcaccactccatttt

SEQ ID NO: 45524 - DNA, 601 bp, Human
ccagccttgaagtcctccatggccaagggcctgcctatgcctccctcctcccaagctctgggcaaaatgagccttgctcggtttctcaatcaagctccgccacagggtgcaggctcagtgccccaggcagtgcccctgacccagtacccagttcctccgacattaaggcttcttgggtgcccctgccccagtacgcagttccttcctccctgatggaggcagatgaggcaggaggctcggtgggagcagggactatgcctgccttgctcatctctgtgtgcctgggacctgccctagagcytagaacacagcaggcctgccatggtgggacgcttaattcttgtcagcttgactgggccacagggttcccacatatttggttaacattgttctccgtgtacctgaatgagattagcatttgaattggtaaactgagtcaagcagactactttccccaatgtgggtggagcctgtccaatcagtcaaaggcctgaatagaacaaaaggaagggtaagaaagaattcactcacttggcctccctgttcaagctgggacatcagtctcctgcagtagaaccataaattatagcatcagctctcc

SEQ ID NO: 45525 - DNA, 601 bp, Human
ctcaagggccttgggcaggccaggcatgtgcagcgatgcatacatgtaggacacagagctacgagcccaggttccaatccaaggtgcacagtctcaggagctccccaggagctagcatctctcatgggcatcgggcgtaaggacacagtggccctctcaggtgccctcgtgggacaagggaggagagaaggcacttcccgtgctgcttaggcactgaggaactcagagctgaaggcactcaaggccaatggcaaaaggcccatggggcctgggtcactgaaaggcagcctggagtgagtcytccccagcaggactgggtgctgcccagccgtccggttcactgaggaaaggaagggtcacatgaggactgtggtcacaggaggagcgggggtgtgagagaaggccaggcccttgccacatggactaagcagtgacttcacagcttcagggcacaggggctagggcaggactgtgtctcctcccttggacccaccatgaggagagggtagggaagtggcatctcctgagtgttggcatgcctcatgctgttgcgagggggcaagggagaactcgggaggtgtgacctgtaaagcccagccta

SEQ ID NO: 45526 - DNA, 601 bp, Human
gtttgtttgtttatttgtttttctgagacagagtctcactctgtcacccaggttggagtgcagaggcatcgtgatctcagctcactgcaacctccccctcccggttcaagcaattctcctgcctcagcctcccaagtagctgggattacaggaacacgccaccatgcctggctaatttttttgtctttagtagagacggggttttgccatgttggccaggctggtcttgaactccggacctcaagtgatctgcccgcctcggcctccaaaagtgttgggattacaggcatgagccaccgcrcccaactcttctctgaccgcacaacccaagatcgttcccagccaaacccttgtgccaggtggatatactgtccccactatatctctgggatggtccccgttccatgcctcacttggcaacacctgctcttccaagcatcacagaatcccagctgttctgcagagcccccaagaacacgctgtcccatgctgctgcctcgagtggcattcaccctgcaactcctacccacagtcacgtctttctagtactttttctggcactgctaccgagttttgttgtttacctcttgtacgctattaa

SEQ ID NO: 45527 - DNA, 601 bp, Human
cccacgcaaatgaatatacttcccaactcttttgtttgtttgtttatttgtttttctgagacagagtctcactctgtcacccaggttggagtgcagaggcatcgtgatctcagctcactgcaacctccccctcccggttcaagcaattctcctgcctcagcctcccaagtagctgggattacaggaacacgccaccatgcctggctaatttttttgtctttagtagagacggggttttgccatgttggccaggctggtcttgaactccggacctcaagtgatctgcccgcctcggcctccmaaagtgttgggattacaggcatgagccaccgcgcccaactcttctctgaccgcacaacccaagatcgttcccagccaaacccttgtgccaggtggatatactgtccccactatatctctgggatggtccccgttccatgcctcacttggcaacacctgctcttccaagcatcacagaatcccagctgttctgcagagcccccaagaacacgctgtcccatgctgctgcctcgagtggcattcaccctgcaactcctacccacagtcacgtctttctagtactttttctggcactgctacc

SEQ ID NO: 45528 - DNA, 601 bp, Human
cagtgatgccgcccacctcccggggtggttgcagggacgcggtgaggccacgcccatgaggggcattcggaatgactgagaatcgtattgtccagccctgtttccatggatgcccaccctcctcggggtgcctggtacccaccagcacagcacccccagcctgctctggcctgccctcctgggacactgatggaacaagggctgtggcccagcaccgcgacctcttcccagctcctggaatcgatgttcctgaagtctgttaatccaggaagccccttgttggtcccctcactccataatyatcatctccacacacaagatcctctgcccacaaaccaccgtcctacagctctcacctgtactgagacagctcccagcaaggcgtccatgccccgcgagtgaagcccacagcctttccaggcctccgcagcctgactctgtaccttcctgtgatgggctgagcgctgtttccaagttgatattgaagccccaatccccatgcctgagaacgggactgcactgggagatagggtctttaaagaggtaaaatgaagtcagtagagtgggtcctaatccaataggactggtgtccttataagga

SEQ ID NO: 45529 - DNA, 601 bp, Human
gaggtggcctccccaccacgctcactgcatctctgctgcatgctccagcccaggccgcgcctggtccccctgccaattcctcctcgcccttcacagcttggcattcctgggcccctctccaggcccacccagtggattctaagagtgagtccaacttcctaaaaccctcaaaagctgacctgttctgttcatcctgactcgtgcctggcaccgagcaggggtaaactgattttttgtgggataacaaaatgtatttggaatctctctgctgatgatgaaattactggtttgttattattgkttcttgtcattgtcccccttccctgataagaccacaaaggtgggaccaccctgtacttcagggcacaggggccaggaaaggctgagtgtgagcggggcgggggcggtctgccacccacaggcttggaaaccaaaccaaaagtaaacagagcaaagcagactgtctcgagctgctagctacttggctggctaggaggtcaggacattaaatcaaggtagatccagcctcatttatgtcataaaaacaaatgccaagaattacacagggcatataaaattgcttttatctccctcctcatcc

SEQ ID NO: 45530 - DNA, 601 bp, Human
tgccgttacattgtctaataacatttctgtaattacaaaactcgtgtatgatcactgtgtaaaatccgaagagtacagaaaagtaaaaaatgtacatattgacaagacattacaactactaccccaccactgtggacttttacccacgcgtacatttacacgcagagagctgtacaaattttgtaacctgaatcctaacttcataagccatgaccattttttctggttcaataaagactttcccaccatgtgatacactggcttaataataatcgcagtgacaatatagctcttagcatgygtctggcgctgtaccgagggctttgccggcatcacctccacagtttgcaaaataatcccatgaggaggaaactggggtcagagagattaaagaactagctggtggtgacacaactgtttccacatggacactgcctgacccctcacctgcagactacttaacataattgagggcattgtgtggagctccagaggtggcctccccaccacgctcactgcatctctgctgcatgctccagcccaggccgcgcctggtccccctgccaattcctcctcgcccttcacagcttggcattcctgg

SEQ ID NO: 45531 - DNA, 601 bp, Human; identical to SEQ ID NO: 37272

SEQ ID NO: 45532 - DNA, 601 bp, Human; identical to SEQ ID NO: 37273

SEQ ID NO: 45533 - DNA, 601 bp, Human; identical to SEQ ID NO: 37274

SEQ ID NO: 45534 - DNA, 601 bp, Human; identical to SEQ ID NO: 37275

SEQ ID NO: 45535 - DNA, 601 bp, Human; identical to SEQ ID NO: 37276

SEQ ID NO: 45536 - DNA, 601 bp, Human; identical to SEQ ID NO: 37277

SEQ ID NO: 45537 - DNA, 601 bp, Human; identical to SEQ ID NO: 37278

SEQ ID NO: 45538 - DNA, 601 bp, Human; identical to SEQ ID NO: 37279

SEQ ID NO: 45539 - DNA, 601 bp, Human; identical to SEQ ID NO: 37280

SEQ ID NO: 45540 - DNA, 601 bp, Human; identical to SEQ ID NO: 37281

SEQ ID NO: 45541 - DNA, 601 bp, Human; identical to SEQ ID NO: 37282

SEQ ID NO: 45542 - DNA, 601 bp, Human; identical to SEQ ID NO: 37283

SEQ ID NO: 45543 - DNA, 601 bp, Human; identical to SEQ ID NO: 37284

SEQ ID NO: 45544 - DNA, 601 bp, Human; identical to SEQ ID NO: 37285

SEQ ID NO: 45545 - DNA, 601 bp, Human; identical to SEQ ID NO: 37286

SEQ ID NO: 45546 - DNA, 601 bp, Human; identical to SEQ ID NO: 37287

SEQ ID NO: 45547 - DNA, 601 bp, Human; identical to SEQ ID NO: 37288

SEQ ID NO: 45548 - DNA, 601 bp, Human; identical to SEQ ID NO: 37289

SEQ ID NO: 45549 - DNA, 601 bp, Human; identical to SEQ ID NO: 37290

SEQ ID NO: 45550 - DNA, 601 bp, Human; identical to SEQ ID NO: 37291

SEQ ID NO: 45551 - DNA, 601 bp, Human; identical to SEQ ID NO: 37292

SEQ ID NO: 45552 - DNA, 601 bp, Human; identical to SEQ ID NO: 37293

SEQ ID NO: 45553 - DNA, 601 bp, Human; identical to SEQ ID NO: 37294

SEQ ID NO: 45554 - DNA, 601 bp, Human; identical to SEQ ID NO: 37295

SEQ ID NO: 45555 - DNA, 601 bp, Human; identical to SEQ ID NO: 37296

SEQ ID NO: 45556 - DNA, 601 bp, Human; identical to SEQ ID NO: 37297

SEQ ID NO: 45557 - DNA, 601 bp, Human; identical to SEQ ID NO: 37298

SEQ ID NO: 45558 - DNA, 601 bp, Human; identical to SEQ ID NO: 37299

SEQ ID NO: 45559 - DNA, 601 bp, Human; identical to SEQ ID NO: 37300

SEQ ID NO: 45560 - DNA, 601 bp, Human
attttagcacctggcacttcacaaattagggcaaataaacaaaacaaaggctgtgggtgtgggcattttggatgtacccacagcgatggcatgggggaaagtgagactgggacaaacagaagggtgcagccaactcatcaagttcaactccaagctctcctgggcctctggggttctaaggccatctccccaatttccctcgtgctgggtccccagtttcagagccccatggggctcctccagcactcaggtcccatgctgggggcatctgagggggggatcaccagcatgcctggctggmagttccttgaggactgaagtctgtggccaccaagcccatctcagcaggagcagtggggccccaggggggcacccctagaaggagcgtgcctggcaggtgcctccatagtgccctctgccctcctgggggctgtgggcctgcttcccaccctccctgccatcccagttagcggagtgaacttggatggtcctggggccagacaggagtcacttacgccagctgggaggtcttgaacaagctgctgctgtatttctgcatgaccccttggaacaagcccattggggcccgggccggcgaact

SEQ ID NO: 45561 - DNA, 601 bp, Human
ggaccctggagccctcagcccacatattcacagcttctccatgacctcaggcaaagtccccgccctatgagtgggggagggttctgggggtgtcaggccatcagagtagtaagctggacgggaccctagaggtcacgttgccctctccagccgtgtcctgcagagaagggagactcagaggggacagcgactctcaggcagtcatgcaggaggtggcagtagctgagaccagctctgggtctcccttttccagattgtcaaccactccacacacccaccacaccaaggaagtggagggcgrcaggatttgaaaaaggctgggaaggagaaagaaaatattggccaattgcctcctcccttctctacaacgtaactgagtgaggaaatgcagttccagtgatagggtccctcttttgcttttggctgcttccggggtcactattccaggggtacagagaggggagggaggcagaattattttctaaggagcgcattagccctgccccctggtgccaggcaaacagagcccctgcagcttagattatttctggattttagcacctggcacttcacaaattagggcaaataaacaaaacaaagg

SEQ ID NO: 45562 - DNA, 601 bp, Human
cttttcctggagtgtctccaaagggaccccagctgaagtggaagggaggagggctggcttttctcgtggccttggcgagcagggcgtggtgcagtgtcgtgagaacactttcaggacctgccgcccagcttgggtctctccagctgtgatgcaaggaccctggagccctcagcccacatattcacagcttctccatgacctcaggcaaagtccccgccctatgagtgggggagggttctgggggtgtcaggccatcagagtagtaagctggacgggaccctagaggtcacgttgccctctycagccgtgtcctgcagagaagggagactcagaggggacagcgactctcaggcagtcatgcaggaggtggcagtagctgagaccagctctgggtctcccttttccagattgtcaaccactccacacacccaccacaccaaggaagtggagggcgacaggatttgaaaaaggctgggaaggagaaagaaaatattggccaattgcctcctcccttctctacaacgtaactgagtgaggaaatgcagttccagtgatagggtccctcttttgcttttggctgcttccggggtcactattccag

SEQ ID NO: 45563 - DNA, 601 bp, Human
tgaagccgttccttgcttggcttgttaaagtccctttgttcattcattgcttccttccttccttcattcattcactgagctccctacctcatccttggagagtccgtgagaaccacgatgtctatgcctctcagatccacttttggggaggcttctgcatcaatagtcccatttcccagatggagaaggtgaggctggaggcaggcctcattcccaggacacccacgccatgttgggctaggatgggctctgggcggtctctgccaccagcccctgcactctcccagccacttcctccagygtgagcagcacttcctcctgactctcagactctgtggttattaatggtgtcagagcacagatgccggtgaagcaacagacccagcaaggacgatgggaaactgatcagataagtcctgaggtccccatcagcaccgtcactgccaccttgacgagttccacttaggaacagccagagcagcccctgtcagcatcaggaaaagcccagtgggggtatgtgccccccttttcctggagtgtctccaaagggaccccagctgaagtggaagggaggagggctggcttttctcgtggccttggc

SEQ ID NO: 45564 - DNA, 601 bp, Human
catagtatgcggcctcgtgcagcggcagccagccctccttgttgggctctgcgagattcttcccttccttgatcatggtcttcaaggcctcttcatcgccatccttgatggcctttatcaaggggtccgcaggcctgtgagaggaaggagtgggtcagtcctcaaggtcaggccaaggccaggccagggggcctctctctcaggagtgctggcagtggagtcactcggtcctcgtccctgctggttccaggatgagcactcagccccctgcagcccagtggctgcaagaggactgggggayccctccatctctgtggctttccatggctgccgggaatgttataccaaaaccaattctaccaagaggattcaggcacacaatgccagcctcctagagggtggctaaccacccacatgtgaggcacttgtgataattaaatgctttccctgagtatagcactctagcatttaccaggcacgcccatctcgggggccccctcttaaccctgagcatatctctggggtcttccaactcctctccttgccctgtcgcttattcctactcccagtacatccagctgcagaaaaaaaatatatactg

SEQ ID NO: 45565 - DNA, 601 bp, Human
actgtttcaaatagaaccataggccaagccttctacctctctaagccttgactttctcatctgtaaaatggagagaataaaaccttcttgagcagatgctatgggagtgagactgtgtgtaaggcatgagcatagtgcttggcacatagtaggtgtgcttgcaagaccagggccaagctctggctgtgggctgcccagcttcctgggcactccctttggacagctgaggttccaggtgatagccatggcgccctggcaggcacggattccagggaagacacttccatggtgggtctgcagyggatccagtgacctactactcagttcctgctgcccaagctgttccaagcactggatagacacatgggaaatcagggatatctgtaatttttccaagtacaaaggcctgatcatttgtaagaccccagctgattgcttcagcatgtaggcatggacaggatgctttagaatgtagtagttgagggcagtgtgacatccacctccctgagtttaaaccactggggtaccccttgcaagctgtgtgatcctgggcgacccatttaatgtcttggtgccttaggtcctcatatgtgaaagggga

SEQ ID NO: 45566 - DNA, 601 bp, Human
ctccagcaaaggctactaatttagttcagggtaaaatgcacgttgtgagtacagctcctcaagtctttcttgacctgctctaacctcctttataagcctcatctctctctagaccccaaacgtgcccttggctctggccccagagttctcaccaggagctgcaggtggtattggagtcacctgggcacttttccaaattaaccagccctggaagcttctctgtgtccgtgtcagtgggaggaggagtgaggaatgggtcagggagactggcagcagggggaggagggctgcctgtgtactstttcaaatagaaccataggccaagccttctacctctctaagccttgactttctcatctgtaaaatggagagaataaaaccttcttgagcagatgctatgggagtgagactgtgtgtaaggcatgagcatagtgcttggcacatagtaggtgtgcttgcaagaccagggccaagctctggctgtgggctgcccagcttcctgggcactccctttggacagctgaggttccaggtgatagccatggcgccctggcaggcacggattccagggaagacacttccatggtgggtctgcagcgga

SEQ ID NO: 45567 - DNA, 601 bp, Human
acaggattaactaatttaatcctcccaaatccccttaaaggatgtagtgatgttatcccctttcacagataaggaaggtgaggcacagagagggtaagtggcttgcccaaagtcacacagatactaagtggcagaactggaattcaaaccctggtagtcaggctgaaggtctctgtcccctgggatgtcccaggatgtccctatcatttccccttccagtggtacctgcttcagtcctccacattaccaaggctggaagaatctttctagatgaggagtcagcggtgtcataatcctgctraacttccccctgctccagcaaaggctactaatttagttcagggtaaaatgcacgttgtgagtacagctcctcaagtctttcttgacctgctctaacctcctttataagcctcatctctctctagaccccaaacgtgcccttggctctggccccagagttctcaccaggagctgcaggtggtattggagtcacctgggcacttttccaaattaaccagccctggaagcttctctgtgtccgtgtcagtgggaggaggagtgaggaatgggtcagggagactggcagcagggggaggagggc

SEQ ID NO: 45568 - DNA, 601 bp, Human
tctgttctaagcacattttacaggattaactaatttaatcctcccaaatccccttaaaggatgtagtgatgttatcccctttcacagataaggaaggtgaggcacagagagggtaagtggcttgcccaaagtcacacagatactaagtggcagaactggaattcaaaccctggtagtcaggctgaaggtctctgtcccctgggatgtcccaggatgtccctatcatttccccttccagtggtacctgcttcagtcctccacattaccaaggctggaagaatctttctagatgaggagtcarcggtgtcataatcctgctgaacttccccctgctccagcaaaggctactaatttagttcagggtaaaatgcacgttgtgagtacagctcctcaagtctttcttgacctgctctaacctcctttataagcctcatctctctctagaccccaaacgtgcccttggctctggccccagagttctcaccaggagctgcaggtggtattggagtcacctgggcacttttccaaattaaccagccctggaagcttctctgtgtccgtgtcagtgggaggaggagtgaggaatgggtcagggagactg

SEQ ID NO: 45569 - DNA, 601 bp, Human
agtactggttctgtgccaggctctctgttctaagcacattttacaggattaactaatttaatcctcccaaatccccttaaaggatgtagtgatgttatcccctttcacagataaggaaggtgaggcacagagagggtaagtggcttgcccaaagtcacacagatactaagtggcagaactggaattcaaaccctggtagtcaggctgaaggtctctgtcccctgggatgtcccaggatgtccctatcatttccccttccagtggtacctgcttcagtcctccacattaccaaggctggaaraatctttctagatgaggagtcagcggtgtcataatcctgctgaacttccccctgctccagcaaaggctactaatttagttcagggtaaaatgcacgttgtgagtacagctcctcaagtctttcttgacctgctctaacctcctttataagcctcatctctctctagaccccaaacgtgcccttggctctggccccagagttctcaccaggagctgcaggtggtattggagtcacctgggcacttttccaaattaaccagccctggaagcttctctgtgtccgtgtcagtgggaggaggag

SEQ ID NO: 45570 - DNA, 601 bp, Human
agcggtccagccgcggttgcagcggtggttggtgtctgcgttgtgctgcaccagaatcttcacggcctccgcgttcttgcgctcgcaggctgtgctcagggggaagcagggatggtcagcagggcctggcaggaactggccagcagagactgcattcattcgcctgtccattcactcatccactcattcagctttccactgcatgtgtattaagttccaatccctgcattgaacctgggataggcgactaaaagtaatactgatactaacattagcaagaatacttgctgattcatatgcmtagtactggttctgtgccaggctctctgttctaagcacattttacaggattaactaatttaatcctcccaaatccccttaaaggatgtagtgatgttatcccctttcacagataaggaaggtgaggcacagagagggtaagtggcttgcccaaagtcacacagatactaagtggcagaactggaattcaaaccctggtagtcaggctgaaggtctctgtcccctgggatgtcccaggatgtccctatcatttccccttccagtggtacctgcttcagtcctccacattaccaaggctgga

SEQ ID NO: 45571 - DNA, 601 bp, Human
tttgttctaatggcagatgtcactagtggatcccgacgctcttcccactgagcctggacacagcctcagcatctttctcaacacagcactctaggaggaaactctcactccatcagtgtgcgcacaagatgacccctaactcgccttcccttagagctgacctctgacatccttcccgtgtgccctttggggactccatgacctagggacccttagccactcaccgtacttggctaagaacctcaaggcctccaactgtccactctgggcggccacgaacaagggggtgatgccgtaggcrttcttggattccaccttggctcctccgctcaccaggatctgcatgacctccaggtcattgcgagacacagactcgtgcagagcggtccagccgcggttgcagcggtggttggtgtctgcgttgtgctgcaccagaatcttcacggcctccgcgttcttgcgctcgcaggctgtgctcagggggaagcagggatggtcagcagggcctggcaggaactggccagcagagactgcattcattcgcctgtccattcactcatccactcattcagctttccactgcatgtgtattaagttccaa

SEQ ID NO: 45572 - DNA, 601 bp, Human
cataggcaaagagggcaaagagctgggttcaagtcccagctctgccactaatttgctgtgtgaccttggacaaatcactttcccatcctggtccttgagttcatcacccataaaagggggaggtgatctaaatgttgcttgaggttccttctggccctgaagtgtgatgtggtggaaagagaagcggttggggtgtcaggagaccaagagtctagctagttctacaattaatttgctataggactatagataagtcacttcctcactctgtgcctcagactcctcgtttgtaaaatgaaartgttggactagattataaatggcaaataggtggtccgtgggccagacccccccatatttgttctaatggcagatgtcactagtggatcccgacgctcttcccactgagcctggacacagcctcagcatctttctcaacacagcactctaggaggaaactctcactccatcagtgtgcgcacaagatgacccctaactcgccttcccttagagctgacctctgacatccttcccgtgtgccctttggggactccatgacctagggacccttagccactcaccgtacttggctaagaacctc

SEQ ID NO: 45573 - DNA, 601 bp, Human
ttcccgtggagagagaaaagaaatcaaaggcattcttggggaagatcaggatataatgttctgaaaccaaaagcaagtctgccatgtctcgtggtcttttgctactgggccatcataatgcaggccgtattgtgttattttctcccattaagatatttcataggcaaagagggcaaagagctgggttcaagtcccagctctgccactaatttgctgtgtgaccttggacaaatcactttcccatcctggtccttgagttcatcacccataaaagggggaggtgatctaaatgttgcttgargttccttctggccctgaagtgtgatgtggtggaaagagaagcggttggggtgtcaggagaccaagagtctagctagttctacaattaatttgctataggactatagataagtcacttcctcactctgtgcctcagactcctcgtttgtaaaatgaaagtgttggactagattataaatggcaaataggtggtccgtgggccagacccccccatatttgttctaatggcagatgtcactagtggatcccgacgctcttcccactgagcctggacacagcctcagcatctttctcaacacag

SEQ ID NO: 45574 - DNA, 601 bp, Human
tctgttgctagagagagggttacttcccgtggagagagaaaagaaatcaaaggcattcttggggaagatcaggatataatgttctgaaaccaaaagcaagtctgccatgtctcgtggtcttttgctactgggccatcataatgcaggccgtattgtgttattttctcccattaagatatttcataggcaaagagggcaaagagctgggttcaagtcccagctctgccactaatttgctgtgtgaccttggacaaatcactttcccatcctggtccttgagttcatcacccataaaaggggraggtgatctaaatgttgcttgaggttccttctggccctgaagtgtgatgtggtggaaagagaagcggttggggtgtcaggagaccaagagtctagctagttctacaattaatttgctataggactatagataagtcacttcctcactctgtgcctcagactcctcgtttgtaaaatgaaagtgttggactagattataaatggcaaataggtggtccgtgggccagacccccccatatttgttctaatggcagatgtcactagtggatcccgacgctcttcccactgagcctggacacag

SEQ ID NO: 45575 - DNA, 601 bp, Human
accctgcctgtgcccctttgttcttacgctgggcagtccagatttgttcctggctgcacggaagggcctgcacctatgttccccactgctcaggcgcgtgctgagtgcatggatgcttacctgggcagagtcccgtgctgccgactctcacagggtagggtggctggcagagcacaaagcatgtgcagtttggagtcagatggcagtgggtcagcatccaggcttggactgtgaccaattagttaacctctctgaacctcagtctcttcatctataaaatgggacgagcatactacctacmacatggggctacggggaaagctccattgccccgatctgtgttcacacttagcaagtcctcaacagattcctacagttcagcctcagcgtctggattacctctggcttctctgttgctagagagagggttacttcccgtggagagagaaaagaaatcaaaggcattcttggggaagatcaggatataatgttctgaaaccaaaagcaagtctgccatgtctcgtggtcttttgctactgggccatcataatgcaggccgtattgtgttattttctcccattaagatatttcataggcaaag

SEQ ID NO: 45576 - DNA, 601 bp, Human
gtagcatttgcctatttccccatgtaaatattcccccatggccaattttaagctatcaatgtgaggtcagtaaacacagagttgggaagaggtgtgcagtcggttcctgagaacaggcacgagctggctctagcacacctctgcctctagccccggctcgtctgtctccacaggagccatgcagctcttcggcatgctctttcatgatgtcatgaattcacatgtctgtgcttcttcccttcctccagattgctccttgggaacttaagcctctctcttctcactcagagtatctagcacwtagtaattgctcaataactgctagttcttatcattggtgctatttgtgttattgtaggttttccttgcatgcttgctaattgcctgggaggttatccttgcattcctgtactcccggaaatattcattagctcagactcatatctgccccccaggatagaattcctgtagctgtgacctttggagcaggtgagtacctgccgcctatgagctgtgtgaccttgggcaagtcactcaacctctctgtgtcttagcttcctcatctaaacaacagagataataatatccacctcagtgagct

SEQ ID NO: 45577 - DNA, 601 bp, Human
tttgggaagcactgtccagcaaaaagggtcagatgctggggtttaagtcctagccctggggacggggctttcaaggggcaaatctcttaactaccagagtcttcgtttcctgtcctgtaaaatgaaaatccgggttgacccgcatacccgcagcacagtgtgaggctcacatgggaggcagatgagtcacactctggaaatgaccaagccctgtccatccttcaagggcagctggagcttcacctctgcggcccaggcttccccatgtagcagtgctgctgggaatgcttaaaaactggcycaagcaagggcagagaagggggaaaggactctggtttgtagcatttgcctatttccccatgtaaatattcccccatggccaattttaagctatcaatgtgaggtcagtaaacacagagttgggaagaggtgtgcagtcggttcctgagaacaggcacgagctggctctagcacacctctgcctctagccccggctcgtctgtctccacaggagccatgcagctcttcggcatgctctttcatgatgtcatgaattcacatgtctgtgcttcttcccttcctccagattgctccttgggaa

SEQ ID NO: 45578 - DNA, 601 bp, Human
atggggatattaacttgcttgtcagtgtgctttataagctgctttttaatttaatgtgttaagtgttctctattttgccttattctaggaagaatttcaagtggcttgcaaagattgataaaatacagcaaaagtgttatatgttggaactaaaagagaaggaatatttaaaaacgagggaggcagaagtaaggcccagaatgcaagtctgtgttttctgttggccacagaagaggctctaagatcctgattctctacccaggctgcacagtaaaatctcccgggcagctcttagacaccytgaagcctcagccacggcccagaccagcggcagcgccatctcgtcaggtggggcccaggcatcagggtttctggtgcagccaaggttggacactactgttttgggtgctattcttggggcatctgctctgcgctaactcacacagtttcttaatacgtctatctttggtgttgatctttgatttcatacggtggctttgctaaactggaaatgaacaacaggaaaatgcgtgtcttggaggtgactgcgacatcgggactttagggctcctttctcagcacacccgcatgtcaccccttg

SEQ ID NO: 45579 - DNA, 601 bp, Human
gcagcagccttgccataccacctggccctggctctgatgtccttcctgaatctagcccaacagcaggggaatgggcagagagctttgagccaacgcaagctgtccttagctagagaggggcccagcatgggcagtggggaaactgggaggctcagagtcaggggtacatgggttacacaccagctctacccttcagcactgggccagcgcaagcatgtcacttaacctctctgaaccgcacctaaagcagaggggtaattaattgtaataatagtgatgatgatgatgatgatgatgatggtgatagctatagctaccctttattgagctccagtgggttgctgtgagcactttaccccttaccttcttaagtcataattgtgctaatattgctgagcgcttactgtgtgccaggtaccatttaaagtggtcctcacatttgtttacttcatttaatcctagcatgaccctcagagctaagaacttaatctcatttactcatttactcataacaatccggcaaggtaggactgcttacaaccccaggtccaggttacaaagcacaatgtaatgatctttcaccaaggctgcttctgagtat

SEQ ID NO: 45580 - DNA, 601 bp, Human
atctgaagcctgacatccttgccccaggtctgggctcccactccaggattctagtttcctcagagcagcagccttgccataccacctggccctggctctgatgtccttcctgaatctagcccaacagcaggggaatgggcagagagctttgagccaacgcaagctgtccttagctagagaggggcccagcatgggcagtggggaaactgggaggctcagagtcaggggtacatgggttacacaccagctctacccttcagcactgggccagcgcaagcatgtcacttaacctctctgaacygcacctaaagcagaggggtaattaattgtaataatagtgatgatgatgatgatgatgatgatggtgatagctatagctaccctttattgagctccagtgggttgctgtgagcactttaccccttaccttcttaagtcataattgtgctaatattgctgagcgcttactgtgtgccaggtaccatttaaagtggtcctcacatttgtttacttcatttaatcctagcatgaccctcagagctaagaacttaatctcatttactcatttactcataacaatccggcaaggtaggactgctta

SEQ ID NO: 45581 - DNA, 601 bp, Human
atagagccgtaggtgtctggaagaatggccccctaccccttccttgtcccctccccaatgcagaggccacaactaccagcttagcctttcctgtctgggccctgagaccggagcagatccagctcagggtcattccaggaagacccagtgcagcagtgtggcaggtgctgagctgtctctgaccttggacctcattccgaatcactgggctcttgtcttgttcctaggacccaccagtatctgaagcctgacatccttgccccaggtctgggctcccactccaggattctagtttcctcaragcagcagccttgccataccacctggccctggctctgatgtccttcctgaatctagcccaacagcaggggaatgggcagagagctttgagccaacgcaagctgtccttagctagagaggggcccagcatgggcagtggggaaactgggaggctcagagtcaggggtacatgggttacacaccagctctacccttcagcactgggccagcgcaagcatgtcacttaacctctctgaaccgcacctaaagcagaggggtaattaattgtaataatagtgatgatgatgatgatgatgatgat

SEQ ID NO: 45582 - DNA, 601 bp, Human
atttctatttgtgtaggcacaggaggcctgactttgctctgcagaggtgctggtcaaaggcaggcctgggcctcaccctggatggcggccacggccaacaaatgctctgctaacagctgtaacgtgcccaagaacgggaaagaacagtgagaggggctgccccggggccgctggacagatggggctggtatctctggcaggtcacagctggtctccggcagttctccacgaaccaagggaaagtggcagaaatgtgggaacttgagcattgtctcagttatgtggtgaatcatcttactgyggcaggactctgccaatcagaaagtgaatgtgtaacgccggacaggctctggagatcagtgcgtccagctttcccattttacacagagtaaacctgaagcccaggcttggggtggggaacagagtgaggttggacagaaggtgggtggtgcacaagagcaaaatacaggtctctggatgtccagggccaagccttctacgatgcccctctcctcccaactatgggagcggccacgttggtagccccactgcacatcatcactcctcttcccagcccattttgtggggcagaggacaggag

SEQ ID NO: 45583 - DNA, 601 bp, Human
accatgaggtcacttacactcctctcctgtcagtctcaacgcctcctccccgaaggctgacgctagcttctcccagtctctctgcctcaccttctgggtgtggagaacttggtcagccactgcggaagcctgagctccctgcaaccaccagttcctctcttccctaaaacacgagcactgatctcagcactttacctctattcatctgtgaaatcctcccagtagccctctgaagtgagtactgtaatatcctcatttcagagatgaggagacataagcccagagaaggtatgtgactccyccaaggatacacagccagtaagtgatggagccaggatttgaacccaggcagtctgaccccaaagctacactcttaacaatgcccctacctcttgtgtagcagtcagggtgacagttaatatatcccggggttttgcagtcttcataatgtgttaacttgcctgcccattttaccttcacttcagccctgggtgggagtggccggagcaggcctgtggccttctttttaacagatgtggctcagagagccgaagtgactaatcaggggtcataagacaattctgggggctcaaccccagga

SEQ ID NO: 45584 - DNA, 601 bp, Human
gccagactgcactagggtttcaagaagctcccactaatttatttcaggctaagcgctgttgcccattgccagctcagttatttggaggaattgcctggaaggcccccaaacccaatgaatgtccaacctcctccctgcaggaggcagtagagcctagtggcgaagtttggagccagaccctgctctctctgggggaggacggacagggacagccagatcccagagcccaccgtgtgccaggaggctcctaaaggctttacaagtgcgattgggtttaatctttacaataacccctaaagcraggctcatcattcccattttgcagatgagaagagtcaagactctgagagattaaggggcttgcccagtcatacagtcagaataggggaaccagggtgtgtgccctcctctgactccagggctgagctgtccctatcttgctgtcctgggaccccagtggagccacgagatcctgaggacaaaaggggacaaatgtgtttggccccaactaatttggccccaactactactgccccaggccccaaccagcccattgtgaccatgaggtcacttacactcctctcctgtcagtctcaacgcc

SEQ ID NO: 45585 - DNA, 601 bp, Human
gcagcccaggtccatgaggaacttgagcagcgacaggcacttcatggcgaacatgatggtggcggggaaggcggtggggtgcgtggcgatataggcgtcgatgttcgcgccgtggtccagcagcagctgcattgtgcgcaggcagccgtggcggatggccacgagcaaggggctgatgacgtcgcggttggggtcggcgccgtgttgcagcagcagctcggtggcgtacacgttgttgttgaccaccgcgaagtacagcgcggagctgcgccggtcttcgtagaggcgcgcgcgctcgggsgccagcggcgtgttcacgtcgaagcgcgcgctcagcagcgcctccagcacctcgtcgtggttgcgctcggccgccaggtgcagcggactgacgccgctacggcgtatgcgcgtgcggctggtcaccggcagcagcatctgcacgatcctgccgggtcgaggggcgggcgcgggtgaggggagggtcggggtgtggacgggtagggccggccccgccagcaggagagctcgggcgccaggctcggctggtcgccctgaccgcgggctgcgacgcggatcccaccggcagggggcgccgcgg

SEQ ID NO: 45586 - DNA, 601 bp, Human
ttcatcccacctgcaagagcctgcggccagggacggcagcggatgtgtccaagcacagacactgtgcacacccaggctaggatcccctgaaccatgtcccctcaacacaggcttctgctgcccaaagtggaagacgggcaacttgagcaagtcacatcacctctgagcctcaatttccctatctataaaataggtatatgaaaccaactccaaggggatttaacatgagaattaggtaatatgaacataaactttgcacacagtaggcagcccatgaatgatcgccattaaccattaaaayaatgagctccaggagaggagtgtgtctaacttccttttaagttctgactttttttttttttttttttttttttgagacagagtctcgctctgtgcccaggctggagtgcagtggcgcgatctcggctcactgcaagctctgcctcctgggtgcacgtcattctcctgccttagcctcccgagcacctgggactacaggcgccggccaccacacttggctaatttttttgtatttttagttaagacggggtttcaccgtgttagccaggatggtctcgatctcctgacctcgtgatccgcc

SEQ ID NO: 45587 - DNA, 601 bp, Human
aaggagttacagagcctggcaagcagcaggtgctcacagggttaggaacagtcgcactccctgaggcctgggactctgagtcaggcagggagatctgccagccttggcagcagcagcaagtccctacctgccttctccttgatgacggcccagtcctcaaagctgtcgatgtgttccttcagccgcgagcagagctgcacgttgcccacgtagtccaggaggacatcgatgatgggccccgcccagcggctcacctctggggcagatacgaactcacagaactgaaagagaacatgccggsaccaagaagtgagttcatcccacctgcaagagcctgcggccagggacggcagcggatgtgtccaagcacagacactgtgcacacccaggctaggatcccctgaaccatgtcccctcaacacaggcttctgctgcccaaagtggaagacgggcaacttgagcaagtcacatcacctctgagcctcaatttccctatctataaaataggtatatgaaaccaactccaaggggatttaacatgagaattaggtaatatgaacataaactttgcacacagtaggcagcccatgaatgatcgcca

SEQ ID NO: 45588 - DNA, 601 bp, Human
acgattggttttactggctaacaaatgcgtactccacactaaggtctctgcagggatttccctggggcatggtttagttgtgggggaccacccttctctaaggaaggcaggagaaggtgacagaatgggtaggactgatacctaggcatagactgctccaccctctagtggccaaggatcgtggtgacagcaactaattattcattagttccctgaaggtttatcatgcgtctagagttaagccctgagtgaatgggcaagctgacgcctccctcctccatcactgccccagaaactttawcaaaggcttcaattcaagtggcttccaggcacctgtgccaatgaaaaatcctacagcacatttgggttcacaggggtgtggggatcaaggaggaatgtggtgagtcagagttggggcacaggggtgggccccccgaggctgcacagtcccacctggggacaggagcagtagtggtggaatgacaatgacctgctgcaggtcagcctccttgtaaacacttggccagggcaggactgtgccctcagagccagagaaagccctagggtagctagaatgccactgcacagatacccatttctg

SEQ ID NO: 45589 - DNA, 601 bp, Human; identical to SEQ ID NO: 23322

SEQ ID NO: 45590 - DNA, 601 bp, Human; identical to SEQ ID NO: 23323

SEQ ID NO: 45591 - DNA, 601 bp, Human; identical to SEQ ID NO: 23324

SEQ ID NO: 45592 - DNA, 601 bp, Human; identical to SEQ ID NO: 23325

SEQ ID NO: 45593 - DNA, 601 bp, Human; identical to SEQ ID NO: 23326

SEQ ID NO: 45594 - DNA, 601 bp, Human; identical to SEQ ID NO: 23327

SEQ ID NO: 45595 - DNA, 601 bp, Human; identical to SEQ ID NO: 23328

SEQ ID NO: 45596 - DNA, 601 bp, Human; identical to SEQ ID NO: 23329

SEQ ID NO: 45597 - DNA, 601 bp, Human; identical to SEQ ID NO: 23330

SEQ ID NO: 45598 - DNA, 601 bp, Human; identical to SEQ ID NO: 23331

SEQ ID NO: 45599 - DNA, 601 bp, Human; identical to SEQ ID NO: 23332

SEQ ID NO: 45600 - DNA, 601 bp, Human; identical to SEQ ID NO: 23333

SEQ ID NO: 45601 - DNA, 601 bp, Human; identical to SEQ ID NO: 23334

SEQ ID NO: 45602 - DNA, 601 bp, Human; identical to SEQ ID NO: 23335

SEQ ID NO: 45603 - DNA, 601 bp, Human; identical to SEQ ID NO: 23336

SEQ ID NO: 45604 - DNA, 601 bp, Human; identical to SEQ ID NO: 23337

SEQ ID NO: 45605 - DNA, 601 bp, Human; identical to SEQ ID NO: 23338

SEQ ID NO: 45606 - DNA, 601 bp, Human; identical to SEQ ID NO: 23339

SEQ ID NO: 45607 - DNA, 601 bp, Human
gaagaatgagagacggatgtgagactagatgcacgcaggccagagcaccagcatacgctggaacagagcacgagcatacactcgaacacacgcgcacacactcaggacatctgcgcacagacatacaatcctccgcgtccgcttccacgcaggcattcgcgcacctacatacacgcagttgcacgcgcgcgcacacacacaggcacacacacgcagacatgcacacacacgcagacatgcacacacaccacacatgcagacatgcacacacacgcagacatgcacacacacaccacacatccacacacacacacacacagttcgcctctccctgggtttctcagaaactaaatgatcaccgcccccccgccccgccccacctcccgacacagacacacaggcacatacaatcctcccagcacgtccgaacggatgcacagaaaactgagcacccagacgggtcccgtcgaccccgcacgttagctctaaactgtgtgcaattctggggcgaaaagctaaaactcgactgcgttcaacttgccggcgggttccccaagtctgcggggcgaagagctcgggcccctcaggcccgcaatcgcac

SEQ ID NO: 45608 - DNA, 601 bp, Human
gtctctttcccctacttttcccggggagtctgaattcctggggtctgttaatgattttaaaatgtagagccttccctgggtcgctcccgcctggagttcccgcccccttccctcctctcctctccccaccgccaacccccaccgcaaccattctcttctctctgtccctagagaaaagcccgctacatccatttggatttatgtaaggtggattagggacacaaaggaaacaataagacccaatttacaaaaaaaggagggagtagaaagggagggtaaaagagagaaaaggaaacgtgaygggaatagaaagcaacaaagtgaattaatttttaagggggaggtgggggaggggaggggaacagacctccctccctccccttcaacattagcctagggctctcagagcctttttgtcttgggctcccaagtttttctcccccccccccaaaaaaagagggggtttaaaaaaaagaaagaaaacagtctctacatctggggcgagagaggtctcaggggacgtcctaacaagtgtgtgaagtggccaggagaacgcgggatccacgattcctctcaggggaatgaataaccctagggaccg

SEQ ID NO: 45609 - DNA, 601 bp, Human
ccaacactgatcaaaacctaaacttgggctcacttatgtaaataatcattactcatttgatcttctccccctctttaaatctgcaggttcttatttattcaacttgcttagcatttaaaattccatcctaggactcacttgattcatttttctaaaaaggatgaatagagaatctgaagtacaattcaaaaagataaatacatctatgtagagcagttacactccagagcaaaatctgcattcatctctgtctggtatctactagaattatttgtttttgcaagtttcagatgaccacataactcatcagggtgacagagccacaagtgaattctctcttctatcagagagtatcctatccaaagggtcaggaaaaggctctccctaacattttcccttccacaaccaagtaaatagtccctgaatatggtatccgctgcttttttaaatatcaaagtttcagaaagagggaatgccagacgtgcagaatcagaatgcaaacgtaccgaaagtattctctctttctcaagatgtgttgggggacaatcagagactcgtcttccacccgtaggaaatcactggcttgaattttaggtatgga

SEQ ID NO: 45610 - DNA, 601 bp, Human
ggcctgccaatcactcctccctcctttaaaaagatggttttaagggcagactggaatttttcaggagagaacaaaccaatggcagtcaagttcaggcagaaaaaataggaagacagggcaatctgttttatctcaggtggattacaaaatctgtttgcaacaagacagcctaaaattctccattttcatgattattttcttgcttagtcttagttctgaaatatgtccttgatagcagactctatgaatctttaatttaaaatccttcattctttattcaatggaccggtgtggagcccaygccaggttctagcattacaatttttgcctagtaaaaactcctaatctttcacccccattgtttttaatcaatggactcagccataaactatcaagcctgtgaaggtaggatgatttgtttaattttaaaaggatttgagagttatttcagtttggcagaagtcagttacatgttgtactgttttctttccaaagctgattcattctgactggttatttagggggagtaggagaatgtggccgttgacctagtaagatggaggcagtaatgacaagtattacaaatttgagaataaatgaa

SEQ ID NO: 45611 - DNA, 601 bp, Human
ggtacatgtagcctgggaaagcctcgcctgaatcagtgacctttccagggtataggattaacaatgagtctgactctcaccaagataaagccgtacctttcttcacattcaaaggatgagggcaattgcctgcaatcagtggtgaatacagcctgtctacactgccagaggcctgccaatcactcctccctcctttaaaaagatggttttaagggcagactggaatttttcaggagagaacaaaccaatggcagtcaagttcaggcagaaaaaataggaagacagggcaatctgttttatytcaggtggattacaaaatctgtttgcaacaagacagcctaaaattctccattttcatgattattttcttgcttagtcttagttctgaaatatgtccttgatagcagactctatgaatctttaatttaaaatccttcattctttattcaatggaccggtgtggagcccacgccaggttctagcattacaatttttgcctagtaaaaactcctaatctttcacccccattgtttttaatcaatggactcagccataaactatcaagcctgtgaaggtaggatgatttgtttaattttaaaag

SEQ ID NO: 45612 - DNA, 601 bp, Human
cattatagcttttaaaaataatccgaaaagcagcaaaacttttgggactcctactaagctggtaggcagcctcaaattcttcattaacatctacagtaatgcattgatacagatctgttataaatcagcttaagtatttaacaaacatatgaatataattagaaggaacaagagatagtttttttaaaaaattgtattctgtaatagctccaggtaaagctccatgcagtccagtgaagtgcatagaatcataatgtatcttttaataggtttcccaactatgcactggcaaactcttaakggatggaaatgttactatgtgaaggaccataagccataaaattctgtatccttttcatctgccaccattataaaagttgaaactaggagggggtaagtgccctgtggtgatgaaaatttctttttatccagtaagcaataaaatcaccagtaatttacttattttaggaaattcatgtaaatccaaaaatagattcccatcttcaaaaacacctactcagcatgcttctcttctcagaacaatgggaatttggaaaaacacatttgtcaatgaaggcacatagggtatctctacagagtt

SEQ ID NO: 45613 - DNA, 601 bp, Human
aaaaatttgtacatgttctcatttttaaaacatagacaaataacaaaactagaaaacagacatgctttgcttctaactcttccgtggacattaaaaataaaatagcaagtgctgtttatgactgaaggcccaagaaaatgaaaggagatggtagcattttctttgcattccacttcctaacacaaagaatctaatggtaggacaacttgcgtctaccactgtgactaaaagtttcactgtcattatagcttttaaaaataatccgaaaagcagcaaaacttttgggactcctactaagctkgtaggcagcctcaaattcttcattaacatctacagtaatgcattgatacagatctgttataaatcagcttaagtatttaacaaacatatgaatataattagaaggaacaagagatagtttttttaaaaaattgtattctgtaatagctccaggtaaagctccatgcagtccagtgaagtgcatagaatcataatgtatcttttaataggtttcccaactatgcactggcaaactcttaatggatggaaatgttactatgtgaaggaccataagccataaaattctgtatccttttcatct

SEQ ID NO: 45614 - DNA, 601 bp, Human
ttttgcctgaaatccagaggcaatggtggatttactgcttgtgagttctcggcagttccttgtggtggtccaacaacctcaaattcacctattacaacagctacaatttcaagtggcaacagttcaaatttactcataaaggaaaaactagtatgggtattgtttcaaccactgagcagagacctgcaaattaagggcaggaagagcagagcttgccaaaggaagacaattatcagttaattagtagtgctcctgtcagaactttgctctctaatacctcaaaaaaaaaaaaaaaaaaaawaaaggcaattgatttttttggcaccctcactactctttaaaggtgaaaagaaaatcccaccattctggtttcagtaatcctaggaagacagggagtaaattttatggctggatttctcaaatatgctatcatttataacagtagacaacttttcaagactgtgtattcaattaaaaaatttgtacatgttctcatttttaaaacatagacaaataacaaaactagaaaacagacatgctttgcttctaactcttccgtggacattaaaaataaaatagcaagtgctgtttatgactgaag

SEQ ID NO: 45615 - DNA, 601 bp, Human
tccgctccgctcctcatgcccagcgttgcataggcagttgccaatgggtaccagccattcaccatctgccccacagtacatttttggcacatctttctcttctgagttgttgacacaggagcctcgaacttccaccagggaagacgtatcagcccctgtgatggtgtcaggaaactgggccagattgcggactgtgagtggacactttttatagaacacacggactgataccagggcgatgcaggcccccacatcctgaaaagccaggtaaaacccctttttgcttaatggccctacatcmcggatctcggtgttcagcttcatgattctgtcaccaatgtccacttgggtgaagctctcatcagcagcaatggtgtcaattttgacaaactggttctctctgatgaaacgctctttgtcgttgtctgattcatagtagtacaggttaaacgtctccttgcaagtccccatgacgcccggaagactattgcagtccctcaaggtgaatttaatctcaatatacaccctctgagccccttctcgggtgatccaatcagttcgtagccagttattctggctgggttccatcacattgcacact

SEQ ID NO: 45616 - DNA, 601 bp, Human
cacgcacttatgcagaagacgggagatatttaacaatctttgtcattttaccaagtccatagacaggaaaactatggctcaaaaatgtgtccgccctctttaagtaaggatcaatcaaggctgtttcttcagcttgttcatttacatttcagagggcgcatcaagccagttcagatataagtgcctgttagcaaatgtgtttggctttctgctgattacagcagcatcatttattttgtcagtattagaaacgtcttagctttgccacctggagctatagcacttactcattagacccctrtgtcccaccacatcccacaggggctactaattactggctttactccatttagtctcatctctgatttaattactcgcactaagccccagtgaaaaaactgcaatatggaccctcttaccttggcattctccgctccgctcctcatgcccagcgttgcataggcagttgccaatgggtaccagccattcaccatctgccccacagtacatttttggcacatctttctcttctgagttgttgacacaggagcctcgaacttccaccagggaagacgtatcagcccctgtgatggtgtcagga

SEQ ID NO: 45617 - DNA, 601 bp, Human
tccccagtattctgacaggaaggggtaaaaaagcaagaatcaactgcatacactgaacctgaggtgagaaaaaaaaatccacttagtaatatggtaagtagtaattaatgtgataaaaatacatagatttcttcaaaaactcaataactgaaatcaataccaaattgggtcacaatttgctattgcttctgaccacagatcaaataagaagactcttgcttgcttaattaccacctcctaagagaaataaagaggtctttcatcaagattaatttcatttagagaacccatcggtgggtgytcagggaacagaatgtacttgaagcaatgtccctccactttgttgggtcatatctccaccggtccacaaggcagaaagaaaaaatggactttcttcactcgattttagtcagtgggagggaactggaacaacttaatcctaatttcacatttagatcattcacgcacttatgcagaagacgggagatatttaacaatctttgtcattttaccaagtccatagacaggaaaactatggctcaaaaatgtgtccgccctctttaagtaaggatcaatcaaggctgtttcttcagcttgttca

SEQ ID NO: 45618 - DNA, 601 bp, Human
catctttcctcgtctctatattatttccactgtgcctgggtgctactcttgatgcctatcatgatatcaaggatagggccaactgtttttattattcctaagacttttagagtctcaagtcatcttttaaaagtctcactctggctgggcgcggtggctcacgcctgtaatcccagcactttgggaggccaaggcgggtggatcacgaggtcaggagatggagaccatcctggctaacacggtgaaaccccgtctctactaaaaatacaaaaaattagccaggcgtggtggcgggcgcctrtagtcccagctacttgggaggctgaggcaggagaatggagtgaacccgggaggcagagcttgcagtgagccaagatcgcgccactgcactccagcctgggcgatggagctagactccatctcaaaataaataaataaataaataaataaataaagtctcactcaagcttggaatcctttgtcattcaagttttttcttacctaactacatcagaaatttttacatggcaataacagaaacaaacaaccaaagtgcaaggtcttgtgcaaaaagtgtcttgaaagagttaatcattttatt

SEQ ID NO: 45619 - DNA, 601 bp, Human
gctaagtgaccaaattcatacatctttcctcgtctctatattatttccactgtgcctgggtgctactcttgatgcctatcatgatatcaaggatagggccaactgtttttattattcctaagacttttagagtctcaagtcatcttttaaaagtctcactctggctgggcgcggtggctcacgcctgtaatcccagcactttgggaggccaaggcgggtggatcacgaggtcaggagatggagaccatcctggctaacacggtgaaaccccgtctctactaaaaatacaaaaaattagccrggcgtggtggcgggcgcctgtagtcccagctacttgggaggctgaggcaggagaatggagtgaacccgggaggcagagcttgcagtgagccaagatcgcgccactgcactccagcctgggcgatggagctagactccatctcaaaataaataaataaataaataaataaataaagtctcactcaagcttggaatcctttgtcattcaagttttttcttacctaactacatcagaaatttttacatggcaataacagaaacaaacaaccaaagtgcaaggtcttgtgcaaaaagtgtcttg

SEQ ID NO: 45620 - DNA, 601 bp, Human
agctaagtgaccaaattcatacatctttcctcgtctctatattatttccactgtgcctgggtgctactcttgatgcctatcatgatatcaaggatagggccaactgtttttattattcctaagacttttagagtctcaagtcatcttttaaaagtctcactctggctgggcgcggtggctcacgcctgtaatcccagcactttgggaggccaaggcgggtggatcacgaggtcaggagatggagaccatcctggctaacacggtgaaaccccgtctctactaaaaatacaaaaaattagcyaggcgtggtggcgggcgcctgtagtcccagctacttgggaggctgaggcaggagaatggagtgaacccgggaggcagagcttgcagtgagccaagatcgcgccactgcactccagcctgggcgatggagctagactccatctcaaaataaataaataaataaataaataaataaagtctcactcaagcttggaatcctttgtcattcaagttttttcttacctaactacatcagaaatttttacatggcaataacagaaacaaacaaccaaagtgcaaggtcttgtgcaaaaagtgtctt

SEQ ID NO: 45621 - DNA, 601 bp, Human
agagtgagacttcatctcttatgttaaaaaacaaataataaaaaataaattaaaaaaaaatttaatggaatattttcctctcttccttctgcttactatttctaaagtaatgaaaacagtcctgtaaaacatctggaacatttcttcattaggggtatgtctgtccggaaggagatgtctgaagtggattttgtttcctttttccaacagtctgatgtggcctggaagcaggactaactagaatcattatattatcctctgcatccaatcactaggcaagttcaaagggctgctaactccygcgatacattctccttgagaagatgggtaagtagctcatacacattgttgttctactgagaccaagccaaatcatttcagaaaatgttattcaagagcagaatgaacttgcctctgcttcagagggcaaagccaccatccccctgccctcatccttcctctccattagcatgtactgctgggggtaggaactgcaagaggaagtgtagttctgtccccaaggtcctttgacgactcagtggatgatcagggttagagtcaaacaacagcacaccccaggcccccgcccgccctgcccatt

SEQ ID NO: 45622 - DNA, 601 bp, Human
tttttttgacatagctctcttcctcttttcagagcacaagtctgtttattttaaaaccattggaacatttctatcttgttctttctttaaaaagcttttaatacgataccttttgttgatatgagtacattttaatactgatgacctcaatatacaacaaaattgtatacttcagcaaggcttgattcttacctagcttaattttgtcatagttgtaatcatttggccttaagagtgactccaaaagaatgtttttattggtattattttttatatgtatgctctgaaaactgctgattartatttcccaaagagaaaatctggagctctcctttcatttttcagctttttaattaagcaaaaaatacactaataacgaatctttttggctgggtgaggtggctcacacctgtaatcccagcactttgagaggctgaggtaggatcacttgaggccaggagttcaagaccagcctaggcaacagagtgagacttcatctcttatgttaaaaaacaaataataaaaaataaattaaaaaaaaatttaatggaatattttcctctcttccttctgcttactatttctaaagtaatgaaaacag

SEQ ID NO: 45623 - DNA, 601 bp, Human
gtcacacaaagaggaaaaaaaaaagtatatcagaaaaaggacaataattaaacgctgctctcttatagataaagaattacattttttcaatgatcacagccatgcttcaaagccggagataaaagcagccatgtgattcaagcaattgattcttaatgatacgattcaaaggtagaggaaaaatttcaacagtgcaaaggatatggaagcagcatctctgtgaagtagattttaaatatttcctttccattacttctttctcctaagctccttctatagtatagttgaaaaaagaaatcattttttttgacatagctctcttcctcttttcagagcacaagtctgtttattttaaaaccattggaacatttctatcttgttctttctttaaaaagcttttaatacgataccttttgttgatatgagtacattttaatactgatgacctcaatatacaacaaaattgtatacttcagcaaggcttgattcttacctagcttaattttgtcatagttgtaatcatttggccttaagagtgactccaaaagaatgtttttattggtattattttttatatgtatgctctgaaaactgctgatta

SEQ ID NO: 45624 - DNA, 601 bp, Human
tgagaaatttatctgacaagcatgcagtcctttgctaatgttaaatttaccaattacccgttcccccaccccccgccattaactagtaaagttcagttatgtgaaagtcaaacttatatcatgaccacccctgctttgcacagcagtaactgaaaaaccacttaagaaggctttttcctagaggctcagatcttaacagaataattatgtgttaattcatttctgaaagatacaaggaagctcagttagactaaaataagtcatcaaatcttgaataccatattcaaaaatccctgagatratttctatgcgatgttttggtgaaccccaaatagagactattgcatgattcacactcacaaaggcagcctggtcacacaaagaggaaaaaaaaaagtatatcagaaaaaggacaataattaaacgctgctctcttatagataaagaattacattttttcaatgatcacagccatgcttcaaagccggagataaaagcagccatgtgattcaagcaattgattcttaatgatacgattcaaaggtagaggaaaaatttcaacagtgcaaaggatatggaagcagcatctctgtgaagtaga

SEQ ID NO: 45625 - DNA, 601 bp, Human
taaaaataagagtaacaattttcactttctaagcattttaatgattctaggcactgtgccaggccctttatacattcatgcatatatgtgtgtcatatataataagatactattgccaccaatttgcaaacgtgaacttgagtttagggaagctaagttagtgtctacaattgcacatctgattaagtggctcaactccaaaggcagttcttggccattttgtgctaactgtatgttaacttcatgtgctgcagagaattttgaaggttcagatgtaaagaagattcataaacacgatttaaaaaggacccaattgagtagaaatcatgaacaaggacctcattaatacattagtcacatgcaaagattttaacatatcatattgattccatgaaacataactccaccaaataatcgatgttactactttggttatgcctaatgctccccccactgacattctcataaggaagttctactaaattcatatgtccaagataaaggcagaaaaatagcaaagcaaggttaatcattcaatgttttaacaaaaatatacatgtatgattacacattaatgtgttagtttaaaagtattactagg

SEQ ID NO: 45626 - DNA, 601 bp, Human
ctcagcctactgagtagctgggactacaggctcacaccaccatgcccagctaatttttgtattttttttttttttttttttagtagagctggggtttcaacatattggtcttaaactcctgacctcgtgatccacctgcctcagcctcccaaagtgctgggattacaggcgtgagccactgcgcccagtcactacttttttttttcatattcttgaatgtctggcttaatagaggacaaccagattcttttacagtagtctcctcatatccatgatttggctttctgtggttttgcctacygaaggtacagtacagtaagatatttttgagaaagggatagaaaaaacgatagagagaggctatattcacataatttttattaagatatattgttataattgttctattttattattgttgttggcattctcttactgtgcttaatctataacttaaactttagcataggtacatatgtatagaaaaaacataatgtataagggtttggtactatttgagctttcagcatctattgagggtcttggaacatatcgtccaaagttaaaggggatcactgtatttgcttctgtattcaactta

SEQ ID NO: 45627 - DNA, 601 bp, Human
tctcctctctgcctcccacccctgatctctggaagcattcaaatcaaaaccgaattaatttgcatggtgtctaaatcattgggctctgcataaacagaaggagattttggctggggtttccaaaggaagccctcattgcctttgtgaaagggggaaatgggtgtgctgttttgcatgaggacgaatacagaatatgcaaatgaagaatctgctgcctggaactgcagggctgggcagacagctgacgacctgcattcacccagaaaaggctgaggtctccaaagggagttgtaagcagtaccaacatgtgtgtttcccaggaaaaagaaatagaccctgaatattcataaaatgttcatttagtcatgggattcttaattaccctccagatcatggaaccaagtgacctcacctgttctcctccccaaaacagctcagaggtaccagctgtaacaggatacagggagaaagcttttatgccttaagtgagatacagtctctcggggtacaggggacagctgaggccttctttaatcattccttctcacgagcacagtaaaactaaagggagcactgagccatgttattggacacagataac

SEQ ID NO: 45628 - DNA, 601 bp, Human
cccattagtgacctaaggcctattttcagaacttcctgagctctgacaattctttttcaaagaattgtatcttttactttacaattttttaaagccctttgttgggacacatctgaacattcctagcataatctgaatagtgccatcccctcccacctcagaaagaacagcaagattccagctgaagctgtcactaaacagacaagccaagggattcaccaaggctgggttccttttccaaaggtcaaaatgaaatgagcagcagggacttgggttattttgcatggggcaggggggccgsagagtgacaaccagccacactgggggcagaggtgcataaaaagagccctgtgcaaatagtctcctctctgcctcccacccctgatctctggaagcattcaaatcaaaaccgaattaatttgcatggtgtctaaatcattgggctctgcataaacagaaggagattttggctggggtttccaaaggaagccctcattgcctttgtgaaagggggaaatgggtgtgctgttttgcatgaggacgaatacagaatatgcaaatgaagaatctgctgcctggaactgcagggctgggcagacag

SEQ ID NO: 45629 - DNA, 601 bp, Human
acaagacataattaagggcctaaagattgcaaagtattaccatattcagtttgtaaaattcattcatcaaaagcaataatttgcttgtagttttcagctcaggtatttctggggatagttagttgcgaacggttattaaaggaagaagtcacataaaagagacagctgcgatcctaatgaagaatccactgtggaaagcaatagctgggaaacgtgaagtcttaaatcagggaagttcttaaggacaaaagcccaagagaaaaagcattcctaactgagctgagtcttaactgatcatgargttggcccatatttacctgccatggtattataggaggaaatcagtattctgttaacctctgacccctcagatctgaagcagacaaaggcccaatctggagccctgggagaacatagccaaatgtcaaacagcagggaagcgattgttacagaaacatttggcttgggcacaggcagcttcattggggcaaactgctattcacagaaacaagccatgaagagataacgccataaaatatgaacaacatggaacctttttcgccttgcttctaaattgttagctttatgggacttcaagctg

SEQ ID NO: 45630 - DNA, 601 bp, Human
agtcccagctactcaggaggctgaggcaggagaatggtgtgaacccaggaggcggaggttgcagtgagccgagactgcaccactgcactccagcctgggcgacagagcaagactccgtcttaaaaaaaacaaaaaacaaaacaaaacaaaaggtgaccaccctcctttcctggatcagtactctcagccgtttatatattctactttcagcaagtataaattaaactgaccttctatcctgccatgccaaacccctaccccttcaaaattacctcctcctcaaggattttctgaaactaargatggaataaccatgcaccaatagatcaagcctaaaacttagaagttacagctttccctgtcactcatcccctaaaccccaatggccactgtatccattggtgggctcccggcagtacacacattcacatacacacaccacccgcacacaatgtgtccctcttctgttgacctggaatgcacttgcttaatccacaagattctacacttaaaggccatgtcaggcatttttgcctttccattgtctgagcagatgcttaggaaaggtttatagttgaaagtcaactgctgttcaacattg

SEQ ID NO: 45631 - DNA, 601 bp, Human
cacaaaaaattagccaggcgtggtggcaggtacctatagtcccagctactcaggaggctgaggcaggagaatggtgtgaacccaggaggcggaggttgcagtgagccgagactgcaccactgcactccagcctgggcgacagagcaagactccgtcttaaaaaaaacaaaaaacaaaacaaaacaaaaggtgaccaccctcctttcctggatcagtactctcagccgtttatatattctactttcagcaagtataaattaaactgaccttctatcctgccatgccaaacccctaccccttmaaaattacctcctcctcaaggattttctgaaactaaagatggaataaccatgcaccaatagatcaagcctaaaacttagaagttacagctttccctgtcactcatcccctaaaccccaatggccactgtatccattggtgggctcccggcagtacacacattcacatacacacaccacccgcacacaatgtgtccctcttctgttgacctggaatgcacttgcttaatccacaagattctacacttaaaggccatgtcaggcatttttgcctttccattgtctgagcagatgcttaggaa

SEQ ID NO: 45632 - DNA, 601 bp, Human
aaagcaaataaaaaaggtatggccgggcgcggtggctcacgcctttaatcccagcactttgggagaccgaggtgggcggatcacgaggtcgggagatcgagaccttcctggctaacatggtgaaactccgtctctactaaaaacacaaaaaattagccaggcgtggtggcaggtacctatagtcccagctactcaggaggctgaggcaggagaatggtgtgaacccaggaggcggaggttgcagtgagccgagactgcaccactgcactccagcctgggcgacagagcaagactccgtctyaaaaaaaacaaaaaacaaaacaaaacaaaaggtgaccaccctcctttcctggatcagtactctcagccgtttatatattctactttcagcaagtataaattaaactgaccttctatcctgccatgccaaacccctaccccttcaaaattacctcctcctcaaggattttctgaaactaaagatggaataaccatgcaccaatagatcaagcctaaaacttagaagttacagctttccctgtcactcatcccctaaaccccaatggccactgtatccattggtgggctcccggcagtacac

SEQ ID NO: 45633 - DNA, 601 bp, Human
ttacaaagcaaataaaaaaggtatggccgggcgcggtggctcacgcctttaatcccagcactttgggagaccgaggtgggcggatcacgaggtcgggagatcgagaccttcctggctaacatggtgaaactccgtctctactaaaaacacaaaaaattagccaggcgtggtggcaggtacctatagtcccagctactcaggaggctgaggcaggagaatggtgtgaacccaggaggcggaggttgcagtgagccgagactgcaccactgcactccagcctgggcgacagagcaagactccrtcttaaaaaaaacaaaaaacaaaacaaaacaaaaggtgaccaccctcctttcctggatcagtactctcagccgtttatatattctactttcagcaagtataaattaaactgaccttctatcctgccatgccaaacccctaccccttcaaaattacctcctcctcaaggattttctgaaactaaagatggaataaccatgcaccaatagatcaagcctaaaacttagaagttacagctttccctgtcactcatcccctaaaccccaatggccactgtatccattggtgggctcccggcagt

SEQ ID NO: 45634 - DNA, 601 bp, Human
tattgatctgaaaagattttatgatcatgctccatgatcattaactcattttgtggtgtatatgtgtacatcaaagaaagtctggaagcataaaaagcaaaataagtgtggctctcattatgtggtaagcttatagatgattttgcctatctttatacttgcctgtattccgcatttttatacatacaaaattaatttgcgattttttactaaacctgataaccttatgataaataagttcgcttcaacatggctctaagccatatttagttaccttactaagaaaggctttctatgctgwacttagcagctacgcacacaataaaaccacagtacaattaataataaatctgattatgttaaagtctagtgaaatattaatcagctaaaacacatagatgattgatagatataatatgatctccatttcacaaacaaggaatacagggcttagaaggataaagtgacttctacaagattcacacatccagaaaagtcctggtcacgggggtggaagctttaggatgccatgtatcttcatctgttcgggctgctataataaaatatcataaactgggtaacttataaataacagaaattt

SEQ ID NO: 45635 - DNA, 601 bp, Human
ccattaaaaataatgttatgaagttatatttattgatctgaaaagattttatgatcatgctccatgatcattaactcattttgtggtgtatatgtgtacatcaaagaaagtctggaagcataaaaagcaaaataagtgtggctctcattatgtggtaagcttatagatgattttgcctatctttatacttgcctgtattccgcatttttatacatacaaaattaatttgcgattttttactaaacctgataaccttatgataaataagttcgcttcaacatggctctaagccatatttagktaccttactaagaaaggctttctatgctgtacttagcagctacgcacacaataaaaccacagtacaattaataataaatctgattatgttaaagtctagtgaaatattaatcagctaaaacacatagatgattgatagatataatatgatctccatttcacaaacaaggaatacagggcttagaaggataaagtgacttctacaagattcacacatccagaaaagtcctggtcacgggggtggaagctttaggatgccatgtatcttcatctgttcgggctgctataataaaatatcata

SEQ ID NO: 45636 - DNA, 601 bp, Human
cactttggagttcatttcattaatgagtattgcatggaaattaacatataatgatcctatatgtatgctctttctcgttatgtttgtttcaagctcaggaagcatgtgtctcaaaactgagcctttttcagtatgtactgaagcttttctaaaaaatgcatatttttcaacttggcaattatttgaaaataattaaggctacattttaaaactttggccaaggatattaagggcaacattattgaaagcatcaaactgaaagcatcttaaatgtccaacaatagaggatagttgaagaaaytgtggtacattcaggcaacagaaaactctgtagccattaaaaataatgttatgaagttatatttattgatctgaaaagattttatgatcatgctccatgatcattaactcattttgtggtgtatatgtgtacatcaaagaaagtctggaagcataaaaagcaaaataagtgtggctctcattatgtggtaagcttatagatgattttgcctatctttatacttgcctgtattccgcatttttatacatacaaaattaatttgcgattttttactaaacctgataaccttatgataaataa

SEQ ID NO: 45637 - DNA, 601 bp, Human
gctgtagtttgtgggccaataaagtgtgtgggaagctgtaactccacaggcatacagatgacagtactcaacccaagcaaaacagaaatgcaatctaaaacagcaaatgaatgctttacccagcaaggtaggtgattctgacgttaccaacaaaccactttccttggtctggaccagcagtagagaggaaaaggggagcaccaccacccaaacagagtaatactctttatattttgtacattgcatttatactttgtacattacaagtacagcaatgagacaggggataggcacccagacrttaccaaatgtgatttcaggtttactttgcatgcagcagcatttctttctctgcattttccaaatgttctacaataaacagtatttgtttcataaataaaataaatagaaaaaaatcaaaaaaatatgattttatactcttattgctgaagagaagagttacagaaagcagaatgaatgctttagtttcaagaaaatacatccctggtttcactgaccttggaaagtctactctgtttctaaatgacaatgtcttccagaccagaggccagggtaggcaggagagaagggagaggcaaaa

SEQ ID NO: 45638 - DNA, 601 bp, Human
agctattttttgtatttttactagagatggaatttcaccatgttggccaggctggtctcgaaatcctgacctcaagtgatctgcccgcctcgtcctcccaaaatgctgagattacaggcaggagccaccgcgcccagcccagttttcttatttaattcaatgaattctctctattcaaagaacaatatccagttgctgctgttgtggttacttaaatttccacgtgcaaaacaaaacaaatgaacacccaactagtctgcactgcagccagtgaatcaaagcatgtcctcagttgtcatamcatctcacagaaggaaacaggattactatgtaacaaataatttggccaatacaacttaaatgatcaaatacgccagttttgatcaactcattttttcccctctttctgtactgatacaacctttttcaagagatgaatacaccacaaaacctgtaccaagtcatgctctgcacgggactgggaacatagtaagaaacttttcattgcctgtgaagtaggaaaggcaatcactgttgaattgcaataacctcagaattataagggaccaggagttattccagtccctgcaactggataacc

SEQ ID NO: 45639 - DNA, 601 bp, Human
catttgaacctaagagttggaggctgcaatgagctatgatggtgccattgcactctagcctaggcaatagagtgagattccatcgaaaagaagaagaagaaagaaggaagaagaaagacaaagatgacgatgacgaagaaggaggaggaggagattatcaataaaaagaaggtcccagacattttgaagaagacagttccaaaacatttccacaaaagttgtggcagccttacagttatccagactatctttttcaaggattcatttgcatgaaagtctctgtatttgtttgctaaaaaamaagggggggttatactttagaattatacagactcttttgtgtaagtatactgcccagcaaaactgacagagtgctgagtgtgtggcaaaatgagtaatttattgaattgaacgaagagtctaaaacgtagtgggatgaaacagatgtatgagtagggttataagtcttctgttataggacacaaatgaaaatctccttagggatactgctctacctgtaatttatttctacattattcttgtgtgtaatattatttttggcatgttaatgtattgtcaatgaattccaatctggtgacat

SEQ ID NO: 45640 - DNA, 601 bp, Human
ttaatccattcattcattcctttcaataacaactgtgtgtcaggctcagttttaggctctgagagtcctgcaaaaaacaagcaaggcccaaaaaacaaagccttctctcatggaagtagcattgtaattgacagctaaatccaaggatgctggagatcttccacattcttcttccacttatgttctcagtgctccaaatacttctcttgaaagtacactcaaagcaatttaaaagtcactcctaaaattagtctgttactttgcaatcactcattgttcttgagtaaaacccaatattacscagtatggctgatctcatttatcaatagcctggtcagtgaattatttgatttccaaaaattaaatccaccttaagggacaaaattgttcagaactaagcacatttaaaaagaaggccccaggcctggcacagtggctcacatctgtaatgcaagtactttgggaggccaaggaggtgaacagtgcttgaagccaggagtttaggactagccagggccacaaaataagaccactcatctctacaaaaaattaaaaatttagcaaggtgcagtggtgcacacctgtagccctagctactcag

SEQ ID NO: 45641 - DNA, 601 bp, Human
agagagaaatctctatgccgtgggactttgaatgcatttgtgaactgttgcatttaatccattcattcattcctttcaataacaactgtgtgtcaggctcagttttaggctctgagagtcctgcaaaaaacaagcaaggcccaaaaaacaaagccttctctcatggaagtagcattgtaattgacagctaaatccaaggatgctggagatcttccacattcttcttccacttatgttctcagtgctccaaatacttctcttgaaagtacactcaaagcaatttaaaagtcactcctaaaawtagtctgttactttgcaatcactcattgttcttgagtaaaacccaatattacgcagtatggctgatctcatttatcaatagcctggtcagtgaattatttgatttccaaaaattaaatccaccttaagggacaaaattgttcagaactaagcacatttaaaaagaaggccccaggcctggcacagtggctcacatctgtaatgcaagtactttgggaggccaaggaggtgaacagtgcttgaagccaggagtttaggactagccagggccacaaaataagaccactcatctctacaaaaa

SEQ ID NO: 45642 - DNA, 601 bp, Human
tctaaacaatgtactttggtcaattcccttgtctctcaaagggggttattatatacccagtttagaatgattgaaacataatgtgagaatatgaccaaatcaggacaacaaagatgtgctgaaaagcagcccagatttgtagttaagggtgaaggcttggtcagtggccagactttgcaggttgaatccagactcctcacctattagctgtgtgactttgggcaagctgcttagcttctctgggctttagtttcctcatctatgaaaagaggataatgacagtcactatttcaccaagtcrtggtgacacaatgaaatactgaaaataaagtgcttagcacaaagccaagttctcatcaggtaaatacatagcgaccttaacataaattattttaaattaatgccataaaggctaaaacaaagagagagagagaaatctctatgccgtgggactttgaatgcatttgtgaactgttgcatttaatccattcattcattcctttcaataacaactgtgtgtcaggctcagttttaggctctgagagtcctgcaaaaaacaagcaaggcccaaaaaacaaagccttctctcatggaagtagca

SEQ ID NO: 45643 - DNA, 601 bp, Human
tgtccatgatcagatcagataattattcagaataaaaattagaaacagtctcccaccctcttgtattgtattcctctaaagattataagccttttggaaatgtgggctttaaatgagaaatggtttttaatccctgtactagaatgcgaacctgctcactgaaggctgccctccagattaccggccttacgatgctctgcactagaccctggcattcttgaaagatgtttccccaaatcctcattaattcccaataattaagccctaacccccaatgtgattacatttggagacagaggcyataaggaggtaataataagtccatgcttcatccatgaagtcattcttcagaaaatccctctaaacaatgtactttggtcaattcccttgtctctcaaagggggttattatatacccagtttagaatgattgaaacataatgtgagaatatgaccaaatcaggacaacaaagatgtgctgaaaagcagcccagatttgtagttaagggtgaaggcttggtcagtggccagactttgcaggttgaatccagactcctcacctattagctgtgtgactttgggcaagctgcttagcttctctg

SEQ ID NO: 45644 - DNA, 601 bp, Human
tcctcaacctaaattaatcagaaccacctaggagcttgtgaaaaattcagatcacagactccaaactctaaagtcttgaggattgatgttaaaagtgtacatttgtaatcagtacctcaaatgattctaaggtataaactcatttttgcaaccactagggttcatcatcagacagaaaagctcagaaagcactcaccttccactaagttatcttatgccattcttacagctactaaaagtaacaaccatatattgactttctagaacagtcccaaatcccaaatctaaataaacattatcrtcttttgtccaatgccctaaaccacctatctacaaagcaataaagcatcaattatgccaaatcaaaggcacttctttttttctgttttttttcctcttcaaacaacggatttgttattttctccttttgttcaaataaagacaatcatcctttaaatataacctgcaagtcaactttactgtgaggcttttcttatcttcttcttctatgcctaaagtggtagaacaaagattttttggtaaacattacaaatcttcatatcaagggcacattccctttggttggatgaaatatctttcc

SEQ ID NO: 45645 - DNA, 601 bp, Human
ttacttagcaagggaacctggaaatcactttcaactgggtgtcatccagagtcagccttagtggtgtgggcaatacacaagtttacctgtggcttccaaaatgctgttcctcaacctaaattaatcagaaccacctaggagcttgtgaaaaattcagatcacagactccaaactctaaagtcttgaggattgatgttaaaagtgtacatttgtaatcagtacctcaaatgattctaaggtataaactcatttttgcaaccactagggttcatcatcagacagaaaagctcagaaagcactyaccttccactaagttatcttatgccattcttacagctactaaaagtaacaaccatatattgactttctagaacagtcccaaatcccaaatctaaataaacattatcgtcttttgtccaatgccctaaaccacctatctacaaagcaataaagcatcaattatgccaaatcaaaggcacttctttttttctgttttttttcctcttcaaacaacggatttgttattttctccttttgttcaaataaagacaatcatcctttaaatataacctgcaagtcaactttactgtgaggcttttct

SEQ ID NO: 45646 - DNA, 601 bp, Human
ctgcaagtgctccaagttctaacacaggcacctagaaaaggtctcaccccctcagatgaaaaactgcatcttgcacatgctggtaaatgcctaaattggccttcttccctggcctggctacagtggctgtggttgtgtgaacttccctaccttttagaagaaagagaataagcaacttccaggctgtgactatccctggaacccatggtcaatttgttagctctgtctaaaagtctcaatagtcaataactttttgattggttcttctttgttctactagggctgtcacatttagctgaawatttaattttatgcccataatcaaactcaatagcctttcagttctgtgtagttgtacttccagttgcttttccacctcaagaaacagtttctgggggaaaaaaggtaaataactcaactctttccagtcgacagaggtgctcttcacttgagcatctacatgatttaacttttttgttgaccagaaagcatatattcacagcatccaatctaagcatatgtgctatactggctaatttctagctgtctgggattaacttcatcggcaattcggggtgcagcttctgcacgttctccatcg

SEQ ID NO: 45647 - DNA, 601 bp, Human
aaaggggaatttcaaacaccaggcaattgtcacacagatatttcaatttattctttttttttttttgagacagggtctcactctgtcgcccaggctggagtgcagcggcatgatctcggctcactgcaagctctgcctccagggttcaagcaattctcctgcctcagcctccagagtagctgggattataggcacgtgctgccatgcgtggctaatttttgtatttttagtagagacggggtttcaccataatggccagactggtctaaaactcctgaactcaggtaatctgactgccttrgcctcccaaactgctgggatgacaggtgtgagccactgtgcccagccagatagttcaatttattctatcaaaagatgagaaaaactcagatcagttgagatttaacattctagttctgattactggccattttaatttgctaagcaggcacatgaattaaccaaattcctagtcatcacaagggcagatattaacttttagttcctacttaaggaaccaacattttagaacccagaagaccagagtgaaagtcaatgcagtcatgccaaaattgtctgttatagatccacacagccttgg

SEQ ID NO: 45648 - DNA, 601 bp, Human
aatgggattcttgaagcaccaccacctccccctccaagtaccctggaggtccttcaaatattagctctaagtggctgaggacagagttgacacctcaaaggcttgggaattaacttataacagctaatttagagagtcacatgatcagccaagtgtacccagttacaatcaagttaagaaaataatcagactacggctgctttaattgcagcaaacaaatacgctctaagactactcaagaaagcaaggacaagtgagatctacaatgaaaaaaatctaacccatgattagtattgaaackgcagaattaggttaaactttctctctaaggtaaggtgagagctccaaattctagttagcagatgtttatactggtaggtttattaccctagtatagattaatagattaaccacctcaatgcctctgaaatactgattatattttacattcttcaaagcattaggacttgcttctgcttgcaaaagccacgcgtactttttgagcttaaaaagtcagcatgcctgggactcaaaatcctctttcaaagaattttgtattgtttaatttttacaaaattcctggcagcccttaggcagaaat

SEQ ID NO: 45649 - DNA, 601 bp, Human
tttgccccaccttgaggaaggctggagaggctgggagaaggggcggtcaccattcacaaagcacaggagggaaactgagtagacagcttcctctctccaccaggaattgtgacttctgggaaacagccacccctccctgcaggctgccaactctctccacacctaaacacgctgacttgtaccaatggaaacgcctagcttttaaaacaaggttacaaatctgttgcatccaggcagagagggagttgattattctacagacagagctaattattttgacctaatgctttgagatcctccrgtatcaaatctgtgactccaaataaatggagaggtcattatcacatgttatctttacgcctggacttaaaaacaaaatttgagacaacgctgaagggcataagcttgctcactgtagtagctttagtacaacactttctgcaaagttgctgacaatggagtatgaagcaccagtctccaacaccgagggtttctaggtgtgacaccatggaacttttagacacaaagcaaacaacttttgtttttcccctacatttgaggaaacccacgagtctattttcctggacatgaagacagaaca

SEQ ID NO: 45650 - DNA, 601 bp, Human
attctaggtcctgtgctgcttccctgacaccatttccccatcctctgatgccacttctatacattttttagccttggcttctgggttccatgccctcctgtgccatcaccaaataggctacattccagatttcaaataaataaatggcccacacaactaaaggcatgctcttatcctctgtccgacatactctctaacacaaccagataaagatcaaagtggcatttacaggtctcaaatacatcaaatgcatggatcattaaaacaaaacaaaacaacaacaacaacaacaaaaaactaygtatatgccaaaaaaagttttaaagaaaaattttaaaaaccactccaagagtacatacaatatagtaatagatgttttccatgagtaagaggattgtgcatggtttcctttactgcaatagtctattctttctaaattttctataatttacatacatgacactgttgcttgacatcagaaaaaaaaagatttcagaaatgttcagtagtgaaagcactgaaaaattccaggtctccacaggaaggaaggaaagggactttgctgcagggggctgattttgccccaccttgaggaaggctg

SEQ ID NO: 45651 - DNA, 601 bp, Human
cggtttatatttatctcacaatagcccgatgaggttcattgtattattattaccattttacagaagaggaaattgaggaacaaagagatgagggaacttatctgtcacatggctaaggaactgtcggagcagggtggagtccaaggcaatctgactccagagctcacaagctgccctgcaaacccctccttttaatatttcgccaatttctgaggctcatgagcagagacaaagacattctttcacaagttaaaagtgtttatacatctttcccaggccccacccctacctaaccaccccmaaccccgccgtttcccctccccttccttctctgtgcacacagcagacaaaccttatctgttgtttaaaacatagagttatgcctgtctcattctctcttgtgtaaatgcagcaagattcctgatacaaaggcctgtaatccatagtaaaagtctgataagcgtctcttaggtgaaagagcaaacatattagcattgtgggagaatgtactcattgagtaaaaaatacacagactcaagaagacagggtgaccagcataaaatagcaaatactagccttgctacgctgcctccctagtaat

SEQ ID NO: 45652 - DNA, 601 bp, Human
gctcgacagtcagacaaacacattgaatgatgttgctgccacttgagagagcaggcgagatgtggctcttaactctcagctgtggcttcctcagcaaaatggggttgatattaagtgaggaataataataagaaactgcccacaaagtacttggcaccagcactcaatacaccactacctgagtcctctccaggaaacaaagttggagcctatatcccttacagggaagaactgagattctctgaaaaaaaataaaacgttgccaagaaaagaagctgggaggataggaaagggtctaccragtacttttagggactgtgtctccagagtgatagaaataatgtataattcttttataactctctattagatactgtgtttcccattttattttctagataaaaaaaattgaggtttagcaaaggtccaactggttacatagccaaagcaggagtccaattgaggtttatcacatttcaaaaataattataactaatatttattgaagaattatggctcagcactttatatacataatcatactaaatatataagacactcttatgaataaggaaacacattattcccattttaagctaag

SEQ ID NO: 45653 - DNA, 601 bp, Human
tatcctattgtcttatttacctggaaggagtgctggagagagaaaaaaagaggcaatttttataaatctataaatatgtaattttatagccttttgaaagagtttactatttgcaatgctcaccaaattacatgcccatgatagaaatttctatttcataaaagaatgtgataaaaattgacgatgcagactagaccaacctgtcagggacctcagtgttcacaatggcctcaggacagagcagctgcaaatcatctgtccccggcaatgtgagcacagagaggacacccatcacgctgcrtggaactccccatttaggcagatgaaaacaggcgtgagactcaatgcacaacatgtagattaagttaaaaggttaattttctgactcgtggtctggatagtagagctgtggaggaaaacgagttaccatatgctccgtaaatttcctttcggttaaaaaagatgagggaaagagagagagatatgtccttgattccgtgccattagttccggcagtgaggatgctcactgtcacgcctttcccaggtttgatctgatggaggacgaacgactcagtggttagacacaggctcgacagtca

SEQ ID NO: 45654 - DNA, 601 bp, Human
tttttagtaactttttttgagacagagcctccctctgtcacccaggctggagtgcagtggtgtgatcccggctcactgcaacctccatctctgaggttccagaaattctcctgcttcagccttctgggtagctgagattacagacgtgtgccaccatgcctggctaatattttttgcatttttaagagagacaaggtttcatcatgttggtcaggctggtctcaaactcctgaactcaaatgacagcctcccaaagtgctgggattacaggcatgagccaccgtgcccggccctcagtagratattttttgagcacctggtatgtcctaggtgctgggataaattcaaaccccttttgttaaattgatggaaaaagaggggagtggaaagaaacaaacaaagcaaaacaaatatatatataaaatgccttgtggtgagaaacgttctgaaggagaggaaaaaaatgacatatattccaatggagaaaactgaggcacccaaatcatgctggacttgcagagggcaatgcaaagttcatgaagtagcggagcagaagtcagatgccaagagaaaactccagagcaaagatgtccagccacgt

SEQ ID NO: 45655 - DNA, 601 bp, Human
tattttttagtaactttttttgagacagagcctccctctgtcacccaggctggagtgcagtggtgtgatcccggctcactgcaacctccatctctgaggttccagaaattctcctgcttcagccttctgggtagctgagattacagacgtgtgccaccatgcctggctaatattttttgcatttttaagagagacaaggtttcatcatgttggtcaggctggtctcaaactcctgaactcaaatgacagcctcccaaagtgctgggattacaggcatgagccaccgtgcccggccctcagyagaatattttttgagcacctggtatgtcctaggtgctgggataaattcaaaccccttttgttaaattgatggaaaaagaggggagtggaaagaaacaaacaaagcaaaacaaatatatatataaaatgccttgtggtgagaaacgttctgaaggagaggaaaaaaatgacatatattccaatggagaaaactgaggcacccaaatcatgctggacttgcagagggcaatgcaaagttcatgaagtagcggagcagaagtcagatgccaagagaaaactccagagcaaagatgtccagcca

SEQ ID NO: 45656 - DNA, 601 bp, Human
cctaatttttgacggggtttcaccatgttcgccaggctggtctcgaattggtctcgaattcctgacctcaggtgatccgcctgcgtcggcctcccaaagtgctgggattacaggtgtgagccaccacgcccagccaaaagatttttttaaactgtctgtccttatgcagcatttgaaaaccccagtacttccaatataccttcctcacttacaaaagagaacactggcgatcagttgggtaataagaatagcaagtagttactggggctctctatgtgcactttcattaattcctttgatmcccccaacaacgctaagaagtaggggctatttttaattggctaactaatatatttagtcaataattttttttttttgagacgcagtttccctcttgttgcccaggctggagtgcaatggcacgatctcggctcaccacaacctccgcctcccaagttcaagcaattctcctgcctcagcctcccgagtagctgggattacaagcatgtgccaccacgcccagctaattttgtatttttagtagagatggggtttctccatgttggtcaggctggtcttgaactcccaacctcaggtgatc

SEQ ID NO: 45657 - DNA, 601 bp, Human
cgttgcagtgagccaagattgtgccactgcattccagcctgggtgacagagcaagactccatctcaataaattaaaaacaaacaaacaaaaaaacaaataaacaaaaaacccaaaataggccggaaatacagagcaaaagggaactagcatttactgagcactgcctgggactaggccaggcacttcaaatatgcattctcatttaattctcaccattttcccttgatatagacattgccagttatgcccatacatgtgaggcaccagataaatttgaggcccagtgttacagataatgcyacattcatcgttgaagaacggggaaggtgcatgaagaaacccaagagaaagcagaatttccagccatcagatagggtatcaaggaaaatgaggcttggaaaaagagtcttggattgtcaatatcacacgtttgaattctttgagaactgcacagggaagtgacaaagacgaagttaagctgtaggattggtccagtgcataaaggcacaattaatcaaaacttagctaaaaacacctgttcaatgaccaacctataaatgatatacggtaacagattcttgacacgacaccactcattat

SEQ ID NO: 45658 - DNA, 601 bp, Human
ggagccaggttgagatgagaaaggggcaattaacagtgagaaaacccagttcctttccttcagctcttcagacgaatccaacagaacttcttttcctctgctccagttattaggttggtacaaaagtcattgcgatctttgccattactttcaatggcaaaaaccgcaattacctttgcaacaaccaacctaatgtaaggacatgctacctgggagactctgctcatggatgatattaatgtttctgcctctgccactcaaagtcagccctacaagttactatcccctagcaagggagctmctcagggtttagaaacaaagaacattaaaaaggcctgtacatagtggtagaataaccaaatcagcctttcaaatgcaaggcaaagaagcattctatactcacagcccaaataaacaaaagcagtttacctccaatgcaacctagagtcctagcctcgccctttctctccctctggactgagacctctttatttcctctgtagtttctcggtgtctcttcttttctcttttgcttcctctcccatttcgtttactgaccattatcaaaatttaaaattaacttttaaacacccattttgtg

SEQ ID NO: 45659 - DNA, 601 bp, Human
atatttagatatgaataattttcagaggaaagatagcagtaaaggttggaggggtggggctggtgcaagaagaaataaatcttatcaaaggcagccttgggagctcaggcagataggataagagataagtccctttgcagagttagtcacaccctcccacatacaattcacttggcaaaggttcctttactaacaaagcaggtgcatgttttaaccaaaaaacagtgcagtgcaacagctagggtggctataaatgtagttttaaacactttttttttaaagcaggatataacaaaacatmgtctataggaaatctgaaaatatagggtcttatggccacaaagcaagtccaagttttctcgtcgaactttaaatgatggacagtttctgaaaaggggcatttggaccttaagtcggagacaacagagctgacattcctcccaaagctctgtggagtggaaaacagatggtgattccaaagcaagaatctgaggaaaggagccaggttgagatgagaaaggggcaattaacagtgagaaaacccagttcctttccttcagctcttcagacgaatccaacagaacttcttttcctctgctcc

SEQ ID NO: 45660 - DNA, 601 bp, Human
aaggctgtattaaggttacatttctcctgtcaaaaacacaaccaggaatccgttccctgctatgtagaagtggaggaagtgaatggctgaaatacagtgactgagaagaggccaggctctgtgaaaaggggacctggattccattcctaacatttaacaatttaaggtttctaggggtcagtttcctctaagagtaccagactaaataatttaaaatatctctttttaatcctcaaaaattccaagtctatacggttcccatgatctgatagattcaatgattttttttttttttttttttgagacgcagtcttgctctgtcctgtaggctggagtgcagaggcacgatctcggctcactgcaacctccgcctctcaggttcaagtgattctcttgcctctgcctcccaagtagctgggattagaggcgtccgccgtgacccctggttaatatttgtatttttagtagaaatggggttttaccatgttggtcaggctggtcttgaactcctgacctcaggtgatcggcccgcctcggcccaaagtgctgggatcacaggggtgagccaccatgcccgacctagattcagtgattctcaaat

SEQ ID NO: 45661 - DNA, 601 bp, Human
ttttggcagcctgagcattctctgtcaacagttcaaattcatgggaaaaggcatgaagccaaaagtgcttgcaggtgaattatttgtccctttcaagtgcatcttacttaccctgatgacgtgtaagtgtgtttatctttgttgggagggactatcaggtaggtcagtaaatccttccatgtataaattataaatcacaaatggcatgcaggagaaataccaagtcagaatctgctcatttgtttgtccgtttctcatcccaaatattaaacacaaacgatgggtgaaaaattgatattamtcataataaaaacaagaccatgatgttgacatgctcccaaagtgtttggtcatgagagaagaaaaagtggaacaactgttctttgtaaaacatggatgagctggaagccagaactgacccatttaaagaaagcaagagaaacagatcaggcttattatcaaatacaaaagaacagcatgtcactaacaacctaaatttatctcagatgtacaaaaaaatcttactcatcccaagcagatctctagaccaacattcaaaaatgactataaaaggcatgggaagttgaaaaccttttctagg

SEQ ID NO: 45662 - DNA, 601 bp, Human
ttgtagggcacaaaaggttagtgtttagtccttctcacagcatggcaagtggagctggtcccaacctcggggattttgggaggttctgtgggaagtgttttggcagcctgagcattctctgtcaacagttcaaattcatgggaaaaggcatgaagccaaaagtgcttgcaggtgaattatttgtccctttcaagtgcatcttacttaccctgatgacgtgtaagtgtgtttatctttgttgggagggactatcaggtaggtcagtaaatccttccatgtataaattataaatcacaaatgrcatgcaggagaaataccaagtcagaatctgctcatttgtttgtccgtttctcatcccaaatattaaacacaaacgatgggtgaaaaattgatattactcataataaaaacaagaccatgatgttgacatgctcccaaagtgtttggtcatgagagaagaaaaagtggaacaactgttctttgtaaaacatggatgagctggaagccagaactgacccatttaaagaaagcaagagaaacagatcaggcttattatcaaatacaaaagaacagcatgtcactaacaacctaaatttatctc

SEQ ID NO: 45663 - DNA, 601 bp, Human
ccagcatttaatatcatatgtgtttgactctttcaacattgcttatgtctgaggagcacaaaataaaaattctcaaggagctccctgaagagacctagtctagactaagtgaaatttatggagaatttgcactgtctgtttttggtacagtacagagaagtcccagggatggtagcaaagatgagagccccaaaagcttgggataacagacgatgatcttcctcttaaaagtacaaaagggtgctggcaacaacccaccctttcccacggactcagttatactcctgtaagccgggggagrgggggtttgaaaatctacttaatgcattttgaactcttcagcttgatgggtcattgtcccaagaaatcggtttgaatcggcagccgaaatacacagtgtgacagtggaaggtcctctgcacccagtttgacaaggacgacttggcagtttgtccagccttacaggtgagcctttcataggaccacatccacaaaagggaacagaggagagcagcacatccccagacctgaatcccaaaggaagtggaccattttcttgctttcgtgtgatgcactcttgtagggcacaaaaggttagtgt

SEQ ID NO: 45664 - DNA, 601 bp, Human
tgccagcatttaatatcatatgtgtttgactctttcaacattgcttatgtctgaggagcacaaaataaaaattctcaaggagctccctgaagagacctagtctagactaagtgaaatttatggagaatttgcactgtctgtttttggtacagtacagagaagtcccagggatggtagcaaagatgagagccccaaaagcttgggataacagacgatgatcttcctcttaaaagtacaaaagggtgctggcaacaacccaccctttcccacggactcagttatactcctgtaagccgggggagggggggtttgaaaatctacttaatgcattttgaactcttcagcttgatgggtcattgtcccaagaaatcggtttgaatcggcagccgaaatacacagtgtgacagtggaaggtcctctgcacccagtttgacaaggacgacttggcagtttgtccagccttacaggtgagcctttcataggaccacatccacaaaagggaacagaggagagcagcacatccccagacctgaatcccaaaggaagtggaccattttcttgctttcgtgtgatgcactcttgtagggcacaaaaggttagt

SEQ ID NO: 45665 - DNA, 601 bp, Human
aaagtgttttatatttaacagatacgatcaggttaaacatctatttttggtattgcatgtagtggactaatgattttacacaactttctgccagcatttaatatcatatgtgtttgactctttcaacattgcttatgtctgaggagcacaaaataaaaattctcaaggagctccctgaagagacctagtctagactaagtgaaatttatggagaatttgcactgtctgtttttggtacagtacagagaagtcccagggatggtagcaaagatgagagccccaaaagcttgggataacagamgatgatcttcctcttaaaagtacaaaagggtgctggcaacaacccaccctttcccacggactcagttatactcctgtaagccgggggagggggggtttgaaaatctacttaatgcattttgaactcttcagcttgatgggtcattgtcccaagaaatcggtttgaatcggcagccgaaatacacagtgtgacagtggaaggtcctctgcacccagtttgacaaggacgacttggcagtttgtccagccttacaggtgagcctttcataggaccacatccacaaaagggaacagaggagag

SEQ ID NO: 45666 - DNA, 601 bp, Human
aggaagcagaccactgcttcctctcacattttaaggagtgatctctggcagaggtgctttgagactttcctggggacctcacccatgcacctaacccaggctgtctgcttgcagaggtaatggaatagaaaaaccacccgaaagaaaaggtgccccctgagtatcacctggagaaaaagagtttaaccaggaagctggcttcacccagaagaagctaaaataatagtgactgctagcctggaacaaaacactgaggtgggtactgtgggtatcacccaaactaatttagacaagaatcctmttttgagggagagcacagtccaataggagacataagtgattctgtcattaactttatgcatatcttacacttgctcagctcctccatttatttaaaagtaaaggcactacagaggcctgggaacgaatgaaatatgttctgaagccagggccagaccaagagaaacacatgttaaataattatttgattaactccggcagcagcattgctagtcattgtcatccaaacgactttacagcctgagttgtcaggaatcatgatttatgcagctgaaatgactgcagtaataagtgctcagtg

SEQ ID NO: 45667 - DNA, 601 bp, Human
gtgctgccatataaactatcaatcctcaccaccgctagcacatcgcagccatgaaatgcaaatcaggagacactaacacctaacttgattgcccaggacatttcacagaggatcaagctttttgatgagttgctattgttttcttcaccctttgatatttggggtacataaagatgagtggctcattatacatcccctgattacagataacaggtcagggcactgaataaaggaagcagctgttcttttcttcttcctctcctcacactagcccgtctgaatttaatacacgggtctatgyagattagcgtcattatgtagaaatttcatcccttattaggtatgtgcatttattcattcattgggccatttatgttttagcaaacatttattaagcctttacataataacagtaatggcaataatgagagcaactatttattgagcacatactaagagctaaaaggctgggaatatgaggctgttcccttcaggaaggaagcagaccactgcttcctctcacattttaaggagtgatctctggcagaggtgctttgagactttcctggggacctcacccatgcacctaacccaggctgtc

SEQ ID NO: 45668 - DNA, 601 bp, Human
aggttaaaatatttaggacagagatgtttcacagacaacaacagcaagaatgtaagtaaagaatgacaaaagcaaaaaataaactacaaacaaatcaaaggtgattttctgtctgacattcatattcactgtctggtggtctctttttgccctgcagaataattgatagcaagggcagtgggagacataacgggaaaggcctgaacttggtttttagctctgccccttattagatgtgtgaacttgaacaaactatgtaactactctgaacttcaattttttcatctgtagggctgaaatsatgatgaaatgagataatacacaggaggataaaagacagtgtgttctgtgtataagctactcactaagagtaactcattattcctatagcacagtgcatggctgcaagaggggaagatggaaatgaccaatggattttcataaaacttcaagttttttgttttgttttaaaataagattggatataatttctaaaacactatgggataacttcttcattattgtttttatttcttctgttattaacatggggtagaaaacccaagattgaagtctaactcatagcatctgcagtttagta

SEQ ID NO: 45669 - DNA, 601 bp, Human
gttaattcttacttattttatttcaagtatttgtttatttgatactcttctgttttctggatagtaaaatcagaatagtacaacctgattgttgttaaaaattactaaagaattaaggctgggcccagtggctcacacctgtaatcccagcactttgggaggcctaggtggactgattaccttaggtcaggagtttgagaccagcctgaccaacatggagaaaacctgtctttactaaaaatacaaaattagccaggcgtggtggcccctgcctgtaatcccagctattcaggaggctgasgtaggagaatcacttgaacccgggaggcggaggttgcagtgagccgagatcgtgccattgcactccagcctgggcaacaagagcaaaactctgcctcaaaaaaccacaacaacaacaattactaaaaacttaaacttagttatttcgagatttttttgtgcactctgaggagactaaactccaaaacatgattgcatcaccagaaattcaagtttatttcattcatacaaagttctactttctctagtaaacctctgagaattcagaaaagatgtactgagttgcttggctctgacctaa

SEQ ID NO: 45670 - DNA, 601 bp, Human
aaggcagccacactttgccctctgtgacccactttccagttcaaggtccctcagagctacactgtccattaaaataactgctcaccccatgtggttactgagcacttgagatgtggccggtcaatgaatactggctgtgagtataaaatatacaccagataccaaacacttagtatcccaaaagtaaaacatcactaataatttgtatatggattacatgttgaaagcaataatgttttgaatgtatacttaaattattaaatttaatttcacctttaaaatttatttatttatttatttwtttgagacaagagttttgctcttgttgctcaggttggagtgcaatggtgtggcctcagctcactgcaacctccgccttctgggttcaagcgattcccctgcctcaacctcctgagtagctgggattacaggcgcctgccactacgcccggctaatttttatatttttagtagagatggagtttcaccatgttagtcaggctggttttgaactcctgacctcgtgatccgcccgcctcggcctcccaaagtgccaggattacaggaatgagccatcacacctgggctaaaatttatttttc

SEQ ID NO: 45671 - DNA, 601 bp, Human
ctgtttatgactataaaatggggagtatgtggggaaaaaaaagaggaagctaaaacagcatttttttaaaaagaattcagtgagatgatacctgatctttatgaaatatcatgaggctcttaaaattttgcaaacaaccaaatggcaaatgatcagtctggggtctatctagtgccttcgttgaagctcacctggtgatctttctccctctatctttaattttcttcaaacaaaaaccatccacttggttgtctagaggtactttttccttttagtagctaaaatgctgaaaggcaatcckaaaggaagaaacaaaaatgtggtatactcactagctaacatcagatgttgaactactaagctctaactgaagcagcagcatacgttgacggctgcatctgaatcgtccaaatgtctttggttgctttgatcagtttgtacagtccatgggacagacacattagctggcttaccaactaacaggcagcaggaccatatgttctgaactaaaaaccaactatgtaatctggcagtggaggagttggtgtctcaatctgagtttttgtcctatgacaaatggaatgcagtatgaaactatact

SEQ ID NO: 45672 - DNA, 601 bp, Human
aaatggcattggcagattattcaagccttccacttgggcatatattagtgtccctcgaatctttgcattttccagtggaatccataatgggctgtttatgactataaaatggggagtatgtggggaaaaaaaagaggaagctaaaacagcatttttttaaaaagaattcagtgagatgatacctgatctttatgaaatatcatgaggctcttaaaattttgcaaacaaccaaatggcaaatgatcagtctggggtctatctagtgccttcgttgaagctcacctggtgatctttctccctytatctttaattttcttcaaacaaaaaccatccacttggttgtctagaggtactttttccttttagtagctaaaatgctgaaaggcaatcctaaaggaagaaacaaaaatgtggtatactcactagctaacatcagatgttgaactactaagctctaactgaagcagcagcatacgttgacggctgcatctgaatcgtccaaatgtctttggttgctttgatcagtttgtacagtccatgggacagacacattagctggcttaccaactaacaggcagcaggaccatatgttctgaactaa

SEQ ID NO: 45673 - DNA, 601 bp, Human
gggaaatggagcatcccccaagagcatgggcagaaaggtaactctcccatgatcgatgtatttaagcactgctgtcacctcactaaaatgctaaggcaaccagtccaacacatatcttggaggaagcagcaccttgggtctgtagttccatttcctaaggcttcattaatcatgtacaacttttggactgtcaatagcacttcagcgtcttagctgtaaaacccttcaacccttcagataagcctttgttgttaatctctctccagctgaaagacaggttataaggaagagtcaacagttsggatgcattacgttttgactctgaaataaagcccatgcttcccctgacatttgtatatgttgccaccactaattgctttctcccagtcctatctgctgtgggttagtttacataaagatggctgttttaaagacatccctcctgacatatatgaacagtgcataacctcttatcatggtggtttatgtgtttttacaacaaagacagccaagcagggctgtccatgattaaaccagaaccttttggatgcatcaatcacttgctgctgtcatgaaaaattcttggcttcctatagaggtt

SEQ ID NO: 45674 - DNA, 601 bp, Human
cttaataatgtcatttaaaagccgtcagccaacactaaacctaaagtcagaaatgtctccagtgtgtctataagtttggtataaaccattccatggaaagtccaggtaccctatgtactctacctcacacccaaagtcagagaaaatgcatttctttattcttacaggaagcaactgaaacttcagtaaaagatgaaaacctgctatgataattgcgttttgaaatgggtttggcagaaatgggttctgccaaagggcttaaatatatgtggatatacggtgtaacgtgccatataaaccyaaaagttctatttctcgtaacgactggaattaaagtgccaacagaatgcaaaactgtggaaaaaagtaagtcaactttaaaactcacattgttagcaaaattttgcacatgcaactcaaaataccttggagctggtagttctgcttggaattctcactcctggccctttgactgactgacttcttatccctggaatagttctcattcctgactactccatacaaactgaaatcctccctttccctgtcccaatgcacccaattgcatcacatttttaaaaatttccttcttaggagaacc

SEQ ID NO: 45675 - DNA, 601 bp, Human
aaataagactatagatcatgatgaaactcttgtttcttgatgtagatttgtgtgtgtgtgtgtgtgtgtgtgtgtgtgtgtgtgatggagtctcgctctgtcacccaggctggagtgcagtggtgtgatctcagctcactgcaactttcacctcccaggttcaagcgattatcatgcctcagcctcccaagtagctgaaaatacaggtgtgtgccaccacacctgctatctttggcggagtttggccatgttggccaggccggtcttgaactcctgatttcaagtgatcggcctaccttgscctcccaaagtgctgggattacaggtgtgagccaccatgcccggccatgattggtcttaatagggcaaaaaaattgtgacacaaactgctttcaagtggaagaatcaggctgggagaagggagagggaattttcttggtctgaaccagttccaaaggcttaaaaggtagctgccacactcaaacgagacatagctactcagtttgacagttggaaagctatttctttcccatttcagtcttccaagagatgagcaaaatgagttttaagaaaaatttgaggtttctagatcactgttatc

SEQ ID NO: 45676 - DNA, 601 bp, Human
gtgttcccaggatctgtatgtaatatttccattgcattcttccaaaagagaactaataaactgttggcaatcacagagtactcatgtttctatcaaaaactcctaaatcatactagtctttgtagaaaaataaaactaatgactgcgaacagtgttcacaacctaaaaattcagaattaaaagacaaaggcctagctggatgacccgttcacattagatattttaaaagactgttcacatttgcagagctgaagatacattccggtaagacttgccattctagcccctgctcaaaaccttscccaagtcttaactttttatttattccaaagagttcagggcaaaatggaaaaataatggctttggattgggacactggaatagttttcacttataggatcaattagtacagatattttactaaactattgagtgcacttactgaaacattcatttaaaagaaaagtgcagttagaggcgataggattgttggcaatttataatccttttctggctatgttttctatcccaagagcctcacaaagaataagccactctaactctgtttcccttctcctctctaactctccagaaataaaaa

SEQ ID NO: 45677 - DNA, 601 bp, Human
atcagctcctaattcagagagaccagcagcaccgatgcgtgttcccaggatctgtatgtaatatttccattgcattcttccaaaagagaactaataaactgttggcaatcacagagtactcatgtttctatcaaaaactcctaaatcatactagtctttgtagaaaaataaaactaatgactgcgaacagtgttcacaacctaaaaattcagaattaaaagacaaaggcctagctggatgacccgttcacattagatattttaaaagactgttcacatttgcagagctgaagatacattcgggtaagacttgccattctagcccctgctcaaaaccttccccaagtcttaactttttatttattccaaagagttcagggcaaaatggaaaaataatggctttggattgggacactggaatagttttcacttataggatcaattagtacagatattttactaaactattgagtgcacttactgaaacattcatttaaaagaaaagtgcagttagaggcgataggattgttggcaatttataatccttttctggctatgttttctatcccaagagcctcacaaagaataagccactctaactc

SEQ ID NO: 45678 - DNA, 601 bp, Human
tggaccttttgccccagtaggtgttgacataacttcttggctcaaatccctacgtgtacagggggtcatagaagtctcccccaaaatctgtgggagccaagcctgtcctcagcgcatctcccacaggcttttctctgccaaggagaatgacttcaccttttacagatgaggctccaaaagtccatccctacttataattcggttaagaaaatgatgtagtgcttgcgaatgaatagccaaaaaggtagaagggggctgcatgtaagaatactgattggatcatcaaccagattctccagayggtgcagaaatcgttctgcattgcatcagctcctaattcagagagaccagcagcaccgatgcgtgttcccaggatctgtatgtaatatttccattgcattcttccaaaagagaactaataaactgttggcaatcacagagtactcatgtttctatcaaaaactcctaaatcatactagtctttgtagaaaaataaaactaatgactgcgaacagtgttcacaacctaaaaattcagaattaaaagacaaaggcctagctggatgacccgttcacattagatattttaaaagactgttcac

SEQ ID NO: 45679 - DNA, 601 bp, Human
cattataatgaggtgtaatgccactttattttattattattattattattattattttgcagttaatgcttaattgtccaaccctagagaacaaggtcagcctaacaagcagcgcccgttcatctgatggcaaaacagctacaacaggattcatgaggggccttgaaaggccctttacaactgcctgttctctgagaacagtaacgggagcatcatgctttcagcatggggcaatggagccagagaaatgtggaatcttccctatgtgttcagccacaggccagctcaagcaaaggccacwtggctatggaaccctgaaatggtgggcactgctatgaagtctgttcttaaaaactattgctggaacagagtttttcagccttagccctatggacattttggaccagaaaattcttcattgcggaggattggggatgctgtgttgtgaattataagatgtttatcagcctgcctggcttctacccactagatgcaactgcaccaaaaattgcctctaaacattgcccattaggggtaggagcagaaatcacccccaatttagaacaactgttcactatcttactgttttccccccgcaacg

SEQ ID NO: 45680 - DNA, 601 bp, Human
cccactcaaataacataatatgtctaattaaaagatggcagagagagaaagaatgggaacttaccagttgaataataaaagacagtgtgcctcttacacttagttatttcttttctttattcattattttggttttattaaatttatcattacttgacaaagagagttaactgatttgattttactgtaaataaatgttaatcaacaaacagatggaactgtacaatgactacatgtggcacagtggcattataatgaggtgtaatgccactttattttattattattattattattatttttttgcagttaatgcttaattgtccaaccctagagaacaaggtcagcctaacaagcagcgcccgttcatctgatggcaaaacagctacaacaggattcatgaggggccttgaaaggccctttacaactgcctgttctctgagaacagtaacgggagcatcatgctttcagcatggggcaatggagccagagaaatgtggaatcttccctatgtgttcagccacaggccagctcaagcaaaggccacttggctatggaaccctgaaatggtgggcactgctatgaagtctgttcttaaaaa

SEQ ID NO: 45681 - DNA, 601 bp, Human
ctgcccatttctcatctcagccaggcacttattttttaaatctcttgatggcttctccagagggtgtaaaagttggtggttagtgttcgatggaacaagcacaacactgagagatgagaaacaaaccagaattaggctgtcaagtgattactggtgaatgaatttctcttcttacaaatgaacatgcatatatctttctgtaggagcaaaaggaaaggactcaggaaaaatagtgttctcagtcctgggtgtataaataaagacttcattttcttagagtggaatattcacatcttttttwaaaaaatgcaatctaacttttgcttatatgcaataattaccactatgttctatagacatactatttgtctgtgctattcagtcaaccttgaaaagttggataatttagtaggctcttttggcaggcttttatttttttttctcctcaccaggacttgtggcacccaccccgaatacaaattcacagacactggtgccacacacaagaggctgcgccattgtatatctgctggtttattttatttttaattacgatcataattagtgagtatgcttattaattatagtggtagcaacagta

SEQ ID NO: 45682 - DNA, 601 bp, Human
taggattgggattagattcattgggtttcaacatgagcctcatcaataattttcagataaaataaaagtctttggttatcttatttctttatctttagataaaaagaagtctttaattacacttgagagtatagagaacacttgatcaagctttctgctggttacatattaaaaatccctggcttgtttatatgtgtggtcctagctttgaaaaagaaacatgaacgaaactgtgctcctatttaacttcaggtttatgctcaaaatacgcacttattttacaaaaaaaaaaaaaaaaaaattagggttgattcaagaggcagatttccagcttgcagtatgttatctagaaaaacacaaattctccagggagccgttgtaagctacccccttttcagtgtttgtgctaatggatggatcttacccaagcttggaacacactgtgagtctattggtggcaggtcactatttagcacccactgagaagttgaagctacatatttaagtcttgtttgtatgcacatgtcacagacaaaaggttcctagacaagaatttttaaaaaacttatctgtcccacagcctttattaaaaggatttttt

SEQ ID NO: 45683 - DNA, 601 bp, Human
atagtttaaatttctataggcattataagaatggggcagaaacaactgagctattaaattttaaaatgttattaaggtcagtagatatcttcaactggatctgtgtttgagaattgagaattgagatgacttttgtagtcataagaaataataaagaatgtattacgaaagctattactgttttaggacttgttttttgtttttgtttttattttttttaaaaaaggaagaaagaaagaaaaccagggggttcacagcatgtcacaggggcctctctcatgaactcaatttgctgaagtgwgaaattcagcataactggctccacccaaagaagtcagtatttagtccattcctaaatactggaggagtttattagaattgcatcttacctagaaatagttccacagcatgatatctaagaaagacactggaggaaagctcctgcacactatggaggaagttattggaagttaatggaaattatttttgtgttttctgaaataggtagaggaaaaagaagtggagggaaagagaaaatgctaccctccaacaaacacgtacagttaaggtgaatccttgaagagtttacagtgagatagaa

SEQ ID NO: 45684 - DNA, 601 bp, Human
gaaatctgtaaccctagaattgtatttttattttattttttatttttagagtatcagctagaaactaagttctatgtgctagatagtttaaatttctataggcattataagaatggggcagaaacaactgagctattaaattttaaaatgttattaaggtcagtagatatcttcaactggatctgtgtttgagaattgagaattgagatgacttttgtagtcataagaaataataaagaatgtattacgaaagctattactgttttaggacttgttttttgtttttgtttttatttttttwaaaaaaggaagaaagaaagaaaaccagggggttcacagcatgtcacaggggcctctctcatgaactcaatttgctgaagtgagaaattcagcataactggctccacccaaagaagtcagtatttagtccattcctaaatactggaggagtttattagaattgcatcttacctagaaatagttccacagcatgatatctaagaaagacactggaggaaagctcctgcacactatggaggaagttattggaagttaatggaaattatttttgtgttttctgaaataggtagaggaaaaagaa

SEQ ID NO: 45685 - DNA, 601 bp, Human
agaagaggttttaagcttggaaatctgtaaccctagaattgtatttttattttattttttatttttagagtatcagctagaaactaagttctatgtgctagatagtttaaatttctataggcattataagaatggggcagaaacaactgagctattaaattttaaaatgttattaaggtcagtagatatcttcaactggatctgtgtttgagaattgagaattgagatgacttttgtagtcataagaaataataaagaatgtattacgaaagctattactgttttaggacttgttttttgkttttgtttttattttttttaaaaaaggaagaaagaaagaaaaccagggggttcacagcatgtcacaggggcctctctcatgaactcaatttgctgaagtgagaaattcagcataactggctccacccaaagaagtcagtatttagtccattcctaaatactggaggagtttattagaattgcatcttacctagaaatagttccacagcatgatatctaagaaagacactggaggaaagctcctgcacactatggaggaagttattggaagttaatggaaattatttttgtgttttctgaa

SEQ ID NO: 45686 - DNA, 601 bp, Human
aaagtaataattttcatagccaatatctaatcactataatacacaatgaagagaaaagcaccaacacgagaggctcatatgacctcagaggaaaccaacattagctattctgagttattagaaatccttttaaattagatttctattttttatttctcaagctaacagaacccatgagacaagtacaatatttgcaaggtgccagctcaaggggctgaattccttggctttcaatggagcctgaatatattataaattactccgtcttcatcactatctcagtgatggtccactgtcttcyaagttgaaagagttgggagtcaataaacgtcacttatgatatgagcacctgtcgactaagacctggactgagaccaattccattaacatagtcattctacggctgccaaatggccgggccttggaccacttatgatatagtccccattcaaggaggtgacctaaagacagaaaggtccagaatcccattagtcatcttccaagccatccaattctccatcagatatactgttggaatgggatacctagttttttaatcgtcatttaaaaagatcacgtgagctgctccaaaacatgtcat

SEQ ID NO: 45687 - DNA, 601 bp, Human
ctcagtgttacattttcatcaatttccatttcacaagggcatgaagatagccttatttaactctgtcaaagagtatcatttacagcttttgttataaacaagtgactaggtaatcaacctccaaacacacaaacaaatgaaaagtaataattttcatagccaatatctaatcactataatacacaatgaagagaaaagcaccaacacgagaggctcatatgacctcagaggaaaccaacattagctattctgagttattagaaatccttttaaattagatttctattttttatttctcaarctaacagaacccatgagacaagtacaatatttgcaaggtgccagctcaaggggctgaattccttggctttcaatggagcctgaatatattataaattactccgtcttcatcactatctcagtgatggtccactgtcttctaagttgaaagagttgggagtcaataaacgtcacttatgatatgagcacctgtcgactaagacctggactgagaccaattccattaacatagtcattctacggctgccaaatggccgggccttggaccacttatgatatagtccccattcaaggaggtgac

SEQ ID NO: 45688 - DNA, 601 bp, Human
aatattacataacatctcatcggtgtgttccctaaaatcatctctgatgccaccattggtatgtttccacactttggtaaacaatgcctaacccaaatgtcttgaatcctgatttgcaatattccagggctctgccttttgcttacagaattagaagaggagataatagaatttttttaaaaagattgtacatcccacccttaaatatatggttcaataagagctctgaccaatcaatgcctaagttcaagagagtttctaatcatagtagaaaatttggtcagcataaaaagaccaagtrgaaaaaaagattctcagtggctgctcagttctttgatttacattctgaaatctcatagagacaaggttcttcctcaacatcaactcggccactagacacatacttaatgagcacctatggaacaaggccgagagggggaatgggtaagcatggccagatagaaaataattgttggtatcagactaagtaccaccaaatactttagcctcttcttaactaaaagaactattgggaaatttttatagtagtcttaaagaaaaaacactttctaatgtcaagtcagagggcccatttttctag

SEQ ID NO: 45689 - DNA, 601 bp, Human
gaattactgagaaagaattgaaaatgaactatactgtacacagggcaattcaatattacataacatctcatcggtgtgttccctaaaatcatctctgatgccaccattggtatgtttccacactttggtaaacaatgcctaacccaaatgtcttgaatcctgatttgcaatattccagggctctgccttttgcttacagaattagaagaggagataatagaatttttttaaaaagattgtacatcccacccttaaatatatggttcaataagagctctgaccaatcaatgcctaagttcaagagagtttctaatcatagtagaaaatttggtcagcataaaaagaccaagtagaaaaaaagattctcagtggctgctcagttctttgatttacattctgaaatctcatagagacaaggttcttcctcaacatcaactcggccactagacacatacttaatgagcacctatggaacaaggccgagagggggaatgggtaagcatggccagatagaaaataattgttggtatcagactaagtaccaccaaatactttagcctcttcttaactaaaagaactattgggaaatttttatagtagt

SEQ ID NO: 45690 - DNA, 601 bp, Human
acatcatggcaagataaaattggggaaggtggcaaaataaatctcctgcttacttactaggtgcaatattaaaggagtcaagccagtcaactcagaaactgaaagtaaatggagatgaataaactctctggagcctgtattctcttggatgttataagtactattgttacttcttacttgttgaaagaaatgcaaattcaggtatgattgttattgacgctgaccatatccagatctttcctcctactctttttttttgaaaggaacattaaatgatggttggtggcttttctagttccayacccagcaatttaaaagaaataactgtgagaaggtcccttatctttttctattttctgtctagaaaatgtaaaatgtgttgtaacatggtttcaatgggaaaatcctgtcccttttctacttttaataaggaagccaataagtgattatctttaaaaagaaaaagaagacaactgttcattttctagacaaccttgaatgcaaatagctctcttcaaaattctgtcctgtaagagagacaagttatttgtaaaaataatgcctttctataactttaagaggctgaagaatgtgattttcc

SEQ ID NO: 45691 - DNA, 601 bp, Human
gggccatcttgattggctttcaaaatcaaataccagggaaggaaagaacagtgggaattcaaaatctatgcaggtcaaccttaagtttccaaaggttgagatattctgctgtttagaatatagagggcatgccaatgtctatatgtttttgtatgtgtgtgtattaaagaaacagaaatgagaatttattgtggatttaacatctcaagatttgactcatcactctaatcaaacatacctattcatagattgtgcatgaaaagcaatgaacacggtgtaaaacagatgcctgtacagaacrtgtttttctatactgtgttatgttagagtgaacataattggtccctgtataccaggacactttagagagtgaggatgggagcatgatattaagaaatacatggccggacatggtggctcatgcctgtaatcccagcactttgggaggccgaggcaggcggatcacttgaggtcaggagtttgagaccagcctggccaacatggtgaaaccgtgtctctactaaaaatacaaaaattagctgccaggtgtggtggcgtgtgcctgtaatcccagctactcaggagggtgagacaggagaat

SEQ ID NO: 45692 - DNA, 601 bp, Human
taaaatcaaaaaagcacatataattcctatacactcccccacatgctccttgcttcccaccatcagatggatattacagttcccggtggttatatgcacagcatgcgtacatatacaaaactaaatggcaatgtacaagaaagagggccatcttgattggctttcaaaatcaaataccagggaaggaaagaacagtgggaattcaaaatctatgcaggtcaaccttaagtttccaaaggttgagatattctgctgtttagaatatagagggcatgccaatgtctatatgtttttgtatgtstgtgtattaaagaaacagaaatgagaatttattgtggatttaacatctcaagatttgactcatcactctaatcaaacatacctattcatagattgtgcatgaaaagcaatgaacacggtgtaaaacagatgcctgtacagaacgtgtttttctatactgtgttatgttagagtgaacataattggtccctgtataccaggacactttagagagtgaggatgggagcatgatattaagaaatacatggccggacatggtggctcatgcctgtaatcccagcactttgggaggccgaggcag

SEQ ID NO: 45693 - DNA, 601 bp, Human
attataaaatcaaaaaagcacatataattcctatacactcccccacatgctccttgcttcccaccatcagatggatattacagttcccggtggttatatgcacagcatgcgtacatatacaaaactaaatggcaatgtacaagaaagagggccatcttgattggctttcaaaatcaaataccagggaaggaaagaacagtgggaattcaaaatctatgcaggtcaaccttaagtttccaaaggttgagatattctgctgtttagaatatagagggcatgccaatgtctatatgtttttgtrtgtgtgtgtattaaagaaacagaaatgagaatttattgtggatttaacatctcaagatttgactcatcactctaatcaaacatacctattcatagattgtgcatgaaaagcaatgaacacggtgtaaaacagatgcctgtacagaacgtgtttttctatactgtgttatgttagagtgaacataattggtccctgtataccaggacactttagagagtgaggatgggagcatgatattaagaaatacatggccggacatggtggctcatgcctgtaatcccagcactttgggaggccgag

SEQ ID NO: 45694 - DNA, 601 bp, Human
ctgagtgtgcatgagccgctgcaagcctgtcagctacctggctccgggcggcctttcccatgacagctttacggccgacactaaagaagaatcaatatgagggcaaggggttgacatttcattttctaaaaagtgatccattgaggaccaatcaccaagcactgtttatcagccttgggaagtgacattttttttttaatgggggagaagggacaggaatcatcgctaggtaactcgacaggctcaattctctaaggtggggactcataattggaaatccgatgcatcctgctatcaatcytgccttatataataaagtgatcaataaaagcagagaggaaattaagtcatcaagcttaaggatgctattttccgtagtcacggcttttaataaacttgtctccccgcattacattttcatgtgtttttcctttcttttcatcaaagccaatgttttaagcagaacatccaaaggaaacttacaatgaggtaacttatttctcattactccagtttgactgctgtatttagggccacttataccaaaaaacaaaaaagcaaagtaaatctaaagcaaagctggactacaactagagaatgt

SEQ ID NO: 45695 - DNA, 601 bp, Human
catccccactacctgtctcctctctgttcacctgttcttgtcccatttaaacatttatagtccaagataacagagcagacaacctgcgtgaggagaagaattggctgagtgtgcatgagccgctgcaagcctgtcagctacctggctccgggcggcctttcccatgacagctttacggccgacactaaagaagaatcaatatgagggcaaggggttgacatttcattttctaaaaagtgatccattgaggaccaatcaccaagcactgtttatcagccttgggaagtgacattttttttttaatgggggagaagggacaggaatcatcgctaggtaactcgacaggctcaattctctaaggtggggactcataattggaaatccgatgcatcctgctatcaatcctgccttatataataaagtgatcaataaaagcagagaggaaattaagtcatcaagcttaaggatgctattttccgtagtcacggcttttaataaacttgtctccccgcattacattttcatgtgtttttcctttcttttcatcaaagccaatgttttaagcagaacatccaaaggaaacttacaatgaggtaactta

SEQ ID NO: 45696 - DNA, 601 bp, Human
tatttcgccagtaccatgtaccacctttcatttgtcctctcacgaaaagcctgggccagccaggctttcatccccactacctgtctcctctctgttcacctgttcttgtcccatttaaacatttatagtccaagataacagagcagacaacctgcgtgaggagaagaattggctgagtgtgcatgagccgctgcaagcctgtcagctacctggctccgggcggcctttcccatgacagctttacggccgacactaaagaagaatcaatatgagggcaaggggttgacatttcattttctamaaagtgatccattgaggaccaatcaccaagcactgtttatcagccttgggaagtgacattttttttttaatgggggagaagggacaggaatcatcgctaggtaactcgacaggctcaattctctaaggtggggactcataattggaaatccgatgcatcctgctatcaatcctgccttatataataaagtgatcaataaaagcagagaggaaattaagtcatcaagcttaaggatgctattttccgtagtcacggcttttaataaacttgtctccccgcattacattttcatgtgttttt

SEQ ID NO: 45697 - DNA, 601 bp, Human
gaaggactgaaactttctcactacgtgagtttctgtccattgacttccttaggaatcttgcatgccatcagcagagtgggagtcagttcaaggggacccccataagggatctatctgtagcatccattccagcataaacattcagtgattctaagaagcacaaagcagccccatcgtcaaaggacatgactcagatttcataggctagggtgtttaatctgttgctttctcatactactggctgaagtctggcaagattatttcgccagtaccatgtaccacctttcatttgtcctctcaygaaaagcctgggccagccaggctttcatccccactacctgtctcctctctgttcacctgttcttgtcccatttaaacatttatagtccaagataacagagcagacaacctgcgtgaggagaagaattggctgagtgtgcatgagccgctgcaagcctgtcagctacctggctccgggcggcctttcccatgacagctttacggccgacactaaagaagaatcaatatgagggcaaggggttgacatttcattttctaaaaagtgatccattgaggaccaatcaccaagcactgtttatca

SEQ ID NO: 45698 - DNA, 601 bp, Human
gctcaggcttctccctataagctgcatgtgtacaatgaaataaatgaaacaattgctataaaaaaaatctagcaagataccaactgtgagcctgaggctgcttcctctttcttaaatgacaaattagcaccaagacaattttctctctgaggtcatcagaaggactgaaactttctcactacgtgagtttctgtccattgacttccttaggaatcttgcatgccatcagcagagtgggagtcagttcaaggggacccccataagggatctatctgtagcatccattccagcataaacattyagtgattctaagaagcacaaagcagccccatcgtcaaaggacatgactcagatttcataggctagggtgtttaatctgttgctttctcatactactggctgaagtctggcaagattatttcgccagtaccatgtaccacctttcatttgtcctctcacgaaaagcctgggccagccaggctttcatccccactacctgtctcctctctgttcacctgttcttgtcccatttaaacatttatagtccaagataacagagcagacaacctgcgtgaggagaagaattggctgagtgtgcatg

SEQ ID NO: 45699 - DNA, 601 bp, Human
tggtttgaaataaaatttatagggacagcatcatataggtacaagaagtgttctgccttaaactaacctagataacaagtacaattatgtgctctggaaagctgaaagaattctgaaattatatcttgagtgatgagaaagacacagatcaaagatgcctacagaaaatataaaattaagttgcttaacataaatgtgggtggtaaaaatatacaatatagctaaatcaatgtgcctagtataacatctcattttaggtattttataaatttagtagtttgattctttcaccgcgatccckaaatgcttacatgttccatttggccaaaagaaaaaagtagatctcgctgaaaaaagtgtagattattctggcttgccttaggctcaggcttctccctataagctgcatgtgtacaatgaaataaatgaaacaattgctataaaaaaaatctagcaagataccaactgtgagcctgaggctgcttcctctttcttaaatgacaaattagcaccaagacaattttctctctgaggtcatcagaaggactgaaactttctcactacgtgagtttctgtccattgacttccttaggaatcttgc

SEQ ID NO: 45700 - DNA, 601 bp, Human
gttgtggagatcacaaatatataaatatatacatgtggaaatgttgatttgctggagagaatgtacaaatagagatttgtttgtggtttgaaataaaatttatagggacagcatcatataggtacaagaagtgttctgccttaaactaacctagataacaagtacaattatgtgctctggaaagctgaaagaattctgaaattatatcttgagtgatgagaaagacacagatcaaagatgcctacagaaaatataaaattaagttgcttaacataaatgtgggtggtaaaaatatacaatwtagctaaatcaatgtgcctagtataacatctcattttaggtattttataaatttagtagtttgattctttcaccgcgatccctaaatgcttacatgttccatttggccaaaagaaaaaagtagatctcgctgaaaaaagtgtagattattctggcttgccttaggctcaggcttctccctataagctgcatgtgtacaatgaaataaatgaaacaattgctataaaaaaaatctagcaagataccaactgtgagcctgaggctgcttcctctttcttaaatgacaaattagcaccaagac

SEQ ID NO: 45701 - DNA, 601 bp, Human
gtgtggtagctcacgcctgtaatcccagcactctgggaggccgaggtgggcagttcacttgaggtcaggggtttgagaccagcctggccaacatggtgaaaccctgtctctactacacatacaaaaattagctgggtgtggtagtacatgcctgtaatcccagctacttgtgaggctgaggcatgagaatcacttgaacccatgaggcggaggtctcagtgagctgagactgagttattgcatgccagcctgggcaacagagtgagactctgtctcaatcaatcaatcaatacggtaataytgttttggaaaaaacactgccctaaaataatctgaattaatactagtttgtgatgcttttggagataacctgatgaaatcattactataaaagggaagagggtgtcagagaaaattagcatagattcagtcattagtcttggaggttatgaccttataattgtattttaggatgtcactgtgaacagtccttttaaagatcactttaaaaaaacaatatagaaaagtggttatgttgtggagatcacaaatatataaatatatacatgtggaaatgttgatttgctggagagaatgtaca

SEQ ID NO: 45702 - DNA, 601 bp, Human
aatgacagaaggaaaactttgttgaaggttttctaattacagagatgtggacaagctgattaaaactgggaaggagtggagtgttttgttagtgaatgctccagaaggaaacatggaccctttcagccgcaggagttggagaaaagagcccacattgcaggtgaaactttgaaagagtgtgaactaagccctcctgcagtccaagggacatggtaataagggtattagcagacattgttgcagaacagcgtgagccctctcaaccaacgtgctgttcctggcaccttgactattcaatatracaaacaaaatagagagggggagcaaggcaggggcccagcataaaccatgcttttactaaattactgacttttctggtcaagtggacagatttgattgatgtggttcactgttccaaaactaattagtaaaaggtaagtaatttattcagctaaagtgcatattaaaaataaagcaacgtaactagcatggctccaggaggtccctttccagcactgaacggcatcacccatgaagattcacagcagccattctttttctccttctttaagctgtcattattcttgcaccgaatgatgtc

SEQ ID NO: 45703 - DNA, 601 bp, Human
cagccagcctgcaggaagccacactgcctgaagaagtcctaactcaaaactgacatctcaggctgatcacttgaatgacagaaggaaaactttgttgaaggttttctaattacagagatgtggacaagctgattaaaactgggaaggagtggagtgttttgttagtgaatgctccagaaggaaacatggaccctttcagccgcaggagttggagaaaagagcccacattgcaggtgaaactttgaaagagtgtgaactaagccctcctgcagtccaagggacatggtaataagggtattarcagacattgttgcagaacagcgtgagccctctcaaccaacgtgctgttcctggcaccttgactattcaatataacaaacaaaatagagagggggagcaaggcaggggcccagcataaaccatgcttttactaaattactgacttttctggtcaagtggacagatttgattgatgtggttcactgttccaaaactaattagtaaaaggtaagtaatttattcagctaaagtgcatattaaaaataaagcaacgtaactagcatggctccaggaggtccctttccagcactgaacggcatca

SEQ ID NO: 45704 - DNA, 601 bp, Human
aaagtgaattcaattgctcttaaaatccattgcttcattgaagtaactaaacaggtttaaataccctgaagccaaacaactttctataaaagatgaagtctcctccaatcttcttcctctccctccacccccgtcctttcccttcttttaaaggaatataagagtgttaggtcagggactactaaaataacattttatgtcaggaaaatgccatcgattggtcccaagggagtgatagggtcctgccagcctgaaacattgtgtcttatcagagctcctaaaagcattatctaaaattacwagtatctcttttaaaccacttaagatctcgaacactgatttgaatttctttcctttgaagaaggaaaaacaaatgcatagagtgagaaagctttggtaccaacttaaaattgtcaatgaaacaaaaacctggaatataccatagaaacccatggcctgaagctgcccgggaaagcgtttatctgttttacatcaagcacattcattaaatatgtgcaaagccagaggaaatacaaaatgacaggggtcattaattataaggttgacacgcccatcccttcctcagacttctaaacataga

SEQ ID NO: 45705 - DNA, 601 bp, Human
tgactacagctaactgtgaagtacagtatttcagtcccaaatcataagcttgcattttcctttgcatttaacttttcaaagggtctatttttatttatttatttatttatttaatttattattttttgagacagagtgtcactctgttgctcaggccggagtgcagtgctatgatctcagctcactgcaacctccacctctagggctcaagcgatcctcctgcctcagcctcctgagtagctgggattataggcacccgccacccatgctcggctaattttgtatttttagtagagccagsgtttcaccatgttggccaagctggtctcaaactcttgacctcaagtaatccgcccacataggcctcccaaagtgctgggattataggcatgaaccaccgcacccagccagaatctattatttaattgcatcttcatgacaaccctttgaaagcaaccaggcagacacacatgctcagattccctgtagatgaggacatggagctggggtggggtggggggtggggagcaagaggatcaccacgtgctctcctagcaagtacaggactttgtgaaagccctgatccagcccacgacttcat

SEQ ID NO: 45706 - DNA, 601 bp, Human
gcatttaacttttcaaagtgctctcatctcatatattatctccttccctaactgtttgcaaagcaggaaccaacttagcaaaacagagaccccaatgactacagctaactgtgaagtacagtatttcagtcccaaatcataagcttgcattttcctttgcatttaacttttcaaagggtctatttttatttatttatttatttatttaatttattattttttgagacagagtgtcactctgttgctcaggccggagtgcagtgctatgatctcagctcactgcaacctccacctctagggytcaagcgatcctcctgcctcagcctcctgagtagctgggattataggcacccgccacccatgctcggctaattttgtatttttagtagagccagcgtttcaccatgttggccaagctggtctcaaactcttgacctcaagtaatccgcccacataggcctcccaaagtgctgggattataggcatgaaccaccgcacccagccagaatctattatttaattgcatcttcatgacaaccctttgaaagcaaccaggcagacacacatgctcagattccctgtagatgaggacatggagctg

SEQ ID NO: 45707 - DNA, 601 bp, Human
agaaccagctcagcaatcagaccctcagagcctacagatgtttctccgtggggataattccctggcaaataataaaaccttgcacttttacactgcatttaacttttcaaagtgctctcatctcatatattatctccttccctaactgtttgcaaagcaggaaccaacttagcaaaacagagaccccaatgactacagctaactgtgaagtacagtatttcagtcccaaatcataagcttgcattttcctttgcatttaacttttcaaagggtctatttttatttatttatttatttattaaatttattattttttgagacagagtgtcactctgttgctcaggccggagtgcagtgctatgatctcagctcactgcaacctccacctctagggctcaagcgatcctcctgcctcagcctcctgagtagctgggattataggcacccgccacccatgctcggctaattttgtatttttagtagagccagcgtttcaccatgttggccaagctggtctcaaactcttgacctcaagtaatccgcccacataggcctcccaaagtgctgggattataggcatgaaccaccgcacccagccaga

SEQ ID NO: 45708 - DNA, 601 bp, Human
aggaggctgaggtgggagaatggtgtgaaccagggaggcggagcttgcagtgagccaagatcatgccagtgcactccagcctggccgacagagcaagactccgtcagaaaaaaaaaaaaaaaaaaaagtcttctaccttgcttaagtcactctagagccacttttaatgtcttctttgacctctttggaacatcaaaattagaatccactaaaaatttattgacagtcactaattctatatcacatatagccattccctgggaagtagcaattactgttacatttcttattcttttcctcstcctcaaatttccagcttagattaaaaaaaatacccatttaattttgccacccagctacaacaatgagccagctagactgataactttcttagggtagaggataaaataagaaaaagtaaaaatctaaagaaacttctctacctcatcccacatctttaatctcaccatccaaatcacccatttcagtttgatacctaggaagtacattattgggataaggaataaatatattatattatataacattaatagccacgtaaatattatttgaacatgtttaaactagaaaacgtgtgaca

SEQ ID NO: 45709 - DNA, 601 bp, Human
gctgggtgcggtggctcacacctgtaatcccagcgctttgggaggccgaggcgggcggatcacgaggtcaggagatggagaccatcctggctaacacggtgaaatcccatctctactaaaagtacaaaaaaattagccgggggtcgtggcgggtgcctgtaatcccagctactcaggaggctgaggtgggagaatggtgtgaaccagggaggcggagcttgcagtgagccaagatcatgccagtgcactccagcctggccgacagagcaagactccgtcagaaaaaaaaaaaaaaaaaaaagtcttctaccttgcttaagtcactctagagccacttttaatgtcttctttgacctctttggaacatcaaaattagaatccactaaaaatttattgacagtcactaattctatatcacatatagccattccctgggaagtagcaattactgttacatttcttattcttttcctcctcctcaaatttccagcttagattaaaaaaaatacccatttaattttgccacccagctacaacaatgagccagctagactgataactttcttagggtagaggataaaataagaaaaagtaaaaatct

SEQ ID NO: 45710 - DNA, 601 bp, Human
ctcagcgaatgctaatggactaaaaaaggaaagttcaaccaggtgttactgtaaataggtgctgaactgcaacagccataaatcaggcagagcagacaagcaaatcccgcaatatattcaagattcccaagcttcactctctgcatctggaaccaaagattccagcacaaggtgtggccaggttttgttgtgctttataggaaaagtacttaaattttattttgcttaccatctgcttgagcccaccctatgacaatcagtttggcctagcaaatatctgaaggatggcatggcataccamaaatctgcaatattaatttctctaaaatctcacacaagctgccttggagatagggtatccagccaaaaccaaagacccatttagagctgactacaagattaatgacttgtcctgcactgatttcctcctattagcaatcagtgggtctgcgccatctgtcatttccctggaaagaaaatgtgtgtttaatttcccagtaacttctagcttggctttgtaaagggggtgacccacgtacatttagtgaccacgccttccaagtgaatgatgttcggatggtcaaactgtcccatgatgctg

SEQ ID NO: 45711 - DNA, 601 bp, Human
gagtagctgggattccaggcactagccaccgagcccagcttgtgaccatagtcttctgacagaacaaatgtgcctaaatgagttttaatcaacctgcctcaatcaaaagatactttgtcaactaacgagaaagggcagcctctcatggctgtgcattaacacctccttgcatttcaccagatccctctggagctgtggagacgacaggagaggatccaaaagtgagggtcatgcggagaatttatggtcctcctgccaatttaaaaagttactcaagtaactgctggtaatgaattcacamgcttccactctaccctttcaccctcacacctccctagtcggactcttggcaccatcttcacaaattttctgcattccattttctgtttattaaaagtatccatttgtcagatcctttatgagctctacaagggaaacaaagatgaatgtctccataagcaaaggggcttataaaataggcctgggctgggctcttggatagaggagtctccttccctgcagtaggcagggatgcagtggggaggaaaggggtgggggaagggaatagcttctccaatagaaattttaaatcattttaatt

SEQ ID NO: 45712 - DNA, 601 bp, Human
gagacaagcctggccaacatggtgaaaccccgtttctactaaaaatacaaaaaaaaaaaaaaaatttgccaagcatggtggcaggcgcctgtaatcccagctactcaggaggctgaggcaggagaattgcttgaactcgggaggccaaggttgtagtgagccgagattgcgtcattacactccagcctggggggcgacgatacagagactccgtctcaaaaaacaaacaaaaaaacaagcatgcgacttctctccactgtcttgctcagctcagggcctctgtctttctcttcactttccmtagctatgaataaacttgctttggtctgattccttaaactgcctacctcaaaaaacaaacaaacaaaaaccccagaacagtcacaggaaaggttcagaaaattatttcatctgagacaggaatttaaattcaatactagaacatccttatttcccccattccccctacctattttttttttctgcaaagaaataaaaatgattttaagctctgagcagaatgaggtgtaaataagattttcacaaaagtccgctttctgaggactttaggacataagaaccattctttaccttcttgatc

SEQ ID NO: 45713 - DNA, 601 bp, Human
aagtgagaagagaggaacagtttcaccagagtgaaagcccagatgtcaccgatctttcttaccctggtggtgtaagctgcttccggatcatcctcaagcactcgggacatgccaaaatcagacactttgcagaccaagttgctgttcaccaggatgttccgtgcggccagatcacgatgcacatagctcatatcagataaatacttcatcccagacccaatgccacgaagcatgcccaccagctgaatgactgtaaatctgccatcatttttctgcatagaaaaggagtgaggaacaatcycattagcattaggccaagttaattctcaccaagcatttattacttgaatctttttgggtatctgtatccggtatgcaatgaaactcaacattatttccaggcctttctgaccaaagtcgctaattcactagtagactgtaccctaggagctgggtttgcttcctgtgatagatggaaattatccaactgtaatgaatctacggctccaacagctccacattacaggaataaatcaaaaactaccctcgttgaacatggattatttaatagccttaaaaatcacatcattctccatttctc

SEQ ID NO: 45714 - DNA, 601 bp, Human
tttattccattagtattttatattcagatagtcgagctaagatagcacagccattaactgtgtacttaaaactcttcactgtgtcctaatccccgcttatctaccagtggtaaaatgaaggccattagatactggaaaaccttgcatggtataaatgttttataaatcctgtatatacattctgagatttggtagccaaccaactagaaacattgctttgtctcatttagaataaggattttttttaaagaatagaaaaaaggcaaatacaaaacctaaaacaacaacaaaaaaaaaaaaaggaagaaagaggcaggaagacaggcaggcaaatacaagtgcaaaaaaataaataagtgaagctacctcctgattttctcagtaattgatcatttgttgtgtaaactgatccttaatgcttgcttctcagctcatttttatttaagacaccgtcttattgttcattagcactttcttccccctgccctcccaaaaaaaaacatagagggaaagataattcattttgcttctagtttgtggctgttaatatggtcatacatctacagtcagcttcaaaatccctcttttattggaaacatgg

SEQ ID NO: 45715 - DNA, 601 bp, Human
cagggctatcatttaaaaggtttctttgctttcttaggtagggctacgaaacaggacaataaattgtactggaaattgctttgatacattgcagtaaactctgaaaacccagtgtattgcattcatccttgttacgcacagaaggacacttgtactgcattcccccctgcttaaatatttggctaaggttttatctatgtaaatgtatcattctagaagcctcctttaacttttctttctccaactactgggaaaaaataaaagatcttcaacattcacaaagatctattcttttctaaaygaatggacttggaattcaaaagaggacaagcataagaatcaaaactggagccaaagaaatagaatactatacccccctgcccccctccaaaaaaagctcagccaaccaaccaacaacaaaaaacccccattgcttgggattgcagatgcaaaatgaagagtgttaaaaggggaaaatggctggtaactgtcagcttcgtgttgattttaacagtgtcagtgttaatggccaataactgttttatgattctgtgtttattccattagtattttatattcagatagtcgagctaagatagca

SEQ ID NO: 45716 - DNA, 601 bp, Human
tcctagggttccacctggggaaattaattcaagtctaattcagacccctgaggtatccccagggctatcatttaaaaggtttctttgctttcttaggtagggctacgaaacaggacaataaattgtactggaaattgctttgatacattgcagtaaactctgaaaacccagtgtattgcattcatccttgttacgcacagaaggacacttgtactgcattcccccctgcttaaatatttggctaaggttttatctatgtaaatgtatcattctagaagcctcctttaacttttctttctcyaactactgggaaaaaataaaagatcttcaacattcacaaagatctattcttttctaaacgaatggacttggaattcaaaagaggacaagcataagaatcaaaactggagccaaagaaatagaatactatacccccctgcccccctccaaaaaaagctcagccaaccaaccaacaacaaaaaacccccattgcttgggattgcagatgcaaaatgaagagtgttaaaaggggaaaatggctggtaactgtcagcttcgtgttgattttaacagtgtcagtgttaatggccaataactgttt

SEQ ID NO: 45717 - DNA, 601 bp, Human
ttaatggagtaagggcaggatattagttgttattaaattaaaaaaaaagacttgtaaaatggtaaagcaagtgaatattacccaggaaaagttgcaaaacacacttttttttctgcctcaaatgtcttgtttgtttatgcttaggtataaggtattttcagtcaggttttcaatgtcctagggttccacctggggaaattaattcaagtctaattcagacccctgaggtatccccagggctatcatttaaaaggtttctttgctttcttaggtagggctacgaaacaggacaataaattgyactggaaattgctttgatacattgcagtaaactctgaaaacccagtgtattgcattcatccttgttacgcacagaaggacacttgtactgcattcccccctgcttaaatatttggctaaggttttatctatgtaaatgtatcattctagaagcctcctttaacttttctttctccaactactgggaaaaaataaaagatcttcaacattcacaaagatctattcttttctaaacgaatggacttggaattcaaaagaggacaagcataagaatcaaaactggagccaaagaaatagaata

SEQ ID NO: 45718 - DNA, 601 bp, Human
cacacaagtctacctccccttatacagcatgagaaatatgtccaatagctaggggatgatatgataaataggcctttagagaaagccaaataataccagatactagagctattaatgactttaatggagtaagggcaggatattagttgttattaaattaaaaaaaaagacttgtaaaatggtaaagcaagtgaatattacccaggaaaagttgcaaaacacacttttttttctgcctcaaatgtcttgtttgtttatgcttaggtataaggtattttcagtcaggttttcaatgtcctarggttccacctggggaaattaattcaagtctaattcagacccctgaggtatccccagggctatcatttaaaaggtttctttgctttcttaggtagggctacgaaacaggacaataaattgtactggaaattgctttgatacattgcagtaaactctgaaaacccagtgtattgcattcatccttgttacgcacagaaggacacttgtactgcattcccccctgcttaaatatttggctaaggttttatctatgtaaatgtatcattctagaagcctcctttaacttttctttctccaacta

SEQ ID NO: 45719 - DNA, 601 bp, Human
atcagtgatatgtagctgacatttgtttgattttttgttggattctctcacccaggagcacaaaggaaggcaatgcttacactgcttcaaaaatcatgaatgaaggaatttaaatatgaacatttctatccatcacacaagtctacctccccttatacagcatgagaaatatgtccaatagctaggggatgatatgataaataggcctttagagaaagccaaataataccagatactagagctattaatgactttaatggagtaagggcaggatattagttgttattaaattaaaaaaaaagacttgtaaaatggtaaagcaagtgaatattacccaggaaaagttgcaaaacacacttttttttctgcctcaaatgtcttgtttgtttatgcttaggtataaggtattttcagtcaggttttcaatgtcctagggttccacctggggaaattaattcaagtctaattcagacccctgaggtatccccagggctatcatttaaaaggtttctttgctttcttaggtagggctacgaaacaggacaataaattgtactggaaattgctttgatacattgcagtaaactctgaaaacccagtg

SEQ ID NO: 45720 - DNA, 601 bp, Human
ttgatcaatgctttcttttatttttttttctttctttctcactggagatgtttgtaattaaattctattactctggaatcttattagtgtcattattgaatccttttctgaaattgcagtcattgtggatactcccttacgaagtagtccagatggtacatttaaagggatgtgcataatttaccaagggtcattgagtgaagctttattttagagtcctcaaggggtgagctctaattacaacgatgccagctttaaaatattcactagttttctttcaataagcctttcatgtccgttytatcatatgtgaaatttattttttcataatctttgcattttcttaaaagtcaaagtttaattttgttttactctggttttgaaagttcaccaagtaaaaatactatcccatattttttatccatgaatctatgtgcgtatgtatctatctcccatactgtaccatgtaggccatttaattcttgtccttgaaatcaatagtcattggttgtaatgttgaactagcttgctagatatatctgtattaagaaatttgagtttaatgtatcatttcaaaccccgtgcccactccatcatacag

SEQ ID NO: 45721 - DNA, 601 bp, Human
accttgcatttgtaaacactctctgataatggactaccacatacataaaaaattaggaaagttcgaaaagtataggtggccatttaattttaatatgattcccaatcttaccagaactaatgtaaacttttccagaattagctaaaacgtgttctaggaagaccccttgatcaatgctttcttttatttttttttctttctttctcactggagatgtttgtaattaaattctattactctggaatcttattagtgtcattattgaatccttttctgaaattgcagtcattgtggatactcycttacgaagtagtccagatggtacatttaaagggatgtgcataatttaccaagggtcattgagtgaagctttattttagagtcctcaaggggtgagctctaattacaacgatgccagctttaaaatattcactagttttctttcaataagcctttcatgtccgttttatcatatgtgaaatttattttttcataatctttgcattttcttaaaagtcaaagtttaattttgttttactctggttttgaaagttcaccaagtaaaaatactatcccatattttttatccatgaatctatgt

SEQ ID NO: 45722 - DNA, 601 bp, Human
ctgtcttattgaaccttattctatttgtttctagcaattacactacgtcagtttgatcacctgggtttcttttatcttcccaggtgcatcgtgttgactctagacttgatgagaacattttgcactgaattgaggagaatgaaagcaacactgggctgatgccagcggaacataaattgttataacccctcagactgattaatgctctttcataagctccctatccactgccagcttggaagatggctcataggttagcaaagcatattttctcagtttactactaaatattttggggggmagaggattaaactaaacaaaaaacttgctaagtttgacatattttcaacagttactttcactccatttaccatatgccaaattaattctatgcatcaaagtaattccccagatacatttcctattgattcctgttctacatagaatccaacacagagacaaataatagatcaatattatttgtgagcaagaaatggcttcagatgccttttcgtggataaagccagagaactgaaagttcaaaacaacagaattctttatatatatatattgtttttttatatatatgtgtgtatatata

SEQ ID NO: 45723 - DNA, 601 bp, Human
tcccaatgacttcactggactcaccctgtggtgggtctattgactgctcagaaattggccttcgaaagaaaagagtctgttgggtccagggtccatggattagtatgactgtgatctttttaataagagcaccgtttcagtttaacaaatcatcttgtgatttattaagccctctgatcctttttctcctatgtattttgccaatatcatgtatcagtatcacctacttttctttgtaaagcagacttctctatgctgtcttattgaaccttattctatttgtttctagcaattacactaygtcagtttgatcacctgggtttcttttatcttcccaggtgcatcgtgttgactctagacttgatgagaacattttgcactgaattgaggagaatgaaagcaacactgggctgatgccagcggaacataaattgttataacccctcagactgattaatgctctttcataagctccctatccactgccagcttggaagatggctcataggttagcaaagcatattttctcagtttactactaaatattttggggggcagaggattaaactaaacaaaaaacttgctaagtttgacatatttt

SEQ ID NO: 45724 - DNA, 601 bp, Human
tccattctgctattagcacacctaaacactcttcgcaaaagagactctgacttagtgccaaagacctcccttgggaagcaattaatagctgtctccaaaatggaattttctttgcctccttttaaggccctgtcctcttacatagacagccagtgtgtcaacaccagagtccaagtccagacgcccagccattttttcttttggattactctacccctagacaccaactctgaatttctttcttggtctcagttggctgtcagtcgaccctgttaaaggtgttagtaagtagatttttttwaaaaaagtaaaaaacaattaaaaaaattccttcttttggggcatttacattttaaaggagaccctcgcacatctaaagaaggaagttataatggtacatgataattgtcttattggccaagaccatccagagtgcccagagtggtctccttgcctagtaagtcataaataactcattcaacagtctctttgctaattctaatttttctaatctgtcttcacaggcattaaattattttcttatagccttttctctaacatcctccccctgctttggggtataaattccaagaaaataata

SEQ ID NO: 45725 - DNA, 601 bp, Human
cttaacattttgacctgattttcaacgtgatactatgtttaagtacaaacatttaaatcacaattatatcattactactaaattttcaaccaaaaaactctttccttgtaaaaacaaaattaagtcgatataatgctttacttttctacatagcagaattaatccaattcgatttttaaaattttcatttttatctaaattgacttgacttgtattatttcttttttatataaatattttaacaaagatttgttttatcagtcagttttgtgtccaaataataccttgccattgtaacctktcttttgtgtccattatttcaatataagtttgattttctaagtacaattctgtaaatgtttacagcaaaaataatcaagatataattattctttcaattttgagtcaacaacaaatgttaccacatagaattttggacatttaattgagtgtggatatatagcaataatatttgttattagacaaaagccaatagtttgcatttacttctgactttaagccaaaagcattaatgaggaagatgtaggctctgagcaccgacaaggtcaaaatgaccttacaatgaaaatatcttcactcg

SEQ ID NO: 45726 - DNA, 601 bp, Human
agaagatgatggaaatcatgacccgagaggtgcagacaaatgacttgaaagaagtggtcaataaattgattccagacagcattggaaaagacgtagaaaaggcttgccaatctatttatcctctccatgatgtcttcgttagaaaagtaaaaatgctgaagaagcccaagtttgaattgggaaagctcatggagcttcatggtgaaggctgtagttctggaaaagccactggggacgagacaggtgttaaagttgaacgagctgatggatatgaactaccagtccaagaatctgtttaaarttcagacttcaaatagtgtcaaataaaaagtgctatttgtgggaaaaaaagagaaagtaatggtatgttttgcagtttaggttattgtattttatatatgtcaggcgatgtatactaaacatgttgtttaagtattctcatttttaaatttttgtttatttactctttcagttatggagagaagtatattaaaaatttcacactacagttatggactctttttttctcttaggtttgttaattactaaattatttattttaatgctataccattaggcacatacaaatttatattttttc

SEQ ID NO: 45727 - DNA, 601 bp, Human
gacccgagaggtgcagacaaatgacttgaaagaagtggtcaataaattgattccagacagcattggaaaagacgtagaaaaggcttgccaatctatttatcctctccatgatgtcttcgttagaaaagtaaaaatgctgaagaagcccaagtttgaattgggaaagctcatggagcttcatggtgaaggctgtagttctggaaaagccactggggacgagacaggtgttaaagttgaacgagctgatggatatgaactaccagtccaagaatctgtttaaaattcagacttcaaatagtgkcaaataaaaagtgctatttgtgggaaaaaaagagaaagtaatggtatgttttgcagtttaggttattgtattttatatatgtcaggcgatgtatactaaacatgttgtttaagtattctcatttttaaatttttgtttatttactctttcagttatggagagaagtatattaaaaatttcacactacagttatggactctttttttctcttaggtttgttaattactaaattatttattttaatgctataccattaggcacatacaaatttatattttttcaattgtactgattgttgac

SEQ ID NO: 45728 - DNA, 601 bp, Human
caggtcagagtcagagttggaatcagggctacggcaactactggaaccagggctacggctaccagcagggctacgggcctggctatggcggctacgactactcgccctatggctattacggctacggccccggctacgactacagtaagtaggagagagggaggccccatccgctcacccctcgtccccaggggaggcaggacagtgtaggagccactggcagcaggggctttggagtcagacaggcctggctcagccatgggagctacttgattttgagccttagacttcggggtcttartaacatgaggaaggcagtctctgctgtcacggctggtgagggtcctgggaagatgcatatcaagcgcgtggcacagggcaaatgcttgtaaatagtagctgctatggttgttctcgtccctaggtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcc

SEQ ID NO: 45729 - DNA, 601 bp, Human
tggaatcagggctacggcaactactggaaccagggctacggctaccagcagggctacgggcctggctatggcggctacgactactcgccctatggctattacggctacggccccggctacgactacagtaagtaggagagagggaggccccatccgctcacccctcgtccccaggggaggcaggacagtgtaggagccactggcagcaggggctttggagtcagacaggcctggctcagccatgggagctacttgattttgagccttagacttcggggtcttaataacatgaggaaggcartctctgctgtcacggctggtgagggtcctgggaagatgcatatcaagcgcgtggcacagggcaaatgcttgtaaatagtagctgctatggttgttctcgtccctaggtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttattta

SEQ ID NO: 45730 - DNA, 601 bp, Human
acacacatgtacacattacatataatatattacatatatgtacatattacatgcaatatattacatatatgcacatattgcatgtaatgttatatcacacacatgtacgtatcatgtgtaatatattatatcacatacatgtatatatgtaatattgcatacatgtacatattatatgtaacattgcatacatgtacatattctatgtaatattacatacatgtgcatattgcatgtaatatattgtatgtaatatattatatgtaatatatattacacatatgtatatattatatgtaaaatatattacacatatgtatatattatatgtatatatgtatacacagtggcgtgcacctatagtcccagctactcaggaggctgaggcaaagggattgcttgaacccaggagttcaagattgcagtgagctatgatataatagtatattatagcagtgaactataatatattatatataatatataatatatatatttttttcttttctttagagacctggtctcactctgttgcccagcgtggagtcccatggtgcaatcacaatcacagctcacagtagcctccacctcctgggctcaa

SEQ ID NO: 45731 - DNA, 601 bp, Human
ttacacacatgtacacattacatataatatattacatatatgtacatattacatgcaatatattacatatatgcacatattgcatgtaatgttatatcacacacatgtacgtatcatgtgtaatatattatatcacatacatgtatatatgtaatattgcatacatgtacatattatatgtaacattgcatacatgtacatattctatgtaatattacatacatgtgcatattgcatgtaatatattgtatgtaatatattatatgtaatatatattacacatatgtatatattatatgttatatatattacacatatgtatatattatatgtatatatgtatacacagtggcgtgcacctatagtcccagctactcaggaggctgaggcaaagggattgcttgaacccaggagttcaagattgcagtgagctatgatataatagtatattatagcagtgaactataatatattatatataatatataatatatatatttttttcttttctttagagacctggtctcactctgttgcccagcgtggagtcccatggtgcaatcacaatcacagctcacagtagcctccacctcctgggctc

SEQ ID NO: 45732 - DNA, 601 bp, Human
tattacacacatgtacacattacatataatatattacatatatgtacatattacatgcaatatattacatatatgcacatattgcatgtaatgttatatcacacacatgtacgtatcatgtgtaatatattatatcacatacatgtatatatgtaatattgcatacatgtacatattatatgtaacattgcatacatgtacatattctatgtaatattacatacatgtgcatattgcatgtaatatattgtatgtaatatattatatgtaatatatattacacatatgtatatattatatgtaatatatattacacatatgtatatattatatgtatatatgtatacacagtggcgtgcacctatagtcccagctactcaggaggctgaggcaaagggattgcttgaacccaggagttcaagattgcagtgagctatgatataatagtatattatagcagtgaactataatatattatatataatatataatatatatatttttttcttttctttagagacctggtctcactctgttgcccagcgtggagtcccatggtgcaatcacaatcacagctcacagtagcctccacctcctgggc

SEQ ID NO: 45733 - DNA, 601 bp, Human
acatattacatgcaatatatcatactacatacatgcacacgttacatgtaatatgttatattacatacatgcacacgttacatgtaatatgttatattacacacatgtacacattacatataatatattacatatatgtacatattacatgcaatatattacatatatgcacatattgcatgtaatgttatatcacacacatgtacgtatcatgtgtaatatattatatcacatacatgtatatatgtaatattgcatacatgtacatattatatgtaacattgcatacatgtacatattmtatgtaatattacatacatgtgcatattgcatgtaatatattgtatgtaatatattatatgtaatatatattacacatatgtatatattatatgtaatatatattacacatatgtatatattatatgtatatatgtatacacagtggcgtgcacctatagtcccagctactcaggaggctgaggcaaagggattgcttgaacccaggagttcaagattgcagtgagctatgatataatagtatattatagcagtgaactataatatattatatataatatataatatatatatttttttc

SEQ ID NO: 45734 - DNA, 601 bp, Human
atgtaatatcacattacatatatgtaatatcacatgtaataaatcatatcacatacacgcacatattacatgcaatatatcatactacatacatgcacacgttacatgtaatatgttatattacatacatgcacacgttacatgtaatatgttatattacacacatgtacacattacatataatatattacatatatgtacatattacatgcaatatattacatatatgcacatattgcatgtaatgttatatcacacacatgtacgtatcatgtgtaatatattatatcacatacatgtctatatgtaatattgcatacatgtacatattatatgtaacattgcatacatgtacatattctatgtaatattacatacatgtgcatattgcatgtaatatattgtatgtaatatattatatgtaatatatattacacatatgtatatattatatgtaatatatattacacatatgtatatattatatgtatatatgtatacacagtggcgtgcacctatagtcccagctactcaggaggctgaggcaaagggattgcttgaacccaggagttcaagattgcagtgagctatgatataatag

SEQ ID NO: 45735 - DNA, 601 bp, Human
tatatatatatgtaatatacattttatatgcaatatatatgttatatattatatgcaatatattatgttatatattatatactatatattatattttatatgtacatctcattacatatatgtacacattacatgtaatatcacattacatatatgtaatatcacatgtaataaatcatatcacatacacgcacatattacatgcaatatatcatactacatacatgcacacgttacatgtaatatgttatattacatacatgcacacgttacatgtaatatgttatattacacacatgtrcacattacatataatatattacatatatgtacatattacatgcaatatattacatatatgcacatattgcatgtaatgttatatcacacacatgtacgtatcatgtgtaatatattatatcacatacatgtatatatgtaatattgcatacatgtacatattatatgtaacattgcatacatgtacatattctatgtaatattacatacatgtgcatattgcatgtaatatattgtatgtaatatattatatgtaatatatattacacatatgtatatattatatgtaatatatattaca

SEQ ID NO: 45736 - DNA, 601 bp, Human
ccagcatggtgctgagcatatatatatatacatatatatatatgtaatatacattttatatgcaatatatatgttatatattatatgcaatatattatgttatatattatatactatatattatattttatatgtacatctcattacatatatgtacacattacatgtaatatcacattacatatatgtaatatcacatgtaataaatcatatcacatacacgcacatattacatgcaatatatcatactacatacatgcacacgttacatgtaatatgttatattacatacatgcacacrttacatgtaatatgttatattacacacatgtacacattacatataatatattacatatatgtacatattacatgcaatatattacatatatgcacatattgcatgtaatgttatatcacacacatgtacgtatcatgtgtaatatattatatcacatacatgtatatatgtaatattgcatacatgtacatattatatgtaacattgcatacatgtacatattctatgtaatattacatacatgtgcatattgcatgtaatatattgtatgtaatatattatatgtaatatatattacac

SEQ ID NO: 45737 - DNA, 601 bp, Human
agcattatgaaccagtgtgtgacatccaattaggtaatctacacgaaatggacaaattcctagaaaaacgcgaatgaaacagatcagcgatggtttcaggttcagctcacatctcttagatactgacatgccagcatggtgctgagcatatatatatatacatatatatatatgtaatatacattttatatgcaatatatatgttatatattatatgcaatatattatgttatatattatatactatatattatattttatatgtacatctcattacatatatgtacacattacatgtaayatcacattacatatatgtaatatcacatgtaataaatcatatcacatacacgcacatattacatgcaatatatcatactacatacatgcacacgttacatgtaatatgttatattacatacatgcacacgttacatgtaatatgttatattacacacatgtacacattacatataatatattacatatatgtacatattacatgcaatatattacatatatgcacatattgcatgtaatgttatatcacacacatgtacgtatcatgtgtaatatattatatcacatacatgtatatatg

SEQ ID NO: 45738 - DNA, 601 bp, Human
cagtaagctaagatcatgccactgcactccagactgggcaacagagagagactctgtctcaaaacaagcaaacagaaataatctaatgcctgatgatctgtcactgtctcccatcacctccagatgggaccatctagtttttatttgtttgtttgttattgagacagagtctcgctctgttgccgaggctggagtacaatggtgcgatctcggctcactacaacctccgcctcccgggttcaagcgattctcctacctcagcctcccaagtagctgggactacaggtgcccaccaccacgmctggctaatttttgtatttttagtagagatgaggtttcatcttgttggtcaggctagtctcgaactcctgacctcaagtgatccacccgcctcagcctcccaaaatgctggggttataggcgtgagccaccacacccagcccagggaccatctagttgcaggaaacaagctccgggctcccagtgatcccacattatggtgagttgtggaattattttattatatattacaatgtcataataacagaaacaaagtgcacaaaaaaagtaatgcgtttgaatcgtccccaaaccatcctcc

SEQ ID NO: 45739 - DNA, 601 bp, Human
atggagaaggacgtaaaaggatccagaccagacaccacgggcacatgcgacccctcggccatcggccaggttttaaatcatcactgtcttcgtcgtcatcctgagtgtcatttgtgtgggggccgggactagggtgaggccatgcggcactcaccttgggggcaaaatctagggaacgccaaaaagccctgccgtgctggtaaattatattttcatacaatcttttattatttatataaaaatatatttatatgtatttattaatatatatttatctattatctataatatataaatatgyatttataaatatataaacaaatatatatttataaatatataaaaacacatatacatatttataaataaaatatatatttaaaaaatatatatatatacacacacatattttgagacagagtctcgctctggcccccaggctggagtgcaacggcacgatctcagctcactgcaacctctgcctcccgggctcaagtgagttttctgcctcagcctcccaagtagctgggattacaggcatgcgtcaccacgcccggctaattttttttattttcagtagagatggggttttgccatgttg

SEQ ID NO: 45740 - DNA, 601 bp, Human
ggctcagggcaggctccagggacctcaccctggccgtttgacctccagcaaaggaggtctggtctcccggtcagaaaacaggagagagggcagggacttctccatggagaatatattcatggagaaggacgtaaaaggatccagaccagacaccacgggcacatgcgacccctcggccatcggccaggttttaaatcatcactgtcttcgtcgtcatcctgagtgtcatttgtgtgggggccgggactagggtgaggccatgcggcactcaccttgggggcaaaatctagggaacgccaaraagccctgccgtgctggtaaattatattttcatacaatcttttattatttatataaaaatatatttatatgtatttattaatatatatttatctattatctataatatataaatatgcatttataaatatataaacaaatatatatttataaatatataaaaacacatatacatatttataaataaaatatatatttaaaaaatatatatatatacacacacatattttgagacagagtctcgctctggcccccaggctggagtgcaacggcacgatctcagctcactgcaacctctgcc

SEQ ID NO: 45741 - DNA, 601 bp, Human
caccgcacccggctaatttttgtatttttagtagagacggggtttcactatcttggccaggctggtcttgaactcctgaccttgtgatccacgtgtctcggcctcccaaagtgctgggatgacagacgtgagccaccgcactggccggggctgtgttttcatctggaggtttgcacggggccggggcattgtaaggctaagcatgggaatttcagtctctcccccagaaccttctggagagacaccactgcagctaccaccgctgcagctaccaggcaccagctgaccaggagggaggaamcacaaggctgctgtgtctggggtcagccagcaggccgggggtgagggcgggggtgacaggggagccagcacacttgttgtgcacaaagttccttgtgacagtgagttcgtcttggcctctgtcccaagatgaggttttgatgacacgcatggaatttctaacaatgaaatggagtgtgtggttttgctcacgcttacatccccttttcttgtctatccaaattccattacgccttttcttgctaatgcagaaacacggccaaatcctgggctgccccaggaagtgccgaggcctctttcc

SEQ ID NO: 45742 - DNA, 601 bp, Human
cagccaggagcggctttctcgtgaactgtgcatgttgtttgcatcccgacaggttcaagtgacaaagctgggcaggctgaggccaccaaagggtttcctgggtccctgttcctgccacacaccttgaatcctcaatgccaaggcaactgcaaacccgagggaccccaggggggacactaggtctggacatgaaggtttggcagcaaactgtcaggacccccggagagaaccctgactcctgtgccaacccaactgtgtctggctcaacgctcgacgctcaaacacagcaaacggcaagaargcaagtccaggatatacgttttggcaaaaatggcagccgtgggggtggaggtggaggaggacatgcacggagggcttaaacagggctgtgtttttttttttttcttttagatggagtctcactctgtcacccaggttggagtgcagtggcggatctcggctcactgcaacctccaccccctgggttcaagcaattctctgcctcagcctcctgagtagctgagattacaggcgcccgccaccgcacccggctaatttttgtatttttagtagagacggggtttcactatcttggccaggc

SEQ ID NO: 45743 - DNA, 601 bp, Human
gaggtcaggagttcgataccagcctggccaacgtggtgaaaccccatctctactaaaaatacaaaaattagccgggcctggtggcgctcgtctgaaattccagctactcgggaggctgaggcagaagaatcgcttgaacccacgtggcggaggtcgcagtgagccaagatcgtgccactacactccagcctgggtgcagagcgagactctgtctcaaaaaacaaaacacaacaaaacaaacaaacaaacagcgacaaccccctctcaagaataatctgaccctaatgtcagagatgctgakacccagagaccctggtcgaagggatgttccagccaggagcggctttctcgtgaactgtgcatgttgtttgcatcccgacaggttcaagtgacaaagctgggcaggctgaggccaccaaagggtttcctgggtccctgttcctgccacacaccttgaatcctcaatgccaaggcaactgcaaacccgagggaccccaggggggacactaggtctggacatgaaggtttggcagcaaactgtcaggacccccggagagaaccctgactcctgtgccaacccaactgtgtctggctcaacgct

SEQ ID NO: 45744 - DNA, 601 bp, Human
atcccagcactttgggtggctgaggtgtgtggctcacttgaggtcaggagttcgataccagcctggccaacgtggtgaaaccccatctctactaaaaatacaaaaattagccgggcctggtggcgctcgtctgaaattccagctactcgggaggctgaggcagaagaatcgcttgaacccacgtggcggaggtcgcagtgagccaagatcgtgccactacactccagcctgggtgcagagcgagactctgtctcaaaaaacaaaacacaacaaaacaaacaaacaaacagcgacaaccccmtctcaagaataatctgaccctaatgtcagagatgctgatacccagagaccctggtcgaagggatgttccagccaggagcggctttctcgtgaactgtgcatgttgtttgcatcccgacaggttcaagtgacaaagctgggcaggctgaggccaccaaagggtttcctgggtccctgttcctgccacacaccttgaatcctcaatgccaaggcaactgcaaacccgagggaccccaggggggacactaggtctggacatgaaggtttggcagcaaactgtcaggacccccggagagaaccc

SEQ ID NO: 45745 - DNA, 601 bp, Human
ctgtctggaaaaaaaaaaaaaaaaaaaaaacctagccaggcccagtggctcacacctgtaatcccagcactttgggtggctgaggtgtgtggctcacttgaggtcaggagttcgataccagcctggccaacgtggtgaaaccccatctctactaaaaatacaaaaattagccgggcctggtggcgctcgtctgaaattccagctactcgggaggctgaggcagaagaatcgcttgaacccacgtggcggaggtcgcagtgagccaagatcgtgccactacactccagcctgggtgcagagygagactctgtctcaaaaaacaaaacacaacaaaacaaacaaacaaacagcgacaaccccctctcaagaataatctgaccctaatgtcagagatgctgatacccagagaccctggtcgaagggatgttccagccaggagcggctttctcgtgaactgtgcatgttgtttgcatcccgacaggttcaagtgacaaagctgggcaggctgaggccaccaaagggtttcctgggtccctgttcctgccacacaccttgaatcctcaatgccaaggcaactgcaaacccgagggaccccaggggg

SEQ ID NO: 45746 - DNA, 601 bp, Human
gtgctctcatgactcaggtggtccttcactcaatcccacctgcagagtccctttttccatgtgtggtgacacagccacagctcccagggattaggacatggatgtctttgaggcctttgttctgccaaccccagcacatcccagacgctgggtaccaaagatgccacttggatggaaggggctggaggccatggtgcagggagttcacaaagggtgttacttcctggaacccactctgttcccagggccgatctccttcccaggacagaggctcccaggcccaggcagccctcggatgtgragtgcctgccccacctccatccatagcaggtgctgctgctgtgcatgggcacacgtggcctggtaggcccacccctctgggctctgcagcaggggccggcccgtccgggcacacacatggccaaggatggacctcgagcctggggttctctgctgtggcccgtgggctccaggtcacatcatcagaatggctagaggtcaccagtatcatgtgtgacatctccagggccaccccactccagccctggtgttgttagaaagtcccggaaaactacaggcccagggagcttctccctgaggg

SEQ ID NO: 45747 - DNA, 601 bp, Human
agaggtgcccgtatccctcggctcgggacccttcctcccccttcacagacacagcacagcctcttcagtctctctctgactctcaccctcctgcctcctctcgtgaggatcctgtgaggtcactgcgcccccccaccccggatcatccacggtggtgctctcatgactcaggtggtccttcactcaatcccacctgcagagtccctttttccatgtgtggtgacacagccacagctcccagggattaggacatggatgtctttgaggcctttgttctgccaaccccagcacatcccagacrctgggtaccaaagatgccacttggatggaaggggctggaggccatggtgcagggagttcacaaagggtgttacttcctggaacccactctgttcccagggccgatctccttcccaggacagaggctcccaggcccaggcagccctcggatgtgaagtgcctgccccacctccatccatagcaggtgctgctgctgtgcatgggcacacgtggcctggtaggcccacccctctgggctctgcagcaggggccggcccgtccgggcacacacatggccaaggatggacctcgagcctggggt

SEQ ID NO: 45748 - DNA, 601 bp, Human
tagaggtgcccgtatccctcggctcgggacccttcctcccccttcacagacacagcacagcctcttcagtctctctctgactctcaccctcctgcctcctctcgtgaggatcctgtgaggtcactgcgcccccccaccccggatcatccacggtggtgctctcatgactcaggtggtccttcactcaatcccacctgcagagtccctttttccatgtgtggtgacacagccacagctcccagggattaggacatggatgtctttgaggcctttgttctgccaaccccagcacatcccagaygctgggtaccaaagatgccacttggatggaaggggctggaggccatggtgcagggagttcacaaagggtgttacttcctggaacccactctgttcccagggccgatctccttcccaggacagaggctcccaggcccaggcagccctcggatgtgaagtgcctgccccacctccatccatagcaggtgctgctgctgtgcatgggcacacgtggcctggtaggcccacccctctgggctctgcagcaggggccggcccgtccgggcacacacatggccaaggatggacctcgagcctgggg

SEQ ID NO: 45749 - DNA, 601 bp, Human
tgaccacggtcatgtgagagtttgcaagcccgggaaccggggccgggccaggacactgaaccccgtggctcctgtcactccagttctgggcttcccggctgaggaaatgctgtcaccctggccccgggccagggcaaggggcagcgccggcctcgtgacggtggtgctcgggagctgaagggcaggagggttaggaagagaacagagggcagtaccgggccttcccacctcagcacaggtgggtctttctccacgcatgccccccccccagaaaactcctacacatcctgcaaagccccaycgatgtcatcccctctgagaagcccctgattgcaaccatctatgcacagccaggctgcactaaaaccccttctccgcacactggcagctccctggacgttcgttgtgtcctgtgacattgtggctgctgcacacgacccatgtttctcatctcacagctctgggctcagagtccaacatgggcctcactgggttaaaatcaaggcacgggcagggctggtccctcctggaggctccaggggagaatctctttcctgcctttcgcctagaggtgcccgtatccctcggctcgggacccttc

SEQ ID NO: 45750 - DNA, 601 bp, Human
aggggacccacgcagagcccggggagcccgactgaaatggaaacttcaatacaagagacaggtctgagactggccacacctgctgcccgctccacagaaccccagggccccctcagcaaccagggtctgcatgcagagaccctgcacccagcgtgggcacccaccctgcacctgcagcctctccagggccaggtcgcccagcagggcctgggagggcggctgtgtgtggggccttccgtgccagctctgaccgttggtggctctgtgacctcaaggcagggccgtggggcccagggctgcrggcgggagggcctctgccacatggaagggagggccgcactggctggaaaatagtgccttgtgactgtccctgtcagtgtgggccctttgctctcaggctaaatcggtccccggggcagctatatttagaaggggctaaagagagggaatgaatgaggtgcccacgagaaagtgaaaaatagaccagcggggcaggtcccgccgctgccttcagccggagcttggagcctaagaatgagccggcttgttcagacaaagaggccgcgacgacagagggtgacgcgccgccagtgtgggtttg

SEQ ID NO: 45751 - DNA, 601 bp, Human
tacaggtgtgcaccaccatgcccggctaatttttaatattttttcttttagagctggggcctcaccgtattgctcaggccagtctcaaactcctgggctcaagcaatccctctgcttcggcctcccaaagtgctaggatcccgggcatgaacccccgctcccggcctgcaatttttcttttcacagccctgagatgagggtgcagcattaaaacccgtgcagagggtggctgcttctccatgagccgagcaaaccgtcctcccatggctgcttcctgtaaaccggctcctaaggccagcgkgcgtttgctctcctgacggcacaggaagtcaggctcagcgaattccagctcagagcgggctctggcggcttccaggcagctccacaatgaggcggctgcgcttttccagtctgctcatcaaagcagagccagccttgtgtggcgcggcgtgccggggtgagtcagccccgggggaaggtggccttgaaggcgggaggggcggccggcctgcagcagcaacgtgagaacagaagcaaccttcatctggctctaaaacttccagaaccagtagctttatagctcgcagagctcctggactct

SEQ ID NO: 45752 - DNA, 601 bp, Human
ggccaggctggtctcaaactcctgatctcaagtgatccacctgccttggcctcccaaagtcctgggattccatgtatgagacgccgtgcctggcctcctttttttttttttttttgacacagggtcttgctctgtcacccaggctggagtgcagtggtgcaatcacagctcactgcagccttgacctcctggcctccagagatcctcccacctcagccttctgagtagctgggactacaggtgtgcaccaccatgcccggctaatttttaatattttttcttttagagctggggcctcacygtattgctcaggccagtctcaaactcctgggctcaagcaatccctctgcttcggcctcccaaagtgctaggatcccgggcatgaacccccgctcccggcctgcaatttttcttttcacagccctgagatgagggtgcagcattaaaacccgtgcagagggtggctgcttctccatgagccgagcaaaccgtcctcccatggctgcttcctgtaaaccggctcctaaggccagcgggcgtttgctctcctgacggcacaggaagtcaggctcagcgaattccagctcagagcgggctctgg

SEQ ID NO: 45753 - DNA, 601 bp, Human
ttttatttttatttttttgtagagacagggtttcaccatgttggccaggctggtctcaaactcctgatctcaagtgatccacctgccttggcctcccaaagtcctgggattccatgtatgagacgccgtgcctggcctcctttttttttttttttttgacacagggtcttgctctgtcacccaggctggagtgcagtggtgcaatcacagctcactgcagccttgacctcctggcctccagagatcctcccacctcagccttctgagtagctgggactacaggtgtgcaccaccatgcccrgctaatttttaatattttttcttttagagctggggcctcaccgtattgctcaggccagtctcaaactcctgggctcaagcaatccctctgcttcggcctcccaaagtgctaggatcccgggcatgaacccccgctcccggcctgcaatttttcttttcacagccctgagatgagggtgcagcattaaaacccgtgcagagggtggctgcttctccatgagccgagcaaaccgtcctcccatggctgcttcctgtaaaccggctcctaaggccagcgggcgtttgctctcctgacggcaca

SEQ ID NO: 45754 - DNA, 601 bp, Human
ccaccacaccaggcttattttttatttttatttttttgtagagacagggtttcaccatgttggccaggctggtctcaaactcctgatctcaagtgatccacctgccttggcctcccaaagtcctgggattccatgtatgagacgccgtgcctggcctcctttttttttttttttttgacacagggtcttgctctgtcacccaggctggagtgcagtggtgcaatcacagctcactgcagccttgacctcctggcctccagagatcctcccacctcagccttctgagtagctgggactacargtgtgcaccaccatgcccggctaatttttaatattttttcttttagagctggggcctcaccgtattgctcaggccagtctcaaactcctgggctcaagcaatccctctgcttcggcctcccaaagtgctaggatcccgggcatgaacccccgctcccggcctgcaatttttcttttcacagccctgagatgagggtgcagcattaaaacccgtgcagagggtggctgcttctccatgagccgagcaaaccgtcctcccatggctgcttcctgtaaaccggctcctaaggccagcgggcgt

SEQ ID NO: 45755 - DNA, 601 bp, Human
catctctgctgttttccttttttttttttttttttggtggtttttgttttgttttgttttgtttttgaggcagagtctcgctctgtcacccaggctggagtgcaatgacgccatctcggctccctgcaacctccgcctcccaggttcaagtgattctcctgcctcagtctcccgagtagctgggattacaggcatccaccaccacaccaggcttattttttatttttatttttttgtagagacagggtttcaccatgttggccaggctggtctcaaactcctgatctcaagtgatccaccygccttggcctcccaaagtcctgggattccatgtatgagacgccgtgcctggcctcctttttttttttttttttgacacagggtcttgctctgtcacccaggctggagtgcagtggtgcaatcacagctcactgcagccttgacctcctggcctccagagatcctcccacctcagccttctgagtagctgggactacaggtgtgcaccaccatgcccggctaatttttaatattttttcttttagagctggggcctcaccgtattgctcaggccagtctcaaactcctgggctcaagcaat

SEQ ID NO: 45756 - DNA, 601 bp, Human
gggcggcccttccaaagagctccctgtggcaggtgcacagtcgggccttggctaggctcatgggaggcagcgctgtgtgttctttttttttttttttttttttttttgagatggagtcttgctctgtcacccaggctggagtgcaatggcgtgatctcggctcaccgcaacctccgcctcccaggttcaagtgattctcctgcctcagcctcccgagtaactgcgattacaggcgctcacaaccacatccagctaacttttgtattttttagtcgagacggggtttcaccatgttgcccakgctggtcttgaactcctggcctcaagcaatccacccaccgcggcctcccaaagtgctgggattacaggtgcgagtcaccgcgcctggcctggggtgggttttttcatttgtgcactgaatgtttattactgacagccagcaaggaaagggggactgcgccctacgactgcaaggaagtgaattcaggaagaacctgaatgagctggggacgacaactggaagcttcgcgtcagacagcaggcggctcacgtttcagtttcagcctgggagaccctgggcagaggacgtcattgcaccatg

SEQ ID NO: 45757 - DNA, 601 bp, Human
tgaactcaggtgatctgcccgcctcggcctcccaaagcgctgggattacaggcgggagacactgcgcccggccataagctcaattttagacacatacgatatccaatgggggatggacacacacctgacacggtcccagtggagccctgaatggacctctgtgctggaggctgggtgtcgtccctcccccagctgccctgtctcattggccaaagggtttagggagaacaacctagaggccttgctcatccagtggcctaaagttctgcattctaaatacacaccatcgcaggaactcacacctctcctttctccttcctgcctccctcccttcttctttctctctccctctccttccttccttcctccttccctccctccctctttctctttctttcttctctctccctctccttcctgccttccttccttcctccctccctccttctctctctctttccttccttttttctttcttctttctttctctttctctctggctctccctccctccctccctcccttccttccctcctccctccctctctctctctctctgtttctttctcaatttctttcttttcttttctccttccttcct

SEQ ID NO: 45758 - DNA, 601 bp, Human
ggctggtctcgaactcctgaactcaggtgatctgcccgcctcggcctcccaaagcgctgggattacaggcgggagacactgcgcccggccataagctcaattttagacacatacgatatccaatgggggatggacacacacctgacacggtcccagtggagccctgaatggacctctgtgctggaggctgggtgtcgtccctcccccagctgccctgtctcattggccaaagggtttagggagaacaacctagaggccttgctcatccagtggcctaaagttctgcattctaaatacacaycatcgcaggaactcacacctctcctttctccttcctgcctccctcccttcttctttctctctccctctccttccttccttcctccttccctccctccctctttctctttctttcttctctctccctctccttcctgccttccttccttcctccctccctccttctctctctctttccttccttttttctttcttctttctttctctttctctctggctctccctccctccctccctcccttccttccctcctccctccctctctctctctctctgtttctttctcaatttctttcttttc

SEQ ID NO: 45759 - DNA, 601 bp, Human
tggccaggctggtctcgaactcctgaactcaggtgatctgcccgcctcggcctcccaaagcgctgggattacaggcgggagacactgcgcccggccataagctcaattttagacacatacgatatccaatgggggatggacacacacctgacacggtcccagtggagccctgaatggacctctgtgctggaggctgggtgtcgtccctcccccagctgccctgtctcattggccaaagggtttagggagaacaacctagaggccttgctcatccagtggcctaaagttctgcattctaaayacacaccatcgcaggaactcacacctctcctttctccttcctgcctccctcccttcttctttctctctccctctccttccttccttcctccttccctccctccctctttctctttctttcttctctctccctctccttcctgccttccttccttcctccctccctccttctctctctctttccttccttttttctttcttctttctttctctttctctctggctctccctccctccctccctcccttccttccctcctccctccctctctctctctctctgtttctttctcaatttcttt

SEQ ID NO: 45760 - DNA, 601 bp, Human
agccattctcctgcctcaacctcccgagtagctgggattacaggcgcccgccaccatgcccggctaatttttttttgtatttttagtagagacagggtttcaccgtgttagccaggatggtctcgatctcctgacctcatgatctgcccacctcggcctcccaaagtgctgggattacaggcgtgagccacggcacccagccctagattgttaaataaattataataaactgttaactaatttaggtatttaatacttgtagtttagttagtaatttttcatatattgcatgttcctgtawacaaatgaactataaactgcgttgcaaagcagattatcttctgttttttccttgcatagtaatcagaattgaaatttgtttgtgacgacaataaattaaggatattttcacaaactgagaaataaacatatataccaactttttttttttttttggatggtgtttccctcttgtcacccaggctggagtacaaaggcgtgatctcggctcactgcaacctttgcttcctgattcaagcgattctcctgcctcagcctcccgagcagctgggattacaggtgtccgccaccacgcctggct

SEQ ID NO: 45761 - DNA, 601 bp, Human
tgacgatgatgactttattgtaaaaagagaacatacacgagcatcaggaataaggaaagccgtgctgagtggcccaggtcagtctgctgagaatgaaaccgaccaggtcaattttagagagatccctccacgatgctatccaaagcatgcgtcaggccatcagcagtggtggtgactcatgcctgtgatcctaccactttgggaggccaaggctggaggatcatttgaggccaggagtttgagaccagcctgggcaacatagtgagacccccgtctctgcaaaaaaaaaaaaaaaaaaaaattagcctggcatggtggtgcacacctgtagttccagctacccgggaggctgaggcaggaagactgcttgagcccaggagttggaagctgaagtgagctatgattgcaccgctgcactccagcctgggcaacagagcaagaccctgtctttaaaaaaacacaatagaaaggcatgcatatattttacttacaaggttcactactctaacagctccactgagattcctgaattcctcactgcattggaagtgctgatggcttcagacttcctagatatatatatttttcttttttttctttt

SEQ ID NO: 45762 - DNA, 601 bp, Human
ggctggtctcaagcgatcctcctgcctcagcctcccaaatcactggggctgcaagcgtgagccatggcacctggctataataaaataaatctgatatagaatatagaatagggtcataatatataaatgtaatcaacatataatacactgagcatgctcaaagtgtacggttctgatgggacaggaagctggaggcgggaaactggccctggagtgggggttgtggtgaagctggaggcgggaaactggccctggagtgggggttgtggtgttaggctgggacccggttacagtgactgcrgggctgacaagaaattatgaaaggtcttgagggaagcgacacagaatttcaaaagaacataatgaatgcactttgggaggccgaggcaggcagatcacttgcggtcaggagttccagaccagcctggccaacacggtgaaaccccatctctaccaaaaaatacaaacatcagccggatgtggtggtgcatgcctgtagtcccagctactcaggaggctgaggtgggagaattgcttgaacctggaaggcggaggctgtagtgagctatgattgcgccactgccctccagcctggacaaca

SEQ ID NO: 45763 - DNA, 601 bp, Human
aggctggtctcaagcgatcctcctgcctcagcctcccaaatcactggggctgcaagcgtgagccatggcacctggctataataaaataaatctgatatagaatatagaatagggtcataatatataaatgtaatcaacatataatacactgagcatgctcaaagtgtacggttctgatgggacaggaagctggaggcgggaaactggccctggagtgggggttgtggtgaagctggaggcgggaaactggccctggagtgggggttgtggtgttaggctgggacccggttacagtgactgyagggctgacaagaaattatgaaaggtcttgagggaagcgacacagaatttcaaaagaacataatgaatgcactttgggaggccgaggcaggcagatcacttgcggtcaggagttccagaccagcctggccaacacggtgaaaccccatctctaccaaaaaatacaaacatcagccggatgtggtggtgcatgcctgtagtcccagctactcaggaggctgaggtgggagaattgcttgaacctggaaggcggaggctgtagtgagctatgattgcgccactgccctccagcctggacaac

SEQ ID NO: 45764 - DNA, 601 bp, Human
gcactccagcctgggcaacaggagcgaaactccatctcaaaaaaaaaaagaaaagaaaagaaaagaaaagggcctcagcttgctgtttttgaaactgaagccacatgttttcttcctaatcagaactaaagtgaaagattaaaacaatcgatgttttgtttgtcttggagcaagaaatataagatctgtgtttctggcttgcagacaagagcactgccgcactgaagcgtgtgtgggtcgtatatgtgacagagcacaggaggcctgcagcgaggtcccgacagggaggactttcttgggycggagacctggttctgagcacgtcccctggacttccctgagcctcagctttctcggctgtaaagttcagaactagacagcggtttcccctgtgctccacgacaccctaggggttctgtgcagaggctgggccaccctgggttctcgggaggggctctcttggccttggggtacagtctgtgcttcctggtcggactccatttgtgtatgtgtatattttattatacagataataaaatatatatacatacatatttttatttttatttttattttttttttttgagacggagtctcgctc

SEQ ID NO: 45765 - DNA, 601 bp, Human
aattaactgggtgtggtggtgtgtgcctatagtctcagctacttggatggctgaggcaggaggatcgcttgagtccaggagttggaggctgcggtgagttatgaccacaccactgtacttcagccgggcaacagagtgagacatatctcaaaaagaaaagaaggccgggcgcggtggctcccacccgtaatcccagcactttgggaggccgaggtgggcggatcacgaggtcaggagtttgagaccagcctggccaacatgatgaaatcccgtctctactaaaaatacaaaaacagtagcygggtgtggtggcgggcgcctgtagtcccagctactcaggaggctgaggcaggagaattgcttgaacctgggaggcggcggttgcagtgagccgagattgcaccattgcactccagcctgggcaacaggagcgaaactccatctcaaaaaaaaaaagaaaagaaaagaaaagaaaagggcctcagcttgctgtttttgaaactgaagccacatgttttcttcctaatcagaactaaagtgaaagattaaaacaatcgatgttttgtttgtcttggagcaagaaatataagatctgtgtttc

SEQ ID NO: 45766 - DNA, 582 bp, Human
taaaaaataaatgcctctcaaaaataaaaaaagtaaagcaacagaagctggatattagaggtgcatattatataattccatttatataaagttcaagaataggcaaaactatggtgatagaaatgaaaacagaggttgctgcctctggccagggtgttggctagaaagggccatgaaataacttctagggtgatggcgatgttctctatgttggttgagctgttggtgtacacaggtgtacacatttgctaaaatccatcaaactgtatctttaagatctgttcatcttactgcatttgarttggactttgataaaatcagttaattacaaacaaaaatcaacaaacaaaagttgccagaggaaaaaacagcagcaattaggtggacccagtgaaaatatccttcaagaattagggggaaataagggcattttcagataaacaaaaccagactttctcaccaacagacttgccttttaaaaggtaaaactagagaaagataattccagatgaaaggtagaaaatgcaggaagaagtgaaaaacaacaaaaatgttgtagagaggaaagagcttgataagata

SEQ ID NO: 45767 - DNA, 601 bp, Human
ttaattgtgttaattacgttcaaagagataaaaagatgagattggaattttcgctgcaaattggaacaatggggaaaaaaaggaaccagtggatatggagaaaatgacaatatctgaaaagtaagaactcaatggaagaaataaaaattagtgaactggaagacagaacagagaaaaatatccagaatgaagcaagacgacacaaagggaaagaaactacagaagaaagagcaaaagacatagaagatgcagtgacgtctaatatacgtgttattggaacaccagaaggaggagagagagratgaagcaggaacaatctttgaagagataatgaccaataactttctaaaactgataaaaagacctcaagccacagatttcagaatccctagaacctcaggcaaaagaaatgtcctaaaaagtggcagagaaatggccaataagcacatgaaatggtgtctaatgattagtcatgaaggaaatatgagttaaagtcatcaagagagactgcctctcaaccactagagtggcaaaaatttaaaagactgacaacactaaatatttgggaggatgtagaagaactggaggcatcatccattac

SEQ ID NO: 45768 - DNA, 601 bp, Human
atgaacccgggaggcggagcttgcagtgagctgagatcacgccactgcactgcagcctgggcaaaagaacgagactccgtctcaaaaaaaaaaaaacaaaaaaaaaacaaaaaccagcactacaaagagacccacagggtttccatatactgggaattgacagagactttaaattaattgtgttaattacgttcaaagagataaaaagatgagattggaattttcgctgcaaattggaacaatggggaaaaaaaggaaccagtggatatggagaaaatgacaatatctgaaaagtaagaaytcaatggaagaaataaaaattagtgaactggaagacagaacagagaaaaatatccagaatgaagcaagacgacacaaagggaaagaaactacagaagaaagagcaaaagacatagaagatgcagtgacgtctaatatacgtgttattggaacaccagaaggaggagagagagaatgaagcaggaacaatctttgaagagataatgaccaataactttctaaaactgataaaaagacctcaagccacagatttcagaatccctagaacctcaggcaaaagaaatgtcctaaaaagtggcag

SEQ ID NO: 45769 - DNA, 601 bp, Human
aggaagcagacaggtccttctagcaactacagcagagttttgaataatctcaatccctaatattggattaaggtgatgcgagattgctggtggccccaaatgcctggaagaagtaaacataaatcccctctggaggaaaataatacgatcccaggcctcagattatttctacatgcaaatccgcaatacaggccgggcgcggtggctcacgaggtcaggagatcaagaccatcctggctaacatggtgaaaccccgtctctactaaaaatacaaaaaattagccaggcttggtggcaggcrcctgtagtcccagctactccggaggctgaggcaggagagtggcatgaacccgggaggtggagcttgcagtgaaccgagatcgtgccactgcactccagcctgggtaacagagcgagactccgtcccaaaaaaaaaaaaaaatgcacaatacaatatctggcatgcaagtaagacatacgaggagccaggaccacataaacaaaaatcagcagaaataaccagcactgccaggtgcggtggctcacgcctgtaatcccagcactttgggaggcctaggcaggcggatcatgaggtcaggag

SEQ ID NO: 45770 - DNA, 601 bp, Human
gagaccagcctggccaacatggtgaaaccccatctctgctaaaaatacaaaaattagctgggcatggtggcacgtgcctgtagtcccagctacttgggaggctgaggcacaagaatcacttaaacccgggaggcagtggttgcagtgagctgagattgtgccactgcactccagcctgggcgacagagagagaccctgtctcaaaaaaaagaaaaaaaagctggacagggctgggtgcggtggctcaagcctgtaatcccagcactttgggaggctgaggtgggaggatcacttgaagtcrggagtttgagaccagcctggccaacatggtgaaaccccgtctctattaaaatacaaaaattagctggacgtggtggcgggtgcctgtagtcccagctactcaggaggctgaggtacaacaatcacttaaacccgggaggcagaggttgcagtgagctgacgttgtgccactgcactccagcctgggtgacagagtgagaccctgtctcaaaaaagaaagaaaagctggacagaatgtcaaagcatctgctcaagggcctgcagggttattaagataatggagaatttccagccaggattt

SEQ ID NO: 45771 - DNA, 601 bp, Human
gggacactctcatctctgcaccaggcctggcccccaggttcctgtgtgaggaaacaggggttccagagtctggcaggcaggaagaggaccctcttccagggacctgtggcaactgccaaatataaacacagctgctggaaagacaaggtggctggaacatcctgcacccagcgaatgtggaagggccggtttgcccggagctcttgagaaatctcactccccgtggacttgcaccctgtcgccactcccctgacctgccctgaggctggggtgcagcagggaattgcaacagccccccacygccggccctggagagacctgggcagagctggaagctgatcagattaaaaatcagcatggatcggattcgggatagagccacaaactgggtgtcctgaaattacccatttttgtgttggtgggtttttttgtttgtttgtttgttttttggagatgatggctcactctgtcgcccaggctggagtgcagtggcaccaactcggctcactgcaacctccgcctcccaggttcaagcgattctcttgcctcagccccctggagtagctgggattacaagcatgcgccaccacacccggctaat

SEQ ID NO: 45772 - DNA, 601 bp, Human
ctaaaaaaaaaaaaaaatacaaaaaaattagccgggcatggcggcgggcacctgtagtcccagctactcaggaggctgaggcaggagaatggtctcaaaaaaaaaaaaaaaagtaaatacaggggtgtttccaaaagggctttaattttattagcatcccagaatgctttgtgactaggagaggccccacagggcgggagtcttcccccagatgtgagccccgttgcatttgaagggagtgagaccacagctcccacagaggagggaactcgggaaggtggtaggccagaaatctgccctkgctctaccaagctgtgtggccttgggaaagtttccttccctctctgagccccagtgacctctgttggaattctcagagggacactctcatctctgcaccaggcctggcccccaggttcctgtgtgaggaaacaggggttccagagtctggcaggcaggaagaggaccctcttccagggacctgtggcaactgccaaatataaacacagctgctggaaagacaaggtggctggaacatcctgcacccagcgaatgtggaagggccggtttgcccggagctcttgagaaatctcactccccg

SEQ ID NO: 45773 - DNA, 601 bp, Human
tattaattatatagtttgatttctattttgacatttacattgtttgctattgattttatatttgtatttataatatatttagattactattttatatctgtatatatgtattatatagttatataatctgttataggtttattgaatattgtttatcttaactttttttttttgagagggagtctcgctctgtcgcccaggctggagtgcagtggcacaatctcggctcactgcaacctccacctcctgagttcatgccattctcctgcctcagcctcccgagtagctgggactacaggcrcgcgccaccacaccgggctaatttttgtatttttagtagagacggggtttcaccatgttggtcaggctggtctcaaactcctgacctagtgatccacccgcctcagcctcccaaagtgctgggattacaggcgtgagccactgctcccggccctatcttaactttttattttgaaacaattatggactcaggcagttgcaaacatagtccagggagccccacgcaccctctcccggtcccctccagggcgacgtcacctgtgactatgagacactatcagaaccgggaccctgaggtcag

SEQ ID NO: 45774 - DNA, 601 bp, Human
tcatttacataatttatacattattaattatatagtttgatttctattttgacatttacattgtttgctattgattttatatttgtatttataatatatttagattactattttatatctgtatatatgtattatatagttatataatctgttataggtttattgaatattgtttatcttaactttttttttttgagagggagtctcgctctgtcgcccaggctggagtgcagtggcacaatctcggctcactgcaacctccacctcctgagttcatgccattctcctgcctcagcctccygagtagctgggactacaggcgcgcgccaccacaccgggctaatttttgtatttttagtagagacggggtttcaccatgttggtcaggctggtctcaaactcctgacctagtgatccacccgcctcagcctcccaaagtgctgggattacaggcgtgagccactgctcccggccctatcttaactttttattttgaaacaattatggactcaggcagttgcaaacatagtccagggagccccacgcaccctctcccggtcccctccagggcgacgtcacctgtgactatgagacactatca

SEQ ID NO: 45775 - DNA, 601 bp, Human
tatcatgcatttattacatatttgaagattcattcactatatattcatatcagttttgtattactaatatatagttttagtatttagtatgtattatacacttattgcatacatattttatatttattcatcatttacataatttatacattattaattatatagtttgatttctattttgacatttacattgtttgctattgattttatatttgtatttataatatatttagattactattttatatctgtatatatgtattatatagttatataatctgttataggtttattgaatatygtttatcttaactttttttttttgagagggagtctcgctctgtcgcccaggctggagtgcagtggcacaatctcggctcactgcaacctccacctcctgagttcatgccattctcctgcctcagcctcccgagtagctgggactacaggcgcgcgccaccacaccgggctaatttttgtatttttagtagagacggggtttcaccatgttggtcaggctggtctcaaactcctgacctagtgatccacccgcctcagcctcccaaagtgctgggattacaggcgtgagccactgctcccg

SEQ ID NO: 45776 - DNA, 601 bp, Human
cctggtctactattagtttataatataaacttatactatattatactatagtattatacatttattacatatttatatattttattatatatttgtttactcatatatttatatttatactcatatttatatttatgtcatttatcatgcatttattacatatttgaagattcattcactatatattcatatcagttttgtattactaatatatagttttagtatttagtatgtattatacacttattgcatacatattttatatttattcatcatttacataatttatacattattaatyatatagtttgatttctattttgacatttacattgtttgctattgattttatatttgtatttataatatatttagattactattttatatctgtatatatgtattatatagttatataatctgttataggtttattgaatattgtttatcttaactttttttttttgagagggagtctcgctctgtcgcccaggctggagtgcagtggcacaatctcggctcactgcaacctccacctcctgagttcatgccattctcctgcctcagcctcccgagtagctgggactacaggcgcgcgcca

SEQ ID NO: 45777 - DNA, 601 bp, Human
gcctgacctcaggtgatccacccgcctcgacctcccaaagtgctgggattacaggcgtgagccaccgcgcctggtctactattagtttataatataaacttatactatattatactatagtattatacatttattacatatttatatattttattatatatttgtttactcatatatttatatttatactcatatttatatttatgtcatttatcatgcatttattacatatttgaagattcattcactatatattcatatcagttttgtattactaatatatagttttagtatttagtatgtattatacacttattgcatacatattttatatttattcatcatttacataatttatacattattaattatatagtttgatttctattttgacatttacattgtttgctattgattttatatttgtatttataatatatttagattactattttatatctgtatatatgtattatatagttatataatctgttataggtttattgaatattgtttatcttaactttttttttttgagagggagtctcgctctgtcgcccaggctggagtgcagtggcacaatctcggctcactgcaacct

SEQ ID NO: 45778 - DNA, 601 bp, Human
tcgatctcctgatcttgtgatccgcctgcctcggcctcccagagtgctgggattaaaggcgtgagccactgcgcctggccaatttttgtatttttaatagagacggggtttccccatgttggccaggctggtctcaaacgcctgacctcaggtgatccacccgcctcgacctcccaaagtgctgggattacaggcgtgagccaccgcgcctggtctactattagtttataatataaacttatactatattatactatagtattatacatttattacatatttatatattttattatatatytgtttactcatatatttatatttatactcatatttatatttatgtcatttatcatgcatttattacatatttgaagattcattcactatatattcatatcagttttgtattactaatatatagttttagtatttagtatgtattatacacttattgcatacatattttatatttattcatcatttacataatttatacattattaattatatagtttgatttctattttgacatttacattgtttgctattgattttatatttgtatttataatatatttagattactattttatatctg

SEQ ID NO: 45779 - DNA, 601 bp, Human
ggagcagccgccctctaaccccttgctccggcagttatcccgagggcaaaaaatgaaaagaaataaaaatctacatatagaaaggcgtttataattgcgttatgtgtaagagtgaaaagttagaatgaaagcaagtgctctgcctcttttttttttgagtcggagtctcgctctgtcgcccaggctgaagtgcggtggcgcgatctcagctcactgcaacctccgccttccgggttcaagcgattctcttgcctcagcctcccgagtggctgggattacaggtgcctgcctccacgccaattttttttttttttttttttttttgagacagagtgtggctctgtctccgaggctggagtgcagcggcgcgatcttggctcactgcaacctcctcctccagggttcacgccattctcctgcttcagcttcccaagtagctgagactacaggcgcccgccaccacgcctggctaattttttatatttttagtagatacggggtttcaccgtgttagccaggatggtctcgatctcctgatcttgtgatccgcctgcctcggcctcccagagtgctgggattaaaggcgtgagccactgcgcct

SEQ ID NO: 45780 - DNA, 601 bp, Human
cctcggtgcacaggctcctgcaggcaggcaaggctccaggccaggctctccaaaaataaaactgaagagggacgccgcccggccccgcgctggcctcctagcaaaaggctcatagccacacccgagtctaagcccgcctcgtgcagaaaaatcccactcgcgcctgaaagtcaagaaggatgagggtaccccccactccaggacatagtggaaatctgtggtcgctcagggaagggtgaccagccccgaaacagagcagacctgagctgatcagacacgaggctccagtgcacagaagggytgaacaaaaccgcaggacaggagctggcagcaccggcagggagggaggtgggaccacagggacccccagggagcagccgccctctaaccccttgctccggcagttatcccgagggcaaaaaatgaaaagaaataaaaatctacatatagaaaggcgtttataattgcgttatgtgtaagagtgaaaagttagaatgaaagcaagtgctctgcctcttttttttttgagtcggagtctcgctctgtcgcccaggctgaagtgcggtggcgcgatctcagctcactgcaacctccgccttcc

SEQ ID NO: 45781 - DNA, 601 bp, Human
gctctgcctcggtgcacaggctcctgcaggcaggcaaggctccaggccaggctctccaaaaataaaactgaagagggacgccgcccggccccgcgctggcctcctagcaaaaggctcatagccacacccgagtctaagcccgcctcgtgcagaaaaatcccactcgcgcctgaaagtcaagaaggatgagggtaccccccactccaggacatagtggaaatctgtggtcgctcagggaagggtgaccagccccgaaacagagcagacctgagctgatcagacacgaggctccagtgcacasaagggctgaacaaaaccgcaggacaggagctggcagcaccggcagggagggaggtgggaccacagggacccccagggagcagccgccctctaaccccttgctccggcagttatcccgagggcaaaaaatgaaaagaaataaaaatctacatatagaaaggcgtttataattgcgttatgtgtaagagtgaaaagttagaatgaaagcaagtgctctgcctcttttttttttgagtcggagtctcgctctgtcgcccaggctgaagtgcggtggcgcgatctcagctcactgcaacctccg

SEQ ID NO: 45782 - DNA, 601 bp, Human
tgacggtcgggctctgcctcggtgcacaggctcctgcaggcaggcaaggctccaggccaggctctccaaaaataaaactgaagagggacgccgcccggccccgcgctggcctcctagcaaaaggctcatagccacacccgagtctaagcccgcctcgtgcagaaaaatcccactcgcgcctgaaagtcaagaaggatgagggtaccccccactccaggacatagtggaaatctgtggtcgctcagggaagggtgaccagccccgaaacagagcagacctgagctgatcagacacgaggctycagtgcacagaagggctgaacaaaaccgcaggacaggagctggcagcaccggcagggagggaggtgggaccacagggacccccagggagcagccgccctctaaccccttgctccggcagttatcccgagggcaaaaaatgaaaagaaataaaaatctacatatagaaaggcgtttataattgcgttatgtgtaagagtgaaaagttagaatgaaagcaagtgctctgcctcttttttttttgagtcggagtctcgctctgtcgcccaggctgaagtgcggtggcgcgatctcagctcact

SEQ ID NO: 45783 - DNA, 601 bp, Human
ggtgtcaccagccggcactgactcaggagcagccatgcccccagcagaggactaagccaacagcagcagaactggccacgcactgagtcagccaggaacgcccctcccaactgcctccctgcagaggcgcacgggtgccgggcaccccgacctgaatgagcttgcctcggggcccgtggcccggggaagctgtgggaggggcgggagcaggcagctccgggggcagggccaggtggtcaaaggtgcacacagtccccacggctccctcctgacggtcgggctctgcctcggtgcacaggcycctgcaggcaggcaaggctccaggccaggctctccaaaaataaaactgaagagggacgccgcccggccccgcgctggcctcctagcaaaaggctcatagccacacccgagtctaagcccgcctcgtgcagaaaaatcccactcgcgcctgaaagtcaagaaggatgagggtaccccccactccaggacatagtggaaatctgtggtcgctcagggaagggtgaccagccccgaaacagagcagacctgagctgatcagacacgaggctccagtgcacagaagggctgaacaaaaccgcag

SEQ ID NO: 45784 - DNA, 601 bp, Human
tatatgagtgcatgtacacatctacgtgtgtgcgtctgcatatgagtgtgtgcataggtgcatttgcatacgtgcatgtgtgtggacatgcatgccagtgtgcacgtgtgtatgtgcacgtgtgtggacacggcactgcatgtgcgtgtgcgcacacgtgtgtgggcatgcatgtcactatgggtgtgtgcatgcgtgttggcgtgtgtgtacgtcactgtaggtgcgtggatatgtgcgtgcgtgggtgtgtacatgtgtctgcatgtgtacatgcgtgtgcgtgtgtgtgcgcacgggmgtgcatgtggatgcttgggctgagatgccgagactcagacacagattgcatcacccatgcagtcgcctccctaagtccccgtctcggtggtgtcaccagccggcactgactcaggagcagccatgcccccagcagaggactaagccaacagcagcagaactggccacgcactgagtcagccaggaacgcccctcccaactgcctccctgcagaggcgcacgggtgccgggcaccccgacctgaatgagcttgcctcggggcccgtggcccggggaagctgtgggaggggcgggagcaggc

SEQ ID NO: 45785 - DNA, 601 bp, Human
gcatgtgtatgtgtacctgcatatgcatgggtgtgcacgtcagcatgcatatgagtgtgcatccttgcatgtgtgtacatgtgcatgtgtctatatgagtgcatgtacacatctacgtgtgtgcgtctgcatatgagtgtgtgcataggtgcatttgcatacgtgcatgtgtgtggacatgcatgccagtgtgcacgtgtgtatgtgcacgtgtgtggacacggcactgcatgtgcgtgtgcgcacacgtgtgtgggcatgcatgtcactatgggtgtgtgcatgcgtgttggcgtgtgtrtacgtcactgtaggtgcgtggatatgtgcgtgcgtgggtgtgtacatgtgtctgcatgtgtacatgcgtgtgcgtgtgtgtgcgcacgggagtgcatgtggatgcttgggctgagatgccgagactcagacacagattgcatcacccatgcagtcgcctccctaagtccccgtctcggtggtgtcaccagccggcactgactcaggagcagccatgcccccagcagaggactaagccaacagcagcagaactggccacgcactgagtcagccaggaacgcccctcccaactgcctccctg

SEQ ID NO: 45786 - DNA, 601 bp, Human
acacatatctgcatgtgtatgtgtacctgcatatgcatgggtgtgcacgtcagcatgcatatgagtgtgcatccttgcatgtgtgtacatgtgcatgtgtctatatgagtgcatgtacacatctacgtgtgtgcgtctgcatatgagtgtgtgcataggtgcatttgcatacgtgcatgtgtgtggacatgcatgccagtgtgcacgtgtgtatgtgcacgtgtgtggacacggcactgcatgtgcgtgtgcgcacacgtgtgtgggcatgcatgtcactatgggtgtgtgcatgcgtgtkggcgtgtgtgtacgtcactgtaggtgcgtggatatgtgcgtgcgtgggtgtgtacatgtgtctgcatgtgtacatgcgtgtgcgtgtgtgtgcgcacgggagtgcatgtggatgcttgggctgagatgccgagactcagacacagattgcatcacccatgcagtcgcctccctaagtccccgtctcggtggtgtcaccagccggcactgactcaggagcagccatgcccccagcagaggactaagccaacagcagcagaactggccacgcactgagtcagccaggaacgcccctcccaac

SEQ ID NO: 45787 - DNA, 601 bp, Human
tgtgcacacatatctgcatgtgtatgtgtacctgcatatgcatgggtgtgcacgtcagcatgcatatgagtgtgcatccttgcatgtgtgtacatgtgcatgtgtctatatgagtgcatgtacacatctacgtgtgtgcgtctgcatatgagtgtgtgcataggtgcatttgcatacgtgcatgtgtgtggacatgcatgccagtgtgcacgtgtgtatgtgcacgtgtgtggacacggcactgcatgtgcgtgtgcgcacacgtgtgtgggcatgcatgtcactatgggtgtgtgcatgygtgttggcgtgtgtgtacgtcactgtaggtgcgtggatatgtgcgtgcgtgggtgtgtacatgtgtctgcatgtgtacatgcgtgtgcgtgtgtgtgcgcacgggagtgcatgtggatgcttgggctgagatgccgagactcagacacagattgcatcacccatgcagtcgcctccctaagtccccgtctcggtggtgtcaccagccggcactgactcaggagcagccatgcccccagcagaggactaagccaacagcagcagaactggccacgcactgagtcagccaggaacgcccctc

SEQ ID NO: 45788 - DNA, 601 bp, Human
tgccctgggcagccaccgcccgcaatttccatgtgagcatcaggtcctgagccgtgctggcttttctgttttgggcgaaattccctgcgagatgctccctttgggctgggtaataacccaggcctgccaggaaggccagagaggactgcgctgtgtgtgtgtgtctatgtttatttgcatgtatgtcaatgatgcacatgtgactgtacacgtgtgtacacgtggtgtgcatgtcagtgtgcacatgtgtatgtgtgtgcacatgtgcatgtatgtgtaccttgcgtgtgcatgtatgtgygtatgtgtatactggcattcatgagtgtgcatatatgcgtgtgtgcacacatatctgcatgtgtatgtgtacctgcatatgcatgggtgtgcacgtcagcatgcatatgagtgtgcatccttgcatgtgtgtacatgtgcatgtgtctatatgagtgcatgtacacatctacgtgtgtgcgtctgcatatgagtgtgtgcataggtgcatttgcatacgtgcatgtgtgtggacatgcatgccagtgtgcacgtgtgtatgtgcacgtgtgtggacacggcactgcatgtgcgtgtgcgc

SEQ ID NO: 45789 - DNA, 601 bp, Human
agagcttcaaagcagccacaaaacatccaactcagggaaaaccgcccttggttgggcttaaaaatacctaaattactcagtgctaaaaatacgtgcacgcagagaacaaacgggctggccgcacctcctgttttccttggaaggccagggggtcctatttagcatccacagtcaggagtgtccacccagaccctgggcccctgctgccctgggcagccaccgcccgcaatttccatgtgagcatcaggtcctgagccgtgctggcttttctgttttgggcgaaattccctgcgagatgctscctttgggctgggtaataacccaggcctgccaggaaggccagagaggactgcgctgtgtgtgtgtgtctatgtttatttgcatgtatgtcaatgatgcacatgtgactgtacacgtgtgtacacgtggtgtgcatgtcagtgtgcacatgtgtatgtgtgtgcacatgtgcatgtatgtgtaccttgcgtgtgcatgtatgtgtgtatgtgtatactggcattcatgagtgtgcatatatgcgtgtgtgcacacatatctgcatgtgtatgtgtacctgcatatgcatgggtgtgcacgt

SEQ ID NO: 45790 - DNA, 601 bp, Human
gttgaggccagactgggcaatttagtgagaccccatctctgaataaataataaaagggcaacacgaatgatccctgttagtgcctcaactacggtgatgaatccacaagcctacatgagtgataaactcacagagagcctcacacactcacacaccagcgggcacaatactgaatactgcggaacctgagtgaggctggtgggtgtgtgactgtctggctgcgatcctgcccatagctttaccaaatgttaccaccagggacggccggggaatgacacacagaattcctctacattctttkttagcactggctgtgactccacggcgatctcaataaaaggggcaattaaacaaaaaatccctttgacaccgcccagcctccttggtttccagcagacgtcccacccccactttttgggggcagagaaggcccaatctgtctgctctggaggcagagcccacgtgtggccgctcagagggctctgattccagagagcttcaaagcagccacaaaacatccaactcagggaaaaccgcccttggttgggcttaaaaatacctaaattactcagtgctaaaaatacgtgcacgcagagaacaa

SEQ ID NO: 45791 - DNA, 601 bp, Human
cgaggatcacttgagtccaggagtttgaggccagcctaggcaacatagcaagaccccctctctacaaaaaattagaaaattagctgggcatgggtagcgcactcctgtggtcccagctacttgggaggctgaggtgggaggatcacttgagcctgggaggttgaggccagactgggcaatttagtgagaccccatctctgaataaataataaaagggcaacacgaatgatccctgttagtgcctcaactacggtgatgaatccacaagcctacatgagtgataaactcacagagagcctcrcacactcacacaccagcgggcacaatactgaatactgcggaacctgagtgaggctggtgggtgtgtgactgtctggctgcgatcctgcccatagctttaccaaatgttaccaccagggacggccggggaatgacacacagaattcctctacattctttgttagcactggctgtgactccacggcgatctcaataaaaggggcaattaaacaaaaaatccctttgacaccgcccagcctccttggtttccagcagacgtcccacccccactttttgggggcagagaaggcccaatctgtct

SEQ ID NO: 45792 - DNA, 601 bp, Human
agtcctgggcagccgcagtcccagccgggcgtctgtgagcagttaattaagccgcaccctgtctctgtcataactcatggcatcgctgtctgttttgcagagccaggcagccgcagagaagtcaaggcagattccagagttctcaaaaaatgcctacttagtgataagaaggaaaggactggccgggcgcggtggctcacgcctgtaatcccagcactttgggaggccgaggcgggcgggtcacaaggtcaggagatcaagaccatcctggctaacacggtgaaaccccgtctcccgggcrtggtggcgggtgcctgtagtcccagctactcgggaggctgaggcaggagaatggggtgaacccggaaggcggagcttgcagtgagcagagatcacgccactgcactccagcctgggggacagagtgagactctgtctcaaaaaaaaaaaaaaaaaaaaaaaaaaaagaaggaaaggaccatccatgcataccacaccgcaggggaatctccagggcctgggatgtgtagcatgcttctgtttgtgtaatgtgtttaagaggactttttttagacagagtctcgctctgttgcccaggctg

SEQ ID NO: 45793 - DNA, 601 bp, Human
ccaggttcaagagtcctgggcagccgcagtcccagccgggcgtctgtgagcagttaattaagccgcaccctgtctctgtcataactcatggcatcgctgtctgttttgcagagccaggcagccgcagagaagtcaaggcagattccagagttctcaaaaaatgcctacttagtgataagaaggaaaggactggccgggcgcggtggctcacgcctgtaatcccagcactttgggaggccgaggcgggcgggtcacaaggtcaggagatcaagaccatcctggctaacacggtgaaaccccrtctcccgggcgtggtggcgggtgcctgtagtcccagctactcgggaggctgaggcaggagaatggggtgaacccggaaggcggagcttgcagtgagcagagatcacgccactgcactccagcctgggggacagagtgagactctgtctcaaaaaaaaaaaaaaaaaaaaaaaaaaaagaaggaaaggaccatccatgcataccacaccgcaggggaatctccagggcctgggatgtgtagcatgcttctgtttgtgtaatgtgtttaagaggactttttttagacagagtctcgctctgt

SEQ ID NO: 45794 - DNA, 601 bp, Human
acatttgtggctgtcatgacttgggggtactcctggcagggagtgggtggaggccacggatgctgctcagcaccctgcagtgcccaggacggccccgctccagggaacgatccagccccacgtgtcagtagtgtccagcctagagaaacctgcttcgtaggacccagtgagggggttggtgctgatgggggtggcaggggcaggggccaggttcaagagtcctgggcagccgcagtcccagccgggcgtctgtgagcagttaattaagccgcaccctgtctctgtcataactcatggcatygctgtctgttttgcagagccaggcagccgcagagaagtcaaggcagattccagagttctcaaaaaatgcctacttagtgataagaaggaaaggactggccgggcgcggtggctcacgcctgtaatcccagcactttgggaggccgaggcgggcgggtcacaaggtcaggagatcaagaccatcctggctaacacggtgaaaccccgtctcccgggcgtggtggcgggtgcctgtagtcccagctactcgggaggctgaggcaggagaatggggtgaacccggaaggcggagcttgcagtg

SEQ ID NO: 45795 - DNA, 601 bp, Human
tctgggacatttgtggctgtcatgacttgggggtactcctggcagggagtgggtggaggccacggatgctgctcagcaccctgcagtgcccaggacggccccgctccagggaacgatccagccccacgtgtcagtagtgtccagcctagagaaacctgcttcgtaggacccagtgagggggttggtgctgatgggggtggcaggggcaggggccaggttcaagagtcctgggcagccgcagtcccagccgggcgtctgtgagcagttaattaagccgcaccctgtctctgtcataactcakggcatcgctgtctgttttgcagagccaggcagccgcagagaagtcaaggcagattccagagttctcaaaaaatgcctacttagtgataagaaggaaaggactggccgggcgcggtggctcacgcctgtaatcccagcactttgggaggccgaggcgggcgggtcacaaggtcaggagatcaagaccatcctggctaacacggtgaaaccccgtctcccgggcgtggtggcgggtgcctgtagtcccagctactcgggaggctgaggcaggagaatggggtgaacccggaaggcggagctt

SEQ ID NO: 45796 - DNA, 601 bp, Human
agtccgtggaatccccagatctcatctgggggtgactctgccctccgtggagcactgggtgatgtctgggacatttgtggctgtcatgacttgggggtactcctggcagggagtgggtggaggccacggatgctgctcagcaccctgcagtgcccaggacggccccgctccagggaacgatccagccccacgtgtcagtagtgtccagcctagagaaacctgcttcgtaggacccagtgagggggttggtgctgatgggggtggcaggggcaggggccaggttcaagagtcctgggcagcygcagtcccagccgggcgtctgtgagcagttaattaagccgcaccctgtctctgtcataactcatggcatcgctgtctgttttgcagagccaggcagccgcagagaagtcaaggcagattccagagttctcaaaaaatgcctacttagtgataagaaggaaaggactggccgggcgcggtggctcacgcctgtaatcccagcactttgggaggccgaggcgggcgggtcacaaggtcaggagatcaagaccatcctggctaacacggtgaaaccccgtctcccgggcgtggtggcgggtgc

SEQ ID NO: 45797 - DNA, 601 bp, Human
ggctggtcttgaactcctgacctcaggtgatccaccctcctcggcctctcaaagtgctgggatgacaggtgtgagcccggcctctcctccgtgtccttcatattgaaccagtcaggagcccatgctgttgcttcttgaattctcctggaaaaacccaggacctcaacagggcagacgatcacaggacgcagagtctcttgggagtccgtggaatccccagatctcatctgggggtgactctgccctccgtggagcactgggtgatgtctgggacatttgtggctgtcatgacttgggggtrctcctggcagggagtgggtggaggccacggatgctgctcagcaccctgcagtgcccaggacggccccgctccagggaacgatccagccccacgtgtcagtagtgtccagcctagagaaacctgcttcgtaggacccagtgagggggttggtgctgatgggggtggcaggggcaggggccaggttcaagagtcctgggcagccgcagtcccagccgggcgtctgtgagcagttaattaagccgcaccctgtctctgtcataactcatggcatcgctgtctgttttgcagagccaggcagcc

SEQ ID NO: 45798 - DNA, 601 bp, Human
ccaggccctctggagaagggaggacccacgcaggctcccgggtggcctgcctcagtccatggcaggggttcttgccctccaggggacactgggtgatatctggggacatctgtggctgtggggggtgctcctggcatggagtgggttgggtggaggccagggacattgctcagctccctgcagtgccccggacggccccacgccagggaaggatccgaacgcgatatccatagtacccaggggagaccctgggtcagggcagggatcacagcagaacccctggtgactgtccccctccgtkttttttttttttttttttttgagacagagtcttgctctgttgcccaggctggagtgcagtggtgtgatctcggctcactgcaacctctgcctcccgggttcaagcgattctcctgcctcagcctcccgagtagctgggattacaggcacgtgccaccacacccggctaatttttgtatttttagtacagacagcgtttcaccatgttggccaggctggtcttgaactcctgacctcaggtgatccaccctcctcggcctctcaaagtgctgggatgacaggtgtgagcccggcctctcct

SEQ ID NO: 45799 - DNA, 601 bp, Human; identical to SEQ ID NO: 32036

SEQ ID NO: 45800 - DNA, 601 bp, Human; identical to SEQ ID NO: 32037

SEQ ID NO: 45801 - DNA, 601 bp, Human; identical to SEQ ID NO: 32038

SEQ ID NO: 45802 - DNA, 601 bp, Human; identical to SEQ ID NO: 32039

SEQ ID NO: 45803 - DNA, 601 bp, Human; identical to SEQ ID NO: 32040

SEQ ID NO: 45804 - DNA, 601 bp, Human; identical to SEQ ID NO: 32041

SEQ ID NO: 45805 - DNA, 601 bp, Human; identical to SEQ ID NO: 32042

SEQ ID NO: 45806 - DNA, 601 bp, Human; identical to SEQ ID NO: 32043

SEQ ID NO: 45807 - DNA, 601 bp, Human; identical to SEQ ID NO: 32044

SEQ ID NO: 45808 - DNA, 601 bp, Human; identical to SEQ ID NO: 32045

SEQ ID NO: 45809 - DNA, 601 bp, Human; identical to SEQ ID NO: 32046

SEQ ID NO: 45810 - DNA, 601 bp, Human; identical to SEQ ID NO: 32047

SEQ ID NO: 45811 - DNA, 601 bp, Human; identical to SEQ ID NO: 32048

SEQ ID NO: 45812 - DNA, 601 bp, Human
tgaatacccgagtatatgatgcttaatctatttttcaatctgttgtggctgtaaacgtcaatgcttccaagtctccatcatttagttcttctctactcttcccacatctgtacatttatatttagatttttgggaagcctagtggaaattcctatctgtatagaaatcaatgtttgcatatggagaacccggccactgtaagagcagttttatatacattagattattattataataattatttttatttttaagagatggagtctcgctctcgcccaggctggagtgcagtggtgcgatsttggctcactgcaacctccgcctcccaggttcaagcaattctcctgcctctgcctccctgtagcctgtagctaggactacaggtacacgctgccacgcccggtttttttttttttttggtattttagtagagatgggatttcaccttgttgcctgggctggttttgaactcctgagctcaggcaatccgcctgcctcggcctcccgaagtgctacgattacaggcgtgagccaccgcacccagccaaaattagcttattatttttataacttgttgcaaaatcctctttttaggttagag

SEQ ID NO: 45813 - DNA, 601 bp, Human
cctttagctaaaacaacctgaagagctctcctttaaaaaaaaaggggggggggcggggcttccaagtaggatttactttgaacacagagttttgttttctcaaacttaaaattttgaaaagtcactgtcttaatgataatatccattaaaaaatgtaactcaatattggccgggcgtggtggctcatgcctgtaatcccggcactttgggaggccaaggcgtgcggatcatgaggtcaggaaagcaagaccatcctggctaacaaggtgaaaccccgtctctactaaaaatacaaaaaatyagctaggtgtggtggcgggcgcctgtagtcccagctactcgggaaatcgcttgaacccaggaggcagaggttgcagtgagctgaggtcacaccactgcactccagcctgggtgacagagcgaaacttcgtctcgaaaaaaaaaagaaaaaaaaaaagaaaaaaaaaatatatatactgaatattaacaaaggtattaactgaattatttcagctacttgttagaatacactggatgtgtaactttaataatatattaacatcattatgcagagactgttaaactgcaagcccggtaaata

SEQ ID NO: 45814 - DNA, 601 bp, Human
tgtcaatggaagaaatgtgcctcggcatgctaagacccctcctgatccaatcgtctcctccctcctgagactgctccaaatctgctccactttgaccttcaacatcccattccatggactccagtggctctaacccttctgctacaaagatactcaagtttcctgattcctttagctaaaacaacctgaagagctctcctttaaaaaaaaaggggggggggcggggcttccaagtaggatttactttgaacacagagttttgttttctcaaacttaaaattttgaaaagtcactgtcttamtgataatatccattaaaaaatgtaactcaatattggccgggcgtggtggctcatgcctgtaatcccggcactttgggaggccaaggcgtgcggatcatgaggtcaggaaagcaagaccatcctggctaacaaggtgaaaccccgtctctactaaaaatacaaaaaattagctaggtgtggtggcgggcgcctgtagtcccagctactcgggaaatcgcttgaacccaggaggcagaggttgcagtgagctgaggtcacaccactgcactccagcctgggtgacagagcgaaacttcgtct

SEQ ID NO: 45815 - DNA, 601 bp, Human
aaaaggtgaaatgtatagttaaaaaaatctacacataaactgatgtgcaatccctatacttcactcaaagcctgttgcatcccaggagtaaaatataattacaaatcagtactatagatctgtctaaagatatggcaataaaactttgagaaatgtgtaagccaaggaaatgtttttatggtttttctcttaaaaacttcaatttgtagaatttgccagtgctcaacagtgaaatcactctttatgtatcaatatcagccctgtccttatacctagcccaaagactttagtagtaacaacyactaaaaaacaaaacccagccctccaagtgagacatttttttccttcccacaaaactaaccaaacaatctcaaacctgtgggattgctagacaatacttatcttccacctgtcagtatagttgctaaaactcaccattttaatcccaaattttatctaatgtaattttacaattttttgtagagacagggtctatgttgcccaggttggtctcgaactcctgggttcaagcgatcctcctgcttcagcctcacaaagtactgggattatagacatgagccgccatgcctggccccctatc

SEQ ID NO: 45816 - DNA, 601 bp, Human
ggttccaaatggcctcttgttctttaactgcaaacgggccaggctccctgccaggtcatgggataacaatccaaggagaggggagaaatgcagtgtgcatgtgtgtgtacatgggcatgctcgtagggggaaagactggggggatggaggtgacgtggacatctgtgtatgcttcagctctatttccctctgcttagtcccaaactgctcgggattagcaattgttaagaacatgcctttctccccaccccgggagttctaggccaggggtggagggattgagcaccgtggctttgttctstgtcaggtggtgcctttctctgtgacaccgagggagacctgccatcaggagggagtctgaggccaggagacagtacttaccgatcaggatggatctttggtcttgtttgtgtgcttggtttcctggctggaatgaaatgtcagtttcatgaggacagggacctgttctctcctgcacaactttctctctgatgaccgacagtgcctggcatgttgtaaaggctcgttcagaagtgactgaatgaatgaatgcatactttttaggcggggctgcatatcgttcccttaaacctcctgattc

SEQ ID NO: 45817 - DNA, 601 bp, Human
gtgctcttctcaggaaagcaggtgagtggtgatgccctgggctaagctcgccagggcctgggcagcccaggcacccgtggttcgggtggggagggagcatgctggtggccggagctgggcttgtgggcagcagccctccccaccttgctgaggccaagctctttctcatggctttggctgtcacttctatgctgatcacccccaaatcattgtgtctatatttctctattggtgcttctgaccttccaaaatctgatcccaccctggcagtcagaccttatttgatgtcaaggattattartttgtagcatgtattacatccctaatatggaccagttcacatgcattctcatatttcatcctcccaatgaacatacaaagtcaaataattattcttattttacagagtctcagacaacttagttcctctaggtaaccagattaattagcattagggggttgtgatcaggatttgaactggctccactggcccctgaccctgaacagagtcagcttggagtccgcccttggagacgaggacagccggtcctgtttctccctctcaccccagtgcactcacacagcaggcgttggcaccctt

SEQ ID NO: 45818 - DNA, 601 bp, Human
gtgagccaagatcgcgccattgtactgcagcctgggtgacagagcgggactctgtctccaaaaaaaaataaataaatagcctttcctgcaaacaccagtgagggctgaatagtggacactgggatgccagcaggaactgtcatagcgacaagacacagcctgggtcaggatggtggcatcaaagctggtagagagtgaggaaggcacaccccacgttctctctccaccgcctcctacctacccttgtctcccgcctgtgcctctgtctcatcggctggacctacaggaaaccagccaggargggagcccaggtgcctccacccagagggctcagccccgctgggtccagagaagggcatacagggaggccgccaaccaggtagcctttccccaaaaggcaaagctgtggaggaggcatccactcagcaggtgtggaaagcaggggggatgagagctctggcatcctagggtctgagcggctgctgctgctactttttgggaaggggctgccaaatcaaaactagttactagttcaaaatttgatcataaagggcaattaggaaagataaggaaataaagaacatccagattggaaaggaag

SEQ ID NO: 45819 - DNA, 601 bp, Human
tcttaagaaagaagaacaggctgggtgcagtggctcgcacctgtaatcccagcactttgggaggccaaggcgggcggatcatgaggtcaggagatcaagaccatcctggctaacatctctactaaaaatacaaaaaaattagtcgggcgtggtggtgggcgcctgtagtcccagctagttgggaggctggagaatgacgtgaacccgggagtcagagcttgcagtgagccgagatcgtgccactgcactccagcctgggcaacagagcaagactccgtctcaaaaaaaaaaaaaaaaaaaaacaacgttggaggactcacacttcctgatttcagaatttaactgcagtgtggtactggtgtaaggatagacatatagatatatagatcaatggaatagaactgagagcccagaataaaccctcacattaacagttaattgattttcagtaagagcgccaagacaatttaatgggggaaagaatagtcttttcaacaagtggcgctaaaacaactgtatatctgcatgcacaggaatgaactggaccccacctcataccatatacaaaaattaattcaaaatggaccaaagacctaaatgt

SEQ ID NO: 45820 - DNA, 601 bp, Human
agcatcctatgttttcactgatgtaatcgtttcttatttctgtgagaatgtgaatgccatgtttgtctctaagttttcttctccctgcatagttggtttcctccaaattgctttctctgctctttcctttggtctccatcctctttgaatgaatctgcccagggacctttggttgcccactcataattattaggagggtctaaaatgctgcctgggagctggagcaggtgggggtccagttctgagtttaccagtacatgatctgggcaggctgtttgttggggaacctcagtgtcaacayctgggagctcagttggggaagggggtagcatgcaaagagtcacgtaacctgccacccccatttttggcaaggtccccaggccctcaactgtgcctcgaatttcccagtccagagaccccacacttttccctccccagaaagtaaacctctgttcttccagggctggagaggggaggtctctggcatgagatgggggaggtaggggtctaactgctatttttttttttttttttcctgagacggagttttaactcttgtcacccaggctggagtgcaatggcacaatctcggctcacttca

SEQ ID NO: 45821 - DNA, 601 bp, Human
taagttctgctatagaataggcatttgccatgtccaccaaaaagcgtgattttacacccccacgcttcaacctccaagtgcctgtgttgatggagagagagaaagaaggtgttgagagcaggggtaaagaaatcagtcccttagaagacaaaagaataattttccagttgttaaatgagattctcaaaagaatttttatgttgatatcctcaaagattaattcatgttgcagaatgtcattggaactaccttaagacattgatagagtgcctgtctgctgtcttccttagctcatcctcaygttttgatcaaattaagtacttggacaccaggtctgtaaaaaagaaaagagccttctttatttgggttctgtaggcaaaagggagagtggagaagcgactctgtctacgctgctcccctcactccccgtctctgggcccttctgggatttgcatgccacccactgctctgtcaggagtggctcttagggaagtgaggaaagggccttgattatagtgtttgccaatttctgtggcataaatatgcccactgtggcccgtgtcaggctaccaacgtgatgtcatagcacagagctggagtc

SEQ ID NO: 45822 - DNA, 601 bp, Human
aaaagagccttctttatttgggttctgtaggcaaaagggagagtggagaagcgactctgtctacgctgctcccctcactccccgtctctgggcccttctgggatttgcatgccacccactgctctgtcaggagtggctcttagggaagtgaggaaagggccttgattatagtgtttgccaatttctgtggcataaatatgcccactgtggcccgtgtcaggctaccaacgtgatgtcatagcacagagctggagtcaggcaagcccgtgggagtgagtcgtgccctggggtcacagtgggkgtcctcactgacacggtgcagctggacagcagaatctcatctttcaggtcgtctgacttgttctaagggtctgtcagggttgaatcatgcttgccaagtagcatcttaaaagatatttccactgcagcagccccagcccttcaacctgggcttctgtggccttctaattcttccttctctgcctcccctccacccacccccacatcatcagcagcagatccaacatgaataccaaacactcacagttaatactaaaagccaacaatttttttttttttgagatggagtcttgctctgtca

SEQ ID NO: 45823 - DNA, 601 bp, Human
atggagttttgctcttgttgcccaggctggagtgcaatagcacgatctcagcccaccgcaacctctgcctcccacgttcaagcgattttcctgcctcagcctcccaagtagctgggattacaggcgtgtgccaccatgcccggctaattttgtatttttagtagagatggggtttctgcatgttggtcaggctggtcttgaactcccaaccttaggtgatccacccgcttcagcctcccaaagtgctgggattacaagtgtgagccacgtgccaggccacacccagctaattttaaaaagttttttttttaattttttggcagagacaggatctcaatatgttgcccaagctgatctcaaactcctagactcaagtgatacccctgcctcggcctcttaaagtgctgagattacaagcatgagccaccacgcctcacggtgaatcttaacagcctcatgccactctgcaacctcattgtgacctgaagtatttcttcactgattcattccctcagacatttatttagttctggtcttacgcactgtacagagtgccagggagatgtggggacaaaagagaccagggatcctgtgcccaggg

SEQ ID NO: 45824 - DNA, 601 bp, Human
gggattacaggcgtgtgccaccatgcccggctaattttgtatttttagtagagatggggtttctgcatgttggtcaggctggtcttgaactcccaaccttaggtgatccacccgcttcagcctcccaaagtgctgggattacaagtgtgagccacgtgccaggccacacccagctaattttaaaaagttttttttttaattttttggcagagacaggatctcaatatgttgcccaagctgatctcaaactcctagactcaagtgatacccctgcctcggcctcttaaagtgctgagattayaagcatgagccaccacgcctcacggtgaatcttaacagcctcatgccactctgcaacctcattgtgacctgaagtatttcttcactgattcattccctcagacatttatttagttctggtcttacgcactgtacagagtgccagggagatgtggggacaaaagagaccagggatcctgtgcccagggccctaacagtgtctattaaaggagacaagacgggtcaacaaatctttataacattaaatgctctttgctgaggacacagacgccacggagacctcatggagagccccctgagc

SEQ ID NO: 45825 - DNA, 601 bp, Human
gtgaggacaggaatatgtaggacgaagcgatgtggggcctcagctgcagcagctcttaggtggcgccctgccctggtccccagaaaggctgctgagcactggggccacgttgttgtctggaacaaaacttgggggatgatggcctgacagcaggattctgtgctccttctggttgcaagaggcatcctgggagatgtagttcaggtctgaagtagtgggatttcagggacattttgatgatttattagacaaattgaaactgccttggcttatctgggacatgtgactgctgacattgttsgtcagctctcgttgggaagctctgagtgccactggtggccctgctggaggccaggccagtgacagttttatcagaagtggggtttttggttttggtattttggtttccaagtgcctgtcacactgtgctcctgatgaaagccgtgacttactcctttagttgagtgaagagtccataggccaactctgatgggtccgagctcctgctctggagggggccatatgaagcgggctccaggccggctctgctggtggcctgggtgtgtcacttaatcccactgcacctggtcccttacctgta

SEQ ID NO: 45826 - DNA, 601 bp, Human
tggagagagggtggtgtgagggggccacgcccatcttacagtgcggtttctcccagccgatgttgattctggaaaggcctgggtttcagatctgggaaggcagtgccattcgataaggaaaaactgggttaaccaagttctaggaagggtgcaggcgccctgggaatgcagtggtgtttcagttcatctttatgtctgttgggccccatccgtgcctggcattgtgtgcgggtcagggagagacaggttggtggtgggggtcttgtgtgaccacagcggtgagcttagtttcagggccatractaggttctaaggagcagtgcagccctcaccctccgtcattcacagcagctcctgacagccttccccagccccacactgcctgctggccaacatttccgtgtcttccgcctcactcggcagcacatcccaaatccatcacagaaacctgccctcccgtctctgactgcctcctgtctcagaccacctccctcatcatcttgccaggtccctagggggccgagggagcaggctgtgggctgtggatcagctactctctgcgtgacccaacctcccgcctccctgcagccagcggcccatg

SEQ ID NO: 45827 - DNA, 601 bp, Human
ggagagagggtggtgtgagggggccacgcccatcttacagtgcggtttctcccagccgatgttgattctggaaaggcctgggtttcagatctgggaaggcagtgccattcgataaggaaaaactgggttaaccaagttctaggaagggtgcaggcgccctgggaatgcagtggtgtttcagttcatctttatgtctgttgggccccatccgtgcctggcattgtgtgcgggtcagggagagacaggttggtggtgggggtcttgtgtgaccacagcggtgagcttagtttcagggccatamctaggttctaaggagcagtgcagccctcaccctccgtcattcacagcagctcctgacagccttccccagccccacactgcctgctggccaacatttccgtgtcttccgcctcactcggcagcacatcccaaatccatcacagaaacctgccctcccgtctctgactgcctcctgtctcagaccacctccctcatcatcttgccaggtccctagggggccgagggagcaggctgtgggctgtggatcagctactctctgcgtgacccaacctcccgcctccctgcagccagcggcccatgc

SEQ ID NO: 45828 - DNA, 601 bp, Human
gtagcaggagctcccttcgccttttcctgcggagctcttcctgtcccttctgtatatttcttcttttttttctaattataaataacgcatccccaatggagaaaatatggaaattttccatatggaaatatagaaaagcataaagaaggaggaaaacacaactctacagcaattccatagcacgtgggagtgaggagggtggcatgcaagcagtcctacagttgttgccattcctttaaaaaaacttcatgagatcatgttgtttaccattaaattttcttggcttcacattacatcacargcatttcccatgtcatcaaaacctgtgcaaacacattattgttaatggttacataatgtctgtgggagccagggtgtggaatctttaaattgcttctcatgattttctgttgtaaataatgctgctttgaacatctttctgcgtacatcttggttcccattttggaatatttcctggggttggatttctggaatagtaatgactgggctcaggggcataacccgccaccatgcctagctaatttttttgtattttttagtagagatggggtttcaccgtgttagccaggatggtctccat

SEQ ID NO: 45829 - DNA, 601 bp, Human
agaggctccgcgtctctcagctcagcctctgaattgccccagacatgcgtcgtctgtcagcccctgctgctcgccagtccagagagatcctttccactgtgcatcgatcatgtccctcctgtcctgtccatggctgaagggaggcctcaaccactgggccctgtctgtggctgcagccccacctcaggccgtgggctcacacttccctctctcaggacagcaccaagcctgttcttcctgagaacttcacaattgctatcccttcttcctggagctttctctgcggatctgtgcgtggccracttctccccatccaggtcccagcttctgtgtcccctcctcagagaggccttttctaatatccagcccccaaacccctgcacccgccccagatcattcgcaaaatgtcacctgtttcttatcttccaggcacttgtgatctgaaatgttctgatttgtgtcttgtttttcttttctttgctcctttcactgccattcatcttccatgagcagaacccttcactgttgtgttctcgactcctaaggcttagaactgtgcctggcataaggtctgcccctagtggggttttctgtttttctc

SEQ ID NO: 45830 - DNA, 601 bp, Human
ttacttaaaacaaaatggctgagtcaagtgttttaaacgttttctaagaaatgaatcagatcggccgggtgtggtggctcacacctgtaatgctagcactttgtgaggccgaggcgggtagaccacttgaggtcaggagttcaagaccagcctggccaacatggtgaaaccccatctttatttaaaatacagccaggcgtggtggttcacacctgtaatcccagcactttgggaggccaaggcaggtggatcgcctgaggtcaggaggtcgaggccagcctggccaagatggtgaaacccygtctctactaaaaatacaaaaattagctgggcgtggtggcgggtgcctgtaattccagctactcgggaggctgaggcaggagaatcactcgaacccaggaggcggaggttgcagtgagccgagatcgcaccattgcgctccagcctgggtgacagagcaagactctgtctcaaaaaaaaaaagaaaaaagaaaagaaacaaaacaaaaacaaaattagccaggcatggtggtgcatgcctataatcccagctacttgggaggctgaggcaggagaattgcctgaacctgggaggcagagg

SEQ ID NO: 45831 - DNA, 601 bp, Human
accatgttggccaggctggtctcgaactcctgatgtaaggtgctcctcccacttcagcctcccaaagtgctgggattacaggcatgagccaccgcgcccaacctgatacttttattttttttgagacggagtcttgccctgtcgcccaggctggagtacagtggcacgatctcggctcgctgcaagctctgcctcctgggttcatgccattctcctgcctcagcctcccaagtagctgggactacagatgcccgccaccacgcccggctaatttttttttttttgtatttttagtagagayggggtttcaccgtgttagccagggtgggccaacctgatacttttaaaagttatagtgcatattatgctgggtacggcagctcacacctgtagtcttaactactcaggaggctgaggtgggaggatcatttgcgaccagcctaggcaacatagggagaccctgtctctacaacaataaagtcacagttaggatatcaggctgagctgggggttccatttggggttggatttgctcccttctctagagccaggaaatgttgggcttggccaggcatcaggaggtagatggtgctagcctttc

SEQ ID NO: 45832 - DNA, 601 bp, Human
atgttggccaggctggtctcgaactcctgatgtaaggtgctcctcccacttcagcctcccaaagtgctgggattacaggcatgagccaccgcgcccaacctgatacttttattttttttgagacggagtcttgccctgtcgcccaggctggagtacagtggcacgatctcggctcgctgcaagctctgcctcctgggttcatgccattctcctgcctcagcctcccaagtagctgggactacagatgcccgccaccacgcccggctaatttttttttttttgtatttttagtagagacggrgtttcaccgtgttagccagggtgggccaacctgatacttttaaaagttatagtgcatattatgctgggtacggcagctcacacctgtagtcttaactactcaggaggctgaggtgggaggatcatttgcgaccagcctaggcaacatagggagaccctgtctctacaacaataaagtcacagttaggatatcaggctgagctgggggttccatttggggttggatttgctcccttctctagagccaggaaatgttgggcttggccaggcatcaggaggtagatggtgctagcctttctgt

SEQ ID NO: 45833 - DNA, 601 bp, Human
ccctcccattgccgtctggccctggccctgtcccgctgccccgctgccctctcctcgcccttggtttgcttccctgatgggtgtggaccctgcctctggcactttcccttcatttcctctcccacttcctcctcgttgcctcctctccctcccatcctcccttctggaaggaaaggaaaggaaaggaagggagcatgggtggatgttgaggccttccccaccaccctgttaaaaacaaaaacaaacccccggtcagccttgcctcttgcctcgcacatggtcctttggaggccctgtcgcyggcctgccgtcccctcgctgtctgggagcccacggcgaggccctttagcggccgggtcagcagacctcaatccgtgctgtggaacgaacgtggatgagtctgaaaggctagagggttgctcaggcaggtgcagcaggtccgtgggaatagaggcagggctggcccctgcctgcccgggcccctctcccgctctgcggcaggcattcccttcctcctctgccccctcccagctcctcacagggagccagtagcagtgactgcgtggcacgtagagaagggacgcactcctgggtttggtgg

SEQ ID NO: 45834 - DNA, 601 bp, Human
gctgtcgcccaggctggagtgcagtggcgcgatctcggctcactgcaagctctgcctcctgggttcaagcgattctcctgcctcagcctcccgagtagctgggactacaggtgccccccaccacgcccggctaatttttgtatttttagtagacggggttttatcacattggccaggctggtctcaaactcctgacctcaggtgttccacccgccttgacctcccaaaatgctgagattacaggtgtgagccaccgtgcctggcctcccagataattcttaatttctggaaaatgtggatccccccccaccaggcaagagcccaagtcatgtagatgcggtcactttgcacagtgtcaggcccccgccagccccctgctctcctcacctggcctggtgcacacagtgtcaggtgcttcaggagcagccgagggtgggggcgcagcagagacatgagcaggaggcttgggaggcaacctgcccttggtgggctggcagctcggcttgtctttgggtggccttggtgggtgccctgcctggcatgaggactctaaatgggtatttaggatctaaagagccctttgctgggctctgttactggc

SEQ ID NO: 45835 - DNA, 601 bp, Human
tcccccgccccccaggtggagaaaggggcactagagaccgtgaccacggggccagcagcaggataagtgtctctggtgtctgggggtgccaagtcctccccaaatgtgcaccaagaccaggccgctggctctagccgcctcctgagcctcatgctagcgcccagcgtggcagccctggccctcctgtccctttgccgtctgtgcccacccaccctgtcccgcgcccccgcccactcctccatggcgttcgctccccacacccttctctgtcgaggaccttgctcccattcatctaaaccasgctctcgaagcccacctctagctgcatgttctggggctgggagggcaggcacacgcgtgtgagccaggtccatgcacacgtgaacacacgtatgccttagagcacctgcctcacctcggctgcccggtggcagcgccttggccctcacacagaaaacaccagggagtctgtgcagcgtgtttgccgtggcctggggtgccagggccgccttctgagttttcatacagcacctgggggagcttgaccctctgcagggctgagggccacgtctgcccatgccccccagccagtgcctagaag

SEQ ID NO: 45836 - DNA, 601 bp, Human
aggatgaagccgatgggtgtgcttgcccacagcgggttcctcaggggactgctggaaaggtgagtgtcagctctgccgagggtgtgaggacagggcgaaggcccttgagaagttcagggagagcttcccaggcaggtgcaaaggtgtggagcgcaaggcaagtttgatgtggctggaggtggccacaatgaggaaggcggtggagggtgtggcctggagatggagaagaggtcacaaggtcccaaaatggccgtggtcgaatcctctggcttgaccagtggcatgggaggagtgggtgatkagggtgatgggatgcaggttttggtaactggggggacagtggggcacccactgggcacaggaggactgggtgcataggcaggaagctggccgtggacttgctgaacttatgcgaggggtgaacaaggaaaggcccgggaggcagttgcacctctgggtcttgccctggaggcagagcctgtcactggcgccacagccccgggacggggcctcctggggagcatgtggtgtgtgaggagctggggaggaagaggacaggagagcaagatggcttggaagcccagggaacgagcagcaaggc

SEQ ID NO: 45837 - DNA, 601 bp, Human
tcatgggggagacaggaggttgccacctgcaggatgggcaccaatgcccctgtctaccctaggcccgcccccggctggtttcagagacatcctgctgcgagaggggcctgagggctttgctcgagctgtgcggaaccacccggggctgctgctgatggacacgaccttcagggacgcccaccagtcactgctggccactcgtgtgcgcacccacgatctcaaaaagatcgccccctatgttgcccacaacttcagcaagctcttcagcatggagaactggggaggtaggctggcatgctgygcagcgcctggtaggaatgggcgcccgctctgtggccagtcccacaggcttaggccactggggacaagctagagacgctgacacgaagaacaccaaagaggaaggaccgaagaaggcacagcgccctctccggccaggcctggtgccggcacgaggttgcagagctgagaccaggtgcatcctgggaggtccagggtcaggaggagacacctgcctgttaattatagcacagagaggtagaggagaagatgggattataaagggggcatagaagggacacaaatgagcctggtctccccc

SEQ ID NO: 45838 - DNA, 601 bp, Human; identical to SEQ ID NO: 45816

SEQ ID NO: 45839 - DNA, 601 bp, Human; identical to SEQ ID NO: 45817

SEQ ID NO: 45840 - DNA, 601 bp, Human; identical to SEQ ID NO: 45818

SEQ ID NO: 45841 - DNA, 601 bp, Human; identical to SEQ ID NO: 45819

SEQ ID NO: 45842 - DNA, 601 bp, Human; identical to SEQ ID NO: 45820

SEQ ID NO: 45843 - DNA, 601 bp, Human; identical to SEQ ID NO: 45821

SEQ ID NO: 45844 - DNA, 601 bp, Human; identical to SEQ ID NO: 45822

SEQ ID NO: 45845 - DNA, 601 bp, Human; identical to SEQ ID NO: 45823

SEQ ID NO: 45846 - DNA, 601 bp, Human; identical to SEQ ID NO: 45824

SEQ ID NO: 45847 - DNA, 601 bp, Human; identical to SEQ ID NO: 45825

SEQ ID NO: 45848 - DNA, 601 bp, Human; identical to SEQ ID NO: 45826

SEQ ID NO: 45849 - DNA, 601 bp, Human; identical to SEQ ID NO: 45827

SEQ ID NO: 45850 - DNA, 601 bp, Human; identical to SEQ ID NO: 45828

SEQ ID NO: 45851 - DNA, 601 bp, Human; identical to SEQ ID NO: 45829

SEQ ID NO: 45852 - DNA, 601 bp, Human; identical to SEQ ID NO: 45830

SEQ ID NO: 45853 - DNA, 601 bp, Human; identical to SEQ ID NO: 45831

SEQ ID NO: 45854 - DNA, 601 bp, Human; identical to SEQ ID NO: 45832

SEQ ID NO: 45855 - DNA, 601 bp, Human; identical to SEQ ID NO: 45833

SEQ ID NO: 45856 - DNA, 601 bp, Human; identical to SEQ ID NO: 45834

SEQ ID NO: 45857 - DNA, 601 bp, Human; identical to SEQ ID NO: 45835

SEQ ID NO: 45858 - DNA, 601 bp, Human; identical to SEQ ID NO: 45836

SEQ ID NO: 45859 - DNA, 601 bp, Human; identical to SEQ ID NO: 45837

SEQ ID NO: 45860 - DNA, 601 bp, Human
gacagttttagtcttgttgcccaggctggagtgcagtggcgtgatctcagctcactgcaacctctgcctcccagattcaagtgattctcctgccacagcctcccaagtagctggaatgatacaccatgcgccaccacacctggctaatttttgtatttttagtagagatggggattcttcatgttggtcaggctggtctcaaactgcgacctcagatgatctgcctgcctcggccttctaaagtgctgggattacaggcgtgagccaccatgcctggactgtaggtcacctctgtgtccartctgccagaggtcagggatacgttgccgtctaggattttttatattggagaccagtctgatgagtagcccttgagcagggactggattctaagtcttggagaaaatgagtaagttctacctcttatgtgaggtatgattgaagaaattgtgttttctttgttttttgagaggcagggtcttgccctgttgcctacctggagtgtggtggcataatcatagctcacttcagtcttgacctcctagggtcaagcaatcctcccacctcagcctcctgagtagctgggactactagcacgtgc

SEQ ID NO: 45861 - DNA, 601 bp, Human
gatggggattcttcatgttggtcaggctggtctcaaactgcgacctcagatgatctgcctgcctcggccttctaaagtgctgggattacaggcgtgagccaccatgcctggactgtaggtcacctctgtgtccagtctgccagaggtcagggatacgttgccgtctaggattttttatattggagaccagtctgatgagtagcccttgagcagggactggattctaagtcttggagaaaatgagtaagttctacctcttatgtgaggtatgattgaagaaattgtgttttctttgttttttgagaggcagggtcttgccctgttgcctacctggagtgtggtggcataatcatagctcacttcagtcttgacctcctagggtcaagcaatcctcccacctcagcctcctgagtagctgggactactagcacgtgccactgtgcccagctaatttttaaatttttttgtagcgatgtggtcttggctatgttgcccaggctggatcctcctgcctcagcctcccaaagtgttgggattacaggcgtgagccaccacacccggcccagaagtgtcttatatttttagacttttgagcagtgtt

SEQ ID NO: 45862 - DNA, 601 bp, Human
ccagaggtcagggatacgttgccgtctaggattttttatattggagaccagtctgatgagtagcccttgagcagggactggattctaagtcttggagaaaatgagtaagttctacctcttatgtgaggtatgattgaagaaattgtgttttctttgttttttgagaggcagggtcttgccctgttgcctacctggagtgtggtggcataatcatagctcacttcagtcttgacctcctagggtcaagcaatcctcccacctcagcctcctgagtagctgggactactagcacgtgccactrtgcccagctaatttttaaatttttttgtagcgatgtggtcttggctatgttgcccaggctggatcctcctgcctcagcctcccaaagtgttgggattacaggcgtgagccaccacacccggcccagaagtgtcttatatttttagacttttgagcagtgttggaacgattgaattgcctgagtggagaaatttggtaggaagagagtagaagagaggctctttattaaagacctaaaaatagaattcattaaagtcacaaatagataacagtaggattcctgtctaactctctcctgctt

SEQ ID NO: 45863 - DNA, 601 bp, Human
gtgctttttccaattttaaaagtagttagaaagtgaccagattctttcatgtaggggagaaatcttagcaggagacgttggttcttctgcttgtagtgccagccctaacctgacaggtcctgtggggacccctgtctcttcagagccctgagcctttttcccttctagttggactttgctgactagagagggatatcctatgtaggccacctgattacctgatttaatcagatggtacctctgttattttggagaagagagtctccttttgattctaatagctgaagataaaaatggctcygtatgctttcttcctgtggagggctctgctgccctgagctgcctgtgccctttacatctgtgtgagggggtggaggaatgtcctggcctcctcacttccatcctgctatgggcttccaggaagaatggggtccattgtgggctgtacccaaaggcacagtcctctgcctcagtgtcaggcttactgtggtctctgtgcccagtttgctgtggtcactgggtgccaaggggttgggagctcaagaagccattgctgcttttttttttttttttgagacggagtcttgctcttgtcacccag

SEQ ID NO: 45864 - DNA, 601 bp, Human
ttttgagacggagtcttgctcttgtcacccagcctggagtgcaatggcacgatctctgctcactgcaacctccgcctcccaggttcaagcaattctcctgcctcagcctcccgagtagctgggattacagatgcgcgccaccacattgggctaatttttgtatttttattgttattattttattttattttatttgagacggagtctcgctctgtcgcccaggctggagtgcagtagcttaatctcggctcactgcaagctccgcctcccgggttcatgccattctcctgcctcagcctcyggagtagctgggactacaggcatctgccaccacgcctggctaatttttttgtatttttagtagagatggggtttcaccgtggtcttgatctcctgacctcgtgatctgcccgcctcaggctcccaaagtgctgggattacaggcgtgagccaccgcacccggccaaggacggagtgttgttctgtcgcccaggctggagtgcagtggtgcgatcttggctcactgcaaccttttggagacaaaaggcctttgttgtgtctggcctttatctttgttgtaatgaccctgaaaccgtggcct

SEQ ID NO: 45865 - DNA, 601 bp, Human
ttacaggtgtgaaccaccatgcccagcctgttttcttgttttgaatccaagctttctgagggttgtcctttaggaggagaatgtaaggaattccagagtcagggaggcatgggctgtgctctgggagaggcctggggaggcactgctctggaactgcctgtaggagtggtgtcagactgccagcagaagccagggtggtgaggggagggctgaatgttctgcaagagagatttataccactattttctttttcttttatttatttatttatttatttatttatttatttatttatttattatttgagacggagtcttgctctgtcgcccagactggagtgcagtggtactatctcggctcactgcaagctccgcctcccaggttcacgccattctcctgcctcagcctccctggtagctgggactataggcgcatgccaccacgcccggctaattttttgtatttttagtagagacagggtttcaccgtgttagccaggatggtctcgatctcctgaccttgtgatcctcccgcctcagtatcccgaagtgctgggattacaggcgtgagccaccgcgcccggccctttttcttttttttg

SEQ ID NO: 45866 - DNA, 601 bp, Human
caggtgtgaaccaccatgcccagcctgttttcttgttttgaatccaagctttctgagggttgtcctttaggaggagaatgtaaggaattccagagtcagggaggcatgggctgtgctctgggagaggcctggggaggcactgctctggaactgcctgtaggagtggtgtcagactgccagcagaagccagggtggtgaggggagggctgaatgttctgcaagagagatttataccactattttctttttcttttatttatttatttatttatttatttatttatttatttatttattttttgagacggagtcttgctctgtcgcccagactggagtgcagtggtactatctcggctcactgcaagctccgcctcccaggttcacgccattctcctgcctcagcctccctggtagctgggactataggcgcatgccaccacgcccggctaattttttgtatttttagtagagacagggtttcaccgtgttagccaggatggtctcgatctcctgaccttgtgatcctcccgcctcagtatcccgaagtgctgggattacaggcgtgagccaccgcgcccggccctttttcttttttttgaga

SEQ ID NO: 45867 - DNA, 601 bp, Human
tctcgatctcctgaccttgtgatcctcccgcctcagtatcccgaagtgctgggattacaggcgtgagccaccgcgcccggccctttttcttttttttgagacagagtctcactctggagtgtagtggcatgatctcggctcactgcaagctccacctcgtgggttcaagtgattctcctaactcagcctcccaagtagctgggattacaggtgtgcatcaccacgcctggctaatttttatatttttagtagagacagggtttcaccctgttggccaggctggtctcgaactcctgacctygggtgatctgcccacctcagcctcccaaagtgttgggattacaggcgtgagacactgcgctcagccggatatgaatattcttgacggtgtcttctgggtatatacctaagagtgaactgttagatatatagtatttgattttttttgtttgttttgttttgctttgtttttgagattcagtctcgctctgttgcccaggctggagtgcagtggtgtgatcttggctcactggatcctctgcctcccaggttgaagtgattttcctgtctcagcctaaccagtagctgggattacaggcgt

SEQ ID NO: 45868 - DNA, 601 bp, Human
ccaccgcgcccggccctttttcttttttttgagacagagtctcactctggagtgtagtggcatgatctcggctcactgcaagctccacctcgtgggttcaagtgattctcctaactcagcctcccaagtagctgggattacaggtgtgcatcaccacgcctggctaatttttatatttttagtagagacagggtttcaccctgttggccaggctggtctcgaactcctgacctcgggtgatctgcccacctcagcctcccaaagtgttgggattacaggcgtgagacactgcgctcagcckgatatgaatattcttgacggtgtcttctgggtatatacctaagagtgaactgttagatatatagtatttgattttttttgtttgttttgttttgctttgtttttgagattcagtctcgctctgttgcccaggctggagtgcagtggtgtgatcttggctcactggatcctctgcctcccaggttgaagtgattttcctgtctcagcctaaccagtagctgggattacaggcgtgtgccatgcctggctaatttttgtatttttagtagtaatggggtttctctgtgttgcccagactgat

SEQ ID NO: 45869 - DNA, 601 bp, Human
tgtttcaaactgccccacctccttcctcttccatcttatgttattaatgaaagagtttgacaatacttaaatgttagtgaaaataagagaaaagtcgtttgtatctttaggtgagggtgtaaattgaaggacattttgccaaatctaacaattccaatgtacatatcctttgacccagcaattccacatctaggattatatccttagatatgttctaagaagaatgcaaggatgagtgtgagaacaccctggagagcaagatatgcaagatacttagacatttagatgtgccacacacaayaggtgtgaatgagaagaaggatctacccactggggctgaggtctctcagttctgctaaattagaaaaaggaacggttatttatttttttttttttgatagggattctcattctgtctcccatgctggagtgcagtggcgcggtcttggctcactgaaacctttgcttcccagggtcaagcgattcccctgcctcagcttcctgagtagctgggattacaggtgcgtgccactatgaccatctaattttttatatttttaatagagacggggtttcaccatgttggccaggctggccttga

SEQ ID NO: 45870 - DNA, 601 bp, Human
tcaaactgccccacctccttcctcttccatcttatgttattaatgaaagagtttgacaatacttaaatgttagtgaaaataagagaaaagtcgtttgtatctttaggtgagggtgtaaattgaaggacattttgccaaatctaacaattccaatgtacatatcctttgacccagcaattccacatctaggattatatccttagatatgttctaagaagaatgcaaggatgagtgtgagaacaccctggagagcaagatatgcaagatacttagacatttagatgtgccacacacaataggkgtgaatgagaagaaggatctacccactggggctgaggtctctcagttctgctaaattagaaaaaggaacggttatttatttttttttttttgatagggattctcattctgtctcccatgctggagtgcagtggcgcggtcttggctcactgaaacctttgcttcccagggtcaagcgattcccctgcctcagcttcctgagtagctgggattacaggtgcgtgccactatgaccatctaattttttatatttttaatagagacggggtttcaccatgttggccaggctggccttgaactc

SEQ ID NO: 45871 - DNA, 601 bp, Human
gagaaaagtcgtttgtatctttaggtgagggtgtaaattgaaggacattttgccaaatctaacaattccaatgtacatatcctttgacccagcaattccacatctaggattatatccttagatatgttctaagaagaatgcaaggatgagtgtgagaacaccctggagagcaagatatgcaagatacttagacatttagatgtgccacacacaataggtgtgaatgagaagaaggatctacccactggggctgaggtctctcagttctgctaaattagaaaaaggaacggttatttatttwtttttttttgatagggattctcattctgtctcccatgctggagtgcagtggcgcggtcttggctcactgaaacctttgcttcccagggtcaagcgattcccctgcctcagcttcctgagtagctgggattacaggtgcgtgccactatgaccatctaattttttatatttttaatagagacggggtttcaccatgttggccaggctggccttgaactcctgaccttatgatctgcttgccaggtgtgagccactgtgcccggcaaaaaaggaacagttttgaagaatttgatttcatttg

SEQ ID NO: 45872 - DNA, 601 bp, Human
tctctcagttctgctaaattagaaaaaggaacggttatttatttttttttttttgatagggattctcattctgtctcccatgctggagtgcagtggcgcggtcttggctcactgaaacctttgcttcccagggtcaagcgattcccctgcctcagcttcctgagtagctgggattacaggtgcgtgccactatgaccatctaattttttatatttttaatagagacggggtttcaccatgttggccaggctggccttgaactcctgaccttatgatctgcttgccaggtgtgagccactgygcccggcaaaaaaggaacagttttgaagaatttgatttcatttgaactttaagaatgaaattaaaagagatgtgcttgtttatgtgtttagagatatacattcaatgtgtcatttgtggagagctactgaagaaactcagtctgctcacctgaggacctgggaaggagacctgcttttcatttgtgtcctagtgtggtgttggaatttattttacctccatgtgaattaccttttttttttttttgagacacagttttgctcttgttgcccaggctggagtgcaatggcgtgatcttggc

SEQ ID NO: 45873 - DNA, 601 bp, Human
atatttggagctcaaataaacaatgacttcacaccactgttttccactgtgttgagtacatcctgttggccatgatattgagcagttttaaactggttaacctttcagaaactttatattaatgttggactgacagttaatatttaacttgtcaaagtgatttttgctagattgaacctgaagtggttaatatttctgctttttatgttttccaaaaccatttaaaataggaacatggtattttattattttaatctggtttcaaaatgaatatcccattttctttattattattattattaattaattttttttttttgagataggttcttgctgtgtcacccaggctggagtgcagtgttgtaatctcactgcaatctcaccatcctgggttcaagcagttcattcacctcagcctcccaagtagctgtgattacaggcatgcgccaccatgcctggctgaactttgtacttttttgtagaaacagggttttgccacgttgcccaggctggtcttgaagtcctcagctcaagcaatctgcccacctcggcctcccagagtactgggattctaggtgtgtgccactgcacctggccattc

SEQ ID NO: 45874 - DNA, 601 bp, Human
ggtattattgataacttgacattttacttcttcttctttttttttttttttgagacagaatcttgctctgtcgcccagtctggagtgcactggtgtgatcttggctcactgtagcctccgcttcccgggttcaagcaattttcctgtctcagccctcccgagtagctgggattataggtgtccgccaccatgcccgactaatttttgtatttttagtagagatggggtttcaccatgttggccgggctggtcttgaactcctgacctcgtgatctgcccgcctcagcctccaaagtgctgrtattacaggcgtgagccactgcacctacctggcctgacattttacttctgcccatcacttgagagtcccacatatcacaactgggaggaagggagtgcctggtcattggcagatgcgagccacttactggccctaccccaactagctctggttcttctggctgagggtgtttatctgcagtgagtctcagggtctggggtctggggcagtgctgagagcttagactcagttgtgggtactgcactgggtgctggcacagaggaataaggttcccattcccactactcgaaaaagagcttc

SEQ ID NO: 45875 - DNA, 601 bp, Human
ggttcaagcaattttcctgtctcagccctcccgagtagctgggattataggtgtccgccaccatgcccgactaatttttgtatttttagtagagatggggtttcaccatgttggccgggctggtcttgaactcctgacctcgtgatctgcccgcctcagcctccaaagtgctggtattacaggcgtgagccactgcacctacctggcctgacattttacttctgcccatcacttgagagtcccacatatcacaactgggaggaagggagtgcctggtcattggcagatgcgagccacttastggccctaccccaactagctctggttcttctggctgagggtgtttatctgcagtgagtctcagggtctggggtctggggcagtgctgagagcttagactcagttgtgggtactgcactgggtgctggcacagaggaataaggttcccattcccactactcgaaaaagagcttctgtagctcctgtcagccagtggtgaatccagctaagacatgttcttgggctgccttgagcacttcctactctcttttagaggatataatgtgaatgagtgtgaggtgttaaattgggtagctgtgtc

SEQ ID NO: 45876 - DNA, 601 bp, Human
tccttagagcatggaaaaccaacacatagtagttggagttgtgccctgaacatcgcctgcctgctaaatgcagagcacttagtcatgcccatgaaacagacaccccatgtcgtcatgtgtccgcagatagcagacagcttaagttcctggtagggcagggtgtgtctcataactgactgtttttaaataagctgagaattttaaaattgagaatgagattggaatagtgaaagatcagctggatctaataagtgaagtaaagactaaagatgatgggaagaacctgaaaaaaaggtcctgygtctccccattcattcattaggtgtatggtgtatgtctggcactggatgagtgctgggcacatattagtgattgcaacagatgtatccctgctctcccacaacttatagtcttgtgggggtgttggttgagctgagccatttactaaattagaattaaaatgcgtctgggcatggtggctcatacctgtaatcccagcactttgggaggccgaggtgggcagatcacccgaggtcaggagttcaagaccagcctggccaacatggcgaaactctgtctccactaaaaaatacaaaaatta

SEQ ID NO: 45877 - DNA, 601 bp, Human
acagcttaagttcctggtagggcagggtgtgtctcataactgactgtttttaaataagctgagaattttaaaattgagaatgagattggaatagtgaaagatcagctggatctaataagtgaagtaaagactaaagatgatgggaagaacctgaaaaaaaggtcctgtgtctccccattcattcattaggtgtatggtgtatgtctggcactggatgagtgctgggcacatattagtgattgcaacagatgtatccctgctctcccacaacttatagtcttgtgggggtgttggttgagcygagccatttactaaattagaattaaaatgcgtctgggcatggtggctcatacctgtaatcccagcactttgggaggccgaggtgggcagatcacccgaggtcaggagttcaagaccagcctggccaacatggcgaaactctgtctccactaaaaaatacaaaaattagccaagcgtggtggcaggtgcttgtagtcccagctacttgggaggctgaggcagggagaattgcttgaacccgggaggcagaggttgcagtgagccgagatcatgccactgtactccagcccgggtgacagag

SEQ ID NO: 45878 - DNA, 601 bp, Human
cagtaaatcccatttccagtttacatgcaaaattcctcaattacccctttgggagctggactcatgggtttttttaaaaagtaaatccagaatccagtcaagagatacacattgtctgggcaagattgcttacctttctaatcctgggagactgaggtgagaggatcacttgaggccaagagtttgaggccagcctgggcagcatagtgggacactgtctgtacaaaagatttttaaaaactagctgagtggagtggtgtgcacctgaagtcccagctatttacttgagcccaggagttcmaggttacattgagctatgaacatgacactgtactctatcctgggccacagagcaagaaccttctctgtccccactcccctacccctagaaagatacacacatcaagtctggttgctgtctctaaatcgagaacagtcatcttatgtttagggatgtcagcatttggagagaccaggccagttgtttggcagaagatcccacattctagatttgtgtgattttctttgcatagctcccatatttcctgtaaattggaagttaggtctaaagcagtgccacccaacagaaatataacatgag

SEQ ID NO: 45879 - DNA, 601 bp, Human
agttggctcattcatggctggcaagttgatgctgcctgttgacagggagcttagctggggctgttggtcagtgtccttgattcctcttcatgtagacctctccatgggctgcttaggtgtcctcaaagcacgatagatggattttaagattaggtatttcgagaaataggaaaggaagctgcccaatctcttaaggcccagaacttgcccaacaacacttccattttactccattggtcaaagcacatatagactctgatgggtgtttaccagcttgcccccgtgacccgtaagccccagscttctagattagaaatggccacaagttctatgccactctttccttgcagaggtgagtctgtgcccttttccctgaatctgggtggacctccccttcagcctgctcccttcttgtgttcgcctccttttccctgttggtcaccttctttttaagccgtggcttgttctcagagtgaccttgtggtctctggggcaaccgtatttctgaagatcttggcccatgtagcagctcacatgtagcagttcacagagctcttcctagtttgcagagtgtttgcataaagtttccttgtcatctttg

SEQ ID NO: 45880 - DNA, 601 bp, Human
atagctgggactacaggcatgcgccaccacacccggctagggtttcaccatattggccagactggtctcaaactcctgacctcgtgatccgcccaccttggcctcccaaagtgctggggttacaggggtgagccaccttgcccagcccacgttttgtatttttagtagagatggggtttcaccatgttggccaggctggtatcaaactcctgacctcaggtgatctgcctgcctcggcctcccaacgtgctgggattacaggaatgagccactgtcccgggcctattttttttttttttttaacatttttcattcactgtagcttgagtatttttttacctgtagtcattaaatgttatgtgggaatgtaacttttaatggctgcctaatattcttgtgttgttttttttttttttttgagacagggtcttgctctgttgcccaggctggagtgcagtggcactatcatggctcactgcagcctccacctcctagcttaagcaatcctctcacctcagccttccaagtaactgggactataggtgtgggccaccacacccaggtaatttttaaatttttttgtagagatgggtctcacttt

SEQ ID NO: 45881 - DNA, 601 bp, Human
catccctgcttccctttagccttcttgcctgcagacaatgtggaccttccctcagcccaagatgttggcaggctgggagcagcccttcctgggactgtgctctcagctgctggcacgggcccccaattgttcccctgagaacaatgggcactctctttggctaggaaggggagttcatgaaaggagcatttctttggatgcttgagagctttgtggcagccccgcctgtgtgagatgagctgcagtttcttcctgccttgagtgggtgttccgcatttctgaatggaccccttgtgaacaragcacaccgggaaatgcgggttggcgatggaaggcatccttgggggtgggctgtcagaatggcatttgcccagattcatcaactcaaatacttagtgaaaatataggcttctatgtttaaaaaaatcactgacaaagactgaaagagaacatgacaaagtaaaatagatgatgtcagggctccagattgaaggactgattctgaggattttattagtggctctaactatgttaagctgccctttacttttttggggaaaaagactaatttttgcttttagatgagaacagtgaacatgag

SEQ ID NO: 45882 - DNA, 601 bp, Human
ccttccctcagcccaagatgttggcaggctgggagcagcccttcctgggactgtgctctcagctgctggcacgggcccccaattgttcccctgagaacaatgggcactctctttggctaggaaggggagttcatgaaaggagcatttctttggatgcttgagagctttgtggcagccccgcctgtgtgagatgagctgcagtttcttcctgccttgagtgggtgttccgcatttctgaatggaccccttgtgaacaaagcacaccgggaaatgcgggttggcgatggaaggcatccttggkggtgggctgtcagaatggcatttgcccagattcatcaactcaaatacttagtgaaaatataggcttctatgtttaaaaaaatcactgacaaagactgaaagagaacatgacaaagtaaaatagatgatgtcagggctccagattgaaggactgattctgaggattttattagtggctctaactatgttaagctgccctttacttttttggggaaaaagactaatttttgcttttagatgagaacagtgaacatgagataaaatgctttgtagctcagaccagaagggcattgactgggct

SEQ ID NO: 45883 - DNA, 601 bp, Human
ggtttcataagccaattataattatttggccctagagagagcctaattcttcagttttgtttttcagctatgcataactgactcagactatgggtggaaacctgcttttatgagaactaagtaatagaagctcctccagccatttgctctttcttcaggtgtggaatggtactggcttggggtgagagactttgcttgagtttcatggtgtttttttttgttttgtttttttgtttgtttttgttgttgttgttttttgagacagagtctcgctctttgcccaggctggagtgcagtggcrcgatctcggctcactgcaagctccgcctcctgggttcacgccattttcctgcctcagcctcccaagtagctgggactacaggcacccgccaccacacctggctaattttttttgtatttttagtagagacggggtttcaccgtgttagccaggatggtctcgatctcctgacctcgtgatccacccgcctcagcctcccaaagtgctgggattacaggcgtgagccactgcgcccggccgtctttgtttttttgagacaggtcttgctctgtcacccaggccaaggtgcggtggcgcaat

SEQ ID NO: 45884 - DNA, 601 bp, Human
gtttttcagctatgcataactgactcagactatgggtggaaacctgcttttatgagaactaagtaatagaagctcctccagccatttgctctttcttcaggtgtggaatggtactggcttggggtgagagactttgcttgagtttcatggtgtttttttttgttttgtttttttgtttgtttttgttgttgttgttttttgagacagagtctcgctctttgcccaggctggagtgcagtggcgcgatctcggctcactgcaagctccgcctcctgggttcacgccattttcctgcctcagyctcccaagtagctgggactacaggcacccgccaccacacctggctaattttttttgtatttttagtagagacggggtttcaccgtgttagccaggatggtctcgatctcctgacctcgtgatccacccgcctcagcctcccaaagtgctgggattacaggcgtgagccactgcgcccggccgtctttgtttttttgagacaggtcttgctctgtcacccaggccaaggtgcggtggcgcaatcatagctcactgcagccttgacttccccaggctcaagcaggcttcccacctcagcctc

SEQ ID NO: 45885 - DNA, 601 bp, Human
gctggagggagtgtcccagagactgaggagtgaccaaaatgttcaaatttggcagttccctggtcattggtcatggtgatttattgtgggcatcacagttttagacctttgtttttttttttgagatggagtctcgctctgtcgcccaggctggagtgcggtggcacgatcttggctcactgcaatctccacctcccgggttcaagcaattctcctgcttcagcctcctaagtagctgggattacaggtgcgcaccaacatgcccggctaattttctttttactttattttatttttttttgagacaaagtctcactcttgtcccccaggctggagtgcaatggtgtgatctcggctcactgcaacttccgcctcccgggttcaagcaattctcctgcctcagcctcccaagtagctgggattacaggtgcctgccaccacacccagctaatttttttgtatttttagtagagatggggtttcaccatgttggccaggctggtcttgaactcctgacctcaggtgatccgctcacctcagcctcccaaactgctgggattacaggcgtgagccactgcgcctggcttttttttgtattttt

SEQ ID NO: 45886 - DNA, 601 bp, Human
gggagtgtcccagagactgaggagtgaccaaaatgttcaaatttggcagttccctggtcattggtcatggtgatttattgtgggcatcacagttttagacctttgtttttttttttgagatggagtctcgctctgtcgcccaggctggagtgcggtggcacgatcttggctcactgcaatctccacctcccgggttcaagcaattctcctgcttcagcctcctaagtagctgggattacaggtgcgcaccaacatgcccggctaattttctttttactttattttatttttttttgagacraagtctcactcttgtcccccaggctggagtgcaatggtgtgatctcggctcactgcaacttccgcctcccgggttcaagcaattctcctgcctcagcctcccaagtagctgggattacaggtgcctgccaccacacccagctaatttttttgtatttttagtagagatggggtttcaccatgttggccaggctggtcttgaactcctgacctcaggtgatccgctcacctcagcctcccaaactgctgggattacaggcgtgagccactgcgcctggcttttttttgtatttttagtaga

SEQ ID NO: 45887 - DNA, 601 bp, Human
ctgggactacaggtgcctgccaccacatccgactaatttttgtacttttagtagagatggggtttcgccgtgttggccaggctggtctcgaactcctgacctcaggtgatctgcccaccttggcctcccaaagtgctgggattacaggggtgagccaccatgcctggcccaataataataattcctaacaatgtcagtaatctcatggttaaaaaaaattttttttttgaaatagagatgggggtctcactgtgttggccagggtggtctctaatgcctgctggcctcaagcaatcctccygccttggcctcccaaagtactgggattataggtatgagctaccatgcccagctttctcatacatttttgctgggtgtaggaaacctgtttaaattagtttaaaggggggaaattatctagtttctgataaggctgctgcctggacacctgggtacaagcctggggtctcctttccaaatcactcaagtactttgttttttggcaggaggaagcccagggaaccagaggcactggggaatccagcagtcagtggctttagctttcctgccacagggagggggaagcattttagggtccccc

SEQ ID NO: 45888 - DNA, 601 bp, Human; identical to SEQ ID NO: 29968

SEQ ID NO: 45889 - DNA, 601 bp, Human; identical to SEQ ID NO: 29967

SEQ ID NO: 45890 - DNA, 601 bp, Human; identical to SEQ ID NO: 29966

SEQ ID NO: 45891 - DNA, 601 bp, Human; identical to SEQ ID NO: 19334

SEQ ID NO: 45892 - DNA, 601 bp, Human; identical to SEQ ID NO: 19335

SEQ ID NO: 45893 - DNA, 601 bp, Human; identical to SEQ ID NO: 19336

SEQ ID NO: 45894 - DNA, 601 bp, Human; identical to SEQ ID NO: 19337

SEQ ID NO: 45895 - DNA, 601 bp, Human; identical to SEQ ID NO: 19338

SEQ ID NO: 45896 - DNA, 601 bp, Human
catcacgggaactccggggctataaaagacctggttgctattttatactcccggagtcactcatcccttaagcaagcagggtggggttaggtgcgcgtgcgcggttttaatactcctccccgaactgccaactcttcacgcacgcgaagtaggccccaccctggctgggtttacgcgtgcgcactaacgggcctggtcccggaagaccacacgcgtgcgtggtggggactacggtgacagtaccccgggtggggcgagggccagtcatggcggagtcctggtctgggcaggccttgcaggytctgccggccacggtgctgggcgcgctgggcagcgagttcttgcgggagtgggaggcgcaggacatgcgcgtgaccctcttcaagctgctgctgctgtggttggtgttaagtctcctgggcatccagctggcgtgggggttctacgggaatacagtgaccgggttgtatcaccgtccaggtgaggcttcctacgaacctccgtgggctggccgcccccgcccccaccctctcccgactgtaccattgggttccccactatcctgcaagaggctcatcagaacttaacattggttcacggc

SEQ ID NO: 45897 - DNA, 601 bp, Human
cactatcctgcaagaggctcatcagaacttaacattggttcacggccttactaccctgaacgcatctgacctcggaagctaagccaggtacttggatgggagaacttaacgttgtgccctgactcatgccaccataccattttacgccagaatccccaccagtccacccatcacattgtatctgttcctcagaactctcacctggcaataccattagtcccttaggaccctcaccagacttcaccaaacaataccagtggtctctaacctgacctgggctgatgcctgctcagattcccaycccagccttctgcagctctggatgtgtttctgcctccaggtctgggtggtcagaatggatccacgcctgatggctccacgcatttcccttcgtggtgagtaaatctgtccataccgcaaccccatgcttggcattccaaggacactcctgtgctggtgacagagaggggagttctcaggctttaagcccaccagcttaatggcctttgcagcaagcttcaagtctgcacgtagagctcaggcttcaagttagggtgacaccaaggtctggacagtccatcatcatgctgttcagcagcct

SEQ ID NO: 45898 - DNA, 601 bp, Human
tgccatgtcacaataggccaggggagtttccaaagatgtgggtggcaaatgcccctatagaaacaccagtacctgaaagcactgtagccctggacctgcctccttccctcggggccatacttctgtttccatctgctgggccaccagccactttagtgacccctgcctacttccttcctgttggatatcatacttccatctggctgcctttgcttaagccatctttgtggtagaggggccctggaattgcagctgtactgaggatgatgttattcacagcccctggcccacccactaataytactgcacagagtcaggatctcacatttcaccccaggctcaactgaggatgtggcttattaaacacggaagtgcatcggttgttgtggttattcagacagaacaagggtgtgcatgcacaggggcagtgagagagggaacatcctggaagctgttgccccttgggacccagatgcaataacttgcagggaggggagaggtgatgcagctccctggaggagcagggatggggtgcccaacaggggcaatatctccatttttatagactggcccctttcaaggagaacctattccaagcttg

SEQ ID NO: 45899 - DNA, 601 bp, Human
aacagccaatcacctgcggtcaggagttcatgaccagcctggccaacgtagtgaaaccccatttctactaaaaatacaaaaatcagccaggtgtggtggcatattcccgtaatcccagctactggggaggctgaggcaggagaatcctttaaacctgggggaaggctgggcacagtggctcactcctgtaatcccagcactttgggaggctgaggtgggtggatcacccgaggtcaggagtttgagaccagcctggtgaaaccccatctctactaaacgaaaaatgagctcagcatggtgrcaacatgcctgtaatccctgctatttgggaggctgaggcaggagaatcacttgaacctgggaggcagaggttgcagtgagccaagaccgagccactgcactctagcctgggcaacagaatgagactccgtctccaaaaaaaaaaaaagaacaaacttggactaagatggcaggatgagaatggattcttctttccaacatttttgttatatggtatactgaagaggcaaaaagctctaattctctacatgctccataaatattctaacatggaaaatggcatcagttgttatgaaaagta

SEQ ID NO: 45900 - DNA, 601 bp, Human
gcacatacctacagtgccagctatttgggaggctgaggtggaaggatcacttgagcccaagagttcaaggctgcatgatcatgtcacagcactgcaggcctgggagacaaagtacaatccctgtctctttatttaagagaaaaaaaaaaaagtatgagaggccaagcaaagcattacttagacaacaaaaggaagcagaagattaaaaaaaaaaacaaaaacaaaccaaaaccaaaattaaaacccaaaaaaaccctccaatttcacaagagctttgttccagtcttgccagagggctttyaggacagaaatggggaagcactgttctcaccatcaatgacaataaaataaaacaactgtggcaggctattttatgttaaagtaaaaaaaaatcttttggccgggcacagtggctcatgcctgtaatcccagcactttgggaggccgagacgggcagatcacaagatcaggagatcgagaccatcctggctaacacggtgaaaccccgtctctactaaaaatacaaaaaattagccagtctggtggtggacacctgtagtcccagctacttgggaggatgaggcaggagaacagcgtgaac

SEQ ID NO: 45901 - DNA, 601 bp, Human
acaatcttgtatggttccctaggctgtactattgcctactgtttttttttttttttgagacagagtttcgcccttgtcgcccaggcttgagtgcagtggcgcagtctcagttcactgcaacctctgcctcccaggttcaagtcattctcctgcctcagcctcccaagtagctgggattacaagtgcctgccaccacgcccagctaattttttgtatttttagtagagattgggttttgccatgttgggcaggctggtctcaaactcctgacctctggtgatcctcctgcctcagcctcccraagtgctggattacaggtgtgagctaccacgtctggccttatactattgcatactgttaaatgaatattcctacacagtaccctctcccatcttggggactcttgagttgctctgaggcaggcaggtagcctgtaatatgctcttcaatcaaacacttttattccaggggactctcctcaagtgagaacctccccctatcttgcgagggtcagtgatgtccaaggtttgcagcacaagaaaaatactcacagaccatgcctcaaggttttaagtcaaggtctctaaatttcttatgggca

SEQ ID NO: 45902 - DNA, 601 bp, Human
cgtggtgaagcatgcctgtaatcccagctactcaggaggctgaggcaggagaatcgcttgaacccaggaggcggaggttgcaatgagtggaggttgcaatgagctgagattgcaccactgcactccagcctggccaacaagagcgaaactccatttaaaaaaaaaaaaaaattagctgactgtggtggtgcacgcctgtagtcccagctacttgggagactgaggtgggaggactgcttgagcccgggaggcggaggttgcagtaagcagagattgtgccactgcactgcagcctaggcastgagaccttgactcaattaggaaaaaaacaaaaaaacaaaacagatactagaactgaaccaagtggcataattcaaaatgtcaagtcaaaaataactctgtagcttataaaagtgtttaattataaataacattctactaggaaagaaagcagacaggagggaagaaatcaaattttaaataacatcctaccaggcatacaggcgagagaggaagatacaagactaagtaaattttctgctataatgtggaaaccatggaaacaaatctgtattttgagttggtaggtaggaaaagacac

SEQ ID NO: 45903 - DNA, 601 bp, Human
gctgaggcgggctgactgcctgagctcaggagttcgagaccagcctgggcaacatggtgaaaccccgtccctactaaaatacgaaagaaattagccaggcacggcagcgtgcgcctgtagtcccagctactggagaggctaaggcaggtgaattgcttgaactcgagaggcaaaggttgcagtgagccaagatcgtgccactgcactccagcactccagcatgggcgacaaagcgagcctccatctctaaaaaaaaaaaaaataaataaaataaaacttagctgagtgtgggctgggtgcrgtggctcacgcctgtaatcccagcactttgggaggccaaggcgggcggatcacctgaagtcggaagttcgagactagcctgacaaatgtggagaaaccccatctctactgaaaatacaaaattagctgggcgtggtgaagcatgcctgtaatcccagctactcaggaggctgaggcaggagaatcgcttgaacccaggaggcggaggttgcaatgagtggaggttgcaatgagctgagattgcaccactgcactccagcctggccaacaagagcgaaactccatttaaaaaaaaaaaaaa

SEQ ID NO: 45904 - DNA, 601 bp, Human
tttcagccacttgatgcccagaaaccagatgccaactagctacacaggcagtgacaaatatcagggtgcagggccactcacctaaactatcagggctgtcgatggaaaaacacatcagtataacatcggtatctgggtaggagaggggcctcaggcgatcataatcttcctgcccagctgtgtcccacaaagccaactctacctgtaatgggaaaaacaaccacaagagtgcaaggttaatccccccacccacttttagaaaaagtgacacttaccatagtacattgaaatggcagaccaytgaaatggcagacggtctaaaacagtaaaacacaggagtatttacattttttcttttttcctttttttttttttttttgagatgtagtcttgctctgtcgcccaggctagagtgcagtggcgcgatctctgctccctgcaagctccgtctcccgggttcacaccattctcctgccttggcctcccaagtagctgggactacaggtgcccgccatcacacccggctaattttttgtatttttagtagagacggggtttcactgtgttagccaggatggtctggatctcctgacctcatgat

SEQ ID NO: 45905 - DNA, 601 bp, Human
ttagtagagacagggattcaccatgttggacaggctggtcttgaactcctgacctcaggatccacccaccttggcctcccaaagtggtgggattacaggtgtgagccacagtgcctggcctagaatagatgttctgttagtaggtgctgtagttatttcctgaatatgtgaaattataccaatagtctacccccttcctggagtttgaggtacatagaatttgaataaattgactgtcgccacttttggtgaataaattttcaaacttttttttttttttttttgagacaagagtctcacyctgtcacctaggctggagtgcagtgatgcgatctcggctcactgcaacctctgcctcccaggttcaagcaattctcctgcctcagcctcctgagtagctgggattacaggtacatgccaccatacttggctaagttttgtatttttagtagcgacaggatttcaccatgttggccaggctggtctcgaactcctgacctcaggtgatccgcctacctcagcctcccgaagtgctgggattacaggcgtgagccaccatgcccggcctaaaaaatataaaaattaaccaagcgcagcagtg

SEQ ID NO: 45906 - DNA, 601 bp, Human
atgatttttttgtatttttagtagagacagggattcaccatgttggacaggctggtcttgaactcctgacctcaggatccacccaccttggcctcccaaagtggtgggattacaggtgtgagccacagtgcctggcctagaatagatgttctgttagtaggtgctgtagttatttcctgaatatgtgaaattataccaatagtctacccccttcctggagtttgaggtacatagaatttgaataaattgactgtcgccacttttggtgaataaattttcaaacttttttttttttttttttgagacaagagtctcactctgtcacctaggctggagtgcagtgatgcgatctcggctcactgcaacctctgcctcccaggttcaagcaattctcctgcctcagcctcctgagtagctgggattacaggtacatgccaccatacttggctaagttttgtatttttagtagcgacaggatttcaccatgttggccaggctggtctcgaactcctgacctcaggtgatccgcctacctcagcctcccgaagtgctgggattacaggcgtgagccaccatgcccggcctaaaaaatataaaaatt

SEQ ID NO: 45907 - DNA, 601 bp, Human
gttgccactaatttatctttggcctcacatgtaccaaagtaatagctggggaaggcaatcaagagtctaacaggcccgggcgtggtggctcacacctgtaatcccagcactttgggaggccaaggcgggcagatcacctaaggtcaggagtttgagaccagcctgaccaacatggagaaaacccgtctctactaaaaatacaaaaattagccaggcgtggtggcacatgcctgtaatcccagcaacttgggaggctgaggcaggagaatcacttaaaccttggaggctgaggttgcagccragatagcatcactgcattccagcctgggtgacaaaagcaaaactgtgtctcaaaaaataaaaataaagagtctaacagaggccaggcacagtggctcacacctgtaatccctgcactttgggaggcaaaagtgggcagatcacttgaggtaaggagttcaagaccagcctggccaacagggtgaaaccccatctattaaaaaaaaaaaaaattagccggtcatggtggagggtgcctgtagtcccagctactcgggagtctgaggcagaagaatcgcttgaaccccggaggcggaggttg

SEQ ID NO: 45908 - DNA, 601 bp, Human
caccagatgtgccaaggcctctaggctgcattctgcatggcctagagccctggcaggcacagctgaaaacaaagcaagcaagaccagcccagtggctgtcgggagccaagacctcctgctggaacctggagagtggtcctgggcagagttggggggcaggcctgagaacccctcgcaggacaggcaggggtcagccggcagtagttgggctggtctggcccactggggcctcttttggggaagagagtgtttcctcatgccttgatgggagccactgagctttcaatttttttttttttttaatacagagtctcgctctgttgcccaggctagagtacagtggtgcaatcttgattcactgcaacctccacctcccgggttcaagcgattctcctgcctcagcttcccgagtagctgggactataggcgcccgccaccacacccagctaatttttgtatttttagtagaggcggggtttcaccatgttggccaggctggtcttgagctcctgacctcaagtgatccacccgcctcagcctcccaaaggaccgggattacaggcatgagccaccatgcccagcctgagctctcaaattctta

SEQ ID NO: 45909 - DNA, 601 bp, Human
agagccctggcaggcacagctgaaaacaaagcaagcaagaccagcccagtggctgtcgggagccaagacctcctgctggaacctggagagtggtcctgggcagagttggggggcaggcctgagaacccctcgcaggacaggcaggggtcagccggcagtagttgggctggtctggcccactggggcctcttttggggaagagagtgtttcctcatgccttgatgggagccactgagctttcaatttttttttttttttaatacagagtctcgctctgttgcccaggctagagtacagtggygcaatcttgattcactgcaacctccacctcccgggttcaagcgattctcctgcctcagcttcccgagtagctgggactataggcgcccgccaccacacccagctaatttttgtatttttagtagaggcggggtttcaccatgttggccaggctggtcttgagctcctgacctcaagtgatccacccgcctcagcctcccaaaggaccgggattacaggcatgagccaccatgcccagcctgagctctcaaattcttaagacacccagataatggccacaccaggaaggtcctagaccact

SEQ ID NO: 45910 - DNA, 601 bp, Human
gctctgttgcccaggctagagtacagtggtgcaatcttgattcactgcaacctccacctcccgggttcaagcgattctcctgcctcagcttcccgagtagctgggactataggcgcccgccaccacacccagctaatttttgtatttttagtagaggcggggtttcaccatgttggccaggctggtcttgagctcctgacctcaagtgatccacccgcctcagcctcccaaaggaccgggattacaggcatgagccaccatgcccagcctgagctctcaaattcttaagacacccagatartggccacaccaggaaggtcctagaccactccctgctctgttccaggtgctggcctggtgccgggttcaccagccacatcaccatgggtgcagatgggcgagctgggagctcctgccaccttggggtgctttgcggctgccaagggcagttgaacccaagccaggcccagctgaaggctttcagcagcctttactctttggccttcttataatccctagtgaaggggttggcttttatttatttatgtatttatttatttatttattttttgagacagagtctcgctctgtcgcccaagct

SEQ ID NO: 45911 - DNA, 601 bp, Human
gctcacgcctgcaattccaacactttgtttgggaggctgagacaagcagataacttgagtctgggagttcacgaccagcctggtcaacatggcaaaccccgtcaatacaaaaaatacaaaaattagccatgtgtggtggtgtgcgcctataatcccagctactcgggaggctcagaattacctgagcctgagcgcttgagactgcagtgtgccatgatcgcgccgctgcactccagcctgggcagcacagtgaaaccctgtctcaaaaaaaaaaaaaagaaaaagaaagagagagagagaaaaagaaagaaagaaagaaagaaagaaagaaagaaagaaagaaagaaagaaagaaagaaagaaaaaaggaaggaaggaaggaaggaaaagaaaaaaactgaggctgaggctcagagaggggaggggagttgctcaggcccacacatctctgatgatttataaagcatttatagagaacttgctatgtgccaggcacttccgcacagtgagagccaggatggcttcgtggctgtacacaggggacctggcatcaaacctgcccagggttctggacgctgctctgcctcttccaggctgtcac

SEQ ID NO: 45912 - DNA, 601 bp, Human
acgcctgcaattccaacactttgtttgggaggctgagacaagcagataacttgagtctgggagttcacgaccagcctggtcaacatggcaaaccccgtcaatacaaaaaatacaaaaattagccatgtgtggtggtgtgcgcctataatcccagctactcgggaggctcagaattacctgagcctgagcgcttgagactgcagtgtgccatgatcgcgccgctgcactccagcctgggcagcacagtgaaaccctgtctcaaaaaaaaaaaaaagaaaaagaaagagagagagagagaaagaaagaaagaaagaaagaaagaaagaaagaaagaaagaaagaaagaaagaaagaaagaaaaaaggaaggaaggaaggaaggaaaagaaaaaaactgaggctgaggctcagagaggggaggggagttgctcaggcccacacatctctgatgatttataaagcatttatagagaacttgctatgtgccaggcacttccgcacagtgagagccaggatggcttcgtggctgtacacaggggacctggcatcaaacctgcccagggttctggacgctgctctgcctcttccaggctgtcactgtg

SEQ ID NO: 45913 - DNA, 601 bp, Human
acttgagtctgggagttcacgaccagcctggtcaacatggcaaaccccgtcaatacaaaaaatacaaaaattagccatgtgtggtggtgtgcgcctataatcccagctactcgggaggctcagaattacctgagcctgagcgcttgagactgcagtgtgccatgatcgcgccgctgcactccagcctgggcagcacagtgaaaccctgtctcaaaaaaaaaaaaaagaaaaagaaagagagagagagagaaagaaagaaagaaagaaagaaagaaagaaagaaagaaagaaagaaagaaagaaagaaagaaaaaaggaaggaaggaaggaaggaaaagaaaaaaactgaggctgaggctcagagaggggaggggagttgctcaggcccacacatctctgatgatttataaagcatttatagagaacttgctatgtgccaggcacttccgcacagtgagagccaggatggcttcgtggctgtacacaggggacctggcatcaaacctgcccagggttctggacgctgctctgcctcttccaggctgtcactgtgggcacgtgaccccacttctctgagctatctcaaaaacaggaatcatag

SEQ ID NO: 45914 - DNA, 601 bp, Human
aggcatgagccaccacacccaacctcattttttaaatttttagtagagatgggatcttgctacattgcccagtctgatcttgaactcctgagctcaaagcagtcctctcagatcagcctcccaaagtgcagggattacaggtgtgcaccaccacaacccattttcctatggggatgctgaggcacagaaaggctgagtgacttgccccaggtcatggagctagtcagtgtcagggctgggatttgaacccaggcagcctgcgtagtaactgtatatagtgtctacacttgattgcttgttaaaaaaaaaaaaaagaacagctgaattcattgccatagtaaagactgacatatgccaggccctggcggcagcctttacccagcaggcctatgaagttagggctgttacatcccaacattttgcatttgggggaaattgagtcccagtgaagcaaactgacttgcccgaggctgaccacacatcagagacagagcgaagggatcacgcccctgtcaaaagcccctccgtgacaacacgtggcattgagataaaatcccaacccatcacaggctccaagcctcctagtgtggaggcccctctc

SEQ ID NO: 45915 - DNA, 601 bp, Human
aaaaggctgtgcagtacttgcctcttagccagcacagtggacattggcttttgtatctcactcctgaaattctttcttgaaatttcttgagcaagatcttcctggacttccagactctatggcctctcaccctatggtgtgtccctgccaccccggtaaaaccctcctcactcattgtgaattatttactcctggcgaactccaggaaggcagggaccttttgtggtcagacggtgcctggcacatagtaggttctcaggaaatccttgagttatgagtgcacccaaagccaaaacactgrgatgaactagagagtcatgggcctccagctggaaaggagcgaggccaccactcacacccggctctggccagcaccacgccgccaccctgcagaggtatttgggtttttcaacaactcagggaaatgatgaaacaaacaaacaaacaaaaacaaccccaagcttgtatccccacctcgctttttttttcctgggattttcacacttctaaatatatccaacaacttggcaggcacaccaggtgacccagaacatcctttttgtgttgcctgaaatgataggaacaagaataaagaatttaa

SEQ ID NO: 45916 - DNA, 601 bp, Human
tcactcctgaaattctttcttgaaatttcttgagcaagatcttcctggacttccagactctatggcctctcaccctatggtgtgtccctgccaccccggtaaaaccctcctcactcattgtgaattatttactcctggcgaactccaggaaggcagggaccttttgtggtcagacggtgcctggcacatagtaggttctcaggaaatccttgagttatgagtgcacccaaagccaaaacactgggatgaactagagagtcatgggcctccagctggaaaggagcgaggccaccactcacamccggctctggccagcaccacgccgccaccctgcagaggtatttgggtttttcaacaactcagggaaatgatgaaacaaacaaacaaacaaaaacaaccccaagcttgtatccccacctcgctttttttttcctgggattttcacacttctaaatatatccaacaacttggcaggcacaccaggtgacccagaacatcctttttgtgttgcctgaaatgataggaacaagaataaagaatttaaaagtgagaaacagcagcagagagtgtgactttaaaaatagccagaggggacatttga

SEQ ID NO: 45917 - DNA, 601 bp, Human
atagaataaaataaaataagaatccgcccccctccccgccccagttggtgtttcaaaccctgagacttggccttggaattcatggggtgatgaggaccccacagccagaggtgccaggcgttccctgccccaaccccagagcaggaggccatcattaaggcaggccagccaggtggcttttcagtgccagccgtagctgaatatattaggcagggagacaggcaagggtttgtatgagacccacagaaggaacagggaatatgctggtctgggttcaagtcccggttttgctggttagccrtgtgcctctgggcaagtttattcctctgaggcttagttttcccatctgtaagatgggcatagaagtggtcactactggctgggcacagtggctcacgcctgtaatcccagcacttggggaggccaaggcaggtggatcacctgaggccagaagttcgagaccagcctggccaacatggtgaaacgctgtttctactaagaacacaaaagttagccaggtgtagtagcatgtgcctgtaatcccagctactcgggaggctgaggcaggaggatcgcttgaacctgggaggcagaggttgca

SEQ ID NO: 45918 - DNA, 601 bp, Human
agtttattcctctgaggcttagttttcccatctgtaagatgggcatagaagtggtcactactggctgggcacagtggctcacgcctgtaatcccagcacttggggaggccaaggcaggtggatcacctgaggccagaagttcgagaccagcctggccaacatggtgaaacgctgtttctactaagaacacaaaagttagccaggtgtagtagcatgtgcctgtaatcccagctactcgggaggctgaggcaggaggatcgcttgaacctgggaggcagaggttgcagtgagccgagatcaygccactgcactccagcctgagcaacagagcaagattatgtctcaaaaaaaaaaaaaaaaaccgaagtggtcactatctccgaggatggttgtgggattcagagagccacttggataggatgcatagcatggggccagcccactgacaccccccagtaaacgtagccagtgctattattactgtgctgttgtttaaccctccagaggggaagtctcttgagaggctgtccagggcaatgttaaaagcttggggtttgaagtcactcagacctgatttcgaatcctctctccctgcttctcg

SEQ ID NO: 45919 - DNA, 601 bp, Human
cctggctgcacctcacaccaggtgccagcaaagccctgatgttgctctatttctagctcccacctgatctgcccctccctggctcactctgctctggcctcccactgttcctggagcactccccccagtcccccacaccagccttgggatctttgcatctgcaagtccctctgtctccgtgctgatctcacacacctcctgacactttctcacctcctgcaggtctttgttcctgcaccaccttcccagggacgctctccttgcagcgactgaaaagtgcaacctcaccccaccctccacrccggcactcccctccctcggtggcattttatttttctctgtggccccttcctatcttgtgacacataatatatcctacttatttgtccctttcttgatttgtctcacctactgagctttgagttccacaggggtcggggtttttgtctgatttgttcattgcagtggtgatttgttcactgcctaaaatagagcctggcaggtacaaagtgtttggtaaatagaaatcaataccccagggtctgtgacctgacttaggtgttaacaggttcctctgaggtgtgtggggaacagactgagg

SEQ ID NO: 45920 - DNA, 601 bp, Human
tagccttctcgtatatcccagccctgcctcatgtcacaatttgtaatgatgtgtttggctgggtgacattttatggccatctgtctccctatcccctataatgtggtttgccgaaagcaaagcccaggactgtctcggccatctgtgtctccaggatcacccctcactgggcatggagtatgtgtccagttaacgcttgctgagtgaatgaatgaatactccatcctctgcctggagaattacgcactttagcatatccaaggctctgacaagtcctgcataaaagagcattattgttttctttctttctttccttctttccctcttcttttctttctgactataggatattgattatcaatctggcaatagtcaagattggcagtctggtgtattagtcaaaggttttcagcctacaaaagacaaaaagaaaaaataaactggctaaaaacaaaaggggatatgatttactaactcacttaaccgacagtcacagaggttcttcaaacctggctgtatcaaggggctttaaaatgttatcagatgggggccaggtgcagtagctcacgcctgtcatccagcactttgggaggccaagaca

SEQ ID NO: 45921 - DNA, 601 bp, Human
tccagttaacgcttgctgagtgaatgaatgaatactccatcctctgcctggagaattacgcactttagcatatccaaggctctgacaagtcctgcataaaagagcattattgttttctttctttctttccttctttccctcttcttttctttctgactataggatattgattatcaatctggcaatagtcaagattggcagtctggtgtattagtcaaaggttttcagcctacaaaagacaaaaagaaaaaataaactggctaaaaacaaaaggggatatgatttactaactcacttaacsgacagtcacagaggttcttcaaacctggctgtatcaaggggctttaaaatgttatcagatgggggccaggtgcagtagctcacgcctgtcatccagcactttgggaggccaagacaggcagatcacttgaggtcaggagttcgagaccagcctggccaacatggtgaaaccccgtgtctactaaaaatacaaaaaattagccaagtgtggtggcatgtgtctgtagctccagctactcgggaggctgaggcaggacaatggcttgaatccgggaggcggaggttacagtgacccaaggtt

SEQ ID NO: 45922 - DNA, 601 bp, Human
tagttttcatagagacgaggtttcatcatcttggccaggctggtcttgaactcctgaccttgtgatccacccatctcggcctcccaaataaatacatattttaaaagatagaaatcactctggaaggagagttaatctgtttgatataataataatatattaatattatattataacaatatattagtattatattctaataatatattaatattatattataataatatattattatattataacaatatattaatattatattataacaatatattaatattatattatgtaataatamtactactccatatagctatggaaaagttcatatgaagaaaccaggctatgatctacaaactggcaacaaatttgttcttctattttccatatgctgtctgtgtacgtataaagtgagaggtctttttatatgagttaagggtgtgaccaaagacaaatggaaaaagacaaatgacaaacatactaataaagagcttcggtttctccacaaaaaatacaataataaaataaaatgttatcagaaatctcttgactctcctccacgttagctcactttttccctcaagagggtgaacatgac

SEQ ID NO: 45923 - DNA, 601 bp, Human
gttaaatggttttttttcttcccgaatgtccaagtcaccttccagacctgcagctcctgagcagccaacttaggacttctaatggagagtgaagttcccctggttcgcggaggggccggccacagcctcaaggctgctgttgattggtccgacctgagtccttgagtctggcagagtgccatggtgctctgtaatcccacctgtaatcccagcattttaggaggcagaggcaggaagattgcttgagcctaggagttcaagaccagcctgggcaacatagcaagacccgtctctacaaaayaaaacaaaacaaaacaaacaaacaaaaaaattagccaggtgtggtggtgcacgcctgtggtcctagctactcaggaggttgaggtaggaggatttcttgagtctgggaggtcaaggctacagtgagccaagatcacaccactacactccagcctgggcaacagagcgagaccctgtctttaaaaaaaaaaagtccttgagtcatgattccagatgcaatcgcagatgtgggggctgcaaccctccgatgggctggggttcacgtctacaccacatggctggagcacaggccaggaggggc

SEQ ID NO: 45924 - DNA, 601 bp, Human
gcaacacctcagacccccaaggcactccctctccccgttttccttccacctgtcttaactggtctctatttcctttctttctgtgtctccaatcccatctctcccagtgattgccccagaggccgtttcttggccgccatctgccaaggtgagatcctaaaactcagaaccctctcctttaggcccttggggaggccacgtcccctcaagctccccaggatggggccatgtactttcagaccccctagggcagggccaagcctgggctctggggacctgggctccagtcccctgtcgccgccccctgctgacccttgtcccacagactgtggccgcaggaagctgcccgtggaccgcatcgtgggaggccgggacaccagcttgggccggtggccgtggcaagtcagccttcgctatgatggagcacacctctgtgggggatccctgctctccggggactgggtgctgacagccgcccactgcttcccggagtgagtgccccccaatggcgctgatgatggggaggcagaggagcggagagacagtggggaggagggcggattgtgcccaggcaggtggccaccctccacccctttccctg

SEQ ID NO: 45925 - DNA, 601 bp, Human
gcaagtcagccttcgctatgatggagcacacctctgtgggggatccctgctctccggggactgggtgctgacagccgcccactgcttcccggagtgagtgccccccaatggcgctgatgatggggaggcagaggagcggagagacagtggggaggagggcggattgtgcccaggcaggtggccaccctccacccctttccctggtaggcggaaccgggtcctgtcccgatggcgagtgtttgccggtgccgtggcccaggcctctccccacggtctgcagctgggggtgcaggctgtggtytaccacgggggctatcttccctttcgggaccccaacagcgaggagaacagcaacgatattgccctggtccacctctccagtcccctgcccctcacaggtaagtctaagggctgagccatggggcttgaggacccgaggccaggaggacagaggaggggaccaggggcacaaggcaatcaacttatggctcaggcatccttggcaataaggggaatgatctcgagggagcacaaagtgggccttaactatcaatgatcagtgcagccaatttggaaaatttgccagcatttccccaagaag

SEQ ID NO: 45926 - DNA, 601 bp, Human
ggctctgtcatcttgaaaataaataaataaataacaaaaaaaatgtggtatatccacacaacgggagaatattggaccatagaaatgaatgaggtactgattcatgctaccacaaggatgaaacttgagaacagtgctgaatgagacaagccagccgcaaaggccacatactgtaggatgccacttgtatgaaatgtacaaggctgggcacggtggctcacgcctgtaatcctggcactctgggcagctgagatgggaggattgtttgtgctcaggagtttaagaccagcctgggcaacayagcaagaccccatcacttaaaaaaatgagctaggtgtggtgacggatacctgtagttccagttactcaggaggctaaggcaggaggatcacttgagcccaggagtttgaggctgcagtgggctaggattgtgccactgtactccagcctgggtaacagagcaaaaccttgtctgttaaaaaagaagaaagaaagaaagagaaagaaaagaaaggaaggaaggaagaaaagaagaaaagaaaaggaaagaaagaaaagaaatgtctagaataggcacatcggtagagatagaaagttgatt

SEQ ID NO: 45927 - DNA, 601 bp, Human
ctgtttgcctggcatgcaactcaatgactcaccaatttctcactacaacttctggggataagtgattattatttccattctacatctgagagctctaagactcaggcaggtgatgtcatcagcaggcagcaggcaacaggcagggctgccaggaacccttgcataggttgtgcactgcacaaggacaccacatctcagggttaccactctctctgtagacctgtgtatttattattatgattttctgccaggtggaagtcaaatgtctcaagataggagtgtctctctctctctctctctctcttctctctctctctctttctttttttgagacagagtcttgctctgtcacccaggctggagtgcaatggcgcaatctcggctccctgcaaactctgcctcctaggttcaagcgattctcctgcctcagcctcctgagtagctgggattacaggcacctgccatctgtaatcccagtgctttgggaggctgaggcaggaggattgcttgagcccaggaggtcgaggctgcagtgagccatgttcctgccactgcactctggcctgggtgacactgcaggcttagaaatgaaaacaagctg

SEQ ID NO: 45928 - DNA, 601 bp, Human
tgtttgcctggcatgcaactcaatgactcaccaatttctcactacaacttctggggataagtgattattatttccattctacatctgagagctctaagactcaggcaggtgatgtcatcagcaggcagcaggcaacaggcagggctgccaggaacccttgcataggttgtgcactgcacaaggacaccacatctcagggttaccactctctctgtagacctgtgtatttattattatgattttctgccaggtggaagtcaaatgtctcaagataggagtgtctctctctctctctctcttccttctctctctctctctttctttttttgagacagagtcttgctctgtcacccaggctggagtgcaatggcgcaatctcggctccctgcaaactctgcctcctaggttcaagcgattctcctgcctcagcctcctgagtagctgggattacaggcacctgccatctgtaatcccagtgctttgggaggctgaggcaggaggattgcttgagcccaggaggtcgaggctgcagtgagccatgttcctgccactgcactctggcctgggtgacactgcaggcttagaaatgaaaacaagctgt

SEQ ID NO: 45929 - DNA, 601 bp, Human
gctgggattacaggcacctgccatctgtaatcccagtgctttgggaggctgaggcaggaggattgcttgagcccaggaggtcgaggctgcagtgagccatgttcctgccactgcactctggcctgggtgacactgcaggcttagaaatgaaaacaagctgtgttaaaacatacatgttatgaaactttggacacgtgacttggcctcattttccccctctctaaaatgggataatatagaccctacctctctgggctgatgaaacattaaagaaaatggtgcaggaaggcgcctagtatgygatgagctcttggtacgtggcgacttccgttgtggcttttttgtttgtttgtttttgagacagagtcttgctctgtcgcccaggctggagtgcaatgacatgatctcggctcactgcaacctccacctcctgggttcaagtgattcttctgcctcagtctcccgagtagctgggattacaggtgcgtgccaccatgcccggctaatttttgtatttttagtagagatgaggtttcgccatgttggccaggctggtctcaaactcctgacatcaagtgatcctcctgcctcggcctcccaa

SEQ ID NO: 45930 - DNA, 601 bp, Human
ggaggctgaggcaggaggattgcttgagcccaggaggtcgaggctgcagtgagccatgttcctgccactgcactctggcctgggtgacactgcaggcttagaaatgaaaacaagctgtgttaaaacatacatgttatgaaactttggacacgtgacttggcctcattttccccctctctaaaatgggataatatagaccctacctctctgggctgatgaaacattaaagaaaatggtgcaggaaggcgcctagtatgcgatgagctcttggtacgtggcgacttccgttgtggcttttttgtttgtttgtttttgagacagagtcttgctctgtcgcccaggctggagtgcaatgacatgatctcggctcactgcaacctccacctcctgggttcaagtgattcttctgcctcagtctcccgagtagctgggattacaggtgcgtgccaccatgcccggctaatttttgtatttttagtagagatgaggtttcgccatgttggccaggctggtctcaaactcctgacatcaagtgatcctcctgcctcggcctcccaaagtgctggtattacaggcatgagccactgtgcccagcctattg

SEQ ID NO: 45931 - DNA, 601 bp, Human
cttggtacgtggcgacttccgttgtggcttttttgtttgtttgtttttgagacagagtcttgctctgtcgcccaggctggagtgcaatgacatgatctcggctcactgcaacctccacctcctgggttcaagtgattcttctgcctcagtctcccgagtagctgggattacaggtgcgtgccaccatgcccggctaatttttgtatttttagtagagatgaggtttcgccatgttggccaggctggtctcaaactcctgacatcaagtgatcctcctgcctcggcctcccaaagtgctggkattacaggcatgagccactgtgcccagcctattgtggttttttttttaaagaacagagagggcagggtgtgttaggggccatggtagcagctggacagaggtttgtaccaggtggggcaggccagcaggggctggaccagcattgtctctctcacagaatacatccagcctgtgtgcctcccagctgccggccaggccctggtggatggcaagatctgtaccgtgacgggctggggcaacacgcagtactatggtgagtcctgtcctctgcctctgatgccaccatttgggagactctga

SEQ ID NO: 45932 - DNA, 601 bp, Human
agaggagtgggacattagcaggggcttaggaagagcccttgaccccatcccagctcaggggagagaggggtccaggcccccgcagagggacagatggggcacagcatcctagctcgcccagcagtcatgctccaacagcacggggagggcgagagcctatggggcaggaggtctgtctcagaggccagagtaggggtcagtggcccagatctctgctggctggtgggaagcaagagtcatggcctggcacccacaggagctccccccagccccctgcggccctgcactgagacctgcaccyaccatcgtcagcgtcatgcggtcgatctcatgcttgtctttggtcttgtgctgccggaaggggctgtgcctgggcaagaaaggccaaaaaccaatgtcaaaggacaggaatggggaaagggaggcaggcagcatggatgagctgtggccaaagtcagggacggtgccaaccctaccaccaaggcagctatgggctcccctcctttggcatcccacctggattggggaggaacttctcttagccccaacccacctgcccacctgggatgggccactcacccccgcagcaacttgaagagca

SEQ ID NO: 45933 - DNA, 601 bp, Human
ctcccgggtagctgggagtacaggcgcgtgccaccatgcccggctaatttttttggtattttttggtagagacagggtttcaccatgttggccaggctggtctcaaactcctgacctcaagtgatctgcgctccttggcctcccaaagtgctgggattacaggcgtgagccaccatgcccggccccagcctgagtttgaatcccagagccgccactttctggctgtgatccagggtgagttccttaaacccgagccagctgctcacttctaagcaggcaggggcctggtgccgcagcagcyggcgaccctcaccttcctcatggcccagctgcttgttcttggctttcttgcgagcctccagccggtctgtctcagcgttgatggtgtcgaagacagtctctgccacctcctgctgccaccgctccgagatggtgagggggaagttgcggtagagctcctgatcactgtccagtaactttaccaggtggatggggcaggggcacatgggtggacagagatgccggaataccatcagccacaggctgcccagacccagggccctgggtagggatggtcagtgcaactgccaccccccaggga

SEQ ID NO: 45934 - DNA, 601 bp, Human
cagggtcgctctgcacatgccaagcccagctctgtcagctggggctctccccagcctgcctggcctggcccctcggccctcccatccctggctcagcccccactcacatcgcactgcaaaatgaactgtttcccaccgcggatcttgaggagcaggcacttgcgctccttgatctgcgtctcctccaccgactggatctcctccatggtcagcaggctctgctgcagggccagggatgggtggtgcaggtaagagccgggccggccagccacccggaagcccggctcccggacccccgcaygggctccttaccggggcctcgccctcgccccgccactcgaggcggttggggaacaggtagaagtaccgccgctgccactgggtcaggaaggggttgcccatcttggacatgtagccatgcatgatgcagtccttgcccagggcgtagtctgaggcgagagacagaggagactcagccggccccacctgggtttcttttttgttttgagacagggtctccactctgttgcccaggctggagggctgtggcacaatcttggctcactgcaacctccacctcccaggttcaaacgatcctccc

SEQ ID NO: 45935 - DNA, 601 bp, Human
aggccagggtgggcggatcacaaggtcaggacttcgagatcagcctggccgacatggtgaaaccccatctctactaaagatacaaaaaattagcagggcatggtggtgcgtgcctatagttccagctactgaggaggctgaggcaggagaatcgcttgaacccagaaggcggaggttgcagtgagctgagatcgcaccactgcactccagcctggtgacagagcgagactccatctcaaaaaaccaataaaattgatgtgacatgacagccacattgtttatcatttattttcctgtctgyctcccaccacataaactcccttcttgttttgtctccccagtggaactatattttcatcttcatggttgtagaaaagttcaggaatttagtagatgttgattgaattaataaaaaaagattaatattactgaaatagtccgttcactttcttcatttatctagtaataaagctttttttccccccactctgttgcccaggctggagtgcggtggcacaatctcggctcactgcaacctctgccttcccagttcaggccattcttctgcctcagcctcctgagtagctgggattacaggcac

SEQ ID NO: 45936 - DNA, 601 bp, Human
tggttggaggttcagggcactgcaagacatttagattcattccagggcaactggaagccactgggggagtagcatggtctgattatttgtccccgtcactttggtggtgtcacatgggatagactgtggatgccaagagatgagcgtgtgttttggaggtgggctggacaggaccgacagacggatagggtgtgggaggtaaggggacaggaagaattaagactccagtgcttggcttgaacagatgggtggattgtggcaccattatacacaagggaacatgagggtaggacagtattgsgggcaaagtcgagatttcacttaagaacttgataaattgaagaagagctagaagcagcaaattagacgttattacaggcctcatctccctgcccctcccatttccatctcactttgttttaaatgtccccttgcaaaggatcggtcactttagggctgttttgagacatacctttttggggcagacacgtggctcctgccggggtggggagaggggggcatgtcctggcacctccccgagagtctgctgcacagccaatgcttcacaaaagttggctgaatgaatgaatgaatgtggctt

SEQ ID NO: 45937 - DNA, 601 bp, Human; identical to SEQ ID NO: 25707

SEQ ID NO: 45938 - DNA, 601 bp, Human; identical to SEQ ID NO: 25708

SEQ ID NO: 45939 - DNA, 601 bp, Human; identical to SEQ ID NO: 25709

SEQ ID NO: 45940 - DNA, 601 bp, Human; identical to SEQ ID NO: 25710

SEQ ID NO: 45941 - DNA, 601 bp, Human; identical to SEQ ID NO: 25711

SEQ ID NO: 45942 - DNA, 601 bp, Human; identical to SEQ ID NO: 25712

SEQ ID NO: 45943 - DNA, 601 bp, Human; identical to SEQ ID NO: 25713

SEQ ID NO: 45944 - DNA, 601 bp, Human; identical to SEQ ID NO: 25714

SEQ ID NO: 45945 - DNA, 601 bp, Human; identical to SEQ ID NO: 25715

SEQ ID NO: 45946 - DNA, 601 bp, Human; identical to SEQ ID NO: 25716

SEQ ID NO: 45947 - DNA, 601 bp, Human; identical to SEQ ID NO: 25717

SEQ ID NO: 45948 - DNA, 601 bp, Human; identical to SEQ ID NO: 25718

SEQ ID NO: 45949 - DNA, 601 bp, Human; identical to SEQ ID NO: 25719

SEQ ID NO: 45950 - DNA, 601 bp, Human; identical to SEQ ID NO: 25720

SEQ ID NO: 45951 - DNA, 601 bp, Human; identical to SEQ ID NO: 25721

SEQ ID NO: 45952 - DNA, 601 bp, Human; identical to SEQ ID NO: 25722

SEQ ID NO: 45953 - DNA, 601 bp, Human; identical to SEQ ID NO: 25723

SEQ ID NO: 45954 - DNA, 601 bp, Human; identical to SEQ ID NO: 25724

SEQ ID NO: 45955 - DNA, 601 bp, Human; identical to SEQ ID NO: 25725

SEQ ID NO: 45956 - DNA, 601 bp, Human; identical to SEQ ID NO: 26666

SEQ ID NO: 45957 - DNA, 601 bp, Human; identical to SEQ ID NO: 26665

SEQ ID NO: 45958 - DNA, 601 bp, Human; identical to SEQ ID NO: 26664

SEQ ID NO: 45959 - DNA, 601 bp, Human; identical to SEQ ID NO: 26663

SEQ ID NO: 45960 - DNA, 601 bp, Human; identical to SEQ ID NO: 26662

SEQ ID NO: 45961 - DNA, 601 bp, Human; identical to SEQ ID NO: 26661

SEQ ID NO: 45962 - DNA, 601 bp, Human; identical to SEQ ID NO: 26660

SEQ ID NO: 45963 - DNA, 601 bp, Human; identical to SEQ ID NO: 26659

SEQ ID NO: 45964 - DNA, 601 bp, Human; identical to SEQ ID NO: 26658

SEQ ID NO: 45965 - DNA, 601 bp, Human; identical to SEQ ID NO: 26657

SEQ ID NO: 45966 - DNA, 601 bp, Human; identical to SEQ ID NO: 26656

SEQ ID NO: 45967 - DNA, 601 bp, Human; identical to SEQ ID NO: 26655

SEQ ID NO: 45968 - DNA, 601 bp, Human; identical to SEQ ID NO: 26654

SEQ ID NO: 45969 - DNA, 601 bp, Human; identical to SEQ ID NO: 26653

SEQ ID NO: 45970 - DNA, 601 bp, Human; identical to SEQ ID NO: 26652

SEQ ID NO: 45971 - DNA, 601 bp, Human; identical to SEQ ID NO: 26651

SEQ ID NO: 45972 - DNA, 601 bp, Human; identical to SEQ ID NO: 26650

SEQ ID NO: 45973 - DNA, 601 bp, Human; identical to SEQ ID NO: 26649

SEQ ID NO: 45974 - DNA, 601 bp, Human
ttgaaatattttattataattagttattcaattaaaattgcatgtaccaaattagaattgaaacaatataaaatgtcttttacagtatgcattttcctaatttatacttttcttaatttatactttcatatttgagaaattaccttttgtgttatgtataaatgttataatacatataggtaaattaatatgcctgtacaattttaggcatatatgtgtttttattcatagcaatgctaatattttaatttttttggaattataatatacttaaaatttttcatatttattctgtatatattttttctcatatacttaatgatgacaactctattgttcatattacctgatatacatggtaaatacatgataaataaaaaataaaaccctgaacaaagaaaaaagtgcaaagaaagacatgcaaagaaaggttgattcatttattctaagaaacttgagaagttttaaatatcctaacataggtgtaacttccccccaacaccaacaatctgtattacagagatggagaactgttctcacaaatacgtgttttgagaaagttcagtacaagtacacatcatggttttaaaatttttagaat

SEQ ID NO: 45975 - DNA, 601 bp, Human
aaagaatttactaatgtgtaagactgtaaaaatcagatatttatataatgatatgagcatttcgttcactgttataaaggcttggtaaagtggaaaacatatgtaaaggaaaggagatctggtggtttctaaatgacataaattgattgtttaaaaattttgaataattgcagacaataatgaaatgcttattccttttaaaaataaattgttagttattttatttggtcaatataaatgttcacattacattgaaatttaaattctttgaaatcaaaaattatagtaagtaggcatactrctgataattacaatattaagaatttgaaaaaagaatatattaatgcatataattttacttaatattgtaactacatctaaaacataaatatatattactaaattttcaaatattttatctaaataatgtctttcttacagatatattaattcaacaaatgaattaatagagctaaaatataaattgacataatctaaagaaaacctttgccactctatttaggtattttttgttgctaaatattttatgtttttatatttaatagatttattaaatccctttggtaaacttattttgaaa

SEQ ID NO: 45976 - DNA, 601 bp, Human
aggaggcatctgtgcacatcattttaaagcatcttcaatttatgataatttaatcaaaaatttttttatgtttcttgaggaaatgtaccttacaaacattcctaagtgaaaaacaaaacaaaacaaaaaatataagtagaagacatatgcttttcgatatatgcagatgtgtctgtgtgtgcctaaaattataaatatttcactggagcctaagtaaagaatttactaatgtgtaagactgtaaaaatcagatatttatataatgatatgagcatttcgttcactgttataaaggcttggwaaagtggaaaacatatgtaaaggaaaggagatctggtggtttctaaatgacataaattgattgtttaaaaattttgaataattgcagacaataatgaaatgcttattccttttaaaaataaattgttagttattttatttggtcaatataaatgttcacattacattgaaatttaaattctttgaaatcaaaaattatagtaagtaggcatactgctgataattacaatattaagaatttgaaaaaagaatatattaatgcatataattttacttaatattgtaactacatctaaaacat

SEQ ID NO: 45977 - DNA, 601 bp, Human
gattctgaatataattattgagtaattaatgtgacacattttgacaaaggtatgtattctagagtatgttttaaattcagacaagcattctcttaacgaatcatatcagcatattcaagagggcaggcatcatttgaaaaggaaattgatctgttacacattttgacaggctttagagcatttagctgtgttctctcaattgaaaggtggtgagagtgggtaaaaaaaaacgctgtaagggtacagtttatcttgttttgttttgatttgattttaaagtggcaaacatctttctagtcayttttgcaaagacactcattttgtcaatcaggggctgtcttcaccattgatagaaaggattcctgtgggattattattacgttccatacttagttgtgtttcaacttcaatctgtttcaccaaagcaaagatacaggtgatagaagatcatcgatgttaaaggaaatcgtcgtgacaacaaatttttcttattcaccagcatggttctcaaacacttggttaggagcaataaattctcatgtaaagaaggtatatagaaagatcaatatctccttttaaacagtttaacacatttattcct

SEQ ID NO: 45978 - DNA, 601 bp, Human
ctcatcaaatactatgggggaagagttacattttgctttaccagttcaagagcaatttcaagcactgtcaagaagtatttgcttagtgacaaatgacactactctcttgaaaattcagagatgcatctataccttttctctttgcctttattattattctagttacattttatgtttatctttatgtttagtagtattatctctacatcaaggaaagtcatatattctccaccaggcctttttaggaataaaatagatggcaaactctctgacacaatttaactataaaacaacttaaagwcaaaaaaatagcgacttcttttctgtgatgtatttatgatttgctcatttccacaggaatgacatttctaaattttgcacacagataaaactgcctaggttattttaagacatgactgatgtgccaaaattatccccactttaatacagtatcttgcaaatttgcaaatttcatttatcatgaaacttcttagaattaaaaaacagctaaactggatctactgctctggtatgttgagaaaccactgtcctaaaataacatttcaaatttcacgtgttgtgccaaggcaggatttttaaa

SEQ ID NO: 45979 - DNA, 601 bp, Human
gtacacatatgtgtgtgaaaacatcaatacgcttatttattattaaccaataaatttggagtcaaatcctcatatgcctacagggttgggttattctataagcattcgataaaagagagaaaataatcaaaaataaaccaatgtcttacatagtctcccaaagaaaagtgttatttagaagaaggggaattatatccacctgacgagtgacattatagcccatttatttctcatcaaatactatgggggaagagttacattttgctttaccagttcaagagcaatttcaagcactgtcaakaagtatttgcttagtgacaaatgacactactctcttgaaaattcagagatgcatctataccttttctctttgcctttattattattctagttacattttatgtttatctttatgtttagtagtattatctctacatcaaggaaagtcatatattctccaccaggcctttttaggaataaaatagatggcaaactctctgacacaatttaactataaaacaacttaaagtcaaaaaaatagcgacttcttttctgtgatgtatttatgatttgctcatttccacaggaatgacatttctaa

SEQ ID NO: 45980 - DNA, 601 bp, Human
taatctcataaaaatcatatttgtgagttaagaattgtatgttttaaacactggtttaaaaatgcaatacacacacacgtacacaaaatgacaacatcgctttgtatctttaaaaatactttaaattaaatttcatgtaagtggttttattaaatccatattgtataaaatgacatgaaagttttataaataattcacatggtcttgaaattatcaaaggagtatacacatgcattcaaaattatctgttaatagagaaatgtgtagccaggtacacatatgtgtgtgaaaacatcaataygcttatttattattaaccaataaatttggagtcaaatcctcatatgcctacagggttgggttattctataagcattcgataaaagagagaaaataatcaaaaataaaccaatgtcttacatagtctcccaaagaaaagtgttatttagaagaaggggaattatatccacctgacgagtgacattatagcccatttatttctcatcaaatactatgggggaagagttacattttgctttaccagttcaagagcaatttcaagcactgtcaagaagtatttgcttagtgacaaatgacacta

SEQ ID NO: 45981 - DNA, 601 bp, Human
cacttttcacaataggaaagacatggaatcaacctggatgctcatcaacaatggacataataaggaaatctgacacatttacacaatggaatactatacagccataaaaatgagatcatgtcctttgccccaataggatggaactggaggccattatctcaagcaaactaatgcaagaacagaaaatcaaatactgcatgttctcacttataagtggaaaacttaacattgagtacacatggacagcacagtaatagacactggggcctaacctacttcagggtggggtgaggagagggcragaatcaaaaaactatctgtcaggtagtattatcactacctgggtgatgatataatttgtacactaaaccgcagcaacatgcaatttacacatgtaacaagctagcacatgtaccccctgaaactcagagttagaaagtaaaaatttaattgaagctataataaaatatagaatactaaaatggaaagtacacttcaaagacatgctataaaaggtaaataagaatatattattattttgatacaaaatattttggaattcaatctcaagataagaattattttagtttcaaattgtata

SEQ ID NO: 45982 - DNA, 601 bp, Human
acaaatcagcaagcaaaaaacaaacaaccccatttaaacatgggcaaaagatatgaacagaggcttctcaaaagaagacatgcacacagccaacaagcctattaaaaaatgagaacacctggacacaagaaggggaacatcacacacctgggcctgtcatggggtgggaggaagggggaaggatagcattaggagatatacctaatgtaaatgacgagttaatgggtgcagcacaccaacatggcacatgtatacatatgtaacaaatctgcacgtggtgcacatgtaccctagaacttamagtataaaaaaaaatattccaaatatcactaatcattagagaaatgcaaatcaaggtcacaatgatataccatctcacgccagtcagaatggctattactatgtcagaatataacagatgctggcaaatttgcatagaaaagggaattcttacacactgctgatgtgaatgtaaattagttcagccactatgaaaagcagtttggagatatctcaaagatcttagaactaccactcaactcggcaaccctagtagtggattatatcactaccattcaactcagcaatcctagtagtggat

SEQ ID NO: 45983 - DNA, 601 bp, Human
atccgacaaatccagaatctataaggtacttaaacaaatcagcaagcaaaaaacaaacaaccccatttaaacatgggcaaaagatatgaacagaggcttctcaaaagaagacatgcacacagccaacaagcctattaaaaaatgagaacacctggacacaagaaggggaacatcacacacctgggcctgtcatggggtgggaggaagggggaaggatagcattaggagatatacctaatgtaaatgacgagttaatgggtgcagcacaccaacatggcacatgtatacatatgtaacaaayctgcacgtggtgcacatgtaccctagaacttacagtataaaaaaaaatattccaaatatcactaatcattagagaaatgcaaatcaaggtcacaatgatataccatctcacgccagtcagaatggctattactatgtcagaatataacagatgctggcaaatttgcatagaaaagggaattcttacacactgctgatgtgaatgtaaattagttcagccactatgaaaagcagtttggagatatctcaaagatcttagaactaccactcaactcggcaaccctagtagtggattatatca

SEQ ID NO: 45984 - DNA, 601 bp, Human
tgtgggacctaatcaaactaaagagcttctgcacagcaaaagaaagtatcaacggagcaaacagacaacacacagaatcagagaaaatatttgcaaactattcatccgacaaatccagaatctataaggtacttaaacaaatcagcaagcaaaaaacaaacaaccccatttaaacatgggcaaaagatatgaacagaggcttctcaaaagaagacatgcacacagccaacaagcctattaaaaaatgagaacacctggacacaagaaggggaacatcacacacctgggcctgtcatggggygggaggaagggggaaggatagcattaggagatatacctaatgtaaatgacgagttaatgggtgcagcacaccaacatggcacatgtatacatatgtaacaaatctgcacgtggtgcacatgtaccctagaacttacagtataaaaaaaaatattccaaatatcactaatcattagagaaatgcaaatcaaggtcacaatgatataccatctcacgccagtcagaatggctattactatgtcagaatataacagatgctggcaaatttgcatagaaaagggaattcttacacactgctgat

SEQ ID NO: 45985 - DNA, 601 bp, Human
agtaacatttctatatactgagaacgtccatgctgagagccaaatcaagaccacaatcccactcaaatagccacaaatagaataaaatacctaggaacacagctagtcagggaggtgtaatttctctataatgagagttacaaaagttactgaaaatcaaagaggacacaaataaatgaaaaaacattccatgctcatggataggattaatcaatattgttaaaatgaccataatcctcaaggaatttacagtttcaatgctatttttatcaaactaccaaagacattcatcacaaaattwaaaaaaatcatactaggccgggcgcggtggctcacgcctgtagtcccagcactttgggaggccgaggcgggcggatcacgaggtcaggagatcgagaccatcccggctaaaacggtgaaaccccgtctctactaaaaatacaaaaaattagccaggcgtagtggcgggcgcctgtagtcccagctacttgggaggctgaggcaggagaatggcgttaacccgggaggcggagcttgcagtgagccgagatcccgccactgcactccagcctgggcgacagagcgagactccatctcaaaa

SEQ ID NO: 45986 - DNA, 601 bp, Human
atttaatatagctgtggaagtcctaaccagagaaataagtcaagatacagaattaaaaggcaaacatataggaagagataatgtcaaaatatctctcttcacagataatatgattctatacctagaaaagtctgcccagaggttcctagatctcattaaaatttcaacaaagttttgggatacaatatcaaggtacaaaaatcagtaacatttctatatactgagaacgtccatgctgagagccaaatcaagaccacaatcccactcaaatagccacaaatagaataaaatacctaggaayacagctagtcagggaggtgtaatttctctataatgagagttacaaaagttactgaaaatcaaagaggacacaaataaatgaaaaaacattccatgctcatggataggattaatcaatattgttaaaatgaccataatcctcaaggaatttacagtttcaatgctatttttatcaaactaccaaagacattcatcacaaaattaaaaaaaatcatactaggccgggcgcggtggctcacgcctgtagtcccagcactttgggaggccgaggcgggcggatcacgaggtcaggagatcgaga

SEQ ID NO: 45987 - DNA, 601 bp, Human
tactgaatgggcaagcgctggaaacatttcccttgagaactggaacaagacaaggatgctgactctcaccactcctatttaatatagctgtggaagtcctaaccagagaaataagtcaagatacagaattaaaaggcaaacatataggaagagataatgtcaaaatatctctcttcacagataatatgattctatacctagaaaagtctgcccagaggttcctagatctcattaaaatttcaacaaagttttgggatacaatatcaaggtacaaaaatcagtaacatttctatatactgakaacgtccatgctgagagccaaatcaagaccacaatcccactcaaatagccacaaatagaataaaatacctaggaacacagctagtcagggaggtgtaatttctctataatgagagttacaaaagttactgaaaatcaaagaggacacaaataaatgaaaaaacattccatgctcatggataggattaatcaatattgttaaaatgaccataatcctcaaggaatttacagtttcaatgctatttttatcaaactaccaaagacattcatcacaaaattaaaaaaaatcatactaggccgg

SEQ ID NO: 45988 - DNA, 601 bp, Human
gaaaagccttggactagacgaattcacagccaaattataccagatactataaagaagacggggtatcaattttactgaaactatttcaaaaatttgaggaggatggactcctttctaactcgttctataaggccggcatcattctaataccaaaatctgtcagagactcaatagcagaagaaaacttcaggccaatatcctggtgaacatagattcaaaagtcctcaacaaaatactaacaaaccaaatacagcaacatatcaaattcaatccatcatgataagattaccttgtttcctgrgatgcaagattagtttaacatatgtaaataaataaatgtgattcataacataagcagaactagaaacaaaaatcacatgatcatgtccatacacacagaaaagcttctgataacatttaatatctcttcatattaaaaaccctgaaaaaaaggcataaaagggacatacctgaaatataataagagccatctatgacaaattcacagcaaacatgatactgaatgggcaagcgctggaaacatttcccttgagaactggaacaagacaaggatgctgactctcaccactcctatttaata

SEQ ID NO: 45989 - DNA, 601 bp, Human
agaggaaagtttattagtcttaaatgtccatatcaaaaagttagaaagatctttacttaataacgtaacatcacacctagaggaaatacaaaaacaagagcaaaccaacccagagttaacataaaaaatagctagctgagctgaaagaaatggagacatgaaaaacacacataacatcaacaaaaccaaagttgttctttgaaagaataaataagattagtatagtactagaagactaataaagaaaaaaaaaaggatccaaataaacacaactggaaatgtccaaggggacattaccacyggccccacagaaaaaaaaaaaaaaaaaaaaaacctgagagactctatgcacacatagtagaaaacctagaagacattgataaattcctggaaacatacaaccacccaagactgaatcaggaagaaactgaaagagattaatagtgagttccaaaattgaatcagtaataaaaaacctacccaaaaggaaaagccttggactagacgaattcacagccaaattataccagatactataaagaagacggggtatcaattttactgaaactatttcaaaaatttgaggaggatggactccttt

SEQ ID NO: 45990 - DNA, 601 bp, Human
atctgtgactctatcttaaagaaataaattgatatctaaaatgttcttatacaaaaaaatttatcaatgtattatttattgtgtctaaacttaaaacctaattgctgagataagccatgtactttttgacatataagttctcttaagtgtttaaagatgttggataggattatggcaaagatatttggagacttgcatagtagaaaaacttagtagtcgaaaaaacctcagggtatcaagaaagtagagttctacatcacattgtattaaaaaataaactagtgttaacagatgaacacawaaatatatatattttctaatttgtcactgaaagagaccacaacataaagaataattctggttatttcttccactaatgtacaccataagtttccaattctgatcttttatatcggccttcaattaagaaaaattaataatttgctgtatagctgaagagaagttttaggagtgaatctcaggaaacagaaataatgaattgaagggtaactggaggttaagaatgaagttccacaattcaaagtagtctttcaaagaagttgctgagagagggaaaacagagagttgggatgatagcaat

SEQ ID NO: 45991 - DNA, 601 bp, Human
tctatctagttctatttttagtttttggagaaaccttcatactgttttacataatggctgtactattttaccttctcagcaacaatgaaggagttccattttctccacattcacaacagtatttttttttagactttttgataatggacattctaactggggtgaaataatatctcattgtgattttgatttgcatttccctgatgattagtgatgttgaaaatttttccatatacttattggccttagttcataaattcttgttataaattgtttataataacagcaaaataaataggarttgtatttttgaaagtaaccaataatgtttctggagtgttaaatactgaaagtcattttattttcaatctcacatctgtgactctatcttaaagaaataaattgatatctaaaatgttcttatacaaaaaaatttatcaatgtattatttattgtgtctaaacttaaaacctaattgctgagataagccatgtactttttgacatataagttctcttaagtgtttaaagatgttggataggattatggcaaagatatttggagacttgcatagtagaaaaacttagtagtcgaaaaaacc

SEQ ID NO: 45992 - DNA, 601 bp, Human
aagttcttaattcataataattttaaaatctttattttgtacatattcaaatatgaacaaataattgtacatatttatgggatacagagtgatattttgatacatgtattcaatgtgtgatgataaaatcagggtaattaggacaacaatcacctcaaacatttatctttgtgtgtatgtgttaggaacattctgaatcctctcctagctttttaaaaagtataaattaaattattgttaaccatattcactgtacagtgctatagaaaagacgaatttgttcctcctctctagccataaytttatatctattaaacaatctttccccatttcctcttcttccattctttcctttctctaataatcataattcttcactctatttctgttagcttaattttattctagctttcaaataacagttagaacttgcagtgtttatctttctgtgcctgacctatttcacttaaagtaatgcagtccaggttcatccatgttgctgtgaatgatagaatttcattcttttctatggctgaatagtatttcattgtgtatatacaccacattttatttattcttttatttcttgatggacacttag

SEQ ID NO: 45993 - DNA, 601 bp, Human
acagaactactttccacgaggcatttcaaagtgcatactgaaattcttactttctattcactcttccacctaatcgttatgttccttctttcccttaatgaaatcagcatcctgttgaaagctcacacttgaataaaaggttcttctctaatgtttccttcagctaacctcccatatacatacatttgagcatgaagcctgactagagatgaactatgattaattctatgtcttaaatccctcaagtaaattcatttacctcctattacctccaagttcttaattcataataattttaaartctttattttgtacatattcaaatatgaacaaataattgtacatatttatgggatacagagtgatattttgatacatgtattcaatgtgtgatgataaaatcagggtaattaggacaacaatcacctcaaacatttatctttgtgtgtatgtgttaggaacattctgaatcctctcctagctttttaaaaagtataaattaaattattgttaaccatattcactgtacagtgctatagaaaagacgaatttgttcctcctctctagccataactttatatctattaaacaatctttcccc

SEQ ID NO: 45994 - DNA, 601 bp, Human
ctcatatttttccatagttcatttaaaagcatggtgagcctgctgtgttatataaacacttccttgcagacttccttgtaagatgaaggagcatggcataatcatgttggattttgcgggtctgtatcttccacctaagcctgtttggggtctatcattttccctttcttcctcaagaggataatcagcagtgattttttttatgtattactttttaagttctcattttgtaacattaagtcaatgttgacccgtaagtagaatctgcataaaatgtaatgatttgtacctccatgatacsatagtttcatgacactagtcaagattcttaaacaatctcagattgagtatcttcagctgcaagacgatttaataaatgtaacctctagatcttctggataaatcccattaaaaataacagaaactgtagttagaatatatcaagtgtttaataaaggtcctcatgtcatataaacatgagatttatttaaatacttataatgtctgacttctttaaataaatgcttattaatcagttcctggagtgcataagataatcactggtaatcacccattgctacaagaatcatcaaaggagcag

SEQ ID NO: 45995 - DNA, 601 bp, Human
aattgaaatgcaaaagaatgaagtaaagcataaatataaatgaaatttctcatatttttccatagttcatttaaaagcatggtgagcctgctgtgttatataaacacttccttgcagacttccttgtaagatgaaggagcatggcataatcatgttggattttgcgggtctgtatcttccacctaagcctgtttggggtctatcattttccctttcttcctcaagaggataatcagcagtgattttttttatgtattactttttaagttctcattttgtaacattaagtcaatgttgaccmgtaagtagaatctgcataaaatgtaatgatttgtacctccatgataccatagtttcatgacactagtcaagattcttaaacaatctcagattgagtatcttcagctgcaagacgatttaataaatgtaacctctagatcttctggataaatcccattaaaaataacagaaactgtagttagaatatatcaagtgtttaataaaggtcctcatgtcatataaacatgagatttatttaaatacttataatgtctgacttctttaaataaatgcttattaatcagttcctggagtgcataag

SEQ ID NO: 45996 - DNA, 601 bp, Human
tttatagaacagtgtttttcaaacttttcataatttattctcctatcagaaagaaatactgctggtgaaccccaatatttgtatatgtatttatatactaatgattcacaaacacaaatgttatcactatgtaaagtatttcctaaaatgaactcaaaattgaaatgcaaaagaatgaagtaaagcataaatataaatgaaatttctcatatttttccatagttcatttaaaagcatggtgagcctgctgtgttatataaacacttccttgcagacttccttgtaagatgaaggagcatgrcataatcatgttggattttgcgggtctgtatcttccacctaagcctgtttggggtctatcattttccctttcttcctcaagaggataatcagcagtgattttttttatgtattactttttaagttctcattttgtaacattaagtcaatgttgacccgtaagtagaatctgcataaaatgtaatgatttgtacctccatgataccatagtttcatgacactagtcaagattcttaaacaatctcagattgagtatcttcagctgcaagacgatttaataaatgtaacctctagatcttct

SEQ ID NO: 45997 - DNA, 601 bp, Human
ataattctatagtatatgttctattatgttgctattttataaatgcagatactgagcatattgaagttaagtaacttgtcttagccataaagcaattggtgggattggaattaagacaaagaattttgctttctttagagctggtacctttaaccaatgtctttgcagaagccattttctggaatacgtatatctttaaaaaaaaaaaagaaaatgcatgtagaagttggttaacacttatttatagaacagtgtttttcaaacttttcataatttattctcctatcagaaagaaatactrctggtgaaccccaatatttgtatatgtatttatatactaatgattcacaaacacaaatgttatcactatgtaaagtatttcctaaaatgaactcaaaattgaaatgcaaaagaatgaagtaaagcataaatataaatgaaatttctcatatttttccatagttcatttaaaagcatggtgagcctgctgtgttatataaacacttccttgcagacttccttgtaagatgaaggagcatggcataatcatgttggattttgcgggtctgtatcttccacctaagcctgtttggggtctatc

SEQ ID NO: 45998 - DNA, 601 bp, Human
ggaaatatcatcaccatcatcatcttgtcaaccatactgagtgtttactctgtgatgattactatgcaaagataatggcattccttaattgacttgtcttacaataattctatagtatatgttctattatgttgctattttataaatgcagatactgagcatattgaagttaagtaacttgtcttagccataaagcaattggtgggattggaattaagacaaagaattttgctttctttagagctggtacctttaaccaatgtctttgcagaagccattttctggaatacgtatatctttaaaaaaaaaaaagaaaatgcatgtagaagttggttaacacttatttatagaacagtgtttttcaaacttttcataatttattctcctatcagaaagaaatactgctggtgaaccccaatatttgtatatgtatttatatactaatgattcacaaacacaaatgttatcactatgtaaagtatttcctaaaatgaactcaaaattgaaatgcaaaagaatgaagtaaagcataaatataaatgaaatttctcatatttttccatagttcatttaaaagcatggtgagcctgctgtgttatat

SEQ ID NO: 45999 - DNA, 601 bp, Human
cattatgttagttaaccatgtttatcacgtaaattatatttgacaaattgaatgaatatacatatttgaatatatatacatatatatatacacacacatatatatatatatctgtaaaggcaacatgaaggattacatatttttcttcgaaccaacagtgtatttcattttcccaagaatttctaacagtatttatttctttgttcttatgctttcattatgaagatatagtttcactttgcacttgttgaaactctttttagccactgcttagtatagtaaataaaccattgtattcaayttgacagtttttgctgatgttgtgatagtagctacataatacctagacaaacatatcatccaaatgttcctttctccaattatcagttgtcctttcagcacatctctctataactgtaatatctataaatttactctactatcaaaaataatacttagtaagcaccactgccaaatggtatagaaagtactattttgttatggaaaagatataatataaacatgattttataaaacacaatccttcgtgaatggaaaaagaaaactaaagtcatgcactttgttaatttgcctttcttta

SEQ ID NO: 46000 - DNA, 601 bp, Human
taacaacacaagaaaaaatttaaaaagtaaaaataaaaatctttaaaggttgatgaataaggtagactgaaaatttcatgaaccttcaaataaatcatgatggtttaacaaaaccaccaattaccatacatgtagagtgggaaattccatagtcataaaattatgcaaagactattttttcctaaaacattgttcagaataatgatcaaacattatgttagttaaccatgtttatcacgtaaattatatttgacaaattgaatgaatatacatatttgaatatatatacatatatatatayacacacatatatatatatatctgtaaaggcaacatgaaggattacatatttttcttcgaaccaacagtgtatttcattttcccaagaatttctaacagtatttatttctttgttcttatgctttcattatgaagatatagtttcactttgcacttgttgaaactctttttagccactgcttagtatagtaaataaaccattgtattcaatttgacagtttttgctgatgttgtgatagtagctacataatacctagacaaacatatcatccaaatgttcctttctccaattatcagttgt

SEQ ID NO: 46001 - DNA, 601 bp, Human
acaaataatgcttcctacttccaacaataataacaacacaagaaaaaatttaaaaagtaaaaataaaaatctttaaaggttgatgaataaggtagactgaaaatttcatgaaccttcaaataaatcatgatggtttaacaaaaccaccaattaccatacatgtagagtgggaaattccatagtcataaaattatgcaaagactattttttcctaaaacattgttcagaataatgatcaaacattatgttagttaaccatgtttatcacgtaaattatatttgacaaattgaatgaatatayatatttgaatatatatacatatatatatacacacacatatatatatatatctgtaaaggcaacatgaaggattacatatttttcttcgaaccaacagtgtatttcattttcccaagaatttctaacagtatttatttctttgttcttatgctttcattatgaagatatagtttcactttgcacttgttgaaactctttttagccactgcttagtatagtaaataaaccattgtattcaatttgacagtttttgctgatgttgtgatagtagctacataatacctagacaaacatatcatc

SEQ ID NO: 46002 - DNA, 601 bp, Human
gaattaacagctttttagaaagcagagaataaacaaataatgcttcctacttccaacaataataacaacacaagaaaaaatttaaaaagtaaaaataaaaatctttaaaggttgatgaataaggtagactgaaaatttcatgaaccttcaaataaatcatgatggtttaacaaaaccaccaattaccatacatgtagagtgggaaattccatagtcataaaattatgcaaagactattttttcctaaaacattgttcagaataatgatcaaacattatgttagttaaccatgtttatcacrtaaattatatttgacaaattgaatgaatatacatatttgaatatatatacatatatatatacacacacatatatatatatatctgtaaaggcaacatgaaggattacatatttttcttcgaaccaacagtgtatttcattttcccaagaatttctaacagtatttatttctttgttcttatgctttcattatgaagatatagtttcactttgcacttgttgaaactctttttagccactgcttagtatagtaaataaaccattgtattcaatttgacagtttttgctgatgttgtgatag

SEQ ID NO: 46003 - DNA, 601 bp, Human
tttgatgattaatgaattaacagctttttagaaagcagagaataaacaaataatgcttcctacttccaacaataataacaacacaagaaaaaatttaaaaagtaaaaataaaaatctttaaaggttgatgaataaggtagactgaaaatttcatgaaccttcaaataaatcatgatggtttaacaaaaccaccaattaccatacatgtagagtgggaaattccatagtcataaaattatgcaaagactattttttcctaaaacattgttcagaataatgatcaaacattatgttagttaamcatgtttatcacgtaaattatatttgacaaattgaatgaatatacatatttgaatatatatacatatatatatacacacacatatatatatatatctgtaaaggcaacatgaaggattacatatttttcttcgaaccaacagtgtatttcattttcccaagaatttctaacagtatttatttctttgttcttatgctttcattatgaagatatagtttcactttgcacttgttgaaactctttttagccactgcttagtatagtaaataaaccattgtattcaatttgacagtttttgct

SEQ ID NO: 46004 - DNA, 601 bp, Human
aataataacatggaggcagaattgacaaaacttaatgaccaactggatgtcaaaagaaattgcctgtgttaggagtgtcaaatgagagttgggaaacgcagaggttaagataccttcaaaaatcacaagtgacaatgctaactggtgctggttactccagactcagaaggaactgcgattgctatcatgatattcttccttccactccatcactctaagaaaagcttaggttcagatttttaagacctcataaactgtccctaaattctgaatgactaatcggatgaaatggctatgactrgtatataaaacaaataaaaaaaagaagaactaaaatgttttggttactgtggtagacatataattgtttaccaatatgtctcttgcaattgcacaaggttacatgactggttttactaacaagatatgagtaaaagtgatgtacaccattttcgaactgaaacactgaaaggcctatgaataattgtctcgtctttattgcttcctagtttggcaatcagtagttgaaggatggtggagcctctaccaagcctgcgtcactgagtgactgtgaaacttggatacacttcccccactaact

SEQ ID NO: 46005 - DNA, 601 bp, Human
tgctcttcagcaaaggacaatataagtaagagaatcaataataacatggaggcagaattgacaaaacttaatgaccaactggatgtcaaaagaaattgcctgtgttaggagtgtcaaatgagagttgggaaacgcagaggttaagataccttcaaaaatcacaagtgacaatgctaactggtgctggttactccagactcagaaggaactgcgattgctatcatgatattcttccttccactccatcactctaagaaaagcttaggttcagatttttaagacctcataaactgtccctaamttctgaatgactaatcggatgaaatggctatgactggtatataaaacaaataaaaaaaagaagaactaaaatgttttggttactgtggtagacatataattgtttaccaatatgtctcttgcaattgcacaaggttacatgactggttttactaacaagatatgagtaaaagtgatgtacaccattttcgaactgaaacactgaaaggcctatgaataattgtctcgtctttattgcttcctagtttggcaatcagtagttgaaggatggtggagcctctaccaagcctgcgtcactgag

SEQ ID NO: 46006 - DNA, 601 bp, Human
tcaatttaaaaaacacatcttacctctcctcttgggaagtgaacacatgaagcaagcaaatactataaagccttcgtgtgaaacaaataggaacacatggctctgggggactggagtggtaatattaaaatggggaagtagttagagaatattacctatctttcttctaatttgagagattctttataaaaaggaaaaaaaaaagaaggaagccacaaagtgtctataaacagtcccctttcattccaaaagcacctctgtagtaccatatagaggagttaacatggagagttagtggcakattttacactatgtggtgaagtctattttaaaaaatgatactaacattgtctcaatgctcatttcaaaaaggtactctgtatttttgtgaatttatttaaatcttgtctgtgtagttaaacacagaagcaagaaaattaatattagaacaatgttaagaaaaaataaatccccttcttgaattgttgtggctggaatatcttttggaatgcgtattacctattgtctttattcccacttccatgcctatccttttatttaatctatttttatcttatattaacattttaattttattagt

SEQ ID NO: 46007 - DNA, 601 bp, Human
agagtttctcttcatcaatttaaaaaacacatcttacctctcctcttgggaagtgaacacatgaagcaagcaaatactataaagccttcgtgtgaaacaaataggaacacatggctctgggggactggagtggtaatattaaaatggggaagtagttagagaatattacctatctttcttctaatttgagagattctttataaaaaggaaaaaaaaaagaaggaagccacaaagtgtctataaacagtcccctttcattccaaaagcacctctgtagtaccatatagaggagttaacatgsagagttagtggcatattttacactatgtggtgaagtctattttaaaaaatgatactaacattgtctcaatgctcatttcaaaaaggtactctgtatttttgtgaatttatttaaatcttgtctgtgtagttaaacacagaagcaagaaaattaatattagaacaatgttaagaaaaaataaatccccttcttgaattgttgtggctggaatatcttttggaatgcgtattacctattgtctttattcccacttccatgcctatccttttatttaatctatttttatcttatattaacatt

SEQ ID NO: 46008 - DNA, 601 bp, Human
tattgcaaaaatactttagtatatattttccctgatgtatatgttccacatgtattttcaaattatttgaatgtcattattttttttctaagcatggttaagtgactatgacagatacatattatcatgcttgaagcaatacatgatattgcatggacatatataagctgaaaatgagcccagtgtgactcagaacaattatattttcaaagaagactaattacgacttaagggatgaaaaatattataatctatgcacttatgcagtttgaaactgaatctaattagaaattgtcttttytatgacctcttcttggttacataaagctaattattccatctgtgaaaacttgtaaaaatataatgtattccggaaagctcatggaaagctgaaatattgagctcaactaagcccagcttctcatagagaaaaacagatggcaattaatataatgtctccatttttagaaaaatattgagtaggcgtggccaaaatgatatatcatagacttagaatttgtggtgatcagagagttccaaacctttcccaaaacaaagaaaaacagaaaaacttaaaggttttgaaaatgctactaaaaaa

SEQ ID NO: 46009 - DNA, 601 bp, Human
aaatgttattttgcaccatagtaaagaccaagagagtcactctctactgactttcgggttattttcccaaatagtttgagatggaatgttctaaagacagtttgctggagataagagtagcacatgtggagcaaggatggctgaataactaactcaacaccaacacttgctagttccatcaccttggacgaatagctcgacctctggttgtctcagttgtctcatgtgaaaattgaggataattattatgcctctcaaggtctgtgttcttgatgaaatgagttgctgcatccaaaatacygtccggcacgtattaagagttaaatgtttttagtgagctacatgaaaatagctattgacaggtgaataataagcatctagtgatttctgcatttctcaaggtcgaaatattcagctattttcatttctgctaaaaatatacacacataaaaagctttgtaaatgactattgcaaaaatactttagtatatattttccctgatgtatatgttccacatgtattttcaaattatttgaatgtcattattttttttctaagcatggttaagtgactatgacagatacatattatcatgcttga

SEQ ID NO: 46010 - DNA, 601 bp, Human
ctgggaggaggtacataaaattggtctcacagttgaacaaacgaccaaccgttgaatacaaacattaaaaaatttatgtcaacatgttgttactcagcagccacataatttggtgccataattgtcaagtgaaataaagaaacggaacacatacaatataatttctttaattgaaggaaaaaagttgtagacaaatgcagggaagaagtcctggatatatataatataaattgattttatataaataaatgttattttgcaccatagtaaagaccaagagagtcactctctactgactttygggttattttcccaaatagtttgagatggaatgttctaaagacagtttgctggagataagagtagcacatgtggagcaaggatggctgaataactaactcaacaccaacacttgctagttccatcaccttggacgaatagctcgacctctggttgtctcagttgtctcatgtgaaaattgaggataattattatgcctctcaaggtctgtgttcttgatgaaatgagttgctgcatccaaaatactgtccggcacgtattaagagttaaatgtttttagtgagctacatgaaaatagcta

SEQ ID NO: 46011 - DNA, 601 bp, Human
tgtttttctaaaatgtgttttttctcttaatgttcttatgacaagatatactacagaaaaataaaacactgttttacttctaatatctaaacaggtattctactattcctttgattatttcagaagataaactcacataaacctgtctttatttttagttttcatgtacaattaaaaagcactgtaaacactctcaatagccaaaatccattcactgggaggaggtacataaaattggtctcacagttgaacaaacgaccaaccgttgaatacaaacattaaaaaatttatgtcaacatgytgttactcagcagccacataatttggtgccataattgtcaagtgaaataaagaaacggaacacatacaatataatttctttaattgaaggaaaaaagttgtagacaaatgcagggaagaagtcctggatatatataatataaattgattttatataaataaatgttattttgcaccatagtaaagaccaagagagtcactctctactgactttcgggttattttcccaaatagtttgagatggaatgttctaaagacagtttgctggagataagagtagcacatgtggagcaaggatggc

SEQ ID NO: 46012 - DNA, 601 bp, Human
acaggcaaagattttatgacaaagacaccaaaagcgatcacaacaaaaggaaaaattgacaagtggaatctaactgctcttaagaatccctgcacagcaaaataaactattaacagactaaacaggaaaactacagaatgagagaaaatatttgcaatctatgcatctgacaaaggtctgatatccagcatctatcaagaacttaacaaaaatttacaagacaaaacaacctcattaaaaagtaggcaaatacatgaacagacacttttctaaagaagacatacacttggccaacaagcamatgacaaaaagctcagtctcacttattagaggaatgaaaatcaaaagtacgagataccatcttacaccactctgaatggctactatgaaaaactcaaaaataacagatgctggtgaggttgaagggaaaaagatacacttacactgtcggtgagagtataaattagtatttacattagttcatttatgtcatcattgtggaaagcagtaaggcaatttctcaaagagctgaaaacaggactaccattcaacccagcagtcccactactgggtatatacacaaatgaatacaaataattct

SEQ ID NO: 46013 - DNA, 601 bp, Human
cataaatggtgttgggtaactggctagccatatacaaaagattgaaactggaccctttccttacaccacatacaaaaatcaattcaaaatggattaaagacttaaacatgaaacccaaaactataaaaaccctggaagacaatctaggcaataccattctgggcatagcaacaggcaaagattttatgacaaagacaccaaaagcgatcacaacaaaaggaaaaattgacaagtggaatctaactgctcttaagaatccctgcacagcaaaataaactattaacagactaaacaggaaaaytacagaatgagagaaaatatttgcaatctatgcatctgacaaaggtctgatatccagcatctatcaagaacttaacaaaaatttacaagacaaaacaacctcattaaaaagtaggcaaatacatgaacagacacttttctaaagaagacatacacttggccaacaagcaaatgacaaaaagctcagtctcacttattagaggaatgaaaatcaaaagtacgagataccatcttacaccactctgaatggctactatgaaaaactcaaaaataacagatgctggtgaggttgaagggaaaa

SEQ ID NO: 46014 - DNA, 601 bp, Human
cttccacattcactattgatgtgaaatcctaagatatacagcaacaagtgccatttcatttttgggctggatatcatgaactttattcaggagcagtggtagaggactgtggattaatgagcagcatatgtgaagtggtaagcactgacaacattaagactgagtgtgcaaaagttctaaaatgaaaagagatagattccaattggttaaataaatgctggtgaaatttcatattcttagatacagtatttcactttttattcccctccacaaactatcagaccatgatttgcccttattkgtcaagggtaaatttttgtatgctcctgtattgaagatttgcctaaaacacctttatcagtatagatcttaattatgtctttaccatctttgcagtctgattttttaaaattattgtacttttttatgagcctttggtgctctcagtgttatacaaaaataaacatcagacatataagcattgataattatattctttgtttaaaaaacatagtgacaggaatagaatgaaatgaagggcatctgaaatttatagggttcgtgtgagaaaaataggaataaaaacatgattttctttttt

SEQ ID NO: 46015 - DNA, 601 bp, Human
cctgtttgtgatctcttaaaaaatcaagggaaacttggcagcttcacagaatgacaccatgcataaaaagactttgaaatggctttctcagaaccactagtatgaaatataaagaaatgtgagtggatacagtttgcatacataagtgaaaaggaagcaatattttggggccaaaaattttaataacccatgtgtcaactctttctctaaacattcattgcacagcactaaaatgtgaaagatcattttctgttttatttatgaactctcattaagcatataatttgcatacttactgtcmccaaaaaaaaaaaaaaaaaaaaaaaagccctctgggacagctacagcagtgtgagtcagaatagctatactggagcctctgatgccctctttgacattacacagccttccacattcactattgatgtgaaatcctaagatatacagcaacaagtgccatttcatttttgggctggatatcatgaactttattcaggagcagtggtagaggactgtggattaatgagcagcatatgtgaagtggtaagcactgacaacattaagactgagtgtgcaaaagttctaaaatgaaaagagatag

SEQ ID NO: 46016 - DNA, 601 bp, Human
gacaaacaacaacactcatgacatctgggtcatttttctaccaagtgctatttttccctattaaatatatgattgaaatatttctcaattcaatttaaagttaaaaatcatcatttataattctaaggaaaaagccctttaatttgaacactcttagataaaacattcaagaaaaatgaatggtagcagtaggtatatctcaataatgaaatactgtggctttgtttatactcctctatattccaaactttctataatggtcatacatttcagcagaagtgaaaaacatttcacataatgmtccacttctgattgaagactggtggcagctgtcagcattgctagactgagaaacactctgggctgaaaccaggcaaataagaaaaaatgctctcgcctgaaatgggccctggataaaccagcagtggcattttgccctgcatttccaatcttgtttatattttccaatcagatgaatatgctaaaaaatctacctaacatttcagtatgaagaaatgctaatactatgtcttatgttagtgtgtttttatattttctcttattgctaatacctgggaatgttaatccatatttattttca

SEQ ID NO: 46017 - DNA, 601 bp, Human
gtgacaagggaatgttttcgcagtgactactgtactgccaggtcaagtctttatagctgcctatcaccaggcctgaacaaatcacagttgttacaccaaagccgtattcctaatcttcaataaaggaaagtgggatgaagactctttctggtgtacagcatcagcacacaaggggaactacaatacgatacatgattaaatgagtccttcaagaagaaataaaataatactagaaggaaatctggatctatgcaaaaatagaatcaccagaaatggaaggtatatcagtaaatagaaagamcttctttaaattataatatcattaaaggagaattggctgttaaagcaaaaataataacaaagtattgtggagcatacatcatttacagaagtaaaatgtatgaaattaacagcataaagattaggaatatgctattttaagctccataaaccatatataaagtggtatgatataacttaaaatagattataataatggtacatgcgcatataataaacctaaagcaactactaaaataaaataacagagtttactacaggctacaaaatagataaaactgaagcctaaagaatactcaat

SEQ ID NO: 46018 - DNA, 601 bp, Human
gttctagtttgaagttaatttcatttcaaacataaatgcagtcagtaaaagcccatcattacttgtaaagaaatgtgtgtttaataagcaacaagttaataattttcttgattttatctcatgacataatgaaatatggattcccttcagtaattcaaaccaaattctgagttcaagtgcagattcaaatataataataggcagttcacttcaatacaacagaaatatatgtaagaaaaagaaacagcaaaatgtttgcaatagttgtttttgaagaataaagtagctggctaggaaattyggaagtaaggtcaatattcaaaaacttaaatggccgtggatatagaaagataatgaagaattgaagttatatttaggtaataaaacccgcagtattcattaatttaatactgagattgaggaaaaaagataaatcacatataattttattaattgatttatttacttcacagtcaacaaaaatgcaggaatgcttcagaaggaaaccgttgctagaagtttggcaaagcaatagaaatattcccctatttccatattatataacacttctaatagcaactgaccatcactcagctggcct

SEQ ID NO: 46019 - DNA, 601 bp, Human
gctgcaattactctacaacctaaagtctcgaagtgaaactcaggaaacagataatattttctcacttgtcatcttaactgggcaaagtgttcttcaaattttttatttttctgtccatagtcacctaaaaactaggtcatttttattatttttgtgctgcatttttgacacctctactttttataatctgagataatggaatttaagtaaaacaaattagactgtgtttaataaatcaaacaatattatatttagaagaataagaagagaaattcatcccagtctcagtcatgttcaactyatgttcccaaaggcaagagatttatagaatctaattcacaaatgtgataaattttgaaaattcatgattttttattttcctgagtattaactgaaattaaatttgtatagattttccatacaaagcttaaggtgaatttaatatttctataaaagctctcctttatgacatattgtaccatattgttgatgaagaatattaaattttctatatgcttttccaaaaaatgcaacttaaaatattgcataataattacagagatcattataacatattatatttgaatttaaaatctgaaat

SEQ ID NO: 46020 - DNA, 601 bp, Human
tttgatcataacccaatgagacccataatacatttgttttaagccatgaagttagtggcaatttattacagcaagaatagaaactaacacattattctttcatttgtatttaacatttaacatgaattaaaataatcataccagaacaattgacaaatttattttatataattttagtgttaatgtagtgcttttagaatgaaaactatataatctacttatatttaacacactcatatttataatgtaatgaagatgtagaatcctttttacttactttctttaaatataggcttattgkcattaacatctgaaagtttaattaatacacttgttgttccagacaacgctcctggctgaccaatcatgtccttggcttgaatgattacccaatactcatcttgcagttctctatccattttagaagatattcttatgactcctttaaaaatataataaaattccaattatttcattattaatcatgacaaagttctagttaatttcttaaccattgcagtatacattattttgctatatgttgaaccactgcaatgtgacagagacttcactagagaaaaataataaaaaataaattaaa

SEQ ID NO: 46021 - DNA, 601 bp, Human
taatatgaggttctcagcccagaggtggtatgtaaagccacgtgtctggataagatcataaaggaatgagtataaaagggaagaaagacgagatcaaaggcctgactcacaaatgttccgaagtttaaagtatacaaagaagaagaaaaggcaaggaaggaaaaaacagagactagtaagacagaagaaaaagctaatgagaatggagcattaaggttttcaaggagaagttgatcaattacataaaattcttccaagaaatcaagtgttatcagaactgagaattgacactgcattccayttaggttattgatagaaatgatcagatcagtttggtcaagtagtgtggatgtaactcaaacggagtaagttctgagattttgaggtcgttaattggaaacaataagtatgaacaatattttaaataaatcttctctaaagagaaaggaagaatacaaagcatctttagctaagtatggaagtgaaggcaagaaagtgtttttgttttgtcttgttttaggatgtgagaaaaaacaataataaacatgtttcgatgtgatagatatgaaccagcagaggacgctgttcacacaagggagag

SEQ ID NO: 46022 - DNA, 601 bp, Human
ggtctacaagcgcccaccaccacgcccggctaattttttgtatttttagtagagatagggtttcaccgttttagctaggatggtctcgatctcctgacctcatgatccacctgcctcggcctcccaaagtgctgggatttcagatgtgagccaccgtgccgggtcgcaattgtagcattctttatttttgatctgtagggaatcccgtatctacctttcccagttacttgttcttaatctttctttatttgttctcttttttctttctctttttcctttctttctttccttccttccttcyttctttccttccttcctctctctgcccccatatatagtctctttccctttctttttgaaatataaatattttctaatctcctatttgagcatctatcatcatctctcaaatatatcttaggaaagtctatcaccaatattatctctatttacatgcatgtctcctcaatattcatgttttattttttattgtaaccttcaaccatactaaattaaatttgacagaaataactttcaattttactctaacattcctgatacctgaagttactgaataaatatacatgtggaataaaggtgg

SEQ ID NO: 46023 - DNA, 601 bp, Human
ttcaaaatgggacccaccttgtaataccatttcactggcatttcagatttcaaatatgaattttgagggacgtaaacatttagacttctgaaataatacatagtcttagtgataaaataaaaattttaagaataatttcttatgaagttcttaataattttatggtagtaattttattacagattgtttgggctcctctaatttttaccatacaaggctccttaaaacaattctatcatctcactttcaagtctaaatattaaatttttccattatttctgtgccccattttttaaaaatkgacatgtagtttgttattataattcatataaaggtagatcttgctcctcaagcttttatgacctcaactaaagcaagagtatttcgttacaccagtttatttaccccacccaagacgtgatgaaactgagtttgggaatttccatgctttacagaaacagcaggtgattcttacttagtaggaaaaactaatatgagttgaatgaattggggctaatttactatgtttaatatgtgttagtgtttctcccacaacaatgagacatccctaaggctaaaatacaatatcctaatatttttt

SEQ ID NO: 46024 - DNA, 601 bp, Human
gttaaattttacatatatgtaaaatacatatatatatttttcccatttttaaactagggagacaaacatcagaaaattcataaatatgtaaacagctgacttatttagatatgtaccatcatgacctcagcaaaatttaaaatttggaattttcccactaatccaattaaaaacattttacaataattttggacttacagaaatgttgcaaaaacagcacacagcatttctacatgctcttcactcagctttttctaatgttaaaatcttatataaactttaatctgtttaataaattaaycgctataatttaattaatcaaactacaaactatagttggatttcactgttttttttccactcatattcttcttttacaatccaatgtagaatccaatacggcctttcattttcctgcgtccttagtctcctccacgattcctcaatgttcttgtctctcaagaccttgatgctattgaagagtattggtcaattattttaaagagcgtctctcaatttgggtttgtctgatgctttctcatgattagactaaggttacatatttttggcaggaataacacagacatgatatactttctta

SEQ ID NO: 46025 - DNA, 601 bp, Human
atatatgctttattctatattacatatagaaaatatgtaatacataatacatatatgttttatgcatatatatgtaatatatgatacatatgttttattatatattacatacaatatatgtatgtatatatgtatgtgatatattacatcacatgtatttattttatattatatatttttacatataatatatatgttttatatatatacacacatataaaacaaaagtaaaatacagtagttctaatgtgcttttagattgtgcatggaagaaagccaagttacaaatttctcccaaggraaaaaaaaaactgaaaaatgatctccacctccacaatgaaagaagacttcgaaatactcagcatgtctcatctatgtggaaacaattaataataaaaattaaagagcaataataactagggttcaataatggcttctcattgcatgtatattcctgaagactttgatgagatatcaaggaagtttaccataattatatggcaaagatgagaatattttaattttgagttcaagtatttccaaaaacattatgctactttgtagctaggtattcagataaggactcaatagaaatcacgag

SEQ ID NO: 46026 - DNA, 601 bp, Human
agatagaaattgtaattttcaattaactaaaaattaaaatttctaggatttattacacacacacacacacacacacacacatccatggcctttaagaaatacagcaactattagtatttatcattttgagacttttctccattgtgtgacatttaggatgaaaataaattaatggaacatttaaaaatgaaaaggtatttctaaagatttcaagaagaaattaaccagaaaatttaggttcgtatttgttatggtttcagcgcatacatcatcacagaatatctttttgcttaaataattaaattgtataatgtaattcagttgtgaataaactgacagaaaattaataagaaattcataatgtttttatctttgtgttcctaaactttgcttgaaattaagttaaattaaacctttggtattactgcacaaaatgtatataaaacttcacagcttcaccttaaaatagttagtagttttattcacttagctagcatactgataaatagcattgtgcttaatttgggaagctttccagaaaagagactaagcacaacgaacttcatttgctggaaaaaaaaaatttttaaatggaacatct

SEQ ID NO: 46027 - DNA, 601 bp, Human
ctcctgaccccaggttatccacccaccttggcctcctaaagtgctggaattacaggcttaagtcatcatacagggcctctctttttcataaaaaaaaaagaaagctataggaaaggtgcatacaattaaagggtataggagtgggattctttagtttgttttagtgtttttatttaaaatatatgtactatttgcaatgataatttgaaagaacaaaacaaattaaaaattagaggccttgtacttgttgaaagcaagggaaaatattttttctttccttccttttctcagagcattcatccacacacacacacacacacacacacacacagagaaagagagagagagagggaaaaaaaaagctttgtatgtaagttttttctttgtccctttgaagcgtatggaaatctttcaaaagttcaacaagtttcttggaagctttaggatccaggattgtatttatcaagtaatggtgaccatctctttgaaatgtaatcttcaaggaatacagcatccctatatcctagatgtggggaaggataggagactcattttagcaacgatcttgttctaagttgtagaactacctcttgtcataaag

SEQ ID NO: 46028 - DNA, 601 bp, Human
ggtgtcagccatcaccccctgcctgcctttatttttaattaaaatgtattagtctgccaaaaagttacagggtttatgtagttacttgttctgttgttgttgttgttgttgttgttgttgttgttgttgttgttgtttcgagacggagtttctctctgtcgcccaggctggagtgcagtggcgcgatctcggctcactgcaagctccgcctcccgggttcacgccattctcctgcctcagcctcctgaatagctggtactacaggcgcccgccaccatgcccggcaatttttttttgtatktttagtagagactggggttcaccgtgttagccagaatggtctcaatctcctgacctcctgatccgcccgcctcagcctcccaaagtgctgggtttacaggtgtgagccacccagcccggcgtagttttgttttgagacagagtttcactcttgttacccaggctggagtgcaatggcgtgatgttggctcactgcaacctccacctcccaagttcaagtgattctcctgcctcagcctcccaagctgctgggtttacaagcattcgcccattcgccactacgcccggctaatttcgtatt

SEQ ID NO: 46029 - DNA, 601 bp, Human
cctgggctcaagtaatcctccctcctcagcatccttggtagctggttctacaggcattaatcaccatgcccagctaattaaaaaaaaaaaatgtagagacggaatttcacagtgtgaaagtccagtccagaaaggctggtcttgaactcctggacttgagtgctgctcttacttcggcctcccaaagtgctgggataacaggtgtcagccatcaccccctgcctgcctttatttttaattaaaatgtattagtctgccaaaaagttacagggtttatgtagttacttgttctgttgttgtggttgttgttgttgttgttgttgttgttgttgttgtttcgagacggagtttctctctgtcgcccaggctggagtgcagtggcgcgatctcggctcactgcaagctccgcctcccgggttcacgccattctcctgcctcagcctcctgaatagctggtactacaggcgcccgccaccatgcccggcaatttttttttgtatttttagtagagactggggttcaccgtgttagccagaatggtctcaatctcctgacctcctgatccgcccgcctcagcctcccaaagtgctgggtttacagg

SEQ ID NO: 46030 - DNA, 601 bp, Human
gatagtctgataaccttgatgttaaaataaaggtaatacaagaaaacgttgctcctgtaggatgatttattgattgttatgtaatcttattgccttaaattgtgttacttcaagatattaatctggttgttttattaatctaggaggtactttgaaagatcacttttctttttattagttttaaggtgctttattagataaatggtgtcccaaaacaccctttactttggttattattcttaaataaaattttctttataatttcattttatatacatttttacatacttgctgaaatttctatacacacaagtaattcatcaaaccaatctatgaatcaatttactaaaaatgttcacttcctattaatattagtaataaatagaatgtggtttctggatctgataaattttttaaatgttaatttctatgaatgcatattgtggaaaataatttgggaaagcttcaacagtactcttacctggttaaaacattcagaatgataaatatgtcacctgtaatggatacagagtgcttggaaatttcttcattggcaaagtcacccacggtatttacattaagtcatttactacatcaacac

SEQ ID NO: 46031 - DNA, 601 bp, Human
gaattttcctttaattatttttcaatacaagtcttcaagtctgatagtctgataaccttgatgttaaaataaaggtaatacaagaaaacgttgctcctgtaggatgatttattgattgttatgtaatcttattgccttaaattgtgttacttcaagatattaatctggttgttttattaatctaggaggtactttgaaagatcacttttctttttattagttttaaggtgctttattagataaatggtgtcccaaaacaccctttactttggttattattcttaaataaaattttctttayaatttcattttatatacatttttacatacttgctgaaatttctatacacacaagtaattcatcaaaccaatctatgaatcaatttactaaaaatgttcacttcctattaatattagtaataaatagaatgtggtttctggatctgataaattttttaaatgttaatttctatgaatgcatattgtggaaaataatttgggaaagcttcaacagtactcttacctggttaaaacattcagaatgataaatatgtcacctgtaatggatacagagtgcttggaaatttcttcattggcaaag

SEQ ID NO: 46032 - DNA, 601 bp, Human
aagaaaatattgtaaagcataattttaagatctgtatatcttcactgaaacacatttggagaattttatattgttttaaaattctatattttacccattctacctattaatagatttgcattataaaaaaagtgaaccagcaaatttcatggacaaccttataatcacatcacaaactttaaaaaacaagttttacaattcaaagaattttcctttaattatttttcaatacaagtcttcaagtctgatagtctgataaccttgatgttaaaataaaggtaatacaagaaaacgttgctcstgtaggatgatttattgattgttatgtaatcttattgccttaaattgtgttacttcaagatattaatctggttgttttattaatctaggaggtactttgaaagatcacttttctttttattagttttaaggtgctttattagataaatggtgtcccaaaacaccctttactttggttattattcttaaataaaattttctttataatttcattttatatacatttttacatacttgctgaaatttctatacacacaagtaattcatcaaaccaatctatgaatcaatttactaaaaatgt

SEQ ID NO: 46033 - DNA, 601 bp, Human
gccagactctgtctcaaacaaaaaacaaacaaacaaacaaaaaagtgagaaacgtgatagacagttccaatcgaaagagaaatagagcagcctcagttattaaacgcctatcttttttaaactctggccatcctggggccaagaatgataactagctggaagaaaatagctgttttttttttttttttttcagttttctgatgctgtagcacatctaagcaatctctaaaatatacaaataaatccatcatgaaaaagttaccaattatttttggagataaggaatttttttcaaaagagtaaagaaaatattgtataattttttctttttttgagttaatttgagttattgtataactgaaaagaacaaagaaaatattgtaaagcataattttaagatctgtatatcttcactgaaacacatttggagaattttatattgttttaaaattctatattttacccattctacctattaatagatttgcattataaaaaaagtgaaccagcaaatttcatggacaaccttataatcacatcacaaactttaaaaaacaagttttacaattcaaagaattttcctttaattatttttcaatac

SEQ ID NO: 46034 - DNA, 601 bp, Human
gtctcgaacttctgacctcaggtgatcctctcgcctaggcctcccaaagtgctgggattacacacgtgagccactgtgtcccacctaggtttacttttatctgagggtttcttagcatcaaatgaaaagttcgtgtatataatttttatgtgtattatttagttcctttgacttgatatgtaaaatatttacagatttcaaagtattgtatattgttaactttttattatttttaggaaagtttaaataacatgaaaattaactgtaactttgaaactcaacgatacaaatctcttgaccraaaatattccttagaaacttctctgtgacatagtctcagtattattaagcataattgttttaatcctcttttctatttttcttacattatttcattttatttcattccagtctaatgactttttttaaaaacctgcattttgaaatgattatagattcacaagaaaatgtaaaccctgtgcatgcagtctctcagacacttcattcagctaaaccaatggttacatcttatgtacctgtagtacattattaatatcacacacgtatgatgacaaaacaaaaaaatcaacctctataacac

SEQ ID NO: 46035 - DNA, 601 bp, Human
aaaataagcccaatactcacattcttcaaaccaaagagatggttcttattaaacatgcaattgatggacagctaatttaagatgcaactcttgtacacaaatatttggagcaagcaatacatttgtgtctgtttccttaccttcatggcaagtcacaatgaaacctacttccaggattagtcaatgaataaattgttgaataggattataaactatagattgaatcatgaactctaaatcaagatacaaatactgagtattaatttatataactcatcaattccttgaagtgcacttaatmaacaataaaaaaatgcttctcaatagaaaaatgttaaacaaaaagttggagttgtaataaatgaatatctggaaagattttcttaaaaatcttatctgagttgcttatttagttattctaggtaggtataccttgtattaggctaaagatgcagattgtctcccattgccaagaaattattatacaaacatatgtatgagaccatcactttttatattactctaatgagtaaatgattttaaattacacctgttttgacaaaataaatctataaaactcaaaaaaggtgttgaacatctg

SEQ ID NO: 46036 - DNA, 601 bp, Human
aaagtcacacatgggccagtttactaagatatcattccagattaattatcctgagccaaaaataagcccaatactcacattcttcaaaccaaagagatggttcttattaaacatgcaattgatggacagctaatttaagatgcaactcttgtacacaaatatttggagcaagcaatacatttgtgtctgtttccttaccttcatggcaagtcacaatgaaacctacttccaggattagtcaatgaataaattgttgaataggattataaactatagattgaatcatgaactctaaatcaakatacaaatactgagtattaatttatataactcatcaattccttgaagtgcacttaataaacaataaaaaaatgcttctcaatagaaaaatgttaaacaaaaagttggagttgtaataaatgaatatctggaaagattttcttaaaaatcttatctgagttgcttatttagttattctaggtaggtataccttgtattaggctaaagatgcagattgtctcccattgccaagaaattattatacaaacatatgtatgagaccatcactttttatattactctaatgagtaaatgattttaa

SEQ ID NO: 46037 - DNA, 601 bp, Human
tggaggatatttatttttcctttaaatataccaatggaaaggttttcattttcattttaaaataaaattataagaaaaacttctatatgttgtattggttgctatttacttatatctctttatctgggaactatcgttgaccttatacatttatgaaaggagtaaagataaattaaaaggtaaaagtatataccaagaacagccatggcttgagagattgggaaaagagaaaatgaaaataactccaaattatgaccaattctgaaagctcagatttttagtattctttttgctctctacrtagaatgttggccaatttatttctgatgcagtacattcaatcatctatatacagtgcattgaaagctacaatggaaatacattgtgtaagccccaagaattgaaaagtaactacaatttaataagaacttacctatgggccaggatctgttctatacattatcttagataatcttcacaatggtctctggaataaatcctattattgttcccatgttataaatgtttatattaagcttcatataagctaagtgtcttaggtaagtaaattggctgggccagaattagaatgtaagctgat

SEQ ID NO: 46038 - DNA, 601 bp, Human
cttttaaatgatcatgtctccacttatatttgctttgtaagttgggcttccaataagatatgttttactggctttcataattactttataaaaataggaagacacagacataaaatgagtcatatatcaagtattatgaattttattgaagttaccttgaacaggtacacttaaacacataccactaataaagggaccacattaatatgctaataagttttgatggaggatatttatttttcctttaaatataccaatggaaaggttttcattttcattttaaaataaaattataagaaamacttctatatgttgtattggttgctatttacttatatctctttatctgggaactatcgttgaccttatacatttatgaaaggagtaaagataaattaaaaggtaaaagtatataccaagaacagccatggcttgagagattgggaaaagagaaaatgaaaataactccaaattatgaccaattctgaaagctcagatttttagtattctttttgctctctacgtagaatgttggccaatttatttctgatgcagtacattcaatcatctatatacagtgcattgaaagctacaatggaaa

SEQ ID NO: 46039 - DNA, 601 bp, Human
gcaagatgacaagcccagatttatattatacttcaaaaaaatagatacatcttcacaggcataaagaacattaggaaaccaatacgatctgtatattacttctccacattgatttatttttaactcattacacattactaataaataatattcatttagtgttaattaagtaatttaacaaaacacattttattcaatccatgcttataattatacatgtggatattgatttatgttaaggtaaagccttcattttagaatattacaggattttgtataggctgggtagagggcaggggcktggaaacccaatattctgaatcctggctttgccatttagaagtttttaaccttgaaaaataaaaatactaatacttaaccttcagggttcattttcaggattataggtcttggcttgtcagagggtttgtcacacgacaaactattatgtgttcctatgtctattatgtgttcctcatgaaaatattctcttgttgagtttttgcatatcatggtgtcctgaatattgttagtcataggcatatggatatctttatatgcacatttgctgaaataagattgataacaaagtatagaattc

SEQ ID NO: 46040 - DNA, 601 bp, Human
atataatttttaacttagagtataataataaaaaataaataaataaaataacgttgaagtctgcaacaaataataataataataataataataataataataataataatacatgtaccccctgaatctaagagtttgttacatggctaaattttgtggaaaggagtctggagatttgtcaaagagcttgaaagagatatttgtggtttttgtctgaaacatatttgagtttcctccccgggggaatttgacgagggcaaaacagacagaaaggtgttgcatttactctcgtatgaaaggyctcttctgaacaaagcttaacctcagctgtaaggagaactgcaagtatttggttacagatacttgagtaataaatcaactgtgtttcataactttgaggtatgaaaaaattaaaacagaagttcttattatgacaaaaagtatctcttactgaagctcatgaaaaagaagcagcgtggctttgtataaagttaatccacctctacagaaaggaaaaataaattctgcccctacaaaaagttctttggaacacttaatccttagattgatacaaattatttagttttgaaggaataagaac

SEQ ID NO: 46041 - DNA, 601 bp, Human
aatcaattttgtatgcttcaatgtatttatttcacctcagtaatttattttatattaatataaattaatctatatatacaaatatcaatgtatttaaatatatacatttaaaaactccagcttagattcatttatattaatatatgtattttaaaatataatttttaacttagagtataataataaaaaataaataaataaaataacgttgaagtctgcaacaaataataataataataataataataataataataataataatacatgtaccccctgaatctaagagtttgttacatgkctaaattttgtggaaaggagtctggagatttgtcaaagagcttgaaagagatatttgtggtttttgtctgaaacatatttgagtttcctccccgggggaatttgacgagggcaaaacagacagaaaggtgttgcatttactctcgtatgaaaggcctcttctgaacaaagcttaacctcagctgtaaggagaactgcaagtatttggttacagatacttgagtaataaatcaactgtgtttcataactttgaggtatgaaaaaattaaaacagaagttcttattatgacaaaaagtatct

SEQ ID NO: 46042 - DNA, 601 bp, Human
atcccaaaatattatgaataacttttgtcattgtaatttcttgtacctcagaactgtattttccctttacttcttttttaccatccctcaaaatattttctatagtcaccaaattttagaagacaatagcagtaaaaggaaaataaaagccttttgaaatgcatgcttaagtaggacatttcccaaatcacctttttaaagacaattcactatgaaacccttaaggtctataaagcccatgtgattttattcgctaggcagatctaagagttgagagacagttgacactttttaaatatgygttttattaaattacttgtgaccacaagcattaaaccaaatcaattttgtatgcttcaatgtatttatttcacctcagtaatttattttatattaatataaattaatctatatatacaaatatcaatgtatttaaatatatacatttaaaaactccagcttagattcatttatattaatatatgtattttaaaatataatttttaacttagagtataataataaaaaataaataaataaaataacgttgaagtctgcaacaaataataataataataataataataataataataataat

SEQ ID NO: 46043 - DNA, 601 bp, Human
tctgtgtgctcccactgtcaccacagtcacagacatggatggtaagtgtgtttgtacttgtaagtgacgggattccattgtcggcaattaagatggagatgtagaagacaggttcttcttgaaggttaaaaccagttctattagtcaaaatgacagctgtgttatctaaaacaaaaatccatgtgcataattttttcaactacgtaagagaaatttgtatgtaatagtcacatgtgctagggacaatagtatagagatatgatcaagtaagttcaaataaaaggaagacgaaatttctgaygagaagacaactaaaacatccacactaaattattagtgttttgacattacctaaaccctaattatgtaatcagatgaattatttaaattatgtagtaaaattactatttaatattattaaatattgagttgatactacttatttagttaaagtatttatattattattgaattaattaaattggttccaaaatgtctttgacacatatataaaacatacgtgtaacacagaaaatggctttttaatcagatatcaataatttatagggactaccaatatgaaatataagctgatagagct

SEQ ID NO: 46044 - DNA, 601 bp, Human
tcagaggagcaataaacgtacacacagacccacattataatgctataatagaattaactatgtatttatcatgttattttaaataaatgagtatatgttcagttcagcaccacctaccaaatatgatcataatgcaaatgagaatagcaatgatgacttctacctaccaaatatgatcataatgcaaatgagaatagcaatgatgacttctgtcttgaatcccatggaaagcacaagctcctggtactggcaggtctgtgtgctcccactgtcaccacagtcacagacatggatggtaagkgtgtttgtacttgtaagtgacgggattccattgtcggcaattaagatggagatgtagaagacaggttcttcttgaaggttaaaaccagttctattagtcaaaatgacagctgtgttatctaaaacaaaaatccatgtgcataattttttcaactacgtaagagaaatttgtatgtaatagtcacatgtgctagggacaatagtatagagatatgatcaagtaagttcaaataaaaggaagacgaaatttctgacgagaagacaactaaaacatccacactaaattattagtgttttgaca

SEQ ID NO: 46045 - DNA, 601 bp, Human
caaactgacatgcattggatttgctgggtttgcttttatttttacattttttgaaggagaatttttattctttttatttacagaaaattcagcagtgtacatttaacccagtttagtggcaacttctttcacctttcccttttccactttggtgattcaaacccacagatttaggacccaggacattgcctccccattggcagcgaatctcatcatatctgtccatgtaattggttctgaaaactgccaccaacttagccacacctcctttgtcttcctagtgaacctgtgtgaaggcaaygtcgtgcaggtcttcctgtggactagacatcccaatcttacctcacccttgataatgcagtaagggacccccattttgggacacagggcaggcaggaagacaaccagctcgatgggatccgcatcgtgtgcaatcaccaccagctgagtcttcttgttctccaccaaggtggtgattgtgttaacccctgctggaaagacgggtggtgtctcgatgggggtatcccctttgctagcagctttcttctcagtccaggacaacagtctctgcttcttctcttgttttgtctctggtctgtgc

SEQ ID NO: 46046 - DNA, 601 bp, Human
actttgggcacatcattaagcttctctgtacctgtgtttcttcatctttaagaagtggataataatagtatccactttatagagttattgtcaggagtaagtgaatggataattatgccaatcacttacaacagtgccaggaacatagtgttacatgttggttattattcagtaggcctaggatgggactcacacatgtggtgtctttactaagcatcttagccagttttggcagttactgaaaaggcatgaaatcaattgaggatgggaggaggttgggagggcatccatcatcttgtckgattatcaagtttctggtttttatctccaatgtggtttaaacttattctctgctaaagacttaacgtggaggtttttcttctgattatccacttggcaaaattttaacactttgtaaactgcttccttgaaaataaataagctgtgtttcatcataacgctctgacttctgttccaacagaccacacctgtgtggttcaccgttatatttctagagccaagcatgtattctactatctccattttttaaagctccccagatgattccaatgtgcagacaacagttcaaagagagtttcta

SEQ ID NO: 46047 - DNA, 601 bp, Human
ggcctaggatgggactcacacatgtggtgtctttactaagcatcttagccagttttggcagttactgaaaaggcatgaaatcaattgaggatgggaggaggttgggagggcatccatcatcttgtctgattatcaagtttctggtttttatctccaatgtggtttaaacttattctctgctaaagacttaacgtggaggtttttcttctgattatccacttggcaaaattttaacactttgtaaactgcttccttgaaaataaataagctgtgtttcatcataacgctctgacttctgttmcaacagaccacacctgtgtggttcaccgttatatttctagagccaagcatgtattctactatctccattttttaaagctccccagatgattccaatgtgcagacaacagttcaaagagagtttctattccatgggattttgaaaatctgacaggaacagaagccccaaactgtcctcattcctcccatttaaatttttctcctttcttctgtccttattacttcttccaatcccatcagttccaatttccccaacttccatcccctgctctctctctcttttctttttaggcagagtctc

SEQ ID NO: 46048 - DNA, 601 bp, Human
cctaggatgggactcacacatgtggtgtctttactaagcatcttagccagttttggcagttactgaaaaggcatgaaatcaattgaggatgggaggaggttgggagggcatccatcatcttgtctgattatcaagtttctggtttttatctccaatgtggtttaaacttattctctgctaaagacttaacgtggaggtttttcttctgattatccacttggcaaaattttaacactttgtaaactgcttccttgaaaataaataagctgtgtttcatcataacgctctgacttctgttccracagaccacacctgtgtggttcaccgttatatttctagagccaagcatgtattctactatctccattttttaaagctccccagatgattccaatgtgcagacaacagttcaaagagagtttctattccatgggattttgaaaatctgacaggaacagaagccccaaactgtcctcattcctcccatttaaatttttctcctttcttctgtccttattacttcttccaatcccatcagttccaatttccccaacttccatcccctgctctctctctcttttctttttaggcagagtctcac

SEQ ID NO: 46049 - DNA, 601 bp, Human
tagacttacaaaatttattaggaagataatacagagaattacagtacacctcatgtccagttaccccattttacattagtatgatacgtttttaaataatgaatgaaccaatattgatacattattattaactgaagtccatactttattcagatttactcagtttttcctaatggccttttgctgttccaggatcccatccaggatactgcattacatttaatagtcatatctccttaggctctttttggctatgaaatttcttagactttccttgtttttgatgcccttgatagttttagggccaggtatgctgtagaatatccctcagttgggatttatcttatttttttctcatggttaaattggggttatgacttttggggaggaatattataaggtgccattctcctcacctcccatcaagggtacatactatccacattatacccactgttttttttttttttttggaaacttaaaactcattttatgttattataagtaagaaattagcattcaatatatgccacaatatatctttgttgaagtgtaagtttgttccacttttctatttttcattttccaacttttattttag

SEQ ID NO: 46050 - DNA, 601 bp, Human
tatccctcagttgggatttatcttatttttttctcatggttaaattggggttatgacttttggggaggaatattataaggtgccattctcctcacctcccatcaagggtacatactatccacattatacccactgttttttttttttttttggaaacttaaaactcattttatgttattataagtaagaaattagcattcaatatatgccacaatatatctttgttgaagtgtaagtttgttccacttttctatttttcattttccaacttttattttaggttcgggggtacatatgaaartttgttacaaggataaattgtatggggctggtataactgctagccatatgcagaagattgacactggatcccttccttttgccatatatgaaaatcaactcaacatgcgttaaaaagttaaatgtaaaatctaaaactataaaaaccctagataatatcactattgatgttaaccttgatgtcctggcttgaaatagcatttgtcagtttttgccacactgtaaagttgctccttttttctccattgccatactatactctttggaacaaagtcactatgcacagcccactattaaggac

SEQ ID NO: 46051 - DNA, 601 bp, Human
caatatatgccacaatatatctttgttgaagtgtaagtttgttccacttttctatttttcattttccaacttttattttaggttcgggggtacatatgaaagtttgttacaaggataaattgtatggggctggtataactgctagccatatgcagaagattgacactggatcccttccttttgccatatatgaaaatcaactcaacatgcgttaaaaagttaaatgtaaaatctaaaactataaaaaccctagataatatcactattgatgttaaccttgatgtcctggcttgaaatagcrtttgtcagtttttgccacactgtaaagttgctccttttttctccattgccatactatactctttggaacaaagtcactatgcacagcccactattaaggacaaagtcttctattctaggccttctgtctttccatatgaactttagaatccatgtgttagcttggattctaaaatagcttgctgggatgttgattgagattgcattgtatctataggtcaagttggaaagaactgacatcttaacaatatttaatcttctagtctatgaatcagaatatctctccatttatttaaatctt

SEQ ID NO: 46052 - DNA, 601 bp, Human
gactttcttcatctgtgttttctaattcatgcttataaatcctatacatattttgttatgtttatacctacgtatgtaatttcaggggtattactatagatggagtttttaaaatttcaaattccagttgttcattctagtatataaaaaagcaaatgactgggtgcgatggctcatgcctgtaatcccagcactttgggaggccgaggtgggtggatcacgaggtcaggagatcgagaccagcctggccaacatagtgaaaccccatctctactaaaaatacaaaaaattagctgggcakggtggcatgcgcctgtagtcccagttactccggaggctgaggcaggagaattgcttgcacccgggaggcaggggttgtggtgagccgagattgtgccactgcactctagcctgggcaatagagcgagactctgtctcaaaaaaaaaaaaaaaagcaattaacatttgtatgttaaccatgtatcctgcaaccctgctgtactcacttgttgactctaggagtttttttctttttttcttactttttttttttaatcctttgggattttctacatagacggtcaggtcatctgcaaataaa

SEQ ID NO: 46053 - DNA, 601 bp, Human
agtatataaaaaagcaaatgactgggtgcgatggctcatgcctgtaatcccagcactttgggaggccgaggtgggtggatcacgaggtcaggagatcgagaccagcctggccaacatagtgaaaccccatctctactaaaaatacaaaaaattagctgggcatggtggcatgcgcctgtagtcccagttactccggaggctgaggcaggagaattgcttgcacccgggaggcaggggttgtggtgagccgagattgtgccactgcactctagcctgggcaatagagcgagactctgtctcaaaaaaaaaaaaaaaagcaattaacatttgtatgttaaccatgtatcctgcaaccctgctgtactcacttgttgactctaggagtttttttctttttttcttactttttttttttaatcctttgggattttctacatagacggtcaggtcatctgcaaataaaaagttatctttattccttcccaatccgaatatcctttacttttctttcttctattattgtactagctaagacttctagtgcaatgttccataggagtggtgagagaggacatccttaccttgttcccagtcttagggg

SEQ ID NO: 46054 - DNA, 601 bp, Human
gtgcgatggctcatgcctgtaatcccagcactttgggaggccgaggtgggtggatcacgaggtcaggagatcgagaccagcctggccaacatagtgaaaccccatctctactaaaaatacaaaaaattagctgggcatggtggcatgcgcctgtagtcccagttactccggaggctgaggcaggagaattgcttgcacccgggaggcaggggttgtggtgagccgagattgtgccactgcactctagcctgggcaatagagcgagactctgtctcaaaaaaaaaaaaaaaagcaattaacwtttgtatgttaaccatgtatcctgcaaccctgctgtactcacttgttgactctaggagtttttttctttttttcttactttttttttttaatcctttgggattttctacatagacggtcaggtcatctgcaaataaaaagttatctttattccttcccaatccgaatatcctttacttttctttcttctattattgtactagctaagacttctagtgcaatgttccataggagtggtgagagaggacatccttaccttgttcccagtcttaggggaaaagtgtctaatttctcactgtta

SEQ ID NO: 46055 - DNA, 601 bp, Human
tgaaaatgttattagcagttaaagaaatgagatgttggattataggtcagagaaatgggaatgatcaatttaggattcctagattgaataattaagcaataaaaatgggagaaaaacaatcctaaaggtggacaaagccaacaaacaacaaacactctcctttgtggctatttaatgtttcataatactcaatatctcaatatctgttcatttctagaataaaaagggaggaggagatccaaattgattaaggtgattttccatagtcaaaacaatttttgaaaatctaaaaatttgaaarctcctcatttgtgaaatctcggtgacaggctgggtagattgcatcattgcattactttatgtgatcaccacaacaatgctataagatagttaataggaagtttttttttctttttctttttcttttttttgagacggagttttgctcttgttgcccaggctggagtgcaatggcgctatctctgtcaccgcaacctccgcctcccgggttcaagcgattctcctgcctcagccccccgactagctgggattacaggcatgcgccaccacgcccggctaattttgtatttttagtagagac

SEQ ID NO: 46056 - DNA, 601 bp, Human
aggtgctgtggctcacgcctgtaatcccagcactttgggaggctgaagtgggaggatcacgaggtcaggagttcgagaccagcttggccaacatggtgaaaccctgtctctactaaaaatacaaaaattagccaggcatggtggcaggtgcctgtagtccaagctactcgggaggctgagacagcagaatcacttgaacctgggaggtggaggttgcagtgagccaagatcatgccactgcactccagcttcggcaaaagagtgagactctgtctcaaaaaaaaaaaaaaaaaaaaaaagmctgctttttagaaagctccacgatactagaaaccagccttattattattaaaagtaatggcaaaaaaataagcaattacttttgcaccaacccaatgtttccagtatccgtatcctacgctgtccctaggaaacaataacaagcccgaagtataccaagataattcactgaaaacaactttgagataaattctaaaatcctaggctgtgtatcattggacaagtcacataacttttctaggcctcaattccctcatttataaaacctggataatgacacctattctgcttccttcataga

SEQ ID NO: 46057 - DNA, 601 bp, Human
tttccttcttcttctgttctctggaattattgttctcttgtcaagaaaatattctactcttttctagaacactgaatttacttccttgccttgactgaaatgaaacatagtttctgttttgattgcgtcttttgcagcccttgcaagtgttttattttcactcagcaactttctttccttcaaaactatatcaagttacaccaaatctctggatcacaagaagtcattatgtcataggctggcattaaagttcctccacaaattggatacaacctccaatttcaggcccatctttctttcttttttttttttttttttttttttgagatgcagtctcgctctgtcgcccaggctggagtgcagtggcgctatctcggcccactgcaagttccaccttctgggttcaggccattctactgcctcagcctccccagtagctgggactacaggcgcccgccaccatgcccggctagtttttttgtgtttttaatacagacggggtttcaccatgttagccaggatggtctccatctcttgacctcgtgatccgcctgcctcagcctcccaaagtgctgggattacaggcatgagtcactgtacc

SEQ ID NO: 46058 - DNA, 601 bp, Human
aaaatcttctacatggcatagtccctagttataggggcatacaactaattgtttaagcttagcattgttcatactggcttaaatactattaagccttagtctagccctgtccttggtgtataattcctacaactggaactgtttgtgcatcttacttaaatttatcagttaatattaggtattatgagttccccttggccttaacccctactcttatcaaagaaacatgtttagaaaatgaagcttatcttccacaggactttaggcataaaatgtgattaagatttattttggctgggcrtggtggctcatgcctgtaatcccagcaccttgggatgcagagacgggtggatcatctgaggtcaggagttcgagaccagcctgaccaatatggtgaaacctcgtctctactaaaactacaaaaaaaaattatttgggtttggtaggatatcagtgatggaagatgaaaggaatgaaatgaagtgagaagggaagtttagagaaaaaagaataaaaagaaacgaacaaagcatccaaggaatatgggactatgtgaaaagaccaaatctacgtcggattggtgaacctgaaagtgacgggg

SEQ ID NO: 46059 - DNA, 601 bp, Human
cctaaaaaaagtcacataggaaaatgcatatggaaataaaatcagaaggcagaaggtatattatttttgtgaggattacttgaagtgctagtagacttgccagaggaaggaagagtgacagtaaatgaatgagaggtagctatgggtgaattacaaatctgtaggtagatttacaagtctgcagtggccgctttgctggcaatgctcatgtgacagcacactcaagtcacagtggctcatggtatgaatagtcactgtgagttgggaacatggtaacagccagctgcttagtgttttgatkaacacaatcatttagcagtctgaatttcagaacttaagctcaatcgctgggtgttttttatttggacaaagtggaaattgatggtaagtctctaaatttctgtggaaaactgagagacacaatcattccaggcctaaagaggtggttatcttcaactgatgatacttgcataactttcctttgtgtgggaggaggagaaagtaagtttttatttaattccgttacaacttccaggtgctctcctattttcctccttcctttcactgccaaacctctgcactaaattttctaaattctcac

SEQ ID NO: 46060 - DNA, 601 bp, Human
tgagtagctaggactacaggtgcacaccaccaaacccagctcatttttgtatttttagtagagatgggatttctccatgttggccaggctggtctcaaactcctgaccttgtgatctgcccgcctcagcctcccaaagtgctgggattacaggcatgagccaccgtacctggccggaaactgctctcttaaaggtcacctgtgaccaacttcattttccttcttctcactactgagtttggtgcttttaaacatttcttccttcttgcagtgctttcttttctggctctaaagtatcttaytttaactttcctcctctctttcctttgacttatttttgtctaaccacctcctgaacctgagtagtcagtaacccaaggatataatgtaaccttttttttttttaacttctgaaatagtaaatatttatttatttatttattttatatttaagttctagggtacatgtgtacaacgtgcaggttttttacatatgtatacatgtaacctttattaaaggccgactatgtgtatacattgttttatatgagtttatttaatctgcataatcaaggcaggagctagtgaacctcttttgtgaa

SEQ ID NO: 46061 - DNA, 601 bp, Human
tagggccagtgagggcaccggggtatttgcaggcgttcccgcaggccaggagggagagggctccagggctcggcttccctggggcggggaatcccttgccctgtcccgaggcgcaggggcggggccggggggcgcccctgacgcggcggctgaggtgttcccagcccggtgtcgttccccgcggtaggtggtccccgacgagctgcagccatgggaaacaccaccagcgaccgggtgtccggggagcgccacggcgccaaggctgcacgctccgagggcgcaggcggccatgccccgggggaggagcacaagatcatggtggggagtacggacgaccccagcgtgttcagcctccctgactccaaggtaagcgtcccatgcccgcagttggtgtcagtactgcagcgggttgatttctgggctcctcttccctttcttggttcttttctaccgcgccgaaccgggctatggttttttgaattaaagggatttatcggggacagaggtgttggatgataattcctcttgaagtgccgcctcaaaataggataaagaggcggagttcttgctttcctggtgttctgactaatctgttggccac

SEQ ID NO: 46062 - DNA, 601 bp, Human
caagttttaagaaatcagtgatctagtttttgaatttttaatgtttcttctttttacttcttagctgaaatacagtttatgaattacttatgaattttgatatctctgacttccattacaactggtaattgagagctattcatatttgcctataaaaatatatggctgacttaattatcttttacagaaccatactttgttttcatttttttttcctctgaagaaagactcagaagcatatcataattgcctgcctatgagttaaactagtggtagggagttatttttttctttttttttkaagggagagtctaaggctctggaagggtaagtgacacaggtagactcaaaagttaggctatgatttaggcagtgcttgagcataggccatttgaccatttttggtcctagatgagttctttttctataatttgttcaaactctgatttagttgctaattttggggtttatatccttagccaaagcctagcacccttctctatcctagggaggagagtgacctttttagaattcttgggtcacagtttattctagggatgacctactccttcttacagctccctggggacaaagagtttgt

SEQ ID NO: 46063 - DNA, 601 bp, Human
aacacaaacacacacattgtaacacaagtctcatgatacaatgtttaccttattacatgggatacactctattttccatgttatcttttataatcactaatgggctacagcctatagtttgaaaagctgtttctagtaatatttcaagttttccactgacctttgatgatattacccagcagaggcgatacatgtgtgtagtttgtttggtttgccccatcttaatcctgccagtttgagacctcagttagcagtttcatgattttatgaggtccaaaaaatgtggggaaaaaaatggttwaaaaaaccaacagcctgggcaatatggcaagacccatctctacaaaaaatttttaaaaattagccgagcgtaatggcacatgcctgtggtcccaacaatttgggaggctgaggcgtgaggattgcttgagcccaggaggtcgaggctgctgtgaagcatgtttgagcctcctcactccagcctgggcagcagagtgagatactgcctcaaaaacaagacaaccacccccctgccccctgacaattctgttgtaggtaattgaaattttgtaaatttttggttaaaaaaaaaaaagtctat

SEQ ID NO: 46064 - DNA, 601 bp, Human
tgcattatataattctggcaaagtaaccaataaatagacatgtatcataattatatagagagaagacttgcatacttttgatatttccctttctcctaatttcccaatctattgaggtaacgcttataatccattttttactaggaatctacagataatggattttagtctgcactcatttactgtctatccatgtatgtaactttaggcaaataaccaatttgtatttatttttttctggtgaaaaggcaataaaaactattctgtgcacttcccaagggtattttgtggatcatgtgaygaaataacaaagcataatactttgtaaggtttcaagttccatatgttttaaagatattatttaatatcagagtattacttctgcttttttcttttgccttatatgtattttttatttttaattgacacataacaattgtacatatttatgagatacaatgtgatgtttcaatacattttatatgtgtaatgatcgagtcagggcaattagcatattcatctcaaacatttgtcgtttcttcgtggtgataacattcaaaatcctttcttctagctattttattttgttacattattgtta

SEQ ID NO: 46065 - DNA, 601 bp, Human
aataaatagacatgtatcataattatatagagagaagacttgcatacttttgatatttccctttctcctaatttcccaatctattgaggtaacgcttataatccattttttactaggaatctacagataatggattttagtctgcactcatttactgtctatccatgtatgtaactttaggcaaataaccaatttgtatttatttttttctggtgaaaaggcaataaaaactattctgtgcacttcccaagggtattttgtggatcatgtgacgaaataacaaagcataatactttgtaargtttcaagttccatatgttttaaagatattatttaatatcagagtattacttctgcttttttcttttgccttatatgtattttttatttttaattgacacataacaattgtacatatttatgagatacaatgtgatgtttcaatacattttatatgtgtaatgatcgagtcagggcaattagcatattcatctcaaacatttgtcgtttcttcgtggtgataacattcaaaatcctttcttctagctattttattttgttacattattgttacctatattcactctactgtgcaacggaa

SEQ ID NO: 46066 - DNA, 601 bp, Human
tgggaggatcacttgagtccaggagtttgagaccagcctgggcaacatagtgagaccctgtctctacaaaaaaaatcaaaaaattagctgggcatggtagcatgtgcctttagtaccaactactctgaaggctgaggtgggaggatcacttgagcccaggaggtcaaggctgtagtgagccgtgatcaagccactgcactccagactcggtgacacagagcaagaccctctctcaaaaaagaaacaataacatttaaataaaatatattataatatatttctcttcatttttgtatattgkattcttgtctgcatactttttttcatttttttgagatgtaatttatacatcataaaattaactcttaaattgtacaactcagtaatttttagtatattcagagttatgtgattatcacaactatctaattccagagcatttttatcacccgcagaataaaccctgtacccattagcagtcacatcccattccctcctcccctccgtccctggcaaccacaagtcttgctgtcttaaggatttgcctgttctggacatttcatatcagtggaatcctacaatatgtggtcttttgtgactg

SEQ ID NO: 46067 - DNA, 601 bp, Human
ccaggaggtcaaggctgtagtgagccgtgatcaagccactgcactccagactcggtgacacagagcaagaccctctctcaaaaaagaaacaataacatttaaataaaatatattataatatatttctcttcatttttgtatattgtattcttgtctgcatactttttttcatttttttgagatgtaatttatacatcataaaattaactcttaaattgtacaactcagtaatttttagtatattcagagttatgtgattatcacaactatctaattccagagcatttttatcacccgcagwataaaccctgtacccattagcagtcacatcccattccctcctcccctccgtccctggcaaccacaagtcttgctgtcttaaggatttgcctgttctggacatttcatatcagtggaatcctacaatatgtggtcttttgtgactggcgtctttcacttagcataatgttttcagggttcatccatgttctaaccatgtatcagtacttcgctcttttttatggctgaataagagcccattgtgtggacatactgtttgtttatccattcagtagttgatagacatcttgattgtttccac

SEQ ID NO: 46068 - DNA, 601 bp, Human
gctgccatgtattgatagctttttccatgcattcttgctaattctccaactctttctcatatttgtataaatatctttcagacctttccagctcacccccagggccttatggtcaagaaatgtatgcgtttcgatctgaggaaagattcaaatccccacccatccttcctcctcatctacttcaagttattcttaacaaagacactaatatttctgtgagtatcctgagtattactggggcatctgggggtgtctaggaccatttggaccaaagttcagtaatcctagaggttaggattaytacagaggtgtgttgagattataagtcatacacataccaataacattacagatttcctttttccagtggtgagtcacagctttttcaggtactgatataaaaattcatagttgtctcctcatcctaataaaatcaggatcagagctatggacttcttttgagcacaacataaaggagtagttatcatttgggggtgtacaaaagaactatgaaagcttttttgtatataattcatgtctctattcaatctacttgattcctactatgattgtttttgccttgtaacacaactcttccttg

SEQ ID NO: 46069 - DNA, 601 bp, Human
aagttattcttaacaaagacactaatatttctgtgagtatcctgagtattactggggcatctgggggtgtctaggaccatttggaccaaagttcagtaatcctagaggttaggattactacagaggtgtgttgagattataagtcatacacataccaataacattacagatttcctttttccagtggtgagtcacagctttttcaggtactgatataaaaattcatagttgtctcctcatcctaataaaatcaggatcagagctatggacttcttttgagcacaacataaaggagtagttrtcatttgggggtgtacaaaagaactatgaaagcttttttgtatataattcatgtctctattcaatctacttgattcctactatgattgtttttgccttgtaacacaactcttccttgtgtgttgtgggcaagatttttgttttagctctcttaaggaagattagtagatgctgaggcatgagatttctgccctggactgataatttttctaattttctgtaataggattgtattattgatacatactagagtgggtgcattattgaaaagagatagcgcattctagtttaaatttctcaa

SEQ ID NO: 46070 - DNA, 601 bp, Human
aacaaagacactaatatttctgtgagtatcctgagtattactggggcatctgggggtgtctaggaccatttggaccaaagttcagtaatcctagaggttaggattactacagaggtgtgttgagattataagtcatacacataccaataacattacagatttcctttttccagtggtgagtcacagctttttcaggtactgatataaaaattcatagttgtctcctcatcctaataaaatcaggatcagagctatggacttcttttgagcacaacataaaggagtagttatcatttggggktgtacaaaagaactatgaaagcttttttgtatataattcatgtctctattcaatctacttgattcctactatgattgtttttgccttgtaacacaactcttccttgtgtgttgtgggcaagatttttgttttagctctcttaaggaagattagtagatgctgaggcatgagatttctgccctggactgataatttttctaattttctgtaataggattgtattattgatacatactagagtgggtgcattattgaaaagagatagcgcattctagtttaaatttctcaaagagctctgag

SEQ ID NO: 46071 - DNA, 601 bp, Human
aggcttgccatctcctcctgtggtacatctgtagtctacaacacagcctgggaaatggtacctcttgctgtcttcttactggttctgactcaggtgaaggtgtttgattattgtggcttagcttggttctgacccattcctgattctctcatattgtttaggcagtttggaattgatccattggattgggtgtctttctgaagaggattttgacatctactttgttcaaggatagagagggattcctaggttccctctaaatcagagagatcttttggaagtcatccctggttttaaatgraaattagacctgctttgggacttggaaatagtttttcagaaggattgtttctttttttcctcattgtctttaagactttcttctagaaatggatgccagaatattttgttcttttttgtttttcttgctagttttaggcccaacattagaatttaaagtagggaagggagcaaggtaggagactattatttcttcagcccttttatgtgtcagaaactgtgtcagatattctcatgtaatcatcagagcaaccttaatggtaggtgttatcttttgtaatgatgagataaaaagacttgg

SEQ ID NO: 46072 - DNA, 601 bp, Human
ggcagccgaatgacacctcagggaccttccatgggaccccctggctatggggggaacccttcagtccgacctggcctggcccagtcagggatggatcagtcccgcaagagacctgcccctcagcagatccagcaggtccagcagcaggcggtccaaaatcgaaaccacaagtaagatgatcctggggcagagggagggagggagggagcctgggaggacacaggtggtgggagtacctgaaccaagaagtggtggtgctgtgtcagcagatggtgctacagaactcatccttgagaatgcktggtggtggtggtggtggtggtggtggtagttctttgagagaagctttgcagtcccttcacattactataaatggacgtgctgacagcttattttcacgttctgactagttctgtcccaacctgataatagtatttattcccaacagtgcaaagaaaaagaagatggctgacaaaattctacctcaaagggtgagtccaggctatatgtcttctggaaagtgtggtgagtttgagtatagagatgatcatcctagatttcaattaatttttctgttcctaagattcgtgaactggtacca

SEQ ID NO: 46073 - DNA, 601 bp, Human
gacacctcagggaccttccatgggaccccctggctatggggggaacccttcagtccgacctggcctggcccagtcagggatggatcagtcccgcaagagacctgcccctcagcagatccagcaggtccagcagcaggcggtccaaaatcgaaaccacaagtaagatgatcctggggcagagggagggagggagggagcctgggaggacacaggtggtgggagtacctgaaccaagaagtggtggtgctgtgtcagcagatggtgctacagaactcatccttgagaatgcgtggtggtggtrgtggtggtggtggtggtagttctttgagagaagctttgcagtcccttcacattactataaatggacgtgctgacagcttattttcacgttctgactagttctgtcccaacctgataatagtatttattcccaacagtgcaaagaaaaagaagatggctgacaaaattctacctcaaagggtgagtccaggctatatgtcttctggaaagtgtggtgagtttgagtatagagatgatcatcctagatttcaattaatttttctgttcctaagattcgtgaactggtaccagaatcccaggc

SEQ ID NO: 46074 - DNA, 601 bp, Human
gctggtggtgtcattctgtccaaataaagctgtttttgttctggctgcttattgcctgtgattcatttcccctctagagtcagacttttctctgttcaaactcgcttagttatgtgcaatggtttgcttaacttgcctcatttcccttgggcaaatgagatgggtaaaacagtgaccctctatgtgttctaggctgcttcttcagggttctgttgctactatgattggtttaatacctgcagatgcctactttgcctatctctcttaagagatattcagaagatattttttgagttttttyccattgttgttggggttcctttttcataggattttgtcttgggaagtttcttctggcctttcctaatgtgatttttattttctctcctctagtcagccttgtccaaatatgatgccactaaacaaaagaggaagttctcttccttttttaagtccttggtgattgaactggacaaagacctgtatgggccagacaaccatctggtagaagtgagtagctctgccttctaggctttgactctgattggaggatgatggacttgggagccgtattttaatgtctaaggagatggggaggtat

SEQ ID NO: 46075 - DNA, 601 bp, Human
acttgtcccatctttttaatgttactatcctggtcactgccacctctttcaagggaaagtctactggtggcctcttgtatgtgccaggccatctctgtatcttgcttgttaataatggtgagatgtagttatccatttttcctggcagcagttgctgtaattagagtgattgactgatagggtactagtacttgccaaggttaccattatagatctgggacttcctcttggtctctgctctgtttacatttacattccaattcaccaaaaatcctttattatgatgcctgattgcacaacrttttgaagcccatgttagcaacagtattctttgggaaacaggcaaaaccagaatgacagtccagccagcactccaagtgaacctaacctgctcctttctttgccagtgtagctgcagccccttaacctcaaccactaagagacatggggaggtctttaccatctaataagggaagtaagtcatagaatcaatagaaacttgtaaatatatttaattttatagcagtagagtatagtggctaagaatgtggactgtagaatcagacacatcagagctcaaatggtggctccgccacttact

SEQ ID NO: 46076 - DNA, 601 bp, Human
tcagagatccctcagcggctccatgccttgcttatgccaccagaacctatcatcattaatcatgtcatcaggtaggcctgtgtgtgggaggcagtgctgtgccggagctgccttgtgccgatttgcacaagccagttgtcaaattttcaggaattttgcaaacaggttgttaaacacaactgttacactgttacttacaattaaattacataaacttataattaaatatattagactaaaagtgggtaacatatattcaaaatgtataacttcctaattattacattttattgtatttgtrcttttttttttttttttttttttggagacagagtctcactctgtcgcccaggctggagtccagtggcgcgatctcggctcactgcaagctccgcctcctgggttcacgccattctcctgcctcagcctcccgagtagccgggactacaggcacccgtcaccacacctggctaattttttgtatttttagtagagatggggtttcaccatgttagccaggatggtctcaatctgacctcgtgatctgcccgccgagcctcgtgatctgcccgcctcggcctcccaaagtgctcggattaca

SEQ ID NO: 46077 - DNA, 601 bp, Human
agcccaaagatcagcaaatgccacacatctgggcacttcctcccactctcctttggaagatcagttgttaaacatctaccagctcttcactcatggaagggctcagcagccatcttttctctggatggtacagcattctagtccgagcctcccaattccattacctctgttcacttttttgtttagaagctggagagcaaggcatctctagatagggggtgaagaaaatttccttctcaaagcagcgtgtctctgtagttggatatagtctctttgtcttccttcctttattccatattawttctggtaagggctttcttttcttttcttttctttctttctttttttttttttttttttttttgagacagacagaatctcactctgttgcacaatctcggctcactgcaacctctgcctcctgggttcaagcgattctcctgcctcagcctcccaagtagttgggattacaggcgcatgccaccacgcccagctaattttttgtattttagtagagacggggttttaccatgttggccaggatggtctcgatctcttggtcacgtgatccacccgcctcggcctcccaaagtgctgggat

SEQ ID NO: 46078 - DNA, 601 bp, Human
agcttgttatgacattgatgttgaagtggatgacaccttgaagacccagatgaattcttttctgctgtccactgccagccaacaggagattgctactctagacaacaaggtaggggtctgtgccctggatagttgggtaccaccagcccctatcacagcttcaaggcctccttttgattcttagtgttcattcaaaatacggtgacacccagtatatgtcaggtactgtgcttggtgctggtttgagccagactcaaatgaattctgattgtggggatactctcaacagcactgagcctcrgtttctgatttgtggaatagagaccatagtaccttttttttccttttttcttttcaggagtctcgctctctcgcccaggctggagtgcagtggtgcaatcccgcctcacggcaacctccacttcctgggttcaagcgattctcctgcctcagcctcccaagtagctgggattacagtcacccaccatcacacccggctgatttttgtatttttagtagagacgaggtttcaccatgttggccaggctggtctccaactcctgacctcaagtgatctgcccgcctcagcctcccaaagtac

SEQ ID NO: 46079 - DNA, 601 bp, Human
caaatggtaacttctgctactattattgttatctgggttgttattactagacgcagtccttgcaaataaagccaaaagtgctttgggaacatgaaggagaaagggaggctttgctggaagagttgatgccccaactaaatcttttcttttttttttttgagatggagtcttgctctgccgctcaggctggagtgcaatggcatgatcttggctcactacgacctccgcctcctgggttcaagcaattctcctgtctcagcctcctgagtagctgggactacaggcacctgccactacgccyggctaatttttgtatttttagtagagacggggtttcaccatattggtcaggctggtcttgaactcctgacctcaggtgatccacccgcttcggcctcccaaagtgctgggatcacaggcgtgagccaccgcgcccggccccaactaaatcttgaaggacaaagtgggtgttaatgaaagggcaaaaaggatagtagtgctgggggcataggaggcagaagacgttccagaaagagggaatagggcatgtaaaggtccagagaagagagagagagcctggtgtcttaaagaagtacgagcc

SEQ ID NO: 46080 - DNA, 601 bp, Human
tctgggttgttattactagacgcagtccttgcaaataaagccaaaagtgctttgggaacatgaaggagaaagggaggctttgctggaagagttgatgccccaactaaatcttttcttttttttttttgagatggagtcttgctctgccgctcaggctggagtgcaatggcatgatcttggctcactacgacctccgcctcctgggttcaagcaattctcctgtctcagcctcctgagtagctgggactacaggcacctgccactacgcccggctaatttttgtatttttagtagagacggrgtttcaccatattggtcaggctggtcttgaactcctgacctcaggtgatccacccgcttcggcctcccaaagtgctgggatcacaggcgtgagccaccgcgcccggccccaactaaatcttgaaggacaaagtgggtgttaatgaaagggcaaaaaggatagtagtgctgggggcataggaggcagaagacgttccagaaagagggaatagggcatgtaaaggtccagagaagagagagagagcctggtgtcttaaagaagtacgagccatttagtatgctagatgcagcatagagtgcc

SEQ ID NO: 46081 - DNA, 601 bp, Human
taatttgtcaagagggcagggctggaggcaggaagcccagttaggaggctggtgcagtaatccatgtgagacgtgttgaggccctaaatttacagtcccgacagtgagggtggagataagtagatagatttgagaggtgtcaaggtggaattgaaggaatttggccactgtttggattattagagtgagggatgaatgagaaggaaatgttatgatgcctcccaggtctctagcttgggtggacagtagtatttactatgactgggaagaggggaggaggaggagcaggtattggagaaasggtagtgagtttaatgtcaagtttaagcagttggattggttggagtatagaagatagactctgggctgcagactggggactcattaccctgtcactggtaatggaagatatacaagtcaaagaaattgccgggaggagtatgcagaatgagaagagagttgagaacaaaacccagagatgagagcttatgagacagccccatatgccagtccttttcttcctgagaacacttttggacccatttgtgctgtggagtaagtattcatcatgtagctttgcccatagtgggcaatgtggaga

SEQ ID NO: 46082 - DNA, 601 bp, Human
agtgttgatttagtgcttactttgtctgtcactgtgcttcatcttgtcagggatacagagtggaagacctgatctctgctttcaaagcagcctacattctgtctgaagaaactaggctagtatagccgggcatggtggctcacacctgtaatcccagcactttgggaggccgaggccgacggatcgcttgaggtcaggagtttgagaccagcctggccaacatggcgaaaccccgtctccactaaaaatacaaaaacttagctgggcgtggtggtgcgcgcctgtaatcccagctacttgrgaggctaaggcaggagaattgcttgaacccaggaagcagaggttgcagtgagccaagatcgtgccgctgcactccagcctgggtgacagagcgaaactctgtctcaaaaaaaagaaactaggctagtatgatacaaagtagtaaaccacataagacattatcaggccaggtgcggtggctcacgcctgtaatcccagcactttgggaggctgaggagggcagatcacctgaggtcaggagtttgagactagcctggccaacatggtgaaaccccatctctactaaaataaaaaaatcagc

SEQ ID NO: 46083 - DNA, 601 bp, Human
gtctcaaaaaaaagaaactaggctagtatgatacaaagtagtaaaccacataagacattatcaggccaggtgcggtggctcacgcctgtaatcccagcactttgggaggctgaggagggcagatcacctgaggtcaggagtttgagactagcctggccaacatggtgaaaccccatctctactaaaataaaaaaatcagccaggcgtggtggcgggtgcctgtaatcccagctacccgggaggctgaggcaggagaatcgcttgaacctgggaggtagaggctgcagtgagccgagattgygccactgcactcccagcctggctgacagagtgagactccatctcaaaaaaaaaaaaaaaaaaaaagacattattagactgaccaggaccaataagatgattcagataagggagatcagtgagactagaatctctggggaaggcttcatggaaaatttgggatttgaagacgttcccagaaaggggagcacagtaagctcagacaagaagataggaatgggcacagagtatgaactcatccgttgtcacccctcctgtgctgactgtgacgagttagagaggctgagcagaggagcaagga

SEQ ID NO: 46084 - DNA, 601 bp, Human
ggagaaggaagaggccacataaaggagaaggaatagaaggaccaggcgtttaagggtagatgcggccaagggagtgcggggcctgtgggtagagaaggggaccccacggggacttcatttttctcccaggctccacccacgtcctctgctctccgactgttcccaagttcttccctccacctcgaggcctgcctcactcgccccttctccatttcgtaaccatctgtgttccaccttcttcccccaaatctcctccttccacacctgctgccagtctcctctcaagcaagcctcctgaaccactggccccaaccaacccactggtggggtgggaggagcaccactcacttctgcagggagcaagggtccagagcagatatggacccctctgcacaggcctcccgaagtcctgaagctgggcggcagtgaggtgtcacccccttccagctgaggagaccaggcccagtggcaggggtttctctgtctgtccgtgggcagagcccgcgtctggtccagagtaactccctctgtccaggtccggaacagtgtctcaactggccaggcggtggcagtggagctgcttctgaccctgcagctggtg

SEQ ID NO: 46085 - DNA, 601 bp, Human
atagccattgtgtacttgaatgaatgaggttcaagagcttaggtagcataacctattaatagtaggcatagaacttttaataaactagacttgagaatccgacatagttgcacccatactggcaattatcataggagcttctgttctgagtcttacagacagtgcattaaagctatacattgagatctattgtgcaggacactttgctgattctcaaaaaaagaaaggcacagctcttctagaattgtcataaaggaaacaagactcaagctatgtaataaaaatgtttgcaaaacatttraattagaacagcttgttctgagtgacagtctaatatacgtaggagaaattttagaaaggaagagatttagggattaaaatttttgcatcagggcaagctagtttttgaaggcattaaggggtggaattatcagaaggaaagaggaaagtaattagaacgaaagaaatgttagagctggaacaggttgccctcctgttggcaggtgtccacctgcagaaccagtctcacctttctttgctacaaaggggagtcagtcctacatgactataaggttgctggccacgaggcactgttttgctc

SEQ ID NO: 46086 - DNA, 601 bp, Human
aataaactagacttgagaatccgacatagttgcacccatactggcaattatcataggagcttctgttctgagtcttacagacagtgcattaaagctatacattgagatctattgtgcaggacactttgctgattctcaaaaaaagaaaggcacagctcttctagaattgtcataaaggaaacaagactcaagctatgtaataaaaatgtttgcaaaacatttgaattagaacagcttgttctgagtgacagtctaatatacgtaggagaaattttagaaaggaagagatttagggattaaratttttgcatcagggcaagctagtttttgaaggcattaaggggtggaattatcagaaggaaagaggaaagtaattagaacgaaagaaatgttagagctggaacaggttgccctcctgttggcaggtgtccacctgcagaaccagtctcacctttctttgctacaaaggggagtcagtcctacatgactataaggttgctggccacgaggcactgttttgctctttatcctttttttctaattcctgatctggcctatattaccatcttacatcactctagctctgaaatgtttggcatgc

SEQ ID NO: 46087 - DNA, 601 bp, Human
gtgccaactattcagtggaaaaagaatcttgataataaaaaagcagccgggcacggtggctcacgcctgtaatcccagcactttgggaggccgaggcgggcggatcacctgaggtcagaagttcaagaatagcctgtgcaacatggcaaaatcccgtctctactaaaaatacaaaaaattagccgggcgtggtggcgtgtgtctgtaatccctgctactcgagaggctgagacaaggaatcgcttgaacccggggagcagaggttgcagtgagccgagatgtcgccactgcactccagccwgggtgacagagagagactccatctcaaaaaaataaataaataaagataataaaaaagcctggctaaaacctattaagagcagctatagaaaagaattttagtgaccatttagaatgagtgcccattaggctttgaccacgtaagtgatcactgctttctttttaggtaacccaaatggaaaacaactttaagattggaaaatacttcagctttgtaaaaatcccaaatttgaaatctgtttttcctttggacaggccagctcagaatgacttacggacttcatttccttcactgagaatc

SEQ ID NO: 46088 - DNA, 601 bp, Human
cagtggctcacgcctgtaatcccagcactttgggaggccgaggcgggcagatcacgaggtcaggagatcgagaccatcctggctaacacagcgaaaccccgtctctactgaaaatacaaaaaaattagccggacgtggtggcgggcgcctgtagtcccagctactcaggaggctgaggcaggagaatggcgtgaacccaggaggcggagcttgcagtgagccgagatcgcaccactgcactccagcctgggtgacagtgcaagactccatctcaaaaataaaaaaaaaattaaaaaaattwaaaaaaaaattttttttaaagtagctgggcatggtggcgcaacctgggtgacagaatgagattcttaaaaaaaaagaaaaaagaagaaattatgaatttttcccacttcaactgaaaatgctttatagaacacaaagaaaatccaggataaaaaaaagacaactactactctaaagaaaaaagcaacatcctagtaaatttttcccagttcatggcacagaaaatagtgccaactattcagtggaaaaagaatcttgataataaaaaagcagccgggcacggtggctcacgcctgtaatc

SEQ ID NO: 46089 - DNA, 558 bp, Human
tgaaaagccgctgttcaaattaaatttaccagcatccaagaccaccttaccagtttaatcaaacttacctcccaccactatgcaataaatacccctctagctaaaccagtctgtccctgcccccagaacagaggcattcctgccttctcacttgtgaccaagctatgcactccaaatggaatgccctacctattacatacccatttaccaagtcccatctggtctgtgaatcttttcctaatcagtttgctacacactaaatttttctagattacccaaaagcatatattttgatacttgkactatcttctgtttcatgagaaaaaaatcctgtctctgaaactaaaataccataatcttcttgaagacaggcaatatgtcatatatacttcattatttcctactatgcatagtgtagcacaaacctagtatgtcactggcacacaacaggcacctgataaatgttaaattatacttattcctaatttatacaccaatgattttttttaaaaagctcaggcagcttatgaaaaattaaaaatagaacataaaaactgt

SEQ ID NO: 46090 - DNA, 601 bp, Human
aactatgaagtgcccctatcaaaaaggaggaaagagaagggaaatttcctcaaaacaaattgagggtgatctttgatttatttaaaatttaaaaatcaggatttggttcatagctcagcaagcaaatttaagtgggtccagaaatcctgatttttttttttccatttactcccggaggcctttgaacaggctcttccatttgccttccctactaccctctctaagcttcttaaagacaaagaccctatgtctcctttgctcttttatctccagtgttgtaacctgcctagcacacagtagrcacttgaaataatctgttgaacaaatgaatgaatgaaaagccgctgttcaaattaaatttaccagcatccaagaccaccttaccagtttaatcaaacttacctcccaccactatgcaataaatacccctctagctaaaccagtctgtccctgcccccagaacagaggcattcctgccttctcacttgtgaccaagctatgcactccaaatggaatgccctacctattacatacccatttaccaagtcccatctggtctgtgaatcttttcctaatcagtttgctacacactaaatttttc

SEQ ID NO: 46091 - DNA, 601 bp, Human
aagtcgcagtgagctgagatcgtgccactgcactccagcctgggcaacagagtgagatgctgtctcaaaaaaaaaaaaaaaaaaaaagatttataaaattcaaattacagtacctcctttaaaaagttacgtacaccctaaactatgaagtgcccctatcaaaaaggaggaaagagaagggaaatttcctcaaaacaaattgagggtgatctttgatttatttaaaatttaaaaatcaggatttggttcatagctcagcaagcaaatttaagtgggtccagaaatcctgatttttttttttccatttactcccggaggcctttgaacaggctcttccatttgccttccctactaccctctctaagcttcttaaagacaaagaccctatgtctcctttgctcttttatctccagtgttgtaacctgcctagcacacagtagacacttgaaataatctgttgaacaaatgaatgaatgaaaagccgctgttcaaattaaatttaccagcatccaagaccaccttaccagtttaatcaaacttacctcccaccactatgcaataaatacccctctagctaaaccagtctgtccctgcccccaga

SEQ ID NO: 46092 - DNA, 601 bp, Human; identical to SEQ ID NO: 36966

SEQ ID NO: 46093 - DNA, 601 bp, Human; identical to SEQ ID NO: 36967

SEQ ID NO: 46094 - DNA, 601 bp, Human; identical to SEQ ID NO: 36968

SEQ ID NO: 46095 - DNA, 601 bp, Human; identical to SEQ ID NO: 36576

SEQ ID NO: 46096 - DNA, 601 bp, Human; identical to SEQ ID NO: 36577

SEQ ID NO: 46097 - DNA, 601 bp, Human; identical to SEQ ID NO: 36578

SEQ ID NO: 46098 - DNA, 601 bp, Human; identical to SEQ ID NO: 36579

SEQ ID NO: 46099 - DNA, 601 bp, Human; identical to SEQ ID NO: 36580

SEQ ID NO: 46100 - DNA, 601 bp, Human; identical to SEQ ID NO: 36581

SEQ ID NO: 46101 - DNA, 601 bp, Human; identical to SEQ ID NO: 36582

SEQ ID NO: 46102 - DNA, 601 bp, Human; identical to SEQ ID NO: 36583

SEQ ID NO: 46103 - DNA, 601 bp, Human; identical to SEQ ID NO: 36584

SEQ ID NO: 46104 - DNA, 601 bp, Human; identical to SEQ ID NO: 36585

SEQ ID NO: 46105 - DNA, 601 bp, Human; identical to SEQ ID NO: 36586

SEQ ID NO: 46106 - DNA, 601 bp, Human; identical to SEQ ID NO: 36587

SEQ ID NO: 46107 - DNA, 601 bp, Human; identical to SEQ ID NO: 36588

SEQ ID NO: 46108 - DNA, 601 bp, Human; identical to SEQ ID NO: 36589

SEQ ID NO: 46109 - DNA, 601 bp, Human; identical to SEQ ID NO: 36590

SEQ ID NO: 46110 - DNA, 601 bp, Human; identical to SEQ ID NO: 36591

SEQ ID NO: 46111 - DNA, 601 bp, Human; identical to SEQ ID NO: 36592

SEQ ID NO: 46112 - DNA, 601 bp, Human; identical to SEQ ID NO: 36593

SEQ ID NO: 46113 - DNA, 601 bp, Human; identical to SEQ ID NO: 36594

SEQ ID NO: 46114 - DNA, 601 bp, Human; identical to SEQ ID NO: 36576

SEQ ID NO: 46115 - DNA, 601 bp, Human; identical to SEQ ID NO: 36577

SEQ ID NO: 46116 - DNA, 601 bp, Human; identical to SEQ ID NO: 36578

SEQ ID NO: 46117 - DNA, 601 bp, Human; identical to SEQ ID NO: 36579

SEQ ID NO: 46118 - DNA, 601 bp, Human; identical to SEQ ID NO: 36580

SEQ ID NO: 46119 - DNA, 601 bp, Human; identical to SEQ ID NO: 36581

SEQ ID NO: 46120 - DNA, 601 bp, Human; identical to SEQ ID NO: 36582

SEQ ID NO: 46121 - DNA, 601 bp, Human; identical to SEQ ID NO: 36583

SEQ ID NO: 46122 - DNA, 601 bp, Human; identical to SEQ ID NO: 36584

SEQ ID NO: 46123 - DNA, 601 bp, Human; identical to SEQ ID NO: 36585

SEQ ID NO: 46124 - DNA, 601 bp, Human; identical to SEQ ID NO: 36586

SEQ ID NO: 46125 - DNA, 601 bp, Human; identical to SEQ ID NO: 36587

SEQ ID NO: 46126 - DNA, 601 bp, Human; identical to SEQ ID NO: 36588

SEQ ID NO: 46127 - DNA, 601 bp, Human; identical to SEQ ID NO: 36589

SEQ ID NO: 46128 - DNA, 601 bp, Human; identical to SEQ ID NO: 36590

SEQ ID NO: 46129 - DNA, 601 bp, Human; identical to SEQ ID NO: 36591

SEQ ID NO: 46130 - DNA, 601 bp, Human; identical to SEQ ID NO: 36592

SEQ ID NO: 46131 - DNA, 601 bp, Human; identical to SEQ ID NO: 36593

SEQ ID NO: 46132 - DNA, 601 bp, Human; identical to SEQ ID NO: 36594

SEQ ID NO: 46133 - DNA, 601 bp, Human
tgcggcactcttgccggatagggtggcccggcggggctaggaaagcgtgaaatctcgcgcgattgcgctgcgaagtcggggacggggcggggctggcggcgggggcggggacccggagcgggaagatggcggcggcgcaggaggcggacggggcccgcagcgccgtggtggcggccgggggaggcagctccggtcaggtacggaggccgagaggggactgagggggttcttccccagccggggggcctcccacggggcgtgtcctacctcttgtcacggaatcccgtgcactgggggctcyttggccagagggaccttgaatacccggcccaggcagggccggaccgcccgggaggccggacggtgccgggaacagggccctgttgcgggtcggttcccctgcacgctcgagccgggcggccaccaggctcattgctcgatccggggagacagtggctcggaggggcgcaggcttgtaccttggcgcgctgggttctcaactccgcgattccatgctctgaggccgttcctagagtggtctggcgttcaggtctcgttgtagtgtttgaggtgtgcgcagtgattaattgggagttttcta

SEQ ID NO: 46134 - DNA, 601 bp, Human
cactgcagagcataccatttcaggcagctaccgttcaggcatttggggaatagatggagagacatgaaggtgctgtcgacccacccactgggatgtcactgacatgtgggaggcagctcaggggaaaggagtgcgggttgagaggggagaatgaagctgactctctgtgtgaccttgggcaagttcctttccctctttaggcctttatctctcccgtgttaaatgcagaggttggacaggagggccagccatatccctgctgtcaggggacgaagagaggagactgacatgtaaacagttrtaatcctgaatgattaggttggtgacaaaagtctgtgtcagggactgggggagcccagagaaagagcaagtggtatcacttgggtaggacacatggatgaaatttgtgtgatagagcccactgtatctgctctgaatcttttcagcattctcagccagggcctggcttcagggacagcttaggaaatgtttgttgagttagtgctggaatgaaggctcagttcctgtcttcaagggtttcccagtcttgctgaaaggaggtcgtttcccctctgggtttctgttgattattgggttgatg

SEQ ID NO: 46135 - DNA, 601 bp, Human
aagttcctttccctctttaggcctttatctctcccgtgttaaatgcagaggttggacaggagggccagccatatccctgctgtcaggggacgaagagaggagactgacatgtaaacagttgtaatcctgaatgattaggttggtgacaaaagtctgtgtcagggactgggggagcccagagaaagagcaagtggtatcacttgggtaggacacatggatgaaatttgtgtgatagagcccactgtatctgctctgaatcttttcagcattctcagccagggcctggcttcagggacagctyaggaaatgtttgttgagttagtgctggaatgaaggctcagttcctgtcttcaagggtttcccagtcttgctgaaaggaggtcgtttcccctctgggtttctgttgattattgggttgatggtggcttgagagaccagggcccaggttgttctcattgccctgagcttccagatggcactctgatcttctcttgtaccaactctgcttaaaaacaatcaagagttacccctttgcctttaggacaaagtacaaattctttaataaatcacagtcttgcacgatccgacacttttcttcaga

SEQ ID NO: 46136 - DNA, 601 bp, Human
ttgtgattgtctttctgctgatagccatcctaataggtgtgaagtgacacctcattgtggttttaacttgcctttccgtgggaaggttcccagccagattgcccatcactaacgggtaagcgaagagacctgggagtcagtcagatgcagcttcaaatcctgacctggcatcaagtgtcctttcctgaccccaaatcagctcagacccattgaaacccatacttggacccctaaatttcccaatagctaggctggccttgaggagggggccttgtgcctgtctgatttcccttccccagcygacccccgccccatagatctcctcatcagaatgtggctttctctgtctcagcctaagggtctcacccagacgacccagacgtcaaagggagctcctcagggaggcctctctgaccacccactccaaagtggatccctgttcccaactcagttgctgtcacttccccctgcttgttttccatgtaccatttttaattatcctgtttaccgttctagtgtgtttccttctagatccccagctctgggtaagcagggcccagatttctgtctaaaatgttccagtattttcacaacctggtcc

SEQ ID NO: 46137 - DNA, 601 bp, Human
aatcctgacctggcatcaagtgtcctttcctgaccccaaatcagctcagacccattgaaacccatacttggacccctaaatttcccaatagctaggctggccttgaggagggggccttgtgcctgtctgatttcccttccccagctgacccccgccccatagatctcctcatcagaatgtggctttctctgtctcagcctaagggtctcacccagacgacccagacgtcaaagggagctcctcagggaggcctctctgaccacccactccaaagtggatccctgttcccaactcagttgcwgtcacttccccctgcttgttttccatgtaccatttttaattatcctgtttaccgttctagtgtgtttccttctagatccccagctctgggtaagcagggcccagatttctgtctaaaatgttccagtattttcacaacctggtccacaggtcagagaggtgaagtgatgtgcccaaggtgtcacagccaagaacggtgggaccaggactatagctgaggtctgtttgaccctggagcccctccaatggtgtcctgtgctttgggagattacaggaaagagctcttgctggtgaaggggac

SEQ ID NO: 46138 - DNA, 601 bp, Human
agcctggcgacagagcaagactgagtctcaaaaaaaaaagagaaaataaaaataaaacaatcatggctgggcgcggtggctcacgcctgtaatcccagcactttgggaggccaaggcaagcagatcacgaggtcaggagatcgagaccatcctggctaacacagtgaaacgccgtctctactgaaaatacaaaaaaattagccaggtgtggtggcgggcgcctgtagtcccagctactcaggaggctgaggcaagagaatggtgtgaacccaggaggcggagcttacagtgagcccaggtsgtgccactgcactccagcctaggcgacagcgagactccgtctcaaaaaataaaacaaaaataaaaaaataaaacaatcattcctttggctagaatgtcttcacatggccatggccagctgcacgggaggctgggaaatgtggtctttaatctgggaaactgagcaccctgctggaaagcagggctcctattactgaggaagaagaggagagtggttatggggggcagctacttatctcttccataaaatcttattactggtttcccttagcttataaattatgagtgtttattttacaaa

SEQ ID NO: 46139 - DNA, 601 bp, Human
ttactggtttcccttagcttataaattatgagtgtttattttacaaaattaagtagttcaaacaatacgaagagtgaaaagaaaaagctaatgaaaaagtgtaatgtgggccgggcgcggtggctcacgcctgtaatcccagcactttgggaggccgaggtgggtggatcacgaggttaggagatcgagaccatcctggctaacacagtgaaactgcatctctactaaaaatataaaaaattagccgggcatggtggcaggcgcctatagtcccagctactcgggaggctgaggcaggagratggcgtgaacctaggaggcggagcttgcagtgtgccaagatgccgccactgcactccagcctgggtgacagagcgagacacagtctcaaaaataaaaaagtgtaatgtgttggtggccatcccataggcacacatttttgtaattggccctaaatgggattatatatagatgctcacagatagagttgtttaaaatagagaaaagttaggaggcggggggcaggtagtgtcagatagcgtgtaagagcacagccctgctgacatctcagccctgccacctctgagctctgtggcctggt

SEQ ID NO: 46140 - DNA, 601 bp, Human
gctggcacgcacacagacaatgttggccatgattccttttgttgttcaacgtggaaaaaaaaaaagcctgagcaacacagtaagacccccatctctctctctctctctcttttttttgggagacagaatctcgctccgtcgcccaggctggagtgcagtggcgcgatctcggctcactgcaagctccgcctcctaggttcacgccattctcctgcctcagcctcccgagtagctgggactacaggcgcccgccacagcgcccggctaattttttgtatttttagtagagacagggtttcaycgtgttagccaggatagtctcgatctcctgacctcgctatccacgcacctcgggctcccaaagtgctgggattacaggcgtgagccaccgcgcctatcctgaccccatctctgtaaaaaactaaaaaattagctgggtgtgatggcgcacacctgtagtgccagctattagggaggccgaagagggaggatcgcttgagcccaggaggtcaaggctgcaatgggccgtgatgatactactgcactccagcctaggcaacagagtgagactgtatctcaaacaaacaaaaaccttaggaaa

SEQ ID NO: 46141 - DNA, 601 bp, Human
caacgtggaaaaaaaaaaagcctgagcaacacagtaagacccccatctctctctctctctctcttttttttgggagacagaatctcgctccgtcgcccaggctggagtgcagtggcgcgatctcggctcactgcaagctccgcctcctaggttcacgccattctcctgcctcagcctcccgagtagctgggactacaggcgcccgccacagcgcccggctaattttttgtatttttagtagagacagggtttcatcgtgttagccaggatagtctcgatctcctgacctcgctatccacgyacctcgggctcccaaagtgctgggattacaggcgtgagccaccgcgcctatcctgaccccatctctgtaaaaaactaaaaaattagctgggtgtgatggcgcacacctgtagtgccagctattagggaggccgaagagggaggatcgcttgagcccaggaggtcaaggctgcaatgggccgtgatgatactactgcactccagcctaggcaacagagtgagactgtatctcaaacaaacaaaaaccttaggaaatatatagtgaaacagtgaaaaaaaaaagttcatgaggccgggtgca

SEQ ID NO: 46142 - DNA, 601 bp, Human
gcgcgatctcggctcactgcaagctccgcctcctaggttcacgccattctcctgcctcagcctcccgagtagctgggactacaggcgcccgccacagcgcccggctaattttttgtatttttagtagagacagggtttcatcgtgttagccaggatagtctcgatctcctgacctcgctatccacgcacctcgggctcccaaagtgctgggattacaggcgtgagccaccgcgcctatcctgaccccatctctgtaaaaaactaaaaaattagctgggtgtgatggcgcacacctgtagtsccagctattagggaggccgaagagggaggatcgcttgagcccaggaggtcaaggctgcaatgggccgtgatgatactactgcactccagcctaggcaacagagtgagactgtatctcaaacaaacaaaaaccttaggaaatatatagtgaaacagtgaaaaaaaaaagttcatgaggccgggtgcagtggctcacgcctgtaatcccagcactttgggagaccaaggtaggtgaatcacctgaggtcgggagttccagaccagcctgaccaacatggagaaacccatctctgcaaaaaat

SEQ ID NO: 46143 - DNA, 601 bp, Human
gtgaaaaaaaaaagttcatgaggccgggtgcagtggctcacgcctgtaatcccagcactttgggagaccaaggtaggtgaatcacctgaggtcgggagttccagaccagcctgaccaacatggagaaacccatctctgcaaaaaatacaaaattagccgggcatggcggcttatgcctgtaatcccagctattcaggaggctgaggcaggagaatcgcttgaacccgggaggcggaggttgcagtgagccgagatcatgccattttactccagcctgggcaacaagagtgaaactctgtcycaaaaaaaaaaaaaaacaactcatgatccctgatgtagtcactgatcacattctagactagagcagaactgcctgcctggtgtcctccaagagtgtcacacaggacactgagaaactgcaggaaagaaacctccccactctgttaagttgcaaaactgacatgtgtgcctcaaaaattcctgccatgtgccctacgcttctcagtcatgcgcccctgtcccttaccgtctccacttcacctcccctccccatggccacgtaaagacttcagattttcttatatatcaccttctttttttt

SEQ ID NO: 46144 - DNA, 601 bp, Human
atacctataattaataagtacttgaatcatttaatcacatggctgcatgcagctgagaaacctccattaacacagtacaggttcatttctctctgatataccagtctggatggaggcagactaggattctgcagtcttcagtgacccagactccttgctgtttgttgtgccattgctaggtttttccctttatcctcatagcccaagacagctgctgaagattcagccatcacatccacactccaggcaacaggagagaagaataaatcaagaaggaatatttcttctctttaaggacacttttttttttttttttttgagatggagtcttactctgtcacccagactggagtccagtggcatgatctcggctcactgcgacctccacctcccaggttcaagcgattcttttgcctccgcctcccaagtagctgggattacaggcgcccgccaccacgcccggctaatttttgtatttttagtagagatggggtttcaccatgttggccaggttggtctcgaactcctgacctcaagtgttggcttcccaaagtgctgggattataggtgtaagccaccacgcccagcctcgttttggttt

SEQ ID NO: 46145 - DNA, 601 bp, Human
aggattctgcagtcttcagtgacccagactccttgctgtttgttgtgccattgctaggtttttccctttatcctcatagcccaagacagctgctgaagattcagccatcacatccacactccaggcaacaggagagaagaataaatcaagaaggaatatttcttctctttaaggacacttttttttttttttttttgagatggagtcttactctgtcacccagactggagtccagtggcatgatctcggctcactgcgacctccacctcccaggttcaagcgattcttttgcctccgcctmccaagtagctgggattacaggcgcccgccaccacgcccggctaatttttgtatttttagtagagatggggtttcaccatgttggccaggttggtctcgaactcctgacctcaagtgttggcttcccaaagtgctgggattataggtgtaagccaccacgcccagcctcgttttggttttggtatctgttgttgctgctgattctcgctcataatgtcgtttccttttgtgcctggcttatctctgtctgtgtcctagtcattatacttgaaaagttatttgtaggaatttcagggctagg

SEQ ID NO: 46146 - DNA, 601 bp, Human
agaatacgtgagcagcatatattctcattctatcaatatgtataattacaaatataaaatatattgatattttcttagtgtattaattttatcaagcttttccaattttttccagtgagagggttggtctgaataattaagcccactgttactaaaattggaactaacgtatcacttactatctgcttctccaaaaattctccaaaagttcagaaatgttgctctttctaagcttctgtgccttcggttcttttccttttcttttttaaaaaatttaattaattaattgattaattttttkgggacaagctctctatctcccaggctggagtgcagtggcgcaatcacgtctcactgcagccttgaccgtcagggctcaagtgactctctcacctcagtcccccaagtagctgggactacaggcatgggccaccatgcccagctaatttttatattttttgtagagacgggatttcatcatgttgcccaggctggtctcaaacttttgagctcaagcaatccgcctgcctcagcttcccaaagtgctgggattacaagcgtgagctgctacacctgacccaattatacttttttttttttt

SEQ ID NO: 46147 - DNA, 601 bp, Human
gtataattacaaatataaaatatattgatattttcttagtgtattaattttatcaagcttttccaattttttccagtgagagggttggtctgaataattaagcccactgttactaaaattggaactaacgtatcacttactatctgcttctccaaaaattctccaaaagttcagaaatgttgctctttctaagcttctgtgccttcggttcttttccttttcttttttaaaaaatttaattaattaattgattaatttttttgggacaagctctctatctcccaggctggagtgcagtggygcaatcacgtctcactgcagccttgaccgtcagggctcaagtgactctctcacctcagtcccccaagtagctgggactacaggcatgggccaccatgcccagctaatttttatattttttgtagagacgggatttcatcatgttgcccaggctggtctcaaacttttgagctcaagcaatccgcctgcctcagcttcccaaagtgctgggattacaagcgtgagctgctacacctgacccaattatactttttttttttttttttttttttgagatggagtctcactctgttgcaaggct

SEQ ID NO: 46148 - DNA, 601 bp, Human
tggcctctatacttcttaagttattttaaaatgtgtaattaaattactattgactagagttgccgtgttttgctaccaaatactagatctcattcattctttttttttttgagatggagtctcgctctgttgcccaggctggagtgcagtggcgcgatcttggctcactgcaacctctgcctcctgggttcacaccattctcctgcctcagcctccggagtagctgggactacaggcgcccgccaccatgcccagctaatttttttgtattttttagtagagacagggtttcaccatgttrgccaggatggtctcaatctcctgacctcgtgatccgcccgccttggcctcccaaagtgctgggattacaggcatgagccgccgcgcccgtcctcgttcattctattttttgtagccattaaccatccccggttctgtgcttttgaagcgctaggattccagattctttcttttaaaaattttatgtttattattttttctttatttcttttttcttttaattcatccatctgcacactgaaggggttccagattcttagtctcctctcgggggatcccagggggctggatggcaggtttc

SEQ ID NO: 46149 - DNA, 601 bp, Human
acacactggcaaacggtggcatctgggctccctccccagatgtggtctttagggacatcttatctccttgccagccctgtgactaccttctcagggcctccctgacttggtcactagccccaggtcaggcgccagcatgtgctaagtcagaaggaagtcaggcgggtctatggcggagagccaaggcttggggactcaccaccttgctgcttctctcctcaggatcttcatcatctgggccatcagcagttggttccgccgagggccggcccctcaggaccaggcgggccccggaggagcyccacgcgtcgccagccgcaacctgttccccaaagacactttaatggtaactgccgggtggtagggcagacttgggaggtgatggggtgtggaggggtggaatgtggaggagtgatgtcagcagtcgggacagaccaggtccttgctcactggcaggtctaggaaaacaggtccagggttgaggaactctgggcccatccccaacacgtgagacctctgtcacctgggtccatccccagcacataaaacctgtgtcacccaaaagaaaaagcaaattcatttggttaaaataggttaaatc

SEQ ID NO: 46150 - DNA, 601 bp, Human
aggaagaccccatctctaaaaaagatagggagagtgaggagaacacaatgtggccaactgaattcgagctctgcacaaggatcagagaggttcagtgctcgcctttgtctccacccagtgcccctggacaacttgcctcccttcttgaagcctcagtttcctcatctggatcaagtgagaatagtcccccttccctgggaggcaaggagacttgatgagataatgaggaagacttgggcagagaggggccagctggaggtagcagggagtagcacccaggagcccacagactgggtttccrtctgcgtacttgccacacactatgtgaccccttggcatgagccccgtttgcctcatctgcaaaatggggtggtaacatgacccattgcataaggttgacatgttatatgtgtgttaactcgttagattaggaagctgttgtctgaagtgcccagggcagggtctggcccatagtaggagctccatgtcggtcagctgcttcttcctgttgagtgagcttaacgagagctcgttgactgagctgtgtgccagtgctccaggtagtccctgcagtggtgccctcgggtcagtgctgtgggaa

SEQ ID NO: 46151 - DNA, 601 bp, Human
ataactcattaatccattaaaccactaatccatgaatgggttaatcagttcctgaggggagggtcctcatgacccagtcacctcttaaaagcctcatctctcagtactggcacattggggattaagtttcactgggagtggggagtactagagtacatcagtagtcccagctacttgggaggctgaggtgggagaatcagcatgagttttggccaggacaaacattcaaaccatagcattgtccgtcctcttgttttcgagaggttaataattgttgtcatctttctgcttgcctggctctttttttttttttttttgagacagggtctcactatgtcgcccaggctggagtgcagtggactatctcagctcaccacaatttccacctcccaagttcaagcgattctcccaccttagcctccaaaatagctgggactacaggcacacgccactacgcccggctagtttttgtatttttagtagagacggggtttcgccatgttggccaggctggtctcaaactcctgacctcaagtgatcgtctgcctcggcctcccaaagtgctgggattacaggtgtgagctgccacacccagccttgc

SEQ ID NO: 46152 - DNA, 601 bp, Human
gggcagccgtagaaatctcttgctgtacctgtttgagcggagctggagaatggcttcctcagaaagccccccattcttctaacgggagttctgtgtactccacctagctttcactttattgaggactattccagacattccctgtggatttggttaagatccatctggctggttttgggtggcgcagcaacagacagaattctatttgtatgagttaggtcttacctacttcttttagtacaaaaatatcctaaaggatggtaatttttttttatcacctatactggatgaaatgaaaagytgactctatgtgggtccctagaaatgacttggaaaggtcttctggagttacttgagcccctttctgagtgagtgtgtctgcagaatgtgctgcgttggtatgtcccacccggctgacgtccatgtggtgagatctttggagaaccaggcagaagtggcttgagggggtgtgacctacagggttggtctcacagatgtttccctgcagggggatacgtcaggggtctgggctaaaatgcccgatgtttcagaggtcgctctgaaggtgacccaggtgggtggctcttcaccctattcttgt

SEQ ID NO: 46153 - DNA, 601 bp, Human
acgggagttctgtgtactccacctagctttcactttattgaggactattccagacattccctgtggatttggttaagatccatctggctggttttgggtggcgcagcaacagacagaattctatttgtatgagttaggtcttacctacttcttttagtacaaaaatatcctaaaggatggtaatttttttttatcacctatactggatgaaatgaaaagttgactctatgtgggtccctagaaatgacttggaaaggtcttctggagttacttgagcccctttctgagtgagtgtgtctgmagaatgtgctgcgttggtatgtcccacccggctgacgtccatgtggtgagatctttggagaaccaggcagaagtggcttgagggggtgtgacctacagggttggtctcacagatgtttccctgcagggggatacgtcaggggtctgggctaaaatgcccgatgtttcagaggtcgctctgaaggtgacccaggtgggtggctcttcaccctattcttgtaccccgtttgacgatcacctaatcatcccgttgacccaaatcgatgccagtattttctgcagttttgtctttggtgagtgt

SEQ ID NO: 46154 - DNA, 601 bp, Human
tatttttttttgagacagagtttcactcttgttgcccaggctggagtacagtggcatgatcttggctcgccacagcctccacctcccaggttcaagcaattctgcctcagcctcccaagtagctgggattacagtcatgtgtcaccacgcccagctaattttgtatttatagtagagatagggtttctccatgttggtcaggctggtctcgaactcccgacctcaggggacccacctgccttggcctcccaaagtgttgggattacaggcgtgagccaaaaaatttttttaaattagccaratatggtggtgcgcaacctgtagtgtcctccgactcaggaggctcaggtagaaggatcatttgagtccaggaggtcaaggctgcagtgaactgtgatcaggccactgcacttcagcctgagcaacaaagcgagaccctgtctcaaaaagaaatataaataaaataataaaaaggtaaggccagggccgtgatggctcacacctgtaatcccagcactttgggaggccaaggctagaggattgcttgagcctaggagttcgagaccagcctgggcaacatggcaaaaccccccctaataaa

SEQ ID NO: 46155 - DNA, 601 bp, Human
aataatcatagaaatgatgaggattggccaggtggctcaagcctgtagtcccagcaatttgagaggccgaggcaggtggatcacttgaggttagaatttgagaccagcctggccaacatggttaaactccgtctctactaaaaatacaaaaattgctggtcatggtggtggatgcctgtaatcccggctactcgggaggctgaggcaggagaattgcttgaacctaggaggcagaggttacagtgagctgaagtcatgccactgctctctagcctgggcaacagagtgagactccatctcaaaaaaaaaaaaaaaatgaggatgacgtttctgctaataagcagtaggccctgggccaagaagtggtgaggcttttcttccttctttagggaagtgacatcactcaccagcatcccttagcttgtaggattcagagccaagattgcccccagagcccccgctgttggccaggtctctttcccctttccctgtctctccctggccccaggggacaggatagagacttgagggagggcagactgagttttccttcatagcataaggaagagctgaaaagtccccgggctcagtggctcacgcc

SEQ ID NO: 46156 - DNA, 601 bp, Human
aaaaaaaaaaaaaaaaaaaaaaaaagaaaagaaaaaagaaaaatacttagcttcttttcgggccaggtgcggcagctcacacctgtaatcccagcactttgggaggccaaggtgggcagatcacgagatcaggagattgagacaatcctggctaacacagtgaaaccctgtctttactaaaaatacaaaaaattagcagagcctggtggcacacgcctgtaatcccagctacttgagaggctgaggcaggagaattgcttgaacccaggaggcggaggttgcagtgagccgagattgtgcyactgcactccagcctgggtgacagagcgagactctgtctccagaaaaaaaacagaaacgtccccaggccagggcagaggttgggagatggagcgtgggcacgcacaagccccttcctccccggcagcatttgggacaacatggcagggggcctgtggccaactgggcctctgcgagaggaagtgaggccaactcctggctggggattcacagcctcaaagtgtttctcatcttggtttctcatgttggtggcttcaggccttttttggaaccgtctgctgcctctttatagtcatgtatt

SEQ ID NO: 46157 - DNA, 601 bp, Human
cagaaaaaaaacagaaacgtccccaggccagggcagaggttgggagatggagcgtgggcacgcacaagccccttcctccccggcagcatttgggacaacatggcagggggcctgtggccaactgggcctctgcgagaggaagtgaggccaactcctggctggggattcacagcctcaaagtgtttctcatcttggtttctcatgttggtggcttcaggccttttttggaaccgtctgctgcctctttatagtcatgtattcaactggtcatcaccgagcctgtgcaggcgccccatgtgtrttcaaacaggccctgcccctacccgcatttccgcacagagtttgcagactggttgcagggacagacagcaggcaggtaaaccactggctaagtggttttggatagtggtgaaatgttgtgaaggaaacaagctggcaggagaatgactgcataggctcattcagtggggtggccagggaagccctgtggaagaaggacattctgccagggacttgaatgccacggaggagccaggccacgaagattgtgtcagggcatgggttcctgggacacggggcagcacgcctgaaggccccgggt

SEQ ID NO: 46158 - DNA, 601 bp, Human
ctcccctccctgagcactgggctcctcctctgggaaatggggtcaggaggcagctgtctctcagggagtgaggaggatcccagacaaggttacctgagcctcttgccagcctgggaggggtctacatcacagtcccattgtcacatgaggacacttgctcagtctcagccggaagtggcaggccagggactctcacccacacagccaggccccagagcccaagctcagcctggctccaagcacacacacgagaatatggctttagtaggaactgcaggattcatagttgctgtcactcccrgtgggctggggagccgggcagttaatctgtggttaacctgcagtgggcactaagagacttcctctctctgcgggtggtcctgtgttgggggggtggtccctgctcatggagctgaggccaccgtgcaagagtgtgtggagcctgctgtcatgaggctgggcttcgcagcctggcctaggatgccagccctgcctctacctctacctcggttttctacatgtggggtgggaggatcctgtcggtggccggaagggtcctgggtggcggaatctctaagcctagggaggagagccttctgcc

SEQ ID NO: 46159 - DNA, 601 bp, Human
tcaccatcaacatcgtggacgaccacacgccgtgggtgaagggcagtgtgccccctcccctggatcaatgtaagctccccagccctgccagctgcctgcagagcctttgagagggtgctcggggtccatctccttgtcttctcctggccctgtccccctgagagagctttccagggctccaccctcccaagctcccaccctgtcctatccccttcccatgtcctctccctctcccacaccaccacccctggggaccccaggactgacttctacacgccagcatcggtccgcaatcaagtgycatccagcccacaaactgttttcaaaaaatgtcttatcacttgccagcttttgaaattgaggcagtatcacttaaaagccacaatttctggcttattttataaaactgggttacatggtcacccacagggcagccgtgggctggagctgagccacagctgcccccttcagtggggacctgcctgccctttgcctcagtcccctctgctgaggtcaaggcgccctttagctcctcatggtgtggcctagaaatgtcccctgtcctccagtctctgtagaggggccctgttgggtctctcca

SEQ ID NO: 46160 - DNA, 601 bp, Human
atctccttgtcttctcctggccctgtccccctgagagagctttccagggctccaccctcccaagctcccaccctgtcctatccccttcccatgtcctctccctctcccacaccaccacccctggggaccccaggactgacttctacacgccagcatcggtccgcaatcaagtgccatccagcccacaaactgttttcaaaaaatgtcttatcacttgccagcttttgaaattgaggcagtatcacttaaaagccacaatttctggcttattttataaaactgggttacatggtcacccacrgggcagccgtgggctggagctgagccacagctgcccccttcagtggggacctgcctgccctttgcctcagtcccctctgctgaggtcaaggcgccctttagctcctcatggtgtggcctagaaatgtcccctgtcctccagtctctgtagaggggccctgttgggtctctccagacatctgaggcctgcgggtaccctggcctcctgcccgggccaaatggtgcccctgccccacgtgctgcagatgtgaagttcgacgccgtgagcggtgactactatcccatcatctacttcaatgac

SEQ ID NO: 46161 - DNA, 601 bp, Human
tcctctccctctcccacaccaccacccctggggaccccaggactgacttctacacgccagcatcggtccgcaatcaagtgccatccagcccacaaactgttttcaaaaaatgtcttatcacttgccagcttttgaaattgaggcagtatcacttaaaagccacaatttctggcttattttataaaactgggttacatggtcacccacagggcagccgtgggctggagctgagccacagctgcccccttcagtggggacctgcctgccctttgcctcagtcccctctgctgaggtcaaggcrccctttagctcctcatggtgtggcctagaaatgtcccctgtcctccagtctctgtagaggggccctgttgggtctctccagacatctgaggcctgcgggtaccctggcctcctgcccgggccaaatggtgcccctgccccacgtgctgcagatgtgaagttcgacgccgtgagcggtgactactatcccatcatctacttcaatgactactggaacctgcagaaggactactaccccatcaacgagagcctggccagcctgccgctccgcgtctccttctgcccactctcgctttggcgc

SEQ ID NO: 46162 - DNA, 601 bp, Human
tctgtagaggggccctgttgggtctctccagacatctgaggcctgcgggtaccctggcctcctgcccgggccaaatggtgcccctgccccacgtgctgcagatgtgaagttcgacgccgtgagcggtgactactatcccatcatctacttcaatgactactggaacctgcagaaggactactaccccatcaacgagagcctggccagcctgccgctccgcgtctccttctgcccactctcgctttggcgctggcagctctatgctgcccagagcaccaagtcgccctggaacttcctgggygatgagttgtacgagcagtcagatgaggagcaggactcggtgaaggtgagtgcggccggtgtgggcgggacttcccggtgccttcctgggcgcaagaggccaagaggaagtgtgccaggcctgggctgtgggacctcccgcctggtgctcctctgcccacagtttcacaacctcccaggtcccttctccacagtgaaaggaagtgggcacccagccctccagccctagatgactgggggtcctctccccaggctgttctgttggaccctttgggtccagacctgtcccttcctccttctg

SEQ ID NO: 46163 - DNA, 601 bp, Human
ggtcctctccccaggctgttctgttggaccctttgggtccagacctgtcccttcctccttctgtcccagaccttgtgtccctggccctggctccaactctgtgtctctgccatctcactgggtcctgaaatgtcagcctgtgtctgtggcgtgaggctcggctttgcctcctgggctgtcgtcactgttgggtctctgctcctggctcccagtgtcccttcacccactccccgcagcactcccttggcctctgcctcttcccctagtgccatctccccgtctcttctgtctttgtgagtcrccctcctctctctccccatctgcccatctctgacccagtctcctcctggctggcccaccttcagcctccctctacaggcggccccaggggcagccctcgggacaaaagctagtgaaggtgctcctgggtggggacaggctgtgctcacatgtgtcccctgcaggtggccctgctggagaccaacccctacctgctggcgctcaccatcatcgtgtctatcgttcacagtgtcttcgagttcctggccttcaagaatggtaggaacaggaccccagggctagtgagaggctgtgcagggtg

SEQ ID NO: 46164 - DNA, 601 bp, Human
ctggcccgctggtggggcagaggccaggccaatactgccaggaagcagggctggggaactccagagccaagagcagggaagccccggagctgctcccgccaccctgcccggcaggctgcctgctgcgggaggccgcttagggctgagtggacggggcctgcccaagtgggaaggaggagcactgtcccccaaaggtccctaggttctaaggctgaccatactgatggccagcgtttgaggagaagcagccacatgccaggcactgtcctgggtaccctccccagtagctccttgagccctrtgggagccagaggctcagggatgtcacttgcccagtcacacggttcctaaggggcagatggttccagccccaactctcatcttctaggccctgcaggccacttcttccttgcccagagcaccccagtctgaaggagtggcctgcggccctgtagctcccgcaggcggcaagaggaatgagtagtagtattcctggtattaagatgctattgccggcctggtggtggctctcgcctgtaatcccagcactttgggaggccaaggtgggaggatcacctaagccccggagtttgagaccagc

SEQ ID NO: 46165 - DNA, 601 bp, Human
agccccaactctcatcttctaggccctgcaggccacttcttccttgcccagagcaccccagtctgaaggagtggcctgcggccctgtagctcccgcaggcggcaagaggaatgagtagtagtattcctggtattaagatgctattgccggcctggtggtggctctcgcctgtaatcccagcactttgggaggccaaggtgggaggatcacctaagccccggagtttgagaccagcctgggcaacaaagcgagattcgtttctacacaattttttttaagaattagctgggcatggcagcgygtgcctatggtctcagctactcgggaggcttgggcctgaaaggtcaaggctgccgtgagccatgatcacaccactgaactccatcctaggcaacagagtgacaccctgttccaaaaaaaaggacgctcttgccattattgagaactaccatctggaagaatgcagtgtcatacgggcacaggagctggtgccgaccccagccagccatctaccagctgtcgctgggagacgggacccttctgcctaggagctggcttggctggggtccagtgagaaatgaggcacaagaaggctgtcctc

SEQ ID NO: 46166 - DNA, 601 bp, Human
cgagattcgtttctacacaattttttttaagaattagctgggcatggcagcgcgtgcctatggtctcagctactcgggaggcttgggcctgaaaggtcaaggctgccgtgagccatgatcacaccactgaactccatcctaggcaacagagtgacaccctgttccaaaaaaaaggacgctcttgccattattgagaactaccatctggaagaatgcagtgtcatacgggcacaggagctggtgccgaccccagccagccatctaccagctgtcgctgggagacgggacccttctgcctagragctggcttggctggggtccagtgagaaatgaggcacaagaaggctgtcctccccagtgtcatgcagcagggggcgcaggcctcacttggcaccagtgctgtgtggcctccctggtctaaggagaggcttgggcccaactgctcccacgagaacccaccagaaccctgtctccagacccattcttctcagttgggacaggggtcattctgatgggcaggggtgggtggggtgaggctatggagtgtgccagagctctgggatgtgggggagctctgggatgtgggggagctctgggatgg

SEQ ID NO: 46167 - DNA, 601 bp, Human
gcgttttccagtcattcgtggtcctcctctacatcctggacaacgagaccaacttcgtggtccaggtcagcgtcttcattggggtcctcatcgacctctggaagatcaccaaggtcatggacgtccgggtaaggctggggcgccatgctgtctcgggagctgcaggggttgggagggggtagtgtggcccagctggaccctggagctggcccccgggggattcccagcaagtgcctcactcccaggactgaggggattttctcaccaggggattttttgggtcacacatggggcaggggamctgggaacggtggggaagggcaggggctggttctggcttgtggggtgggagccagcgtagcaactgaccatggcacccacctcatccacagctggaccgagagcacagggtggcaggaatcttcccccgcctatccttcaaggacaagtccacgtatatcgagtcctcgaccaaagtgtatgatgatgtgagtgtcctgcacagtgggcccctgggggtggtctccaggtacccacgtatccctgaggcacccggggccggccatctgtctgccggacccatgctttacagcctgtgcca

SEQ ID NO: 46168 - DNA, 601 bp, Human
ctccgcccaccgcccaccgcccctccctggcattggttggcgccaggggaagccgaggctccatcctttctgcgcaggttcccgccgcactcgcgcagacctagcgcgtccaggtgggaggttagtgtggcccgggcgtccgctcctcagcggatgtggcagccccgagccatggctctcgccgtccgagtcgtttattggtaagcccagcggccagcggcccccgtccccgacccccgccgggacccgattctcggagccggggtcagggagccccggggagaggacccatgggagcccytgtatgggaaaagggagcccctgtatgtgggtggggtgggcgtacggaggggcgaaaaacagagggcggtcgtccctaggccccgtcttcgacttgtgacacgctgggcatctcgggttataaaaggtggggctgagacgagtgtgtgtcaatttcgaacccccgactccggggctccgctggggaaggggctgggggtcagctttgtaaagggacctaaggctcctccaccctaaggcttcccctcccccaatatcccgaacagtcgcggggtggggacagtgagagcccagaaggttc

SEQ ID NO: 46169 - DNA, 601 bp, Human
cctcagcggatgtggcagccccgagccatggctctcgccgtccgagtcgtttattggtaagcccagcggccagcggcccccgtccccgacccccgccgggacccgattctcggagccggggtcagggagccccggggagaggacccatgggagcccttgtatgggaaaagggagcccctgtatgtgggtggggtgggcgtacggaggggcgaaaaacagagggcggtcgtccctaggccccgtcttcgacttgtgacacgctgggcatctcgggttataaaaggtggggctgagacgagtrtgtgtcaatttcgaacccccgactccggggctccgctggggaaggggctgggggtcagctttgtaaagggacctaaggctcctccaccctaaggcttcccctcccccaatatcccgaacagtcgcggggtggggacagtgagagcccagaaggttcgagaatgtctcagcctgtgttttagaagcacttgaattgttggcctctgcccagtgggttcccttggccacgaaccccactccttttctggcctcagttttccgtctgtggcaagagggaggctctgtgtcaataccgaacacg

SEQ ID NO: 46170 - DNA, 601 bp, Human
agaggacccatgggagcccttgtatgggaaaagggagcccctgtatgtgggtggggtgggcgtacggaggggcgaaaaacagagggcggtcgtccctaggccccgtcttcgacttgtgacacgctgggcatctcgggttataaaaggtggggctgagacgagtgtgtgtcaatttcgaacccccgactccggggctccgctggggaaggggctgggggtcagctttgtaaagggacctaaggctcctccaccctaaggcttcccctcccccaatatcccgaacagtcgcggggtggggacmgtgagagcccagaaggttcgagaatgtctcagcctgtgttttagaagcacttgaattgttggcctctgcccagtgggttcccttggccacgaaccccactccttttctggcctcagttttccgtctgtggcaagagggaggctctgtgtcaataccgaacacgcttaatttctgcaagtctcaggaagggtataataggataggatataaattacgttctctccactccccagcacctaatactgtgtggcatgctgtaggtatttaataaatacgtgttcaatgaatttatcctcccag

SEQ ID NO: 46171 - DNA, 601 bp, Human
gtatgtgggtggggtgggcgtacggaggggcgaaaaacagagggcggtcgtccctaggccccgtcttcgacttgtgacacgctgggcatctcgggttataaaaggtggggctgagacgagtgtgtgtcaatttcgaacccccgactccggggctccgctggggaaggggctgggggtcagctttgtaaagggacctaaggctcctccaccctaaggcttcccctcccccaatatcccgaacagtcgcggggtggggacagtgagagcccagaaggttcgagaatgtctcagcctgtgtttyagaagcacttgaattgttggcctctgcccagtgggttcccttggccacgaaccccactccttttctggcctcagttttccgtctgtggcaagagggaggctctgtgtcaataccgaacacgcttaatttctgcaagtctcaggaagggtataataggataggatataaattacgttctctccactccccagcacctaatactgtgtggcatgctgtaggtatttaataaatacgtgttcaatgaatttatcctcccaggaatcccttaagagaggggaattttaggccaggtgccgttga

SEQ ID NO: 46172 - DNA, 601 bp, Human
tgatccagctccagaaacttacccactttggaactgaacatgagtccaagaatgctctagaaacaaatgctaactctagaatggattgtctgctccaaaaaaaccctagagctgactcccagttctccccatagagccgagaatgaaatacaccaccagctcccaacacactgtaaacctgagccccccttcccaacccagcaattgaaaaatgtgaaccagctcctaagcactagaattgaccactagttcctggagttggctactggttccttatcactgtttttctttctttctttctttcttttttgagatggagtcttgctctgtctcccgggctggagtgcagtggcgcgatctcggctcactgcagcctctgcctcccgagttcaagcaattctcctgtgtcagcctcccaagtagctgggattacaggcacatgccactatgcccggctaatttttgtatttttagtaggtctgatcctgttggccaggctggtcttcaggtgatccacctgccttggccttccaaagtgttgggattacaggcgtgagccaccgtgcttggcctccttaagcactctgaaccaagtattgtt

SEQ ID NO: 46173 - DNA, 601 bp, Human
tccagctccagaaacttacccactttggaactgaacatgagtccaagaatgctctagaaacaaatgctaactctagaatggattgtctgctccaaaaaaaccctagagctgactcccagttctccccatagagccgagaatgaaatacaccaccagctcccaacacactgtaaacctgagccccccttcccaacccagcaattgaaaaatgtgaaccagctcctaagcactagaattgaccactagttcctggagttggctactggttccttatcactgtttttctttctttctttctttyttttttgagatggagtcttgctctgtctcccgggctggagtgcagtggcgcgatctcggctcactgcagcctctgcctcccgagttcaagcaattctcctgtgtcagcctcccaagtagctgggattacaggcacatgccactatgcccggctaatttttgtatttttagtaggtctgatcctgttggccaggctggtcttcaggtgatccacctgccttggccttccaaagtgttgggattacaggcgtgagccaccgtgcttggcctccttaagcactctgaaccaagtattgtttcc

SEQ ID NO: 46174 - DNA, 601 bp, Human
tctcggctcactgcagcctctgcctcccgagttcaagcaattctcctgtgtcagcctcccaagtagctgggattacaggcacatgccactatgcccggctaatttttgtatttttagtaggtctgatcctgttggccaggctggtcttcaggtgatccacctgccttggccttccaaagtgttgggattacaggcgtgagccaccgtgcttggcctccttaagcactctgaaccaagtattgtttccagcctaatacattgtggaacaagtggcaatttctatatgaacctcaggaacaamgaactactttccagcaccttctgagtctgattttccagtttgtaagccagtatggtccagataagcgtgaaacccaacccattctagaacagttactagccctttttctggtctctggcactgcagggcctggagcatagtttattttttgaggtggagtctcgctctgtcgcccaggctggagtacagtagtgtgatctcggctcactgcaacatctgcctcctgggttcaagggattcttgtgtctcagcctcgtgagtagctggaattacagatgtctgccaccatgctgggcaaat

SEQ ID NO: 46175 - DNA, 601 bp, Human
gggccacccagcatgctcctgttgaaggctgggactcctcagcccttcctcacctctgctgattgacagcacgccccacacccccaggttttttgtagccagtgctatctggtcaaagggtcagtgggcctcttatggccagggcttcctcccggggtgatgggtctgctctgtgccagaaacagaggacacagcgcctccacagcactgcttccccactcatcctaccctaaggagcgcctcatctgccatcattcattcattggttcattccaccagtaattcttaagtgcctactctgtactaggcactgcctcagctctgggattacagaagtgaacaaggcaagatttctccctcccccagctatggaatttatattccggtgaacaggaataaatgatggatagatggataccaaaatttcagagagtatcaggggctctcagtggactaaggcaaaggctggagcagagggttctctttatttagatcgggtggtcagggaaggcaacatttgagcagagacctgaacaaaggggacccagctttacaaagatctggggaaggggaacagtggggcacatgccctgaggtggga

SEQ ID NO: 46176 - DNA, 601 bp, Human
tgagcctctgttagctagtcaagaaaaatgggttgtggctgggtgcagtggtttactcttgtagtcccagcaatttgggagtccaaggctggaggattgtttaagcccagaagtttgaagctacagcaagccataatcacaccactgcactccagtctgagtgacagaaaaagaccctgtctctttatttatttatttttttcattgagatggagtctcgctctgtcatccaggttgaagtgcagtggcacgatctcggctcactgcaacctctgcctcctgggttcaagtgatcctctcrccaaagcctctcaagtagctgggactccaggcacccgccaccacacccagctaatttttgtatttttagtagagacagggtttcactatgttggccaggctggtctcggtctcctgacctcaagtgatccacctaccttggcctcccaaagtgctgggattacaggcatgagccactgctcctggccaaccctgtctctttaaaaaaataaaaaagggctcggggtgggggtcattcatgagtcaattcctatagagagcttagcacagtacaaacactagccatgatcctcatggctgt

SEQ ID NO: 46177 - DNA, 601 bp, Human
tagtcaagaaaaatgggttgtggctgggtgcagtggtttactcttgtagtcccagcaatttgggagtccaaggctggaggattgtttaagcccagaagtttgaagctacagcaagccataatcacaccactgcactccagtctgagtgacagaaaaagaccctgtctctttatttatttatttttttcattgagatggagtctcgctctgtcatccaggttgaagtgcagtggcacgatctcggctcactgcaacctctgcctcctgggttcaagtgatcctctcgccaaagcctctcaartagctgggactccaggcacccgccaccacacccagctaatttttgtatttttagtagagacagggtttcactatgttggccaggctggtctcggtctcctgacctcaagtgatccacctaccttggcctcccaaagtgctgggattacaggcatgagccactgctcctggccaaccctgtctctttaaaaaaataaaaaagggctcggggtgggggtcattcatgagtcaattcctatagagagcttagcacagtacaaacactagccatgatcctcatggctgttagtgacaacccggg

SEQ ID NO: 46178 - DNA, 601 bp, Human
tcccatctgtcagacaggaaaatgattaattcactcattcattccttcatctaactgcaccgggttctagggatatagcagagaagaaaaatacatgcaatccctgccctcaggaatagtaagtcagtcaacatacaagaagctcttttttataaagctgttttttaagaaaattataatttttaaagacaagtacaccagaaaaaagtgttagtacaaagtgcgaggaggctgagaggaaggcactttaagggctggaagactacttttgggaacgcttctctgagcaatctgagaaatratacttcatctgagttccaagtggcaaaaaggaaccagtcacgaaaagtttggaggaagaaggaggtgctgaggtgagcatggtgtgtcccagaaacagcaaagaggcccatgtggctgccactgtgcaggcaaggaagagagaggtaggaaattatgtaggagagggagctggaaggccctgtgggtgagggagtggccttcaggttttattctaatgaagtaggaagccatgaggagccatgtctgaatagagtggtagctcacacctataatcccagtactttgggaggccaaggtg

SEQ ID NO: 46179 - DNA, 601 bp, Human
ataaaccactgtttctcccccaccttgtatggtctccattctgaagtttacttcatgatccaaaatgactgcttgagctccagcgttttttgttttttttttttttttgagctggagtcttgctctgtcgcccaggccggagtacagcggcgcgatcttggctcactgaaacctctgcctcctgggttcaagcaattatcctgcctcagcctcccaagtagctgggactacaggcacatgccaccaggcccagctaatttttgtattatttatttattttttttaatttttcagtagagayggggtttcaccatattggccaggacagccttgatctcttgacctcatgatctgcccacctgggcctcctaaagtgctgggattacaggcgtcagccaccgcacccagccttttttttttttttttttaacagggtcttgctctgtcacccaggctggagtgcagtgatgccgtcacaaatcattgcagcctcaacctcctgggctcaagtgatcctcccacctcagcctctctagtagctgggactacaggcatgccaccacaccaggctaattttttgtagagacgaggtctcactttg

SEQ ID NO: 46180 - DNA, 601 bp, Human
tcgcccaggccggagtacagcggcgcgatcttggctcactgaaacctctgcctcctgggttcaagcaattatcctgcctcagcctcccaagtagctgggactacaggcacatgccaccaggcccagctaatttttgtattatttatttattttttttaatttttcagtagagatggggtttcaccatattggccaggacagccttgatctcttgacctcatgatctgcccacctgggcctcctaaagtgctgggattacaggcgtcagccaccgcacccagccttttttttttttttttttaacagggtcttgctctgtcacccaggctggagtgcagtgatgccgtcacaaatcattgcagcctcaacctcctgggctcaagtgatcctcccacctcagcctctctagtagctgggactacaggcatgccaccacaccaggctaattttttgtagagacgaggtctcactttgtttcctacgctggtctcgatctcttgggctcaagaggtcctcttgtcttggcctcccaaagtgctgacattacaggcgtgagccactgtgcctagctccacacgccagctttttttttttttttttt

SEQ ID NO: 46181 - DNA, 601 bp, Human
taattttaagttctgggatacatgtgcagaacgtgcagggtttgttacataggtatacatgtgccatggtagtttgctgcacccatcaacccatcatctaggtttgaagccccgcgtgtgtcaggtatttgcctaatgctctccctccccttgtcccccaccccccaggctccaggttttatgtctacattccaaccacaagaaggggaaaaaaggaaaatggcaccccttctttttattttttgagacgtagtctcactctgtcttccaggctggagttcagtggcacgatctcagctcmctgcaagctccgcctcctgggttcacgccattctcctgcctcagcctcccgagtagctgggactacaggcgcccgccaccacgcctgactaattttttgtatttttagtagagacggggtttcaccgtgctagccaggatggtctcaatctcctgaccttgtgatccgcccgcctcggcctcccaaagtgctgggattacaggcgtgagccaccgcgcccggcctcattttcttacccatgttgtttttgttcctgcgctcctgtgcctgtctgctgtgctgagctgcagatgtgtcctg

SEQ ID NO: 46182 - DNA, 601 bp, Human
tgggacccagacccccacgggcggccagatttcggtagcatcttgaagcggcttgaagtcatcgaacagtcagccctgttccagatgccactggagtccttccactcgctgcaggaagactggaagctggagattcagcacatgtttgatgaccttcggaccaaggagaaggtgaaggcagggggcaaggtgggaaagatggagcaagacccctgagttctgatgccttgggctgctcagagactcctcccctgaaccccagcctttgggtccatgcagggtcaagggagccttttttgcrtattaagaaaagacagcctcctgttggtggattaataagaaaaaggcaccctgtactgaagtacttacaggtgacactgcatgatgtctggggttggctttaaaatactacagcagaaacgaagagagggcaagaggagagaaggacggggatacaagattcgcaaagcataggtaattgttgaaattggatgatgggtacaggggggtgcactgttctctgcttttgtggatgtttgaagttttctaaattgaagagttaagaaagaaaaagaaagaaaaagcacccctttctttgagc

SEQ ID NO: 46183 - DNA, 601 bp, Human
ttaatcagattcagattcaggtttgattttttttttccccacactgcttcccaggtaatgcattcaggagggaggcacgtagtgtctacttgtctctttctgtgatgttacaagccagaaagcagtgccttaagcagcagtggccagtggaaatataatacaagccacgtgtataattttaaattttctagtaagctacacataaaagcaaaaagaaataagagatgtcaattttaatattttttattaggccaggtggggtggctcacgtctgtaatcccagcactttttggggctaagrcgggcagatcacctgaggtcaggagtttgagaccagcctgaccaacatggagaaaccccatctctactaaaactacaaaattagccgggcgtggtggcgcatgcctgtaatcccagctactcaggaggctgaggcaggagaatcgcttgaacctgggaggcagaggttgcagtgagccgagatcgcgccattgtactccagcctgggcgacaagagcaaaactccatctcaaaaaatatatatattttttaatttagcccaatatatccatgcaatcaatacaaaataattgtgagatat

SEQ ID NO: 46184 - DNA, 601 bp, Human
cgaagacgtgggccccggcctgggcctggcgccctcggccaccctcgtgtcgctgtcgtccgtgtccgactgcaactccacgcgttcactgctgcgctctgacagtgacgaggccgcaccggccgcgccctccccaccaccctccccgcccgcgcccacacccacgccctcgcccagcaccaaccccctggtggacctggagctggagagcttcaagaaggacccccgccagtcgctcacgcccacccacgtcacggctgcatgcgctgtgagccgcgggcaccggcggacgccatcggayggggcgctggggcagcgggggccgcccgagcccgcgggccatggccctggtgagtgaggcgccctgcacccaggtcacagaaaaccccttctttcctcctctgccagggtcgcaagtccagcccagccacgacccctcaggcagccacctcctgcttcttgtggaggagggagggtctgtgtccctttaccgctcactcctggaggcatcgggggtctccaggggactgagacacaggcggcaaactgatgcctataaggccaggcaggtgcctatagcggttgtgaccagcatgaccat

SEQ ID NO: 46185 - DNA, 601 bp, Human
ggctacggcaaccgtgagttccgctgcctgtcctgcatccagccaggccacaggcaggggtgggatcacagcatctcaggtcctctagaggggaaatagggggaatgcctaggaaccctgtccttacccactgcctgggccatgaccagctgggcatcatctgtcctctctatggcagggaagctgagctgtgggagggtaaatattgatggcctaataacctgcaataggcgggtgggtgcgtgcttcctccctgccccagggcttctccctgaggctggtaggtgggcccctcgctttstgctcttttcctagtccctgtcacacagtaggcccagtgcaagtatttgaagggtgcaaagtgattaaggctctgcctggagaattaaggaccctgatccttgcgctctgcactgcaccccaggctctgacgttcccttttgggccatcaagaacagctggggcactgactggggtgagaaggtgagtcttgctggcttggcccctggccctccagccgccatcctaccctggtgccctcaccagctccccctctcccccagggttactactacttgcatcgtgggtccggggcctgtgg

SEQ ID NO: 46186 - DNA, 601 bp, Human; identical to SEQ ID NO: 19924

SEQ ID NO: 46187 - DNA, 601 bp, Human; identical to SEQ ID NO: 19925

SEQ ID NO: 46188 - DNA, 601 bp, Human; identical to SEQ ID NO: 19926

SEQ ID NO: 46189 - DNA, 601 bp, Human; identical to SEQ ID NO: 19927

SEQ ID NO: 46190 - DNA, 601 bp, Human; identical to SEQ ID NO: 19928

SEQ ID NO: 46191 - DNA, 601 bp, Human; identical to SEQ ID NO: 19929

SEQ ID NO: 46192 - DNA, 601 bp, Human; identical to SEQ ID NO: 19930

SEQ ID NO: 46193 - DNA, 601 bp, Human; identical to SEQ ID NO: 19931

SEQ ID NO: 46194 - DNA, 601 bp, Human; identical to SEQ ID NO: 19932

SEQ ID NO: 46195 - DNA, 601 bp, Human; identical to SEQ ID NO: 19933

SEQ ID NO: 46196 - DNA, 601 bp, Human; identical to SEQ ID NO: 19934

SEQ ID NO: 46197 - DNA, 601 bp, Human; identical to SEQ ID NO: 19935

SEQ ID NO: 46198 - DNA, 601 bp, Human; identical to SEQ ID NO: 19936

SEQ ID NO: 46199 - DNA, 601 bp, Human; identical to SEQ ID NO: 19937

SEQ ID NO: 46200 - DNA, 601 bp, Human; identical to SEQ ID NO: 19938

SEQ ID NO: 46201 - DNA, 601 bp, Human; identical to SEQ ID NO: 19939

SEQ ID NO: 46202 - DNA, 601 bp, Human; identical to SEQ ID NO: 19940

SEQ ID NO: 46203 - DNA, 601 bp, Human; identical to SEQ ID NO: 19941

SEQ ID NO: 46204 - DNA, 601 bp, Human; identical to SEQ ID NO: 19942

SEQ ID NO: 46205 - DNA, 601 bp, Human; identical to SEQ ID NO: 19943

SEQ ID NO: 46206 - DNA, 601 bp, Human; identical to SEQ ID NO: 19944

SEQ ID NO: 46207 - DNA, 601 bp, Human; identical to SEQ ID NO: 19945

SEQ ID NO: 46208 - DNA, 601 bp, Human; identical to SEQ ID NO: 19946

SEQ ID NO: 46209 - DNA, 601 bp, Human; identical to SEQ ID NO: 19947

SEQ ID NO: 46210 - DNA, 601 bp, Human; identical to SEQ ID NO: 19948

SEQ ID NO: 46211 - DNA, 601 bp, Human
aaaaaaataaaagatgatgaggtgttgtcagcaggagtggctccttctgaggctgtccaggaagatctgttcccggcctctctcctgggcttggagcggccgtcctcatcttcacacgctgttctccttctatgtgggtccaaatgttccttttcataaggacatcgggcacactggattggggcccactgtaatggccttatcttaacccagtgacctctgtaaggaccctgtctccaaagaaggtcacatctggagttcctgggggttgcgactccagtgtatcttttttggggtcacaacacagcccctgacagtgtgtatgttggggtcctcctgcctcccatgaggacttgttcccattttactgatgggaagtcgagacttcagagctgaagtgaccagctcggcctcccggaacttgccatgtgccagctggggctgcctgtggctccctgtcctctctggcttctgtgtggagctctgggaacagcaacagctgaagctgctaacttcctgtggctccagcagctggcccgtgctgcccgtggagaacttatgaagtggtctggtgttacctgcattttacagatggggaaat

SEQ ID NO: 46212 - DNA, 601 bp, Human
aaaaataaaagatgatgaggtgttgtcagcaggagtggctccttctgaggctgtccaggaagatctgttcccggcctctctcctgggcttggagcggccgtcctcatcttcacacgctgttctccttctatgtgggtccaaatgttccttttcataaggacatcgggcacactggattggggcccactgtaatggccttatcttaacccagtgacctctgtaaggaccctgtctccaaagaaggtcacatctggagttcctgggggttgcgactccagtgtatcttttttggggtcacaacacagcccctgacagtgtgtatgttggggtcctcctgcctcccatgaggacttgttcccattttactgatgggaagtcgagacttcagagctgaagtgaccagctcggcctcccggaacttgccatgtgccagctggggctgcctgtggctccctgtcctctctggcttctgtgtggagctctgggaacagcaacagctgaagctgctaacttcctgtggctccagcagctggcccgtgctgcccgtggagaacttatgaagtggtctggtgttacctgcattttacagatggggaaatgg

SEQ ID NO: 46213 - DNA, 601 bp, Human
attttactgatgggaagtcgagacttcagagctgaagtgaccagctcggcctcccggaacttgccatgtgccagctggggctgcctgtggctccctgtcctctctggcttctgtgtggagctctgggaacagcaacagctgaagctgctaacttcctgtggctccagcagctggcccgtgctgcccgtggagaacttatgaagtggtctggtgttacctgcattttacagatggggaaatggaggctcagagaggtgaagtggctgggccaaggtcacacagctcctaagtggtgggttcttttttttttttttttttttcggagacagaatcttcgctctgtcgcgcaggctggagtgcagtggcgcgagctcggctcactgcaacctccgcctcccgggttcaaatgattctcctgcctcagcctcctgagtagctgggattacaggcacctgccaccatgcccagctaatttttctgtttttagtacaggcagggtttcaccgtgtgggccaggctggtctcgaactcctgacctcgggtgatgcccccccccccccgtctcggcctcccagagtgctgggattacaggcatgagcca

SEQ ID NO: 46214 - DNA, 601 bp, Human
cagagaggtgaagtggctgggccaaggtcacacagctcctaagtggtgggttcttttttttttttttttttttcggagacagaatcttcgctctgtcgcgcaggctggagtgcagtggcgcgagctcggctcactgcaacctccgcctcccgggttcaaatgattctcctgcctcagcctcctgagtagctgggattacaggcacctgccaccatgcccagctaatttttctgtttttagtacaggcagggtttcaccgtgtgggccaggctggtctcgaactcctgacctcgggtgatgcccccccccccccgtctcggcctcccagagtgctgggattacaggcatgagccactgtgcctggctgctaagtgatgggttcttgactgcaggccagcagggcctccgtggcgtcttgggccgggaggcagatgctggtgtgttcgggggttcccagctcacccacctctgcccacagctccctacaccatcatcaccttccccttcctgtttgctgtgatgttcggggatgtgggccacgggctgctcatgttcctcttcgccctggccatggtccttgcggagaaccgaccggctgtga

SEQ ID NO: 46215 - DNA, 601 bp, Human
ctgctaagtgatgggttcttgactgcaggccagcagggcctccgtggcgtcttgggccgggaggcagatgctggtgtgttcgggggttcccagctcacccacctctgcccacagctccctacaccatcatcaccttccccttcctgtttgctgtgatgttcggggatgtgggccacgggctgctcatgttcctcttcgccctggccatggtccttgcggagaaccgaccggctgtgaaggccgcgcagaacgaggtgaggggcggggctggggtcctgatgagggtagcagggccaggcarcccctcaccacaccactgcccccccagatctggcagactttcttcaggggccgctacctgctcctgcttatgggcctgttctccatctacaccggcttcatctacaacgagtgcttcagtcgcgccaccagcatcttcccctcgggctggagtgtggccgccatggccaaccagtctggctggaggtgaggcccgggccccagcccggctgggggccccgcagcacccgcagccctgaccgccctcccctgcgttgccgcagtgatgcattcctggcccagcacacgatgcttaccctgg

SEQ ID NO: 46216 - DNA, 601 bp, Human
agggtagcagggccaggcagcccctcaccacaccactgcccccccagatctggcagactttcttcaggggccgctacctgctcctgcttatgggcctgttctccatctacaccggcttcatctacaacgagtgcttcagtcgcgccaccagcatcttcccctcgggctggagtgtggccgccatggccaaccagtctggctggaggtgaggcccgggccccagcccggctgggggccccgcagcacccgcagccctgaccgccctcccctgcgttgccgcagtgatgcattcctggcccarcacacgatgcttaccctggatcccaacgtcaccggtgtcttcctgggaccctacccctttggcatcgatcctgtgagtcctgggatggagtgtccgtgggtggtgaaggcagctgggagtgggggctggggctcccctcggttcagccgtcctgcagcgctgtcgctgagcactcctgtgtgccaggccctttcctcagcacaagaggcagacaagcctcctgccctgcggagcctgcatcacagtcccctgagtgtgcggaggcaaagcgagaccagccaggaaccagtctcctgagtg

SEQ ID NO: 46217 - DNA, 601 bp, Human
gtcatctacaagtggctgtgtgtctgggctgccagggccgcctcggcccccagcatcctcatccacttcatcaacatgttcctcttctcccacagccccagcaacaggctgctctacccccggcaggtgggctgcggctggtgggggccgggctcacacggcctcatggggaccccgcggtcacagggccactgggagctgcaagatcctcgtccgagaaacggggatgcaggccccgggccgtgcagacagggccgtcagaggtgatggtgtgcatctttagcaggtggcacaactggcrctgggaaccgggggtcccttccctcaggagtccttatggaggcagaccctcacccagtgagggcacggagcccccgggggccctggagggaggagcgaccgcaggctctctgggccccgtgactgctgtgactcaggttcctttgcaggtgtgcacagcagggacgccctgactctcgccctctccctggcaggaggtggtccaggccacgctggtggtcctggccttggccatggtgcccatcctgctgcttggcacacccctgcacctgctgcaccgccaccgccgccgcctgcggag

SEQ ID NO: 46218 - DNA, 601 bp, Human; identical to SEQ ID NO: 46211

SEQ ID NO: 46219 - DNA, 601 bp, Human; identical to SEQ ID NO: 46212

SEQ ID NO: 46220 - DNA, 601 bp, Human; identical to SEQ ID NO: 46213

SEQ ID NO: 46221 - DNA, 601 bp, Human; identical to SEQ ID NO: 46214

SEQ ID NO: 46222 - DNA, 601 bp, Human; identical to SEQ ID NO: 46215

SEQ ID NO: 46223 - DNA, 601 bp, Human; identical to SEQ ID NO: 46216

SEQ ID NO: 46224 - DNA, 601 bp, Human; identical to SEQ ID NO: 46217

SEQ ID NO: 46225 - DNA, 601 bp, Human; identical to SEQ ID NO: 23877

SEQ ID NO: 46226 - DNA, 601 bp, Human; identical to SEQ ID NO: 23878

SEQ ID NO: 46227 - DNA, 601 bp, Human; identical to SEQ ID NO: 23879

SEQ ID NO: 46228 - DNA, 601 bp, Human; identical to SEQ ID NO: 23880

SEQ ID NO: 46229 - DNA, 601 bp, Human; identical to SEQ ID NO: 23881

SEQ ID NO: 46230 - DNA, 601 bp, Human; identical to SEQ ID NO: 23882

SEQ ID NO: 46231 - DNA, 601 bp, Human; identical to SEQ ID NO: 23883

SEQ ID NO: 46232 - DNA, 601 bp, Human; identical to SEQ ID NO: 23884

SEQ ID NO: 46233 - DNA, 601 bp, Human; identical to SEQ ID NO: 23885

SEQ ID NO: 46234 - DNA, 601 bp, Human; identical to SEQ ID NO: 23886

SEQ ID NO: 46235 - DNA, 601 bp, Human; identical to SEQ ID NO: 23887

SEQ ID NO: 46236 - DNA, 601 bp, Human; identical to SEQ ID NO: 23888

SEQ ID NO: 46237 - DNA, 601 bp, Human; identical to SEQ ID NO: 23889

SEQ ID NO: 46238 - DNA, 601 bp, Human; identical to SEQ ID NO: 23890

SEQ ID NO: 46239 - DNA, 601 bp, Human; identical to SEQ ID NO: 23891

SEQ ID NO: 46240 - DNA, 601 bp, Human; identical to SEQ ID NO: 23892

SEQ ID NO: 46241 - DNA, 601 bp, Human; identical to SEQ ID NO: 23893

SEQ ID NO: 46242 - DNA, 601 bp, Human; identical to SEQ ID NO: 23894

SEQ ID NO: 46243 - DNA, 601 bp, Human; identical to SEQ ID NO: 23895

SEQ ID NO: 46244 - DNA, 601 bp, Human; identical to SEQ ID NO: 23896

SEQ ID NO: 46245 - DNA, 601 bp, Human; identical to SEQ ID NO: 23897

SEQ ID NO: 46246 - DNA, 601 bp, Human; identical to SEQ ID NO: 23898

SEQ ID NO: 46247 - DNA, 601 bp, Human; identical to SEQ ID NO: 23899

SEQ ID NO: 46248 - DNA, 601 bp, Human; identical to SEQ ID NO: 23900

SEQ ID NO: 46249 - DNA, 601 bp, Human; identical to SEQ ID NO: 23901

SEQ ID NO: 46250 - DNA, 601 bp, Human; identical to SEQ ID NO: 23902

SEQ ID NO: 46251 - DNA, 601 bp, Human; identical to SEQ ID NO: 23903

SEQ ID NO: 46252 - DNA, 601 bp, Human; identical to SEQ ID NO: 23904

SEQ ID NO: 46253 - DNA, 601 bp, Human; identical to SEQ ID NO: 23905

SEQ ID NO: 46254 - DNA, 601 bp, Human
gagcagcttgagctgtttgctgtcggcgaaggcgtcctcctcaatgctgacggtggacacggagttgtcatccaggtgcagcttctccagcagcgggatgcgggccagcgagtccctggcaatggtgcgcacattgttgtcctgcaggtgcagctcccggagggagcggggcaggttgatggggaactcatccaggtcattctcgtataggtagatgacctgcacgttgaccttggtcttgaggtcctgggggatgccggcgttgttgatctggttgttctgcaggtagagggtggtggcrtcatcagggatatctgcggggatggatgtgagtccccggtcgttgcagtagatgaagccgttgtcgcagcggcacaccgaggggcaggtggtgctgtcgatgacctccgtcaggaaggcgatgagcccgtagcagaggaacagccagtcccgcaggtccatggtggccgtggtcatcacaacggtggccgtgacagtggcagtgggcgtggtggtggcagtggcggtggggtgtgccaccaccatggtggatggctgggggcgtccggccccacctggcctggagcctgaatacctgcaa

SEQ ID NO: 46255 - DNA, 601 bp, Human
cagccccgaggggatgctgctcaggtggttccggctcaggaagagcagcttgagctgtttgctgtcggcgaaggcgtcctcctcaatgctgacggtggacacggagttgtcatccaggtgcagcttctccagcagcgggatgcgggccagcgagtccctggcaatggtgcgcacattgttgtcctgcaggtgcagctcccggagggagcggggcaggttgatggggaactcatccaggtcattctcgtataggtagatgacctgcacgttgaccttggtcttgaggtcctgggggatgccrgcgttgttgatctggttgttctgcaggtagagggtggtggcatcatcagggatatctgcggggatggatgtgagtccccggtcgttgcagtagatgaagccgttgtcgcagcggcacaccgaggggcaggtggtgctgtcgatgacctccgtcaggaaggcgatgagcccgtagcagaggaacagccagtcccgcaggtccatggtggccgtggtcatcacaacggtggccgtgacagtggcagtgggcgtggtggtggcagtggcggtggggtgtgccaccaccatggtggatggctgg

SEQ ID NO: 46256 - DNA, 601 bp, Human
gccgcggatttccaggatggagttatccttcttggtccctgactccatatagtcatcctttttcctgctgccccggttgtaggccctctcccgggtcagcagctcgccagcctggtgcacgtaccagcagatggcccccaggaccaggaagaggaagaccagagccactgccccgccgatgatgcccgccaggggcaggctcgccatggggccagcgttctgctcctggttgagtgtggtggtagggccatagctgtcggctgtctctgccttggcacacacgggtgtctcatcagctacrtaggcattgctggtctccatggtgaccatgcagatgatgtaggtggacttgggctccagggctgtcagcaggtactctgtcttgtccccctgcaccaaggtctccgtgatggagcccacggctgggctgtggcccaggcgcagccaactgagccggaaagaggaggcggggagcgtggccttccacgtgatgcggatggagtctgccgtcagggccttcacgtggatggccagggtcttggcgccatcacccgtggccatggggtagtcaatgttggagtcggggaggcgcagccctggc

SEQ ID NO: 46257 - DNA, 601 bp, Human
cagcatctgcagcccagggccgcggatttccaggatggagttatccttcttggtccctgactccatatagtcatcctttttcctgctgccccggttgtaggccctctcccgggtcagcagctcgccagcctggtgcacgtaccagcagatggcccccaggaccaggaagaggaagaccagagccactgccccgccgatgatgcccgccaggggcaggctcgccatggggccagcgttctgctcctggttgagtgtggtggtagggccatagctgtcggctgtctctgccttggcacacacrggtgtctcatcagctacgtaggcattgctggtctccatggtgaccatgcagatgatgtaggtggacttgggctccagggctgtcagcaggtactctgtcttgtccccctgcaccaaggtctccgtgatggagcccacggctgggctgtggcccaggcgcagccaactgagccggaaagaggaggcggggagcgtggccttccacgtgatgcggatggagtctgccgtcagggccttcacgtggatggccagggtcttggcgccatcacccgtggccatggggtagtcaatgttggagtcg

SEQ ID NO: 46258 - DNA, 601 bp, Human
ttgtgttctacaaaatcgtcagccctccccaaactttgctttctgcggaggaaagtcacccatggaatttctcttccttgctctcttggattgcagcaggctgggcaaagccacatggccacgccagggcagctggggctgaggcggggcagcccgggtgggcgggcatcatgtgtaggagtagtctatgtcggggatgccgccgtcccggtagccccgcgtggtgccgtagccaatggtgtgtgtggccttgcagaggctgctgccgttggaggggaagatagtgtggaccacgtactcytctttggcgcggtacgggttgatgggcagcatctgcagcccagggccgcggatttccaggatggagttatccttcttggtccctgactccatatagtcatcctttttcctgctgccccggttgtaggccctctcccgggtcagcagctcgccagcctggtgcacgtaccagcagatggcccccaggaccaggaagaggaagaccagagccactgccccgccgatgatgcccgccaggggcaggctcgccatggggccagcgttctgctcctggttgagtgtggtggtagggccatagctg

SEQ ID NO: 46259 - DNA, 601 bp, Human
gtataaattatgtcttcaacaatgtcgaattccccctcctgccttctattcttttaaaaaaaattgtcactgttgtgttctacaaaatcgtcagccctccccaaactttgctttctgcggaggaaagtcacccatggaatttctcttccttgctctcttggattgcagcaggctgggcaaagccacatggccacgccagggcagctggggctgaggcggggcagcccgggtgggcgggcatcatgtgtaggagtagtctatgtcggggatgccgccgtcccggtagccccgcgtggtgccrtagccaatggtgtgtgtggccttgcagaggctgctgccgttggaggggaagatagtgtggaccacgtactcctctttggcgcggtacgggttgatgggcagcatctgcagcccagggccgcggatttccaggatggagttatccttcttggtccctgactccatatagtcatcctttttcctgctgccccggttgtaggccctctcccgggtcagcagctcgccagcctggtgcacgtaccagcagatggcccccaggaccaggaagaggaagaccagagccactgccccgccgatgatg

SEQ ID NO: 46260 - DNA, 601 bp, Human
aagaatgcagtgaaagatgccatgtttctgcaaatctgcaagggaaatggtatggaataagccaggggagagatttcaggaccatatctccagggcaaaagatcttttcttccctctctcctttgtgaggagcctgaaaaccttccatcgggtcgccagcgagtggccagtggcgggagagctgcgtgggagctttgagagccggctgcttctccctggcggttcctttgtgatggccttgaacagagcatgaggtgtccacagatgttgtacaggtagtatccttccagttcaggggggaaaaaaaaaaaacccaacccagccctgcctgcaatattatttttagtccttccctccccaactggcataacttggtataaattatgtcttcaacaatgtcgaattccccctcctgccttctattcttttaaaaaaaattgtcactgttgtgttctacaaaatcgtcagccctccccaaactttgctttctgcggaggaaagtcacccatggaatttctcttccttgctctcttggattgcagcaggctgggcaaagccacatggccacgccagggcagctggggctgaggcggggcagccc

SEQ ID NO: 46261 - DNA, 601 bp, Human
tcctcccccacctcactcccatccccaacacacggtctacttactcaaggatttctaggagaaagcaacactttcacaattctattgttcaggaaatggtaagaactgacccaagaagaacggtaaggaccgtgcatgtggctctatctacccatctgtacttagagacaccgcgacagggatagacaggcagacagatgcacctccaggtggcagggaaagctacggcttccgccggggcttctacggagcgtggtgcatggaactgaagagggcttcagcctaggaaaaaaaagtttgttttttttttttaatcgactacatgattgttcaaagaatgcagtgaaagatgccatgtttctgcaaatctgcaagggaaatggtatggaataagccaggggagagatttcaggaccatatctccagggcaaaagatcttttcttccctctctcctttgtgaggagcctgaaaaccttccatcgggtcgccagcgagtggccagtggcgggagagctgcgtgggagctttgagagccggctgcttctccctggcggttcctttgtgatggccttgaacagagcatgaggtgtccacagatgt

SEQ ID NO: 46262 - DNA, 601 bp, Human
tgacgtggcagagcatggacttaatcgatcccacctcgaccacggtgccaagtggaagtagggtcaggacagtgtgggggggcttggtactgcgtggactcctatagtcccaaaactgggaaatcgggggacagaggcatttctagctctacagggtccctaacaagaggcgaagcacctgcttccatagttcagaggaggagctgaggacagcattttagctgaagccacagagcagagcactgtcagtcacactctctgaaggggaggggactcccatgccctcctcagtaataagccrggcaccatggctcacatccgtaatcccagcactttggggcgccaaggtgggaggaaagctttgggccaggagttcgagaccagccagggcaacatagcaaaaccctgggcaatataacaaaaccatgtccctacaaaaataaaaatattggctgggcacggtggctcacacctgtaatcccagcactttgggaggccaaggcgggcagatcacgaggtcaggagttcgagaccatcctggccaacatggtaaaatcccatctctactaaaatacaaaaaattagccgggcgtggtggtgt

SEQ ID NO: 46263 - DNA, 601 bp, Human
gcttgagctgaggaggtcgaggctgcagtgagccatgatcatgccactacactccagcctgggcaacagagcaagactcagtatctaaaataataacaataatagtaatcatatagaatgcatgcatcagaccctgggataagccctgtatacaaaatgactttcttggccgggtgcggtggctcacgcctgtaatctcagctctcagggaggcaagaggcgggaggatagcttgagcccaggagttcgagacctgcctcggcaatatagcgagaccccgttctccagaaaaaggaaaaaaaacaacaacaacaaaagataaaatgactttctttttcagagggaggcactattatgattcccaagttacagaagtgtgtgcccaaggtcgcacagctgggattcaaacacagatgaccttgccccaaaggccgcctctcaaccatcatacgtggtctgtaggtctacagggatgggttctaggtctctgcctctctgggcctcagtcctccatctgtgaaatgggacaacagatgttcaagtctagccctgagcctctgagtctggagaggagaccgcccaaatctcatgtcagcattcc

SEQ ID NO: 46264 - DNA, 601 bp, Human
tgacatggtcaggtccaacccctgggacttgcttaaaatgcatgtgggtgtgagagacacagagggcggcctccaagaaaccgcccgaaaaggcagtggtgccctgatgttatctgtagtcatactgaaaagaaaagtgcggccggggcggtggctcacacctgtaatcccagcactttgtgaggccgaggcaggtggatcacctgaggtcaggagttcaagacaagcctgaccaatatggtgaaaccccgtctcaactaaaaatacaaaaattagccgggcatggtggtggtgcctgtamtcccagctacttgggaggatgaggcaggaaaatcacgtgaaccaggaggcagaggttgcggtgagctgagatcctgccactgcactctagcctgggtgtcagtgctagatgccgtctcaaaaaaaaaaaaaagagagagagagaatggtggcatgactcccagtattaggcacctactgtatgcactagcccattcaactctatcactgtagacccattttacagatgaggctgaggaaagtaaaggcaaaggtgacccggcactgccccaccccatggtgcttgcccccatgcagccct

SEQ ID NO: 46265 - DNA, 601 bp, Human
ggggcacaggtctcactttgtcttggtctcagttgccatctctgtctctctctgcatctcttttcctctgtctctccatgtctatttttttttttagtttttgtttgtttgtttgtttttgtttttatttttgtttttttgagatggagtcttgctcttgctgcccaggctggagtgcaatggcacaatctcggctcactgcaacctctgcctcccgggttcaagtgattctcctgcctcagcctccagagtagctgggactacaggtgcacaccaccacgcccggctagtttttctgtakttttagtagagacagggtttcactatgttggccaggaaggtctcgaactcctgacctcaggtgatctgcccacctcagcctctcaaagtgctgagattataggcgtgagccactgcacccggccttagtatttttatttattattattattattattattgagatgcagtttcactcttgttgcccaggctggagtgcagtggtgggatctcagctcactgcaacctccacgtcccgggttcaagcaattctccctcctcagcctcccgaatagctgggaccacaggcacatgctaccac

SEQ ID NO: 46266 - DNA, 601 bp, Human
aggaaggtctcgaactcctgacctcaggtgatctgcccacctcagcctctcaaagtgctgagattataggcgtgagccactgcacccggccttagtatttttatttattattattattattattattgagatgcagtttcactcttgttgcccaggctggagtgcagtggtgggatctcagctcactgcaacctccacgtcccgggttcaagcaattctccctcctcagcctcccgaatagctgggaccacaggcacatgctaccacacccagctaattttttgtatttttggtagagacraagtttcaccatgttggccaggctggtcttgaactcctggcctcaggtgatccacccacctccgcctcccaaagcactgagattacaggtgtgagccacagtgcccggcctccccattttatttactcattcatgagttggacatttgtgtgctttccaccttttgaatgatgtgaagtatgctgctatgaacacgcatgtacatgctacaacgcctgttttcaattcttttgattacatagattacatacacagaagtggatttgctaactcgtatgataattccatgttaacttattg

SEQ ID NO: 46267 - DNA, 601 bp, Human
ccgcctcccaaagcactgagattacaggtgtgagccacagtgcccggcctccccattttatttactcattcatgagttggacatttgtgtgctttccaccttttgaatgatgtgaagtatgctgctatgaacacgcatgtacatgctacaacgcctgttttcaattcttttgattacatagattacatacacagaagtggatttgctaactcgtatgataattccatgttaacttattgagaaaccgtcaaattgttttccacagtggctgtacaattttacattcccaccagcaatgtaygagggttccaatttcaccacatccttaccaacacttactttctgtgttttttgttttgttttgtttttgtttttgtttgtttgttttttgagatggagtctcgctctgtcacccaggatggagtgcagtggtgtgatctcagctcactgcaagctccacctcctgggttcaagggattctcctgcctcagccgcctaagtagctgggattataggtgcacgccaccacgcccagctaatttttatatttttagtagagataagatttcaccatgttggccaggctggtctcaaactcctg

SEQ ID NO: 46268 - DNA, 601 bp, Human
ttttgtttttgtttttgtttgtttgttttttgagatggagtctcgctctgtcacccaggatggagtgcagtggtgtgatctcagctcactgcaagctccacctcctgggttcaagggattctcctgcctcagccgcctaagtagctgggattataggtgcacgccaccacgcccagctaatttttatatttttagtagagataagatttcaccatgttggccaggctggtctcaaactcctgaccttgtgatccacccgcctcggcctcccaaagtgctgggattacaggcatgagccacsgcgcctggccactttctacttttttgatgctagccatcctagcgggtgtggagtggtgtctcatagtggttttgattttcattttcctaatgactaatgatgttgggcatcttttcatgtgcttattggccatttgtgtatcttctttggagaagtatctattcaagtcctttgcccatttttaaaaatatattttttgtagagatgggggtctcactgcattgcccaggctggtcttgatctcttgggttcaagcaatcctcccacctcagcctcccaaagtgctgagatcacaggtat

SEQ ID NO: 46269 - DNA, 601 bp, Human
gcaagctccacctcctgggttcaagggattctcctgcctcagccgcctaagtagctgggattataggtgcacgccaccacgcccagctaatttttatatttttagtagagataagatttcaccatgttggccaggctggtctcaaactcctgaccttgtgatccacccgcctcggcctcccaaagtgctgggattacaggcatgagccaccgcgcctggccactttctacttttttgatgctagccatcctagcgggtgtggagtggtgtctcatagtggttttgattttcattttcctartgactaatgatgttgggcatcttttcatgtgcttattggccatttgtgtatcttctttggagaagtatctattcaagtcctttgcccatttttaaaaatatattttttgtagagatgggggtctcactgcattgcccaggctggtcttgatctcttgggttcaagcaatcctcccacctcagcctcccaaagtgctgagatcacaggtatgagccaccgtgcctggccctttgcctttttttttttttttttttgtctgagacggagtctcactctgtcgcccaggctgcaatgcaatgg

SEQ ID NO: 46270 - DNA, 601 bp, Human
tggtgtctcatagtggttttgattttcattttcctaatgactaatgatgttgggcatcttttcatgtgcttattggccatttgtgtatcttctttggagaagtatctattcaagtcctttgcccatttttaaaaatatattttttgtagagatgggggtctcactgcattgcccaggctggtcttgatctcttgggttcaagcaatcctcccacctcagcctcccaaagtgctgagatcacaggtatgagccaccgtgcctggccctttgcctttttttttttttttttttgtctgagacrgagtctcactctgtcgcccaggctgcaatgcaatggccctaactcagctcactgcaacctctgcctctgggttcaagcgatttatcctgcctcagcctcccgagtagctggaattataggcacccgccatcatgcccagctaatttttgtagagatggggtttcataatgttggctggtctcgaactcctgacctcaggtgatccacccaccttggcctcccagagtgttgggattacaggcgtgagccaccacactgggcccctttgcccatttttgaattgtctttttgttgttgagt

SEQ ID NO: 46271 - DNA, 601 bp, Human
ctcccagagtgttgggattacaggcgtgagccaccacactgggcccctttgcccatttttgaattgtctttttgttgttgagttgtagaatctctatctctttctattcctttatatccctctgtctctgtctttcagtctcctctctgcctccttctcatccttcaggtctgctcaaatgtcccctccttcaacagccctaactccattactctccattttgcaccacctatttcattctccatagcactggccacaaagggtaattccatatttgttagtttctttgtgtgtgtgtgtktgtttttttttttttttttaaacagacggagtctcactttgttgcccaggctgcagtgcagtggcgcgatcttgactcactgcaacctccgcttcccaggttcaagcgatcctcctacctagcctcctaaatagctggaattacaggcccacgccaccatgcccagctaatttttttgtgtttttagtagggacggtttcaccatgttgcccaggctggtctcaaactcctgacctcaagtgatctaccctcctcggcctcccaaagtgcttggattataggcatgagccacctcgccca

SEQ ID NO: 46272 - DNA, 601 bp, Human
ctctccttccccctccctgtctctcccggctctagtccctggatggctttgtgttcgccttgaaccaggaaggaaaattcctctacatctcagagacagtctccatctatctgggtctctcacaggtaagggacccccagtggacctggattggctcagccaccatctcccttgccaggcctatgcatatccttcctctctcctggtctcaccatagcagcaagaaaaatggactggatctctgtggtccccaaagtgtgttccttggcaccccacatggcacccagcatggttcatcctygaaggcagaggagggctattgttttttgtttgtttgtttgtttgtttttgagacggagtctcgctctatcacccaggctggagtgcagtggtgcgatcttcgctcagtgcaacctccacctcccgggttcaaacaattctcctgcctcagcctcctgagtagctgggactacaggcgcccaccacacccggctaactttttgtatttttagtaaagatggggtttcaccatgttagccaggatggttgagatctcctgacctcgtgatccacctgcctcggcctcccaaagtgctaggat

SEQ ID NO: 46273 - DNA, 601 bp, Human
atggactggatctctgtggtccccaaagtgtgttccttggcaccccacatggcacccagcatggttcatccttgaaggcagaggagggctattgttttttgtttgtttgtttgtttgtttttgagacggagtctcgctctatcacccaggctggagtgcagtggtgcgatcttcgctcagtgcaacctccacctcccgggttcaaacaattctcctgcctcagcctcctgagtagctgggactacaggcgcccaccacacccggctaactttttgtatttttagtaaagatggggtttcaycatgttagccaggatggttgagatctcctgacctcgtgatccacctgcctcggcctcccaaagtgctaggattacagtgtgagccactgtcctggctgatgagggctatttttttttttttgagttggagtttccctcttgttgcccaggctggagtgcaatggtacgatctcagctcactgcaacctctgcctcctgggttcaagcgattctcctgcctcagcctcccgagtagctgggattacagacatgcaccaccacgcctagctaactttgtattttttaaatagagacagggtt

SEQ ID NO: 46274 - DNA, 601 bp, Human
cggagtctcgctctatcacccaggctggagtgcagtggtgcgatcttcgctcagtgcaacctccacctcccgggttcaaacaattctcctgcctcagcctcctgagtagctgggactacaggcgcccaccacacccggctaactttttgtatttttagtaaagatggggtttcaccatgttagccaggatggttgagatctcctgacctcgtgatccacctgcctcggcctcccaaagtgctaggattacagtgtgagccactgtcctggctgatgagggctatttttttttttttgagtyggagtttccctcttgttgcccaggctggagtgcaatggtacgatctcagctcactgcaacctctgcctcctgggttcaagcgattctcctgcctcagcctcccgagtagctgggattacagacatgcaccaccacgcctagctaactttgtattttttaaatagagacagggtttcttcatgttggtcaggcttgtcttgaactctcaatctcaggcaatccgcctgcctcagcctcccaaagtgctgggattacagcgtgagccaccgcgcccagcctgagggggctattaaagtaaca

SEQ ID NO: 46275 - DNA, 601 bp, Human
tgccagtccctccaatacaaattgctatcaactttgatcatttttacaaatatttttcacaaataggaaatttaggaaattcagtgcattggcaacttgtgagtaccttttcagtgagattcctggaggaggaagacaccaaaaggaggggaatttggacaagaggacgggagggaggaagagtggaggaaaagcttggccaggtgtggtggctcacgcctgtaatcccagcactttgggaggcaaaagcaggcagatcacctgaggtcaggagttcgagaccaacctgggcaacatggcraaacccagtctctactaaaaatacaaaattagccgggtgtgctggcagatgcctatagtcccagctactccagaggctgaggcagaagaatcacttgaacccaggaggcagaggttgcagtgagccaagattgcaccattgcactccagcctgggcaacgagagcaaaaccccatctcaaaaacaaaacaaaacaaaaaaagtccaggcgcggtggctcatgcccgtaaacccagcactttgggaggctgaggcgggcagatcacctgaggtcgggagtttgagaccagcctgaccaaca

SEQ ID NO: 46276 - DNA, 601 bp, Human
taggaaattcagtgcattggcaacttgtgagtaccttttcagtgagattcctggaggaggaagacaccaaaaggaggggaatttggacaagaggacgggagggaggaagagtggaggaaaagcttggccaggtgtggtggctcacgcctgtaatcccagcactttgggaggcaaaagcaggcagatcacctgaggtcaggagttcgagaccaacctgggcaacatggcgaaacccagtctctactaaaaatacaaaattagccgggtgtgctggcagatgcctatagtcccagctactccrgaggctgaggcagaagaatcacttgaacccaggaggcagaggttgcagtgagccaagattgcaccattgcactccagcctgggcaacgagagcaaaaccccatctcaaaaacaaaacaaaacaaaaaaagtccaggcgcggtggctcatgcccgtaaacccagcactttgggaggctgaggcgggcagatcacctgaggtcgggagtttgagaccagcctgaccaacatggagaaaccccgtctgtactaaaaatacaaaattagccaggtgtgttggcacatgcctgtaatcccagctt

SEQ ID NO: 46277 - DNA, 601 bp, Human
aaaaaagtccaggcgcggtggctcatgcccgtaaacccagcactttgggaggctgaggcgggcagatcacctgaggtcgggagtttgagaccagcctgaccaacatggagaaaccccgtctgtactaaaaatacaaaattagccaggtgtgttggcacatgcctgtaatcccagcttcttgggaggccgaggcgggagaattgcttgaacctgggaggcagaggtcacggtgagccgagatcgcgccattgcactccagcctgggcaacaagagcaaaactccgtctaaaaaaataaaaaaaagaagaagaagaagaagaagaagaagaaggaaaggcttgaagctgttgaagctggcgtgggggaggatttaatgagggggcggagcccagagggataacggactgagggaagcatgtgacctccaagctgaggggcaatgggagtcatggcagccatggtggtcaggtaagtaacttgcagaggcatctttgaactgtaggtcagaagaccagtgaggacgcgggggcagaaacacagtggggagaagatgggggcctgcattgagggaggcagggagagaaggggactgctaggagag

SEQ ID NO: 46278 - DNA, 601 bp, Human
aaagtccaggcgcggtggctcatgcccgtaaacccagcactttgggaggctgaggcgggcagatcacctgaggtcgggagtttgagaccagcctgaccaacatggagaaaccccgtctgtactaaaaatacaaaattagccaggtgtgttggcacatgcctgtaatcccagcttcttgggaggccgaggcgggagaattgcttgaacctgggaggcagaggtcacggtgagccgagatcgcgccattgcactccagcctgggcaacaagagcaaaactccgtctaaaaaaataaaaagaagaagaagaagaagaagaagaagaagaaggaaaggcttgaagctgttgaagctggcgtgggggaggatttaatgagggggcggagcccagagggataacggactgagggaagcatgtgacctccaagctgaggggcaatgggagtcatggcagccatggtggtcaggtaagtaacttgcagaggcatctttgaactgtaggtcagaagaccagtgaggacgcgggggcagaaacacagtggggagaagatgggggcctgcattgagggaggcagggagagaaggggactgctaggagagaga

SEQ ID NO: 46279 - DNA, 601 bp, Human
ctcagaggtgctggagcaactggggctgcggacgccgacgcccggccccccaaccccgccctccgtctcctcttcctcctcctcttcctcttcgcttgcagatacccccgagatcggtaattctaagggctcctaaagaatgaagtctgagggtagatcgggggacgcccgctgtactgtatccagccatgccgcgtttatacaaatagcagtgaagttagaactgtgtagaacgaatctttgcaaaaggaatcggagtataaattgaggcggtgagacttggttccttaagcttgccaarctcccaaagattcgagctacagaaagacccccctggctgctgaaaggagttgggagaggcttaggtaaataacaaggcaggcttattgggaatatacaccggctgtgtctgtaagtgcacaatcacattacataattacgttagggccgggcgcggcggctcgcgcctgtaaccccggcacttcgggaggcccaggggggcggatcacttgagctcggttggagaccagcctgggcaacatagtgaaacctcatctctacaaaaattacaaaaaaggccaggagtggtggcacaaagctg

SEQ ID NO: 46280 - DNA, 601 bp, Human
ggggcggatcacttgagctcggttggagaccagcctgggcaacatagtgaaacctcatctctacaaaaattacaaaaaaggccaggagtggtggcacaaagctgtagccccagcactttgggaggccgaggcgggtgggtcacctaaagtcaggagtttgagaccagcctggcttgcatagtgaaaccccatctctactaaaaatacaaaaaaaaaaaaaaaattagctgggtatggtggggggtgcctgagtcccagctactcgggaggctgaggcagaaggatcacttgaacccaggaratggatgttgcagtgagcagagattgtgccactgcactccagcctgggcgagtccaagactgtctccaaaaaaaacaacaacaacaaaagaaagaaaaaaacattagctgggcatgatgacacatgccagtggtcccagctacttgggaggtgggaggatggcttgagccttggggacagaggttgcagtgaggagatcacgttgctgcactccagcccgggtgacaaagccagtgtctggaaaaaaaaaaaaaaaaaggctgggtgcggtggctcacgcctgtaatcccagcactttgg

SEQ ID NO: 46281 - DNA, 601 bp, Human
ggagtttgagaccagcctggcttgcatagtgaaaccccatctctactaaaaatacaaaaaaaaaaaaaaaattagctgggtatggtggggggtgcctgagtcccagctactcgggaggctgaggcagaaggatcacttgaacccaggagatggatgttgcagtgagcagagattgtgccactgcactccagcctgggcgagtccaagactgtctccaaaaaaaacaacaacaacaaaagaaagaaaaaaacattagctgggcatgatgacacatgccagtggtcccagctacttgggaggygggaggatggcttgagccttggggacagaggttgcagtgaggagatcacgttgctgcactccagcccgggtgacaaagccagtgtctggaaaaaaaaaaaaaaaaaggctgggtgcggtggctcacgcctgtaatcccagcactttgggaggccgaagtgggcggatcacctgaggtcgggagttcgagaccagcctggccagcatggtgaaaccccatctctactaaaaatacaaaaattagccgggcgtggtgcaggtgcctgtgatcccagatactcaggatgctgaggcaggagaa

SEQ ID NO: 46282 - DNA, 601 bp, Human
tgggtatggtggggggtgcctgagtcccagctactcgggaggctgaggcagaaggatcacttgaacccaggagatggatgttgcagtgagcagagattgtgccactgcactccagcctgggcgagtccaagactgtctccaaaaaaaacaacaacaacaaaagaaagaaaaaaacattagctgggcatgatgacacatgccagtggtcccagctacttgggaggtgggaggatggcttgagccttggggacagaggttgcagtgaggagatcacgttgctgcactccagcccgggtgacaragccagtgtctggaaaaaaaaaaaaaaaaaggctgggtgcggtggctcacgcctgtaatcccagcactttgggaggccgaagtgggcggatcacctgaggtcgggagttcgagaccagcctggccagcatggtgaaaccccatctctactaaaaatacaaaaattagccgggcgtggtgcaggtgcctgtgatcccagatactcaggatgctgaggcaggagaatcgcttgaacctgggaggtggaggttgcactgagccgagatcaggccattgcactctgagtgagactccgtctcca

SEQ ID NO: 46283 - DNA, 601 bp, Human
ggcgcggagaggttaagttaattgcccccaggtcacacagctataagtgattgagttggattctagcccaggtctgtctgttccggggtcagcacgcctaacccttctctccagtggaaatttccactcccactgtgtatgggagggagggtgctgcagattaccctgccggctctttttagctctgagatgttgggggcctatgaggctaactatcctgtaaataggattttccaatcttgggtttgcttaacaccaaaaacatctgagacatcagctgtgcttgcaagcgtggggcgawgtctgcaacacgtgcaggctgttggggagtgggactgtgtttgtacctgagttttaggcacagggtcatctgtgtgtgagcatatttttaagaccgttttgtaggggttacagaaggatctggatttgtgagtcttatttattgctattccccaatcccctgttctgggccagcccctgtcctggtgacataggagtgaccatgacagctccagccccacccacctggggctcccagtccagtgaggggagaccaacctgtcctcagacagtggcaacccagatggggcagggctgggat

SEQ ID NO: 46284 - DNA, 601 bp, Human
tttgggaggccgaggcggccagatcacgaggtcaagagattgagaccatcctggccaacatggcgataccccgtctctactaaaaatacaaaaactagctgggcatgatggcgcgtgcctgtaattccagctactcaggaagctgaggcaggagaatcacttgaactggggagacggaggtcgcagtaggccgagatcgtgccactgcactctagcctggtgacagagcgagactccagctcaaaaaaaaaaaaaaaaaagacatggatgggaccagacatggtggctcacacatgtaatygtagcaccttgggaggccaaggagggcagatcccttgaagtcaggagttcaaaaccagcctggccaacatggcaaaaccccgtctctactaaaaatacaaaaattagtcgggcatggtagcatgtgcctgtaatcccagctacttgggaggctgaggcagaagaatcacttgaacccaggaggcggaggttgcagtgagccaagattgcgccattcactccagcctggacaacagagtgatattcagtctcaaaaaaaaaaagaaaggatgcggatggctgccacataggggagcccaca

SEQ ID NO: 46285 - DNA, 601 bp, Human
agcccacatactgtccccatgagctttcaaaatcatcaggcatgcctctgagtgcggccgtggcccagcggacatcttgtgtctatgtccggctggctctgcaagggtcagggtggcctgtgtgtttcctcttcaggaccccataaccttccttcactctctgtcccagaggccagcctcaccaaggtgcccccctcctccctggtccaggagcgctccttctttgtccgcatgaaatccacgctcaccaagagggggctgcacgtcaaggcctcagggtacaaggtgggtgtgagcagtyaggctcctgtattccaggcagccatgtccccagattgagggtgaccgagggaaccaggctggtggcttcactggctgcaggtggcttagggaactgggtctgggaatgggactgggggggtcacacagtgtccagtcctccagcacctgtgggggacagagggaacccagcccagtgatggtcctcttgcccccactggcccgccttgtccctcctccaaccatgcccaccaccagcaggtcatccacgtgactgggcgccttcgggcccacgccctgggccttgtggccctcgggcaca

SEQ ID NO: 46286 - DNA, 601 bp, Human
tttcaccatcttaggcaggctggtctcgaactcctgacctcaagtgatccacacgcctcagcctcccaaagtgctgggattacaggtgtgagccaccgcgcctgccaacactgttattgcacccattttacagcaagggtgtgaaccccaggggactctggagccaactctgcctctcccccaaccccgtggtcttggactcctcccctcttctctgtcaccccccagagtcagcgaccacatggacctggggccctcagagctggtgggccgcagctgctaccagtttgtccacggacargacgccacgaggatccgccagagccacgtggactgtgagacccacctccacccaccaagcctgcctaccaccccccagacccgagcatcccactccctggtccctggaagtccttcttcagggctgcccacagtccctcctgctgcacctacagctccagggactccgtttagcattggaagagcagcaaggagactgagtgatgcctcaggatgtgtgtgtggggggggggtctggggggctgtggggtctccaaaacacccaagaggcctcgctgctgggctacctctcagtctctct

SEQ ID NO: 46287 - DNA, 601 bp, Human
ccagagtcagcgaccacatggacctggggccctcagagctggtgggccgcagctgctaccagtttgtccacggacaggacgccacgaggatccgccagagccacgtggactgtgagacccacctccacccaccaagcctgcctaccaccccccagacccgagcatcccactccctggtccctggaagtccttcttcagggctgcccacagtccctcctgctgcacctacagctccagggactccgtttagcattggaagagcagcaaggagactgagtgatgcctcaggatgtgtgtgtgkggggggggtctggggggctgtggggtctccaaaacacccaagaggcctcgctgctgggctacctctcagtctctctgactctgcctctctgtgctttcacctttttctcttctccccaccgtctccctgcccactcccctgctctcactcctcctgtctcctcctgtctacctggctctctgtcttgcccctgtccccaccccacccccttcccatctctccctgggctgggcccagtgctggacaagggtcaggtgatgactggttactaccgttggctgcagcgtgccgggggcttcg

SEQ ID NO: 46288 - DNA, 601 bp, Human
agagtcagcgaccacatggacctggggccctcagagctggtgggccgcagctgctaccagtttgtccacggacaggacgccacgaggatccgccagagccacgtggactgtgagacccacctccacccaccaagcctgcctaccaccccccagacccgagcatcccactccctggtccctggaagtccttcttcagggctgcccacagtccctcctgctgcacctacagctccagggactccgtttagcattggaagagcagcaaggagactgagtgatgcctcaggatgtgtgtgtgggkggggggtctggggggctgtggggtctccaaaacacccaagaggcctcgctgctgggctacctctcagtctctctgactctgcctctctgtgctttcacctttttctcttctccccaccgtctccctgcccactcccctgctctcactcctcctgtctcctcctgtctacctggctctctgtcttgcccctgtccccaccccacccccttcccatctctccctgggctgggcccagtgctggacaagggtcaggtgatgactggttactaccgttggctgcagcgtgccgggggcttcgtg

SEQ ID NO: 46289 - DNA, 601 bp, Human
tcaggtgagggctgtgcccacccctcctgcagggcactcagggccctgctgtctctccccacctccagtgggggtgctttggggagggcttctagaatgggacaagcccagggggtctgcagacacgaaggggaaggaggggaggatggtgagagcagaggcccagagtggaacggtcttgctggcaggagacagagaggagtcgccagggggagggggacagtatctttgaggaaggcaggggcaggctcacagcctcctcaggctcaggtggagggtctggactcttgactctggggcmctggcgagccacggcaggctcttaccaggggaggcccacagagcacagcaactaatggaaagaagcagggaggggtgttccaagcagaggaagggctccaagcaacagcctgaccctaaaggtaatgccttgggctggagtagaaagcagtgagaaaccagcctgaagatgacggcctggccttttggctcaggggcactggggagtcatagaaagctttagagctggagaggatcatagtcagatctgctttttagaaagactgctctagaccggacatggtggctcatgcctgtaatc

SEQ ID NO: 46290 - DNA, 601 bp, Human
aagggctccaagcaacagcctgaccctaaaggtaatgccttgggctggagtagaaagcagtgagaaaccagcctgaagatgacggcctggccttttggctcaggggcactggggagtcatagaaagctttagagctggagaggatcatagtcagatctgctttttagaaagactgctctagaccggacatggtggctcatgcctgtaatcccaacaatttgggaggccaaggcaggtggtttgcctgagcccaggagctgaagaccagcctgggcaaccaagtgaggtcccatctctattaaaaaaaaatttttttaattggcccgttacagtggcacgcacctgtggtcccagctacagcagaggctgaggtgggaggatcacctgagcccaggaggtcgaggctgcagtgagccgtgatcgtgccactgctctccagcctgggcgacagagtgagaccctgtctcaaaaaaaaaaaaaaaaaaaaaaaaaaaaggaaaaaacacccttctaggccaggcacagtggctcacgcctggaatcccagcactttgggaggccgaggtgggtggatcacgaggtcaggagttgaagaccagcc

SEQ ID NO: 46291 - DNA, 601 bp, Human
aagcaacagcctgaccctaaaggtaatgccttgggctggagtagaaagcagtgagaaaccagcctgaagatgacggcctggccttttggctcaggggcactggggagtcatagaaagctttagagctggagaggatcatagtcagatctgctttttagaaagactgctctagaccggacatggtggctcatgcctgtaatcccaacaatttgggaggccaaggcaggtggtttgcctgagcccaggagctgaagaccagcctgggcaaccaagtgaggtcccatctctattaaaaaaaaawttttttaattggcccgttacagtggcacgcacctgtggtcccagctacagcagaggctgaggtgggaggatcacctgagcccaggaggtcgaggctgcagtgagccgtgatcgtgccactgctctccagcctgggcgacagagtgagaccctgtctcaaaaaaaaaaaaaaaaaaaaaaaaaaaaggaaaaaacacccttctaggccaggcacagtggctcacgcctggaatcccagcactttgggaggccgaggtgggtggatcacgaggtcaggagttgaagaccagcctggccaaga

SEQ ID NO: 46292 - DNA, 601 bp, Human
cagcctgaccctaaaggtaatgccttgggctggagtagaaagcagtgagaaaccagcctgaagatgacggcctggccttttggctcaggggcactggggagtcatagaaagctttagagctggagaggatcatagtcagatctgctttttagaaagactgctctagaccggacatggtggctcatgcctgtaatcccaacaatttgggaggccaaggcaggtggtttgcctgagcccaggagctgaagaccagcctgggcaaccaagtgaggtcccatctctattaaaaaaaaattttttwaattggcccgttacagtggcacgcacctgtggtcccagctacagcagaggctgaggtgggaggatcacctgagcccaggaggtcgaggctgcagtgagccgtgatcgtgccactgctctccagcctgggcgacagagtgagaccctgtctcaaaaaaaaaaaaaaaaaaaaaaaaaaaaggaaaaaacacccttctaggccaggcacagtggctcacgcctggaatcccagcactttgggaggccgaggtgggtggatcacgaggtcaggagttgaagaccagcctggccaagacagtga

SEQ ID NO: 46293 - DNA, 601 bp, Human
agcctgaccctaaaggtaatgccttgggctggagtagaaagcagtgagaaaccagcctgaagatgacggcctggccttttggctcaggggcactggggagtcatagaaagctttagagctggagaggatcatagtcagatctgctttttagaaagactgctctagaccggacatggtggctcatgcctgtaatcccaacaatttgggaggccaaggcaggtggtttgcctgagcccaggagctgaagaccagcctgggcaaccaagtgaggtcccatctctattaaaaaaaaatttttttaattggcccgttacagtggcacgcacctgtggtcccagctacagcagaggctgaggtgggaggatcacctgagcccaggaggtcgaggctgcagtgagccgtgatcgtgccactgctctccagcctgggcgacagagtgagaccctgtctcaaaaaaaaaaaaaaaaaaaaaaaaaaaaggaaaaaacacccttctaggccaggcacagtggctcacgcctggaatcccagcactttgggaggccgaggtgggtggatcacgaggtcaggagttgaagaccagcctggccaagacagtgaa

SEQ ID NO: 46294 - DNA, 601 bp, Human
agctggagaggatcatagtcagatctgctttttagaaagactgctctagaccggacatggtggctcatgcctgtaatcccaacaatttgggaggccaaggcaggtggtttgcctgagcccaggagctgaagaccagcctgggcaaccaagtgaggtcccatctctattaaaaaaaaatttttttaattggcccgttacagtggcacgcacctgtggtcccagctacagcagaggctgaggtgggaggatcacctgagcccaggaggtcgaggctgcagtgagccgtgatcgtgccactgcwctccagcctgggcgacagagtgagaccctgtctcaaaaaaaaaaaaaaaaaaaaaaaaaaaaggaaaaaacacccttctaggccaggcacagtggctcacgcctggaatcccagcactttgggaggccgaggtgggtggatcacgaggtcaggagttgaagaccagcctggccaagacagtgaaacctcatctctactaaaaatttaaaaaaaattagctgggcatagtggtgcacgcctgtaatcccagctactcgggaggctgaagcaggagaattacttgaacccgggaggtggagg

SEQ ID NO: 46295 - DNA, 601 bp, Human
gatcacctgagcccaggaggtcgaggctgcagtgagccgtgatcgtgccactgctctccagcctgggcgacagagtgagaccctgtctcaaaaaaaaaaaaaaaaaaaaaaaaaaaaggaaaaaacacccttctaggccaggcacagtggctcacgcctggaatcccagcactttgggaggccgaggtgggtggatcacgaggtcaggagttgaagaccagcctggccaagacagtgaaacctcatctctactaaaaatttaaaaaaaattagctgggcatagtggtgcacgcctgtaatyccagctactcgggaggctgaagcaggagaattacttgaacccgggaggtggaggttgcagtgagccaagatcatgccactgcactccagcctgggcaacacagtgagactccatctcaaaaacaagcaagcaaacaaaaaaacccttctagctgccatgaaggaggcactgagggacaagatgggcgctggaggaccagggcagaggctggggccagtcctgggaagtgccagactctatgggggaggaggggaggagaccatcttctgcccaggtctctggctttgctgagcccggatt

SEQ ID NO: 46296 - DNA, 601 bp, Human
gaccagggcagaggctggggccagtcctgggaagtgccagactctatgggggaggaggggaggagaccatcttctgcccaggtctctggctttgctgagcccggatttgggctcctgagaggaacagcaggtttgaaaggaagatgtagacatcagatgggcatgaggtgccagaggacacccaggtggtgacatccaggtggccaccggctatccaggtctggccttaggagcgagggccacgctgggctagaagtcaacccggagtttagggatctggtgttgagccttgtaagtgccycagggtggggactccacatttccccgtgggagtgtccacacattgccacaagttgggtaaagcaggagggagtcctgagaggccaaggacccctggctcctaaccgcatccatcttctccccagccaagccgagggtggccaaactcctttggatgccttccagcttccagccagcgtggcctgtgaggaggcatccagcccggggccagagcccacaggtgagccccacctcccaccttggcccctgggaagctccaaggaacctttgggtcctggctgtccattccagaagccactag

SEQ ID NO: 46297 - DNA, 601 bp, Human
cactgcactccagcctagcgacagagcgagactctgtctcaaaaaaaaaaaaaaaaaaatttaaatccaggccaggagtggtgactcaagcctgtaatcccagtactttgggaggccgaggcaggcagatcaccaggtcaggagatggagaccatcctggctaataaggtgaaaccccatctctactaaaaatacaaaaaaattagctggacatggtgccatgctcctgtaatcccaactactcgggaggctaaggcaggagaatcgcttgaacccggagggcagaggttgcagtgagccragatcatgccactgcactccagtctaggtgacagagcaagatttaaaacaaaacaaacaaacaaaaaattagctgggcatggtggcacgtgcctgtagtcccagctactcaggaggctgaggcaggagagtcgcttctacccaggagtcagaggttgcagtgagctgagatctcaccgctgcactccagcctgggtgacagagtgagactccatctcaaaaaaataaaataaaataaaatccaggcccggtgtggtggcttatgcctgtaaacccagaactttgggaggctgaggtaaga

SEQ ID NO: 46298 - DNA, 601 bp, Human
tggtgacagaaccagctggccgggcacagtggctcacgcctgtaatcccagcactttgggaggctgaggcaggcagatcacctgaggtcaggagtttgagaccagtctggccaacatggcgacaccccatctctacttaaaatagaaaaattagctgggtgtggtggcacacacctgtaatcccagctactggggaggctgaggcaggagaatagcttgaaccccagaggcggaggttgcagtgagctgagatggtgctggtgcactccagcctgggggacagagcaagactccgtctcamaaaaaaacaaaaaacaaaaacaaaacaaacaaacaaacaaaaaaaccccactcccagctgagaactacaggtctggcccactaagcacagctccattccacagatgggaagactgagggctggggacacacacaggccctcagcatcttcctcttccagagccggagcctccgacggaagggaagcaggctgccccagcggagaacgaggccccccagacccagggcaaacgcatcaaagtggagcccggcccgagggaaaccaaaggctccgaggacagtggcgacgaggatccctcca

SEQ ID NO: 46299 - DNA, 601 bp, Human
cctgtaatcccagcactttgggaggctgaggcaggcagatcacctgaggtcaggagtttgagaccagtctggccaacatggcgacaccccatctctacttaaaatagaaaaattagctgggtgtggtggcacacacctgtaatcccagctactggggaggctgaggcaggagaatagcttgaaccccagaggcggaggttgcagtgagctgagatggtgctggtgcactccagcctgggggacagagcaagactccgtctcaaaaaaaaacaaaaaacaaaaacaaaacaaacaaacaaamaaaaaaaccccactcccagctgagaactacaggtctggcccactaagcacagctccattccacagatgggaagactgagggctggggacacacacaggccctcagcatcttcctcttccagagccggagcctccgacggaagggaagcaggctgccccagcggagaacgaggccccccagacccagggcaaacgcatcaaagtggagcccggcccgagggaaaccaaaggctccgaggacagtggcgacgaggatccctccagccacccggccacaccgaggcccgagttcacctctgtc

SEQ ID NO: 46300 - DNA, 601 bp, Human
aataataatggcaaacactcatgaaacactatgggctagaccctctttttaacgctttacttgtatgagcttattcagtcctcactatagtcttagggggtcttaacctggtattaagaggttaagtgatttgcacaaggtcacccgatgcataagttgtgcgctgggattctaactccggagttctggcccagagccctgctctggccgaccgcctctcaaatcatcataatgtcggttaatgtttaatgagggctcacactgtgctccacgccctgtgtgcccggtcgtatttcactcytgctgcaatcttgtgaagtgagtgctcaagatgaacctactttacagacgggaaaaatgaggctcagaagcttctgctgaaggcagagttagaatcgaagctgggcctgggtgattccagggctcctgcccctggtcgccacattgtccgctgccagccattaggtctctcctggaagcagggggctgggcagggctgggccactccctgggcggatcggattgtctgcttggtttccttggaagggtgtgatctggcagggaagattcctgtgagcctatgggagtagggtgtttgtag

SEQ ID NO: 46301 - DNA, 601 bp, Human
agtgtccctgggtggtaccctgggcagagcggggtgttcactgttcttaaaaccctaagctctcactgtggtccttagtcactcccacctcacttcttatggctctgcccatttctccccagcccctttactgttctccaactccaggcccatgcctcccgcccggtctttgaccttcctgttccttctgctgggaatcctttccccaccctgccctctctcactgacgggtcgctcactctcagctggcccgggaccaccctggctcgccttgctgcaggctctttttctctcatctgaycagcccttacctccctccttaccttaattattagggtgcatggtggaattgctctgtggggttccttgcctcggtccccactgaagccctgcctggcctgcagaggatgtgacattgctgggggttgactgttgggcactgtgccgggtgctgggagtgtggcaggggacgagatccacagagcccctagcctcagagggcactcagttccctggtgggagcagagtggaaccagcccccaagccagtgacacaagactgcgtctctgcaaacggtgatgtggcttgcgagggcatcttc

SEQ ID NO: 46302 - DNA, 601 bp, Human
tggtgggagcagagtggaaccagcccccaagccagtgacacaagactgcgtctctgcaaacggtgatgtggcttgcgagggcatcttcagagagccgggagagtgcccctaccctgggctgaagcctgagtccctttcccctgggaaggctctgaaggatggggaggagggctgggaatgggcttaccaggcaggaggagcagtgtgtgcagaggccctggcatgactggaggtcaggactcgggtgcacagttggggatctgggcaacacgtagcctgtgcaggttcagggcaagaccckgaggggactcagctttggagggacggtgggagcaggggagggctgaggagtacctgtatgtgtggagctgcctgaggccttgatggagcgtgattcagaaagcagtgctgggccagagatgcctggtacacacccctctccatcactcacagagcatgtgaggacctccgtttccacttctgcaagatgggcatagtgttagcgctgcctcatagaattgctgtgaggatgcaggctagagagccttggcccaaggcctggcatacagtagttgctgtgtaagcattagtcttgctgctg

SEQ ID NO: 46303 - DNA, 601 bp, Human
gcgtctctgcaaacggtgatgtggcttgcgagggcatcttcagagagccgggagagtgcccctaccctgggctgaagcctgagtccctttcccctgggaaggctctgaaggatggggaggagggctgggaatgggcttaccaggcaggaggagcagtgtgtgcagaggccctggcatgactggaggtcaggactcgggtgcacagttggggatctgggcaacacgtagcctgtgcaggttcagggcaagaccctgaggggactcagctttggagggacggtgggagcaggggagggctgargagtacctgtatgtgtggagctgcctgaggccttgatggagcgtgattcagaaagcagtgctgggccagagatgcctggtacacacccctctccatcactcacagagcatgtgaggacctccgtttccacttctgcaagatgggcatagtgttagcgctgcctcatagaattgctgtgaggatgcaggctagagagccttggcccaaggcctggcatacagtagttgctgtgtaagcattagtcttgctgctgctgctgctgccaccccaccactgcctggggagggcctcagagacagt

SEQ ID NO: 46304 - DNA, 601 bp, Human
tctgcagcctttcatactttgactgcccttgaatgtattcaccaacagtagagcaacagctcttgcccctggctgcacattgcaactccctggagagctttgaaaagatgccttggcccaggcccgccatggaaattctgcttccaacttacttggtctgggctggggctggcctcaggcttttggaagctccctgggcagttcttatggccagcaggggctgacgactgttgtttcacagttcagataaatggtgtcaccataaacatgcctttctgcaagttgctgtttttgttcaacrttataggtatatttgagatgggatcttgctatgttgcctagactggactcttaactcctgggctcaagctatcctcccacctcagcctctggagtagctgggattacaggcgcgcacacctgctccccgctttgagctgagcattggagtctggatgtctcttggtggggatgtgtgtaggcctgggacaggccatttgtttttcctgatggtgtttctttttgtgatcgtgtcacacaggagttgcctgttcacctgttgatggccactgaggtggtccgttggagctataaccgtgca

SEQ ID NO: 46305 - DNA, 601 bp, Human
ctgggctggggctggcctcaggcttttggaagctccctgggcagttcttatggccagcaggggctgacgactgttgtttcacagttcagataaatggtgtcaccataaacatgcctttctgcaagttgctgtttttgttcaacattataggtatatttgagatgggatcttgctatgttgcctagactggactcttaactcctgggctcaagctatcctcccacctcagcctctggagtagctgggattacaggcgcgcacacctgctccccgctttgagctgagcattggagtctggatstctcttggtggggatgtgtgtaggcctgggacaggccatttgtttttcctgatggtgtttctttttgtgatcgtgtcacacaggagttgcctgttcacctgttgatggccactgaggtggtccgttggagctataaccgtgcagcaatgggccttctggaacgcgtgttcctgtagaccatggccagagtctctctggcatatgcctagtagtggaaaagccggagctccccgctttcctagcggttgccaagtcatgcccccagtggctggaccactgtgctccccagcaggctccggg

SEQ ID NO: 46306 - DNA, 601 bp, Human
taggtatatttgagatgggatcttgctatgttgcctagactggactcttaactcctgggctcaagctatcctcccacctcagcctctggagtagctgggattacaggcgcgcacacctgctccccgctttgagctgagcattggagtctggatgtctcttggtggggatgtgtgtaggcctgggacaggccatttgtttttcctgatggtgtttctttttgtgatcgtgtcacacaggagttgcctgttcacctgttgatggccactgaggtggtccgttggagctataaccgtgcagcartgggccttctggaacgcgtgttcctgtagaccatggccagagtctctctggcatatgcctagtagtggaaaagccggagctccccgctttcctagcggttgccaagtcatgcccccagtggctggaccactgtgctccccagcaggctccggggctccctttatttcaagtcctgctttgggcagctttgtggccctcactgaaacgatttcctcggccgtgacatgggaggtttatgggcccacccacccacccaccaggctgtttggaaacagatggggagatggttcacacaactgg

SEQ ID NO: 46307 - DNA, 601 bp, Human
gatcttgctatgttgcctagactggactcttaactcctgggctcaagctatcctcccacctcagcctctggagtagctgggattacaggcgcgcacacctgctccccgctttgagctgagcattggagtctggatgtctcttggtggggatgtgtgtaggcctgggacaggccatttgtttttcctgatggtgtttctttttgtgatcgtgtcacacaggagttgcctgttcacctgttgatggccactgaggtggtccgttggagctataaccgtgcagcaatgggccttctggaacgcrtgttcctgtagaccatggccagagtctctctggcatatgcctagtagtggaaaagccggagctccccgctttcctagcggttgccaagtcatgcccccagtggctggaccactgtgctccccagcaggctccggggctccctttatttcaagtcctgctttgggcagctttgtggccctcactgaaacgatttcctcggccgtgacatgggaggtttatgggcccacccacccacccaccaggctgtttggaaacagatggggagatggttcacacaactggcttagctgggacctcgtc

SEQ ID NO: 46308 - DNA, 601 bp, Human
gggaaacccaggcagaggggtcagggcgggatggggaaacccaggcagaggggttggggctggatggtggggaggggcacagagagggattgggactgggatggaggcgcagggaccgtaggaagcccgaggaggcatgtggcccagcgtggggagttgaggagggctttctggataagatgacatctgactgatgagaacatatgagcgaggctggaaggaggtggaaagaatgtaacaggtcatgggtacggaagtgccaaggccctgagggtcggaatgacctcggaatggtcgaggmtcatcagataggccggtgtaggctatgctgtgcaccctgactgtgtggtagccttgctctgcaaagagcagttaaagaaatacataaaatataaaataaataaataaataaaaaagcaaaaaaaagaagccagtgtggctgagcagggggtggggtcagaggcttggaggcggtgttggatacagcagggcctagcagagccaggtggggtgtgtggattccattctgtgcataatgggaagtcatcagaggctttagtgacatctggttttccccttataaagattgctcaggctgctg

SEQ ID NO: 46309 - DNA, 601 bp, Human
ggtggggaggggcacagagagggattgggactgggatggaggcgcagggaccgtaggaagcccgaggaggcatgtggcccagcgtggggagttgaggagggctttctggataagatgacatctgactgatgagaacatatgagcgaggctggaaggaggtggaaagaatgtaacaggtcatgggtacggaagtgccaaggccctgagggtcggaatgacctcggaatggtcgaggatcatcagataggccggtgtaggctatgctgtgcaccctgactgtgtggtagccttgctctgcaargagcagttaaagaaatacataaaatataaaataaataaataaataaaaaagcaaaaaaaagaagccagtgtggctgagcagggggtggggtcagaggcttggaggcggtgttggatacagcagggcctagcagagccaggtggggtgtgtggattccattctgtgcataatgggaagtcatcagaggctttagtgacatctggttttccccttataaagattgctcaggctgctgtgtgggggacggatcgcggggggtggcgacagggaggctgtggggaggctgctgtgacagtccaa

SEQ ID NO: 46310 - DNA, 601 bp, Human
cctgggtagtttctgggcgctgggtccctacctccctcagggcctccctttcctttctcatctactcctcgtcccactggctcgtggtgagccagacttcctggccagacaccggtcaggggtgtccccagcagctgtttctcccatcaccgagcccagccccgcacatgctgccagcaggaagcaacctccttccaagtcatggccagggaagtgggacccttcccgcctagtcacccatccggggccaaggcttcttgtctgccagacgccttggcccacaggaaggttggaggggccraggagggtgagaaggggaacactctcccatcccaggggagccagcgctggcggatgcgacagaagccaccgctcactgaagcctctctcctgggaccctccggtcctgccccgacccttcccaggctgggaggccatctgctgccttcccgaggggcagtggaacttccctgccagggctgctcagtccacacacatcccttagcctttttcactagctgggagcccctggggaagagacaaagaacttccctgggcctctgattcctcacctgttacagggagtattggtggccacctc

SEQ ID NO: 46311 - DNA, 601 bp, Human
agggctgtgggagggcggaagatcatgtgtgtgcgtcgtgcttagcccgatgctcagcactcagtaagtgcttggtaaatgttgaacttggtgcgttcgatggtttccgtcccttgcaccctgtccccctctgggttctcatcccgtagtgagctgtaataaccccagccccccgcccggggtcccagctccacgtgccaggcacgcgtgtgctgtgagtctatgagcatggtcatgtggctgtacccagagaccctgaggaggaggtgtttttaacctcgtttctcttttcccgtgtttyaattttcagaaagcacgtttttcctccatgtgcatgcattacctattcccctaaataatcactgaaaaactgcacacagcacaaaaggatgtacagggacgagcaaatctctttcccacccgcctgccaggcccttcccagagatagcatcatcacccccggtttcttttctttctttcttgaaatatttgttcccccaagtgcccgcccctcccttttgtttttactcaaatggagcggacttcccatgtttatattctgtcctgtgctttgcgtttcccactccgaagctcgctgtca

SEQ ID NO: 46312 - DNA, 601 bp, Human
aatctctttcccacccgcctgccaggcccttcccagagatagcatcatcacccccggtttcttttctttctttcttgaaatatttgttcccccaagtgcccgcccctcccttttgtttttactcaaatggagcggacttcccatgtttatattctgtcctgtgctttgcgtttcccactccgaagctcgctgtcaggacacagagtgccgcctcgtgtcccacgcacacgcgtgcccccacggacagcacagccattctgtgctgatggccatcaggccattcccatctttccgtgctgtraacagggctgcgcccgcctgagtgtggctgtgcatatgtctctaggtgtgagtctgagcttgtggcctcgtggtctgagacaggtgccccgttaactttgccggtagtgttagtgtttcaccctgctggggaggttgtctggctcacactcccaccccccagtgtctgatgacaccggggtttcctcactcccttgctggaatagacgggtgtcacctgacattctcacctttgccagtcagataggtgacaaacagtctcatcatggttctgattttaatcagagcaaagtgggacagc

SEQ ID NO: 46313 - DNA, 601 bp, Human
ccttttcttggagctgtctattcctgataattttactttctctgagaaggggaaactgaggcacaggccagcagtcccacagcaaatacgtggcagatgtggcactcaaaccttggctccgttctggagctcctaacccatctgacacagaagaggtcaagggcttggcctccggagccagctttgtctcttactagcagtgtgaccccagacaagtcacatcacctctctgtgcccgggtgtcctcatctgtaaaatgagggtgctaatgatatctactcttagagttgttttgaggatmtaaatgtatattcggcaggcaaaatgtatagtaagtgctcaaagactgttagctgcgttactaatagccgtattattaatattatagctatgtcaccaatagccatgttattaatatgagcaggcactgtttgagtgctttctgtgaactaacctactggaccctcccatcaactccaagacacacgtgttcttaggatctcccttttctagggaggagactgagagcctgggggacctggccccgtcacagagcaagaggaactgggatttggatgctggaggcctggctggtaatcgc

SEQ ID NO: 46314 - DNA, 601 bp, Human
agaattacaaagtgaacaacgcttccccaccacctcggtaaagacagaacacaacctcccaaaagccgcctgcccataacccctgtccatcacgaccacagtcgtgagtgctctcctgaccttggtggtcactgtgtccttgcttttcctgatagtttttaccatgaggtatgcatccttgaattacagaatgtcatcttgcctgcttttgaacttgacataaatggaatcttccagtatgtccttgtctgtgctttctttcgcccttaggcctgtgagatccatctgtgtgctgagtgtwtctgtagtcattcatctttgttgctgtataatattctttttttttctttgacacagagtctcgctctgtcacccaggctggagtgcagtggtgcaatcttggctcactgcagcctctgcctcctgggttcaagcgattcacctgcctcagcctcccgagtaactgggattacaggcatacaccgctatgcctggctaatttttttttttaatttttagtagagagggggtttcaccacgttggccaggcgagtcttgaactcttgacctcaggtgatccacccacctcagcttcccaaag

SEQ ID NO: 46315 - DNA, 601 bp, Human
accttggtggtcactgtgtccttgcttttcctgatagtttttaccatgaggtatgcatccttgaattacagaatgtcatcttgcctgcttttgaacttgacataaatggaatcttccagtatgtccttgtctgtgctttctttcgcccttaggcctgtgagatccatctgtgtgctgagtgtttctgtagtcattcatctttgttgctgtataatattctttttttttctttgacacagagtctcgctctgtcacccaggctggagtgcagtggtgcaatcttggctcactgcagcctctkcctcctgggttcaagcgattcacctgcctcagcctcccgagtaactgggattacaggcatacaccgctatgcctggctaatttttttttttaatttttagtagagagggggtttcaccacgttggccaggcgagtcttgaactcttgacctcaggtgatccacccacctcagcttcccaaagtgccggcattacaggcgtgagccactgtgcccagccccatataatattctgttcctccatctcctgctgcgctgatgcgagccatctctttgtagcatctcctggggtgccggtgcct

SEQ ID NO: 46316 - DNA, 601 bp, Human
aggctggagtgcagtggtgcaatcttggctcactgcagcctctgcctcctgggttcaagcgattcacctgcctcagcctcccgagtaactgggattacaggcatacaccgctatgcctggctaatttttttttttaatttttagtagagagggggtttcaccacgttggccaggcgagtcttgaactcttgacctcaggtgatccacccacctcagcttcccaaagtgccggcattacaggcgtgagccactgtgcccagccccatataatattctgttcctccatctcctgctgcgctgrtgcgagccatctctttgtagcatctcctggggtgccggtgcctgcgtttcttcagggaatatacccaggagtgcgtagcccagggcagagggtggggtagcttcagatttagtgggcgctgccacacagcctcccaaggtggtcaaatctgtgtatcctcctagcggtggtgactgaggatcttagttgctccacctcctcaccaacatttggtaccgtcagactttttggttgaccttggaacatttttattcttttttcctgcaaaagtaacaccactggttatcatcgggctgagcc

SEQ ID NO: 46317 - DNA, 601 bp, Human
ccggtgggaacacagacctcgactgcagagcaacagaaagataagccgggctggaggctcccggcccccatcttcccacagtgaccccattttgggaacaggaacccccatccctcgtcttgtttcgggattaggcttctccaaatctggcaccctatcaccttgactcctctcttgcccccccgccacatccaaagtgtctggaaagcctgtcactctacatgacaatgtaacctggtgctgcgggctcctcttccttgtcactccccttcctcgtcatcccccttcttcgtcaccccccttcctcgccacccccttcctggtcacacctcttcctcgtcacccttcttccttgtcacccctcttcctcgtcaccccccttcctcatcatcccccttcctcgttaccccccttccttgttacccttcttcctcgtggccccctagttcaagccaccctcatctccctcctggaccattgaggcgtgctccctgctcccttctcccccactgtccccacagttgtccgcacacagccagaggtagccgtgcacacctggtcagggcaggaaccctcccctggctccacctctcccagcaga

SEQ ID NO: 46318 - DNA, 601 bp, Human
ctcttcctcgtcaccccccttcctcatcatcccccttcctcgttaccccccttccttgttacccttcttcctcgtggccccctagttcaagccaccctcatctccctcctggaccattgaggcgtgctccctgctcccttctcccccactgtccccacagttgtccgcacacagccagaggtagccgtgcacacctggtcagggcaggaaccctcccctggctccacctctcccagcagagaagcttgcaaggtcccaggcaacctggccactttcctgcctgccctgcttccctcttctyctgccaccattcctggaacattccaggcaggtcctaccccggggcctttgttcttgctgccccctgggcaggcagcaccctccttccttctgttcagtcagcctctgctgacagtggcccccttggggagatgtttcttcccgaccatgggtccccaggagcagcccctgtcaccctccctctagcaccttcccccggtaaccctcatgatggttacttccattatgacatgtgggtctgttggtttattttgtctcccggcataacgtagcctcagggcatgggggtaggggtagaacc

SEQ ID NO: 46319 - DNA, 601 bp, Human
caagccaccctcatctccctcctggaccattgaggcgtgctccctgctcccttctcccccactgtccccacagttgtccgcacacagccagaggtagccgtgcacacctggtcagggcaggaaccctcccctggctccacctctcccagcagagaagcttgcaaggtcccaggcaacctggccactttcctgcctgccctgcttccctcttctcctgccaccattcctggaacattccaggcaggtcctaccccggggcctttgttcttgctgccccctgggcaggcagcaccctccttcyttctgttcagtcagcctctgctgacagtggcccccttggggagatgtttcttcccgaccatgggtccccaggagcagcccctgtcaccctccctctagcaccttcccccggtaaccctcatgatggttacttccattatgacatgtgggtctgttggtttattttgtctcccggcataacgtagcctcagggcatgggggtaggggtagaaccacagggccttgccctgccccttgctatgttctcagggattggagtgtggtagtctctcagtaaatgctggttgactgactgactgac

SEQ ID NO: 46320 - DNA, 601 bp, Human
actgtccccacagttgtccgcacacagccagaggtagccgtgcacacctggtcagggcaggaaccctcccctggctccacctctcccagcagagaagcttgcaaggtcccaggcaacctggccactttcctgcctgccctgcttccctcttctcctgccaccattcctggaacattccaggcaggtcctaccccggggcctttgttcttgctgccccctgggcaggcagcaccctccttccttctgttcagtcagcctctgctgacagtggcccccttggggagatgtttcttcccgaccrtgggtccccaggagcagcccctgtcaccctccctctagcaccttcccccggtaaccctcatgatggttacttccattatgacatgtgggtctgttggtttattttgtctcccggcataacgtagcctcagggcatgggggtaggggtagaaccacagggccttgccctgccccttgctatgttctcagggattggagtgtggtagtctctcagtaaatgctggttgactgactgactgactgactgactgaactgtagtaagctgggctgccagagcgtctaatggggacccgccctggg

SEQ ID NO: 46321 - DNA, 601 bp, Human
ctctgtggtctgatgtgtttttctggtagccagtcaggtggggcagctttcaatttgttcttccagactcctgtgaaggaagggccagttcaggtcactttcctttttttttttttttgagacagagtctcactctgtcacccaggctggagtgcagtggcacgatcttggctcactacaacctccgcctgccgggttcaagcgattctcctgcctcagcctccggagtagctgggactacagtcgtgcgccaccatgcctggctaattttttgtgtttttaatagagatgaggctttgcygtgttagccaggatggtctcgatctcctgaccttgtgatccgcccaccttggcctcccaaagtgctgggattacaggcgtgagccactgtgcctagtgtcttagccattcctgaggttttttttttttttttgagacagggtcttgctctgtcacccaagctggagtgcagtggttcaagattggctcactgcagcctccacctcctgggttcaagcaattctctttcctcagcctcagtagctgggactgcaggtacacgccaccaccctgggctaatgggctaattttttttattttt

SEQ ID NO: 46322 - DNA, 601 bp, Human
tgtgtttttctggtagccagtcaggtggggcagctttcaatttgttcttccagactcctgtgaaggaagggccagttcaggtcactttcctttttttttttttttgagacagagtctcactctgtcacccaggctggagtgcagtggcacgatcttggctcactacaacctccgcctgccgggttcaagcgattctcctgcctcagcctccggagtagctgggactacagtcgtgcgccaccatgcctggctaattttttgtgtttttaatagagatgaggctttgccgtgttagccaggmtggtctcgatctcctgaccttgtgatccgcccaccttggcctcccaaagtgctgggattacaggcgtgagccactgtgcctagtgtcttagccattcctgaggttttttttttttttttgagacagggtcttgctctgtcacccaagctggagtgcagtggttcaagattggctcactgcagcctccacctcctgggttcaagcaattctctttcctcagcctcagtagctgggactgcaggtacacgccaccaccctgggctaatgggctaattttttttatttttagtagaggtgggg

SEQ ID NO: 46323 - DNA, 601 bp, Human
agggccagttcaggtcactttcctttttttttttttttgagacagagtctcactctgtcacccaggctggagtgcagtggcacgatcttggctcactacaacctccgcctgccgggttcaagcgattctcctgcctcagcctccggagtagctgggactacagtcgtgcgccaccatgcctggctaattttttgtgtttttaatagagatgaggctttgccgtgttagccaggatggtctcgatctcctgaccttgtgatccgcccaccttggcctcccaaagtgctgggattacaggcgkgagccactgtgcctagtgtcttagccattcctgaggttttttttttttttttgagacagggtcttgctctgtcacccaagctggagtgcagtggttcaagattggctcactgcagcctccacctcctgggttcaagcaattctctttcctcagcctcagtagctgggactgcaggtacacgccaccaccctgggctaatgggctaattttttttatttttagtagaggtggggtttcactatgttggccatcctgttctcaaacttttttttgttgttgtatttttatagagatgggatt

SEQ ID NO: 46324 - DNA, 601 bp, Human
tacaacctccgcctgccgggttcaagcgattctcctgcctcagcctccggagtagctgggactacagtcgtgcgccaccatgcctggctaattttttgtgtttttaatagagatgaggctttgccgtgttagccaggatggtctcgatctcctgaccttgtgatccgcccaccttggcctcccaaagtgctgggattacaggcgtgagccactgtgcctagtgtcttagccattcctgaggttttttttttttttttgagacagggtcttgctctgtcacccaagctggagtgcagtggtwcaagattggctcactgcagcctccacctcctgggttcaagcaattctctttcctcagcctcagtagctgggactgcaggtacacgccaccaccctgggctaatgggctaattttttttatttttagtagaggtggggtttcactatgttggccatcctgttctcaaacttttttttgttgttgtatttttatagagatgggatttcaccatgttgcccaggctagtctcaaactcctgagctcaagccagctgcccgcctcagccttccaaagtgctgggattacaggcatgagccactg

SEQ ID NO: 46325 - DNA, 601 bp, Human
tccatcccccactgagctgtgacaggtggagggcagcaggtgtgatggagattacagccgattcctcccctgattcacatcatcccccacagcccatggctggctggggaggggctggccctgtccctccagcagctttggcagggcccgtccctccccactttcctgcagcaccccagcctcgctggcctttgtggagtgctcggacttcatttattctgtgggtcttggcttaaaggtcagcacctctgggaagcctcctcgggcctccctcctgtcagagctggtgatcagccgcacrgccccttgccagttcttgggatcatggttgttcatctgctgcaactcctgcagacactgagaagtacactgagggggatgcctgagctgggccagtgtcggggtacccagcgggataaagggttcgggacctgggctccaaggagggggctgggaaggggtgttcagggaggactgagtgatggcttggaggcggctggaccaggaacacctcatgggagtttgcgaatggggaggggactctggagatggctgtgccaggcctgacttcattccttgcattcctcagcaggccccagac

SEQ ID NO: 46326 - DNA, 601 bp, Human
gctggaccaggaacacctcatgggagtttgcgaatggggaggggactctggagatggctgtgccaggcctgacttcattccttgcattcctcagcaggccccagactcctgatggtcctaagtgggggaaggtgagccagagagggccttctgggtactgccctccccccactccatcagtctgtctcagtctctctttacaccctcccccatccaggtctcagggctggatccatcctcctgcccactccccaatctccttatcctttggctgcgccttagggtcacccggggtgggagkcactgcaggggcccaagctggaccatttgaagctgactgtacagctgtggggtctgggccttggggttttttaatgctcccctggcgactctgacatgcttctgagctggagtgagggctgctggcctgcaggaatggcaacaaatgtgttttagcttttggcatgttctgggtgcttttctaggcttctgacatggaggggttaagtcacggcacgctacggggacatgtgactgtgattcctgtgttccagataaggcaactgaggcccagagaaggcctcgagcttggcgatggcag

SEQ ID NO: 46327 - DNA, 601 bp, Human
agagagggccttctgggtactgccctccccccactccatcagtctgtctcagtctctctttacaccctcccccatccaggtctcagggctggatccatcctcctgcccactccccaatctccttatcctttggctgcgccttagggtcacccggggtgggaggcactgcaggggcccaagctggaccatttgaagctgactgtacagctgtggggtctgggccttggggttttttaatgctcccctggcgactctgacatgcttctgagctggagtgagggctgctggcctgcaggaatgrcaacaaatgtgttttagcttttggcatgttctgggtgcttttctaggcttctgacatggaggggttaagtcacggcacgctacggggacatgtgactgtgattcctgtgttccagataaggcaactgaggcccagagaaggcctcgagcttggcgatggcagtctctgtcactgtcttatcttcccatttctggtctgtccagatgtctgtctgggccttctctgtttcacctctgtctctctccctgtttttctgcctcttatctcccttccccaccccaccctcctgcatttcagctt

SEQ ID NO: 46328 - DNA, 601 bp, Human
ctcgagcttggcgatggcagtctctgtcactgtcttatcttcccatttctggtctgtccagatgtctgtctgggccttctctgtttcacctctgtctctctccctgtttttctgcctcttatctcccttccccaccccaccctcctgcatttcagcttccctcctcccctggcagaaacttcccagatttctgtgttttgaggcaggatctggctgaagccacagaggggagatgggttctgcaggcccaggacatccttctgaggggaaggatgctgatgtcaccacgctggcctccctwacagctcctgacacgtggagtctggggctgggggcaacacaccatctgactgacagtccaagggtggctagggctggctctgcaagtttgcagggaggactgtccccacgggttgactctgacatgccctgtgacaccagccacctctacggtcccgggagtcctctactgccagttaatgtttcagcttttgtgggtaggactgcctgtcggtcagtagtttaattgcaacaaaggtttgtgctagaaaggcgaatattacattgcaagagcctttattatttgatgggactagggggg

SEQ ID NO: 46329 - DNA, 601 bp, Human
acccttggctgcctgtgtcaccctgggtggctttcccagcctctctacctgcttccttcttgacagcctgatggtggccatacgtcccttgggctgtggtgactgggcctctgggagctgcccttccacttctgcattttaacataaacctccttgacctcagctgctccattctctgctcccttccagccactcggattccagtcctgggggcctcctcactgaccatgccctccaccctcagtgctgttccctggtactctgcatggcttcctcacctgtatcccgtctttgctcagaygccacccctttagagacctccctgactgtgccctctgaaagagcaccttgtcactctctgtcccttctcccacttgtttacttgtatattgtgttcccactagaatgtcaactccaggagagcagagactcttgtcttattcactgctgtgtccctggtgcctagaacagtgcctggcacctgctaagtgcatattaaggagtcgttgctcactgggtagaagcattaaaaaaaaaaaaaaaaaaggctgggtgtggtggctcacgcctgtaatcccagcactttgggaggcaaaggtgg

SEQ ID NO: 46330 - DNA, 601 bp, Human
cagtgagccaagatcacaccaatgcactccagcctgggtgacagagcaagactctgtctcaaaaaaaaaaaaaaaaaaaaaaaaaaaaaagaattgttgagtgcatgaatgaataaaagaaagaaaatgactgggcacagtggctcacatcccagcactctgggaggctgaggtgggcagatcacttgagcccaggagtttgagaccagcctgggctatagtgagacctctgctctacaaaacatttttaaaattattgttttaaaataatttaaaaattatttaaaatgtaaaagggcgyggtggcatgtgcctgtggtcctagctactcaggaggctgaggtgggaggattgcttgagcccaggagttggaggctgcagtgagctatgatggggtcctagctactcaggaggctgaggtgggaggattgcttgagcccaggagttggaggctgcagtgagctctgattgcaccactacactccagcctgggtgacagagcaaaacctatgatgatagatagatagatagataagatagagcgagcaagaccctatctcaggtagatagatagatagatagatagatagatagacagaca

SEQ ID NO: 46331 - DNA, 601 bp, Human
caagactctgtctcaaaaaaaaaaaaaaaaaaaaaaaaaaaaaagaattgttgagtgcatgaatgaataaaagaaagaaaatgactgggcacagtggctcacatcccagcactctgggaggctgaggtgggcagatcacttgagcccaggagtttgagaccagcctgggctatagtgagacctctgctctacaaaacatttttaaaattattgttttaaaataatttaaaaattatttaaaatgtaaaagggcgtggtggcatgtgcctgtggtcctagctactcaggaggctgaggtggraggattgcttgagcccaggagttggaggctgcagtgagctatgatggggtcctagctactcaggaggctgaggtgggaggattgcttgagcccaggagttggaggctgcagtgagctctgattgcaccactacactccagcctgggtgacagagcaaaacctatgatgatagatagatagatagataagatagagcgagcaagaccctatctcaggtagatagatagatagatagatagatagatagacagacagacagacagacagatagatagatagattagattagatagatagata

SEQ ID NO: 46332 - DNA, 601 bp, Human
aaaagggcgtggtggcatgtgcctgtggtcctagctactcaggaggctgaggtgggaggattgcttgagcccaggagttggaggctgcagtgagctatgatggggtcctagctactcaggaggctgaggtgggaggattgcttgagcccaggagttggaggctgcagtgagctctgattgcaccactacactccagcctgggtgacagagcaaaacctatgatgatagatagatagatagataagatagagcgagcaagaccctatctcaggtagatagatagatagatagatagatagayagacagacagacagacagacagatagatagatagattagattagatagatagatagatagatatggttaagtgagtggactttggtcctggtcagacttgccacggaatcccagttctgatacactcgccgtgtgactgagggctgacatgtcttctctctgagcttcactctcctgcttcacacaccgtgtgaacggcaccctcctcgctgccttcttttgcaccaggatggagcctgcacgtaacactttgtagtggtctcactgctgtcctgtctccagcacggggcaccgatgagc

SEQ ID NO: 46333 - DNA, 601 bp, Human
ctcaggaggctgaggtgggaggattgcttgagcccaggagttggaggctgcagtgagctatgatggggtcctagctactcaggaggctgaggtgggaggattgcttgagcccaggagttggaggctgcagtgagctctgattgcaccactacactccagcctgggtgacagagcaaaacctatgatgatagatagatagatagataagatagagcgagcaagaccctatctcaggtagatagatagatagatagatagatagatagacagacagacagacagacagatagatagatagattagattagatagatagatagatagatatggttaagtgagtggactttggtcctggtcagacttgccacggaatcccagttctgatacactcgccgtgtgactgagggctgacatgtcttctctctgagcttcactctcctgcttcacacaccgtgtgaacggcaccctcctcgctgccttcttttgcaccaggatggagcctgcacgtaacactttgtagtggtctcactgctgtcctgtctccagcacggggcaccgatgagccagccagaagccgtccctgccggggggatgcttgacc

SEQ ID NO: 46334 - DNA, 601 bp, Human
ccactctgggtgaccagctgtggtgccccagggcagggacttgttgatctgggtttgttctggaggccagaagggtttcctggggactgggattggagcaggattgagagtgcctggtatgtggagagacctggctgttgtggcatgagtccgagggctcaggggccggctgcttcccggcctttgtcttccttgcaggaaacaggccaggagttacaaggggccagaggatgctgctgtggttatggtggaagttaacagctttgggaagtgtgcatgtgtgtgagtgtgtgtgtgtgttcacttgtgctcattgtaaagagagacggtaaagaaatgaggagagactgcaggcacatgcaaatacagagaaagctttcagttgtcaggatcgctctcccggtttttcctgcatggtggtgtaaaatctgacatgtgtacagaaaagtgtgtaaaacctccatgttcagtttaatgaataattataaagcaaacagccatgaaactaccacccagatcaagaagacaggcatcaccagctccctgaaagccctctccttcacctgcccttcccagtgctaacaaaaacattctcctccct

SEQ ID NO: 46335 - DNA, 601 bp, Human
ttaaggtatagagcatccattcagtcacaaggatccctcctaataccttctcatagctacacccttcccctgcccatccctaacctctggcaaccactcatctgtctattcccccattgttaggattttgtcaattcaagaatgttatgtaaatggagccacccagtatgcaccctttttgcattgactttatcccctcagcatgattctctggaggtgcatccgcattgtggtgctgatagtgactactgagtagtattccgtggtctggatgccccaccgtttgtttaaccatttcccrttggaggacatctgggtttttctaattttttggctattacagacaaagccactataaacctcgacaaacagggtttcgtgtgaatgtcagtttttgtttctctggggccaatacccagaggtacaattgctgggcagcgtgctggttgcatgttttaagaaaaccatcaaaaccattttctagagtggctgtaccatgttatattatcaccagcagcaggttccccacatcctcaccagcatttggtgttgtcactattttttattttagctcttctaataagtgtgcagtgataactca

SEQ ID NO: 46336 - DNA, 601 bp, Human
ctgcccatccctaacctctggcaaccactcatctgtctattcccccattgttaggattttgtcaattcaagaatgttatgtaaatggagccacccagtatgcaccctttttgcattgactttatcccctcagcatgattctctggaggtgcatccgcattgtggtgctgatagtgactactgagtagtattccgtggtctggatgccccaccgtttgtttaaccatttcccgttggaggacatctgggtttttctaattttttggctattacagacaaagccactataaacctcgacaaasagggtttcgtgtgaatgtcagtttttgtttctctggggccaatacccagaggtacaattgctgggcagcgtgctggttgcatgttttaagaaaaccatcaaaaccattttctagagtggctgtaccatgttatattatcaccagcagcaggttccccacatcctcaccagcatttggtgttgtcactattttttattttagctcttctaataagtgtgcagtgataactcattgtggctttaatttgcatttctctaatggtaatgatgttgattagcttttcacgtgcttatctgccat

SEQ ID NO: 46337 - DNA, 601 bp, Human
aagtctcagaaccctgtgccctgtcttaggtaccaaataagtttcttctgcttttttttttttttttttttttttttttttgagagagagtctcgctctgttgcccaggctggagtgggctcactgcagcctctgcctcctgggttcaagtgatgcttctgcttcagcctcccaagtagctgggactagggaggcgcccaccaccatgcctggctaatttttgtgtttttagtaggcacaggatttcaccatattggccaagctggtcttgaactcctgacctcgtgatccgcctgcctcrgcctcccaaagtgctgggattacaggcgtgagccaccacaccctgcctgctttttttttttccataaaagtttgatagttttacatttaagtctgtgatccattatgagttaatttttgtacaaagtataagttttggattaaacttctttttttcccccgtttggcatgtggatgtccagttgttccagccagcatttgttgaaaatgctgtctttcctctgttgaattgcttaggcttctttcacaagaatcagttaccacgatgagatactacatcacacctactaggatggctgct

SEQ ID NO: 46338 - DNA, 601 bp, Human
atctgggttacttgctgcagcgctgggagagggattcctctggcttcctctctcttttctctttttcaagattgagctcttgaaaaaagagctctgggagctggcattttggagctcctctagggttccgcgtgtagaagatggcactgtgttgggcctaggttcagagtcgtccttgacaccacctcatcctcagcccgtgtctgactcatcagcgagcattgccttttcttggtagacatagcccaggtctgtccccctctctccactgccactgtcctggctgcctcacagttgcccraacagcgctgcctccttgtcactcatcctcacgcccactcaggccccttgattccgtccttcacagggcaaccaaagttacatctgtaaaacccaggcctggaccaggtggagtggctcccacctgtaatcccagcacttggggaggccgaggtgggcagatggcttgagctcaggagttcgagaccagcctggacaacgtagtgagaccttgtctctaaaaaaaataaattaataaaaattaaaaaaatgtaaaaacccaggcctgtccttggcacccacgttgtctccccttgctctc

SEQ ID NO: 46339 - DNA, 601 bp, Human
cacctcatcctcagcccgtgtctgactcatcagcgagcattgccttttcttggtagacatagcccaggtctgtccccctctctccactgccactgtcctggctgcctcacagttgcccgaacagcgctgcctccttgtcactcatcctcacgcccactcaggccccttgattccgtccttcacagggcaaccaaagttacatctgtaaaacccaggcctggaccaggtggagtggctcccacctgtaatcccagcacttggggaggccgaggtgggcagatggcttgagctcaggagttcragaccagcctggacaacgtagtgagaccttgtctctaaaaaaaataaattaataaaaattaaaaaaatgtaaaaacccaggcctgtccttggcacccacgttgtctccccttgctctctcatgatctgcctccaccacaccgtccccgttcaggcctgctgcccacccatccctccagccagtgtgtgtccgctggactttcacattttttgcgtgtggtgcttgactataagcctgatggggtagggcccacactgcacttctgcccccgcacaggcggcacgtgacagacgtgcatta

SEQ ID NO: 46340 - DNA, 601 bp, Human
gggtagggcccacactgcacttctgcccccgcacaggcggcacgtgacagacgtgcattagatttctgtcggtggacgccatgaacgtgggaaggaggctgcctgtggccggagcaggtggttgggggcggagagtgtgcaaaaatgaggacagagaggtgggcgcgacctcggtgaggagacggctttagctctgtgggcctgagtaggtttttagcaggagaggatacaatcagattagatttacaaaggtctccctgacctagcagaaaaaggcaaaggctttgaatagacacttagyggaagaggacattctgatggcttttataaatatgaaaaatgctcaaccctactaaatagaaaaatacaaatgaaaactaggctgaggggggccacacctcacatatcagcagagatcagagagactggccacgccccgtgctgcaaggccgaggggagataggccctggcaccgccgaggggctgtgagtggggacaggcctcacgcagggccacttggcagtggtgaacttcactggacatttacccacagacaaacttgcacacctgtgaaatgacagctgcacacagtgagtgttgc

SEQ ID NO: 46341 - DNA, 601 bp, Human
gcaaaaatgaggacagagaggtgggcgcgacctcggtgaggagacggctttagctctgtgggcctgagtaggtttttagcaggagaggatacaatcagattagatttacaaaggtctccctgacctagcagaaaaaggcaaaggctttgaatagacacttagcggaagaggacattctgatggcttttataaatatgaaaaatgctcaaccctactaaatagaaaaatacaaatgaaaactaggctgaggggggccacacctcacatatcagcagagatcagagagactggccacgccccrtgctgcaaggccgaggggagataggccctggcaccgccgaggggctgtgagtggggacaggcctcacgcagggccacttggcagtggtgaacttcactggacatttacccacagacaaacttgcacacctgtgaaatgacagctgcacacagtgagtgttgccgcaccatttataagagcaaaagacaggaaaccaccactctggcccgatggggactggctccagacatcacggtccttccacacagctgccaaagcagcaaggcagtgctctgccaagatcaaggcagggaaagatca

SEQ ID NO: 46342 - DNA, 601 bp, Human
ttgagatggactctctgtcacccaggctggagtgcagtggcaccatctcagttcactgcaacctccgcttcctggtttcaagcgattctcccacctcagcctcccaagtagctgggattacaggcatgcgccaccacgcgcagctaatttttgtatttttagtagagacaaggtttcaccatgttggccaggctggtctcaaactcctgacctcaaggaatccacccaaagtgctgggattacaggcatgagccactgcgccggcccaacagctcatacattttaaattgtgcaccattcygagttatcgtgattttttttttttttgtagagacgaggtctccctatattgctcagctggtctcgaactcctgggctcaaatgatcctcctgcttcagcctcccaaagtgctgagattacaggcaggagccactgcacagcctcgtgatgaaatcttgagccatcccactctgtcccgcccgggacgtgaatcacctttcttaccccacatatccatggtgtatgtgctacccatctgtggctactcagtagctttctcggttctcacatccactgttgccgtatcacagtgcttatgtt

SEQ ID NO: 46343 - DNA, 601 bp, Human
ctggagtgcagtggcaccatctcagttcactgcaacctccgcttcctggtttcaagcgattctcccacctcagcctcccaagtagctgggattacaggcatgcgccaccacgcgcagctaatttttgtatttttagtagagacaaggtttcaccatgttggccaggctggtctcaaactcctgacctcaaggaatccacccaaagtgctgggattacaggcatgagccactgcgccggcccaacagctcatacattttaaattgtgcaccattctgagttatcgtgattttttttttttttgtagagacgaggtctccctatattgctcagctggtctcgaactcctgggctcaaatgatcctcctgcttcagcctcccaaagtgctgagattacaggcaggagccactgcacagcctcgtgatgaaatcttgagccatcccactctgtcccgcccgggacgtgaatcacctttcttaccccacatatccatggtgtatgtgctacccatctgtggctactcagtagctttctcggttctcacatccactgttgccgtatcacagtgcttatgttcaggtagcctttatttcacttaacat

SEQ ID NO: 46344 - DNA, 601 bp, Human
tcccaaagtgctgagattacaggcaggagccactgcacagcctcgtgatgaaatcttgagccatcccactctgtcccgcccgggacgtgaatcacctttcttaccccacatatccatggtgtatgtgctacccatctgtggctactcagtagctttctcggttctcacatccactgttgccgtatcacagtgcttatgttcaggtagcctttatttcacttaacattgtccccaaagtgcaagagtagcgatgctggcaatttggatatgccaaagagaagctgtaaagtgcttcctttargtgaaaaaggggaaagtattgaacctaataaggaaaagaaaaaaaattgtatgctaaggttactaagctttacagtaagaacgaaccttctatccatgaaattgcgaagaagggaaagaatttgtgctgggtttactgtcacacctcaaactgcgaaagtcaacagccacagggcataagggcttggttaagatgaaaaaggcattacgtttgggggggtggaagacaggaacagaaacgtgttccaactgatggcaatcgggttcaatgttatccacagtttcaggcatccattggggg

SEQ ID NO: 46345 - DNA, 601 bp, Human
ttcctttaagtgaaaaaggggaaagtattgaacctaataaggaaaagaaaaaaaattgtatgctaaggttactaagctttacagtaagaacgaaccttctatccatgaaattgcgaagaagggaaagaatttgtgctgggtttactgtcacacctcaaactgcgaaagtcaacagccacagggcataagggcttggttaagatgaaaaaggcattacgtttgggggggtggaagacaggaacagaaacgtgttccaactgatggcaatcgggttcaatgttatccacagtttcaggcatccattgggggtcttggaacatacgccttgcagataaggggaactgctgtatatatagttggccctgggtatcatgggccctcaggatcacgggttctgcacccacccattcaaccaacgaaggactgaaaatttactatggagggccagcttttccatccgcggttatggagggctgactgagggacgtgagcatccctggatgtggtacctcctgcgggggttctggagccaatctccctcagctaccgagggagaattgtatagatatatcaatttttttctttcaaatcataattataa

SEQ ID NO: 46346 - DNA, 601 bp, Human
tccgcggttatggagggctgactgagggacgtgagcatccctggatgtggtacctcctgcgggggttctggagccaatctccctcagctaccgagggagaattgtatagatatatcaatttttttctttcaaatcataattataaattgttaggatacacagtgaaaattgcataaaacataaatgtatagcaaaaccaattactataaagggaaaaatctatgtagccacccctccaggtgaagaaacagatggtgccagcctcccccaacccccaaaagctcccagtccctcccttccyccagaagcatccactctttttaattttaattttttttgagacagagtcccactccatcacccaggctgaagtgcagtggcacaatctcagcttactgcaacctccaccttctgggttcaagcaattctcgtacctcagccttccgagtagctggaatcacaggcatgtgccaccacacccggctaatttttgtgttttgttgttgttgttttatttttttgaaacagagtctcactctgtcacccaggctggagtgcagcggcaccatctcggctcactgcaaccttcgcctcccaggtt

SEQ ID NO: 46347 - DNA, 601 bp, Human
taaattgttaggatacacagtgaaaattgcataaaacataaatgtatagcaaaaccaattactataaagggaaaaatctatgtagccacccctccaggtgaagaaacagatggtgccagcctcccccaacccccaaaagctcccagtccctcccttcccccagaagcatccactctttttaattttaattttttttgagacagagtcccactccatcacccaggctgaagtgcagtggcacaatctcagcttactgcaacctccaccttctgggttcaagcaattctcgtacctcagcctyccgagtagctggaatcacaggcatgtgccaccacacccggctaatttttgtgttttgttgttgttgttttatttttttgaaacagagtctcactctgtcacccaggctggagtgcagcggcaccatctcggctcactgcaaccttcgcctcccaggttcaagtgattctcctgcctcagcctcccgagtagctgggattacaggcgcctaccgccacgccacgccaatttttatatttttagtagagacggagcttcaccatgttggtcaggctggtcttgatctcctgacctcaggcga

SEQ ID NO: 46348 - DNA, 601 bp, Human
acagtgaaaattgcataaaacataaatgtatagcaaaaccaattactataaagggaaaaatctatgtagccacccctccaggtgaagaaacagatggtgccagcctcccccaacccccaaaagctcccagtccctcccttcccccagaagcatccactctttttaattttaattttttttgagacagagtcccactccatcacccaggctgaagtgcagtggcacaatctcagcttactgcaacctccaccttctgggttcaagcaattctcgtacctcagccttccgagtagctggaatyacaggcatgtgccaccacacccggctaatttttgtgttttgttgttgttgttttatttttttgaaacagagtctcactctgtcacccaggctggagtgcagcggcaccatctcggctcactgcaaccttcgcctcccaggttcaagtgattctcctgcctcagcctcccgagtagctgggattacaggcgcctaccgccacgccacgccaatttttatatttttagtagagacggagcttcaccatgttggtcaggctggtcttgatctcctgacctcaggcgatccactcgccttggcc

SEQ ID NO: 46349 - DNA, 601 bp, Human
cctccaggtgaagaaacagatggtgccagcctcccccaacccccaaaagctcccagtccctcccttcccccagaagcatccactctttttaattttaattttttttgagacagagtcccactccatcacccaggctgaagtgcagtggcacaatctcagcttactgcaacctccaccttctgggttcaagcaattctcgtacctcagccttccgagtagctggaatcacaggcatgtgccaccacacccggctaatttttgtgttttgttgttgttgttttatttttttgaaacagagtcycactctgtcacccaggctggagtgcagcggcaccatctcggctcactgcaaccttcgcctcccaggttcaagtgattctcctgcctcagcctcccgagtagctgggattacaggcgcctaccgccacgccacgccaatttttatatttttagtagagacggagcttcaccatgttggtcaggctggtcttgatctcctgacctcaggcgatccactcgccttggcctctcaaagtgcagggattacaggtgtgaaccaccccacctggccttaattttaattctctaaaaatgtagagat

SEQ ID NO: 46350 - DNA, 601 bp, Human
ggtgaagaaacagatggtgccagcctcccccaacccccaaaagctcccagtccctcccttcccccagaagcatccactctttttaattttaattttttttgagacagagtcccactccatcacccaggctgaagtgcagtggcacaatctcagcttactgcaacctccaccttctgggttcaagcaattctcgtacctcagccttccgagtagctggaatcacaggcatgtgccaccacacccggctaatttttgtgttttgttgttgttgttttatttttttgaaacagagtctcactcygtcacccaggctggagtgcagcggcaccatctcggctcactgcaaccttcgcctcccaggttcaagtgattctcctgcctcagcctcccgagtagctgggattacaggcgcctaccgccacgccacgccaatttttatatttttagtagagacggagcttcaccatgttggtcaggctggtcttgatctcctgacctcaggcgatccactcgccttggcctctcaaagtgcagggattacaggtgtgaaccaccccacctggccttaattttaattctctaaaaatgtagagatggggtt

SEQ ID NO: 46351 - DNA, 601 bp, Human
gtgaagaaacagatggtgccagcctcccccaacccccaaaagctcccagtccctcccttcccccagaagcatccactctttttaattttaattttttttgagacagagtcccactccatcacccaggctgaagtgcagtggcacaatctcagcttactgcaacctccaccttctgggttcaagcaattctcgtacctcagccttccgagtagctggaatcacaggcatgtgccaccacacccggctaatttttgtgttttgttgttgttgttttatttttttgaaacagagtctcactctrtcacccaggctggagtgcagcggcaccatctcggctcactgcaaccttcgcctcccaggttcaagtgattctcctgcctcagcctcccgagtagctgggattacaggcgcctaccgccacgccacgccaatttttatatttttagtagagacggagcttcaccatgttggtcaggctggtcttgatctcctgacctcaggcgatccactcgccttggcctctcaaagtgcagggattacaggtgtgaaccaccccacctggccttaattttaattctctaaaaatgtagagatggggttt

SEQ ID NO: 46352 - DNA, 601 bp, Human
tgtgttttgttgttgttgttttatttttttgaaacagagtctcactctgtcacccaggctggagtgcagcggcaccatctcggctcactgcaaccttcgcctcccaggttcaagtgattctcctgcctcagcctcccgagtagctgggattacaggcgcctaccgccacgccacgccaatttttatatttttagtagagacggagcttcaccatgttggtcaggctggtcttgatctcctgacctcaggcgatccactcgccttggcctctcaaagtgcagggattacaggtgtgaaccaycccacctggccttaattttaattctctaaaaatgtagagatggggtttcacaatgttggccaggctggtctcgaactcctggcctcaagtaatcctcccgcctcggcatcccaaagtgctgggattacaggcatgagccaccgtgcccagtccaactctcctgacttttgaggccatcatatgcttgcttttctctctgtttgccacctctgtatgcagcctgaagcagtttccttttgcctggctttgaaccttaaagtccgaggatggagtattgttcgatgtttttgcctcttctgt

SEQ ID NO: 46353 - DNA, 601 bp, Human
tgttggtcaggctggtcttgatctcctgacctcaggcgatccactcgccttggcctctcaaagtgcagggattacaggtgtgaaccaccccacctggccttaattttaattctctaaaaatgtagagatggggtttcacaatgttggccaggctggtctcgaactcctggcctcaagtaatcctcccgcctcggcatcccaaagtgctgggattacaggcatgagccaccgtgcccagtccaactctcctgacttttgaggccatcatatgcttgcttttctctctgtttgccacctctgyatgcagcctgaagcagtttccttttgcctggctttgaaccttaaagtccgaggatggagtattgttcgatgtttttgcctcttctgtgtggcgtcttctttgatgctcatccacatgtagctgtagtcattcattcattcattctccctatcatgtgcggtgccatggagccttcattcaccacctcctggggacgagcatttgtcttgtttctagtctcttctcgcgtgtgctccctgccccatgggcctgcgttatgctggagtgtgtacccaggagagctcttgctaggtcaagcgt

SEQ ID NO: 46354 - DNA, 601 bp, Human
cacacgtaggatctctcagaaaggaaaagaaaaaacctgaaagtctagtagcggttgcctccagggctgagctgggccagggtggaaggaggacatcctgtcacagtttaccctttggtgccttttgtcttttgaaccgtgtgcctgtattacaaagacagagagaaggaaaagaaggaaaaggggtagatgagtgtaaatgtggtaaagtgagaatcactgagaatcgcccagtgcagctccctctccgtccattggggacctcgtttcctgtggctgtccagagctgtccaatccccayccactccccgccagagcccaaacctgcccgtctggtttgcagagctgccccacgtggctcctctgcgggtggttactcgacaaatgccccaccccccaccccatggggaggcagtggcctgagatctgggacttctggatctaggcccctagacctgccctgctgtggtccagagcctggcccagcccctccttggacttcctcctcactgtgacagggggtggacagaggtggagatgggagttccaggccctgagagcaagcgctggcctcccagcccacgttctgtgtgtggagata

SEQ ID NO: 46355 - DNA, 601 bp, Human
gcagctccctctccgtccattggggacctcgtttcctgtggctgtccagagctgtccaatccccatccactccccgccagagcccaaacctgcccgtctggtttgcagagctgccccacgtggctcctctgcgggtggttactcgacaaatgccccaccccccaccccatggggaggcagtggcctgagatctgggacttctggatctaggcccctagacctgccctgctgtggtccagagcctggcccagcccctccttggacttcctcctcactgtgacagggggtggacagaggtggrgatgggagttccaggccctgagagcaagcgctggcctcccagcccacgttctgtgtgtggagataacatctgcccttgaggagttggctgcaggggcaggggtgtgccagagcagggtagtgggaaggacccaggtgcgtctgtctgctgtgtgccggggcgcttgctcactgttgtccctggattcaccatggcctgggtgcccatcctgggtccgggcacccagcagccttggtccctaccgcctaccagactggagtccctggtagagcccctctagggtgtcaactcccgtgggca

SEQ ID NO: 46356 - DNA, 601 bp, Human
atgccccaccccccaccccatggggaggcagtggcctgagatctgggacttctggatctaggcccctagacctgccctgctgtggtccagagcctggcccagcccctccttggacttcctcctcactgtgacagggggtggacagaggtggagatgggagttccaggccctgagagcaagcgctggcctcccagcccacgttctgtgtgtggagataacatctgcccttgaggagttggctgcaggggcaggggtgtgccagagcagggtagtgggaaggacccaggtgcgtctgtctgcygtgtgccggggcgcttgctcactgttgtccctggattcaccatggcctgggtgcccatcctgggtccgggcacccagcagccttggtccctaccgcctaccagactggagtccctggtagagcccctctagggtgtcaactcccgtgggcaggaagttttgtggagtttgttcagtgctgaactatcagggcctcccacaggtgtgcctggtatgtgcctggagctcagtgaatgaatgagaggcgggcaagctgcagacagtgacagcctgggtgctcagggctggcatggggaggtgc

SEQ ID NO: 46357 - DNA, 601 bp, Human
agacctgccctgctgtggtccagagcctggcccagcccctccttggacttcctcctcactgtgacagggggtggacagaggtggagatgggagttccaggccctgagagcaagcgctggcctcccagcccacgttctgtgtgtggagataacatctgcccttgaggagttggctgcaggggcaggggtgtgccagagcagggtagtgggaaggacccaggtgcgtctgtctgctgtgtgccggggcgcttgctcactgttgtccctggattcaccatggcctgggtgcccatcctgggtcygggcacccagcagccttggtccctaccgcctaccagactggagtccctggtagagcccctctagggtgtcaactcccgtgggcaggaagttttgtggagtttgttcagtgctgaactatcagggcctcccacaggtgtgcctggtatgtgcctggagctcagtgaatgaatgagaggcgggcaagctgcagacagtgacagcctgggtgctcagggctggcatggggaggtgcagggtggagtgcacagggctggagcccagaggatacctgacccagcctggggtggcagggagggctt

SEQ ID NO: 46358 - DNA, 601 bp, Human
tgtggctgggtatgtatctgcatgtctgtgtgatggtcttaggactcggctctatgtggtgtcagctgcggacatcttgcatgctctggcatgtcctcacatgcatctgtgtctagggatcatgcatgtgtgtatgcatgtgtgtgagtgtgcatgtatgtgagcatgtatttgtgagcgtgtgtgtgagcatgcatgtgtgtgtgtgcatgtgtgtgcatgcatgtgagcattgtgtgagtgcgtgcgtgcatgtgtgagcgtgcgtgtgtgcacatgtgtgcatgtttgtgagtgtgcrtgtgtgtgagcgtgcatgtatgtgcatgtgtgggtgtgcgtgtgtgtgcatgtgtgtgcgcgcatgtgtgagcatgcatgtgttgcgggatggcttcgctcgctgctgtgtgttgggtctgtgaggagaggccgtggttgctgcctggtgtatgtcctggcgtctgtgcacggccttgtgtgttgcatggcaggggaggtagacagtgagagggcttgggtgctggagcctgagaggggcagggcctctttcctgccacatcacccccttccccctgcccagcctcaggcgaggaataaa

SEQ ID NO: 46359 - DNA, 601 bp, Human
atctgtgtctagggatcatgcatgtgtgtatgcatgtgtgtgagtgtgcatgtatgtgagcatgtatttgtgagcgtgtgtgtgagcatgcatgtgtgtgtgtgcatgtgtgtgcatgcatgtgagcattgtgtgagtgcgtgcgtgcatgtgtgagcgtgcgtgtgtgcacatgtgtgcatgtttgtgagtgtgcatgtgtgtgagcgtgcatgtatgtgcatgtgtgggtgtgcgtgtgtgtgcatgtgtgtgcgcgcatgtgtgagcatgcatgtgttgcgggatggcttcgctcgcygctgtgtgttgggtctgtgaggagaggccgtggttgctgcctggtgtatgtcctggcgtctgtgcacggccttgtgtgttgcatggcaggggaggtagacagtgagagggcttgggtgctggagcctgagaggggcagggcctctttcctgccacatcacccccttccccctgcccagcctcaggcgaggaataaatgacgtctgctctgatttcccaggccgtatgggctcccacacactctctgttgtggtgtccatccccaccctgagtacctctggggggtgaagggcaccagcag

SEQ ID NO: 46360 - DNA, 601 bp, Human
ggctggtctcgaactcctgacatcaggtgatccacctgcctcggcctcccaaagtgctgggattacaggcatgagccactgtgcccggccatggacctgcagtttgaaggaagaggaagggataacaaggtgaaggttgagggggcagggggctcttcaggacccaggctaagggcacagtccatgcagaggcctggtggcggggacggcgctatacctggaggaacgaaggagagcagggctgccccctccaccctccacagacgctgctgaatccaggccccacttccaaaggcgtccmccccactggatctgtgtctttatgggcttttacccattgtgggggctcatggatttccagaggcaccccccatgtgatttggcttttgccaggatacgctgccacttcctgagattcccagcgtaggccatgtggctgggtgggcccccctgcagtggggagggcctgggcgttcacagtgggggtaccttttgtggtgctgggacacacaccagcttacttgctgaacagccagattcagtctctgaagacccattttctccccaggcgtcaaggtcagacttccagggagtgagtgta

SEQ ID NO: 46361 - DNA, 601 bp, Human
tggtctcgaactcctgacatcaggtgatccacctgcctcggcctcccaaagtgctgggattacaggcatgagccactgtgcccggccatggacctgcagtttgaaggaagaggaagggataacaaggtgaaggttgagggggcagggggctcttcaggacccaggctaagggcacagtccatgcagaggcctggtggcggggacggcgctatacctggaggaacgaaggagagcagggctgccccctccaccctccacagacgctgctgaatccaggccccacttccaaaggcgtcccccscactggatctgtgtctttatgggcttttacccattgtgggggctcatggatttccagaggcaccccccatgtgatttggcttttgccaggatacgctgccacttcctgagattcccagcgtaggccatgtggctgggtgggcccccctgcagtggggagggcctgggcgttcacagtgggggtaccttttgtggtgctgggacacacaccagcttacttgctgaacagccagattcagtctctgaagacccattttctccccaggcgtcaaggtcagacttccagggagtgagtgtacga

SEQ ID NO: 46362 - DNA, 601 bp, Human
aggcgtcccccccactggatctgtgtctttatgggcttttacccattgtgggggctcatggatttccagaggcaccccccatgtgatttggcttttgccaggatacgctgccacttcctgagattcccagcgtaggccatgtggctgggtgggcccccctgcagtggggagggcctgggcgttcacagtgggggtaccttttgtggtgctgggacacacaccagcttacttgctgaacagccagattcagtctctgaagacccattttctccccaggcgtcaaggtcagacttccagggartgagtgtacgaggcccagggacttgtgtctgtctcggccccatccccgtgccctgcgcctcctcagggaccaggctcattactttggtaatggcatcacccatttgttccacagatatgtctcgagcacctactgtgttccagccactgctctagatgccggcaagaaccagacagacagacaggtccctgccctcagggcactgacattctgctgggggcactgccagtcagtaggtgtaggatgccagggggtggtaagtgccacagagacataaaaagcgaggtgcacattttgttc

SEQ ID NO: 46363 - DNA, 601 bp, Human
agaaaggctgagcagtgcagttctggctgagggaagataggtgcagaggcccggaggctggaacagctgtgatgagtccaagacatacacggaggcagccagcgcggctggagagaagcgaggggaggagatgaggtttgcgaggttggcagggccctcccagtcagggccgtgttgaatcagtgtttgagccaaagtgggaagccctgtagaactgtgtgtgtacatttgtgtaatgtcttcagattcccttctaaccacggtggcttttctggtcttggtctggtcattgtcagggacrttgtcccttcctgtttttgtcccataaacctccaaggtcctttctttagagtggaggccttggctggagccgggaccactggggaacaggaggctgggggatgttgacttgccttctctgtgggacagagtggctgcttttgtgacctggcactggatagccctgggcagtgagttcccctctcggcctcagtttcctggtttggggaacaggaaggaagaggactccccacccagcacccagcactgtttagagggctccgcgtggcctggtctgtgtgcctggcacagcctgggcaag

SEQ ID NO: 46364 - DNA, 601 bp, Human
agactctggggatgtgtcggtcccaaacctgaggactccttggaggaacgaggctcagtgtgggaggcctgaagagagatgtggttagaggagggttgggggccgtgcaggatgggggcaagagctaagccaaggtttggaggcaggaatggcttgggggactcaggacagcgaggagcctgctgtgccgggacgggaagccaaactcccagcgcctccaccatcaaagcacatgccagaaggtaggaggtaaactgaggcagggaggggccctcccagagctggtaggtgaagattgtgkcagggtggtgagtgggacccaatggtggaaggctgagtgcaggctggaggcagtgagcggtctgggtccccttcctgattcgagtttcattttggtaatgatgaaaggatgcctgtggtcctggccacctcccctgctctgcccctgggcccctgtgttctgggtgggccagccccctcccttccaggggcagcagctttgatcagagcctggagggggcggggcaggaggtaagggtttttgcacgctcacgtctgctgacactgacagctttgtcgcacggtggatcttgcttttcca

SEQ ID NO: 46365 - DNA, 601 bp, Human
gggccgtgcaggatgggggcaagagctaagccaaggtttggaggcaggaatggcttgggggactcaggacagcgaggagcctgctgtgccgggacgggaagccaaactcccagcgcctccaccatcaaagcacatgccagaaggtaggaggtaaactgaggcagggaggggccctcccagagctggtaggtgaagattgtggcagggtggtgagtgggacccaatggtggaaggctgagtgcaggctggaggcagtgagcggtctgggtccccttcctgattcgagtttcattttggtaaygatgaaaggatgcctgtggtcctggccacctcccctgctctgcccctgggcccctgtgttctgggtgggccagccccctcccttccaggggcagcagctttgatcagagcctggagggggcggggcaggaggtaagggtttttgcacgctcacgtctgctgacactgacagctttgtcgcacggtggatcttgcttttccatttgggccagttaaccttgtgggggagaatgggggtggtgggacccttttcctcccagaaaaggtcagaggatgcagggggtgactggaaaatctgaag

SEQ ID NO: 46366 - DNA, 601 bp, Human
aggacagcgaggagcctgctgtgccgggacgggaagccaaactcccagcgcctccaccatcaaagcacatgccagaaggtaggaggtaaactgaggcagggaggggccctcccagagctggtaggtgaagattgtggcagggtggtgagtgggacccaatggtggaaggctgagtgcaggctggaggcagtgagcggtctgggtccccttcctgattcgagtttcattttggtaatgatgaaaggatgcctgtggtcctggccacctcccctgctctgcccctgggcccctgtgttctggstgggccagccccctcccttccaggggcagcagctttgatcagagcctggagggggcggggcaggaggtaagggtttttgcacgctcacgtctgctgacactgacagctttgtcgcacggtggatcttgcttttccatttgggccagttaaccttgtgggggagaatgggggtggtgggacccttttcctcccagaaaaggtcagaggatgcagggggtgactggaaaatctgaagtgtctgctaggccaggtcaacgctgcctgtcccgcatgttaaagaattcaaaagattttttaaaa

SEQ ID NO: 46367 - DNA, 601 bp, Human
gaattatacacacacacacaagcacgccatatatgtggtaagagccctgaggaaagataaagcagagacaggtgtagagggcgacaggacaggagcagggcttgtgagcacaggcgggcctgggaagtcagggaaggtgggagatcagtgagaggagagttccaggtggggcactcgcccatgcaaaggccctgaggtggaaccatgtctaggatttgaggaacagcagggggacctgtgtggccagggcacagtgagtacaggggtgcttgggagaagaggagggcagcatggtgatggkcgcatcctgtggggactctcaggccacgaggaggcattttgggggccagcaaagggtttaaggctgtgaactctggagtgggcaggactctggaatgggcaggactctggcttccaggcccagctctgctcggtgagcttagtgagagattttacctttgtgagtctctgtttccacagctgcaaaatggggctcagaatggccactccaccgtggttgagggcgcctgcgagctcagcgtcagcgtctgctctgggccatgggtcccttgtggtggtggcgatggtggtgggagtaccg

SEQ ID NO: 46368 - DNA, 601 bp, Human
aaagcagagacaggtgtagagggcgacaggacaggagcagggcttgtgagcacaggcgggcctgggaagtcagggaaggtgggagatcagtgagaggagagttccaggtggggcactcgcccatgcaaaggccctgaggtggaaccatgtctaggatttgaggaacagcagggggacctgtgtggccagggcacagtgagtacaggggtgcttgggagaagaggagggcagcatggtgatgggcgcatcctgtggggactctcaggccacgaggaggcattttgggggccagcaaagggtktaaggctgtgaactctggagtgggcaggactctggaatgggcaggactctggcttccaggcccagctctgctcggtgagcttagtgagagattttacctttgtgagtctctgtttccacagctgcaaaatggggctcagaatggccactccaccgtggttgagggcgcctgcgagctcagcgtcagcgtctgctctgggccatgggtcccttgtggtggtggcgatggtggtgggagtaccgagctgagcctcaggccacatttggtgggaggggttggttttaagcatctttcctgctg

SEQ ID NO: 46369 - DNA, 601 bp, Human
atttgaggaacagcagggggacctgtgtggccagggcacagtgagtacaggggtgcttgggagaagaggagggcagcatggtgatgggcgcatcctgtggggactctcaggccacgaggaggcattttgggggccagcaaagggtttaaggctgtgaactctggagtgggcaggactctggaatgggcaggactctggcttccaggcccagctctgctcggtgagcttagtgagagattttacctttgtgagtctctgtttccacagctgcaaaatggggctcagaatggccactccaccktggttgagggcgcctgcgagctcagcgtcagcgtctgctctgggccatgggtcccttgtggtggtggcgatggtggtgggagtaccgagctgagcctcaggccacatttggtgggaggggttggttttaagcatctttcctgctgcacaggcccatgggaaaggctggtgtacagccattggggaggtgggggccccggggcccactttgtgcttcctcccactacccgtggggtccaggacaggtcacacaggagggagggaccctcactcagcagagactaggcaggagaggaaaggc

SEQ ID NO: 46370 - DNA, 601 bp, Human
tgccctctgtgcagtgcccagagggaaggggtggccccaggcaaatatccggaggcgtgccccttgcccccttcccttgggggtttatgggtgggagggcaggaggccaggcgtcggaggacatcccccagaccccatgctgccagctgggccagccgcccgccctccaggctgctcttgccccgtccccaggtgtcccccacctcagggtctgccccgctgtccgccctccgggcttagtgaggggtcacatggctgatcctcttcccgtggctctgggaactgcctagtgccccgcagyggggagggagcgggatggggcggggcgacaggttcacgatgaagaggcctgggctgggcatggggccaaagggggtggagggacatctgggaggacggagaggccggaggacatgggacgcagatctggaatgacagcaggcagagtgggcaaatggggactgttggggtatgtggatgaccctgggagctgggcctagaaagccatgagagagtaggtcagggccaccaggggtgggctgggctggaaggccacgagggaggggtgggcagcactcagggcgccagcattgggctcaga

SEQ ID NO: 46371 - DNA, 601 bp, Human; identical to SEQ ID NO: 33288

SEQ ID NO: 46372 - DNA, 601 bp, Human; identical to SEQ ID NO: 33289

SEQ ID NO: 46373 - DNA, 601 bp, Human; identical to SEQ ID NO: 33290

SEQ ID NO: 46374 - DNA, 601 bp, Human; identical to SEQ ID NO: 33291

SEQ ID NO: 46375 - DNA, 601 bp, Human; identical to SEQ ID NO: 33292

SEQ ID NO: 46376 - DNA, 601 bp, Human; identical to SEQ ID NO: 33293

SEQ ID NO: 46377 - DNA, 601 bp, Human; identical to SEQ ID NO: 33294

SEQ ID NO: 46378 - DNA, 601 bp, Human; identical to SEQ ID NO: 33295

SEQ ID NO: 46379 - DNA, 601 bp, Human; identical to SEQ ID NO: 33296

SEQ ID NO: 46380 - DNA, 601 bp, Human; identical to SEQ ID NO: 33297

SEQ ID NO: 46381 - DNA, 601 bp, Human; identical to SEQ ID NO: 33298

SEQ ID NO: 46382 - DNA, 601 bp, Human; identical to SEQ ID NO: 33299

SEQ ID NO: 46383 - DNA, 601 bp, Human
cataaatgaaaaaagagaatcttgccactgagagttataaacctgtcccgtatttgttaaattggaataccatccagtctattattttatcttcaagggagttgctgctgctatcagtcagaaactcggattttatttagggatcacaaatggtgcagggagagaaaagaaaaagttaactgtatacattataaacattgggcctactcgtcatatgtagagacaggagcaaatgaagtctcttttttttttttttttttttgagacggagtctcgctcagtcacccacgctagagtgcartggcgcgatctccgctcactgcaagctccgcctcctgggttcacgccattctcctgcctcagcctgctgagtagctgggactacaggcgcccgccaccgtgcccagctaatttttttattttattttattttttagtagagacggggtttcaccgtgttagccaggatggtctccatctcctgacatcgtgatccgcccgccttggtctcccaaagttttgggactataggcgtgagccaccgcgcccggctgcagatgaagtctcttatcctgcgtagaattgtagtttgtagtctgca

SEQ ID NO: 46384 - DNA, 601 bp, Human
tcacgcctgtaatcccagcacttttggaggccgaggcgggtggatctcttgaggtcaggagtttgagaccagcctggccaacatggtgaaaccctatctctactaaaaaagtacaaaaattagctgggcgtggtggcaggcgcctatagtcccagctactcaggaggctgaggcaggagaatcacgtgaacctgggaggcagaggttgcagtgagccaagttcacgacactgtattccagcttgggcaacagagggagactctgtctcaaaaaaaaaaaaggaaaaaggaaaaaaaatgtrtatatatataaatactctttattttttcagaaaaagacattttggtgacatgccacaacagaactgtgttatataataatccttcaccagcagattatgatatatagaaggattttttcacgttaaagcttttgctactctccctcccatgaaagaacagagaacagagttacttgtctgaaagtactgcagggacctctggaaagaaagattgccagaaacttttattattacaaatcctaccaaatcagaaggttctagaatccaggctgtcttgagagctgacaatcctgacaactc

SEQ ID NO: 46385 - DNA, 601 bp, Human
atttggcctttggtttttattggcatgacaaagcaatacaatatttatttggagggagggggcagctaggcactaggatttcagttggtaagggaaaatacactgagtacctcctgcgtgccaggcaccatagggaaatgacacagacccttcttgcccagaccttagtacccagttgaggcagcaaggcctacacagccactgaaaataggtggcctgcccagggaaggctatgtgtgggcatgtcgggttagttatgttagagtaggttgtagtgattaggagctcaggctctgggaayctgggctacagtcaactccagctcctccgcttccttagttggactttgggcatgtgagtcacttctccacattctttctgcaaaagagggagcaccttcctgatcaggttgtgagaaatgaacaccgggcgtagtgcatgctggataagtgtcagctgtcatcatttaactagaccccagagaatgagtggaactaaagcagtggcatgaggtaaggaaggacttgaaggtggaaatatgcatattgtattccgagaaaggagaaaacttgtctggtctagctgagggcttgagggacca

SEQ ID NO: 46386 - DNA, 601 bp, Human
gactgtaaagctgactctcattctgggtgcttttcccagctgaaccatttagcaacccaccctcatagtgggagccttccgcactcagctgaatgaaattgaaaatctacgattgcacttcagtagggtccatgaatagtggctttgtctgtaaagagttgttgttgcacatggtctctgtctcccagtgccatgcgtttgcaaagacgagatcaggatcggcagggtcttattttaaagccaaaaaacaggctggggagccttgttccacaaagtatgccttttggtcatgctgaaatgsctgcgtttggtgtgtttgactgtggatttaaaaagaagacattattggctatttacccttctatctgatgtgttcttattttggtgctaaaaaaaaaaagacaaaacagaatgataaagaaaatctttcactcactgcagcaaccacatgacaagacaacctattgaaaagctaaccaattcaatcatgcattgtttggtctataaggcaccaagtaaccagtttgacagtttgtgtccccccctagtgaattggcttatttcattggattcagtgaattggctggttgttgtggctttg

SEQ ID NO: 46387 - DNA, 601 bp, Human
tccaccacctggtgatactgaaatacctttgtagggactcaaattattccagctctagtcaggaatcacctttgcttataaggcaaaggccttccaaatggattttctacagcatttgagagaagcaagcaataagaactgacccatagcgttggaaagtccaaattcagtgtgtgttgaacttcaggcaagtgttcatgaaaatgtacctggaactagtgggccctcctcgctgtttggctccagatcacactggccacgagttgtcttctcgggggggtggatccgcggtcaccagacktcatgccttaatagaacaaaaagctatggtctgcgctgggcgcggtgggtcacacctgtaatcccagcactttgggaggccgaggcaggcacatcacttgaggtcaggagttcgagaccagcctggccaacatggcgaaaccccgtctctacaaaaaatacaaaaattagccaggtgtggtggtggacgcctataatcccagctactcgggaggctgaggcaagagaatctcttgaacccgggaggcagatattgcagtgagccaggatcatgccactgcactccagcctgggcaacaga

SEQ ID NO: 46388 - DNA, 601 bp, Human
ttgttagaacacaccagcatcatcttgttcctagtattaagagggtgggggaatgtaagattgaaatttgttgtctgtttcctagaaccatggttagaaggaggctttaaggtgattaggaatagcttctttgcagcttccatttctgttccttcacagcggtttatttggaagcctgttttattgaacagtgctgttagtttcaacaggcatattctgtaggatttgagattgttaaaaacttcaatgatagaagatggatgaatgtgatttaagtacagatgctctttggttattcagmttgtatagctaaccttttaaactccaaatgtaaaacttttcgacttttaaccttttaaactttaaattaaaaaaaaataggaaacattttaagtggggagagcattgtttgaatcattgttatctggttgcaacaatgtgtgaaacagaggcactcagcccctcttccccaccccgcccctcctcccggagacacagtcttgctctgtcgcccaggctggagtgcaatggcacaatctcggctcactgcaacctctacctcctgggttcaagtgattctcccacctcagcctcctgagta

SEQ ID NO: 46389 - DNA, 601 bp, Human; identical to SEQ ID NO: 28131

SEQ ID NO: 46390 - DNA, 601 bp, Human; identical to SEQ ID NO: 28132

SEQ ID NO: 46391 - DNA, 601 bp, Human; identical to SEQ ID NO: 28133

SEQ ID NO: 46392 - DNA, 601 bp, Human; identical to SEQ ID NO: 28134

SEQ ID NO: 46393 - DNA, 601 bp, Human
ttaagaaacctccccccttcccagggcacaagaaaacccagaggagaagatgggtaacctcacaagctccagagctaagttccatcactaacagaagttggatagttgctatttttcatcctgcaatgggatagtagttctccatgtgcaagatacgcggggcgggaatactggcggggctttcacttggggtaatggaaaccaaagtgaggagaggtcaacaccttgagtaacccagatctccaaaaccggggcagggtgaggggtggtgggggtggtgaaggagacaagtaaaggagtsaaaactcctcgaagtcatcgcaaagagaaagctaacacctctaggagccacggggccattccttgcagcagcaccctgctccaagtgtggggtgcctgcctcggagggcaaaaagcgcagggtgcccttagttcagttgagtagctccggggacccgggcagcgagagggcaggggcatccgccggccgggaggcggactcgcactttgcctcaactctgagccccatcccgagcgcaagggagagggcggcggagggcacggtactcactagggctcgttggtgaatcggggggtccgg

SEQ ID NO: 46394 - DNA, 601 bp, Human
tctccctcattcccatgtattatcataaatacccaactccccattatccacatgtggcaatttctacctcttttagtcacccacttctgaccacttaaggcactggagcaaggtacagaaggcacataaagccagttcacagaatgagggaaaaagtcaagaaaaggaggcaaggatattactattttacactatttacattaggatcccccacagaagcagagataatgagagatgattatactcatagacacacacaaaatttaattacatcaatgtatattaaaatttgaaacatacyagtcatagaaatagccacctgcttagttagctagaaaagatagtttacttacattatgtcccagtggaagaacaagttggtaaattattctatttatactggaagtttacaggccaacgttgatatgaaacatatatgtacataaacacacatacctacaaggcaaatgtgcccagcctatttatctctgtaagaaatcctgccaaaccaaaaatgcactattttattcgttaaattcctattagtccacagtatactgtcaaatacacagatggcactcaaatggtagttgacagtgct

SEQ ID NO: 46395 - DNA, 601 bp, Human
caaaaacccgtctctacaaaaaatttacaaaaattagccaggcatggtgttgtgcgcctgtagtcctaggtacttgggaggctcaggtgggaggatcacctgagcctgggaggttgaggctgcagtgagctgtgattgtgccactgccctccagcctgggtggcagagtgagaccctgtctcaaaaaaaaaaaaaaaaattagagcatgtatgcaaagttacttaacgtcatcttctctgtcctcccattccaccagctccttccggtttcataaattcattggccatctggagaccttarttaaaaaaaatcatgaggctaatccctagtatcctacattagttactactgaattttgataccagttcaagggtccttttggggtatctgattatctttgatagccaggaggcccacaaggtgcttcaatactaaattacgttcataagttaatagtttcttgagctccaatagacaactaagtagaattttcaaccactggttaaaagagataatggtcttactgccaatgattctgtcaattatgagaccagctactatcatgtgagagataggtgagtttaaacagtttgccttctt

SEQ ID NO: 46396 - DNA, 601 bp, Human
aaaaagggcaatgggagttgccaagatggccgaacaggaacagctccagtctgcagctcccagcatgaccaatgcagaaggtggatgatttctgcatttccaactgaggtacctggttcatctcattcggactggttggacagtgggaacagcccacggagggcgagctgaagcagggcggggcgttgactcacccgggaagcgcaaggtgttgggggatttccctttcctagccaagggaagccgtgacagactacctggaaaagcgggacactccctgcccaaatactatgcttttacsaaggtcttagcaaccggcagacaaggtgattctctcccgtgcctggctcggcagctcccacgcccacggagccttgcttactgctagcacagcagtctgagatgcatctgcgaggcggcagcctggctgggggaggggtatccgccattgctgaggcttgagtaggtaaacaaagcagccaggaagctcgaactgggcggagcccacctcagctcaacaacgcctactgcctctagactccacctctgtgggcagggcacagctgaagaaaaggcagcagacaacttctgcagacttaaa

SEQ ID NO: 46397 - DNA, 601 bp, Human
aagtctgacccccattcgtcttgctgcaacgacccctacaccttagctacctcactctgtaatcaacgttgtgaggttgttggggctgggggttgggttcttggtctgagaattatgggggtctggacacttggacttctaacctggaaggggactgtgggcttgaggtggggtgtggggcaggaatggctaggttctccaaggagtcaagatctggtgactgcgggggccccagtgtgcctgagtcttgggtctggggctcgaaactgtagggtgggactcctggatccccaggccttcmgggctgggcaaggtgcctgggaagggccagtcctgggtttggggaggtgtgaggtgcacgtggggtggggcagggccaacagggaaagggactgggagtgttgagaggtggaggcagggtggctggaggtatcagttgtgagatgcggaaggcagagacccaggtgggaaatggagggttccaggtagtgggggtgatcccagctggacctctgcagaactcagtctggggacctgatttaagggaaccacctacagaccaattgtacaaaccaactacagttgttttgggggcacatct

SEQ ID NO: 46398 - DNA, 601 bp, Human
ggggtcctgggttgggtctgggactagaaacttggcttctggcttcacactgccttcctctgctccctgtcacacccttctccagagacaataaggaaatgaaagaggagaaattccagtctcctggtgtgggggtgcgggtcccccaagggcttccccccaatctcagccccaccctgtcaggggagatccggctcagacccggacaccaggggttcatcccagccccggggcgtgggaaagcctagggtggattagggcagctggagtgcttgaggtcggacctcaaggaggacttccrggtgggtggggagccagaaaggagggccctggggtccctgtctgtcttactctgcaataccagagagcctgactgggttgcagaaatggggggtggaggtatagggggatttggaaactctgtggacccctctaatccatcaccttctcacctcatcccttttctttttctggggaggggacccgaagccaccaaccagcgggagagcctgcatgggggaagggagtaactgtggctgcaatttcactgtaagacttggggtgagggggaatggatttgttgaagggagggagatagata

SEQ ID NO: 46399 - DNA, 601 bp, Human
actagaaacttggcttctggcttcacactgccttcctctgctccctgtcacacccttctccagagacaataaggaaatgaaagaggagaaattccagtctcctggtgtgggggtgcgggtcccccaagggcttccccccaatctcagccccaccctgtcaggggagatccggctcagacccggacaccaggggttcatcccagccccggggcgtgggaaagcctagggtggattagggcagctggagtgcttgaggtcggacctcaaggaggacttccaggtgggtggggagccagaaagkagggccctggggtccctgtctgtcttactctgcaataccagagagcctgactgggttgcagaaatggggggtggaggtatagggggatttggaaactctgtggacccctctaatccatcaccttctcacctcatcccttttctttttctggggaggggacccgaagccaccaaccagcgggagagcctgcatgggggaagggagtaactgtggctgcaatttcactgtaagacttggggtgagggggaatggatttgttgaagggagggagatagatagatagatagatagatagataga

SEQ ID NO: 46400 - DNA, 601 bp, Human
atgctgcagcttccagagaagtcttagatttgaagatatatagtaaatggataatattattaggttgaaaagtgatttctgatattcaaacacttttatgtataaatacagtaatttatttttatttatttattttttttttttgagacagagtcttgctctgtcgcccaggctggagggcagtggtgcaatctcggctcactgcaacctccaccttctgggtgcaagcaattctcctgcctcagcctcctgaatagctgggactacaggcgcccgccaccatacctggctattttttgtrtttttagtagagacagggttttgccatgttggccaggctggtctcgaactcctgacctcaagtgatccacctgcctcggcctcccaaagtgctgggattacaggtgtgagccactgtgcccagcctaaatgcagtaattttataagctaaaagattgaagagagctacacatatatgttagatatgttagattattacagagttataataacttttttttttttttttgagacagaatctcactgtcgcccaggctggagtgcagtggcatgatctcagctcactgcaagctccaccttc

SEQ ID NO: 46401 - DNA, 601 bp, Human
tttgtgtttttagtagagacagggttttgccatgttggccaggctggtctcgaactcctgacctcaagtgatccacctgcctcggcctcccaaagtgctgggattacaggtgtgagccactgtgcccagcctaaatgcagtaattttataagctaaaagattgaagagagctacacatatatgttagatatgttagattattacagagttataataacttttttttttttttttgagacagaatctcactgtcgcccaggctggagtgcagtggcatgatctcagctcactgcaagctccrccttccgggttcacgccattctcctgcctcagcctcccaagtagctgggactacaggcgttcgccaccacacccggctaattttgtttttgtatttttagtagagacagggtttcaccgtgttagccaagatggtctcgatctcctgaccttgtgatccacctgcctcggcctcccaaagtgctgggattacaggtgtgagccaccgtgcccggcctataataactctttatgattactaaaattgagaactgctgatttacctaataaaccagcagttattaaatgttttggtctcagg

SEQ ID NO: 46402 - DNA, 601 bp, Human
cgccattctcctgcctcagcctcccaagtagctgggactacaggcgttcgccaccacacccggctaattttgtttttgtatttttagtagagacagggtttcaccgtgttagccaagatggtctcgatctcctgaccttgtgatccacctgcctcggcctcccaaagtgctgggattacaggtgtgagccaccgtgcccggcctataataactctttatgattactaaaattgagaactgctgatttacctaataaaccagcagttattaaatgttttggtctcaggaccaccccccttcttttttttttttttttgagatggagtcttgctctgttgtcctggctggagtgtgcagtggcatgatctcagctcaccgcagcctcagactcctgggctcaagcgatcctcctgcctcaacctcccgagtagctgggattacagtcctgtgccacgatgccggctgatttttgtatttttggtagataacagggttttgccacgttgccaggctggtcttgaacttctgacctcaagtgattcaccctccttggctcccaaagttctgggattactttgggaggctgaggcaggaggattac

SEQ ID NO: 46403 - DNA, 601 bp, Human
aggatcacttgagccccagagtttgaggctacagtgagctgcgattgcaccactgcacttcagcctgagtgacagagtgagaccctgtagaaaaaaaaaattatttaggagtccaaacagtttctgttgatgtgggttatgtctatctacgtttacagtatttacaattaaaactgagaaatattacaaacatgtattcatttaaaaatagcaatcatttgttagtgtaaaagatttttattaaaaaaaccaaatttcaaaaaatttagtcaaaagagcgacactgtttttttccattttygcaaatcaagtctggcccagtggaagacagctggattctcctggttgcttcttcattctctctgttggaatatcaacaccccctggaaaactccactgtacacttcatgagaaagagagtgaaaagggctaataataacttaggattgcgggtgtggtggctcatgcctgtaatctcagcactttgggaggccgaggcgggcagatcacgaggtcaggagttcaagaccagcccggccaacatggagaaaccctgtctctactaaaaatacaaaaaaaaaaaaaaaaaagctggcgtggt

SEQ ID NO: 46404 - DNA, 601 bp, Human
agaaaaaaaaaattatttaggagtccaaacagtttctgttgatgtgggttatgtctatctacgtttacagtatttacaattaaaactgagaaatattacaaacatgtattcatttaaaaatagcaatcatttgttagtgtaaaagatttttattaaaaaaaccaaatttcaaaaaatttagtcaaaagagcgacactgtttttttccattttcgcaaatcaagtctggcccagtggaagacagctggattctcctggttgcttcttcattctctctgttggaatatcaacaccccctggaraactccactgtacacttcatgagaaagagagtgaaaagggctaataataacttaggattgcgggtgtggtggctcatgcctgtaatctcagcactttgggaggccgaggcgggcagatcacgaggtcaggagttcaagaccagcccggccaacatggagaaaccctgtctctactaaaaatacaaaaaaaaaaaaaaaaaagctggcgtggtggcacacacctgtaatcccagctgctctggaggctgatgcaggagaattggttgagcccaggaggcggaggttgcattgaggtgagat

SEQ ID NO: 46405 - DNA, 601 bp, Human
tctctgttggaatatcaacaccccctggaaaactccactgtacacttcatgagaaagagagtgaaaagggctaataataacttaggattgcgggtgtggtggctcatgcctgtaatctcagcactttgggaggccgaggcgggcagatcacgaggtcaggagttcaagaccagcccggccaacatggagaaaccctgtctctactaaaaatacaaaaaaaaaaaaaaaaaagctggcgtggtggcacacacctgtaatcccagctgctctggaggctgatgcaggagaattggttgagccyaggaggcggaggttgcattgaggtgagatcacgccactgcactccagcctgggcgacagagcaagactctgcctcgaaaaaaaaaatagcattattttgaaaatagttttgacttcgtggacatcctcaaagggtttcagagactgccctgggagtcccgaaccctggagaatcacttaaaggatgatgttgagtgtatgggagcatggtgggtgggaaagcagggggcagaaagggcgtgtccagggagtgaggagagaccttgagagactgctttctacagatagaggtaatgatgga

SEQ ID NO: 46406 - DNA, 601 bp, Human
tcttcatcaccgccatcccggtgagactcctggcggcgtggcagcctcgtggccacagccagcacccctccctccagccctttggatgaagcttagcgggcgcttcctcaccgcgcacctgtgacccctcgttgagctcattatgggctgaagctcggagaggggaatgcttcccccgtggctaggaaagtagaacttcagcaatgcccacatctcagaggggcaaggccaccagcccacagggtctggaatgagcaaaggcgctgccacccctctctgtgtgtcgttattcctgagtcastcaccccaaaagtcggttatcgaacgtttgattttctttgaaataccatgaatttcattcattcactcattcattcaacaaactttttttttttttttttttttgagacagagtctggctctttcgcccaggctggagtgcagtggcgccatctcggctcactgcaagctccgcctcccgggttcacgccattctcctgcctcaccctcccgagtagctgggactacaggcgcccgccgccacgcgcggctatttttttttgtatttttagtagagacggggtttcaccgtgttagccag

SEQ ID NO: 46407 - DNA, 601 bp, Human
gggagcctctgagtcttgcctagttgagcagcagcccccatccctgtcctccacagccttcagtgcagtcctacagggcagcctcttcgggcagctgggcaccatgccctccacctacagcaccctcttcctcagcggccagggcctggctgggatctttgctgcccttgccatgctcctgtccatggccagtgagtgcacttgggtggctggagggctggggtggcctctgaggtttggggaagagagagggcatgtgagagcaagacacatgggttctgggtgaagatggaggtaagcrggtgatatggaaatggggattgggtctggggctagggagtggggctcatgggccctgcagtgaggagtaataaccaagtgaggactgggttaactcagggacaggggcaggattcctggggctaatactggcatgtggcagcaggttgaagttgaaggataaggggatgggtttgggattcagatagtcttgggtttgaatctgcttcaccgcttaccagctaggggtgttggacaaggcttgtcacctctctgtgctagcttccccaccgacgtgattggtatagctccctgctcagat

SEQ ID NO: 46408 - DNA, 601 bp, Human
tttgtcagtgaagggaggagcggaagaggctgggagtgggtctgagaagtacacaatgggaagtgggacaagagttggaagccccgtgggagccggcgggaccaggtgcctctcttctgcagctgaagttcctccgcaggtggcgtggacgccgagacctctgccctggggtactttatcacgccctgtgtgggcatcctcatgtccatcgtgtgttacctgagcctgcctcacctggtgagcctgctgttgggctcgaggccccacctcaaagcatcttggatagagtcctgagcctgargccctgagagaggccaggggaggtggaggagacctggtctcagccctgacccccagagaagacactgaggggccccagcctccaggccaatggtatggggagggatccagacacctcaggcaagccaggcaggcccaacactttcctgtccttctgcagaagtttgcccgctactacctggccaataaatcatcccaggcccaagctcaggagctggagaccaaagctgagctcctccagtctggtaagccctgagaccctcctggggaggtgggagatgcagaggaagctagagccacc

SEQ ID NO: 46409 - DNA, 601 bp, Human
tgttttggggtgagggggttgttgttattttgagtcaggatctcactctgtcacctaggctgcactgcagtgctatcacaactcaactgcagcctcgacctcctgggctcaagtgagccacctcagtctcccgagtagctgggactataggtgcaggctgccatgcccggctaatttttttatttttgtagaaatggggattcaccatgttgcccaggctggtctcgaactcctgggctcaagcaatatgcccgcctcggccttccaaaatgttgggattacaggcgtgagccaccatgcygagctgaggatcacttgttttaactgctgggaatctcccttcgttgggcctggctgtcgggaaacctgggtcacaagcatgacccttccccgtcccccctcaccccagatgagaacgggattcccagtagtccccagaaagtagctctgaccctggatcttgacctggagaaggagccggaatcagagccagatgagccccagaagccaggaaaaccttcagtcttcactgtcttccagaaggtttggcttggatacagcccccaaccaccatctttggggaagaatggggctcacattg

SEQ ID NO: 46410 - DNA, 601 bp, Human
acagccatggtgaccagctccaccagtcctgggaagtggagtgagtgtcagggtggagaagacggcagggcagggggtacaaaggggagaggacgggagaggggagttggagaccagtatgagctgcagccgtttccctcccaggtcagttcttcaaccccatctgctgcttcctcctcttcaacatcatggactggctgggacggagcctgacctcttacttcctgtgggtaagcacaccagggctgggtgatccgatgttttaggaagcagtttgggatccgagggcttgaaagagcayggaggtgattttctggtagtccaaatggcctggtaatgcaaccactggccaagcagcagggagcacttgggccctggaggcgtgcaggccagggcttgcactgtgagctccctgaaagcaaaaatcatgtccagctgacctctgtgtccccagcatccagcctttgctgctcagagaatgttacatggaggttcctgcaccaggtgagggactgagcaagagtcttagttttggggttggttttagccatggtactgtatctttaaatgaaatcttccaaagagacaatacataacgcag

SEQ ID NO: 46411 - DNA, 601 bp, Human
gtcctgggaagtggagtgagtgtcagggtggagaagacggcagggcagggggtacaaaggggagaggacgggagaggggagttggagaccagtatgagctgcagccgtttccctcccaggtcagttcttcaaccccatctgctgcttcctcctcttcaacatcatggactggctgggacggagcctgacctcttacttcctgtgggtaagcacaccagggctgggtgatccgatgttttaggaagcagtttgggatccgagggcttgaaagagcatggaggtgattttctggtagtccaartggcctggtaatgcaaccactggccaagcagcagggagcacttgggccctggaggcgtgcaggccagggcttgcactgtgagctccctgaaagcaaaaatcatgtccagctgacctctgtgtccccagcatccagcctttgctgctcagagaatgttacatggaggttcctgcaccaggtgagggactgagcaagagtcttagttttggggttggttttagccatggtactgtatctttaaatgaaatcttccaaagagacaatacataacgcaggtgaaagaggagctggtctcatcca

SEQ ID NO: 46412 - DNA, 601 bp, Human
caggcgtggtggctcacacctataatcctagcactctggggctggacgcggtggctcacacctgtaatcccagcactctgggaggccgaggcgggtggatcacgaggtcaggagttcgagaccagcctggccaacatggtgaaaccccgtctctactaaaaagataacaattagcaggtgtggtggtgcacacctgtaatcccagggaggcagaggctgcagtgagccgagatcgcaccactgctctccagcctgggagacagagcgagactctgtctcaaaaacaaacaaacaaaaaaamccctaaaatccgagcactttgggaggccaaggcaagaggatcgcttgagctcaggagttcaaaaccagcctgggcaacacagtgagactttgtctgtacacacacacacacacacacaaatttttaatgaagaaaatagaggccgggtatggtggctcacgcctgtaatcccagcactttgggaggctgaggcaggtggatcactcgaggtcagaagttcgagaccagcctggccaacatgatgaaacctggctctactaaaaatacaaaaattatctgggcatggtggtggcgggcgcc

SEQ ID NO: 46413 - DNA, 601 bp, Human
gctacctggtgtccctcaccatgtgcctggcgcccaggtccggggcaatggggtggggtggggggctgggagtagggaggtgggttcagtctttgggaagggaccgcctgcaatggagggacggcccatcctgcttctggccagcccaaccctagctgtctgcaggccttgctggcgccccctactgggccaagccttaactgcaggggagagaactgggctagggaggtacccgcccaaccaagtagcccaggcactggttctggggccgcctcaatgtgcctcagtttccccatctgtaaaaaaaaatgggttgaactgtcatccctcagggcccatctaactgtaaaattctcagttgaaggagagctaaggttttgaccaaaaacaaggtcatgggctatttcctcaaggggcaatggagtggagaatccagagagaatgaagctggcagggcagacaggctgagagcactgtggaaagggcaggctgtggaatctggaatcccatcatgttagactcagaggccctgagagacatccttatccagcagcctcatttacagaccaggaaactgaggcccagaaagaaggggccagtt

SEQ ID NO: 46414 - DNA, 601 bp, Human
tcagtttccccatctgtaaaaaaaaatgggttgaactgtcatccctcagggcccatctaactgtaaaattctcagttgaaggagagctaaggttttgaccaaaaacaaggtcatgggctatttcctcaaggggcaatggagtggagaatccagagagaatgaagctggcagggcagacaggctgagagcactgtggaaagggcaggctgtggaatctggaatcccatcatgttagactcagaggccctgagagacatccttatccagcagcctcatttacagaccaggaaactgaggcccrgaaagaaggggccagttatggtgacagaggggttgggtcagagcccagactggatgggcagagggcagtggagctgggtccagatttagacccagcattttctaagagctcctgttcccgggtgttctaggcaggtgctgccacacgagagggaggtggccggcgccctcatgaccttcttcctggccctgggactttcctgtggagcctccctctccttcctcttcaaggcgctgctctgaagtggcccctccaggctctttggcagcctcttctcgacgtctccttccggagctgaga

SEQ ID NO: 46415 - DNA, 601 bp, Human; identical to SEQ ID NO: 32218

SEQ ID NO: 46416 - DNA, 601 bp, Human; identical to SEQ ID NO: 32219

SEQ ID NO: 46417 - DNA, 601 bp, Human; identical to SEQ ID NO: 32220

SEQ ID NO: 46418 - DNA, 601 bp, Human; identical to SEQ ID NO: 32221

SEQ ID NO: 46419 - DNA, 601 bp, Human; identical to SEQ ID NO: 32222

SEQ ID NO: 46420 - DNA, 601 bp, Human; identical to SEQ ID NO: 32223

SEQ ID NO: 46421 - DNA, 601 bp, Human; identical to SEQ ID NO: 32224

SEQ ID NO: 46422 - DNA, 601 bp, Human
tgtttttacattccaaataaaaacatttgaagaccacacatttccttaactgatttcacaaccctttgctggacttttagagttttcccaaagttttgcttttataaatagggctgagattaatgctttggagcataaattttcttctcagtttgaactattttatctagaatagagtccaagaagcagagcagcaaagaatatgaagacttttaaagctcatggtaagttttttgttttttttttgagacagagtctcactgtcacgtaggttggattgcagtggcacagccatagctcygaaacctcaaactcctgggcacacgccaccaagctcagctaattttattttattttatttttattttttggagatggagtttcgctcttgtcgcctaggctagagtgcagtggcatgatcttggctcactgcaacctccacctcccgggttcaagtgattctgcttcctcagcctcccaagtagcccaactaatctaaaaattttttgtagaagactgggcgtggtggctcatgcctgtaatctcagcactttgggaggacgaggcaggtgaatcacgaggtcaggagtttgagaccgac

SEQ ID NO: 46423 - DNA, 601 bp, Human; identical to SEQ ID NO: 36411

SEQ ID NO: 46424 - DNA, 601 bp, Human; identical to SEQ ID NO: 36412

SEQ ID NO: 46425 - DNA, 601 bp, Human; identical to SEQ ID NO: 36413

SEQ ID NO: 46426 - DNA, 601 bp, Human; identical to SEQ ID NO: 36414

SEQ ID NO: 46427 - DNA, 601 bp, Human; identical to SEQ ID NO: 36415

SEQ ID NO: 46428 - DNA, 601 bp, Human; identical to SEQ ID NO: 36416

SEQ ID NO: 46429 - DNA, 601 bp, Human; identical to SEQ ID NO: 36417

SEQ ID NO: 46430 - DNA, 601 bp, Human; identical to SEQ ID NO: 36418

SEQ ID NO: 46431 - DNA, 601 bp, Human; identical to SEQ ID NO: 36419

SEQ ID NO: 46432 - DNA, 601 bp, Human; identical to SEQ ID NO: 36420

SEQ ID NO: 46433 - DNA, 601 bp, Human; identical to SEQ ID NO: 36421

SEQ ID NO: 46434 - DNA, 601 bp, Human; identical to SEQ ID NO: 36422

SEQ ID NO: 46435 - DNA, 601 bp, Human; identical to SEQ ID NO: 36423

SEQ ID NO: 46436 - DNA, 601 bp, Human
tccagttactgggagtcagcaaagacagccgcccagaacctgtacgagaagacatacctgcccgctgtagatgagaaactcaggtagcacctgcccctggagaaatggggtctggcccataccaccgactgcatccaggacccagaagttcaggccccagcccctcctccctcagacccaggagtccaggcctcagcccctcctccctcagacccaggagtccaggcccccagcccgtcctccctcagacccaggagtccaggcccccagcccctcctccctcagacccaggagtccaggyccccagaccctcctccctcagacccaggagtccaggcccccagcccctcctccctctaaccatctgtgctttctccccagggacttgtacagcaaaagcacagcagccatgagcacttacacaggcatttttactgaccaagttctttctgtgctgaagggagaggagtaacagccagaccccccatcagtggacaaggggagagtcccctactcccctgatcccccaggttcagactgagctcccccttcccagtagctcttgcatcctcctcccaactctagcctgaattcttttcaa

SEQ ID NO: 46437 - DNA, 601 bp, Human
tataaaaattagctgggagtcacggtgggcgcctgtaatcccagctactcgggaggctgaggcaggagaattgcttgaacccaggagacagaggttgtagtgagctgagatcgcaccactgcactctagccttggcaacagtgcaagactgtctcaaaaacagcaacagagagcaggacgtgagacttctacctgctcactcagaatcatttctgcaccaaccatggccacgtttgtggagctcagtaccaaagccaagatgcccattgtgggcctgggcacttggaaggtaaatatgcaratctttgcacacccttcttctctggaggggcgtttgggtgttttctctttctgcattcagccaggaaagcctggaggtcgggcaggggttggagaggtaagattcagccctggagccaggacttaggttgctttcttttctcagagctgattcaggctgcaaagctccaaggctggctttcccagcagtgatgagagcttctctagcaagtatcaaatttcaagcagctgttggacttaaaactgttttccagggcagtttctctctctggttctaggacacttaattgggctcaacgtt

SEQ ID NO: 46438 - DNA, 601 bp, Human
agctccaaggctggctttcccagcagtgatgagagcttctctagcaagtatcaaatttcaagcagctgttggacttaaaactgttttccagggcagtttctctctctggttctaggacacttaattgggctcaacgtttcccccaagtcttggctgtgggtttgttgtgggctgggtggttgaggagaggatgcagagcccgaagtccttggcacccctttgcagatcacggtgtgagacttgggctagcagcatccctatgacctggaaacttgctagaaatgcaaactggccaggtgtsgtggcttatccctgtaatcccagcactttgggaaatccagacgggagggttgcttgagcccaggagttggagaccagcctgggcaacatggcaagaatccatttctacaaaaaataaataaattttctgggcatggtggcacgcacctgtagtcccagccacttgggaggctgaggtggagattgagtgttgagcctgaggggtcaaggctgcaatgagcagtgattgtgccactgcactccagtctgggcaacagagtgagatccaagaaagcaagaaagagagaaagagagagagaga

SEQ ID NO: 46439 - DNA, 601 bp, Human
gctccaaggctggctttcccagcagtgatgagagcttctctagcaagtatcaaatttcaagcagctgttggacttaaaactgttttccagggcagtttctctctctggttctaggacacttaattgggctcaacgtttcccccaagtcttggctgtgggtttgttgtgggctgggtggttgaggagaggatgcagagcccgaagtccttggcacccctttgcagatcacggtgtgagacttgggctagcagcatccctatgacctggaaacttgctagaaatgcaaactggccaggtgtgktggcttatccctgtaatcccagcactttgggaaatccagacgggagggttgcttgagcccaggagttggagaccagcctgggcaacatggcaagaatccatttctacaaaaaataaataaattttctgggcatggtggcacgcacctgtagtcccagccacttgggaggctgaggtggagattgagtgttgagcctgaggggtcaaggctgcaatgagcagtgattgtgccactgcactccagtctgggcaacagagtgagatccaagaaagcaagaaagagagaaagagagagagagaa

SEQ ID NO: 46440 - DNA, 601 bp, Human
agtctgggcaacagagtgagatccaagaaagcaagaaagagagaaagagagagagagaaagaaagagagacagagagaaacaaaatgcagagtctcaggctccaacccaggctacctaatgggcatctgcactttaacaagatccctacgtggttcctgtacacattgaaatctgcaacatgctggggctgcagagagcctgggctgggagtcgtgagcaccacccggctgtgttaacgacagctggcaaaatgtggtaaggcacatccaggactcagtgaggcaggttcccgagcctctsttaggctaagtttcaagttgttccatcaccacctccctctgccttctttgccatttccatccatgatagcactaccctaactagtgatgagaagcagtctttggagttcctcttctctcctgtccctcatggctaatgtccctgctgagacttctgcctctggctctctttccttctgtgcaccctgatttttcttctcttctgtcccaagctagaggttaggaccctctgctgcagcactgggtcatcctcaggatacattcttggtgtatctggaggaacagatcacttccagcttga

SEQ ID NO: 46441 - DNA, 601 bp, Human
tggtagggtagctgtgcatctctgttttgtgtactgttcaatgtttgttatctcacaattgaagaggtttaaaagaccattttgtgagagatcaagttttaagtgcttttttgcccccatcattggcttggctaggttagaacaaaatgtgataattctatttcccttcttttctttttttctttcttttcttttctttccttcccttctttctctccctctctgtcattcccctccctctctctttctttttacaggagtggaaaacaaactctattcctataaggttttctatttctcytttttttctgaaacgatcattgtataatgatggcctctactgaaccttactgtgtgtcaggtaatgtgcaaaaagcttaatattcattgcagcatctcatcaccacaaaggcctcatgaggctggtgctatttttttttccattttgcatacaaggtttacagagattgaatcacctgcttagacccacacacccagtaagtgatcgaatccagattgatggtgtaatgaccattatccagatccttatcaccatttggggaaattgtctgaaaatcccttggggttatttagagtcaag

SEQ ID NO: 46442 - DNA, 601 bp, Human
ttcatctgggtcttcagaaagttgtagtggagcggtctgcacccccacacacctgaagacatttcaggactaacctggatgaaaagggaactgacttttagctaggataggacataaggacataatcataaaataattcactttccttcttttcttttgaaaagttttgtaaagtgtgtatcctcccagagatcccctggcaaaggagaccccagtgaggccttggtttggagaaactgggccttgtggggcagcctgttgaaggtggcctggggataagagaatatgatggttgctgagwgtggtgtaattccagctactcgggaggtgggagggttgcttgaacctgggagtgtgaggccagcctgggcaacacggcagggccccatctcttaaaaaaaacacatatgtgatgagcttttcttttgcctttcagtctcctcttggcaaagtgaaagaagcagtgaaggtggccattgatgcaggatatcggcacattgactgtgcctatgtctatcagaatgaacatgaagtgggggaagccatccaagagaagatccaagagaaggctgtgaagcgggaggacctgttcatcgtcagc

SEQ ID NO: 46443 - DNA, 601 bp, Human
ttggaaaatgcatacatctggtaggacaaatagacctcactgtgtagcagccaagtctggataaagcctttgtaaaattatcacttggggccttataggcttgataagggacctatcagataggtcagataaaggaccatctgctcccaaaggcctaagaatgcttgacatttaaaagctacacacaattcctgctctcagagagcctacagctgaggaagagactgagacaggtaaacaaatttcaaatctgtggccacatttacttcaatgatctgagacacgtatagagtactaggasagttgaaaaagtcaattgcttttaacacttaagacatgtcattgaggtgctgagccctggtgatgttccacactgtgtcgtggatcttaatcagctttgttacaaatggcttgtggtgggttagatgaggatgcaaatcaaaaagcagggacaatgagtacaatgtggcccttccttttcccagtattaatagctcattgctacactctttgcagttgtggcccactttctttgagagaccccttgtgaggaaagcctttgagaagaccctcaaggacctgaagctgagctatctggacg

SEQ ID NO: 46444 - DNA, 601 bp, Human
agtcaggatcctgaaaccttgttgaacagaaccaagtgtcctgatgcagattccagtaaacttttcattctgtgttcacagtctggggatgaccttttccccaaagatgataaaggtaatgccatcggtggaaaagcaacgttcttggatgcctgggaggtaggttcccagcttcctctaagtgtgctgggagagaaatcttcagttatccatgagattcgcatggatatgaatgaggccatgtgcctgatgctttctaatttcatcattgtgattttctagctcttctaatatcttcctyatcacctttggcttttgggtacatctgatactatttatatttcaaggctaatagtcttcaaataagactggaaatacaatgtaccccactttggggaatacacatgctgttctcaaaccagggcgaggcatttggaacaggaggtttgggcctgggtgtgctcatagcagctgagtaacctagggtcagttttgtaactcatgtagggctcagttttctcttcttaaaaagaagttgtataatacatactaccaatatatatcttccagtgtgtgataaagattaagatggtttacatgc

SEQ ID NO: 46445 - DNA, 601 bp, Human
tgataagatttttttatcttaactcttatgatgccatgaagtatggcaagtatgtcaatgtagcctgcttctcgcagtgctgttttttgaatgaatacaagaacgactgctaaataaaacatttgaaaggcatgaaaagatagcagtgatcaagatcagaggctctgatttgaaatgagcaggcttgaatatgtaagcgttggatgtttatgtagacccacaaccagttcagtagaaacctcactgaccacattgaagcagagaggaggaaaaatgtataaagaagtcaagttctaatacwggaaaactaacctgacctatgtgcacaaaaacttttaaattatctaattgccccatctgaaattttgggaaacctaatgatttcacagcttctaaattctactgcccaatttggataacatcatatatcctagtggttctcaacgtggctatgcattagaatcacctgaggagtttaaaaatcccaacgtctaggctacaactcagagaaaatctgtaagaaactctggggggtgaaatccaggcactggtaatttttttttttaatttagagagagtctctctctgttgcccaggctgg

SEQ ID NO: 46446 - DNA, 601 bp, Human
ctcagcctctggtaatatatatcagaaacatatatattattagtaggtattataagactttttttaagaagagaaagctaaggcctacaagagttaaaaaacttaccctaggttactcaaacctaggcccaaaacccctgttccaatcctcctgtcacctcccaaagtgctgagattacagtcatgagccactgcatccagccagtattttttaaagctccctggtgattccaaattgcagccaaagttgagaagggctggataaagtgttccctgaacatgtcgtgcttatccctgcctytgagctttgctcctgccttcctgtgtcatatgctcatgttttttccctcttttctgtctttttttttttttttttttttttcttttgaggcccagcttatactctacctgaaggactcccctgacaactgcgggctgtatgtatctcttctttctctgccctttctgactctgtctatgccgctgtgatgttatctgaggcagcctcagtgtcatgattgatggctccatagaagggaactctagcactttaattggactataagaatcccagaaaaagggagcacattgtatacattta

SEQ ID NO: 46447 - DNA, 601 bp, Human
ttcctgtgtcatatgctcatgttttttccctcttttctgtctttttttttttttttttttttttcttttgaggcccagcttatactctacctgaaggactcccctgacaactgcgggctgtatgtatctcttctttctctgccctttctgactctgtctatgccgctgtgatgttatctgaggcagcctcagtgtcatgattgatggctccatagaagggaactctagcactttaattggactataagaatcccagaaaaagggagcacattgtatacatttacatcctgacaacttctgrgcaggatctggaacatgtaatagatggctactaaatacatattgcactggaggctgctgctaacatgtatggtatctttgggcaagtttggaaaatgcccaatataggctaaaaattatacaaagattcccttccttgcgtgtccatgcagtttctgtaccaggaagcatggctggatatgcaaacagtgggtcaggcttcagtcccacacaactccatggccgggtgcccctatcagggtgtaatctgaatgcatgaccttcctgcaaaccaaagcatgcttagtgtgggagagaggga

SEQ ID NO: 46448 - DNA, 601 bp, Human
taggctaaaaattatacaaagattcccttccttgcgtgtccatgcagtttctgtaccaggaagcatggctggatatgcaaacagtgggtcaggcttcagtcccacacaactccatggccgggtgcccctatcagggtgtaatctgaatgcatgaccttcctgcaaaccaaagcatgcttagtgtgggagagagggactcaggacccacaagtgaggcttctccgtatgctgcagcctcttcctgactaacacagcttgcccaggtttgggtgtgcaatgcacacacacaacagcagctccctgctatcatttggattcattaaaaattaaatcatctcataagcttacaaatgttgatttttatttactttttatttttttgcattacaaaactttcatatttcccctgtgtacagaagtttaattttttatgtgtttcttcacgtgtaaggtgagagtggcaagaacataaaatctttacctgttactcctagtttttcttgcgctggggaggggcagtagggctggaaccagtcactgatgggcacccaggccctggactaaaatttcctgtgaatgcttcggctaaccctgttacggt

SEQ ID NO: 46449 - DNA, 601 bp, Human
gggtggtagtgggactgatcctttatacagggtgtgtaaagggaggctttgctgtgagggatataccatatgcatatttgggggaagagcattcttggcggtgataacagcaggtgcaaagtccctgaggtgggattgtgtttagaacattcaagcaagaaggccagggaggctggattaaatcatctccaaatgcctcttaaaggaggtggtgctaactttacttaaaatcttagataagtggtgaaaaaaagctttcactctggctgggcaggcattctaaatcatctctttacaagcwatactttctgaataatgtatctaattaaatgtatcaaaaagagttgtctggcatttattactgccagatctgtaattcaatgaggatttgaatctctttcaatgtttctatagccaaaaacgatttttcaccttttaaaaatgatttcggctgggcgtggtggcccacggctgtgatcccagcactttgggaggccaaggtgggctgatcaagaggtcaggagatcaagaccatcctggctaacatggtgaaaccccgtctctaccaaaaattagctgggcgtggtggtgggcacctgta

SEQ ID NO: 46450 - DNA, 601 bp, Human
gctacttagagcaaaaaggaagggtgaacgtaaagtgggactcacccccaaactaaactgcttaccttcctatgagcatcatttctggcaatgggtagcaatggaggcaatgggttggtgggctctgcagtaaatccacctggcctcaaatccaactttaacactggtttattagctgtgtgacattgggcaaatttcctagtttttccaagttggtttcttcacttataaagtaggatgataatactaatcgcagctaacatccattgaaccttagcttagaatgtgccagggtcctgcrcccttttccggtggtattatctcatttaatactcagaacaatccccaagctgtcaattctgctgttgtttcctacttcatgatgttgtgagagtggattgggacaagacttgtctgtcacctcgcctgacaccaggcttactatgggttgtcattacgagtttattctgctgccctgctcactgtctgccctccttccgagcaaagccctcatatcgatttgagggaaggtcaaagtgtgggcaccctccttatgttcttgcagggaggaggctaagagagcacaaatatgatagagtcc

SEQ ID NO: 46451 - DNA, 601 bp, Human
cttcatgatgttgtgagagtggattgggacaagacttgtctgtcacctcgcctgacaccaggcttactatgggttgtcattacgagtttattctgctgccctgctcactgtctgccctccttccgagcaaagccctcatatcgatttgagggaaggtcaaagtgtgggcaccctccttatgttcttgcagggaggaggctaagagagcacaaatatgatagagtccaccagggaagaataccttctcaaccagagttgttgttttgatggaactcagtttctctgtttttgttttttgttytttcctgcagatcctctcatttggaagactatcccttcaatgcagaatattgaggttgaatctcctggtgagattatacaggagattctctttcttcgctgaagtgtgactacctccactcatgtcccattttagccaagcttatttaagatcacagtgaacttagtcctgttatagacgagaatcgaggtgctgttttagacatttatttctgtatgttcaactaggatcagaatatcacagaaaagcatggcttgaataaggaaatgacaattttttccacttatctgatcagaacaa

SEQ ID NO: 46452 - DNA, 601 bp, Human
ctgtcacctcgcctgacaccaggcttactatgggttgtcattacgagtttattctgctgccctgctcactgtctgccctccttccgagcaaagccctcatatcgatttgagggaaggtcaaagtgtgggcaccctccttatgttcttgcagggaggaggctaagagagcacaaatatgatagagtccaccagggaagaataccttctcaaccagagttgttgttttgatggaactcagtttctctgtttttgttttttgttctttcctgcagatcctctcatttggaagactatcccttcratgcagaatattgaggttgaatctcctggtgagattatacaggagattctctttcttcgctgaagtgtgactacctccactcatgtcccattttagccaagcttatttaagatcacagtgaacttagtcctgttatagacgagaatcgaggtgctgttttagacatttatttctgtatgttcaactaggatcagaatatcacagaaaagcatggcttgaataaggaaatgacaattttttccacttatctgatcagaacaaatgtttattaagcatcagaaactctgccaacactgagga

SEQ ID NO: 46453 - DNA, 601 bp, Human
gagaggttggtgtatcacagattgtgggtcccaccctcagagtttcggaatcagtaggtctggggcgcaccctgagaatctgcatttcttagaagttttaggtgatgctgatactgctgattggggttccacactttgagaagcactagtctaaaggactgtatggcttgttgtagtgaaatgaaaggaagctaggaaaggaaggaattgttgaaatggccttgaaagtaaattagagtttttcaagtcaagtaaattatctagacttcagttttgctcacgttcttccaactttaaacartgattgctgttcctagacgtaggtttcctgagcagttcttttgtttcaaacttcttttcagaacaggcttagtcattgactggaagaaagttagggggaaggaaactaaaaggatagttggtttatttatcttgactctaaaaatttggaaatcagcagcagccataattttaactactttatgtcatgttctacatgtatactaaaacatactgtattgttacctttttaagtaacatgaaccaaatgaactcttgaggattcaggttcaccggttttgagcatcagtgattgcactgt

SEQ ID NO: 46454 - DNA, 601 bp, Human
ctacagcccaaccacagctcattgtacacatcccctcctgctagtgcattgatgatttaactattttttactgttctttttgagggaaatcggaaagtttaacaaatgatggtaaagaagactataaccatggtgggggcaaagagagaattacatgtagaggttgtgtttagacatagcaaaacttacttttctacatttgagggaggctttgaaactattagcaatttatttaattaatttaatcaaatggtgtacctgctttggaaaacaatctggcagttcctcagaagggctaaacatagagttaccatatgatccagcaatcccacgcctacccatatagctatattagcttcccagtgctgccgtaagaaaacaaccaaactgggtgggttaaaacaacagaaatgtgttttctaggggctggaagtcccaaatcaaggtgtgagcagggctgtgctctctctgatgactctaggagacaattcttccttgccttggctagcttcggtgtttgtcggcaatctttgatgttctgtggcttgcagaagcatcactccttggcattctccttgtgtgtgtgtttcttatccacatt

SEQ ID NO: 46455 - DNA, 601 bp, Human
aataaggtcccaagtattctttttcacaactgcaagaattaagcataagtgactttctcaagatcagaagacatagtatgtcatcatatttttttcacatcatttctgttaatttagtgagattttagccctttcaaaattgattgtagatgtattcactcaccagaataggcatgttaatctaatgttagtcctcttgtattgcatgtctaactttccacagctcaagttacagggtttgtgtgcttcttggtaacttaccaacctaaaagaaagcatttcattggatttagatgctaamttttcaagactcaaaaaattaagtgaatctcccctactgtttaggggggaaataaaggttttcttttataggaaggactgctttgccagttcatgtgtatgtgtttatggtggtacaaaatataagttaccatcttaattgccaatttatgcttactatcaagttacatgatcatacatgcccattttgtggttaatgcctgttgtccgaatgtaattattaatagcatctccttttactttcaaaagtgccccagtctggatgataaattatgtggttacctcactataaaaatattga

SEQ ID NO: 46456 - DNA, 601 bp, Human
ttagaggtgtcatccatatacctcaacagtaaagagtgttggttctgaagatgttagttgtttctcagatatttgatattatgacactgtaggcagtcatatcctgactgatgctttctccatttgtggaaaagaagacaggtgctgttggaggaaactgaaatctaaagagactctagattccttggccgtgatcatggtaattagttggcatcaagaactctactcaaaactcagttcactgaggctccacacacagttatcacctgggctttaaaacttttttctaaaaggtagcctytcccttgacctattctttgtttggaatactgtgttttaagaagctgagtcaagaacatccatggcaggtaaactataaaaaggtaatttaatgcaactaattgagtcttaaattattactgctgttataacattgtggtctgaatggcacactctagcatagctatacgggatgacctttattcagtgcatactgcatgccaagcacagttttaggcattttacgtacacatgttgttttatgtaggaactagaacatggctctgaactcactggaaagctatggttcaatactgcgttt

SEQ ID NO: 46457 - DNA, 601 bp, Human
ggaatactgtgttttaagaagctgagtcaagaacatccatggcaggtaaactataaaaaggtaatttaatgcaactaattgagtcttaaattattactgctgttataacattgtggtctgaatggcacactctagcatagctatacgggatgacctttattcagtgcatactgcatgccaagcacagttttaggcattttacgtacacatgttgttttatgtaggaactagaacatggctctgaactcactggaaagctatggttcaatactgcgttttactttgctgtttagtatatccwggtcatattttttatttcatttgatcaatcattgatcactaagctgttttgcttaaagaaactgctttagtaaaaagaagcaaactattgatacacccatcatcatggatgaacctcagctgcattttgccaagtgaaagaaattgggctaaaaaagctgtgtattgtatgattccatttatgtgccatttgggaaaatatagaactatcgggaaataacagattggtggggtaagagtaggctgctgggggcacaaggaaattttaaggggttgatagagctgttttatatcctgattg

SEQ ID NO: 46458 - DNA, 601 bp, Human
taggaactagaacatggctctgaactcactggaaagctatggttcaatactgcgttttactttgctgtttagtatatcctggtcatattttttatttcatttgatcaatcattgatcactaagctgttttgcttaaagaaactgctttagtaaaaagaagcaaactattgatacacccatcatcatggatgaacctcagctgcattttgccaagtgaaagaaattgggctaaaaaagctgtgtattgtatgattccatttatgtgccatttgggaaaatatagaactatcgggaaataacagattggtggggtaagagtaggctgctgggggcacaaggaaattttaaggggttgatagagctgttttatatcctgattggttattacactactgtatgcagttgtcaaaactcatagaactgtatgctaaaaagggtgacttttgctatatgtaaattatacctgaaaaaagacttgctttatccagtgaactcaccattgccttaattgggaccttaccttttgttcacaaaggtaatagactacattagtcaattaggagaattaagtgaagggttgaaggtttgctatatgcaccta

SEQ ID NO: 46459 - DNA, 601 bp, Human
tattgatacacccatcatcatggatgaacctcagctgcattttgccaagtgaaagaaattgggctaaaaaagctgtgtattgtatgattccatttatgtgccatttgggaaaatatagaactatcgggaaataacagattggtggggtaagagtaggctgctgggggcacaaggaaattttaaggggttgatagagctgttttatatcctgattggttattacactactgtatgcagttgtcaaaactcatagaactgtatgctaaaaagggtgacttttgctatatgtaaattatacctsaaaaaagacttgctttatccagtgaactcaccattgccttaattgggaccttaccttttgttcacaaaggtaatagactacattagtcaattaggagaattaagtgaagggttgaaggtttgctatatgcacctatctgtgcctttgaaaactaacctggagggcatttgttatgctttctcaaggcttcaggagccatctggttctgactttagcacctaaaccatggtcattatagggaactgccttttaaagtccttcttcatgagaagttatgtttgagaatcttgctaatgttat

SEQ ID NO: 46460 - DNA, 601 bp, Human
ggtaaggtcataggagagcacagtgtttaatcaaggcttcaacaataaaagactagatttaatttgaaaacccagagagttcgaatttattcaattcaggtttgcacctagggttcactaaatcaggtcttgttcatggtacaagggatatagcacctatatgtgaatgagacacacaaggtccttttgtggagcttttaacctctttctgaaatttgtctgtactgtacctctgacaaagtccttagggtgttttcatatataggctttatgttttaggatttttaaattaacattttgktcttttttttttttttttgagatggagtctcgctctgttgcccaggctggagtgcagtggtgcaatctgggctcactgcaagctccacctcccaggttcacgccattctcccacctcagcctcccaagtagctgggactacaggtacccgccaccacgcccggctaattttgtttttgtatttttattagagacggggtttcactgtgttagccaggatggcctcgatctcctgacctcgtgattgcctgcctcggcctcccaaagtgctgggattatgggcatgagccaccacacccag

SEQ ID NO: 46461 - DNA, 601 bp, Human
ggatttttaaattaacattttgttcttttttttttttttttgagatggagtctcgctctgttgcccaggctggagtgcagtggtgcaatctgggctcactgcaagctccacctcccaggttcacgccattctcccacctcagcctcccaagtagctgggactacaggtacccgccaccacgcccggctaattttgtttttgtatttttattagagacggggtttcactgtgttagccaggatggcctcgatctcctgacctcgtgattgcctgcctcggcctcccaaagtgctgggattaygggcatgagccaccacacccagcctaacattttattccttatagcctttagttatatgtaaaaagtagattcacataataaatacagctgtaattacttagtggatcatattactgaataatttctggaccctagcagccaaaccataaaagtgttacttacagttgaataaacatttactaaatcttgcagtgggtaaagcactgtgttgtaacagcatgggtgatacagaaatggatcaaacattgttcctgctctcaaggaatttataatcctggtgggaaaagtgagcatttgcac

SEQ ID NO: 46462 - DNA, 601 bp, Human
tagagcaggtttttatttaaccactctggatctgtttccttttttttttttttttttttttaaattgagacagagtcttgctgtgtcacccaggctggagtgcaatggcacaatctcggttcactgcaacctccacctcccaggatcaagcaattctcctgcctcagcctcccaagtagctgggattacaggcgtccaccaccacgcctggctaatttttgtatttttagtagagacagggtttcaccatgttgcccaggctggtcttgaactcctgacctcaagtgatccacccacctcrgcctcccaaagtgctgagattagaggcatgagccactgcgcccagccctgtttactattttttaacatctttattgcgttataattcacatactatgcaattcgccatttaaagtatacaattaaatggcttttagtgtattcacaaaattgtaaatccattaccacaatcaatgttggaacattttcactaccctaaaaagaaacccagtgccccttagctgttatcacccccccagttcctcccctattccacccagccctgggcaacaactaatctactttgtgtcactatagattc

SEQ ID NO: 46463 - DNA, 601 bp, Human
gtcttgaactcctgacctcaagtgatccacccacctcagcctcccaaagtgctgagattagaggcatgagccactgcgcccagccctgtttactattttttaacatctttattgcgttataattcacatactatgcaattcgccatttaaagtatacaattaaatggcttttagtgtattcacaaaattgtaaatccattaccacaatcaatgttggaacattttcactaccctaaaaagaaacccagtgccccttagctgttatcacccccccagttcctcccctattccacccagcccygggcaacaactaatctactttgtgtcactatagattcacctgttgtggacatttcatgtaaatggacttatgcagtaagtggtcctttgtgactggcttcttttatttagtagcatcatgctttcaagattcatccaagaaccttgttgtggtttggttcagtacttcattccttttcattgccaaataatattctattgtatggatataccacatttaatttatctgttcattagttaatggacatttgtgttgtgttcactttttgactattatgagtaatgctgctatgaaggtttg

SEQ ID NO: 46464 - DNA, 601 bp, Human
tacagtgtattatgattccagtttctccacatccttattcacacttgtttataatctgactttttattgttgccatcctagagggtacaaagtagtatctcattgtggttttgatttgcatttccttgatagctagtaatattaagcctatttttatgtacttattgaccttttgtatatctttggagaaatggctgtttaaaccttttgcccatttttaaatttgatcatttgtctttttattattggagacagttcttatatctgataaggaacttgtatctagactatatatgatatrcaaatttttctcccattctctgggttgcctttttatgttcttaatagtgtcctttgaagcacaaacatttttaatttttatatacccagtttatttttttcttgtgtatgcttttggtgtcatatctgagaaaccattaattaactcaaggtgatgaagactttactcctatggctttttttctaaaaatttttacaattttagctcttgactctaagtctttgattcattttgagttaatttttatataaagtatgagtcaggggtccaacttcattctttcacatatggatatacagt

SEQ ID NO: 46465 - DNA, 601 bp, Human
gctcactttgaactcagaaacttgagaggagttacattatacagtgggtacagacccctaggtttgaatccaggctctgtcatttactctctgtgtgataattgtttacttaacctctctgtgccagaacttgttacatggagaaataatatgtcatcatattgcaatgatgattaaatgagttaatacatacaaaatgcttaaaagagtacctggcatgaaatatgaactcagaacatgttagctgtttattgttaaaagtacttataaagaatattattactaccactgctactacaastacagctcttctggtccaagttgaattacctgtaattcagttgtactttaaaaagggctaaaggtggcttgtgttttatatataccttccttttttagcagctggaatgttcagggatcataggagagcgagccctgttcacaggcatgctgtaaaatcccttcctgattcccttgactgtgctttctaagcacctgggaaagcattcctgttggactggatctagctcagggtattgcaagctcacttagtgtgggaaaaccaaacacattttaagcaaatgaactagatttagagatt

SEQ ID NO: 46466 - DNA, 601 bp, Human
tccaccttggctggggtgtcgtcattggctgcctattagaaaaacgacaggacaatgcataccaccgcctcccgactgtaaacataggggatatgtgttcacttagcatggacttctgggaggggccaaggaagggcggtctggagttttattgaatagagcagtgtgtattcggctgcctgcctgcccgcctgcttgctctctggctgtgctcctgcttaaagaaatcagtccttcctttccgacttagtcctcgggaagaagtttcagactacaaggtaaggcacagaaggctttcttktttatcttctagagagaatctggggactttctccggctttcagtcaacattcctggctaaggtagctggagatgcaagaatgttcaaggcaataaaccatgcaaactcccgagcctgactgggcttcactgccatacggatattcccggaaggcaaacaggatgagatttccagttttgtttttagaattgggacaagaagagtgaccatatagagacttacatttagggaacactggcaactttgattaggatagccttttgtttaggacagccatatgagattatacctgatatccaa

SEQ ID NO: 46467 - DNA, 601 bp, Human
tctgcatcttttattgccaaagatttgaagaggttttgctttaaaaacaaaatcaacaatcctttaggttgatgagaagccaaaagggaatgatttttttaaccaaaggcttttgcgttatagtctgctgccagtatttaaaactagacttccagagttgcaaggaaatacggtcagagatggagagatcactagcacctagcactggttgggttaatgtcactgatgggatatttgctaagacagaagatgcctaggctggtctgtttcctataaaacctaataacaagagaatgcatgygctagtgggtgtgtttttttagaaagcacatttaacgtcctaccaaactattttttaagaaatctttttttctgtttgaaagtgtgcctgagtgtgtctagagaatctaaagagatgtcgattggcaatgtgtttcagaaaggaaggaggcaggcttttatatctagatagacatatttgggtgtctgaaacagtagtacaaggcagctagttggtagtagcctggaattccttttagaaagagctgatggcaaggggtgggggaattttagtgctgtggcaatacatggtcaaaaaaag

SEQ ID NO: 46468 - DNA, 601 bp, Human
ctgatgggatatttgctaagacagaagatgcctaggctggtctgtttcctataaaacctaataacaagagaatgcatgcgctagtgggtgtgtttttttagaaagcacatttaacgtcctaccaaactattttttaagaaatctttttttctgtttgaaagtgtgcctgagtgtgtctagagaatctaaagagatgtcgattggcaatgtgtttcagaaaggaaggaggcaggcttttatatctagatagacatatttgggtgtctgaaacagtagtacaaggcagctagttggtagtagmctggaattccttttagaaagagctgatggcaaggggtgggggaattttagtgctgtggcaatacatggtcaaaaaaagtggatgagaacaaagtgcttgatatttatagatgccttctattaacaggactatgcagatggacttgtaaactgaaaatccttctaatgtgtttgtcaaaaccagacatatacagctagaacctgagtgaagactagatgctatatggcaagcagggtaaatctgatgattttttagtagtgctggctattaaagactaccagctgcaaatgactgattcaa

SEQ ID NO: 46469 - DNA, 601 bp, Human
aggaggcaggcttttatatctagatagacatatttgggtgtctgaaacagtagtacaaggcagctagttggtagtagcctggaattccttttagaaagagctgatggcaaggggtgggggaattttagtgctgtggcaatacatggtcaaaaaaagtggatgagaacaaagtgcttgatatttatagatgccttctattaacaggactatgcagatggacttgtaaactgaaaatccttctaatgtgtttgtcaaaaccagacatatacagctagaacctgagtgaagactagatgctatmtggcaagcagggtaaatctgatgattttttagtagtgctggctattaaagactaccagctgcaaatgactgattcaactggattttattccatgcaatgcggtagtttggggttgagattcattaaataaagttttctctttgtatttagaagtttggggataattttcttgggaatgcctatttctccttctagaagtgatatatgagaacagaattccttgtgaatttccttccctggaacagttctgagtaagtgtgagagaaaagctgcaggcaaaagctatagtttaattactgt

SEQ ID NO: 46470 - DNA, 601 bp, Human
atcctaggacacacaaggaatgtatgtacaatggattgatccataagtaaagtgcagggttgtttcaagtattcgaagcaaatagaaggtgtaatttaaatcattccagtcaaaagattgccttaagtaaatacacaattcttatattaaagttaggagaaggagaaccaggctcaaactgcagtttaaaggattttaaatgagatacatgaaagcatttcctgacagtaaggcaactgccttattatgagaatcattaacaattctaattggctcctgtgactggcctgagaatctcctkgtcttaggtagatagaataagttgatcttatggccagccatgtaaaggtccagaatctagcccaggtattctctgttctgataaataaaatgcacctcagcaggcatttttgtagaaacacatgtaattgtctccatttgccattttcttgatagcatgattaccagttagtcattccttagcaagacgcaaaagtgattcagagatgggcatgaaaagagatttgctagttccccatttgcctgtagtctatcacatgtctcagaaatgtggtcgggggacaggaaaaatgctgataga

SEQ ID NO: 46471 - DNA, 601 bp, Human
ccttactgaaagtccttcatctgtcaggctaatccaagtttgctattggagagatgcccataagtcctgagtagatgggtagtttaaagagaaacttttggcacaggcttaacttatgagaaccactacaacatctcagttctagtattggttcctctgcttaagtaaccctgacctttttgaggaaatcatcagcttttgacttcatctgttgagtgaagaacggacattggtaatgcttctccgatgtcccacagtggttaagacgtccaaatgagatgaagctgtttgctccctcttycctgcagattctataccctgaactgcctatcatttgagtcctctggacattatgctcatcttggctggtatcctccacttcttacctagtatccctaatgatctcttcctttctcgtatttaaggacccttgagtgatatcttctcgctcctggttatttctagagccctgagccgtgtccagtgaatactggtctatcccaatgttgtctgaatttttactttgatgatcacagactaagaggacacaaatataaggaagtggaataagatgggccatcagtggtacaaggcaccagga

SEQ ID NO: 46472 - DNA, 601 bp, Human
acccttgagtgatatcttctcgctcctggttatttctagagccctgagccgtgtccagtgaatactggtctatcccaatgttgtctgaatttttactttgatgatcacagactaagaggacacaaatataaggaagtggaataagatgggccatcagtggtacaaggcaccaggaaatccaaagatccacttgagcataagaccagtgagaaagtgctgacaacagaaagcccttaagtaattgaggcagcttctctgcctccagccaaaagcatggaatgaaccccggaacgtcatgcckgggccttgtaggaagggcaaggaaggcaggaacacctggctgtggttcctgttggtattgaaaccagactgctccacggagctcgcctctcacctctttgcttctgtctttagtgctcccagctgtaacggaccctagttgcatccctaacttccttacccccaggcctccacctgtaacctcttccccagctcccccatccctgtaccggatagggagctttcttgatccaacattgacaatttgcaggggccagctctaagatgaggcccagagtacagcagaacactctagcacaga

SEQ ID NO: 46473 - DNA, 601 bp, Human
aggaagtggaataagatgggccatcagtggtacaaggcaccaggaaatccaaagatccacttgagcataagaccagtgagaaagtgctgacaacagaaagcccttaagtaattgaggcagcttctctgcctccagccaaaagcatggaatgaaccccggaacgtcatgcctgggccttgtaggaagggcaaggaaggcaggaacacctggctgtggttcctgttggtattgaaaccagactgctccacggagctcgcctctcacctctttgcttctgtctttagtgctcccagctgtaacsgaccctagttgcatccctaacttccttacccccaggcctccacctgtaacctcttccccagctcccccatccctgtaccggatagggagctttcttgatccaacattgacaatttgcaggggccagctctaagatgaggcccagagtacagcagaacactctagcacagataggttctagctagggaaagccacttgcacagacagaggagatgtcagagcatgttttgtggtaaggacccactctgcttctcaccccaaactcataattggcaggctgtgggtaaggctatgggagcgg

SEQ ID NO: 46474 - DNA, 601 bp, Human
ttcaccttgtgctgaagaccagaaggaccaaggcaaagtgcccaagagggccaaggaccagttggcatcaaagatattagttccactggggtcaggaggaccagtctaagccagaatggatatcagttacaaaaatgggctaagttgtgcatgacagccaggtgagtaaagaagaaacagcaaaaatcagaagtcaggcagagcttagtgaagtagtgtatggatgaataaggtgaagtctgggagagcacatggcccagtgttaggaagaaatagacctctatgtgagcaaactttggtwgctcaagtaaagggccaggattgtaagacacagattaacgaacggatgaaatcacagggatatccaagagcagaagcccaaataggaccagggcccaaagagagtagagttagagtcaaggtgggtgagaggatcccagccgcggtccatggatatttactccatccctttccactagtgtgactcagctcagcgcacgtgtctgcctctttctgttgttctatcaactggaaaatttcttctgtgtttccaggtccagtcctgagagaggagatctgattggttcagtcaaagactatt

SEQ ID NO: 46475 - DNA, 601 bp, Human
agggcccaaagagagtagagttagagtcaaggtgggtgagaggatcccagccgcggtccatggatatttactccatccctttccactagtgtgactcagctcagcgcacgtgtctgcctctttctgttgttctatcaactggaaaatttcttctgtgtttccaggtccagtcctgagagaggagatctgattggttcagtcaaagactattgtctttggcaaatcctttagtaggaggaggacatcaaaggcacaggcgcgcctaaggatgaattactctaatccaggcagtggtcacccytgggcaaagaagagctcaatgggtaattttagttagaagagaaattgagcatggaaggcaaattagctgaaatgtccaacagctctcaatgggaatcatttgaattttgaggtgaataaactcctagagaggcaaacacccaatgaatgatcacacagttcttgatgatcactgtgacccactgagccagtgttaagggagattaatctagaagtttgcaccactggtaactgaaaggataagaatcatccatctcagaaagattttgggaaaaaacattctggatattattgttggcaa

SEQ ID NO: 46476 - DNA, 601 bp, Human
gtgtttgtcaagtggactaaaatatcccctgagttctgcatagttcggatcccatttgggaacttgtgctctgttctgggctcatttttctgaaaggcatggatacatatgcattctagggttagcatcaaaggctggagggagtcaggaggcaaaacatatgctgaaccgataagggatctagagctgtttatcccaaagaaaagaaaatgaggccacataaatatcttctaatatttggggtacttttatatgaacatgggagaaggcatttgtgtttctcaaggcagcagaacagaaytgaatatataaattcatagaatttttaagctgggcaagaccttaggagctcattcagcccaaggagtacatataacttttcatctgtatgccagctccaaccaattggcatgttaagaaggattctgaggatgaatctaagctcagaggggaggggaaaatgtggtcactgatagtgatatctgttgtggaagagaagggccatatctactcaagtaccatgttttagtcttcattaatgtggtctgtaggtttttaacctctgggtggtggatccctgggaggccacaaagtcattgca

SEQ ID NO: 46477 - DNA, 601 bp, Human
agtagatgtatgtagttacttattcctcagaagcctatttctttagttttgaataatttctttctaaaaattatagttgcatatgccaaataatccgtttggccagaagagcaaaacctttagttttgcttttttttcagtttaagcacaaagttatcaaccctgtaaggtcaaatttttctgatgagatttccagtgtttgcttttgtaaaggactggaaatgtggcaagaataaaatttctcatggtatttcccacttccttttccagccatcattactaagggaaatttaggcttagrgggaggggtgaatctaggagaaaaaaaattttaagtatttctgttcttaggaggttttgagcagatatttcgcttcctaggaaaagctgaagatgtttttctctgtttccactttgtggtgaggatgcacaaatcctgaagaggggagaagcttcctccacctccaccctcacccctacatcttctctagggcaggagtcatcacagcccctggtttagatgcttccctgggtggcccttttgaaagtatgtggaccctaagagacaggagactttgagtgcatggatgggggataattt

SEQ ID NO: 46478 - DNA, 601 bp, Human
gggagaagcttcctccacctccaccctcacccctacatcttctctagggcaggagtcatcacagcccctggtttagatgcttccctgggtggcccttttgaaagtatgtggaccctaagagacaggagactttgagtgcatggatgggggataatttgcttttgcagaaggacagaaaatttatctctaggttcttcctttattcggcagttaggaattacatcctctgtattgcacagaagaatctaccatattcagagcactgagtacatggattatattcactaaagattggagagcyaaaagtttctctgcaagagtgacctgatctagtaagaatgtcaaaattgttactatatttgtacccttgctcttcggtttagagggcaggtgcttccgtgtgtacatagaagcagagcttgttggagaagaggagctaaaaaggaattagattagaatccacctctgtacaatggcaccatctggactcagtctccttcatctctaacactgtccccactttctctgcaccccaaactcatactggctcccaaaagctcattgttaaactttcgagaattttgagagccagttgtaaaac

SEQ ID NO: 46479 - DNA, 601 bp, Human
ctggtttagatgcttccctgggtggcccttttgaaagtatgtggaccctaagagacaggagactttgagtgcatggatgggggataatttgcttttgcagaaggacagaaaatttatctctaggttcttcctttattcggcagttaggaattacatcctctgtattgcacagaagaatctaccatattcagagcactgagtacatggattatattcactaaagattggagagctaaaagtttctctgcaagagtgacctgatctagtaagaatgtcaaaattgttactatatttgtacccwtgctcttcggtttagagggcaggtgcttccgtgtgtacatagaagcagagcttgttggagaagaggagctaaaaaggaattagattagaatccacctctgtacaatggcaccatctggactcagtctccttcatctctaacactgtccccactttctctgcaccccaaactcatactggctcccaaaagctcattgttaaactttcgagaattttgagagccagttgtaaaacacagccattataaaaactaaatcatataaacttacaattaaacacattatatgaagagccaagataa

SEQ ID NO: 46480 - DNA, 601 bp, Human
tgcctgtagtcccagcactttgggtggccaaggcaggcagattgcttaagggcaggagtttgagactagcctgagcaaaatggtgaaacactgcctctacaaaaaatacaaaaattagccggccatggtggtgtgcatctgtagtcccagctacttgggaggctgaggtgggaggatcacatgagcttgggaggtcgaagctgcagtgagctgagattgtaccactgcactccaccctgggtgacacagtgagaccctgtctcagaaaaaaacaaaaagtaaaaaaaaaaaaaaaaaaaaaagtctacaatttctactttaaaaatacctgaagccagtgttcatgttggagctcattgattcctcatgaattgtatcattgttcagtgtttagaacagtgcctggcacatgctaagtagcatgtagatttttattaggtaaaaataaaataagttatcttcataacagctaattttacagatgaagaaactgagttacgattagattaagtaatatagctaaggtcccacagctagtaagtagctgggtcaggatctaaacccgggataatctggaggcactgcccaccttctttaccac

SEQ ID NO: 46481 - DNA, 601 bp, Human
aaaaaaagtctacaatttctactttaaaaatacctgaagccagtgttcatgttggagctcattgattcctcatgaattgtatcattgttcagtgtttagaacagtgcctggcacatgctaagtagcatgtagatttttattaggtaaaaataaaataagttatcttcataacagctaattttacagatgaagaaactgagttacgattagattaagtaatatagctaaggtcccacagctagtaagtagctgggtcaggatctaaacccgggataatctggaggcactgcccaccttcttyaccactgtgctatgctgcctcttgctagttactccacgtcactgagactcctcttttgtatgtggctctagaaagaattgagatctatttgagaacaaactttggagtcaggagaacttgagtttgaatctcaaatttaccacttttttcacttacaaaatggggatgatttctcctccactttgtagttgtcacaactactagaagtaatatcttgaaactgctttgcacgtacatgatagacactcaattacaaatggtcagctattggctgtgatttcctgtggaggctacctgtta

SEQ ID NO: 46482 - DNA, 601 bp, Human
taaacccgggataatctggaggcactgcccaccttctttaccactgtgctatgctgcctcttgctagttactccacgtcactgagactcctcttttgtatgtggctctagaaagaattgagatctatttgagaacaaactttggagtcaggagaacttgagtttgaatctcaaatttaccacttttttcacttacaaaatggggatgatttctcctccactttgtagttgtcacaactactagaagtaatatcttgaaactgctttgcacgtacatgatagacactcaattacaaatggtyagctattggctgtgatttcctgtggaggctacctgttagcgtggggcttagccacacactgtcccctgttgcctcctctaggccatcctgtagacagattaaaaagggctcactgcttctacatttggggtctccaggaggtaagactaggaccaatagatacaagttctaggaagtcctatttcagatcagcttacagactttctaaatagatatttctgtctctgaagcacgaacctcgctgctctacagaagcagacaacttccactgtcctttccaaccagaaggtttacctgctt

SEQ ID NO: 46483 - DNA, 601 bp, Human
ttaccactgtgctatgctgcctcttgctagttactccacgtcactgagactcctcttttgtatgtggctctagaaagaattgagatctatttgagaacaaactttggagtcaggagaacttgagtttgaatctcaaatttaccacttttttcacttacaaaatggggatgatttctcctccactttgtagttgtcacaactactagaagtaatatcttgaaactgctttgcacgtacatgatagacactcaattacaaatggtcagctattggctgtgatttcctgtggaggctacctgtwagcgtggggcttagccacacactgtcccctgttgcctcctctaggccatcctgtagacagattaaaaagggctcactgcttctacatttggggtctccaggaggtaagactaggaccaatagatacaagttctaggaagtcctatttcagatcagcttacagactttctaaatagatatttctgtctctgaagcacgaacctcgctgctctacagaagcagacaacttccactgtcctttccaaccagaaggtttacctgcttgcccttatcaacaaatctatgctgcctttaacatttt

SEQ ID NO: 46484 - DNA, 601 bp, Human
tgggcactttatttgtttgtttgttttttgagatgaagttttgttctgtcacccaggctggagtgcagtggcacgatctcggctcactgcaacctctgcctcctgggttcaagcgattctttcacctcagcctcctgagtagctgggattataggcacacgccaccatgcccagttaattttttgtatttttagtagagacggggtttcactatgttggccaggctggtctcgaactcctgacctcaagtgatctgcccactttggcctctcaaagtgctgggattacagggaccatgccyggccacaacaggcactttagaatgcaggctcagtaaccaactttatgaagggagaaacagaggcatgaacagttgaaactatttccttaaagacagccagttccatcttgccatacagagtgcccacattttcagataatccgaagaggcatcacttagtgtccccagggaaatgaaaaacaaaaaacaaaaaacaaaaaaacctgtaaatagtctggtcatcttctcctaactatcatcttggaccagattgcatctggagtactagtttattaggcatacccgagactgggtaattta

SEQ ID NO: 46485 - DNA, 601 bp, Human
tagagacggggtttcactatgttggccaggctggtctcgaactcctgacctcaagtgatctgcccactttggcctctcaaagtgctgggattacagggaccatgcccggccacaacaggcactttagaatgcaggctcagtaaccaactttatgaagggagaaacagaggcatgaacagttgaaactatttccttaaagacagccagttccatcttgccatacagagtgcccacattttcagataatccgaagaggcatcacttagtgtccccagggaaatgaaaaacaaaaaacaaaaaacaaaaaaacctgtaaatagtctggtcatcttctcctaactatcatcttggaccagattgcatctggagtactagtttattaggcatacccgagactgggtaatttataaagaaagaggtttaatggactcacagttccacatgattggggaggcctcacaatcatggcggaaggcgaatgaggagcaaagtcacaaattacatggtgacaggcaagagagcttgtgcaggggaactcccatttataaagccatcagatttcctgagacttattcactaccacgagaatagtatgggggca

SEQ ID NO: 46486 - DNA, 601 bp, Human
tacccgagactgggtaatttataaagaaagaggtttaatggactcacagttccacatgattggggaggcctcacaatcatggcggaaggcgaatgaggagcaaagtcacaaattacatggtgacaggcaagagagcttgtgcaggggaactcccatttataaagccatcagatttcctgagacttattcactaccacgagaatagtatgggggcaactgccgccgtgattcagttatctccacctggccctgcccttgacacatgggattattacaattcaaggtgagatttgggtggggrcacagccaaaccatatctgatgccacaacaaaatgcacaaacaaatttatttctggatggaggttagaagtccaagatcaaggtgtcagcagggttggttccttcaagggctgtgagggaagtctctgttccagccctctctgtttcacttgtagatggttatctttgtgttcacaaggcattctttctgaacgtgtatctgcatccaaatttcctcttcttttttttttttttttttttgagatggagtttcgctcttattgcccaggctggagagcagtagtgccatctcgactcact

SEQ ID NO: 46487 - DNA, 601 bp, Human
gaatgaggagcaaagtcacaaattacatggtgacaggcaagagagcttgtgcaggggaactcccatttataaagccatcagatttcctgagacttattcactaccacgagaatagtatgggggcaactgccgccgtgattcagttatctccacctggccctgcccttgacacatgggattattacaattcaaggtgagatttgggtggggacacagccaaaccatatctgatgccacaacaaaatgcacaaacaaatttatttctggatggaggttagaagtccaagatcaaggtgtcagyagggttggttccttcaagggctgtgagggaagtctctgttccagccctctctgtttcacttgtagatggttatctttgtgttcacaaggcattctttctgaacgtgtatctgcatccaaatttcctcttcttttttttttttttttttttgagatggagtttcgctcttattgcccaggctggagagcagtagtgccatctcgactcactgcaacctccatctcccaggttcaagcaattctcctgccttggcctcccgagtagctgggattacaggtgctcgccaccatgccaggctaa

SEQ ID NO: 46488 - DNA, 601 bp, Human
gggagcagcttcagggcagctggccgggccagggaggcagccacagagggaccttgtgcatgcctgcacagggcccaaagagggtggcccttttccgtcatttttatatatgctgatcacaaccacaaatccccagacacaaggaaaaatatttgaagcctacacatatttgcgctctgaatcatttgtctcttgtctttattttcctctctctcctctctatctatccttaaatttttatactttttctctcaacagtcctcctcactttatctgtctttgctctagttggtttcaagcrcccatacattgtgtcttgtctgcattttccatgttctatttttaaggtattttattttagcctttttgtcccttttttgtccctttcctaaagctcttcttggtgcccatttcccagctttggtcctgctcatggcttctctgtcttaggccaggggtagtctatagacaggatgactataccatttatcgtcaaactgggacacgttgaagagggaaagaaggggcagttaataatttccctaaaatgcagtcccgaagtgggactgtcccagtgtggagtggatgcttattctatcca

SEQ ID NO: 46489 - DNA, 601 bp, Human
gtccctttcctaaagctcttcttggtgcccatttcccagctttggtcctgctcatggcttctctgtcttaggccaggggtagtctatagacaggatgactataccatttatcgtcaaactgggacacgttgaagagggaaagaaggggcagttaataatttccctaaaatgcagtcccgaagtgggactgtcccagtgtggagtggatgcttattctatccatggtgtggttttctgctttccacaaatctctcttcacctatcaaccactccctccatttatgtaccattttttttttttaaaccttttatgttctggtccttcttttttatttcaaccccaagaagctttatgtgttcttgtatttctgtcttcttttatctcctcctcattccttcactttactctactctgctctctatcttgtctcaccacttcaattcttcttctcccttgatttccttcttttgggtacagactggactgcagctcacagaggccatgcctgtctgccatgatacatgcaggacatagtccctgcatttctgaaacaaatcaaggcacagctgagcacatacacacacacttcaaaataagcca

SEQ ID NO: 46490 - DNA, 601 bp, Human
ataccaaaggcctagcaatggctgccataggttttttgttgttgttgtcaattgaaacagagtctcactctgtcgcccgggctggagtgcagtggagcaatctcagctcactacaacctccacttctcgggttcaagtgattctcctgcctcagcctcccaagtagctgggattacaggtgtgtgccaccacgcccagctaatttttgtatttttagtagaagtggggtttcaccatgttggccaggctggtcttgaactcctgacctcaagtgatctgcccgcctctgcctcccaaagtrctaggattataccatgcccagcctgctataagtctaacataagtaacaataaacttttaggcaacaagatagaataaatatttttttcagttctttttaaatgttctcatgacacagtcatctgcaacttatggtttattctgaaaaatcacttcaattttccagatattccttagacttaaggttgtgcaaggaaggcctgaaactccttcccaacttgaaaatgagaaaggaagagtattttcctcttgtaagtcgctggaagccagtccactgatacctgaaatacttgacagaatg

SEQ ID NO: 46491 - DNA, 601 bp, Human
gctgccataggttttttgttgttgttgtcaattgaaacagagtctcactctgtcgcccgggctggagtgcagtggagcaatctcagctcactacaacctccacttctcgggttcaagtgattctcctgcctcagcctcccaagtagctgggattacaggtgtgtgccaccacgcccagctaatttttgtatttttagtagaagtggggtttcaccatgttggccaggctggtcttgaactcctgacctcaagtgatctgcccgcctctgcctcccaaagtactaggattataccatgcccrgcctgctataagtctaacataagtaacaataaacttttaggcaacaagatagaataaatatttttttcagttctttttaaatgttctcatgacacagtcatctgcaacttatggtttattctgaaaaatcacttcaattttccagatattccttagacttaaggttgtgcaaggaaggcctgaaactccttcccaacttgaaaatgagaaaggaagagtattttcctcttgtaagtcgctggaagccagtccactgatacctgaaatacttgacagaatggcactgtgtcagctgtcagg

SEQ ID NO: 46492 - DNA, 601 bp, Human
aatagatattttatgaacggaaatacaggttttgttcaagttctctccttccttcctctctctttcccttccttccccctcctccttttctttctttctcttcctcctcattcttcacattcttccagtttttgtttcttctcccactgagattgatatggctggaaatgtgctattatgattgggcagccttgtgctttatccatggtggcctatagctctcttgcttatatatatctttttatgaagatcgatggtaacaaaaaatacttcacccacactctgctgggaagatgcgacrgtggaatggaaatatctatccagagagctccctacgaccctaagacttgacagagtcatccccagccagcctggagccactgacccacctgtgtctgagtaactgggaaacaaggagtgtaggagtttgagagttatttttgttttttacttttttaaactttcatgcctttccatatttctgctcttagatattctgttaaaataaaacaacggctctttccatgggagtagtttctagcttgctaattcttttttgagagagtgtttgcatgaggttttaagtttttaaagtcttggc

SEQ ID NO: 46493 - DNA, 601 bp, Human
caccatattgtccaggatggtctcgatctcctgacctcaggtgatccacctgactcggcttcccaaagtgtttggattacaggcgtgagccaccatggctggccaaattgtttatttgtattgttctttaaataaaagtttattttagaatacttttaaatttacagaaaagtagcaagaatattacagagttctcatatgccccacacccagtttcccctattgttaacattaaggcacatttgtcacaaataataaaacaatattgatgcattattattaatgaaagtccaacctttayttggattgttttaggtttctttaagccccttaaaatagaaaaatgtttcatatggggaaaatgtaatgttcacattgtagctatatagttggaactctaatacatgagtgaaaatggtttaagctaactcttttcttgaacatatgcttactggactgacaatctcttgaggactttccacctgtaataccttaggcctcttctgttctctggtttgtttcccttgagaccgttagcagattgctcagcctgacccaccctggtgccagatgttggaaccctcttgctgctgccaatctg

SEQ ID NO: 46494 - DNA, 601 bp, Human
tatttctgtctaattatcttaaagtgggtctcattaatagcatatagataaatttcaaaatctagtcacagagatttctatcatttaatgtatgagataaatccattatatttgttattatggattatgtacaggatgtctgaaaatctgaaaacagggcaaacttaatttaaacaatatattagtcacattttaaaaatacttgcttaatatgttttcttcaagtttcagacaacatttcaagtaaagtatctttaaatttaaagcaatgtccaattttttaaccctaaaaagtataatraatacactattttctgaatttccagaatttttagaccctatgtaatgtatttattgtacaaaacataggagcatattatttgaaatgtatctaacctacagtataagtgcctaccctatattttctgatttttttggactcaaggtaatttagtcttatttttaacatcatattttgtatttcttctttcccatgtgtattcttcacgtctttattttctcccttcctagtgttttattatgtttattgattcccttttagtctttactgttttggttatatacatccctattctagaga

SEQ ID NO: 46495 - DNA, 601 bp, Human
aaacttaatttaaacaatatattagtcacattttaaaaatacttgcttaatatgttttcttcaagtttcagacaacatttcaagtaaagtatctttaaatttaaagcaatgtccaattttttaaccctaaaaagtataatgaatacactattttctgaatttccagaatttttagaccctatgtaatgtatttattgtacaaaacataggagcatattatttgaaatgtatctaacctacagtataagtgcctaccctatattttctgatttttttggactcaaggtaatttagtcttatktttaacatcatattttgtatttcttctttcccatgtgtattcttcacgtctttattttctcccttcctagtgttttattatgtttattgattcccttttagtctttactgttttggttatatacatccctattctagagaatatttctattaacatttaatatgcatatattacaaagtataaactttattttccctcaaaactatccgtgttcatcctataagctattattgtttaataatctgtttcgtttttaaaccttgacaaattcatttttttttaaaacagccaattgttaca

SEQ ID NO: 46496 - DNA, 601 bp, Human
ctgttcactgcggtgatgctgtttttaacacttacaagcaataaattagcattccagtggctccctatctttaacaacatttggagtagtcagtctttctaatttaaacaattctagtagttgtttagtggtatctcattgtggtcttattttgcatttgtctaatgacaaatgatattcggcatattttttgttcttattgaacatatgtatatcttctatgaaggatttattcacgtttcttgcccaatctttaaattaaactgtttattattattttgtaggagctcattatactttmtggatacaagtcagatatatgtattatattaatacatattttctcccagtcagtggctcaccttttcatttccttgatgctgtattttgataaacaaaagttttatattttaatgaaatcccatttatcattctttaaaattttatggctagttctttttcttttctctttaagaaatatttgcatactctatctaggttgcaaggatcttctatttaaaaaaaacttttagtttttgtttttatgtttagatctgtggtccatgtagaatgagtatttgtgtatggtgtcagatagcag

SEQ ID NO: 46497 - DNA, 601 bp, Human
attattattttgtaggagctcattatactttctggatacaagtcagatatatgtattatattaatacatattttctcccagtcagtggctcaccttttcatttccttgatgctgtattttgataaacaaaagttttatattttaatgaaatcccatttatcattctttaaaattttatggctagttctttttcttttctctttaagaaatatttgcatactctatctaggttgcaaggatcttctatttaaaaaaaacttttagtttttgtttttatgtttagatctgtggtccatgtagratgagtatttgtgtatggtgtcagatagcagttgagtttcatttttcccattcatttatccaattgttccagaacaatctgtcaaaaaaccttgtctttatgaattgtattgactccttgttgaaaatcattcatctcctgcataggtgtgggtctaatttttttttttttttttgagacagtctcactgtgtcacccaggctggagtgcagtggcacaatctcggctcgctgcaaccttcgcctcctgggtttaagcgattctcctgcctcagcctcctgaatagctgggattacaggt

SEQ ID NO: 46498 - DNA, 601 bp, Human
ccccatactttcaatattataataattgtatgaatacttcatagcttaccacatagtatactatgattacattttctttctatattaccactttccttgctactatcccccatgatttaataatgacttcgtttcttttacctgtttgttttctatcattaatgcctgccccagggtatctgacaggaatgtcaaaccctttttaatacagtcaaacacatcaggtaatttgtcaattatttttctttaaagagacttttctggaaacttcttggcattttctaggtttggtgcacagctkgctgttctaaatcttcacttcacagtcatctgaggcatttccttcctaggactgaaaggaatttcctttgtatgtgggctgaaatttgaatcctccatttcctggttcccattattcctccttctttatactcttgttttgatgaagaagattatctaagagcatcttgaacaagcgtccagggacgacaacatttcttaaaacttaattgtttttagtatctttgatttaagacatacttgattaatttattggctgggcatagaattctaggctggaaatcatttttcctaaaacttc

SEQ ID NO: 46499 - DNA, 601 bp, Human
tatctgacaggaatgtcaaaccctttttaatacagtcaaacacatcaggtaatttgtcaattatttttctttaaagagacttttctggaaacttcttggcattttctaggtttggtgcacagcttgctgttctaaatcttcacttcacagtcatctgaggcatttccttcctaggactgaaaggaatttcctttgtatgtgggctgaaatttgaatcctccatttcctggttcccattattcctccttctttatactcttgttttgatgaagaagattatctaagagcatcttgaacaagygtccagggacgacaacatttcttaaaacttaattgtttttagtatctttgatttaagacatacttgattaatttattggctgggcatagaattctaggctggaaatcatttttcctaaaacttccccaaacatacctgcactgtaacctcccaacagggtctccttgcccgcttcctagacagagctgatttgtcaagatggggaattgcaatagagaaagagtaattcattcaaaaccggctgtaggggagatcaaagttttattactgctaaaatcagtctttctgataactcaggat

SEQ ID NO: 46500 - DNA, 601 bp, Human
gcattttctaggtttggtgcacagcttgctgttctaaatcttcacttcacagtcatctgaggcatttccttcctaggactgaaaggaatttcctttgtatgtgggctgaaatttgaatcctccatttcctggttcccattattcctccttctttatactcttgttttgatgaagaagattatctaagagcatcttgaacaagcgtccagggacgacaacatttcttaaaacttaattgtttttagtatctttgatttaagacatacttgattaatttattggctgggcatagaattctagkctggaaatcatttttcctaaaacttccccaaacatacctgcactgtaacctcccaacagggtctccttgcccgcttcctagacagagctgatttgtcaagatggggaattgcaatagagaaagagtaattcattcaaaaccggctgtaggggagatcaaagttttattactgctaaaatcagtctttctgataactcaggatgggaatttttaagggtaatttggtgggtagggggccagtgagttgggagtgctgattggtcgggtcggagatgaaatcatagaagtagaagctgtcct

SEQ ID NO: 46501 - DNA, 601 bp, Human
tttcccatgttctgatacacacagtctcctctgtcactgaattattgagagcttgaacctcctaaaccaactctctgattttgtattttcttaactatattctacttttctgtatcttattctaatttttgagagtttccttaactttggctatatattgtttttagccatagtatttttaatttctaagggttctttgttgttgttgttgttgaacatttctttttataacatcctgatcctctttcatagatacagtagttctctatgcccctggaaatatcatttatattttcagtgyctttctgcccctgccttatctgagttttctctgtgttcctgttttctattatttgtgctagtctctgtctttcattcttccctcagaatcctggtgatccttggctgtctgtccatatataggagcaaggcagtaaaaagctgattaaaagctatgggttcaggagtgctggctggcagaaaatgggccagttattttcttcccatggcaatctccaaatacccatatctctagatcctttttcttgaacaagtttatccaaagattttctttttgctctgttacccaggctggagtgtg

SEQ ID NO: 46502 - DNA, 601 bp, Human
cagattttatatctattaaaacattggcacaaccatgcaacattctttccatgataccatgactggtttattgaggagtctcaactcactgggggtataaagaagaaatgatttctatttttccctatcagtactgttctgtgtcaaacttccttttattactagctacagggggcctttaattacatctccgaccagtttctaaactcaagaaggataaattgctcctaccctcaccccactcccccaggctagagtctagtggcttagaattgtagggttctggctcttaaacagcttmttttccttcattccagtgaataaccctggaatatgggggagcatgaagagggtggaggaagaagaggtctgtactagacttctcataataactggtgttatgaaatgacctaagccaatctgcctcttcacagttgtctggagtggagcgatctcagctcactgcaacctccgcctccctagttcaagcaattctcctgcctcagcctcctgagtagctgggattacaggtgcccgccaccatgcccagctaatttttgtacttttattagagacggggtttcaccatgttggccaggct

SEQ ID NO: 46503 - DNA, 601 bp, Human
gggtttcaccatgttggccaggctggtcttgaactcctgacctcaggtgatccacctgcctcggcctcccaaagtgctgggattacaagcgtaagccaccgtgcccggccgattatctccaatttttagatgtaggcaccatttcctcccagataacctcaataccaggtgatatgttacaatggaaacaagtctcagagactaaattctgccacacatgaaacaaataggcataaaaacaattacaaagcctgttccatacatttggtaaagtccccattccatctttttttttttttttgagacagggtcttactttgtcgcccaggcttgagtacagtggtgcaatcatgtttcactgcagctccaaactcctgggctcaagcaatcctcccacctcagcttcccgagtagctggggccttgggcatgtgctatcatgctgggctaatttttttttttaattactttttgtagagacaacgtctcactatgttgcccaggctggtcttgaactcctgggctcaagtgatcctcccaactcggcctgccaaagtgctgagattacaggcatgagccaccacctggcccccattctattt

SEQ ID NO: 46504 - DNA, 601 bp, Human
aataccaggtgatatgttacaatggaaacaagtctcagagactaaattctgccacacatgaaacaaataggcataaaaacaattacaaagcctgttccatacatttggtaaagtccccattccatctttttttttttttttgagacagggtcttactttgtcgcccaggcttgagtacagtggtgcaatcatgtttcactgcagctccaaactcctgggctcaagcaatcctcccacctcagcttcccgagtagctggggccttgggcatgtgctatcatgctgggctaatttttttttttaattactttttgtagagacaacgtctcactatgttgcccaggctggtcttgaactcctgggctcaagtgatcctcccaactcggcctgccaaagtgctgagattacaggcatgagccaccacctggcccccattctattttttaaagtgctctgacaagtgcttttgcactttaagcaaaagatccactccctggcaaaagttacaatattctaatggcagagccagctcatgttctagtcaggccagaaagtttcattaaatgggcacaggcctgaatagaatcctagatctatggcac

SEQ ID NO: 46505 - DNA, 601 bp, Human
ccaggtgatatgttacaatggaaacaagtctcagagactaaattctgccacacatgaaacaaataggcataaaaacaattacaaagcctgttccatacatttggtaaagtccccattccatctttttttttttttttgagacagggtcttactttgtcgcccaggcttgagtacagtggtgcaatcatgtttcactgcagctccaaactcctgggctcaagcaatcctcccacctcagcttcccgagtagctggggccttgggcatgtgctatcatgctgggctaatttttttttttaatwactttttgtagagacaacgtctcactatgttgcccaggctggtcttgaactcctgggctcaagtgatcctcccaactcggcctgccaaagtgctgagattacaggcatgagccaccacctggcccccattctattttttaaagtgctctgacaagtgcttttgcactttaagcaaaagatccactccctggcaaaagttacaatattctaatggcagagccagctcatgttctagtcaggccagaaagtttcattaaatgggcacaggcctgaatagaatcctagatctatggcacgcct

SEQ ID NO: 46506 - DNA, 601 bp, Human
ccatctttttttttttttttgagacagggtcttactttgtcgcccaggcttgagtacagtggtgcaatcatgtttcactgcagctccaaactcctgggctcaagcaatcctcccacctcagcttcccgagtagctggggccttgggcatgtgctatcatgctgggctaatttttttttttaattactttttgtagagacaacgtctcactatgttgcccaggctggtcttgaactcctgggctcaagtgatcctcccaactcggcctgccaaagtgctgagattacaggcatgagccaccrcctggcccccattctattttttaaagtgctctgacaagtgcttttgcactttaagcaaaagatccactccctggcaaaagttacaatattctaatggcagagccagctcatgttctagtcaggccagaaagtttcattaaatgggcacaggcctgaatagaatcctagatctatggcacgcctctgaatgctggatttgtcagatttcttaatccctgtacacacaaggatggagatgcctgaataagtctttctatccaatccaatcacatatattgaacacccactcatttgcctggt

SEQ ID NO: 46507 - DNA, 601 bp, Human
ttttaatgtagtattttgggcagctgaagctgacgggtcagaactgatgcataagagagaacttcattgtaatacaaaagtcactgggtctgtcctagctgtgagaacttagataaaatattgaatcctttgcgcttccatttcctcatccattaaaagataggggtgaggggtgggagttataagaactaaatgaaataatataaataatttagccactgcctgttgaggctggataaatatcagttccctcctcttgtagccacaaagttttaactaagctgatatgtttgttacattmtgctcatgtcttttccaggagaactccatctagaacaaaatgtgcattcagcaaggtataattgtgtatgtttttattgtcagttttagtcatatctgtcattttttattttccaacatgaaaagagaggtttagggtagtcacattggaaaacaaagaaaataagattaaaattccctcaaatcaactttggagccctaaaatattaatgccttgacggcttactcacaatcacaaaaggctgtgagccaacattcagctttgtattgcagaggtgatgagaacatattttcattgcta

SEQ ID NO: 46508 - DNA, 601 bp, Human
agttttccaaactatacaggctaatggtagtggactgtgttaaaaagctattcaggatactccgaaattatccctgctcacatctcaccaatccttatgctagttgaggaccttcaaagaaccctccctgtccaaaatacatcattcagaatcttctgtttagctctcttcattttagtgaaagtctcctaaaactagtcctggatgtgttttcatcacacttgaagtttaattaactgataactcaggcacaatggaaatacttagatagatgctcttaaattacatttaaacaaaactrtttacaagcgatctagtaaaaatctgtgtctttaatgggctatttttaatgtttcctaaacaaattattgtaggtgggccaattttccctctttacttgttacttagaagcccatttggacatgttctaccccgatctggttctctcaccccactggctacagaatagtgtgtttttgtttgaaagggtcaaaacattaagaatgtgacatccaaaatatgtgctatttttttttcctggagtcaaaacccctaaagtataaatcgtttttaaatgaagaaagcagtgccaaaaggaatg

SEQ ID NO: 46509 - DNA, 601 bp, Human
cgtttttaaatgaagaaagcagtgccaaaaggaatgaaacatatttggtccttctccaaaacagagagatagcactgaaacaggaagtggatgatttaaatatccactcggcatcttggcaacatatttatgtttaagggacttaaggttaaaaggtttttgtctggcctgggaacactctatcttccctagggtttggaggtttggggaaaacttttaacaacttatcaaatatttgcaattagccattttttggagaacaaattgttactgagaatgtcataggaaatgttccctatawgctgcatgctaccattactctcctgcttcttatgataatctctttagccacctagcttcatgtggtagaaagttattgttttattttctataaagaaagaagaatgtggttcgagttcttgtaactacttctcccaaagttggaactacacagaatgactgaataagcagaatgcaaaattggggtttaattgattttgtgtgtgctgtttccaaggaccacttagtggccccattcttatagctagaaatcgacaatatcgggagtgtttacacaaggaagtaggccttctcctacttc

SEQ ID NO: 46510 - DNA, 601 bp, Human
aatatttgcaattagccattttttggagaacaaattgttactgagaatgtcataggaaatgttccctatatgctgcatgctaccattactctcctgcttcttatgataatctctttagccacctagcttcatgtggtagaaagttattgttttattttctataaagaaagaagaatgtggttcgagttcttgtaactacttctcccaaagttggaactacacagaatgactgaataagcagaatgcaaaattggggtttaattgattttgtgtgtgctgtttccaaggaccacttagtggscccattcttatagctagaaatcgacaatatcgggagtgtttacacaaggaagtaggccttctcctacttcccacccttcagagatgagagactgctattatccatttaccagcacaccactggaaagaatagtttaaaaaaaaaaaaaaatgagctcaaggtttttggtctaaaagactggaataatggtgttttcatttaccaaacttaggaagaacatacaaggaggaactatgggagtgcaagtcagtagttcagctttgaacattttatatttgtcacaacaattaggcatttgat

SEQ ID NO: 46511 - DNA, 601 bp, Human
aaattgttactgagaatgtcataggaaatgttccctatatgctgcatgctaccattactctcctgcttcttatgataatctctttagccacctagcttcatgtggtagaaagttattgttttattttctataaagaaagaagaatgtggttcgagttcttgtaactacttctcccaaagttggaactacacagaatgactgaataagcagaatgcaaaattggggtttaattgattttgtgtgtgctgtttccaaggaccacttagtggccccattcttatagctagaaatcgacaatatygggagtgtttacacaaggaagtaggccttctcctacttcccacccttcagagatgagagactgctattatccatttaccagcacaccactggaaagaatagtttaaaaaaaaaaaaaaatgagctcaaggtttttggtctaaaagactggaataatggtgttttcatttaccaaacttaggaagaacatacaaggaggaactatgggagtgcaagtcagtagttcagctttgaacattttatatttgtcacaacaattaggcatttgattggaattgttaaataagcagttggatataca

SEQ ID NO: 46512 - DNA, 601 bp, Human
ttagccacctagcttcatgtggtagaaagttattgttttattttctataaagaaagaagaatgtggttcgagttcttgtaactacttctcccaaagttggaactacacagaatgactgaataagcagaatgcaaaattggggtttaattgattttgtgtgtgctgtttccaaggaccacttagtggccccattcttatagctagaaatcgacaatatcgggagtgtttacacaaggaagtaggccttctcctacttcccacccttcagagatgagagactgctattatccatttaccagcrcaccactggaaagaatagtttaaaaaaaaaaaaaaatgagctcaaggtttttggtctaaaagactggaataatggtgttttcatttaccaaacttaggaagaacatacaaggaggaactatgggagtgcaagtcagtagttcagctttgaacattttatatttgtcacaacaattaggcatttgattggaattgttaaataagcagttggatatacaagtctggggttcagggaagaggtcctgaatatatttttttgggagtcaggcatttgcatggtatttaatgccaagagacaaga

SEQ ID NO: 46513 - DNA, 601 bp, Human
gtagaaagttattgttttattttctataaagaaagaagaatgtggttcgagttcttgtaactacttctcccaaagttggaactacacagaatgactgaataagcagaatgcaaaattggggtttaattgattttgtgtgtgctgtttccaaggaccacttagtggccccattcttatagctagaaatcgacaatatcgggagtgtttacacaaggaagtaggccttctcctacttcccacccttcagagatgagagactgctattatccatttaccagcacaccactggaaagaatagtttaaaaaaaaaaaaaaatgagctcaaggtttttggtctaaaagactggaataatggtgttttcatttaccaaacttaggaagaacatacaaggaggaactatgggagtgcaagtcagtagttcagctttgaacattttatatttgtcacaacaattaggcatttgattggaattgttaaataagcagttggatatacaagtctggggttcagggaagaggtcctgaatatatttttttgggagtcaggcatttgcatggtatttaatgccaagagacaagacgagaccaagccagtgagtta

SEQ ID NO: 46514 - DNA, 601 bp, Human
tttattttctataaagaaagaagaatgtggttcgagttcttgtaactacttctcccaaagttggaactacacagaatgactgaataagcagaatgcaaaattggggtttaattgattttgtgtgtgctgtttccaaggaccacttagtggccccattcttatagctagaaatcgacaatatcgggagtgtttacacaaggaagtaggccttctcctacttcccacccttcagagatgagagactgctattatccatttaccagcacaccactggaaagaatagtttaaaaaaaaaaaaaaatgagctcaaggtttttggtctaaaagactggaataatggtgttttcatttaccaaacttaggaagaacatacaaggaggaactatgggagtgcaagtcagtagttcagctttgaacattttatatttgtcacaacaattaggcatttgattggaattgttaaataagcagttggatatacaagtctggggttcagggaagaggtcctgaatatatttttttgggagtcaggcatttgcatggtatttaatgccaagagacaagacgagaccaagccagtgagttattagatagaggagct

SEQ ID NO: 46515 - DNA, 601 bp, Human
ggcatttgcatggtatttaatgccaagagacaagacgagaccaagccagtgagttattagatagaggagctcagtcccaggataatttttagggtcttccaacatttaaaggtcagagtaaagaccagcaaaggagactgagaagagtggccaatggggcagaaagagaaccaggagggtgagatgtgctagaagccaaatgaagaaaggacttccaaaagaaggaagtgatcaactgtgtcaaacgctcatgtattaattaagatgagaattgagaattgatcattggctttggcaatgyagaaatattgatgatcttgaaaagcatcaaggatggtagagaaaaagcctgattggcatgggttcaacagaagatgggaggaaaagaactcggagcagtgaatagagacaacattttcagaattttttttgaaagaggggcagaggattggaataggagctggagagttgtatgggtttaatgaagatttctttttttcttttagcttaagactagatatattttgacatgcttgtatgatgatgagaataatctagtagaaagagatcattgatgatgcataagagaggtgacaattgc

SEQ ID NO: 46516 - DNA, 601 bp, Human
gtgtagtggtgagactgggactgctgtggagggatttccttccaagaacacacagaattctggggctccctttccctttctactgaggttgattggaggcttgggaaggagttggttactaagagcacacaaagccctggggaccaccttcattcctctaaccctacggaagatgctatttattccataccttgtttaatgcttcagtgcagctggtccacaagtgtttgctgtatccagaagaaggtcagataaagagtgaaggcacacccctgttggaaaagaagcaacagtctctctmtgattgttgattcactgtttgcctgttgactcctggaattaacactcaacagagtcaagaaacctgggtattggtcttgactgagtgtccttggataaatgcctcccccagtttgaatttgaatttcttctctgtaaaataagggagctggatcacgtgacatctaggttcctttcaagccctgaatctgagtctttaactgtggcttcctagattttgggattggcctacattggcccctgcttcctaccctttattctcagttttgccgtggtctagcttttcatttcttatgtcagg

SEQ ID NO: 46517 - DNA, 601 bp, Human
ttgttgattcactgtttgcctgttgactcctggaattaacactcaacagagtcaagaaacctgggtattggtcttgactgagtgtccttggataaatgcctcccccagtttgaatttgaatttcttctctgtaaaataagggagctggatcacgtgacatctaggttcctttcaagccctgaatctgagtctttaactgtggcttcctagattttgggattggcctacattggcccctgcttcctaccctttattctcagttttgccgtggtctagcttttcatttcttatgtcaggagcrtgggccagccacagtacttttgactaggttgcttgctgtcccttaggtgactgtgtcctcatcatgtccggacaagtgatgccaaggattgctgcaactctagctggcctttggggatgaagtgggttagaacccaacacacactaatatggttggaatttaggctgtgcatattgtctgagaagcaactatcaaattgcttgtatgtctgtgacacaaagaacaagaagagatgaaaggagaacatatactccatgttgtctctccggctggtcctcaagttgtagaatttctgcctct

SEQ ID NO: 46518 - DNA, 601 bp, Human
gtcttgactgagtgtccttggataaatgcctcccccagtttgaatttgaatttcttctctgtaaaataagggagctggatcacgtgacatctaggttcctttcaagccctgaatctgagtctttaactgtggcttcctagattttgggattggcctacattggcccctgcttcctaccctttattctcagttttgccgtggtctagcttttcatttcttatgtcaggagcatgggccagccacagtacttttgactaggttgcttgctgtcccttaggtgactgtgtcctcatcatgtccrgacaagtgatgccaaggattgctgcaactctagctggcctttggggatgaagtgggttagaacccaacacacactaatatggttggaatttaggctgtgcatattgtctgagaagcaactatcaaattgcttgtatgtctgtgacacaaagaacaagaagagatgaaaggagaacatatactccatgttgtctctccggctggtcctcaagttgtagaatttctgcctcttttttccccagtgctagtgggacttcccagtcccagtgcctcctggagaagtttcccgtcattgttcttg

SEQ ID NO: 46519 - DNA, 601 bp, Human
atatcattcacctatctgaagtctcactgtttagaggggtgaccctctaaaccatttctcatgttttttaaggttgaaggaatgtttagctgagcctatgaggtcctataccaaaattttacctatcttctggaagctagcaaggcctaggatttttactaaactgaaaaattcaatgaattagtggaactgagaaatttggtgtttagagaaaatgaaaatatagacagaatacttaccaccatttacaaatatacaatattctcaaaagaaccaattatcaaataaaacattttaagayatctatcctttgaaaaacaaagcctattaattttttaaaaactatcctcgaactggcatatatcccctttgtaaaatatcaattccttaagaatctttctttcaaaatagcaattgtgataaccagggtcattcacttgtgaacttgtcttgtctcctcttaactagatccagaacatttgttttgctcagtgctatcctgctttcactcagcctatctaaagttttactaatttagttcagttgtataacttccctccaggagtagtcatctccagctttaaaattttatttttctgga

SEQ ID NO: 46520 - DNA, 601 bp, Human
ctggcatatatcccctttgtaaaatatcaattccttaagaatctttctttcaaaatagcaattgtgataaccagggtcattcacttgtgaacttgtcttgtctcctcttaactagatccagaacatttgttttgctcagtgctatcctgctttcactcagcctatctaaagttttactaatttagttcagttgtataacttccctccaggagtagtcatctccagctttaaaattttatttttctggaatcatgcaagagtttgttatgcacaaatatggactataggctttaaaaaagcyaaattttatgtcaaattggaatttatctcagtgtctgattatataatgtgatgttgcaaatcaatagatgtgtccctagcactgcatcaagtaaggatgaggaacacaggggccatgtcaatccaagagcttcacagtttgtccattggcagccatttattgaaggaaattgctagattcttggattttccacttattaattttcacatgctggaaaaggtgcgaatttgactagttccatttagtctgcaatttaaaagctaccccaaaatatttgaaagagcttatgacatcattctt

SEQ ID NO: 46521 - DNA, 601 bp, Human
gcaattgtgataaccagggtcattcacttgtgaacttgtcttgtctcctcttaactagatccagaacatttgttttgctcagtgctatcctgctttcactcagcctatctaaagttttactaatttagttcagttgtataacttccctccaggagtagtcatctccagctttaaaattttatttttctggaatcatgcaagagtttgttatgcacaaatatggactataggctttaaaaaagctaaattttatgtcaaattggaatttatctcagtgtctgattatataatgtgatgttgmaaatcaatagatgtgtccctagcactgcatcaagtaaggatgaggaacacaggggccatgtcaatccaagagcttcacagtttgtccattggcagccatttattgaaggaaattgctagattcttggattttccacttattaattttcacatgctggaaaaggtgcgaatttgactagttccatttagtctgcaatttaaaagctaccccaaaatatttgaaagagcttatgacatcattcttagatcatgtgtacatgctcagaaaccaaacctattcctgaatagcccctttctcttc

SEQ ID NO: 46522 - DNA, 601 bp, Human
aatttagttcagttgtataacttccctccaggagtagtcatctccagctttaaaattttatttttctggaatcatgcaagagtttgttatgcacaaatatggactataggctttaaaaaagctaaattttatgtcaaattggaatttatctcagtgtctgattatataatgtgatgttgcaaatcaatagatgtgtccctagcactgcatcaagtaaggatgaggaacacaggggccatgtcaatccaagagcttcacagtttgtccattggcagccatttattgaaggaaattgctagaktcttggattttccacttattaattttcacatgctggaaaaggtgcgaatttgactagttccatttagtctgcaatttaaaagctaccccaaaatatttgaaagagcttatgacatcattcttagatcatgtgtacatgctcagaaaccaaacctattcctgaatagcccctttctcttcagccaatttaagcaatcagtagactgttttgtatatgcaacattaactcatttggaagatttatgcttatgctgttgctctgactgagctggtcagaggattttagaagtttccaggcgaa

SEQ ID NO: 46523 - DNA, 601 bp, Human
agtagctgtcagaggattagagacaattcattgaattggattacttgttgtcacaaatattataatagtattgtagagcacagaccaacggagagctgttcccatttgctaggatgttgttactgcttcggttttatttttatttaaattttttatctctgctattctcctttatggtcaaaattgtaaagagtgcatctttggaggaatgcaaggtaggcaagcttgctaagagcttctacaagactaccttaaaagaagacttatatttaacaaacagaatctcaacatatggacatasaccctcttgagctggttagaaaggacttttttctttatttgctctttttgaccactgacatttattttaatttttttcatttttaaacatttttattttgaaataaagtaaaagattaacaggaagttacaaaatagtatagaaaggtcccaggtacccagttttccccagtagtaacatcttgcataactacagtgcaataccaaaacccaagaaattgacattcgtgtgattcacaacgttattcaggtaagaaggtctttttaaaacaagaaataattcattacaaccacggggttc

SEQ ID NO: 46524 - DNA, 601 bp, Human
catattctatgagtaataaatttagttttgagggataagatagcaaaccataaatatggaagcactctcttaaggtcaacattaaatctgataatatgtagaatagatttaagactatttcgaagtttcaactagagtttcacccagtgtgctttcttcttaggttttaatgctggtttacaaaaggaaaagtaaattgctttctggtaacaaattattgcagaagatcttctacttaaagcatagatgcatttttatttttcatttacttctctgtttttgaagggttcagtgtttattyggcggaggtttatgtcaattatttaatcagaagcaggccccagagtttgccagtgatattttggaatgtagggtctacttcaaagaaaggttccatgtctcttgacccagatgaagccaatttttcatagtgaagagcaaggtaattcgattttctttttcagagcaaaaattatttttagactgaatttgatgggtcatatttctctgctcagtaaatcttgcaattatcactccacactggaaaatgtaactcaatgacccaccattgcgccagagcttctgtgggcagccgagctcc

SEQ ID NO: 46525 - DNA, 601 bp, Human
gagctccgagaggcagctggacatgatgtgaagttggtgtctatgacatactgcaagatggaaaccaagcagtcaaccagtggcagtagttcacatgccaacatttttgtttatttgtaatggaaaactttaggaggaaaacacaggagactgggtgccatgggtgtgaggtagagatttcaatcctgttcagtcacaggaaaatccaaattggccacgctaaaccagatccaaaatcccagactaatttcctctcctctttcctctgcgagtgtttctgatttcacacaaggcaagagcmactgagaacagggagcctgactagatgaagtaagaaccgtcgtgaggcccaggagcaagaaaaaaaggcctggagttgtagaacatgctagaacatgaatgacagtctctgcggaattaagaagcattctccactctattccatggcctcttgctgacctaactcctagtcttccttcacatctcaccttaggataccacttcctaaggaaagcttaacagactcaagtttgacttattacctttctctgtgccctgacaattcctgataccctctccagagcagggttatcacaccaca

SEQ ID NO: 46526 - DNA, 601 bp, Human
ttcaatcctgttcagtcacaggaaaatccaaattggccacgctaaaccagatccaaaatcccagactaatttcctctcctctttcctctgcgagtgtttctgatttcacacaaggcaagagcaactgagaacagggagcctgactagatgaagtaagaaccgtcgtgaggcccaggagcaagaaaaaaaggcctggagttgtagaacatgctagaacatgaatgacagtctctgcggaattaagaagcattctccactctattccatggcctcttgctgacctaactcctagtcttccttyacatctcaccttaggataccacttcctaaggaaagcttaacagactcaagtttgacttattacctttctctgtgccctgacaattcctgataccctctccagagcagggttatcacaccacattgtaatatttaatattgacatccctactggactgcaagcctaatagaacttgggccataccgctcaagtttacaattgcatgctttttgcttagcactgtgtctagcacacaggaaatgcttaatatgtatgcgttgtttatgttatccatgccttaatgtttgggatgctccagat

SEQ ID NO: 46527 - DNA, 601 bp, Human
ttaaaaattaatctcttttaaaatgagattttccataaatgctagatgcccaatttcaaaggaaaaatctatgtgatactctgacatattggtcaaatattttattctaggggacatggtgggtagcaaggggtggtcgtggactgtaggaagtgttgacttcaaaatatatattagcatttccatcattttaaaagattttttaaaagactaacaatataacatatggacaaagggatacattccttagaaaaattttaatggtaacatgaaaccacagtaaacagtgaaggagaggggrggagaaaaatgatgcaaactatttacttccccttagaggctagaatgcagttgttttctattaaacttagattacgtttatgcgtaactgactcaattataaaatgaaagctaagcaactgttggaatttgtgattacaccatgtaaatgttacataccttggcaatgtaaaataataatataattttttaaatagagaagaaagagactgtaagaaaaaaagtaagtgtacaaatttccctatgctttatagtagggattcagataatgtctagtgataatatctgtagttaaaacaac

SEQ ID NO: 46528 - DNA, 601 bp, Human
aaaatgacttctccgtgggtcaccctgcccaccccacctgtccctccacatgcccccttaaaatgcaaaattgctggaagcttggggaagatgtatgcctctatatgtacgtacatatcatctcaaaaggaaaatttctgtaattttcatctaaaagatgcctatgagaacaaagccaaacaagtagctaaggcccgaagcactgaatgggatgaataaaatatctcgatatttacatggttcattttgaccgtacccacagggcagcaaacatctgcgtgaaaagtaaagaattcagccygttagatgactggttgtgaagagccaaacattgggtatcatgtcatccacatgtctggttgattgaatatgaattgccccctttttatccagatagcttcagcaatagataaagcatggagatttttccacattttacatggtgcttggtgttgtagaattcagcctttgtgtgttcttttccccccgtcttgctattgcctggatctcattaggaaccattagtgatgtaatactaaacctatggaatcttaaacatgcttttaaaatcctgtggaataaagatgtctcctaccaaacc

SEQ ID NO: 46529 - DNA, 601 bp, Human
accctgcccaccccacctgtccctccacatgcccccttaaaatgcaaaattgctggaagcttggggaagatgtatgcctctatatgtacgtacatatcatctcaaaaggaaaatttctgtaattttcatctaaaagatgcctatgagaacaaagccaaacaagtagctaaggcccgaagcactgaatgggatgaataaaatatctcgatatttacatggttcattttgaccgtacccacagggcagcaaacatctgcgtgaaaagtaaagaattcagcctgttagatgactggttgtgaaragccaaacattgggtatcatgtcatccacatgtctggttgattgaatatgaattgccccctttttatccagatagcttcagcaatagataaagcatggagatttttccacattttacatggtgcttggtgttgtagaattcagcctttgtgtgttcttttccccccgtcttgctattgcctggatctcattaggaaccattagtgatgtaatactaaacctatggaatcttaaacatgcttttaaaatcctgtggaataaagatgtctcctaccaaaccaaaaatgcagtgggaatagac

SEQ ID NO: 46530 - DNA, 601 bp, Human
atgtaattttttcccagttccccctcaattgtacatacggagttttctgctttttttcattttctattgtgatgataacttctcaacagaagggttaaaagaatatttgacacccattatattacgctgttaaagaatattagaactagagatatacgtcacttggtcagatctgagctccagggcctgatgtctctgatgatggcaagaagagactgttgttggaatttgtgttattctctgagactttaagaatactacctttccttcagaggcttttaaatatctattatgcagtaayatctctaaactactcttgaacctatgcacatttttatcatggtaccagcattgaaagtaatagattccaagtgtttaatacttataatggaaagaggtttttctattatttgacctaaaatgatcacttcaaagctttaagatttagataaagtggggagaaagggggataggaaaaggagcatgggaaaaggggtaaggtaattaacatttataagatgatggccaagtttattagaaaacagatggagtcatacatttgggtagacctgaacttcacttccagctctgtctcattcca

SEQ ID NO: 46531 - DNA, 601 bp, Human
agttctttttttcttcattcccacaaagctgctgcatttaacagactttgatgaatggtttatggtgatagaagggcattaaaatgcagcccacactggatcacagctcaaaattaaatattttaatttgagaaaaaaattaactctttagctctttgccttaattctctcccatgtgattttggagtggacagggccattcaacttttacaaccacaaagcaaggtcaggatatttatgtaaacaaaatacaatagttatctaccctgggcttatgcccttagtaactctaagaagcaayagaagttttgacattagtttttctttaacttggcccaggctgaaatcttaggcagatctccctatctcagtggaccaggacaatgtcaggagccaatgggtattcatttgctacattcttagttgggaaaatgaatccagcactattttccagaatgtagtaagattaggaagagagtaaaaacagaaaatgggcattttttgccatttgctgagctttttctccataccaggttctatactgttatacacgttaccccatttccctctcacaacaaccatgcaaggtaggcattctcca

SEQ ID NO: 46532 - DNA, 601 bp, Human
ggtcctctgcaccaaggcagttttcttgagagcattttctcactggtttaaaagcaatagagacaaatgtggctcagagtatatttttaaatgtggctggaaagaaaaataaaaattcactgatccaaaaagaattcggaatcgcagctagaccaaagtcagatttttaagctggaagacttggagagatttgggtatttgcttgcttcttattgaaagactcaatcaattttttaaaagcccagccaaccttaacacagatataggagaggaaatcagaacaaaactgcatcatctgttscataattgtccaatgttgttctcgttgcttaatctcgtgggttagaaacccagcatttgagctctggattcactacattctgagtaatcctagacactgggcttaatttcattgtttgtcaaatgggggatgatatactacctatatcataggattcttaggaaaatccaatgagataatgcatgattcaactattaccaaaaaagcatattataagccttctgtttttcaaactacaacacttggagaaaagtagcagcagagaaaatagcttttaggtctgcccctggttgctctgat

SEQ ID NO: 46533 - DNA, 601 bp, Human
aagaattcggaatcgcagctagaccaaagtcagatttttaagctggaagacttggagagatttgggtatttgcttgcttcttattgaaagactcaatcaattttttaaaagcccagccaaccttaacacagatataggagaggaaatcagaacaaaactgcatcatctgttccataattgtccaatgttgttctcgttgcttaatctcgtgggttagaaacccagcatttgagctctggattcactacattctgagtaatcctagacactgggcttaatttcattgtttgtcaaatggggratgatatactacctatatcataggattcttaggaaaatccaatgagataatgcatgattcaactattaccaaaaaagcatattataagccttctgtttttcaaactacaacacttggagaaaagtagcagcagagaaaatagcttttaggtctgcccctggttgctctgatacagttatctgcttttcatttagatttatcatattctgctttgacagctaataattattcatctatatattcattcttttattcagaatattgagcacttagcaagtgccaagctcttaattaggagct

SEQ ID NO: 46534 - DNA, 601 bp, Human
ggaaaatccaatgagataatgcatgattcaactattaccaaaaaagcatattataagccttctgtttttcaaactacaacacttggagaaaagtagcagcagagaaaatagcttttaggtctgcccctggttgctctgatacagttatctgcttttcatttagatttatcatattctgctttgacagctaataattattcatctatatattcattcttttattcagaatattgagcacttagcaagtgccaagctcttaattaggagctcttattctcatctttgcaaatagatgataaayctataaagctccccccccatcttatcattagatactcttttgaaatatttttatttcaagatacatgttggccattcattcattccatgtatatttattgagtgactactaaatggcaggcaactgcaaagtgctgaggaatcattagtaaacacaataaatacatcctcatggagatttcagtctagtagaaaagacagatattaaatacataagtaaccaaacataaatatcattgcaaattgtgattgtacatgaagacaaagagcagagacttacaacagagaatgacgtggaagt

SEQ ID NO: 46535 - DNA, 601 bp, Human
tagatgcactatgaagctactgaaatgttttaagcatgggagtgacatgattagatttatgtttttaaaagggtaattgtttgcagatggctggaagatagaacagaaagaccagttgggaggaagagtccagatgagatgatggtggcttggatttgagtgacagcaacaataatgaagataaatgaaccattttaggcaaatatcctgaagggagaatcacctggatttagtaatttactgtagagggagtaacggtagatgaggaaggaggaagtgtatgaaatgattcccaagtccrgagcttaagcaaccaggtaaatattggtgtcatttgctaagatgggaaaaacttgggaaacaaggactgtgttcaattctgtcctgtttgctgaggaaaaaaaaaaggggccagggagtagtggtggaactttttgtgagttatagagaggaaacaaaagtataaagcttaacacccatcttcagaatgcttgcaccctaagcattaaatccactgttgatatttccttaacaggctttctcaaaccaccagaggctctactatgatgtgtgttatctcactcgtagaatttattctttc

SEQ ID NO: 46536 - DNA, 601 bp, Human
aaagaccagttgggaggaagagtccagatgagatgatggtggcttggatttgagtgacagcaacaataatgaagataaatgaaccattttaggcaaatatcctgaagggagaatcacctggatttagtaatttactgtagagggagtaacggtagatgaggaaggaggaagtgtatgaaatgattcccaagtccggagcttaagcaaccaggtaaatattggtgtcatttgctaagatgggaaaaacttgggaaacaaggactgtgttcaattctgtcctgtttgctgaggaaaaaaaaaaggggccagggagtagtggtggaactttttgtgagttatagagaggaaacaaaagtataaagcttaacacccatcttcagaatgcttgcaccctaagcattaaatccactgttgatatttccttaacaggctttctcaaaccaccagaggctctactatgatgtgtgttatctcactcgtagaatttattctttcttcacccttcctctgtgtgtgtccaaatataatgcagttgattttaataatttaatttgctacacctttgaattatctcatttatcaaggcatcagtcaatcttaa

SEQ ID NO: 46537 - DNA, 601 bp, Human
gttcccctctatgtgtccatgtgttctcatcatttaactcccacttataagtgagaacaagcagtatttagttttctgttcctgcgttagtttgctaaggataatggccaccaactccatccatgtccctgagaaggatatgatctcaaaccagatttttaaaggcaatatattttttttggtgcttctataatcttggcagtgaataatgacaatagaagtctttaccattttgtcttcctgttatttactgtaactcaactacaaatattccaacttctccagtggtgtatgtggaaamaagaagagttcacagaaagaaaattatgatcagtttgattcccctgagagccgctgatagagtactaagctctacattacttagcaatgcaaaaacaaagtggtagagatttagtgatcaagatttatgtacaagaatgtccatcacagcactacttataatagcccaaacctgaaatactctcagtgtccagtgataagggaatgattacatataactgtaaagttatcatgttttaaaaattgtgtaaaaaatatgtataatataataagtgaaaaaattgagtgcataacatcacat

SEQ ID NO: 46538 - DNA, 601 bp, Human
ccaaaaacagatgtagtgattgatttgtcctaaaataaaaaataaccagctcctgctaaatggacttagttgttaactaatcaaacacaggcagaatggtgttctacaaaaagaacagatttggagacccagctcctcccatcactagctgagaagccttgggtaaaccatttaacctctctaggcctttctaggtcttatttataaaatgttgccaataatacttgtcttactgacctccagggtttctatgaaaatcatttaagaatagagatatgcaagccctgtttactgtaaaagkgccatgtatttgtattcttaacccatttgtgatgtcactaggcacttggaaatcagcccacaaatggctgatctgattgatgatagaagcataattgccctgtgaccaacccacttcatccctaccaaacattccagacatttcagtgcaggaacaaggtctatgggaaaaagtcaaaaggagactgatcagaggaattccactggcccttcccagggccctgtgcacaaaatggtcccctgtgcattgttattttgctgtgtttgccgatgtccacagcttcctagacattaacagatg

SEQ ID NO: 46539 - DNA, 601 bp, Human
cattgggaagcccatactcatgcaatgctaccatagaggcattaaccaagtacaatggaagaagaaaaaaacccttcagcgtagtaattactatcctcattttaaaattgaagtagctgatacctgttagttatctttgttaaagagcttctcttaggttattaagtgtagagttctatgtgacccatagtcagtcttacaattccatgctgttttaatgggaaagatctatgttcaatccaactgaatgatttaaagctttgtctgctatccaataaatctgtttgctacagaatgccayaaaaattctgactttcactgaataattgactttttctttaattataagaaaaatttccttaatttcccactttagcctgtttggtagctaaattcctaacatattatcatattaatacatcttgtccctcttatctactcatttatacaaatatctgtatacatttccatatgcataataattccttaataacacagaaaacatatcccataaaaatcaagagattctcatacagacataaacctatacactaaactacaagcatactatagatgaatttgttcaagatacatagggaaa

SEQ ID NO: 46540 - DNA, 601 bp, Human
tcatttaggtgcgggatgatgttacttttctacagacaggggttgtcttaccttctggttgttttgatagagttgggaaagttctcttcagttaaatggggctgagctgatctacaactcatcttccattttgcaagactccttcaacctctggtttgctccttctccgtggctgaactctccaagtgtcctaatgcctccaaattaattttggttttgtggaatattatccagagtttctagttattctcaatgaaagcactggactgccacaagctattccatttaggcagatacctaygtcagtctagctacattccacaaactcatcaacaatctcctccaaaacatttaaagaaaaatgttgtgtagaactcaaaaaggtaaaagaaaatgtcagtgttggcagctatggctgctccatgtatcctgtcatggaaggagctttggaataaaacaaacctgggttttaattctaacttgtcatttattaactgtgtgacaatgaatcttacttccaagtggggataataaaaaacaactagtttcacagttttcttgtgaagattaaatgaaagaacagatatcaaatacctcgcaa

SEQ ID NO: 46541 - DNA, 601 bp, Human
catcttgggccttttccttccttactacctccggtctagactcagctttccctgcagagacctttggcaactgcttctgagccagggcagccagcatctgtgtgtcgggcactgcattaaaagctatggcttaaagggctcaagggaggaatggttcacccgggcgtctatttgaagttgcgaggtaactgatgggagagaaagatcttaaacagggagtaagagctttagcaactctctggcccttagaccctaaatctgaaaatagaaaggaaagagattatctgaagacaaactccaytgttagtgactctgccattcattttatgttttctcttgaaagcctttctgtctttgtctcactaacaaggtagttcatggacatacatagacactacagaccaaaaaagttttccacttataacattttcttccttcagtttccctttattcattctcaaattttgaaataaaattactgaggggattgggagcagtgaaaaagaaacttggcaattagatactatccctgggtttgtcttaactatacctccttctccagaataatttattcagaataaatggatggactttgcgataa

SEQ ID NO: 46542 - DNA, 601 bp, Human
ctttagcaactctctggcccttagaccctaaatctgaaaatagaaaggaaagagattatctgaagacaaactccactgttagtgactctgccattcattttatgttttctcttgaaagcctttctgtctttgtctcactaacaaggtagttcatggacatacatagacactacagaccaaaaaagttttccacttataacattttcttccttcagtttccctttattcattctcaaattttgaaataaaattactgaggggattgggagcagtgaaaaagaaacttggcaattagatactrtccctgggtttgtcttaactatacctccttctccagaataatttattcagaataaatggatggactttgcgataactgtattttccttaaaatgcaaatgcacaatagctatttctacccctgccttacttctccctttagattctaactaacaacagtacttgaggaagaaatgatatttgaaaatatatagtctgtattagctaaaattcattcaactgaattatgtttccatcctccttttattccaggtatcattggaacatttcaagatcatcaaatcaaattccacagggattg

SEQ ID NO: 46543 - DNA, 601 bp, Human
aattaatcagttagaatctatcaagttttgaaggatctatcaagtcttttatcctgttttgtaatctgatttttttttttgctttatttttaaatgtttcctgcaatgtaatatctttcacaaaacagtcctggatcaatcatgaagtcttcacttcctgtgaaaaatgctagtgacttgaatcaataaagacaacatgagtcagccttccaaggtgaataagctcacctttgtgcaaacactggtgatctcaggagtgctaagtacccctcactttcaacaaatctctctcacctgggargaaaacttctaccagaacaaggaccacctagggaggtgaaagaggggatttccactttagaggatggagaaaccaaagggcatttcactcattcacagttttgctgagcttggctccagtaggtagaaaagttcttcaggagttcagcacaccactcaggcaattgttgtttcaaaattctatctgttgcccccatgcaagttttctcaggctaccatagtgaaaatccacagactgggtggcttaaacaacagagatttcttttctcaccattctggagggtagaagtctgagatcaaa

SEQ ID NO: 46544 - DNA, 601 bp, Human
cctgcaatttatttgctttaagactgtctccaaatgatgagtattaaagatgctttctcctcacttcctgccccccaagacaggtagaaataagttaaggctgaggagaaaaattgaaagaaaggtgtgattgactaatagcaggagagttacctttctcccagaggtaggaaatagtaaatagcacaagcatgccccagttaaggtggcctttccacaagaaaactgttcggggatccaagagggacttactgagtttgaagcctgtgggacatgcaagggcatgtgtctagaaaacaaygcatatgcaggtctgaaggtcaggtgagaaccagagatgttcacagtcaccacctacaggcaggaagcagcagtgtgtcaatgaatgaggccaccaaggaagactgtgtagagggagaggagcagtggcttaaagattccatcagaaattgtgtatggaaatttttcctgctagataacaggagaaggacccgtccaagaggaagaacactgcacgatacttctaatgaagctgtgtgagaacatgtagatgagctaatgtgtgtgtctattttttctcccctagtgtttttggacctat

SEQ ID NO: 46545 - DNA, 601 bp, Human
gtgtgagaacatgtagatgagctaatgtgtgtgtctattttttctcccctagtgtttttggacctattttgttccttctctgtcctgtcttttgggggctatgccccaaaccattcctgtgagccttctcctacccacctttgctcccttctagctaactccacctatggtcattgtccaactcccctgctgcctgctcagggaatcttagacaaacttcctttgggcccattttcttcatcagccaatcagagctgatcagaatggacaggaggggaggccaggatgagaatccttaatraccaaagagacagaggcaggtcgttttcagggtcaggtggctgtgacgctatggtcacagagcatcatcttgtttagtcagtaaaggccccagataggggtggagggctgtgcctcttttgccctgaactccctcctttgtccattgtcccctgctgattgtcccactccacctgttccccagaataagctttggcagtattttagggtttccctgccagaccagagagtggaggggccaggccatggcccctgacagtcattaccagcctcccctctctaggcctcaccatcaaatgtc

SEQ ID NO: 46546 - DNA, 601 bp, Human
ggaggccaggatgagaatccttaatgaccaaagagacagaggcaggtcgttttcagggtcaggtggctgtgacgctatggtcacagagcatcatcttgtttagtcagtaaaggccccagataggggtggagggctgtgcctcttttgccctgaactccctcctttgtccattgtcccctgctgattgtcccactccacctgttccccagaataagctttggcagtattttagggtttccctgccagaccagagagtggaggggccaggccatggcccctgacagtcattaccagcctcccmtctctaggcctcaccatcaaatgtcatttctcacggagccatatttacccctgggctgaatttccctaatttgccctgctagcatgatgcaaataaaaggggtaaaggtatttattcatctctcttttattttccaaagtgttatttcttttcctttaagttctctccttgctttatgtttcttctctctcccttagttctccttccttagtagaaacccttgagcttcagggtgattttctgattatgagcagaagaggctatcagagatctggaagccacctcctgcatttctttatt

SEQ ID NO: 46547 - DNA, 601 bp, Human
ctctcttttattttccaaagtgttatttcttttcctttaagttctctccttgctttatgtttcttctctctcccttagttctccttccttagtagaaacccttgagcttcagggtgattttctgattatgagcagaagaggctatcagagatctggaagccacctcctgcatttctttattccccctcctcacccaattgttttaaatgtacattgagataccagctttcttcaagaacccacttccacactttcctctttgtgttcttggagtagccaggaaaaagatgcccattttctygaaggtacccaaaatgtcagtgacacttgggtcagtgattttatgcaaattactaattatatcaaatgagaaatgttgaaagcaagaggaaaccctttgcaatccatgaatggtctagttggggtgttccaatgaatgatggccagtggccaacataggtgcctcccgactgtgtttcattaatttcagtcagctcgtgggcttggagagaaagatcattttcctatgagcacgtaaaagaagtgctttgagttgtaagcacttcgaaggctttgcccttgttttcgaatgggagatttt

SEQ ID NO: 46548 - DNA, 601 bp, Human
gtaaccttgcccaaataaacgtgtttccccggccagggaattgcacctggtcttaagaggcacctccatgaaaacacacctttctgcctggcatgaccattgacagagaaagactgtgctgagaagggggatacagcagggagaaaaacacacaacggtgccaggagctcttgtctagaactcctttccaggctttttttccccataagcgcaagtgagtacacaagtaaagagaaaagaatgattgtgctatttagctttgaaccaaaaactatcaagcctttcctaaggttccaactgkaatagcatttgtacagttacaggacacagactcaattgcttctgaactctgctttaggatgcctaacaggattaagttgtgaacatctcataccacgccgtgcaacagtactcaaataggacttaagcagaacaaacagtctggggaaaaaaaaaaagccctaagacattttccttcctactattctctgtatcccaggctcaacttaatgccaaattaaatctggatttttttttaatagacgtttcctagaggaaaaggcagagctgcattccctgaaacatattttagcccaaactt

SEQ ID NO: 46549 - DNA, 601 bp, Human
cacctggtcttaagaggcacctccatgaaaacacacctttctgcctggcatgaccattgacagagaaagactgtgctgagaagggggatacagcagggagaaaaacacacaacggtgccaggagctcttgtctagaactcctttccaggctttttttccccataagcgcaagtgagtacacaagtaaagagaaaagaatgattgtgctatttagctttgaaccaaaaactatcaagcctttcctaaggttccaactggaatagcatttgtacagttacaggacacagactcaattgcttcwgaactctgctttaggatgcctaacaggattaagttgtgaacatctcataccacgccgtgcaacagtactcaaataggacttaagcagaacaaacagtctggggaaaaaaaaaaagccctaagacattttccttcctactattctctgtatcccaggctcaacttaatgccaaattaaatctggatttttttttaatagacgtttcctagaggaaaaggcagagctgcattccctgaaacatattttagcccaaacttataacttggattttttctttcctcctccctttcgctaattcaa

SEQ ID NO: 46550 - DNA, 601 bp, Human
gaaaaacacacaacggtgccaggagctcttgtctagaactcctttccaggctttttttccccataagcgcaagtgagtacacaagtaaagagaaaagaatgattgtgctatttagctttgaaccaaaaactatcaagcctttcctaaggttccaactggaatagcatttgtacagttacaggacacagactcaattgcttctgaactctgctttaggatgcctaacaggattaagttgtgaacatctcataccacgccgtgcaacagtactcaaataggacttaagcagaacaaacagtcyggggaaaaaaaaaaagccctaagacattttccttcctactattctctgtatcccaggctcaacttaatgccaaattaaatctggatttttttttaatagacgtttcctagaggaaaaggcagagctgcattccctgaaacatattttagcccaaacttataacttggattttttctttcctcctccctttcgctaattcaaaacaaaatgtccatcacgcactctaacaccagcctctaagagctagagacaaatgaagtctgaatattcacgccaatgtggtacaaatgagctgtgatt

SEQ ID NO: 46551 - DNA, 601 bp, Human
aacacacaacggtgccaggagctcttgtctagaactcctttccaggctttttttccccataagcgcaagtgagtacacaagtaaagagaaaagaatgattgtgctatttagctttgaaccaaaaactatcaagcctttcctaaggttccaactggaatagcatttgtacagttacaggacacagactcaattgcttctgaactctgctttaggatgcctaacaggattaagttgtgaacatctcataccacgccgtgcaacagtactcaaataggacttaagcagaacaaacagtctgggraaaaaaaaaaagccctaagacattttccttcctactattctctgtatcccaggctcaacttaatgccaaattaaatctggatttttttttaatagacgtttcctagaggaaaaggcagagctgcattccctgaaacatattttagcccaaacttataacttggattttttctttcctcctccctttcgctaattcaaaacaaaatgtccatcacgcactctaacaccagcctctaagagctagagacaaatgaagtctgaatattcacgccaatgtggtacaaatgagctgtgatttcag

SEQ ID NO: 46552 - DNA, 601 bp, Human
accagcctctaagagctagagacaaatgaagtctgaatattcacgccaatgtggtacaaatgagctgtgatttcaggatgctggctgttttactgacaggggaaaagggcagttgactagtttaatatatttggctgaaaacactttgctaaagagcagtgaagaaggccaatgttaataatgaatcctgttctttaatgaccaaatatgatatatcatggaatggggcatcctgagtttgggggaaagcatttcaccatatccacaggatgcagacgagaatgaatgcaaacatactgcmttcatgttgggccctaatgaagaagctcttctaggagtattttctccaagttcctcaaagaattcctcccataagtatatgataccatgattttgaatctgatttcacacagaattacaaaattataaatataaagacatttgttattatgagagactccgggaatctagctaactgtctcccattattggctaatggtttataaattttaaaatgcaattataagttggggttgatgagggaagcctgtgaccaccattagcaccttccttaaatatgcatattcagtcagtcgttaat

SEQ ID NO: 46553 - DNA, 601 bp, Human
aagaaggccaatgttaataatgaatcctgttctttaatgaccaaatatgatatatcatggaatggggcatcctgagtttgggggaaagcatttcaccatatccacaggatgcagacgagaatgaatgcaaacatactgcattcatgttgggccctaatgaagaagctcttctaggagtattttctccaagttcctcaaagaattcctcccataagtatatgataccatgattttgaatctgatttcacacagaattacaaaattataaatataaagacatttgttattatgagagactccrggaatctagctaactgtctcccattattggctaatggtttataaattttaaaatgcaattataagttggggttgatgagggaagcctgtgaccaccattagcaccttccttaaatatgcatattcagtcagtcgttaattcattcattctacagatatcactggattggaccttctccatctcacgtgccatattagttctgtgttacatttgcaattctagtattccttaccataaaatgggcttttttttaattaaatgcaatggaaaattttgtgaatccaatgacgtgttcagtga

SEQ ID NO: 46554 - DNA, 601 bp, Human
actgcattcatgttgggccctaatgaagaagctcttctaggagtattttctccaagttcctcaaagaattcctcccataagtatatgataccatgattttgaatctgatttcacacagaattacaaaattataaatataaagacatttgttattatgagagactccgggaatctagctaactgtctcccattattggctaatggtttataaattttaaaatgcaattataagttggggttgatgagggaagcctgtgaccaccattagcaccttccttaaatatgcatattcagtcagtcrttaattcattcattctacagatatcactggattggaccttctccatctcacgtgccatattagttctgtgttacatttgcaattctagtattccttaccataaaatgggcttttttttaattaaatgcaatggaaaattttgtgaatccaatgacgtgttcagtgacgtaaattgtgatttctaatactgtatttatttttcattggcttcgtcttggcaaagggtcataatattttaaatttctctgccctctcatccacctatcacactttattatgcggtttataggcaaaacacag

SEQ ID NO: 46555 - DNA, 601 bp, Human
tataagttggggttgatgagggaagcctgtgaccaccattagcaccttccttaaatatgcatattcagtcagtcgttaattcattcattctacagatatcactggattggaccttctccatctcacgtgccatattagttctgtgttacatttgcaattctagtattccttaccataaaatgggcttttttttaattaaatgcaatggaaaattttgtgaatccaatgacgtgttcagtgacgtaaattgtgatttctaatactgtatttatttttcattggcttcgtcttggcaaagggycataatattttaaatttctctgccctctcatccacctatcacactttattatgcggtttataggcaaaacacaggcatgcactggctatatctgtaaatctacttttctgcaaatcacttgaagggtaatgcataattgccccctacattattgtttcctagattctaacttttgtatagaatgttgttaaaagcagattataatgtagttccaagtatgctgcttcctctgtatccataggggattggtttcaggactcccgaggataccaaaatatactgatgctcagttccctgata

SEQ ID NO: 46556 - DNA, 601 bp, Human
tggcaaagggtcataatattttaaatttctctgccctctcatccacctatcacactttattatgcggtttataggcaaaacacaggcatgcactggctatatctgtaaatctacttttctgcaaatcacttgaagggtaatgcataattgccccctacattattgtttcctagattctaacttttgtatagaatgttgttaaaagcagattataatgtagttccaagtatgctgcttcctctgtatccataggggattggtttcaggactcccgaggataccaaaatatactgatgctcarttccctgatatacaatggcacagtatttgcacataatctatgcatatcctatcgtatactttaaatcatctctacctctaacacctaataaaatgtaaatgctatgtaaatcactgttatactgtatttcctattatattttttattgttgtatggtttttttaattgcgttggttttttttaaaaaaatatttttctatccctggttgattgaatctatggatgcagaacccatggatatggagagctgatagtaattgaatttaaaagcaaaataagggtgctgtgatatttttatga

SEQ ID NO: 46557 - DNA, 601 bp, Human
ctcatccacctatcacactttattatgcggtttataggcaaaacacaggcatgcactggctatatctgtaaatctacttttctgcaaatcacttgaagggtaatgcataattgccccctacattattgtttcctagattctaacttttgtatagaatgttgttaaaagcagattataatgtagttccaagtatgctgcttcctctgtatccataggggattggtttcaggactcccgaggataccaaaatatactgatgctcagttccctgatatacaatggcacagtatttgcacataayctatgcatatcctatcgtatactttaaatcatctctacctctaacacctaataaaatgtaaatgctatgtaaatcactgttatactgtatttcctattatattttttattgttgtatggtttttttaattgcgttggttttttttaaaaaaatatttttctatccctggttgattgaatctatggatgcagaacccatggatatggagagctgatagtaattgaatttaaaagcaaaataagggtgctgtgatatttttatgaaatgctcatgagaatcaaagatgagagaccagaagcc

SEQ ID NO: 46558 - DNA, 601 bp, Human
tagaatgttgttaaaagcagattataatgtagttccaagtatgctgcttcctctgtatccataggggattggtttcaggactcccgaggataccaaaatatactgatgctcagttccctgatatacaatggcacagtatttgcacataatctatgcatatcctatcgtatactttaaatcatctctacctctaacacctaataaaatgtaaatgctatgtaaatcactgttatactgtatttcctattatattttttattgttgtatggtttttttaattgcgttggttttttttaaaaawatatttttctatccctggttgattgaatctatggatgcagaacccatggatatggagagctgatagtaattgaatttaaaagcaaaataagggtgctgtgatatttttatgaaatgctcatgagaatcaaagatgagagaccagaagccaatttaccgtgaagtcagtagagtttaagccgcagggcctctcatggggagaggtccctgcctcaacacccccatgcctaactttttacatttactattgtattctggttttccaagaaggcctctcaaataatcttcaggtcccacaaaa

SEQ ID NO: 46559 - DNA, 601 bp, Human
gaggtccttgctacagtctactatgtattatccatttacaggtcttgtgagatgtaacagagtgttgtgattaaaagcacacaatctggggctgagttgcctggatgtagaccccagctctaccacttactagctatgtgaccttgggccaatgactcaccttctctgggcctctgtcttttcatctgtaaaatggaaataataaggattgtcacaaggatttaaactgatattatcacagttcttagaactgtgcttggtacatagtaagtgctacataactgttgtcgaaagaaatcarcttatccatctagaatgaaagctatatgggattgcttgtgggttcactcttgcaactcctcacagtgcctaacatggcacatggtcagccatcaatgaaagacagcaacccagggcccatgctgccctgcaaatgtgcttcccttgtccacccttgatgtggtttggctttgtgtacccactcaaatctcaccttgagttgtaatattcctcatgtgtcatgggagggaccaggtgggaagtaattgaatcttgggagtgggtttttccctgtgttgttctcatgatagtgaataagtct

SEQ ID NO: 46560 - DNA, 601 bp, Human
gttgcctggatgtagaccccagctctaccacttactagctatgtgaccttgggccaatgactcaccttctctgggcctctgtcttttcatctgtaaaatggaaataataaggattgtcacaaggatttaaactgatattatcacagttcttagaactgtgcttggtacatagtaagtgctacataactgttgtcgaaagaaatcaacttatccatctagaatgaaagctatatgggattgcttgtgggttcactcttgcaactcctcacagtgcctaacatggcacatggtcagccatcartgaaagacagcaacccagggcccatgctgccctgcaaatgtgcttcccttgtccacccttgatgtggtttggctttgtgtacccactcaaatctcaccttgagttgtaatattcctcatgtgtcatgggagggaccaggtgggaagtaattgaatcttgggagtgggtttttccctgtgttgttctcatgatagtgaataagtctcacaagatctgatggttttataaaggggatttcccccacacatgctctctcttgcctgctgccatgtaagacgtccctttgctcctcattcacct

SEQ ID NO: 46561 - DNA, 601 bp, Human
caactcctcacagtgcctaacatggcacatggtcagccatcaatgaaagacagcaacccagggcccatgctgccctgcaaatgtgcttcccttgtccacccttgatgtggtttggctttgtgtacccactcaaatctcaccttgagttgtaatattcctcatgtgtcatgggagggaccaggtgggaagtaattgaatcttgggagtgggtttttccctgtgttgttctcatgatagtgaataagtctcacaagatctgatggttttataaaggggatttcccccacacatgctctctctwgcctgctgccatgtaagacgtccctttgctcctcattcaccttccaccatgattgtgaggcctccccagccacgtggaactgtgattcaattaaacatctttcctttataaattacccagtctcaggtatgtctttactagcagtgtgagaatagactaatacaagcatttttttcaaattttgagtctgaatgctcatagggatgcagggatgcatatgttctccattttcccataagctaccactccccaaatagttacctctttggtcctttaagctatttgagtttgtcatgcctg

SEQ ID NO: 46562 - DNA, 601 bp, Human
gtaagacgtccctttgctcctcattcaccttccaccatgattgtgaggcctccccagccacgtggaactgtgattcaattaaacatctttcctttataaattacccagtctcaggtatgtctttactagcagtgtgagaatagactaatacaagcatttttttcaaattttgagtctgaatgctcatagggatgcagggatgcatatgttctccattttcccataagctaccactccccaaatagttacctctttggtcctttaagctatttgagtttgtcatgcctgatataaatgaatratcccataatacacgaacactgcaacagttagtggcagttttatggctcactggagtaaagagatgggcccataaggaagtgaaatatgagtcacttccactccctgatgctctacctgcaaacagtgttccggttaacctacctatccctgtttctaaactagaggtctcagaagggaaataggaaatcaggaatctgagcaagcacttgcttagaaacagagacgagtacaacctaatgtcagagctggccaagactctatcagtcatgacaagctaggttatgctggtgtcagaaac

SEQ ID NO: 46563 - DNA, 601 bp, Human
ttatttggaacttggagtctcaggccagaattcttaagcttttcaatgagttcaactcagcaaatatttccattcataaataactgcacagcaaagtactcagcactgtgaggggatgtcagaggagatgtaggccttgacactgagcagcttcagacttggtcaagagaaagtgatggtacaaaacatttgaacagcaaggccatatagtattgatcaccaagaacaaggccaataattgctgtagaagctgaaagggagggtggttctgggataaagataggacttgagctggactctrgaaaaatataggggatttgcaggagtggagggcacttcaggttatgggcagcaagaagccagagacaaaggcccagaggcagaaatgagggtgaaattattgcaggattcaggagtttggcttggctgtaagttgtgtttgcatgggagggtagggtggggagaggaatcatgtgatggatagagtggagccatttcacagtgagtttctgggttctgcagagaaacaagatggtggtatgtgggaggaagatcatttttcctgaataactccattcaaaaccaaggaatttgcacctcc

SEQ ID NO: 46564 - DNA, 601 bp, Human
cttgttttcatgaatgtccaggggctgtgtgtcaacaaataaaaggtctgcttgtggtactcaaagtggaaaagctggttgtgagatgttctgccactgggataaatttattatggactgtttgtctcttggaatcatgcaccagcatttgaaaataaatcagcatatttctgcttgatggcgtgttagaaccatgcttttattgtcggaagttcacagagctggatgggtctagaaagatgccctctttcatgcctcccaccttagctgcatgaagttaatgtcttaacgtggattcccygggtctgcatgaattctggcaacagtttctgatggatcattatttttatgtgacttatgtaggacctgaagtgggaaagaagtgggtgagactagttcaccatccctcaaatctgactagttgcttttctcctcacccacctatttaggagagagaagtggaaaggaattttatttatctgcacctaggggagcaaatgtctggcatgtactcgatgtcaatttaatttgttgaatgaatacaaactccagtcttataaatttatgttccctgtatgaattcatgtctctatatatatta

SEQ ID NO: 46565 - DNA, 601 bp, Human
cccaccttagctgcatgaagttaatgtcttaacgtggattccccgggtctgcatgaattctggcaacagtttctgatggatcattatttttatgtgacttatgtaggacctgaagtgggaaagaagtgggtgagactagttcaccatccctcaaatctgactagttgcttttctcctcacccacctatttaggagagagaagtggaaaggaattttatttatctgcacctaggggagcaaatgtctggcatgtactcgatgtcaatttaatttgttgaatgaatacaaactccagtcttayaaatttatgttccctgtatgaattcatgtctctatatatattaatgtcattccttttggaaaaggtgattaccacccagatcttattctaacacataggaaaccattagatcgttcctgtagttctctctcatagtagcttctttttttcttctttttaggtttcttcctaacattaacctaatttgtattttatttgttgattgcccatctccaccatcagactacaagcaacttgaaggcagaatagctgcattcacatcttatatgctacactaagcaaggtagctagtacatgaat

SEQ ID NO: 46566 - DNA, 601 bp, Human
tgaagttaatgtcttaacgtggattccccgggtctgcatgaattctggcaacagtttctgatggatcattatttttatgtgacttatgtaggacctgaagtgggaaagaagtgggtgagactagttcaccatccctcaaatctgactagttgcttttctcctcacccacctatttaggagagagaagtggaaaggaattttatttatctgcacctaggggagcaaatgtctggcatgtactcgatgtcaatttaatttgttgaatgaatacaaactccagtcttataaatttatgttcccygtatgaattcatgtctctatatatattaatgtcattccttttggaaaaggtgattaccacccagatcttattctaacacataggaaaccattagatcgttcctgtagttctctctcatagtagcttctttttttcttctttttaggtttcttcctaacattaacctaatttgtattttatttgttgattgcccatctccaccatcagactacaagcaacttgaaggcagaatagctgcattcacatcttatatgctacactaagcaaggtagctagtacatgaatatttcataaacattt

SEQ ID NO: 46567 - DNA, 601 bp, Human
gtcaatttaatttgttgaatgaatacaaactccagtcttataaatttatgttccctgtatgaattcatgtctctatatatattaatgtcattccttttggaaaaggtgattaccacccagatcttattctaacacataggaaaccattagatcgttcctgtagttctctctcatagtagcttctttttttcttctttttaggtttcttcctaacattaacctaatttgtattttatttgttgattgcccatctccaccatcagactacaagcaacttgaaggcagaatagctgcattcacrtcttatatgctacactaagcaaggtagctagtacatgaatatttcataaacatttattgaattttttatttatttatttttattatactttaagttctggggtacatgtgcagaacgtgcagcttgttacataggtatacacatgccatggtggtttgctgcacccatcaacccatcacctacattaggtatttctcctaatgccatccctcccgtagccccccacccccaccccgacaggtcccagtgtgtgatgttcccctccctgtgcccatgtgttctcattgttcaacttccaat

SEQ ID NO: 46568 - DNA, 601 bp, Human
tcttataaatttatgttccctgtatgaattcatgtctctatatatattaatgtcattccttttggaaaaggtgattaccacccagatcttattctaacacataggaaaccattagatcgttcctgtagttctctctcatagtagcttctttttttcttctttttaggtttcttcctaacattaacctaatttgtattttatttgttgattgcccatctccaccatcagactacaagcaacttgaaggcagaatagctgcattcacatcttatatgctacactaagcaaggtagctagtacrtgaatatttcataaacatttattgaattttttatttatttatttttattatactttaagttctggggtacatgtgcagaacgtgcagcttgttacataggtatacacatgccatggtggtttgctgcacccatcaacccatcacctacattaggtatttctcctaatgccatccctcccgtagccccccacccccaccccgacaggtcccagtgtgtgatgttcccctccctgtgcccatgtgttctcattgttcaacttccaattatgagtgagaacatgcggtgtttggttttctgtt

SEQ ID NO: 46569 - DNA, 601 bp, Human
acacactcacattcatttggccatacacgctactgaaggtcacggcgggatgggctaaactaaccatctctattttctcaatttaaggtggtcagctacatctgtcatatagctggcccggattaatgtcatagcacagggccatagcttaggatttttttcccctcaaatgagtaactcattcctggtgggataaatctgtgactttagccttattagcaagaaattctggcccacgaagctatctggtaaaggcagtgtgatatggtttggatttgtgtccctgccaaatctcatgtcraattgtgatccccattgttggaggaggggcctggtgggaggtgattggatcatggggaaggatttcccccttgctgttctcgtgatactgagtgagttctcacaagttatggctgtttaaaagtgtgcagcacctcccccactctttcttcctcctactcccgccatgtcaggcatgcctgcttcctgtttgccttccactatgattgaaagtctcctgaggcctccccagccatgttactcatacagcctgcagaatcatgatccaattaaagtcttttctttataaattacacagtct

SEQ ID NO: 46570 - DNA, 601 bp, Human
ttcatttgctccatttttctttggcttcctgtgtagatggaattgaaatgggaatgatatgtgcattccaaaggatctcaagagaaatgctcattcgtttacaagaggtgcaatcccacaatagtttcttgctttgtatacttgaaaacattcccaaagaaacaaagttggatgcagaaaagatattgggagaaaagaaaaataatactccaaattctgaacaattctactttaacatgttgatctgtctgccagctggccacagggttgactacttgtaatatatacttttggtaggccrcatgtagttcttggaactgtttatattcggctgcagaaacttaattattctaaaattggcagagtgatctttggttacttaatacaaaattgcttagtcatctttaaacatagtgtggacagcttttgtttaagtgtgaaaaattaggaattgcaaatgtactccaaagagattttaggtcagggagaaaaacaagaaagtatcattctttcaagatatttagcccggtggttgccacatgttttaatttgacaagctaggtaactgtcgagttgaagtccttgattacaagtatttttc

SEQ ID NO: 46571 - DNA, 601 bp, Human
tgaggaactgaattttaaattttatttattttcaatttaaatgacctcgtggctggtggctaccatattggacagcatagccttagaatcttaaaaaatatattttcgccataaccctaaatagatggccacttcttctccctggctttttcagagataggggtctaccctttccatgcacccccatttttgggtagttgcgctggagccagccctccctgtatctgaattatgtgtgataatattgtgaatgcctctgttagtcaggcatacatttagaaagcatctttacatatttgtwgcaagtctacgcattttttctcacatggacacaaggtagtggagaatttccaccttgccttagggtttacgcttgtgtcatttgttcttctctagtggccaatagagcagcatgcctattctgatttagcattaaactctgtctttcagcctaattctccttgagttcatcaaggaaaagtatttaaatgcttgaaaagaaaacagaagaagtcgtgtcccaaattttcacttctcttcattcttctaagaaactttcaagttggtttagaaattagtctaaatgccaatcctggttttc

SEQ ID NO: 46572 - DNA, 601 bp, Human
acttgggaggatcaaataatgataaccataaagttttgaaaaatataaagtgctccaaattaaggtggtgatatttgtgataacacttgaagatgcaacctaaagtccctaaacatggtgtcttcctaagtgttgaagttagtatatacaaaaaccatcatttcacaaatctaaactactcaaactgtctgctactcagaaggtgaaagaaagggcataaagacattggctttaataatgttaaatctgccaggtcttctgtttgctagtggagaagtacaaatagagaaatggtaatgcwaagagattgtgcggggaaggcaagggaaaaacaggtcataacctgttaacctgcccttagtatgttggattccattgattagagaaaagaaacaccttgagaagacaaagtgcctcaggttgattgtattcactcttatttctatgctgctgttcttgacagacctgccttggtaaatgcatgtatttttttaaagtagcacagatttttggaacaagatggtgaaggttgagctaaagttaagtgcaaactgtacattataatccatttgtttatttggtttttcaatcccaaatgaac

SEQ ID NO: 46573 - DNA, 601 bp, Human
aacctgcccttagtatgttggattccattgattagagaaaagaaacaccttgagaagacaaagtgcctcaggttgattgtattcactcttatttctatgctgctgttcttgacagacctgccttggtaaatgcatgtatttttttaaagtagcacagatttttggaacaagatggtgaaggttgagctaaagttaagtgcaaactgtacattataatccatttgtttatttggtttttcaatcccaaatgaaccattgagctcagaaaagagcaaagtgggttgacaaattgatttttttkgaaaaggacaaaagttcatttggtacagtcggaaagaaagtgctgccagatttactgtgtaactactgcaaatgtgggtttatataatttttgagattcatacatagtcaattaccaaggtctttgattcactttgtaaacactgatcagtcaataaagtacagagagatgaattggcttgagttacattttccatactcagaatggtaaaatctagaatagaaatccagtggctcaaattggctacaatttctgagtgcctactctgtctcaattgtggaaaaatttttttaaagacta

SEQ ID NO: 46574 - DNA, 601 bp, Human
ccttagtatgttggattccattgattagagaaaagaaacaccttgagaagacaaagtgcctcaggttgattgtattcactcttatttctatgctgctgttcttgacagacctgccttggtaaatgcatgtatttttttaaagtagcacagatttttggaacaagatggtgaaggttgagctaaagttaagtgcaaactgtacattataatccatttgtttatttggtttttcaatcccaaatgaaccattgagctcagaaaagagcaaagtgggttgacaaattgatttttttggaaaagracaaaagttcatttggtacagtcggaaagaaagtgctgccagatttactgtgtaactactgcaaatgtgggtttatataatttttgagattcatacatagtcaattaccaaggtctttgattcactttgtaaacactgatcagtcaataaagtacagagagatgaattggcttgagttacattttccatactcagaatggtaaaatctagaatagaaatccagtggctcaaattggctacaatttctgagtgcctactctgtctcaattgtggaaaaatttttttaaagactatatcttt

SEQ ID NO: 46575 - DNA, 601 bp, Human
tgtctgggaaggaggaagaagcatggatatgtcatgtgtgatacctccagctttgctggctcaagcaggtatacagccatagtattattatgtggcgtaagatgaaactttgaatattatctctccaaccagctcactttatagagaaacaaagctcatagagcttcagtctcagtctcctaggtctcattccaggtcactatttgccaagggtttgtgaaggaaaacagttaaagggtcaaggtaagcgatgatcattgcagatcagaggtaggaaatctgctggagtatgttgtacccmgaaatcacccaatacctgtaggatgaagagaaacatcactgagttgcagcgatggcccaactgaaatgaatgcaaatctttaggatatacacgacatgctccctttctcccacaaagcactgaatctcaagaacacaaaacagaaagcaggtgataggtgtgattcaaggttgaagatgggtgtgacaagcctggtggaactttaaagaagcaagaaagtctaaactatcaattccaggaaggcaaagaccttttctgtcttgttcactgttataccccagtgtcgagaacagtacctgg

SEQ ID NO: 46576 - DNA, 601 bp, Human
agtatgttgtacccagaaatcacccaatacctgtaggatgaagagaaacatcactgagttgcagcgatggcccaactgaaatgaatgcaaatctttaggatatacacgacatgctccctttctcccacaaagcactgaatctcaagaacacaaaacagaaagcaggtgataggtgtgattcaaggttgaagatgggtgtgacaagcctggtggaactttaaagaagcaagaaagtctaaactatcaattccaggaaggcaaagaccttttctgtcttgttcactgttataccccagtgtckagaacagtacctggcacatagtagctgtgcggtaaatatttattgtatattgattgtataaatgtttttgtgaggcctcactgaagtagctgaatcatgaaatttacagtgggtgcaaaatgatggctagtcagagaggacctgtctaataatggttttgagtgttccaagactagagttccttgcgagagcagagaaatgatgatgttgtgaatgaggatacagtgggttagaggaggaagatgtgtaatgaagaaggtacaatataagagaagaaactaagatattgaagaaaagtat

SEQ ID NO: 46577 - DNA, 601 bp, Human
tgtacccagaaatcacccaatacctgtaggatgaagagaaacatcactgagttgcagcgatggcccaactgaaatgaatgcaaatctttaggatatacacgacatgctccctttctcccacaaagcactgaatctcaagaacacaaaacagaaagcaggtgataggtgtgattcaaggttgaagatgggtgtgacaagcctggtggaactttaaagaagcaagaaagtctaaactatcaattccaggaaggcaaagaccttttctgtcttgttcactgttataccccagtgtcgagaacartacctggcacatagtagctgtgcggtaaatatttattgtatattgattgtataaatgtttttgtgaggcctcactgaagtagctgaatcatgaaatttacagtgggtgcaaaatgatggctagtcagagaggacctgtctaataatggttttgagtgttccaagactagagttccttgcgagagcagagaaatgatgatgttgtgaatgaggatacagtgggttagaggaggaagatgtgtaatgaagaaggtacaatataagagaagaaactaagatattgaagaaaagtatgcaatga

SEQ ID NO: 46578 - DNA, 601 bp, Human
tgctcatgcacaggtgacacaggtgagcatacccacacacacctaaaatggcttatctgccaccaacactgacccaaacaaaagcagaaacttactagttccccttataaaggcatcacaggaaatatctatagtgagggctacatgcccatagagggaaaaagaaaaacagcaaaaaagaatataaaacataatacatttcttggttgaaagatgcacatcagctattgaactaaatttttaaaggaaacgagccataaattgattttaataaatataaatatactttcatttccgacayagggtgggagacagagaagaaaaaaaagtcacaaagaaagagaaaattttttttaatgtcagaagaaataccactcaatattctgcctttgaaaagaggcagagaaaaaaaagcaaggaggaaggaaaggaaagagaggaaagtcccggaagccctggcgtggtggtaagatgcaggacacgcctctcgtcacatcatgccaatcccctgggccgcaggctcgtggctttgttcaaaaagaagggcaggctgggtgcggtggctcatgcctgtaatcccagcactttgggaggccgaggg

SEQ ID NO: 46579 - DNA, 601 bp, Human
attgaaaacacagacatatccataggtaatgacatctgcctctgttaaggtttttgtttttcccctctttacaaaagaagtcacctcagtaaatttttcaatagcatgaccacagtccctcctccagcacaaaaatttagattttcataaaactctccgagaacgcatcatctgtcactaacatcaatacttagctctttcacactactctatttgtgacacccagagcctcacgactgatggaatcaccctgtcttgacttttcatcccttcattggttgagagtttgtttcctaaccartgttgctgaaaagaattcagcactgagtaggggtagggcaggaaatgagggattactgcctggggactggggacgtagaagagaaaaagaaaatcacttaccattctacctagacatgtctcctcttacaaaggaaagatgctagagaagggctgaaaagctctgtgatataagggtgcagggatgaaggaggatctccagccccatcctgggttgataccgagagccattttcataaacacatacaccttctctcccccacacaagacacacacaccaccgagagtcataccacatggt

SEQ ID NO: 46580 - DNA, 601 bp, Human
taaatttttcaatagcatgaccacagtccctcctccagcacaaaaatttagattttcataaaactctccgagaacgcatcatctgtcactaacatcaatacttagctctttcacactactctatttgtgacacccagagcctcacgactgatggaatcaccctgtcttgacttttcatcccttcattggttgagagtttgtttcctaaccaatgttgctgaaaagaattcagcactgagtaggggtagggcaggaaatgagggattactgcctggggactggggacgtagaagagaaaaaraaaatcacttaccattctacctagacatgtctcctcttacaaaggaaagatgctagagaagggctgaaaagctctgtgatataagggtgcagggatgaaggaggatctccagccccatcctgggttgataccgagagccattttcataaacacatacaccttctctcccccacacaagacacacacaccaccgagagtcataccacatggtacacagatgtggttttgtgctttcctctaagctacacccactcgtgtgcacaaagcctcacctagaaaagcactggtctgtaggaaatg

SEQ ID NO: 46581 - DNA, 601 bp, Human
ccctgtcttgacttttcatcccttcattggttgagagtttgtttcctaaccaatgttgctgaaaagaattcagcactgagtaggggtagggcaggaaatgagggattactgcctggggactggggacgtagaagagaaaaagaaaatcacttaccattctacctagacatgtctcctcttacaaaggaaagatgctagagaagggctgaaaagctctgtgatataagggtgcagggatgaaggaggatctccagccccatcctgggttgataccgagagccattttcataaacacatacascttctctcccccacacaagacacacacaccaccgagagtcataccacatggtacacagatgtggttttgtgctttcctctaagctacacccactcgtgtgcacaaagcctcacctagaaaagcactggtctgtaggaaatggcacacactctctctctccctctgggtgcccccacatgtatactcagcagcattcaaatggcaggtagtttttctatggctgggaaagaaaaagtgctcaagtaagcaagagaaggtgaggagtgggagaagagaatgggtaggagaaaaagaatttgc

SEQ ID NO: 46582 - DNA, 601 bp, Human
gtcttgacttttcatcccttcattggttgagagtttgtttcctaaccaatgttgctgaaaagaattcagcactgagtaggggtagggcaggaaatgagggattactgcctggggactggggacgtagaagagaaaaagaaaatcacttaccattctacctagacatgtctcctcttacaaaggaaagatgctagagaagggctgaaaagctctgtgatataagggtgcagggatgaaggaggatctccagccccatcctgggttgataccgagagccattttcataaacacatacaccttytctcccccacacaagacacacacaccaccgagagtcataccacatggtacacagatgtggttttgtgctttcctctaagctacacccactcgtgtgcacaaagcctcacctagaaaagcactggtctgtaggaaatggcacacactctctctctccctctgggtgcccccacatgtatactcagcagcattcaaatggcaggtagtttttctatggctgggaaagaaaaagtgctcaagtaagcaagagaaggtgaggagtgggagaagagaatgggtaggagaaaaagaatttgcgtgg

SEQ ID NO: 46583 - DNA, 601 bp, Human
agagtttgtttcctaaccaatgttgctgaaaagaattcagcactgagtaggggtagggcaggaaatgagggattactgcctggggactggggacgtagaagagaaaaagaaaatcacttaccattctacctagacatgtctcctcttacaaaggaaagatgctagagaagggctgaaaagctctgtgatataagggtgcagggatgaaggaggatctccagccccatcctgggttgataccgagagccattttcataaacacatacaccttctctcccccacacaagacacacacaccacygagagtcataccacatggtacacagatgtggttttgtgctttcctctaagctacacccactcgtgtgcacaaagcctcacctagaaaagcactggtctgtaggaaatggcacacactctctctctccctctgggtgcccccacatgtatactcagcagcattcaaatggcaggtagtttttctatggctgggaaagaaaaagtgctcaagtaagcaagagaaggtgaggagtgggagaagagaatgggtaggagaaaaagaatttgcgtgggttaagagccagtgaggatggtcagccaa

SEQ ID NO: 46584 - DNA, 601 bp, Human
cagcactgagtaggggtagggcaggaaatgagggattactgcctggggactggggacgtagaagagaaaaagaaaatcacttaccattctacctagacatgtctcctcttacaaaggaaagatgctagagaagggctgaaaagctctgtgatataagggtgcagggatgaaggaggatctccagccccatcctgggttgataccgagagccattttcataaacacatacaccttctctcccccacacaagacacacacaccaccgagagtcataccacatggtacacagatgtggttttgygctttcctctaagctacacccactcgtgtgcacaaagcctcacctagaaaagcactggtctgtaggaaatggcacacactctctctctccctctgggtgcccccacatgtatactcagcagcattcaaatggcaggtagtttttctatggctgggaaagaaaaagtgctcaagtaagcaagagaaggtgaggagtgggagaagagaatgggtaggagaaaaagaatttgcgtgggttaagagccagtgaggatggtcagccaaactgacctcacgatgttagtttcacttcccttttaag

SEQ ID NO: 46585 - DNA, 601 bp, Human
acttaccattctacctagacatgtctcctcttacaaaggaaagatgctagagaagggctgaaaagctctgtgatataagggtgcagggatgaaggaggatctccagccccatcctgggttgataccgagagccattttcataaacacatacaccttctctcccccacacaagacacacacaccaccgagagtcataccacatggtacacagatgtggttttgtgctttcctctaagctacacccactcgtgtgcacaaagcctcacctagaaaagcactggtctgtaggaaatggcacacrctctctctctccctctgggtgcccccacatgtatactcagcagcattcaaatggcaggtagtttttctatggctgggaaagaaaaagtgctcaagtaagcaagagaaggtgaggagtgggagaagagaatgggtaggagaaaaagaatttgcgtgggttaagagccagtgaggatggtcagccaaactgacctcacgatgttagtttcacttcccttttaagtattccaagacactgcccggctctgcagaccatgtgcatctccagcctgcttggagatattcatttcactgctcatta

SEQ ID NO: 46586 - DNA, 601 bp, Human
tccagcctgcttggagatattcatttcactgctcattagcacctctaccagaggtataggctgagaaccactgttgctgacaaacagccagaatgactacttaaatttgatgaggtaggagcaaaaaccagacagaggcttagaggatgctcttcaagctacttggataaattttaaaaggtaaaattgtttgcttatagacggacctctttttcccatgtctgtttgctattgctatagttattcaagaggcactttatatgcaacaaaagaccacatggaaggaagagaagagtctacyctcccactgcacctggcattcgagtccaggagtttagaccctactgcccacagggctgtcctcacacactcctgccctgtggtcagaacaggagcctaccccagggagaagggccctgggatgccctcttagggaactctcaaatcactttttctttttccattcagataattacagactagattggaaagtgtagaaaaatttctttatggtcgatgaaataataagaaggaaaatgggttgtttccttcataactagcaaagcctagggaagtactcttggtaagagtaagatagata

SEQ ID NO: 46587 - DNA, 601 bp, Human
agaaggaaaatgggttgtttccttcataactagcaaagcctagggaagtactcttggtaagagtaagatagataaacatcaaaaatttaaaaccccaaataaacaccaagatttgaatttctaaagatttataagcagcattaataataccctagaggataaaaaaggggaaaaattcaaacattgtatagttttgcttttgttggctgaacttttatttttgtttttgtggggtttttttagaggggaaaaaacctttgaaaataaaataattggacaatttatttaagaaggtttctgwacttggcttcaaaatctaagttttgttttttgctccttcaaacaaagatgccttcaggtgtgatggctttaggttttgtacagctccttattttttcacacagggcaaatggctcgtctcatgtgcacataaagggctggaaaatatttctgtgattcgagcgcagcagagagtctaggattccagaggaagtggaggcctcccattccgcacaggaaacaatcttcaagcaggccttaaatgccagattccaggctgagtttaactaaccactgacagctctgtaaacaaagcaaggac

SEQ ID NO: 46588 - DNA, 601 bp, Human
ttcataactagcaaagcctagggaagtactcttggtaagagtaagatagataaacatcaaaaatttaaaaccccaaataaacaccaagatttgaatttctaaagatttataagcagcattaataataccctagaggataaaaaaggggaaaaattcaaacattgtatagttttgcttttgttggctgaacttttatttttgtttttgtggggtttttttagaggggaaaaaacctttgaaaataaaataattggacaatttatttaagaaggtttctgaacttggcttcaaaatctaagtkttgttttttgctccttcaaacaaagatgccttcaggtgtgatggctttaggttttgtacagctccttattttttcacacagggcaaatggctcgtctcatgtgcacataaagggctggaaaatatttctgtgattcgagcgcagcagagagtctaggattccagaggaagtggaggcctcccattccgcacaggaaacaatcttcaagcaggccttaaatgccagattccaggctgagtttaactaaccactgacagctctgtaaacaaagcaaggacaaaaagagcccgcttccccctt

SEQ ID NO: 46589 - DNA, 601 bp, Human
cctagaggataaaaaaggggaaaaattcaaacattgtatagttttgcttttgttggctgaacttttatttttgtttttgtggggtttttttagaggggaaaaaacctttgaaaataaaataattggacaatttatttaagaaggtttctgaacttggcttcaaaatctaagttttgttttttgctccttcaaacaaagatgccttcaggtgtgatggctttaggttttgtacagctccttattttttcacacagggcaaatggctcgtctcatgtgcacataaagggctggaaaatatttytgtgattcgagcgcagcagagagtctaggattccagaggaagtggaggcctcccattccgcacaggaaacaatcttcaagcaggccttaaatgccagattccaggctgagtttaactaaccactgacagctctgtaaacaaagcaaggacaaaaagagcccgcttccccctttctggtagtcattttgggtttgggggctgcaggggaattctggaatacttgactccatggcacagaaacgcaggggaaacgggctcctcatttaaagagctggaaggggaaggtctttccggaattaa

SEQ ID NO: 46590 - DNA, 601 bp, Human
ggctcctcatttaaagagctggaaggggaaggtctttccggaattaaaaccatcacagaggaggtaggaaagggtaaaatggttgggttacatctgtagaaaagcagtgattttagagcttggaaaacagcttgatcaccacttaactgcttttaaaaatgttgcttcatgatgtttattcatgatgttactgctgcagtctttattaaaatcctgatgcttctttgagaatatgcacattatatgcctagacactgtattattttatttctcgctttcacttttctcctagttcctacawatacctcttcttgccacttttcttttctgtttgtcattcctgttttcctcctcctttgttcactttttcataactttggtctggggttcagaaagttacaaagagcaaaatcattcattagaatttcaagtgattctaccaatatttcaagtcttcaaaacctctctgtctccggaggtcttttttaaagaataaataatcttgggatcttacttatttgtctctaggagattcatgaatgagactgaatttaactcggctcaggagtcagaaattgatcactggctaccttatcagctt

SEQ ID NO: 46591 - DNA, 601 bp, Human
cttggaaaacagcttgatcaccacttaactgcttttaaaaatgttgcttcatgatgtttattcatgatgttactgctgcagtctttattaaaatcctgatgcttctttgagaatatgcacattatatgcctagacactgtattattttatttctcgctttcacttttctcctagttcctacaaatacctcttcttgccacttttcttttctgtttgtcattcctgttttcctcctcctttgttcactttttcataactttggtctggggttcagaaagttacaaagagcaaaatcattcaktagaatttcaagtgattctaccaatatttcaagtcttcaaaacctctctgtctccggaggtcttttttaaagaataaataatcttgggatcttacttatttgtctctaggagattcatgaatgagactgaatttaactcggctcaggagtcagaaattgatcactggctaccttatcagctttctaagagtaaagaaaaatcaggagaatgacaaatgggaaagagggcccatagtaactcaggagaagtaacacactgagttatcaatgatattgactctacctcctctctttcaggtc

SEQ ID NO: 46592 - DNA, 601 bp, Human
gagtaaagaaaaatcaggagaatgacaaatgggaaagagggcccatagtaactcaggagaagtaacacactgagttatcaatgatattgactctacctcctctctttcaggtccagacatcatctggtctccctgaacctgaaatcacaccatggatgattttgagcgtcgcagagaacttagaaggcaaaagagggaggagatgcgactcgaagcagaaaggtaaggatctagggtgaaaaatacttgtattcccttattaacaaccttggtttcaggcctcaaagaccatccttttgaraggccaaatgtggtcatatcgcacaccaaactgttcgcaaaagtagttatggaaaatttttctgctaagactctaaattaagcatttaaaaaaggaaaacaaacaagaatcaagaaaaagagagatttgagaggaatcaattgataactgcatattgataattgcatttaatcaatacctttcacattggaatgttttaaatgacaaaagtaatgtgtgaatgaaggtttaaaaagcttatataataagaaatgacaaaaaaatgtcaagtattgaatattggaaccacttaggacatga

SEQ ID NO: 46593 - DNA, 601 bp, Human
ctgaacctgaaatcacaccatggatgattttgagcgtcgcagagaacttagaaggcaaaagagggaggagatgcgactcgaagcagaaaggtaaggatctagggtgaaaaatacttgtattcccttattaacaaccttggtttcaggcctcaaagaccatccttttgagaggccaaatgtggtcatatcgcacaccaaactgttcgcaaaagtagttatggaaaatttttctgctaagactctaaattaagcatttaaaaaaggaaaacaaacaagaatcaagaaaaagagagatttgagrggaatcaattgataactgcatattgataattgcatttaatcaatacctttcacattggaatgttttaaatgacaaaagtaatgtgtgaatgaaggtttaaaaagcttatataataagaaatgacaaaaaaatgtcaagtattgaatattggaaccacttaggacatgagagtcttcaatctaaaaaatataaaggcaaaaagccctggatgaatcttgtgaaaaattttcattcttattagaaaagtatccaactctagggatctgcatagtacaggttaataacgggctatgttaccga

SEQ ID NO: 46594 - DNA, 601 bp, Human
ggacagtgtggtatttgatgcgacttaaatcagatgttcttttgagaaagcaggttaggcattcacagagagaaaaatgttaaacaatgaccttaaaatcaaatcgatttttttcccagtaactccaatgctcagatgaaaaatgacactttaacgataccacagcacaaaactggaaacttacacctataatgaaaagtattgttcttatgttctacttatttgcatggagaatgcaaaagcaaaagataaaataactgcctatgatgaactgggccagagtcagctggcattcatgaamtgactaaacatgtccacaaggcactatggatggtacctgcattctgttggttcaaatcctagctctgccatttgcaagctgtgtggccctgagcaaatgatttctctttaagccatagttgccttatatataaaacaggcataatatctacatagcctgtgtgattgttgggaagattattgagcttcataaatagcctagtcaggtacctagcacatagtagtttttcataaatgatagtttttcataaatgatagctattattattattaaccattatcactagccaaacaagaaata

SEQ ID NO: 46595 - DNA, 601 bp, Human
acagagagaaaaatgttaaacaatgaccttaaaatcaaatcgatttttttcccagtaactccaatgctcagatgaaaaatgacactttaacgataccacagcacaaaactggaaacttacacctataatgaaaagtattgttcttatgttctacttatttgcatggagaatgcaaaagcaaaagataaaataactgcctatgatgaactgggccagagtcagctggcattcatgaactgactaaacatgtccacaaggcactatggatggtacctgcattctgttggttcaaatcctagctctgccatttgcaagctgtgtggccctgagcaaatgatttctctttaagccatagttgccttatatataaaacaggcataatatctacatagcctgtgtgattgttgggaagattattgagcttcataaatagcctagtcaggtacctagcacatagtagtttttcataaatgatagtttttcataaatgatagctattattattattaaccattatcactagccaaacaagaaatagcatagcagcatagccagagctaaacaatcatgccaagagaaggaaaggtagtcattatcctgc

SEQ ID NO: 46596 - DNA, 601 bp, Human
gattgccagatgcagttttactttgaaatgataaataatttaaaacttgtacttttacccggtgttataaccacagattaaaataaagcgaatttttacacattttattcttcagaaacagaccttttcaaagactattttgcaagctaattgaaggctttgtgccatgctggcttgcatgtgcttaggactggcatttattcactgcatccgagctgtcctgagactctgtcgtccacatatctccttctaagggttttagcccagttcatttcaaataacctcgactgcaaacgtagtrcatcaaaaacgttcttccagctgggcgcagtggctcacgcctgtaatcccagcactctgggaggctgaggtgggtggtcaggagttcgagaccaccctggccaacatggagaaaccccgtctgtactaaaaatacaaaaagtagctaggcatggtggtgggtgcctgtaatcccagctactctggaggctgaggtaaggagaatcgcttgaacctgggaggcagagggtgcagtgagccgagattacgccactgcaccccagcctaagtgacggagtgagactcggtctcaaaaaaaaaa

SEQ ID NO: 46597 - DNA, 601 bp, Human
taatttaaaacttgtacttttacccggtgttataaccacagattaaaataaagcgaatttttacacattttattcttcagaaacagaccttttcaaagactattttgcaagctaattgaaggctttgtgccatgctggcttgcatgtgcttaggactggcatttattcactgcatccgagctgtcctgagactctgtcgtccacatatctccttctaagggttttagcccagttcatttcaaataacctcgactgcaaacgtagtgcatcaaaaacgttcttccagctgggcgcagtggcycacgcctgtaatcccagcactctgggaggctgaggtgggtggtcaggagttcgagaccaccctggccaacatggagaaaccccgtctgtactaaaaatacaaaaagtagctaggcatggtggtgggtgcctgtaatcccagctactctggaggctgaggtaaggagaatcgcttgaacctgggaggcagagggtgcagtgagccgagattacgccactgcaccccagcctaagtgacggagtgagactcggtctcaaaaaaaaaaaaaaaaaaaaaaaaacttccttctttgtcttgccc

SEQ ID NO: 46598 - DNA, 601 bp, Human
cccggtgttataaccacagattaaaataaagcgaatttttacacattttattcttcagaaacagaccttttcaaagactattttgcaagctaattgaaggctttgtgccatgctggcttgcatgtgcttaggactggcatttattcactgcatccgagctgtcctgagactctgtcgtccacatatctccttctaagggttttagcccagttcatttcaaataacctcgactgcaaacgtagtgcatcaaaaacgttcttccagctgggcgcagtggctcacgcctgtaatcccagcactytgggaggctgaggtgggtggtcaggagttcgagaccaccctggccaacatggagaaaccccgtctgtactaaaaatacaaaaagtagctaggcatggtggtgggtgcctgtaatcccagctactctggaggctgaggtaaggagaatcgcttgaacctgggaggcagagggtgcagtgagccgagattacgccactgcaccccagcctaagtgacggagtgagactcggtctcaaaaaaaaaaaaaaaaaaaaaaaaacttccttctttgtcttgccccttagcctgtgcaacttttatg

SEQ ID NO: 46599 - DNA, 601 bp, Human
ttctaagggttttagcccagttcatttcaaataacctcgactgcaaacgtagtgcatcaaaaacgttcttccagctgggcgcagtggctcacgcctgtaatcccagcactctgggaggctgaggtgggtggtcaggagttcgagaccaccctggccaacatggagaaaccccgtctgtactaaaaatacaaaaagtagctaggcatggtggtgggtgcctgtaatcccagctactctggaggctgaggtaaggagaatcgcttgaacctgggaggcagagggtgcagtgagccgagattaygccactgcaccccagcctaagtgacggagtgagactcggtctcaaaaaaaaaaaaaaaaaaaaaaaaacttccttctttgtcttgccccttagcctgtgcaacttttatgccattacctcgtccttccttgtcttccatttggctttctcactctgagttcttgagataaggtctttagatttggcaaaaaggaaggaagtacttcattttgtcataaaaagaaatacagatgctgaatacctacaaaatgcaagatactataccgaaccataggaatcagtggtcaccagtagggacag

SEQ ID NO: 46600 - DNA, 601 bp, Human
ttcaaataacctcgactgcaaacgtagtgcatcaaaaacgttcttccagctgggcgcagtggctcacgcctgtaatcccagcactctgggaggctgaggtgggtggtcaggagttcgagaccaccctggccaacatggagaaaccccgtctgtactaaaaatacaaaaagtagctaggcatggtggtgggtgcctgtaatcccagctactctggaggctgaggtaaggagaatcgcttgaacctgggaggcagagggtgcagtgagccgagattacgccactgcaccccagcctaagtgayggagtgagactcggtctcaaaaaaaaaaaaaaaaaaaaaaaaacttccttctttgtcttgccccttagcctgtgcaacttttatgccattacctcgtccttccttgtcttccatttggctttctcactctgagttcttgagataaggtctttagatttggcaaaaaggaaggaagtacttcattttgtcataaaaagaaatacagatgctgaatacctacaaaatgcaagatactataccgaaccataggaatcagtggtcaccagtagggacagtatcccagtagtcactaagctccta

SEQ ID NO: 46601 - DNA, 601 bp, Human
cctcgactgcaaacgtagtgcatcaaaaacgttcttccagctgggcgcagtggctcacgcctgtaatcccagcactctgggaggctgaggtgggtggtcaggagttcgagaccaccctggccaacatggagaaaccccgtctgtactaaaaatacaaaaagtagctaggcatggtggtgggtgcctgtaatcccagctactctggaggctgaggtaaggagaatcgcttgaacctgggaggcagagggtgcagtgagccgagattacgccactgcaccccagcctaagtgacggagtgagmctcggtctcaaaaaaaaaaaaaaaaaaaaaaaaacttccttctttgtcttgccccttagcctgtgcaacttttatgccattacctcgtccttccttgtcttccatttggctttctcactctgagttcttgagataaggtctttagatttggcaaaaaggaaggaagtacttcattttgtcataaaaagaaatacagatgctgaatacctacaaaatgcaagatactataccgaaccataggaatcagtggtcaccagtagggacagtatcccagtagtcactaagctcctattctaaggg

SEQ ID NO: 46602 - DNA, 601 bp, Human
tgctgtttattattctccaccaatctcaggggagtaaaaagttaaatagatacattctggccggatgcaatggctcactcccgtaatcccagcattttgggaggccaaggcaggcagatcacttgaggccaggagttcgaaaccagcctggccaacatggtgaaaccctgtctctactaaaaatacaaaaaaaaattcgctgggcatagtggctggtgcctgtaatcccagctactcgggaagctgaggcaggagaatcacttgaacctgggaggcagaggttgcagtgagccacgatcaygccactgcactacaagctgggcgacagagcaaaaacaaacaaacaaacaaacaaacaaaacaaaaaaaacccaaaaaacaaaaaaaaacactatattctgcttccctttctgtttcttttatttcaatccctctcctctgccttcatctctgttttccttggtgcaccttcatgtgcctcttccccggtccacgtgcatcttcatcaacacttgatttgtttgtttctgtgtctcttcccatctgcactcctaatctgtctgctctgaattatgtgtggatgtgctgttgcatcaccagg

SEQ ID NO: 46603 - DNA, 601 bp, Human
atggctcactcccgtaatcccagcattttgggaggccaaggcaggcagatcacttgaggccaggagttcgaaaccagcctggccaacatggtgaaaccctgtctctactaaaaatacaaaaaaaaattcgctgggcatagtggctggtgcctgtaatcccagctactcgggaagctgaggcaggagaatcacttgaacctgggaggcagaggttgcagtgagccacgatcatgccactgcactacaagctgggcgacagagcaaaaacaaacaaacaaacaaacaaacaaaacaaaaaaaacccaaaaaacaaaaaaaaacactatattctgcttccctttctgtttcttttatttcaatccctctcctctgccttcatctctgttttccttggtgcaccttcatgtgcctcttccccggtccacgtgcatcttcatcaacacttgatttgtttgtttctgtgtctcttcccatctgcactcctaatctgtctgctctgaattatgtgtggatgtgctgttgcatcaccaggaaatacatacttctggccaggaaagagggagagagaaacccagttctcttcctgttcagcaagtataaa

SEQ ID NO: 46604 - DNA, 601 bp, Human
tattttgtatcctcccttacaaaatgggggtagtaaaagtatccacctcactgggtttttgtggggatgtaaaaaggtaagacatgaaagtattaacacagtgttattcatctaataaacattcaataaactcattattaattattattatttaatttgattctctacaacatggaaataaaaaaataaaaatatgaaaggcttgtggattgttttgcacatcatagatggtacaagaaccataggcaagatgaaaggcaggaatgcgtgactgactgaagagctttgagtgactgtgatyggtaacagtttttgaggaaggactgtgttgtctcagctggaagaattagcaccagtttaagttatttttaaaaatttggccgaaagaatgttgagctgtggtgtattttctttttttctttttttctttttttttgttttcatttttgtttttttgagaaggagtctcactttgtcggccaggctggagtgcagtggtaccatctcggctcactgcaatctctgcctcccaggttcaagcgattctcctgcctcagcctctcgagtaggcacacgccaccacacccagctagtttttgta

SEQ ID NO: 46605 - DNA, 601 bp, Human
cgccaccacacccagctagtttttgtattaattagagaggaggtttcaccatgttggccaggctggtctcaaactcctggcctcaagtgctccaccggcctcagcctcccaaagtactgggattacaggcatgaggagctgtgatgtattttctgagaaaccagcagtgatgcttttatccatgagaaaatctccagcagacatacttggccgacaccgggcttggttccccaacaaatggctctctcactttccaagatgtgctcattacgttcacagcatctgctttctgcacccaacrtgagttcctctcactgatcagaagaaaggcccctattgtagagttacgttatcagattcagaagcttacagacataaataaagggaatgaaaacacttgctgttgtcatcattcatacatttttatgggcttctgaaatggcttgatgattagacatttgaaagtaaatatttttactacactataaaaagaagcaattttttaaaatccatggggtctctaaagtcccctctcagaactgtatcactgagacttttttacatgatttaatagaaacagccaatgaatgattatacaaca

SEQ ID NO: 46606 - DNA, 601 bp, Human
gttttggaccacacactatttttgaggcactgatgaaagctctggaccctcctccaagaaaaatgcacatatgcacccaccaaacttggcacttacattcagtggcatcatgaacctccgtccgcagacctcctgggggccgatgccttctggccaagaatccctgatctaatgaattttaaaactgcctgttaaatattaagaaactcaagcctaggagacatatccccttaagatcacccagttaagctgtttgcatagtgtgggcccctggacaaacaaagccatcctgatcttgctrtatgtaaaaaagtctatggctattgattaggaaaataaagcatattttggaaaagagtgtattctacaatgtactgcatgtagagtgctttctaaaacttaaaaaccgtttatggataatgtttctaaataaaggagattcggtcagattacagtgaataaagtgaaaaataaagaaagatgagtggataggcagaatgataccagttaatagtcaggaactgggaatcaaagtttggcgtctttgtcaacaaggacaaaaaaactttggtgatttactacaatcccattttctatcaat

SEQ ID NO: 46607 - DNA, 601 bp, Human
ccgcagacctcctgggggccgatgccttctggccaagaatccctgatctaatgaattttaaaactgcctgttaaatattaagaaactcaagcctaggagacatatccccttaagatcacccagttaagctgtttgcatagtgtgggcccctggacaaacaaagccatcctgatcttgctatatgtaaaaaagtctatggctattgattaggaaaataaagcatattttggaaaagagtgtattctacaatgtactgcatgtagagtgctttctaaaacttaaaaaccgtttatggataatrtttctaaataaaggagattcggtcagattacagtgaataaagtgaaaaataaagaaagatgagtggataggcagaatgataccagttaatagtcaggaactgggaatcaaagtttggcgtctttgtcaacaaggacaaaaaaactttggtgatttactacaatcccattttctatcaattttggaagtcttttatttggtatatgttgtgttagcatgattccttcaaacaaagcttaattttgaaactaagttatgtaggatttctccattcttaccagtttttagaaaattcatcaaa

SEQ ID NO: 46608 - DNA, 601 bp, Human
cagtttttagaaaattcatcaaatgacttttctctctaaatatgaaaaagataagaactgatttgattcctaacagagaaacttatattttacatttatcactactatctttggggaggatgggacagatttggagtgggacaggtgcctttcagagagtaggatctagagtcatgaagacttagattcaaatcccagaatcccagctggattcaaaatggttgttctactccgcctctctcagcccatttcatcaagtggaaaatggccatcgaaacagttcttccttataaggtttaaygcagattataaagcacttagtagtccctaaaacatgactagtgctcattctgttacctcttgttgctgtttttctgctggctgaaggacatggtaagaaaggcgctctcagaaaagccctctctggggtcacctcagaaactcagccttttggcagctaccatctggggtatcactgaacaaggtacaactccatgtgtcagatggctcagtgtctaatcttttctctgtttcagatctgttttagcagctaccttgaaagtgatgggagaattatggatataaatgtctccctgtaaaa

SEQ ID NO: 46609 - DNA, 601 bp, Human
tgggagaattatggatataaatgtctccctgtaaaaagaaaattacctttttattattaagagttcttttccattttccctacttgtttgaaatcaagacaaaagcatgcaatagtctggtacatatcaaggtctttgtcacaatgatatatacatatgtgtatgtatgtatataatttaattaatcatgtatggtcagctctccatacctgaggattcaaccaacccagatcaaaaatgtagttaggcctacaatggttgcatctgtgctaaacatgtacatacttttttccttgtcatyatttctgaacaatacagtataacaactatgtacatagcatttatattcccctgctgatactgagggatgactatatttaaaatactctttttgccttgtgaaattatcatttctcttttcatattgcataatctatggtttcattaccattaaagcatcaaccagaagcttctcaatgccaacattatatataaatattgtaataataacataaggaaaatcatatgcctaattgttacaaaatgattttgaaaaaatgtatcccaaattactaatttattcattttaattatgaaaaaa

SEQ ID NO: 46610 - DNA, 601 bp, Human
ctgagggatgactatatttaaaatactctttttgccttgtgaaattatcatttctcttttcatattgcataatctatggtttcattaccattaaagcatcaaccagaagcttctcaatgccaacattatatataaatattgtaataataacataaggaaaatcatatgcctaattgttacaaaatgattttgaaaaaatgtatcccaaattactaatttattcattttaattatgaaaaaactgatgcatacaaagtaatcctatgtaatatatatggaagttctaactcatcctaatgcrtatcctataaactcaccatacagcctaagacctagaacatttccaatgccccaggcccctctccaatcccttcccttcacctccccacccacagaggtaaccagtgtcctgaataattcatttattttaaaataaaatttgaaatgagatcatacgaatttaggtactagcttctccagggccctgggatccaggcattccaaagattctctccagactctcaggtaaaggtgtcagtgagagcccacttccctgagagggcaagaagtttgtctttctaaacacacaggacaggctggg

SEQ ID NO: 46611 - DNA, 601 bp, Human
ggaaaatcatatgcctaattgttacaaaatgattttgaaaaaatgtatcccaaattactaatttattcattttaattatgaaaaaactgatgcatacaaagtaatcctatgtaatatatatggaagttctaactcatcctaatgcgtatcctataaactcaccatacagcctaagacctagaacatttccaatgccccaggcccctctccaatcccttcccttcacctccccacccacagaggtaaccagtgtcctgaataattcatttattttaaaataaaatttgaaatgagatcataygaatttaggtactagcttctccagggccctgggatccaggcattccaaagattctctccagactctcaggtaaaggtgtcagtgagagcccacttccctgagagggcaagaagtttgtctttctaaacacacaggacaggctgggcatggtggctcctgcgtgtaatgtcagcactttgggaggctgaggcgggcaaatcacttgaagtcaggagttttagactagcttggccaacatggtgaaacctcttctctactaaaaatacaaaaattagccgggcatagtagtgggcgcctgta

SEQ ID NO: 46612 - DNA, 601 bp, Human
cactactgtgcccgcttagaataacagcagtcaacccattttttattcccacagaaaactttacactgttggaaggttttctggaggtggggggagactcaagagactaatatgaaaaataactgagcaagaagtgagcaaataaacaagcaggatgagatgatgggttatcaggctgattcaaagacaagaagcatcatcaggtctaatcacactgcatctttcccaaggcacaattggcagctacagtacatgtatatctctgcccacttcttccttgaacaattcttctgtttctctmatcaaaactgttgtgtagatcttgatctttttttagtggagtttcatttgggggatctaacattccctcactatttgtcctttgatgaagaagatgagaaaggacctattattaaggggcctcgcgcaaaagttgtgatgtagaaagaactgatatctgacacctgtctttcctgctactaccttttaagatcctttaactcttcctatctaagcaggagagtgtattttccctgagccagcatcttcatagcatatcctggctacctagggattatcattgctacagatgctcagcggc

SEQ ID NO: 46613 - DNA, 601 bp, Human
cagagaaatgaagagatttatctcatgtatttttttgattattaaggataattggacctttacaacatagaattttgaccacttatgcttatttagttgcattgtggaggcaaatgatattaatatggtaagagtccatttccttttgttggcctatttactccggtactcaagcccttggtatatttgcaattagtatctgcattataaatcagataatcatcaaattacagggtttatgccaaacgtacaggagtccaacagtgaacaaactgtataatcaaaaatttctctaatgaargatcaagcttgtggtcaggaggagtaaagtatccagttaatcccagaagaatgggcagaagtaggataagggtagggccaatctctggcatgtatttatcaacattctttctgataatagaatgtttagcatacaatagaatggagtgtttaacatacaagttgagttcaaagtttagatttcaaatggtaaatggttttccaatattgggatgtaatgatggaccaaaaaagaaaaagaagaaagtaatacattagagcccaatactttttaatcaagatatgaggacttaattatttt

SEQ ID NO: 46614 - DNA, 601 bp, Human
ggccagtagaagaagcctgcatgtctgccaagttcaagacctggtttggccctggggatctaggaatatccaaatgagacagaccttgaatctcagggttggttgagtttcagggtggtgacatgagatttatggcttgaatctcacagagttgtgacatgaaaagtattctctccacttggagaagtgtttcctcatgtctcccactggcttgggtaaaatattacctgtgatgatttcaccccgctttgctctgacttcacactcatgaagaagtcgctattgactacgcagcttcctracatcctggcttggggaatgggaggtgccctggttgggaatgagagttctccaggcactgaagatggagagcatttattctatcttaattggcactagagaaggcatcagtctcttgtgcatctgtgagttcatcaatcttcctgatacctgtcgattctggacctcccaagatccaatttctggtgcagaactgttatgaatactccaaaaaaaaaaaaaaggccaatctttagaaacctttggaaaaacaagccaactgaccttggtgcagcgtctctactccatcgttgtccctctt

SEQ ID NO: 46615 - DNA, 601 bp, Human
tccaggtctgaccaccccccaaaaagaaggaaatcaatattttttaagactttatatggtatcactggaaaaaaatctggatttcattccagctataaaagccatgtgtaaatttaatatccagatgcaaaaggtggacacccacaaataaatttatgattgtggaaatatttagacactttgaacaagagtggtacacactgagaattctgtggcttaggaactaatatgcttcctttgaagatttgaccttttcttctgcactagaattatctcctgagtccttataataatttccttsacaacctgtacctatgaacaacaaatctacattctaaaatatatcactatggcctagattcagtttcttatgggtagaaatcacattcttcatgtacacacttctttcctagaattatataaagcaggtattattattatcgttttcaccgagaccagaaccagaattttgtagatgtgcaccagccaccattcattcaagaaattgttagagccctgctatttccaagcaccgtttattgttttaaagatatgtttcaagttggagggcagaaaggagttagaggcatgatccttttca

SEQ ID NO: 46616 - DNA, 601 bp, Human
agtaaacattccaatagtgctacgcgaagcaaagcaaaaaggaatgtgctgggacaaaataaaactacatgctcaccattataagggcaataagacagtgtcacaacccaagcccctattacaggcctagagacagatgaggcaaagaataattaagaaacgtgtatcagcacaggccatgaagacgctggtgaagaaccactggaagactaggatgaggagtaaactgtgatttttccacagcagctcctgcattcaagatcacaggacatgacagagcaatatagtttaagtgaacacrttcaacgccatggcaggggcaggggatgggagatgccgtcgtctatgaggggaaaactatgagaggccaacagaaaggaggaaagagatgctgcctttgaatatgtaaactcctttacctacattcctgttcaccttggggtgggggaacagctgtctaggcaagattttttgcctagttctaagagtacagagcctatgaatttcttcataagaaaatttatctccaacagccttttcaaacgtcccctttgtactactcgaactgttgcctccctagtggtagatttcccttaggttt

SEQ ID NO: 46617 - DNA, 601 bp, Human
cattctctgctatgcagtgaaagcacacaggcctgtaggtctctgcaggaccagaacactgtgcacaaataacctttagattgttatttctcaatcctcttaccttgcctctccagccccaggcaccaggtctcagaggactcttggaagcacttgcctagcccagccctgctctcagctcatgattcacttgttatctctatgcgtcttcccgcgttgcctgtctttcattggcctttgtgttcttcctcttcccagagagtgtctgaaccaggtccaagactcacttctctcttcactsttcccatgtcagtaccctaccaggtagcatgagctataacaccactgggttttactatcacaaactgaagacagacagctgcttcccaaatgcatgcccctaataacaaaggagggtgcgcgctgtttccctttccctcttttggcaattagggaaatagcctggtggacatcctgtgtacagctggcaattagcacactttctgtacatggattctgcacatgagtggaagactactaaattcttgctctcctccatggagaatactggccagaaagaaccacaatttttttttctagg

SEQ ID NO: 46618 - DNA, 601 bp, Human
tcgatacatgtttctgtctcagttctagagcgagaaactcaggacaagtcagtgtatatttaagtcctcttgtgtgaaggcagatgtatctctacttttatgggtgtcttatgtgctactttcatcaatatatgttcggtgatcatatgtgtaatcagagatatttaaatgcatatatacataatgatatatagagataattaactttaagtttattaaactgtatttactctataaactatgacttcattttttgttttgttttgttttttgttttttgagatggagtctcactctgtcrctcaggttggagtgcagtggcgccatctcagctcactgcaacctccgcctcctgggttcaagcaattctcctgccgcagcctcccaagtagctgggactacaggcacctgccaccaagcccgggtaatttttgtatttttagtagagacggggtttcaccatgttggccaggctggtctcaaactcctgaccttgatccacctgcctcagcctccccgagtgctgggattacaggcatgagccacctcgcctggcctataaactacgactctgatgaccgcatagtatttaagcaagaaa

SEQ ID NO: 46619 - DNA, 601 bp, Human
ttttttgttttttgagatggagtctcactctgtcgctcaggttggagtgcagtggcgccatctcagctcactgcaacctccgcctcctgggttcaagcaattctcctgccgcagcctcccaagtagctgggactacaggcacctgccaccaagcccgggtaatttttgtatttttagtagagacggggtttcaccatgttggccaggctggtctcaaactcctgaccttgatccacctgcctcagcctccccgagtgctgggattacaggcatgagccacctcgcctggcctataaactaygactctgatgaccgcatagtatttaagcaagaaaacaaccaaaatgttctagctaaagtggagaccacttaacctaacccaattaaactttaagttgaacacaagagtagtagatgcagttcagctccatgacattgggtgagttgtctaaatgctctgtgctttggtgtccttgtctgcgtgtgacatgaagccgcagatctcaaagatctctttcattccgtgaaagcgctctcaatgtgtgaagttgactgcttctcctgctgtttaccaagagaataatcttaaccctacattgtg

SEQ ID NO: 46620 - DNA, 601 bp, Human
gttaacacaaagggagaacacgggagcatcctgcaccgtgcatttcagccacagatcacatggcccctccgcgggcccagcccacgccctgaccgcccggcctggccaggtctccgtatctctctgccccgccgccccttcccaactgcggacatgctgggtggatccggatcgcatggaagacgcagcctggccgcgctctcccagtgagtcctcatttcgcctctttggttttttcctttcttttttttttttataaaaaacaaacgaattgttgtaaaaaaaaaaaaaaaaaaaaaaatgtgggagtgggaggggagaggaggagacaccaggcaggaaaggaatgcagtgagtgtgtgagtttcagacctgtctgaaactttctggtttccacttcatggttgctctgattcgctggcttttctcgtttccattttaatggtggtttgtggaccatttgccaggagtttatacctaggcacgggtttctccgtttcaaataccaatccataaagcattgtgtttctaaaggtctgctgttaatttagaccttagccctccgttcagaatgatccatttgcagggctcagagattttg

SEQ ID NO: 46621 - DNA, 601 bp, Human
tcctgcaccgtgcatttcagccacagatcacatggcccctccgcgggcccagcccacgccctgaccgcccggcctggccaggtctccgtatctctctgccccgccgccccttcccaactgcggacatgctgggtggatccggatcgcatggaagacgcagcctggccgcgctctcccagtgagtcctcatttcgcctctttggttttttcctttcttttttttttttataaaaaacaaacgaattgttgtaaaaaaaaaaaaaaaaaaaaaaatgtgggagtgggaggggagaggaggagrcaccaggcaggaaaggaatgcagtgagtgtgtgagtttcagacctgtctgaaactttctggtttccacttcatggttgctctgattcgctggcttttctcgtttccattttaatggtggtttgtggaccatttgccaggagtttatacctaggcacgggtttctccgtttcaaataccaatccataaagcattgtgtttctaaaggtctgctgttaatttagaccttagccctccgttcagaatgatccatttgcagggctcagagattttggctaaagcacacattgcccaatccttag

SEQ ID NO: 46622 - DNA, 601 bp, Human
ggaggagacaccaggcaggaaaggaatgcagtgagtgtgtgagtttcagacctgtctgaaactttctggtttccacttcatggttgctctgattcgctggcttttctcgtttccattttaatggtggtttgtggaccatttgccaggagtttatacctaggcacgggtttctccgtttcaaataccaatccataaagcattgtgtttctaaaggtctgctgttaatttagaccttagccctccgttcagaatgatccatttgcagggctcagagattttggctaaagcacacattgcccartccttagagtaaacagccaaagccctcaatatactgaccatctgactaagacagaacaagacccagagcatatgctattgatcagggaattgttcagataacggactccaagggtttaggatcatgaaatcctggaatgttaaagccagaagggaggcctttagactctttggtgcaatgctgtctttcaataggcagggaaacagaaaccagaggggcaactcaacttaccccaaagcagacaacagtcggtagcaaagccatgtctttgtactctcatgcaaagggccgttttcacac

SEQ ID NO: 46623 - DNA, 601 bp, Human
caagggccatgttattttcaggagcagtcgtgaatggttgttcagttatttagatttcaaggcatgtttaatttgttcctaccaagatcactgagagattctgtcacttgcggtttaatattttcactggtacttttatcattttcccaaagcctaaggaagtttacttgcaacaagatttggggtttcctgtaaatatttgttttagtccataaagggttatttttcttatagagaagtgtgcttttatatatcttgcagctgaaagttaaaagttttttgtgtgtgttacattttgtamcaaacatggaagggtatgtaaattgtaaaatcatggagtcaaggaaacgtaggaaattatttagttcatcccactgttttctgagggaactgaatccaaaacagtgctgggaaataaataaataaataaataaataaataaataaataaataaataattggcacaatttttaaagattctgcagaaatgacaaaggaaataaacataagaatattgagatttgtcaaaagtttaggaatgcctggcttattcaatgttatcaggaaatgtagcattataattatccaggatgctaaattt

SEQ ID NO: 46624 - DNA, 601 bp, Human
gaagaggtcctctgtcctctggaggcgaacttacccctggcatttttaatcagactagtgaggatccgtttccctatagaaacacagcttcgtttctccataccagcttcagacacaccttgggtttaaaaaggtggttgtaggctggtctgagagcccgactaccatgtgtcatgctgttgaaagtttcaaaagccaatttacaatgaaggtcttggaaacaacctcttcataaatgtagtgctgcctggatctatttccaagcctaattgaatttttaagaggagtccttagaaaatcygtaaacctcattcatttccagtcattcattcagcaaatactcattgagggtttcgcattctagtgaatactgctgtactgactgagcattaagaacatcaaaaaggacaaagctcaggctctggcctcaagggttctgttgtcttctgacctcccacccagcttagcattatctacatcagtgttctcagttttcattttttttttcctgtgaccttctgaaataaatgcattttattttgtaaccccagtacctatatacaatatatatatataaatatatatatatatatttgaagca

SEQ ID NO: 46625 - DNA, 601 bp, Human
ctcggctcactgcaacctctgcctcccaggttcaagcaattattctgcctcatcctcccgagaagctgggattacaggcgcccgccaccatgcctggctagcctgggggtttaagaaaagtttttttggatgggagtcagagggtctggattctggtctaactccttcagtaatcagtactgtgatctgcagcaagtcgcttcaacttgctgcgacacagctatgaagtggagatgctgatgcctgttctgtgtaattcacagggtgagcaagaacatccagtataataatgtgcattaaygtgtgcagaaaaatattaagtacagagcaaatccaagttattattaaacagtcttacttttacaattaaaatttaatatcagaggaacaacttggagggaccatttgttctttgtagatctgggaaaggattcttgaacaaggctataatatgatgcaacttcataaatggaaatctcagggtaactttttttgtgatattttaagtagatttgaattgaagaaactcagccaagttatcctggtccctcttcccttaaatacttttttttttggttttattttttatttttattttttt

SEQ ID NO: 46626 - DNA, 601 bp, Human
attcaaggcctgctgaattcctattcggagcctaacccaccctagagctgtgccttacaggctagctctgcctgctgcattagctccctgtgtctttccatgtctgtttattgatctttcttttttgtttttgtttttgttttgagacagggtcttgctctgtctcccaggctagagtgcagtggcactatctcagctcactgcagcctcaacctcctgggctcaagcaatcttcccacctcagcttcctgagtagctaggactacagatgcttgccaccactcctagttaatttaaaaawttttttttgtagagacgaggtctcactatgctgcccaggctgctctcaaactcctggactcaagagatcctcctgcctcgggatcccaaagtgtagagattacagacatgagtcaccacacccagtctgtttgctgatctgttttaaaggaatgtctacattcaccttttctaggagtcagttctccaaatcactctacctttcactttgtaagtaacggtggggaagaataaaataacaataaaataaaataaaaacaaaactatattcactccaaagagaagaaaataattccctttt

SEQ ID NO: 46627 - DNA, 601 bp, Human
gtggataaataaactgtggtgcacccagacaatagaatattactcagaaccaaaaacaaatgagctcttaagccatgaaaagacatgcaggaaacgtaagtgcatattactaagtgaaagaagccagtctgaaaaggctgcatactgtaggattccaactatgtgacattctgaaataggcaacactatggagacagtaaaaagatgagtggtttctaggcactagggcaagaagagagggatgaataggcagagcacaggggatttttagggcagtgaaaatagttggtatgacactacmtttgtccaagcccattgaatgtacaatggcaagagtgaaccctaatgtaaactatggactttgggtgatactgatgtgtcactgcaggttcatcagttgtaacaaatgtactacacttgtgagggatgtttataatgggagaggttatgtgtgtgtgagacggaatatatgggacatttctgtatcttcctctcaattttgccatgaatgtaaaactcctctacaaaaataaaatctttaaaaataaataaatcacaagcagggttggttccttctgagaaccgtgaggaagaatctgtt

SEQ ID NO: 46628 - DNA, 601 bp, Human
tcccaggagtttgagactagcctgggcaacatggtgaaatctcgtctctacgaaaactaaaaaaattagctgggcatggtggcacacacctgcagtcccagctactcaagaggctgcggtgggaggattgcttgagctgggaggtcgttgttctcaccactgcactctggcctgggtgacacagtgagatggtgtcttaaaataaaaataataaaaatcaataaatgaaatgccagctggctgaagtttgttggggcagggaggacagctgggtccttccctcacaggtaaaaaacctgtrtaaaaccattgggtctagggagcttttgcctctttgtgatcaggaagtattcgcttcttagaaagctaactaatctccctgcatcgagctctgatccatcaattctccgtgaagtctgggtattaaaccagccccaaagaagaacagaaaaggggattatcctcttccactaggacacatgccttttctggcatgggaagataaagctctctgatgataaatttccaagtacattttaatgagaaatgacatggattaagaaagagatagagaaaataagagatgaaaggcattctattt

SEQ ID NO: 46629 - DNA, 601 bp, Human
aatcatatttaagagcctggaatgtttctataaacttcttttaactttcaaacatacagtaaatctgcaaggcaaatatgactcatttcagtagctcaggattttccctcctgatcacagtatggtctgagattttgctaagaatgtttgagcaatttatagagctatttggatatgtttggagaatgtgcttgtatttcatgctatgaaataaaatccctgggggttttggtacatgaaaaagaataatgaaagtatgtgtgagtcattttgcctccaaatagttgataagcatgtttcyaacctacatgaggtttttaactttttaagttggatcccaaattaagacccaggttcagacaatgccattagcagaaccaataatgatgggaatcaaataaaagtaattgactaagaagtcatccttttttgaggctgtgagccccaggcattcttctttggggtgtggccttcatggggagtgtattgctgcagaaagctggggacagaatagtgttctggattgagtatctcagttaccagcctgaaatctccatcgaccaacactgccttctctcaaatgacttcttatatgaaagtg

SEQ ID NO: 46630 - DNA, 601 bp, Human
gcttttaaaatccaaaagaatgaacaattcagggtacttttttttcaatttcggaagaaaaaataataaacctgtggtgttagtaggatgggaagctcaccatgagggagaggcctaaaagctaagaaatgactgtttgctttgcttgcctaacgctaatgtagggagcctcagagttgaagaattttcacccctatcaagtcatttggcatggacacaattttacctataaagtcaactgatatgttcttgaaccagcaactggacatgttatgattgaaaatgccatgaaaccattttwgctctttttttgttcttaactttgtaaataattttaatatgtttctttattagtagtcataaaaagatccatagatattttgccccgtgatatcgttaggctttgtgtccctacccaaatctcatcttgaattgtactccccgtaatctccatgtgtcaagggagagaccaggtggaggtaactgaatcatgggtgcagtttcccccgtgctattctcatgacagtgagttctcacgagatctgatggttttataagggggggctcttcctccttcacttggcgcttcttcctgccacct

SEQ ID NO: 46631 - DNA, 601 bp, Human
acatatctgggtttctattttgtagatatgtaagtaacattgtaataaaaacactgtaactctccaatacaaaaagcagcttcctacacaatgcagccccatacccatacccaacccattgacccatcaagccagcacccatcctttcttggcactctgtatctcagtacacattctaccttcaaaaacagctaagtcaaacgtgtcaaaatagctatttcctcttgagtttgagcatctgcagttgcccagccccaattctttatttggaaataagtattaggagaaacatatctagcayagtgatattgatttgtaatttcctcaaatagacattcactttagatgactacaaaagctaaatagagctcaggagctcgagaccatcctgggcaacataatgaaacaccatctcttaaaaaaaaaaatacaaaagttagctgggtgtggtggtgtgcacccatagtcccagctactcaggaggctgaggtgggacaattgcttgagcctgggaggtcaaggctgcagtgagctgtgatcacaccactgcattctggcctgggtgacagagttagactgtgtctcaaaaaaaaaaaaaaaa

SEQ ID NO: 46632 - DNA, 601 bp, Human; identical to SEQ ID NO: 29781

SEQ ID NO: 46633 - DNA, 601 bp, Human; identical to SEQ ID NO: 29782

SEQ ID NO: 46634 - DNA, 601 bp, Human; identical to SEQ ID NO: 29783

SEQ ID NO: 46635 - DNA, 601 bp, Human; identical to SEQ ID NO: 29784

SEQ ID NO: 46636 - DNA, 601 bp, Human; identical to SEQ ID NO: 29785

SEQ ID NO: 46637 - DNA, 601 bp, Human; identical to SEQ ID NO: 29786

SEQ ID NO: 46638 - DNA, 601 bp, Human; identical to SEQ ID NO: 29787

SEQ ID NO: 46639 - DNA, 601 bp, Human; identical to SEQ ID NO: 29788

SEQ ID NO: 46640 - DNA, 601 bp, Human; identical to SEQ ID NO: 29789

SEQ ID NO: 46641 - DNA, 601 bp, Human; identical to SEQ ID NO: 29790

SEQ ID NO: 46642 - DNA, 601 bp, Human; identical to SEQ ID NO: 29791

SEQ ID NO: 46643 - DNA, 601 bp, Human; identical to SEQ ID NO: 29792

SEQ ID NO: 46644 - DNA, 601 bp, Human; identical to SEQ ID NO: 29793

SEQ ID NO: 46645 - DNA, 601 bp, Human; identical to SEQ ID NO: 29794

SEQ ID NO: 46646 - DNA, 601 bp, Human
gatcctttccatgtcccaaaatatgtattggggtgagcaagtaaaaccttttcttcaaatgcagggacttttcttaacttggggattgggttaacagagtcctccctgctgggaagtacttcccctcaatggataaaaaatagcttttaagaaagtctaatatgttaaagtcaaacttacaaaaaagctctcttaagggatttcagcatcctggcatgcttccacaaaccaaactactaccttctattaaacggaaatgcccctttaggggcaaggggtttggattcacttcttttatttmtctccacagcacctggtgcattgctgtgtctggaagttgttaaccacctggctgactgtggatcccatgggtaaggggatggtaggggttggtaaggattggtaagagactcagttttctctcagttatcttccaaaactctgcattgctaaatactttaaatcttcctcactgcctgattgaggacatatacatgcactcttttgatttctatatgctaaatcatcaaaataaaacacagaagctacctatcatatttgatttaggtttatttcttccataagggtttagcattaggca

SEQ ID NO: 46647 - DNA, 601 bp, Human
ttttagttatgactacatatatgtatacgtgaactgtgcaacatgaaaagtatttatcattgtaggtcctcagaactgatcctaacagggctggacaagtgtctaagctccctgtaaagccacatgtagtcactgagcacttgaaattagctagtccgaattgagatgtattgcaagcacaatatacacattggatttcagacttagtatgaagaaaataatataagatctcattaataatttttatattgcatgctgacataatattttggatacaaaattaatttcaccttttttaacytttaaaactgtggccacttgaaaattttcaattacacatgtggctcatgctgtatttctactgggcagagctgttctagagttctaggccagtatgtgacccacaatgggggcttaagatccactcaaaaatggattgatcctttccatgtcccaaaatatgtattggggtgagcaagtaaaaccttttcttcaaatgcagggacttttcttaacttggggattgggttaacagagtcctccctgctgggaagtacttcccctcaatggataaaaaatagcttttaagaaagtctaatat

SEQ ID NO: 46648 - DNA, 601 bp, Human
acagcaggttaattagtgtctttaaattgtcccaatgtgggctgggcgcagtggctcacgcctgtaattccagcactttgggaggccaaggcgggcggatcacctgaggtcaggagtttgaggccagcctggccaacatggtgaaaccctgtctctactaaaatacaaaaattagctgggcacggtggcgcatgcctgtaatcccagctactcgggagggggaggttgcagtgagccgggattgcaccactgcactccagcctgggtgacagagcaagactgtctcaaaaaaaaaaaaaaattgtcccagtgttatgaatgtgttgtgtgtgtgagtgtgccctgcgatgggatggtgtcctgttcaggtctggttcccaccaggtgccctgaggtgccaggataggtcccagtcacccattaccctgaactggaataagctggcaaataattatcttgtttttattagtctttcttaaatgtatacatagctcacatgtatttcaatgttgaatgatactagcagtgttttggtctttatttagaagtgtggtggtgttgaagtggcttctttctcagtatagttattgatttgtggtga

SEQ ID NO: 46649 - DNA, 601 bp, Human
gtgaaatgagcccaaagaaatgcatatcacagtcctctatatttcaaaaaggtaagactacaaaaatggctttaagctcccagtagtcacagcaaagaggaaaacaaagttaatgttgtccttaagcacaaagcaaaatagctattgaggaaaaagcacagcattttcctgatgctgagttctgagagaaattcctcccgtggtgccaccttaaagggtatgatgggtaatactgtagtaacatcggtactgatacactcaacaacagccccctagtacagaaagtcctgtttttgtttgyttgcttgtttgtttttgagacggagtcttgcattgttgcccaggctggagtgcagtggcgcgatctcagctcactgcaagctctgcctcctgggttcacgccattctcctgcctcagcctcctgagtagctgggattacaggtgcccgccaccatgcccggctaattttttgtacttttagtagagacggggtttcaccatgttggccaggatggtcttgatctcctgacctcgtgatccgcctgcctcggcctcccaaagtgctgggattacacgcgtgagccaccgcgcctagccaga

SEQ ID NO: 46650 - DNA, 601 bp, Human
atgtggttcagcaccaagaaatatccatttttttcatttagttatgtatggaatgtacatgttataagtaacaggcaccattgaaaacagcaagacagatacgtatgtactgacagggaattatatctaagacattttgttgaatgcaaaaagcaagtcacaaagcaatatgtataatatgtatgtatacatgctatctagtatgatgtcatttatagtaaaaagagagagaagggggaagagagagaaaaagaagaaaagagagaggtaattgtgtagaaatagtttagggacaggcgcrgtggctcatgcctgtaatcccagcactttgggaggccaaggcaggtggatcgcctgaggtcaggagttcaagaccagcctggccaacatggtgaaaccctatttctactaaaaatacaaaaattagccgggtctgatggcacacacctgtaatcccagctacttggaaggctgaggcaggagaattgcttgaacttgggaggcggaggttgcagtgagctgagatcacgccactgcactccagcctgggtgacaagagtgaaactctgtctcaaaaaaacagaaaaaagaaaagaaaaag

SEQ ID NO: 46651 - DNA, 601 bp, Human
tttgctttataaaaaattctatgctccttaggttctgtctcttccatatactagaggcagatcaacttcaggacaatgtgagtaagatagaggcttctgggaggggcaggaactgaactaacttcaccatttgccaaagctgagatgcttccagggatcctctggtgtagaccctacataaaactaaggcctgataacataaggtaatagctaaatctttgagtacctacttagtgccatgtatccatcgatatactaagcactttaaatgtatttgctcatttaatttgtacaacacctytgtgaggtagatattatcttcactgaaccagtcttcaaggtgacaccaagtgacagcaagaagcaacagcagtggtagatccctcaaactcagttacctttttggctccctgtgagctgaggaaaccctcaggatttttagactatagggatggaaaaacctcgaaaaggggatacatgatttcctgatagagaaggggtaactcaaacaattaactgaagaaataaaagcatgtaaccatatttttggccagacttaatgaagtaggtcaaatgacttgcttgtagttatttgcaagcc

SEQ ID NO: 46652 - DNA, 601 bp, Human
tttttactgatgcttcagaaataacaaaagctcttcagtgtctatagtatgccaggtactagatgagatactctgctgttatctcttttaggcttcgcagcaccccgtgatgaatagatacttctatccttctagagcataggataatactatccctatttcacaaaaaggaaactgaggctcattagagttaagaaatacgccaagtcatgcccttggaaagtcacaatgcccagcttcgaacatttcacaaccgagggcagtcttcaaacatttagactcacccacacccaggagactyggctggaaagagtgccatactcagaagcgtggcacgccatctcctatatttcacacacaccagcttggccaatgacaaactctgatgtctctttcaatgcaaaggccaaagctgttatctgtgccttgggaaggcttaaaagcacagcaatttgggcaggctgcagatgacttctcctgtggtagcttcaacagcgactagcggctagaggccctgccccaggcagcttgggctggggctctggggaacgctgtgagaaagatgtagtcacttggaagcctgcccagaaagtggccctgc

SEQ ID NO: 46653 - DNA, 601 bp, Human
tacaataatagtcatctcacatggtctttgcaaagagtacagagcatcacatcgagcagatatatacagatatatagtaagttctacttccctttcctttccctagaaaggtagaggccctttcagtttgggcctgatgctcaccctttaactttaggtcaagtctgttttcttcataaccacctggacttttttttttttttttttttttttaaaaaaacagagtcttgcgctgtcgcctaggctggagtgcagtggtgcgatctcggctcactgcaacctctgcctcctgggttcaagygtttctcctgcctcagcctcctgagtagctgggattacaggcatgcgccaccacgcctggctaattttttgtatttttagtagagacaaggtttcaccatgttggccaggctggtctctaactcctgacctcaggtgatctgcccgcctcagcctcccaaagtgctgggattacaggcatgagccaccacgcccggtcagccacctggacttttatttggcatcccttggatatattgctgggttggtatttctgtgtgtggtctccagaccactaactttagaatcaccctgactatct

SEQ ID NO: 46654 - DNA, 601 bp, Human
ctaatttttgcatttttagtagagatagggtttcaccatgttggccaggctggtcttgaactcctgacctcaagtgatccactcgcctcggcctcccaaagtgctgggattacaggcatgagccaccgccctcggcctgatatttgaagttctaaataaagaaatttctaacacaagtaccctggctaggtactcatcaacatcacggattttcttagataatttcccagggtcatcacctcaggttagtgggcagaatttctcttctaaagatcaggagttcatctttgttccatctcaytccccctctaatgacctgtattatttcaaaatacaccaccatcttattactgcttaaactgcttggcagcaggcaatgtacaggtgcccaatttcacccagttagcttgataccagctcaaaataccagaacaaactctctctgcttctatttccagaggaagaactacttctcttgtcccacactttttttttttttgaggtgaagtttcattcttgtcgcccaggctggagtgcagcggctcgatctcagctcactgcaacctctgcctcccaggttcaagaaattctcctgcctcag

SEQ ID NO: 46655 - DNA, 601 bp, Human
aagagacaaaaacagagcactgaggagttctcttgacccagagtggagtctaggtgcctgagccggcagagtcagcccagctggaacacgtaggcaggagtaactgaggagctcaatggaaaaggcaaatggcttcatccttgggtgtggcagtcctgaatgaagaccccaagtccctgttctcaaaggcaacgatgtactggaatctgttcacatggctcaccttacaacctttcttcccaactccaggtcacgttggtagcctgaagtcagccacgatagagtgcttccacgacagaarttggcaaatgctacaaatcagggcttatttcccgctagaggaccagctgttaaacctttactagcataccactgcaaggccactccctaacctctttggtataataagagattagggacatacgcctcaaagggaggagagtcaggatgtaatgttgcatgtagaagtggtgctcagggctgaagatgaacaaccaacactatagtccttcctagggagaaaggtcaaaagtgaagaggtcacacagacagtggcatctagtgctctaaaaagtgctgttccaagaggaagagggacaca

SEQ ID NO: 46656 - DNA, 601 bp, Human
tgatggcaataataataataaattatgttgttatttttggtaaataactcagaagttcaaagaattgagtggcatcactgtaacaaactccttccattctatctacacatttgcatgaacaacatatttcagcacttataactatgacaaggaaaaaatagggataaaattgatgttaaaccctgcctcattctagcagtcagttatattcatccataagtacatctccaggtacatactattcatctcattaagagatacattgctgtccaaatttatgtctatgttaacaattatttaycaaagtgtatataatgtggtgctttggttagttatgctctaatttatatacatatttttgtttcagagaagtatgatacagtgatcactaaaagatttgcaaacattaaaacacatcacattaggaaaaattatgggagagaagcagaatgaaaatataagtttgagggaaaaaatgaaacttataaatatttaaaagttaaaaaatagcttgttatatgttttgtaaattgttgatgatatatttcaaagcattatagtatttagatgccaatagatgcattaaagtgatggggtaaca

SEQ ID NO: 46657 - DNA, 601 bp, Human
ttacttaaaaaggaagttaaaaacctgtgttatcaacttatatcataaaatatttattctatttacaggtcatcctaattcatctcattgtctataatgtttattttctacctctttataacaaaaaataaaattattatctgcctccagaccaattactttttaataatatatgccccctttctatctttaaatacataggaaaagtttagtcatggtatctactaaagataactatttctgtttttcatatttatttgattattcccaaaaggcaaacactagaatttgatatatatayacacacacacacacacacacacacactcacacacacacgtgtgccaatatttagagaaggaataacatgccttttaaaaatcatactcttcttcgtataaatatcacataattttatgtataaattacattgcattactacaaattaagtgcattgatttattgtcttgtcttgtttataacttattatattagatctacatcattttaatcttgactgattctattttacataatccattctatcatttatttttgagtgttttttataaagcttcttgaaatacattaatacatttga

SEQ ID NO: 46658 - DNA, 601 bp, Human
ttccagctatttacttgaaaatcacttcaataaaccaaagctatataggctggtactgctgcttcttagaaatgtgactagaatattttctagaattatcaaatttttcaagatacattggaatagacacatgggtaaaacatttacataattttttacaggcttcatacgcattacttaaaaaggaagttaaaaacctgtgttatcaacttatatcataaaatatttattctatttacaggtcatcctaattcatctcattgtctataatgtttattttctacctctttataacaaaaartaaaattattatctgcctccagaccaattactttttaataatatatgccccctttctatctttaaatacataggaaaagtttagtcatggtatctactaaagataactatttctgtttttcatatttatttgattattcccaaaaggcaaacactagaatttgatatatatatacacacacacacacacacacacacactcacacacacacgtgtgccaatatttagagaaggaataacatgccttttaaaaatcatactcttcttcgtataaatatcacataattttatgtataaatta

SEQ ID NO: 46659 - DNA, 601 bp, Human
accacacatacagtaatcaagatccagcctttcaaccaacaacacaggacacctattcttgaagacctccctaactttcctcagtatagaattgtctgccattaagttggttggtttgtcattctccagaaagacagtctaagataaaggtctccttaaactacgatacatataccctcatggacacacacagacttttcttttttcttttcttttttttttttttgagatggagtctcgctctgtcacccaggctggagtgcagtggcgtgatctcggctcactgcaacctccgcctccygggttcaagcaattctcctgcctcagcctcccaaatagctgggattacaggcgtgtgccaccacgcttggctaatttttgtatttttagtagagacggggtttcaccatgttggtcaggctggtcccgaactcctcacctcatgatccgcccactcggcctcccaaagtgctgggattacaggcatgagccaccgcacccagccacatagacttttcaaaaggtatccatgaacagctagttttaaacgaatcaatgtccagattcaacttccagtggtacactttcctaatattaacta

SEQ ID NO: 46660 - DNA, 601 bp, Human
tgtgtttaatttaaaaattttaattgatgcataataattaacatatttatggggtagagggtgatgtttccatgcatgtatacattgtataataatctaatcaggatatttagcatatccatcacctcatacctttatcatttctttgtggtaagaacattcaaaattctgtcttatagctattttgaaatatacaatattgttaaccatagtcaccctaatgtgcaatagaacaccagaacttattcctcctaactgtaacttggtactcgttgatgaacttctccctgtcccccgtcayctaccttccccagcctctggtaaccactgttctactctctgtttccatgagatcagcttctttagattccatatataagtggtatataaacacaaagaaatactatttagctatgaaaaagaatgaaatcctgtcatttatggcaacatggatggatctggaggttattttgttaagtgaaataagccagacacaggaagacaaatactgcctaatctcacaagatgtgttttaagaacaaaaatatgatcattttcttggaactgaatgatgacccacacccagaatcaaatctggcca

SEQ ID NO: 46661 - DNA, 601 bp, Human
aaaatcttatgtcagtaggattctcagggtcacaaaatcatagatataaagttctttctttaaaggctgacctgtgactttctggataagatgtgtgttcatttgtcccatgaaaaagaatgcctgtgaatcgataagcatcaataatgacggtggtgatggtggtgacaatgacatttttggagctcttgctatgggccagccagtgttctaactgcttaactaagattacctcttagatcttcaaaacacgtccacaaggaagataccaacatcatcccattttacagttgaggtaagygagtacagtgtggttagatatcttgttcaaggtcccacaactaggaagagatagaggcaggatttggacctgggcggtttagctccagggcccacactcaaagaagtgagaggataccagtcctcgggcttgggcggacgaaaggtgccacatcaagcagttccacatgacagttcctgaagttacctcttttagaaattgagagagactttgggctttccgtagtcttggctgcagaaccagactccctaatcttgctacttagagaatgtgggagaatgagaagtaccttgtgttttt

SEQ ID NO: 46662 - DNA, 601 bp, Human
caggactaactttggacagaaggagtccagattattaactagccagttatctacctgcttctggaaggaaatttcttgggagtatccaataatctcattgtgaagacttaattatgaatgaggaaaatggctgccatttaagtaatggggtcctgcacttttcgtctgatgaccccggaaattaagccttagacctgaagttgagcactttggtgctcaggttcattcctatataaatacctaaatggtatctgtgccataactgagccttagcacatgctaacagtggcttgtagaagcygcctgggggacacctaaagttgtaactccctgtttgtatacactgcagatgtcccagggcagacagatgtctcttattgcacctgattattgtgatgtggttgacaggtgagcacaggggaatgcctcacctgcttcctttatgtgcttgtaaacatcatcagagccagcagaggaatacggaatgtcatcatgagccacaaagtcaatctgttgaagagagagaagagtgatgtcaccactgggatggatgtgcatgtctgcagatttgaaggggggaatggtgacttcataatgcctt

SEQ ID NO: 46663 - DNA, 601 bp, Human
taaaacaggctctttttaaggctcatttaaaaagaagagttaagaaaggcaagaattccactaggaagagccaagctttgaggagtataaaaagggtattataaatcccagaagtgtcttttgaactattaagaaccagaggctgagtagactcagggtacagaatgtttgactataagccctggagtgtatattaaccctgggaaggcatgaaattaattaaggggcagttttctgctctccaggaagaagaaaagcacctctgggagttgaggggaggagtgcagagagggattgggargcggacagcagaaatgagagaacaggagtgcggtctgtcccttgctctgactcaggttcaaataccaggggcaggggcaggaaagagacccctttagaaagctcagtgcagggccactggcaccttgtttatggccaggaattttggaaagaaatagttttacagaggccaacatggcgggcaggtcagacagggcctgacatggcttactgacattgcctggtttcccttgccctctagtagattatggaggacagtttttaaatttcctggggactctctagaggaatatggaaggaa

SEQ ID NO: 46664 - DNA, 601 bp, Human
agaaatgggaatctctggccccaccagacctactgaatctgaatctgaattttcacaagattccacagatgatctgaggcatatctaagtttcataagcactggtctataacaaatccttatggcaattttaggaaaggagcagctggctcatagttcagatcttacaatgactttaaagggtatttatcaggccaggcatggtggctcatagctataatcccagcactttgggaggccgaggtgggaggatcacttgagcccaggagtttgagaccagtctgggcaacatagggaaactytacaaaaaagtttaaaattagctgggcatggtggtgtgtgcctgtagtcccagctacttgagaggctgaggtgggaggatcgcctgagcccaggaggtcgaggttgcagtgagctatgatcataccactgtactccagcctgggtgaaagagtgagaacttgtctcataaattaagtaagtaaagtaagtaaataaataaatattaatcacgccatgctgtaacccatcttgatgtaactgaggcatctgccagtttcttctccagttccagagcagacttccaagtccgaagtgtatga

SEQ ID NO: 46665 - DNA, 601 bp, Human
ctggagtgcaatggcatgatctcagctcactgcaacctctgcctcccgggttcaagcgattctcatgcctcagcctcctgagtagctggaataacaggcacacaccaccacatctggctaattttttgtatttttagtagggacggggtttcaccatgttggccaggctggtcttgaactcctgacctgaagtgatccactcgcctcggccttccaaagtgctgggattacatgcatgagccactgtgcctggcctgtgtttcggaagtttttgaaacacctggaatattgcaaaactggktaaagagtccttgatttcgaccttccaaaccttcctgcagcctcaggctggggcatgagctatgtgtgttgctactgagagctatatatatacatatatgtgctatgggaggtcactctgtcttccgttacttactaggtgaccttaggtgagttgttcaacctctctgggcctctgtttcctcatttctatgttggacatagtcatcctacccacccttgtaggcccatcatgaggattaaatgagataatccaagtaaaacacttagatgagcatatgatgagttcttggcaaatgtt

SEQ ID NO: 46666 - DNA, 601 bp, Human
tagtatctctttcatacaaccctcgtcaaccctttagcgtctctaaagtaaacttttcgaatctcttttacagacccctcatcaactctcctgacaatactggtatttacttgggaagggcatgcacaatagaaataccaataaagtaccagtggaggtttccagaattttcttttccctttccatagttatcattcaaagttgttcagattttaggcaaggagaccctctacatttcctctcagttttaagattcagatcatgtcctcagtccccaaagactgttgtgccttatcccaamacttgcgtgtcatgaaaaaccaggggaaaatcagggcacgatgggcacagatgcagggcaaactcctacttcttctctctctgtcttgcaaccagtaaaagaggagggctcctcacaacaaaaactgactgacagagtacatttctttggattctcctccccaaaacataaatgccagtagttgatccaagatcccatgatccatgtcttgtaacacaagctccgtgctgccactagcccacttcatctgtactcccaaagtttcatcatccccaactgggagactgagatgagcgacag

SEQ ID NO: 46667 - DNA, 601 bp, Human
aatgtaccttcctgtgtgattaaaatgggtggcgggaggccaaggtgggtggatcacttgaggtcaggagtttgagaccagcctggccaacatggtgaaaccccgtctctactaaaaatacaaaaattagccgggcgtggtagcacatgcctgtagtcctagctactcgggaggctgaggcaggagaatcacttgagcccgggaggcagagattgcagtgaaccgagatcgcgccattgcattccacctggggtgacagagtgagtgagactccatctcaaaaataaataaataaataaawataaataagtaaataaaatgggtagaataaatgtgcaaggacattgaaaaaagaattcaacctgccatacaacttttagacaatatcatcatcatcaccttcttatttactatcatcatcatcatcatcatcatcatcatcatcactactttctactcagagatagcatgtaagggcttcaattttatattggcatccttaatgtcaaatatgaggtcacttggggagacttaaaagactatggccaggcactgtaatcccagtggctcatgcctgtaatcccagcaccttggtgggcca

SEQ ID NO: 46668 - DNA, 601 bp, Human
atatgaatatatttgtcacaaatttgttttttgaggcggagtttcactcttgttccccaggctggagtgcagtggtgcaatctcgagtcattgcaacctccgcctcccgggttcaagtgattctcctgcctcagcctcccgagtagctgggattacagccgtgtaccaccatgcctggctaatttttatatttttagtaaagatggggtttcaccacgttggccaggctggtcttgaactcttgacctcaggtgattcacctgcttcggcctcccaaagtactgggattacaggcgtgaaytactgtgcctggccaccagctgacgtcttaactgcaacttcatgaaagaccgagtcagaaccatccagctgggctgcttcctggttcctgaccctcagagactgtgagataataaatgtttgtcgttttaagccaccaagttttgaggtaatttgttaccaccaaaagctaactaataggcatggataccacactttctgtttgctgagaatttttagagacagcagtacagtggagggctgagagtgcctatcataaatctagatggcctggtctcaagcacaattctggcaactggca

SEQ ID NO: 46669 - DNA, 601 bp, Human
ttaggacgattatttaaaaaaaaaaacaaagaaacagaaaataacaagtgttggtgaggatgtggagaaattagatccctgtgcattgctcgtggaaatgtaaaactgtgcggccactatggaaaacagtaaggcggctcctcaaaaaaattaaacatagaattaccatgttgtccagcaattctatttctcagtatatacccaaaagaattgaaagcagaactcaaacaccaatgttcacatcaacccaaacatccatcaatggaacaatggataaaaaagatgtgatgtacacataaartggaatatcattcagccttcaaaagaaagaaaattctgacacatgctacaacatggatgaaccctgaagacatcatgctaagtgaaatatgccagccacaaaaggacaaatgctgtatgattccactcatatgaggttcatagagtggtcaaatttatagaggcaggaagtagaaggctggctgccaggggctgggggcagaaggggatagggagctcttgtttaatggttacagtttctgtttgggatgatgaagaagttactggagatggatggtggtgatggttgcaggacaatgtg

SEQ ID NO: 46670 - DNA, 601 bp, Human
atgccattgcactccagcctgggcaacagagcgagactccatctcaaaaaaacaaaaacaaacaaacaaaaaccagaagtacttaacatctagtggggcaataaatgtcttgacaaatgcctttaaaggtttcagtatttcagatctattctggtttatctgccgaaaagaaatgataaagttcctggtacgatctggtttggtttggcccttgggtaagcaagatgaaactcaaggagagaaaagggcccatgcttcagttctggccaaatcaataacaactaacccttacacggtgccygacacaggtgccaggcactgctctaagggcgttgaagtgtgagccagtctgggtgcgatggctcatgcctataatcccaacactttgggaggctgaagtgggaggaccgcttgagtccaggagttcgagatcagcctgggcaacatagtgtgagacccccatctctacaaacaattttgaaaaacttagctgggcatggtggtatgcacctgtagtcccaggtactcaggttgagtggggagagggcctaggtgggaagatcgcttgagcctgggagttcaaggttgcagtgacccatga

SEQ ID NO: 46671 - DNA, 601 bp, Human
tattaagaggtttccatttataatgttttccctcaagaaaataatcccatttatagtcctgtccatacgaaagtagttttctatttctctcctatgaagttttcccttttaagaagtacttaacatcggccgggtgcggtggctcatgcctgttattccagcactttaggaggctgaggcgggcggatcatgagttcaagagttcgagagcaacctggctaacatggtgaaaccctgtctctactaaaaatacaaaaattacctgggcatggtggcgggtgtctgtaatcctagctactcrggaggctgaggcaggagaatcacttgaacccaggaggcggaggttgcagtgaggcgagatcatgccattgcactccagcctgggcaacagagcgagactccatctcaaaaaaacaaaaacaaacaaacaaaaaccagaagtacttaacatctagtggggcaataaatgtcttgacaaatgcctttaaaggtttcagtatttcagatctattctggtttatctgccgaaaagaaatgataaagttcctggtacgatctggtttggtttggcccttgggtaagcaagatgaaactcaaggag

SEQ ID NO: 46672 - DNA, 601 bp, Human
cttcataaaatgcaatatccatgcaaaataactcccagcctcaatttgccagctctctgatctgtttctggtgcattttgaagggtggttcccttgcaaaggagcggaattcaatacagtcaggagacagtttgtaatgagcttcctgggaagaaaagcactttagaaatataacaaataaggaagagtatgcatggcattttccaagagtaaaggtatttaaattcagtctctcactgtattaagaggtttccatttataatgttttccctcaagaaaataatcccatttatagtcctgwccatacgaaagtagttttctatttctctcctatgaagttttcccttttaagaagtacttaacatcggccgggtgcggtggctcatgcctgttattccagcactttaggaggctgaggcgggcggatcatgagttcaagagttcgagagcaacctggctaacatggtgaaaccctgtctctactaaaaatacaaaaattacctgggcatggtggcgggtgtctgtaatcctagctactcgggaggctgaggcaggagaatcacttgaacccaggaggcggaggttgcagtgaggcgagatc

SEQ ID NO: 46673 - DNA, 601 bp, Human; identical to SEQ ID NO: 28411

SEQ ID NO: 46674 - DNA, 601 bp, Human; identical to SEQ ID NO: 28412

SEQ ID NO: 46675 - DNA, 601 bp, Human; identical to SEQ ID NO: 28413

SEQ ID NO: 46676 - DNA, 601 bp, Human; identical to SEQ ID NO: 28414

SEQ ID NO: 46677 - DNA, 601 bp, Human; identical to SEQ ID NO: 28415

SEQ ID NO: 46678 - DNA, 601 bp, Human; identical to SEQ ID NO: 28416

SEQ ID NO: 46679 - DNA, 601 bp, Human; identical to SEQ ID NO: 28417

SEQ ID NO: 46680 - DNA, 601 bp, Human; identical to SEQ ID NO: 38502

SEQ ID NO: 46681 - DNA, 601 bp, Human; identical to SEQ ID NO: 38503

SEQ ID NO: 46682 - DNA, 601 bp, Human; identical to SEQ ID NO: 38504

SEQ ID NO: 46683 - DNA, 601 bp, Human; identical to SEQ ID NO: 38505

SEQ ID NO: 46684 - DNA, 601 bp, Human; identical to SEQ ID NO: 38506

SEQ ID NO: 46685 - DNA, 601 bp, Human; identical to SEQ ID NO: 38507

SEQ ID NO: 46686 - DNA, 601 bp, Human; identical to SEQ ID NO: 38508

SEQ ID NO: 46687 - DNA, 601 bp, Human; identical to SEQ ID NO: 38509

SEQ ID NO: 46688 - DNA, 601 bp, Human; identical to SEQ ID NO: 38502

SEQ ID NO: 46689 - DNA, 601 bp, Human; identical to SEQ ID NO: 38503

SEQ ID NO: 46690 - DNA, 601 bp, Human; identical to SEQ ID NO: 38504

SEQ ID NO: 46691 - DNA, 601 bp, Human; identical to SEQ ID NO: 38505

SEQ ID NO: 46692 - DNA, 601 bp, Human; identical to SEQ ID NO: 38506

SEQ ID NO: 46693 - DNA, 601 bp, Human; identical to SEQ ID NO: 38507

SEQ ID NO: 46694 - DNA, 601 bp, Human; identical to SEQ ID NO: 38508

SEQ ID NO: 46695 - DNA, 601 bp, Human; identical to SEQ ID NO: 38509

SEQ ID NO: 46696 - DNA, 601 bp, Human; identical to SEQ ID NO: 38502

SEQ ID NO: 46697 - DNA, 601 bp, Human; identical to SEQ ID NO: 38503

SEQ ID NO: 46698 - DNA, 601 bp, Human; identical to SEQ ID NO: 38504

SEQ ID NO: 46699 - DNA, 601 bp, Human; identical to SEQ ID NO: 38505

SEQ ID NO: 46700 - DNA, 601 bp, Human; identical to SEQ ID NO: 38506

SEQ ID NO: 46701 - DNA, 601 bp, Human; identical to SEQ ID NO: 38507

SEQ ID NO: 46702 - DNA, 601 bp, Human; identical to SEQ ID NO: 38508

SEQ ID NO: 46703 - DNA, 601 bp, Human; identical to SEQ ID NO: 38509

SEQ ID NO: 46704 - DNA, 601 bp, Human; identical to SEQ ID NO: 38502

SEQ ID NO: 46705 - DNA, 601 bp, Human; identical to SEQ ID NO: 38503

SEQ ID NO: 46706 - DNA, 601 bp, Human; identical to SEQ ID NO: 38504

SEQ ID NO: 46707 - DNA, 601 bp, Human; identical to SEQ ID NO: 38505

SEQ ID NO: 46708 - DNA, 601 bp, Human; identical to SEQ ID NO: 38506

SEQ ID NO: 46709 - DNA, 601 bp, Human; identical to SEQ ID NO: 38507

SEQ ID NO: 46710 - DNA, 601 bp, Human; identical to SEQ ID NO: 38508

SEQ ID NO: 46711 - DNA, 601 bp, Human; identical to SEQ ID NO: 38509

SEQ ID NO: 46712 - DNA, 601 bp, Human; identical to SEQ ID NO: 38502

SEQ ID NO: 46713 - DNA, 601 bp, Human; identical to SEQ ID NO: 38503

SEQ ID NO: 46714 - DNA, 601 bp, Human; identical to SEQ ID NO: 38504

SEQ ID NO: 46715 - DNA, 601 bp, Human; identical to SEQ ID NO: 38505

SEQ ID NO: 46716 - DNA, 601 bp, Human; identical to SEQ ID NO: 38506

SEQ ID NO: 46717 - DNA, 601 bp, Human; identical to SEQ ID NO: 38507

SEQ ID NO: 46718 - DNA, 601 bp, Human; identical to SEQ ID NO: 38508

SEQ ID NO: 46719 - DNA, 601 bp, Human; identical to SEQ ID NO: 38509

SEQ ID NO: 46720 - DNA, 601 bp, Human
tctggccttcacctaagctcaccatcaatatgcttactgctctcccctgcttttcttcccactgatccttaccgtggtgccccgagtggccccctcaagctgagttggggtcttcagtcccccatacttcttccagtagatccaacaggaagcacagaggcggcactgcatgttaggtgggccccaggcataccactgagcagactgtgtggctgtagagtacggagaggagggggacagggaagaagcatactacctaagcccctcagattcttgagccacagcaggccttccacccatycccaccatcccagtgcccccgtaactcactgtggcaactctcacaagtcaggcccttctgaaatccagccccattcatgccaggttttgaacccacagaaatgatctggttagggtttggcttagtgctaacggggaaggcgaggagaagggaaaaaaacaagaaactggtcaaggaaaagaatcaatttccactctcagtgtgcccctacctcctgcccacccccaatcactgaggaaggcacaagttaggggaagggaaggaaaacactctggtctcccctacccaccacacttacta

SEQ ID NO: 46721 - DNA, 601 bp, Human
cataggcccgtttcaccataatgccccccagtccccggttctgggacagctggtttctgttgatcggtgtcttggtaccccgaggtgtttttggtttcaggggtgcctgggccactggaaaaaaacagaaaactttcgcaccttttcttcccacgcagttcccctttgttacttccatctctcttccctggaccagcagtttacctgggcatccccaaaagtagcaatgggggaatgttctggcaagctatcactagtatttcaaatatcagtatgaccttatcaaatcagtacagtaatrctgaatagtttacaaaaaaaattattaaacaacaaaagtacagtttgttagactaaatctctgaggacactatgaggaagaaaaaaagcaaggggagagatgtcagacagggaaaggactgggagcctgatgccaacctcactggtccccatcccatacccagatctttgacgatagttgccaggggcagccgcaccagagggtgaatcttcaatggagtcttggcggccttaggaagtcgaatggagcctggagaacaaagaagaaagcttctgaagggcttcaccattcaggtctcct

SEQ ID NO: 46722 - DNA, 601 bp, Human
gctacaggggaccaaatttgtgatgaaggcatcaagccaaactcaattttcgaaagctgcatgctgaccagggaaactctcctgctgtagtcatttacaggaggccttagggctctctggttcttccacagcagttcatgttttatttatttatttatttatttatttatttttgagacagagtctcgctctgtcatccaggcttcggtacagtagcgcaatcttggctcactgcaatcgctacctcccagtttcaagcaattctcttgcctcagcctcctgagtagcttggactacagcygcacaccatgacacctgcctcggcctcccaaaatgctgggattacaggcttgagccaccgcgcctggccttatgtttttagcattttacatttttcttctgtggttttggaaacttctaggtctctgtgattcatcatctctttttgtcttgcattagcgacaatatattctggccaactgatgatggaaggagagccagagagccaatctgcaagtttatagtcagtgccagatcagatcagtggtaatactttcaatattctccctctgctctgagggtgactgctggggtgtctgtc

SEQ ID NO: 46723 - DNA, 601 bp, Human; identical to SEQ ID NO: 17723

SEQ ID NO: 46724 - DNA, 601 bp, Human; identical to SEQ ID NO: 17724

SEQ ID NO: 46725 - DNA, 601 bp, Human; identical to SEQ ID NO: 17725

SEQ ID NO: 46726 - DNA, 601 bp, Human; identical to SEQ ID NO: 17726

SEQ ID NO: 46727 - DNA, 601 bp, Human; identical to SEQ ID NO: 17727

SEQ ID NO: 46728 - DNA, 601 bp, Human
tgtaggtattagaaaatttaggaattacattatgtggtttgctatatttctagtggtcagtactgggccagatgatctctaagatcactttcatctcaaacattcagtgactttttgaaatcttgatgggaccagtataggaaagatagagagaaatcagcactcatggtagtagttagaagtgagatggaagagaaagggagatgacagaaaatgaaaacagattgaaattccaaatacttgtgatttgacaacatgaacaattgcatgttatttgcctctgtcctctcatctgacccayagttgtattttttaactaactggtcttgatgagcccaataatcggcatggaatcatctttctctttcaaattgctttacaaatattaaaaaacatgatttctccttaatccttcctaattaataggaagtcaaacatcacttaccagaaacaaaactgaaaaccagtggttaaccacccagtttcccattgtcaagaggtggtttggagcccttctaggcaacagggaagattcagcaatccggattctggagaggtccttcaggaatggaacatttgtccagcgcagggtctgtgagcc

SEQ ID NO: 46729 - DNA, 601 bp, Human
ggctgagagctctatgcagttatgcagtgatggtaaatgttttaatgactgtggaatgtttaaataaattatggcatattaattagccaggcttggtggcgcacacctgtggtcccagctaatcaggaggctgaggtgggaagatagctgaagcctgggagagtcgaggctgcagtgaaccatgatcatgccactgcatgccagcctgggtaacagagaaagaccctgtctcaaaataaaaagaatgaaaacaaagaaagaaagaaggaaggaaggaaggaaaagaaaagaagaaagagaaaaagagagaaggaaagaaggaaggaaggaaggaaagaaagagagagagaagaaagagaaagaaaaggaaggaagaataaagaaaggaagaaagagaaaaaagaaagaaggaaagaaagagacctgcacttataccccctacatatgtaaacaatttttaaataattttgaaaaaaaaatgtccatgggacatcagcataatttatttttgtgctgctgacattttggtcatgtagtaatcaagctgttaataactagtcacatttattgcatcattctcttagtaaaaagctatttttaa

SEQ ID NO: 46730 - DNA, 601 bp, Human
tacttactgtaagagcttgtcagtttacttaatctcttggaatcctgtccttttgtttcaaaatttagacaaaaaagaagtaatatctcataggctattgctatatataaatgaaataatccatattatgcagcaaggctggcagatgataaacacaattaataatgtgggctatcattattacctttgcagagggtctcacaacatgcaagaactattagttttttctcttcaagatccccttgtaattgcctgttgccagtgatactggaagtttcttaaaggtaggaaccccatagayatccttcataagacccagcacaggactgaactaataataatgatgataataacaataagagtaataataagaataataacagtaacagctcctaacaagagtctgtccttgcccgtagggctcttacctcagggggatgcccttcaaacttagggcgcctacagtgggagtcacgatcatcccacatctcaaaagactctgcacacttgcgaggatgactctcattcatgctctcctctgtttgaccccggacaattccactgaaatagacaaagaaggatggtttgggacaaagaatta

SEQ ID NO: 46731 - DNA, 601 bp, Human
ttcttctaggttgtttttttttttagtttgtgtgcatagagatgttcatagtagtctctgagggtttttttttttttaatttctgtgcggtcagtcataatgtcctctttgccatttctgattgtgttttttggattgtctctcttttttctttattagtgtagctagtggtctattctttatttgtgtagctagcattctatctatcttattagaaaattactttctaaataggtaatatatgtatatggtacaaaatctgaaagtacaacagtacaatagtaaaaagcaaatcctcctrcccctccagatccccagaggtaatgttattattttgtgaattcttctggagaacatgcatttaaatgatcttttcaatgcaaatgataggagactctacacactgccctgccttttgcatttaacatcttagagactggtccctattagtgtctatggtactgtctctttcgttttactggttgcagactattccactgcatgaaagtcccaaaatgtaactagttccccactgatggacacttgtttccagtctttttttctattcaacaatgctgtaatgaataacttaatgcatgta

SEQ ID NO: 46732 - DNA, 601 bp, Human
caatagtttcagtaggaatggtaccagatcttctttgtacatctggaagaatttggctgtgaatctatctggtcctgggcattttttagttgtaggcttttttattactgattcagttttggaactcaatattggtctgctcagggattaaatttcttcgtggtctggtcttgcgaggttgtatgtgtccaggaatttatccatttcttctaggttgtttttttttttagtttgtgtgcatagagatgttcatagtagtctctgagggtttttttttttttaatttctgtgcggtcagtcrtaatgtcctctttgccatttctgattgtgttttttggattgtctctcttttttctttattagtgtagctagtggtctattctttatttgtgtagctagcattctatctatcttattagaaaattactttctaaataggtaatatatgtatatggtacaaaatctgaaagtacaacagtacaatagtaaaaagcaaatcctcctgcccctccagatccccagaggtaatgttattattttgtgaattcttctggagaacatgcatttaaatgatcttttcaatgcaaatgataggagactc

SEQ ID NO: 46733 - DNA, 601 bp, Human
agatatattgcataggatgtgccaacaattatttttataaccaataattccatgattttgcttgggtagtcccttttaatggtgaacttcaggtcacaacagtaactatcaattcaattacaccaaggtttctgaagacaatggcttctccacccaagcaggttgtatataaattccaaatagaacctggcatcaccctgaaggaatgctaacttcacactgttggggaaatttaccaagatggcttcagagtagactaactttacacagcacattaaaaaaaaaaagacatttattcagygtcatgatcagactatcacatatagcaattttttgcatgggtgcaaaaaaaatctacattaaaaccctttgttggaatgctttacactttccatagaacagaaactaaaataacctgttatacaattagtcacaaatacagtccttgacttttttgcccataaacatgagtatttgtataaaacatgtcttctttgtggcagctaggccctgtcaccactgtgtttggctgagttcatgaatctgttgtaacctgtagcttctctgtcacttctctggctctcctctcctgctaagcttt

SEQ ID NO: 46734 - DNA, 601 bp, Human
ccattattcaacgtagatatattgcataggatgtgccaacaattatttttataaccaataattccatgattttgcttgggtagtcccttttaatggtgaacttcaggtcacaacagtaactatcaattcaattacaccaaggtttctgaagacaatggcttctccacccaagcaggttgtatataaattccaaatagaacctggcatcaccctgaaggaatgctaacttcacactgttggggaaatttaccaagatggcttcagagtagactaactttacacagcacattaaaaaaaaaaagacatttattcagcgtcatgatcagactatcacatatagcaattttttgcatgggtgcaaaaaaaatctacattaaaaccctttgttggaatgctttacactttccatagaacagaaactaaaataacctgttatacaattagtcacaaatacagtccttgacttttttgcccataaacatgagtatttgtataaaacatgtcttctttgtggcagctaggccctgtcaccactgtgtttggctgagttcatgaatctgttgtaacctgtagcttctctgtcacttctctggctctcctc

SEQ ID NO: 46735 - DNA, 601 bp, Human
cacaagcttcattcccatctataattttatctggtaccattattcaacgtagatatattgcataggatgtgccaacaattatttttataaccaataattccatgattttgcttgggtagtcccttttaatggtgaacttcaggtcacaacagtaactatcaattcaattacaccaaggtttctgaagacaatggcttctccacccaagcaggttgtatataaattccaaatagaacctggcatcaccctgaaggaatgctaacttcacactgttggggaaatttaccaagatggcttcagwgtagactaactttacacagcacattaaaaaaaaaaagacatttattcagcgtcatgatcagactatcacatatagcaattttttgcatgggtgcaaaaaaaatctacattaaaaccctttgttggaatgctttacactttccatagaacagaaactaaaataacctgttatacaattagtcacaaatacagtccttgacttttttgcccataaacatgagtatttgtataaaacatgtcttctttgtggcagctaggccctgtcaccactgtgtttggctgagttcatgaatctgttgta

SEQ ID NO: 46736 - DNA, 601 bp, Human
gtgagacaagatcacaccactgcactctagcctgagtaacagagggagactgtctcaaaacaaaaaaaaatgtttcaaaggaaagcatccattatatcaatcaaggaaaaacattatttcctctaggtggtagaactctatgaaattttttatttacttctagtattttttgtattttccaaactttctacaataaatgtatattatttttctaatttttaaatggggtgaatatggagagagtattttttaaatgtttatggaagaaacaaagcaatacattcaggtggcaaaactggtrttctctctcttagagtattacacgaccaaccaaagcaacccctaagttttaaggataccaaatagaccaactataacttaactcaggtaatagatgagaaaaagacagaagctgatgtgcaagataagacaaggtattaaccatcttagctagtaagctttcctaataatctttaaatagctccctatcttttttttcaagagaattaaattgtttattgattacacatgataatggatgatacacaagcttcattcccatctataattttatctggtaccattattcaacgtagatata

SEQ ID NO: 46737 - DNA, 601 bp, Human
aacacaaaaaagggaaagtatgtgactgatgctactggtacataaaactcagtacttatccatcacctcctttctcaagtgcttaaacatttaacatagtaatatcttttttaccttgtctacattttttttaaaggcagctttttggccaggcgcagtggctcacgcctgtaatcccagcaccttgggaagccaaggcgggtggatcacttgagatcaggagttcaagaccagcctggccaacatggtgaaaccccatctctgctaaaaatacaaaaattagccaagtgtggtggtgggygcctgtaatcccagacactcgggagactgaggaaggagaatcactcgaacccaggaggtcgcagtgagcccaggtcgcgccactgcattccagcctgggtgacagagtgagactccgtctcaaaataaataaaataaataaataaataaagcagcttttctatccctgagatctttgcaaagcagcagtttgcttctacctgcacaggaactactaaaaatatacttcctagcaatactaaattatgtcctttcttgcacagttgctcaagtgtgatacattgggactgtgtgaagtgag

SEQ ID NO: 46738 - DNA, 601 bp, Human
attaaaaacaaaacaaacacaaaaaagggaaagtatgtgactgatgctactggtacataaaactcagtacttatccatcacctcctttctcaagtgcttaaacatttaacatagtaatatcttttttaccttgtctacattttttttaaaggcagctttttggccaggcgcagtggctcacgcctgtaatcccagcaccttgggaagccaaggcgggtggatcacttgagatcaggagttcaagaccagcctggccaacatggtgaaaccccatctctgctaaaaatacaaaaattagccragtgtggtggtgggcgcctgtaatcccagacactcgggagactgaggaaggagaatcactcgaacccaggaggtcgcagtgagcccaggtcgcgccactgcattccagcctgggtgacagagtgagactccgtctcaaaataaataaaataaataaataaataaagcagcttttctatccctgagatctttgcaaagcagcagtttgcttctacctgcacaggaactactaaaaatatacttcctagcaatactaaattatgtcctttcttgcacagttgctcaagtgtgatacattggg

SEQ ID NO: 46739 - DNA, 601 bp, Human
ttaattttaaggcctggcacagtggctcatcctagcactttaggaggccgaggcgggcagactgcctgatctcaggagttggagacctagcctgggcaacatagcgaaaccctgtctctactaaaaatacaaaaaattagctgcgcgtggtggtgcatgcttgtaattccagccacatgggatgctgaggcataagaatcgcttgaacccaggaggcagcagaggttgcagtgagctgagatcacaccactgcactccagcctgggcaacagagcaagacactgtctccaaaaaaataaattaagatttaattttaagaatctaagactgtcttcgaggacagcttgtccaatctaaaaaaccaacagagaaagtagatgtgaaatagaggcagatgattaaaaacaaaacaaacacaaaaaagggaaagtatgtgactgatgctactggtacataaaactcagtacttatccatcacctcctttctcaagtgcttaaacatttaacatagtaatatcttttttaccttgtctacattttttttaaaggcagctttttggccaggcgcagtggctcacgcctgtaatcccagcaccttggg

SEQ ID NO: 46740 - DNA, 601 bp, Human
tctcctggtctcaaggacctacctgggaattggtgaatattgttgttcgaaagcccttatgagattttctgtccagtcccctgctgctcggatatgaatggagaagaaatcttcctctggagcagaggtcaaagtaaaaggatgccattccaggagagagattgaggggcaattaacaaagatatactgccccacttccatgctgaagccacgcttgttcatctgcaattccaaaactttggatgggtgcataacaacctgtgaatgaagcacatagaccaaagaaagcaaactctaatgrcgacagggacaggcagataaagcaaatgagtgaagctggagggctggtgacagtggtgaactacaaacacaagtcctctctaaagagggcagcagctacttagctccagacagtggttgcgatatggaaccatgacagtgttatcaggtttcctgattcttcaagagaagcaagaaatagcttttaaaaaatcaaacgaaagcttccatccagatttttaaatgttggcaaccaattcaactttataaacaaacattgtgtgcaccaaacaaaatatagctgtgaactagctctggccca

SEQ ID NO: 46741 - DNA, 601 bp, Human
ctgtgccaaagggaccatccacttcaatcctggcagaagacagaagataacgggcaactgaagactcccctccacctccaacctcaaacatcctcccagaaatatagttgttcccatggctgacttctgcatatttattataatcctattctattgtaccaaacttaagattcaacgaagaattgctttctcttttctgccagtctgcatcctggtctgggactctcctggtctcaaggacctacctgggaattggtgaatattgttgttcgaaagcccttatgagattttctgtccagtyccctgctgctcggatatgaatggagaagaaatcttcctctggagcagaggtcaaagtaaaaggatgccattccaggagagagattgaggggcaattaacaaagatatactgccccacttccatgctgaagccacgcttgttcatctgcaattccaaaactttggatgggtgcataacaacctgtgaatgaagcacatagaccaaagaaagcaaactctaatgacgacagggacaggcagataaagcaaatgagtgaagctggagggctggtgacagtggtgaactacaaacacaagtcct

SEQ ID NO: 46742 - DNA, 601 bp, Human
cggggcttggtggatcatgcctgtaatctcagcacttttgggggctgaggcaggtggatcacctgaggtcaggagttcgagattagcctgaccaacgtggtgaaacaccatctctactaaaaatacaacaaattagctgggcatggtggtgggcacctgtaatcccagctacatgggaggctgaggcaggagaatcgcttgaacccgggattcggagattgcagcaagcagagatcgcaccactgcactccagcctgggcgacaagagcgaaactccatctcaaaaaaaaaaaaaaaaaaaggtaatcaagaatatttgtagcattgaattgatcatcacctccctacttgttcagggaatctcagcttcatctccttcccattggaatggctgatttcatagcaccaggattttttgtgctgtaacatgtctcaaaaccctccagaaagattgagctcaggtggccagtaaactagataatacctttgttactttaagtagagattattgagtcccctccccgcaaaaatgcatttgaattgctccagttctctagtttgtttggtagtatagatcagaagtgggtccacttgcctcact

SEQ ID NO: 46743 - DNA, 601 bp, Human; identical to SEQ ID NO: 46728

SEQ ID NO: 46744 - DNA, 601 bp, Human; identical to SEQ ID NO: 46729

SEQ ID NO: 46745 - DNA, 601 bp, Human; identical to SEQ ID NO: 46730

SEQ ID NO: 46746 - DNA, 601 bp, Human; identical to SEQ ID NO: 46731

SEQ ID NO: 46747 - DNA, 601 bp, Human; identical to SEQ ID NO: 46732

SEQ ID NO: 46748 - DNA, 601 bp, Human; identical to SEQ ID NO: 46733

SEQ ID NO: 46749 - DNA, 601 bp, Human; identical to SEQ ID NO: 46734

SEQ ID NO: 46750 - DNA, 601 bp, Human; identical to SEQ ID NO: 46735

SEQ ID NO: 46751 - DNA, 601 bp, Human; identical to SEQ ID NO: 46736

SEQ ID NO: 46752 - DNA, 601 bp, Human; identical to SEQ ID NO: 46737

SEQ ID NO: 46753 - DNA, 601 bp, Human; identical to SEQ ID NO: 46738

SEQ ID NO: 46754 - DNA, 601 bp, Human; identical to SEQ ID NO: 46739

SEQ ID NO: 46755 - DNA, 601 bp, Human; identical to SEQ ID NO: 46740

SEQ ID NO: 46756 - DNA, 601 bp, Human; identical to SEQ ID NO: 46741

SEQ ID NO: 46757 - DNA, 601 bp, Human; identical to SEQ ID NO: 46742

SEQ ID NO: 46758 - DNA, 601 bp, Human
tggaggcttgctagtaagtgtatatctttaagaaacagataaagttgacattagaaattcttcagttgctccagcctgggcgacagagtgagactctgtctcaaaaaaaaaaaaaaaaaaaagaatttccattgctaaggagttatttccagttaaagatgaattcaaattcatcaagccattagtagtactaactgtggcattagtcattcctgtcactcttttcaggaatttttgaagttagcgtatttttctcttttaaccttttgtttctgaaatgacttgttaaaagaagtcaatrtgcctagttctctaacttaggttaacattgtccttccatgtgatcatgatccccagctttcctctgagaacagaaaatacactctcactttcctccacagaaacaagaggctttcacatcatttatttctcagctctggagaatctaaaattatcagctggttcttacagcagccctgaaaagtagatatttgaaatgatttagctttttgttttgcctccctaactttcttgtactttcttcttgattaggccttggcactggtgcccctgtcattgagtcaccttatggagagaccat

SEQ ID NO: 46759 - DNA, 601 bp, Human
cttggtcagggtggaatgcatgtcaatggcgcacctcctctgatgcaagcttctatgcagggtggagttccagcaccagggcaaatgccagctgctgtcacaggacctggccctggttccttagctcctggaggtaagtttcatttagtcttcaccatttcagtacttgctaaagttttgtcatagccactgttgcagtgcagccaaatatgataatgggatccttaggtaaaattaatacacagctagaaagtatatatcttaggtggaggaaatagtagatttcttacgttaaatcctrtatgtctaattataagaacagggaaagggacagtaaagtgaaagagcatagtaaaacttccaagttaacaagggggaaaatggaatgagtggaaacaaaatcaagccagcaaaaatagagaagaggaaaaaagtaagagacagtgtaaaataagtaataataaatgtagagtaagatggaaggaataaaaactaatgtagttgttactctgctaaatatgaatgaactgtcagattaggttcaaaagctcatgaagaaaacagacaaaaaaatacaaggtcacatttgttatagcatatt

SEQ ID NO: 46760 - DNA, 601 bp, Human
caatggcgcacctcctctgatgcaagcttctatgcagggtggagttccagcaccagggcaaatgccagctgctgtcacaggacctggccctggttccttagctcctggaggtaagtttcatttagtcttcaccatttcagtacttgctaaagttttgtcatagccactgttgcagtgcagccaaatatgataatgggatccttaggtaaaattaatacacagctagaaagtatatatcttaggtggaggaaatagtagatttcttacgttaaatcctgtatgtctaattataagaacaggcaaagggacagtaaagtgaaagagcatagtaaaacttccaagttaacaagggggaaaatggaatgagtggaaacaaaatcaagccagcaaaaatagagaagaggaaaaaagtaagagacagtgtaaaataagtaataataaatgtagagtaagatggaaggaataaaaactaatgtagttgttactctgctaaatatgaatgaactgtcagattaggttcaaaagctcatgaagaaaacagacaaaaaaatacaaggtcacatttgttatagcatattaaactgacataaaattgtatttt

SEQ ID NO: 46761 - DNA, 601 bp, Human
tggggatcatgcctctgactctgctctgagtactttacttagatcatcttattaaatccacaagatcctgtgagatggataccattattagtcccattttacacgtgaaactgatgtgtggaaaagttaaataatgtgtccaatatcacacagctaataagtgatagagcctagatttgaacccatacagtctgaatccagagctcatgttcttatgcattgttctgcaaactcatacatataatgaatattcgttgattcctccctaattatgaaccaaataacgaaattctagaatacrtggatttatatctctgtagcttttcttccatctatttggtgttattttcttgttagtattcatagactacatcagctctttgttggatgtttacttactgatctggttggtactttgttgttgttttgttctattttaaaatacaacgtttttctccatctccagaggttacttgggaccacctcatcagggtccacccatgcaccatgtccctggccatgagagccgaggaccacccccacatgaactgaggggagggccattacccgagcccagacctctaatggcagaaccaagagg

SEQ ID NO: 46762 - DNA, 601 bp, Human; identical to SEQ ID NO: 23707

SEQ ID NO: 46763 - DNA, 601 bp, Human; identical to SEQ ID NO: 23708

SEQ ID NO: 46764 - DNA, 601 bp, Human; identical to SEQ ID NO: 23709

SEQ ID NO: 46765 - DNA, 601 bp, Human; identical to SEQ ID NO: 23710

SEQ ID NO: 46766 - DNA, 601 bp, Human; identical to SEQ ID NO: 23711

SEQ ID NO: 46767 - DNA, 601 bp, Human; identical to SEQ ID NO: 23712

SEQ ID NO: 46768 - DNA, 601 bp, Human; identical to SEQ ID NO: 23713

SEQ ID NO: 46769 - DNA, 601 bp, Human; identical to SEQ ID NO: 23714

SEQ ID NO: 46770 - DNA, 601 bp, Human; identical to SEQ ID NO: 23715

SEQ ID NO: 46771 - DNA, 601 bp, Human; identical to SEQ ID NO: 23716

SEQ ID NO: 46772 - DNA, 601 bp, Human; identical to SEQ ID NO: 23717

SEQ ID NO: 46773 - DNA, 601 bp, Human; identical to SEQ ID NO: 23718

SEQ ID NO: 46774 - DNA, 601 bp, Human; identical to SEQ ID NO: 23719

SEQ ID NO: 46775 - DNA, 601 bp, Human; identical to SEQ ID NO: 23720

SEQ ID NO: 46776 - DNA, 601 bp, Human; identical to SEQ ID NO: 23721

SEQ ID NO: 46777 - DNA, 601 bp, Human; identical to SEQ ID NO: 23722

SEQ ID NO: 46778 - DNA, 601 bp, Human; identical to SEQ ID NO: 23723

SEQ ID NO: 46779 - DNA, 601 bp, Human; identical to SEQ ID NO: 23724

SEQ ID NO: 46780 - DNA, 601 bp, Human
ggtagtagtagttttcagaccacgctttcagcctggaaagtaaaacaggatccaagcaactcgaagaacatctcaaaacatggacaaaacaatccagtgggagattatgaacatgctgatgatcaagctgaagaagatgctttgcaaatggcagtgggatattttgagaaaggtaaaggtggattgttttccttatgaaactcctatttctgtaaaaatattctagtctttttttcttaagaatttttaaaggaaagcataattttgctcattcatgcttttgtttatttaatagacattsagcaattactatatatcagtatgctaggcactagggacacaacaacaaaacttactagcagagtggttcccaaacggctgcatattgggatcacttgagaatctttttttctttttttttttcctccctctctacccctttggctctgagaatctttaacaaacaaactgatgtcaggcatctactcttagactttctgattttattggtatgggatgcaacctggcatagggattttttttaaaggcttcctaggtggttccaatgtatggtaaagtttgggaaccactgtcctaatat

SEQ ID NO: 46781 - DNA, 601 bp, Human
aaagtaaaacaggatccaagcaactcgaagaacatctcaaaacatggacaaaacaatccagtgggagattatgaacatgctgatgatcaagctgaagaagatgctttgcaaatggcagtgggatattttgagaaaggtaaaggtggattgttttccttatgaaactcctatttctgtaaaaatattctagtctttttttcttaagaatttttaaaggaaagcataattttgctcattcatgcttttgtttatttaatagacattgagcaattactatatatcagtatgctaggcactaggracacaacaacaaaacttactagcagagtggttcccaaacggctgcatattgggatcacttgagaatctttttttctttttttttttcctccctctctacccctttggctctgagaatctttaacaaacaaactgatgtcaggcatctactcttagactttctgattttattggtatgggatgcaacctggcatagggattttttttaaaggcttcctaggtggttccaatgtatggtaaagtttgggaaccactgtcctaatattgaaacaggttgtagtctaagttcagtgcttttagt

SEQ ID NO: 46782 - DNA, 601 bp, Human
gattatgaacatgctgatgatcaagctgaagaagatgctttgcaaatggcagtgggatattttgagaaaggtaaaggtggattgttttccttatgaaactcctatttctgtaaaaatattctagtctttttttcttaagaatttttaaaggaaagcataattttgctcattcatgcttttgtttatttaatagacattgagcaattactatatatcagtatgctaggcactagggacacaacaacaaaacttactagcagagtggttcccaaacggctgcatattgggatcacttgagaayctttttttctttttttttttcctccctctctacccctttggctctgagaatctttaacaaacaaactgatgtcaggcatctactcttagactttctgattttattggtatgggatgcaacctggcatagggattttttttaaaggcttcctaggtggttccaatgtatggtaaagtttgggaaccactgtcctaatattgaaacaggttgtagtctaagttcagtgcttttagtttagaataggaatgtcagggcataatccagctttcctcactgaagttgctatcgctgttaaatatt

SEQ ID NO: 46783 - DNA, 601 bp, Human
ggttggtctcgaactcctagactcaagtgatcctcccgccttggcctctcaaagtgctgggattataggcttgagccaccgcacctggctcgagggggatgttgttttgttttttgttttttgttttgagatggagtcttgctctgtcacccaggctgtagtgcagtggcaccatctcagctcactgctacctctgcctctcgggttcaagcaattctcctgcctcagcctcctgagtagctgggactacaggtgcgtgccaccacacctggctaattttttgtattttttttttttttttagtagggacgggtttttgctgtgttagccaagatggtctccatctcctgacctcgtgatccgcctgcctcggcctcccaaagtgctgggattacaggtgtgagccaccgtgcctggccgaggggatttttttttcttttgggagactgggtctcactccatcgcccaggctggagtgcagtggcgcaatctcagctcactgcaacctccactttccgggttcaagcagttctctgcctcagcctcccgagtagctgggattacaggtgcctgccaccacgcccggctaatgtttttgtat

SEQ ID NO: 46784 - DNA, 601 bp, Human
ttgagccaccgcacctggctcgagggggatgttgttttgttttttgttttttgttttgagatggagtcttgctctgtcacccaggctgtagtgcagtggcaccatctcagctcactgctacctctgcctctcgggttcaagcaattctcctgcctcagcctcctgagtagctgggactacaggtgcgtgccaccacacctggctaattttttgtattttttttttttttttagtagggacgggtttttgctgtgttagccaagatggtctccatctcctgacctcgtgatccgcctgcctyggcctcccaaagtgctgggattacaggtgtgagccaccgtgcctggccgaggggatttttttttcttttgggagactgggtctcactccatcgcccaggctggagtgcagtggcgcaatctcagctcactgcaacctccactttccgggttcaagcagttctctgcctcagcctcccgagtagctgggattacaggtgcctgccaccacgcccggctaatgtttttgtatttttagtagagacagggtttcaccatcttgggcagactggtcttgaactcctgacctcgtgatccacccg

SEQ ID NO: 46785 - DNA, 601 bp, Human
ctctgcctcctgggttcaagcgattctcctgcctcagctttctgagtagttgggcttatcggcatgtgccaccacacccagctaatttttgtatttttagtagagacggggtttcgccatgttggccaggctggtctcaaacttctgacctcaggtgatccacccgccttggcctccctaagtgctaggattacaggcgtgagccagtgtgcccagctaagatgctttttcttttgtgcaaatatcttttcctgttctaaattcattggtggtggttgggatggttggaagaggttcttasaaataacacctggtcaatattttatttacttgaaccttttaagtttttctcatttaaattcagacttggaagatattttagactctaaacactctcatttaaaggtgaggaaaaagaggctcagagtagttaaagagacttgcttaaagatgtccaaactcccattctagtgcttatactgtaccacattgctgctttttttcctacttaaaaaaaagttaaggctgggtatagtggctcatgcctataatcccagcactttgaggggccaaggcaggatgattgcttgaagccagattt

SEQ ID NO: 46786 - DNA, 601 bp, Human
attagacctaataaaattggcttttttcttgtagatggttttagattatttggttctaatatctttccaggaatccatgtttaactgaacaatgtctgtcaagatcaattctcccactcccatctcaccttaaaacatatatggagtaggggccgggtgcagtggctcacgcctgtaaccccaacactttgggaggccgaggtgggcggatcacgagatcaggagatcgagaccatcctggctaacatggtgaaaccccgtctctcctaaaaatacaaaaaattagccgggcgtggtgtcrggcgcctgtagtcgcagctacttgggaggctgaggcaggagaatggcgtgaacccaggaggcggagcttgcagtgagccgaggtcatgccactgcactcaagcctgggtgaagagcgagactccatctcaaaaaaacaaaacaaaaaaacaacatgtatggagtatacagatgttttctattttagaaatttttttttcgtgacagagtctcgctgtgttgtccagactgcagtgcagtggtatgatcatggttcactgcagccttgaccttctggactcaagcaatcctcccatctcag

SEQ ID NO: 46787 - DNA, 601 bp, Human
ttgtttggaagtcacctaagtgttttcgtacctacttaacatgcatactttaagtctaaaagtgactggcatctgtacctttatcttataggatacaaaaaccttaggatgctttaactctttttttctttttcttttttttctcttcttgtcatatggtgctgaagaatgctttaactctcatcatactgctcctggcttatatgctgttgttgtctggttttagttttaccttgtttttctccatccctttacacacacacacacacacacacacacacacacacacacacagagtagwttttttttttttttgagatggagtttcactcttgttgcccaggctggagtacaatggtgtgatcttggcttaccgcagcctctgtctcctgggttcaagcctcagcctcccaagtagctgggattacaggtatgtgctaccacgcccagctaattttttgtatttttagtagagacagggtttctccaggttggtcaggctggcctcaaactcaggtgatccgcctgcctcggcctcccaaagtgctgggattagaggcatgagccaccacgcctggccgatactatttttacagttgat

SEQ ID NO: 46788 - DNA, 601 bp, Human
cctaagtgttttcgtacctacttaacatgcatactttaagtctaaaagtgactggcatctgtacctttatcttataggatacaaaaaccttaggatgctttaactctttttttctttttcttttttttctcttcttgtcatatggtgctgaagaatgctttaactctcatcatactgctcctggcttatatgctgttgttgtctggttttagttttaccttgtttttctccatccctttacacacacacacacacacacacacacacacacacacacacagagtagattttttttttttttgagatggagtttcactcttgttgcccaggctggagtacaatggtgtgatcttggcttaccgcagcctctgtctcctgggttcaagcctcagcctcccaagtagctgggattacaggtatgtgctaccacgcccagctaattttttgtatttttagtagagacagggtttctccaggttggtcaggctggcctcaaactcaggtgatccgcctgcctcggcctcccaaagtgctgggattagaggcatgagccaccacgcctggccgatactatttttacagttgataattgtttagattt

SEQ ID NO: 46789 - DNA, 601 bp, Human
aaaacattgctgagctggcaggaaagcggtcagggtcattcagagtatctaatacacaatatttctatagatggttatcaggtcattggaattgaggtcagtaaactgtaagaccacggtgatttgttgatatggacattaaagtcatctggcatgatattgggattagagttagagctgaaaactgagtgagatgcccaaatcctcacggaattttggggaaggtactaggttagtagtgagctgacagggtataggtaaggtagaggtagtaaagttgggtgaactaagtctcagaggwggtctttttctatacaacggtgaaagagtggtaaccttggaagtgtcgatagaaagtaaggatgcaggatgctcatccctgttccatgtcctgtggtgcacaggtgtggttgaatgacaagtggtatgtcattgtctctctcttacctttgacatctctcttaacctcatattgtttctgttcataaactgaccaaattgcaatacaaatgaattctgtgtttaaacatactttgtaaagaataggaaataagaagagacgctttctgctttcttctaacagctcaatagactgagttct

SEQ ID NO: 46790 - DNA, 601 bp, Human
ggtgaactaagtctcagaggaggtctttttctatacaacggtgaaagagtggtaaccttggaagtgtcgatagaaagtaaggatgcaggatgctcatccctgttccatgtcctgtggtgcacaggtgtggttgaatgacaagtggtatgtcattgtctctctcttacctttgacatctctcttaacctcatattgtttctgttcataaactgaccaaattgcaatacaaatgaattctgtgtttaaacatactttgtaaagaataggaaataagaagagacgctttctgctttcttctaayagctcaatagactgagttcttccagtcagggactgagccttttataacccaagtacttattaaagttcttgccattgaaatggcaaaaactgcaattacttttgcaccaacctaaatatttgccagaaaggcaattgtaaaatgattaaaatatatgagtttttcctttctagatgtgattaaaagagaatgtcagatttcctataataatggagtctagggcaagtgattgtgtaacactcatttcatattcaacatgatagtattgctagtagttcatatccttaagcatatgacata

SEQ ID NO: 46791 - DNA, 601 bp, Human
ccaggctggagtgcagtggggtgtaatctcagctcactgcaacctccgcctcctgggttcaagcaattctcctgcctaagcctcctgagtaactgggattacaggcgcccaccaccatgcctggctaattttttgtatttttagtagagacggggtttcatgttggccaggctggtctcgaactcttgacctcaggtgatctgcctgcctcggcctcccaaagtgcagggattacaggcatgaaccactgcacccggcctgcttgagagaatttttaagggatgaataggatttaagtagrcaaagaagggagagaagggcattcctcccagagggaacagcatgagcaaagacatggagatgtcaaacagcaaacattgtttagggagctgggttggtatggctggaacagtaagtgttagggagtggtcataaatgaatttatattttgtacggatgtgatctaggaaagcttttttttttttttttttgagatggagtttacctctgttgcctaggctggagtgcagtggtgcgatctcagctcactgcaacctctgtctcccgggttcaagcgattctcctgcctcagcctcccgag

SEQ ID NO: 46792 - DNA, 601 bp, Human
ggtttcatgttggccaggctggtctcgaactcttgacctcaggtgatctgcctgcctcggcctcccaaagtgcagggattacaggcatgaaccactgcacccggcctgcttgagagaatttttaagggatgaataggatttaagtaggcaaagaagggagagaagggcattcctcccagagggaacagcatgagcaaagacatggagatgtcaaacagcaaacattgtttagggagctgggttggtatggctggaacagtaagtgttagggagtggtcataaatgaatttatattttgtayggatgtgatctaggaaagcttttttttttttttttttgagatggagtttacctctgttgcctaggctggagtgcagtggtgcgatctcagctcactgcaacctctgtctcccgggttcaagcgattctcctgcctcagcctcccgagtagctggaactacaggcgcgcaccaccacgccaggctaattttttatatttttagtagagatggtggtctcatcatgttggccaggctggtctcgaactcctgacctcaggttatccatctgccttggcctcccaaagtgctgggattacagg

SEQ ID NO: 46793 - DNA, 601 bp, Human
tttttgtatttttagtagagatggggtttcaccatgttggccaggctggtctcaaacttctgacctcaagtgatacacccacttcggccttccaaagtgctgggattacaggcatgagctaccgtgcccagccacctttttcattcttttactgtcttttaaatggggctttgggagaacccagaattaatcatatgttcgatatgccatttttaactggaaatctcccccttaccttttttagtattaactttttaacaaaaaagatagttttaattaactagactataagttctaaagkcctcagcacaactaagtattctctaaaaagcattctagctcaaaacaaacactctgatactcattaataatgggtgtacagaggttaggagatattttcaacatagataaactgggtcattttggttttgttttaataaatttaatttcaagaagctgttataaaatggaaatattgtatttctaagcctcatttgctgcctttgtgcagtattcgattcaataaaattttagtataataaaacaatttggttacttccttagaattcattttagtggtgtgttttctctggatagccag

SEQ ID NO: 46794 - DNA, 601 bp, Human
cactcaactcaaagttaatgcatagaatgttccttttttaaggctgtgttgcatacagttttcctgacctgtttccacttgtagcaaatgacatagtgaacgaacaagtggcagatgcatattaataaaaacaaacaaactgagaaatacttagtttgattgttgtggtttatatttttgtagatacatttattcatttcacaaatattttttgagcacctactaaatacccttcttgacactgggaatatagtagtgaccaaagcaaacaaaactccctgtgacattcatattttatatktatagtaatagtcgttttctgctagtaaaattgttccaaccttatatataatatgttactattttggagtggtctccaagaagaccaatatggcttccagaagttctacctgaatgagtttgagagccactttcttatagaatggttattcctattctagaagaggggcaattaagtaatttttcttttataacttttttttttaaccttaaatcacttactgttggccacattgacaggaaacatgttgtcctggttagcgtttgtcgtaattgaatggcacttgattaattacctatc

SEQ ID NO: 46795 - DNA, 601 bp, Human
ctgtttccacttgtagcaaatgacatagtgaacgaacaagtggcagatgcatattaataaaaacaaacaaactgagaaatacttagtttgattgttgtggtttatatttttgtagatacatttattcatttcacaaatattttttgagcacctactaaatacccttcttgacactgggaatatagtagtgaccaaagcaaacaaaactccctgtgacattcatattttatatttatagtaatagtcgttttctgctagtaaaattgttccaaccttatatataatatgttactattttggrgtggtctccaagaagaccaatatggcttccagaagttctacctgaatgagtttgagagccactttcttatagaatggttattcctattctagaagaggggcaattaagtaatttttcttttataacttttttttttaaccttaaatcacttactgttggccacattgacaggaaacatgttgtcctggttagcgtttgtcgtaattgaatggcacttgattaattacctatcatattaacttggatttgaggtctatttatgctaattgtaacttttacatcctgaccaatatcatcatt

SEQ ID NO: 46796 - DNA, 601 bp, Human
tggaataggaagttataacaaagaaaaaaataatagattttggtgtggttcagttcaggttatgacagaatctagtgtgtggctgtgggagtgggtaactaaggtggagtgaaggtgaaggttatttgattcaaagtcaaggaactgtgaagctgaaatgttgggataatttgcatggacactggtgtaactgaggtattgatggcaggacatgatgcagagttctaaggtcctcaatgaatctggataagattccaagtgatagcagagatatgagaagataaaaaaatagagggtagtrtagctggatagtatgaacaaaggagaaagggttttttacacaaggaaagaggaataatggtttggaaatagggttgaagataccttttgtgttgtgttcagaaaagcaagggatagtcagactcatgagaaaaactgactgtagcaaaatgcaatcaaatatttagcctaacaaattcagcttttagcagtagcttgactaatgaggttctttctgtagctcacaaattatttgtaaacaatcttaaggcaatttttttccatggcacttgattaaatagaagatccatttgatttttgt

SEQ ID NO: 46797 - DNA, 601 bp, Human
aacattgcataataattttcatgtttccacatagtcgacataatgttgttaatagtggcactgtagtccttagtaccataatttatttaataatttattattatttctctctctttttttagagacaggatcttgttctgttgcccaggctggagcgcagtggcatggtcatagctcactgtaaccttgaactcctggtctcaagggattctcccacctcagcctcccaagtagctgagactacaggcatgtgccaccaaacctggctaatttttaaagtttttgtagagacaaggtctcrctatgttgcccaggctggtctcgaacttctggcttcaaatgatcctttcacctcagcctcccaaaatgttgggattacaggcgcgagccactatacctggcctctattatttatttctaatttgtttcttttgtcggaatagataacagtctcgagcatcttcatgatatagatttttttcttaaactcttcccttggcgtacatttataggagtgagattactgggtgaaaagtaaggtgctgttccttggctaatgggatgttcactgcaagttcttggaaagaaggaggatgcagtg

SEQ ID NO: 46798 - DNA, 601 bp, Human
gagtagttgagattacaggtgcccgccaccatgcctggctactttttgtatttttagtagagatggcgtttcaccatgttggccaggctggtctcgaactcctggcctcaagtgatccgcccgcctcggcctcccgaagttctgggattacaagtgtgggtcactgcaactggcccctcatacctttctttaatgtggtgacaggggtagggtaggtggggaattaaagattttttttttttttgatacggagtctcactctgtcgccaggatggagtccagtggcgtgatctcggctcastgcaacctgtgactccctggttcaagcaattctcctgcctcagcctcctgagtagctgggattacagacatgcccagctaatttttgtattttcagtagagatggggtttctccatgttggccaggatagtcttgatctcctgaccttgtgatccacctgcctcagcctcacaaagtgctgggattacaggcgtgagccaccacgcccagccaagatttttttttttcctgagatgggatctcattctgttgctcaggctggtgtgcagtggtgcgatcttggctcactgcaacctctgc

SEQ ID NO: 46799 - DNA, 601 bp, Human
tggttgacaccaaagtagactattgtcttagatgattccagagttgctttcaactagaacatacttctaacctgaatgtgagttgtcaaaaagtatattaattgaacttttctctgaagtagcagtgagcactctattactggaaacactcaaatgattagtagaccattatgtagtaagaatttttaagaaaggtttgctgtattagattttgggatggtatggattgctttcaaatttatagatattacggtttatcatcataaatgccctggacgaatttatgtcattattgtatgtktttttttttttgttttttgtttttttttttgagaaagagtctcactctgtcacccaggctggagtgcagtggcacgatcttggctcactgcaagctccttctcctgggttcacgtcattctcctgcctcagcctcccaagtagttgggactacaggcgcccgccaccacgcctggctaattttttttgtatttttagtagagacggggtttcaccgcgttagccaggatggtctcgatctgctgaccttctgatccgcccgcctcggcctcccaaagtgctgggattacaggcgtgagcc

SEQ ID NO: 46800 - DNA, 601 bp, Human
gacaccaaagtagactattgtcttagatgattccagagttgctttcaactagaacatacttctaacctgaatgtgagttgtcaaaaagtatattaattgaacttttctctgaagtagcagtgagcactctattactggaaacactcaaatgattagtagaccattatgtagtaagaatttttaagaaaggtttgctgtattagattttgggatggtatggattgctttcaaatttatagatattacggtttatcatcataaatgccctggacgaatttatgtcattattgtatgttttttgttttttgttttttgtttttttttttgagaaagagtctcactctgtcacccaggctggagtgcagtggcacgatcttggctcactgcaagctccttctcctgggttcacgtcattctcctgcctcagcctcccaagtagttgggactacaggcgcccgccaccacgcctggctaattttttttgtatttttagtagagacggggtttcaccgcgttagccaggatggtctcgatctgctgaccttctgatccgcccgcctcggcctcccaaagtgctgggattacaggcgtgagccaccgc

SEQ ID NO: 46801 - DNA, 601 bp, Human
gatgattccagagttgctttcaactagaacatacttctaacctgaatgtgagttgtcaaaaagtatattaattgaacttttctctgaagtagcagtgagcactctattactggaaacactcaaatgattagtagaccattatgtagtaagaatttttaagaaaggtttgctgtattagattttgggatggtatggattgctttcaaatttatagatattacggtttatcatcataaatgccctggacgaatttatgtcattattgtatgtttttttttttttgttttttgtttttttttttgagaaagagtctcactctgtcacccaggctggagtgcagtggcacgatcttggctcactgcaagctccttctcctgggttcacgtcattctcctgcctcagcctcccaagtagttgggactacaggcgcccgccaccacgcctggctaattttttttgtatttttagtagagacggggtttcaccgcgttagccaggatggtctcgatctgctgaccttctgatccgcccgcctcggcctcccaaagtgctgggattacaggcgtgagccaccgcacccagcccatcattgtatgttttt

SEQ ID NO: 46802 - DNA, 601 bp, Human
ttcagtttaactcattttataaattatattcttatatttaaagccaattttcatgatggctagaaaaatctctaacgtaattttgcgtacaactttgtttttatgtttctgtgctgtattttggttatatgtgttaatttatcttaactttggagtttaaaataagagccctaaattgttaaatgtgtgctttaccttcaaagtaaaagtaaaagactaaatttcaaggaactgcataatcaggttgttttgactctttctacctaaaatctttgccttctcctacatatatatatatatwttttgagacagtcttactctgtcacccaggctggagtgcagtggcacaatattggctcacctcaacctccacctcccagcttcaaatgattcttctgcctcagcctcccaagcagctgggattacaggcatgtgccaccatatccagctaagtagagatggggtttatttagtagagatggggttccaccatgctggccaggatggtctcgatctcttgaccttgtgatctgcccgcctcagctttccaaagtgctgggattacaggtgtgagccactgcgcctggccaagaaccactat

SEQ ID NO: 46803 - DNA, 601 bp, Human
ctgaaattcctctcttttacttgtggttctccctaacctgcattcccttctgtgggctgctgagcctggacccatatttgttcgttctctattccctggatcagcaggagatttaacaaaatagtaggtttgcatctataatatttggccaacttgcagtgtaagtctctgatacccctgaaatagctgccttacaatttctgtattatcttttcaaaaatcttcggattcctcttttattagtgtcataagttaaggcagacaatttaaaaaggaattctgttttctaaaattcttatawaaatggtgatacatgtggataattttgcttgccatatcaatatttggcattatatagtatagctcaagttttaaataattctttttattaagtgtaggtataatgccctatttttatcatgtgaccatatgccatatcactgtcaaaaagggagtaaattgtagttatatatcataaaaagagaagggtagaaaacttctcaacagtggttctcgaagggggccatttctggttgtcacagcgactgggaagaggttgcaaccatcatttagtatgtgggagatggggatgctcaatgtg

SEQ ID NO: 46804 - DNA, 601 bp, Human
gtgtcataagttaaggcagacaatttaaaaaggaattctgttttctaaaattcttataaaaatggtgatacatgtggataattttgcttgccatatcaatatttggcattatatagtatagctcaagttttaaataattctttttattaagtgtaggtataatgccctatttttatcatgtgaccatatgccatatcactgtcaaaaagggagtaaattgtagttatatatcataaaaagagaagggtagaaaacttctcaacagtggttctcgaagggggccatttctggttgtcacagygactgggaagaggttgcaaccatcatttagtatgtgggagatggggatgctcaatgtgcttcagtgggtgggaagtaggaggcagtcctgaacagtgaattgtttcatccaaaatgccgatagtgtcttgtggagaaacacttcaaaagaggctgttctgagcaatcgtctttgtttcaaattatttcagacacagttgccaagtgctaccaaaaatcatagttaagatacagttatgcctgtaatcccagcactttgagaggctgaggccagcggatcacttgaggtcaggaattccag

SEQ ID NO: 46805 - DNA, 601 bp, Human
ttgaatggtctcctgatccttccttgattgccttggcactgaagtatcatggtggtgggcagtagtagagtcatcatcatctctgaaactctaagattatacatgttcttttccttatgcgtaaccattgttgactacctagataggagggcaaagctatgaattcaaatttgtaagtcttttcctaatccatttaacattggattgaaggacaggggtgagtagatggatggattgaactaatacccataggtactgtaagagactccattcattgatccagggagaatataaaatagcyagatctgttttttgctagaagaataaaagatgccaaaaattttgctaattcccttttagggttgaattgaattcaagtgaaaaaaaaatatacatatatatattttgagatggagtctcactctgtcgcccaggccaggctgaagtgcgatagcacgatcttggctcattgcaacctccacctcctgggttcaagggattctcctgcctcagcctcccaagtaacggattacaggcgtgcaccaccacacctggctaatttttgtatttttagtagagatggggtttcaccatcttggcc

SEQ ID NO: 46806 - DNA, 601 bp, Human
ttccattttctccacctctttcctaacactttttatctgtttttttggttctagccatcctggaagtgtgaaatggtatttcattgtggtattgatttgcatttccatggtagctattgatgtttagcatcttttcatgtgcttattgaacatttatatattttctttggagaaatgtctatcagactctgctcattttaaattttttaaaaagtttttatatttcttgttctttttttttttttgagacggtcgttctgtagctcaggatggagggcagtggccagtggcacaatcacarcttactgaagccttgaactccagagctcaattgattctcccacttcagcctcctgagtagctgggactacaagcgcacgccaccactcctgaccgttttttgtagacagggtttcaccaaattgcccaggctggtctggagctcctgggctcaaatggtccatccaggttggcctcccagagtgctggggttacaggtgtgagccaccatgcctggccctttgctcattttttaatgagtttatttgtgattttattatcaagttataatggttctttttatattctagatacaaatcct

SEQ ID NO: 46807 - DNA, 601 bp, Human
ttgtatttttagtagggacggggtttcgccatgttggtcaggcgggtcttgaactcctgacctcaagcgatccacccgcctcggcctcccaaagtgctgggattataggcatgagccaccatgcctggccaatagagatcactttggcttctttatggagtatggggttataagaagaggctcgagtggaaacaggaacaccaattaggtggctactgctgaagtctagacaagagatattgacagtgatttgtatgaaaggggtagtaatggaaattgacagaaatggactgctttgagrtatattgcagtggtagaacagatggaacttgatgatagtttgattggaagtgggaatgagaaaatgacccttttttttgagacagagtctcgctctgtcgcccaggctggagtgcagtggtgcgatcttggctcactgcaagctccgcctcccaggttcacgccattctcctgcctcagcctcccgagtagctgggactacaggcacccgccaccacgcctggctaattttttgtattttttagtagagagggggtttcaccgtgttagccaggacggtcttgatctcctgacctcgtga

SEQ ID NO: 46808 - DNA, 601 bp, Human
atatgataaaaacctgcctacatctgaaacaactattttaatcattataacaattctgttaaaaaggcattgtgttatacatagtttatttatttaaatagagacaaggtctcatgttgaccaggctgatcttgaactcctggtctcaagagatctgcccgccttgtcctcccaaagtgttgagattacaggcatgagccactgcacccggcctgttttacatagtttaagagttttcacttagcaataatttttaaaatgttatttcttaaagctgatggatatttgaaaggaatccaaragtgatggtaggaatagaactttgcaaatgagcaagtgaattgccatcttaattttctgatgatttgtactaaccaagtatttctatcaccatatctccccacttcttttttgttttgctttgttttgttttttgtttgtttgtttttaaggaaagcccagaagaaaggacagtaaatgtgagctctattcgggtaaataaatttactttcatcgtgttgagggatttcatacagcttaatttcatcaagagaatttatacttttccttttttccaaaccttaagcctgctgcctccaca

SEQ ID NO: 46809 - DNA, 601 bp, Human
tgcctctgggagtccacacaggccaggggttccactagggcccgaggcagagctcgtgggcacaggtgtccggcgaggacatgtggtgtgtggggtccggagtcctgtgaggccgggcaggccaggccatgctcaggcaccacaggccatgaagctctgggggtgtcctgtccctgctttctcagcctgggcttctccatccagcacgagggctgtgagaaccctgcggggaggtgggggcgggttccaggagctgtctggctctcaggcccgggacacccatcctgtctgtcctcaccamatactgaaagagcctgccctgtgccccccggagtcctgtctggggcctggggctgcaccctgttctggaaggagcagctcaagtcctcttagcggcttgtttacctgacaggagaggtcaggctgggcacatgagagctgggagaaggtacaactggggaggttgtgtcaggttggacggggcagggtctggggtcaactgggacccagcctcactctctctgggaccctcactgttctccaccctctgttctactgggtcctgcctggcttctgcccaccctcagcccccaatgggcag

SEQ ID NO: 46810 - DNA, 601 bp, Human; identical to SEQ ID NO: 29285

SEQ ID NO: 46811 - DNA, 601 bp, Human; identical to SEQ ID NO: 29286

SEQ ID NO: 46812 - DNA, 601 bp, Human; identical to SEQ ID NO: 29287

SEQ ID NO: 46813 - DNA, 601 bp, Human; identical to SEQ ID NO: 29288

SEQ ID NO: 46814 - DNA, 601 bp, Human; identical to SEQ ID NO: 29289

SEQ ID NO: 46815 - DNA, 601 bp, Human; identical to SEQ ID NO: 29290

SEQ ID NO: 46816 - DNA, 601 bp, Human; identical to SEQ ID NO: 29291

SEQ ID NO: 46817 - DNA, 601 bp, Human; identical to SEQ ID NO: 29292

SEQ ID NO: 46818 - DNA, 601 bp, Human; identical to SEQ ID NO: 29293

SEQ ID NO: 46819 - DNA, 601 bp, Human; identical to SEQ ID NO: 29294

SEQ ID NO: 46820 - DNA, 601 bp, Human; identical to SEQ ID NO: 29295

SEQ ID NO: 46821 - DNA, 601 bp, Human; identical to SEQ ID NO: 29296

SEQ ID NO: 46822 - DNA, 601 bp, Human; identical to SEQ ID NO: 29297

SEQ ID NO: 46823 - DNA, 601 bp, Human; identical to SEQ ID NO: 29285

SEQ ID NO: 46824 - DNA, 601 bp, Human; identical to SEQ ID NO: 29286

SEQ ID NO: 46825 - DNA, 601 bp, Human; identical to SEQ ID NO: 29287

SEQ ID NO: 46826 - DNA, 601 bp, Human; identical to SEQ ID NO: 29288

SEQ ID NO: 46827 - DNA, 601 bp, Human; identical to SEQ ID NO: 29289

SEQ ID NO: 46828 - DNA, 601 bp, Human; identical to SEQ ID NO: 29290

SEQ ID NO: 46829 - DNA, 601 bp, Human; identical to SEQ ID NO: 29291

SEQ ID NO: 46830 - DNA, 601 bp, Human; identical to SEQ ID NO: 29292

SEQ ID NO: 46831 - DNA, 601 bp, Human; identical to SEQ ID NO: 29293

SEQ ID NO: 46832 - DNA, 601 bp, Human; identical to SEQ ID NO: 29294

SEQ ID NO: 46833 - DNA, 601 bp, Human; identical to SEQ ID NO: 29295

SEQ ID NO: 46834 - DNA, 601 bp, Human; identical to SEQ ID NO: 29296

SEQ ID NO: 46835 - DNA, 601 bp, Human; identical to SEQ ID NO: 29297

SEQ ID NO: 46836 - DNA, 601 bp, Human
gctgtccgcagcccagagcaagcgcaggctccctttctgcgtcccagctcagctgcagccacgctttgatctgtcagttcgcatgtctctcacctatctctcctccactctctgtccacctccgtttctctttctgacagtcactatctctccttcgctttcggcctccacttctcgctgttcctcgcggcacagggccttggataaactacttaaccttaactaagccccagcctcctcatctgaaaaatgggggcaataatagcaccacccttagcgttgctggatgggtgaaattaayatttgtaaggcgctcagcacaggcctggtgcttggaaacactcaggtaataggtgtcacaatcaccatttcctctttgcgtctttccttctcaccacacctcgtcctcgtggtttttccacccctttggccttcctcttcccctcgttcatggtttttgttcccccttctccgttctctgagctgggcaagcctcccctcactcccaaccccacacctagcctttgatccccagcccagggcagtcctgcccagccagggggagagggtttttctaacgccgctgaatccttccctttgg

SEQ ID NO: 46837 - DNA, 601 bp, Human
ccaagacccctctctgctttcagaccaaacaccccgtccttccctccttgaagggagcgctccgtgcctggggcatagccctggcccccatcccagtacctccctccccacgagtgccctgatcaggaagcactggaggtcgggatgctagggttcccaggctcccgccgaggcctcacatctggatttggttatgggaaggcagaggggaggagattctggggggcggtatgaatgggaggggtgaacacacctggcttggctcggatcatcgggggaggggacaggcactggaggaagsggggggattaggaaaaactgcacagcccctggcagtggagagtggaggagggagggtacaggaatcccctcgggggccggcaatgtggggggcattgggcgctgggaagggtggagaggggagccagaacacctggctcccaccccatgggagctgcaggagagaagagaaagagggtgggtgaggcagcctcttcctggggaccaaatgatgtcctccagctaggggtcagatgggaagccagccagcctgaggtgagaggcgcaaggtccccatgggtggcaagagacagccctgctc

SEQ ID NO: 46838 - DNA, 601 bp, Human
tttccaattttgtgttcagcagggtctctgagacagacagagagacagagtcagtgcctggggtgggggagggaggtcaggaagaccagatccctgggaaccgaggcaggtggatcctcttagctctgagctagaggagttggggggccaagaggggagcaagccctgccctctgcacccgcctgatttctggcctcttctgctaagtgccaaccccacccccaacatctggtaggcatggggctcccttgggataccccagatctaggcctccctggaggagggagggagatcaaaatgkacggggagaaggggcggcagctcagaaagggttaaaatgagagctgcgccctggtcctgacccccacgagcagaggctgctggtgtgggaggggaacctcttgtctcagcctccacgtttcctcccctaagtcccagaatcagcctctctaccccacaatttcattccctgtccaagacccctctctgctttcagaccaaacaccccgtccttccctccttgaagggagcgctccgtgcctggggcatagccctggcccccatcccagtacctccctccccacgagtgccctgatcagga

SEQ ID NO: 46839 - DNA, 601 bp, Human
gagaattccttctgattctctctggccccagtcccactgggggccttcctgtacttaactctccagcccagctttacgagctcctcaccctctctttcttattcatttattttgagagaggatctcacactgctctgtcacccaggctggcatgcagcggtgcgatcatagctcactgcagcctccgactcctgggctcaagcaatcctcctgcctcagcctcttgagtagctgggaccacaggcatgcaccacctcgcctggctaatatttttattttttgtagagagaagatcttcctrtgttacccaggctggtcttgaactccagggctcaagtgatccgcctgtctcagcctctgaaagtgctgggattacaggagtgagccactgcgcccagccattgccctctttctgcctcttgcccccaaagccttagcccctcacacttccggggtacccaacttcacagcccctgcctctccccttcaggccctcagtgacatctctcccgccagaccaccagccgccccagcccccaagtctcaccctctcggtcagtggtgacattgacaggctcaaatgggacgggccccgtggcta

SEQ ID NO: 46840 - DNA, 601 bp, Human
aggctcaagctgctgggtgaggaccgcgtcacccggatgtcggacactgcaggaggtactgtgagaggcagagacacagggaacccttgtgcatggtagctctgtcccttaacttaaaaaaaaatttttttttcgagacggagtcctgctctatcacccaggctggagtgcagtggcgcagtctcagcttactgcaacctccgcctcctgggttcaagcaattcttctggttgcttcccaagtggattacaggtgcccaccaccatgcctggctaatttttttatttttagtagacatggrgtttcaccacgttggccaggctagtcttgaactcctgaccttgtgatcagcctggccatgtcccttatcttttccaacacttcctctgctggctacacttgtctcaatttccccctggctgtttcgagaattccttctgattctctctggccccagtcccactgggggccttcctgtacttaactctccagcccagctttacgagctcctcaccctctctttcttattcatttattttgagagaggatctcacactgctctgtcacccaggctggcatgcagcggtgcgatcatagctca

SEQ ID NO: 46841 - DNA, 601 bp, Human
gtgatggctaagggctatagggtctcttttgagggtgctgaaaatgtcccaaaattacttgtggtggtgactgcacaattctgtgaatgtatcaaaagtcatcgattgtacactttgaacaggcaaattgtatggcaggggaactgtatttcagtaaagctattacagaaaattacaaggtttagaaagccactggtccaatgctgggtgtggcggctcatgcctgtaatcccagcactttgggaggccgatgcgggaggattgctcgaggtcaggaatttgagaccagcctgggcaacayagggaaactgtctcaacaaaacataaaaaaaaatttagttgagcacggtagcacatgcctatagccccagctacttgggaggctaaggtggaaggattggttgagctcgggagttgtaggctgcaatgagctatgatggtgccaccgcactccagcctgggtgataaaaaagaccgtgtctcttaaaaaaaagaaaaagttaggccgggcgtggtggctcacgccagcagtcccagcatttcgggaagccgaggcgggtggatcaggaggtcagcagatcgagaccaggaggtggagctt

SEQ ID NO: 46842 - DNA, 601 bp, Human
ctgaggtgggtggattgcctgagctcaggagttcgagaccagcctgggaaacatggtgaaaccctgtctttacaaaaaataccaaaaaaaattagctgggcatggtggctcatgcctacagtcccagctgcttgggaggctgaggtgggaggatcacttgagcctgggaggttgaggctgcagtgagctgtaattgaaccactgcactccagcctgggtgacagagcgagaccctgtttccaaaacaaacaaaaaacaaaccacaaccaaaaaaacccacggatatatactacaacatacrtaaaccttgaaaacattctgctcggtgaacagtcacaaaagaccacactggaagatttcaagacagaaagtgggttagtgcttgccagggactaaggcaacagaaagatctgggtggggggtgatggctaagggctatagggtctcttttgagggtgctgaaaatgtcccaaaattacttgtggtggtgactgcacaattctgtgaatgtatcaaaagtcatcgattgtacactttgaacaggcaaattgtatggcaggggaactgtatttcagtaaagctattacagaaaattacaagg

SEQ ID NO: 46843 - DNA, 601 bp, Human
atttttagtagagatgggctttcaccaggttggacaggctagtctcaaaccagcctaggcatgcccagccgccagagtggttttgatttggttctagtataaataccagagtccacaaaaaaatctccattcaatgaaacgttctaaaggtgaaacattttcaggtttttatccaaaaagtcgatacaattgaaatgttcaccaaaagatacaataaaaaacaaaatcagctatttccatacaactgattattacgtctccataaaaagaaatgaaatattggccaggagcagtggctcaygcctgtaatcccagcactctgagatactgaggtgggaggattgtgtgaggccaggtgttcaagaccagcctgggaaacatagcaagaccccgtctctatcaaaaaataataataattagccaagcatggtggtgagcacgtgtggtcccagatactcaggaggctgaggtaggaggatcgcttgagcccaggagtttgaggctgcaatgcactatgatcagaccattacattccagcctgggtgacaaagcaaaatcgtgtgttcaaaacaaaaacaaaaaacaggccaggtccagtggc

SEQ ID NO: 46844 - DNA, 601 bp, Human
cagctgctcccgccagccctcgctctctgcggaaggaaaggctgctgatcaggagaaactgatggtcctgtaggaggccccagccccggctttgagcaatgaactgtgatctcctgagaacaggtccccagtacaggggacaggtggagggagaggacacaagcaggcaaggtcagggaacaaacagtgggtttcaaactctcccccaggggccagcaggctcctctgaagtacctcagggcaagggaggaagtttcgaaatcttttcttactgccagagtaattttttgtttgttttttkgagacgcagtctcactctgtcgcccaggctggagtgcagtggcgcaatctcagctcactgcaatctccgcctcccgggttctgcgattctcctgcctcagcctcctgagtagctgggattacaggtgtgtaccaccatgctcggctaatttgtgtatttttagtagagatgggctttcaccaggttggacaggctagtctcaaaccagcctaggcatgcccagccgccagagtggttttgatttggttctagtataaataccagagtccacaaaaaaatctccattcaatgaaacgttct

SEQ ID NO: 46845 - DNA, 601 bp, Human
ttcttaacccaagtggcctctgggtgtaagtgggaactccgggtggccgcagaagccagggagggtgctcacccgcaggaaggagtccagggcgccgttctccatgaactctgtgagaatcatgacgggcatgctgttggtgaccacgccctccaggcggatgatattggggtgctcgaactggcccatgatggaggcctcgctcagaaactcacgccgctgccgctccgtgtagccacccttcagggtcttgattgccacacagctctccttcttccctggggccttgagccgcccccgrcacacctcgccaaactcaccttcaaacaaggacgcagaggtcatcagctctcccgctccggtgtggccctgcccacccccgcttcgttcccaggtgcccgggcagccttcggctctcacctgcaccaatcacctcttcaatcttgacgtaggagacatcgatctcttttgcaaattccctcacagcctcattagggtcttcataagtgaaggggtcgatgtagaccttagtacctgagaaatcaggcagggccccgtcagctgggaattaactcccactggactcggaggctcggctcat

SEQ ID NO: 46846 - DNA, 601 bp, Human
gggcaacaagagtgaaactccatctcaaaaaaaaaaaattcaattaaaacaaaattaaaaaaaaaaagaaggaatgacaaccttcagctgtatggggcagtgggaaaggaaggtcccaggagcccagcctttcccagagggaaaattaaaggcagagggctggccaggcgtggtgcctcacacctgtaataccagcactttgggaggctgaggtggggagatcacttgaggtcaggagtttgataccagcctggcctacatggtgaaaccctgtgtctactaaaaatacaaaaattagtcrgcatggtggtgcatgcctatagtaccagctacttgggagactgaggcaggagaatcgcttgaaccctggaggtggagacagcaatgagccgagatcgcgccactgcactccagcctgggcgacagagcgaggctctgtcttaaaaaaaagaaaaggcagaggaccagggcttagcccaagaggaaaaggctggaggaggtgacctgggacccactgtctgtcctggcttcttaacccaagtggcctctgggtgtaagtgggaactccgggtggccgcagaagccagggagggtgctcacc

SEQ ID NO: 46847 - DNA, 601 bp, Human
aggccaggcacagtggctcatgcctgcaatcccagtgctgtgggaggctgaggagggaggctcgcttgaggccaggagttcagaccagcctgggcaacctatcgagatcctgtctctacaaaaaattttaaaaatttgctgagcatggtggtacatgagtgtagttccagctactcaggaggctgaggcgggaggatcacttgagcccaggaggtcaaggctacagtgagctatgaatgcaccactgcactccagcctagaggacagagtgagactctgtcttaaaaaaaaaaaaaaaaaattggccgggcgcggtggctcacgtctgtaatcccagcactttgggaggccgaggcaggcggatcacctgaggtcgggagttcgagaccagcctgaccaacacagagaaacccccgtctctactaaaaatacaaaattagtcaagcgtggtggcacatgcctataatcccagctactggggaggctaaggcaggagaatcgcttgaacctgggaggcggaggttgcggtgagccaagatcttgccattgcactccggcctgggcaacaagagtgaaactccatctcaaaaaaaaaaaattc

SEQ ID NO: 46848 - DNA, 601 bp, Human
gtaatcccagcactttgaggggccgagatgggtggatcacttgagcccaggagttcaagaccagcctgggcaacatgatgaaaccctgtctctactaaaaatacaaacatcagctgggtatggtggtgcatgcctgtaattccaagctactcaggaggctgaggcaggagaatcacttgaacccaggaggtggacgttgcggtgagccaagaacgcaccactgcactccagcctgggtgacagacggaaactccatctcaagaaaaaagaaaagcctaataaagttaaaaaaaaaaaaaaagtcagtaaaatctggtaaagtgaccaaataaattaagcagttctctttcctctctagccacatctgcatgaaggaccccgtttgctttttttcacatttgaaatgatttgtttacttttttaaaaagcctgtctatttacttgctaattttcagtccccctgccccattagaccctctgctccccaagaggagaaatccagtttgccgtgtgtatagctttattcctggggactgggaggatgaccggtgcgtagaaagcactcagtaaatatttgtcaaaagaaggaatgacaggccag

SEQ ID NO: 46849 - DNA, 601 bp, Human
aggccaggcatggtggctcatgcctgtaatcccagcactttgaggggccgagatgggtggatcacttgagcccaggagttcaagaccagcctgggcaacatgatgaaaccctgtctctactaaaaatacaaacatcagctgggtatggtggtgcatgcctgtaattccaagctactcaggaggctgaggcaggagaatcacttgaacccaggaggtggacgttgcggtgagccaagaacgcaccactgcactccagcctgggtgacagacggaaactccatctcaagaaaaaagaaaagcytaataaagttaaaaaaaaaaaaaaagtcagtaaaatctggtaaagtgaccaaataaattaagcagttctctttcctctctagccacatctgcatgaaggaccccgtttgctttttttcacatttgaaatgatttgtttacttttttaaaaagcctgtctatttacttgctaattttcagtccccctgccccattagaccctctgctccccaagaggagaaatccagtttgccgtgtgtatagctttattcctggggactgggaggatgaccggtgcgtagaaagcactcagtaaatattt

SEQ ID NO: 46850 - DNA, 601 bp, Human
aaggacatctttagaacaactagagaaacgtgaaaatcaactgggtattcaatgacgctagggaatcgctataactctgttcaatgcaatgttattttgctacatagaaaaatgttttgatttttttaaaaagatgcctaggccaggcatggtggctcatgcctgtaatcccagcactttgaggggccgagatgggtggatcacttgagcccaggagttcaagaccagcctgggcaacatgatgaaaccctgtctctactaaaaatacaaacatcagctgggtatggtggtgcatgcctgyaattccaagctactcaggaggctgaggcaggagaatcacttgaacccaggaggtggacgttgcggtgagccaagaacgcaccactgcactccagcctgggtgacagacggaaactccatctcaagaaaaaagaaaagcctaataaagttaaaaaaaaaaaaaaagtcagtaaaatctggtaaagtgaccaaataaattaagcagttctctttcctctctagccacatctgcatgaaggaccccgtttgctttttttcacatttgaaatgatttgtttacttttttaaaaagcctgtctat

SEQ ID NO: 46851 - DNA, 601 bp, Human
gtgaaggacatctttagaacaactagagaaacgtgaaaatcaactgggtattcaatgacgctagggaatcgctataactctgttcaatgcaatgttattttgctacatagaaaaatgttttgatttttttaaaaagatgcctaggccaggcatggtggctcatgcctgtaatcccagcactttgaggggccgagatgggtggatcacttgagcccaggagttcaagaccagcctgggcaacatgatgaaaccctgtctctactaaaaatacaaacatcagctgggtatggtggtgcatgcatgtaattccaagctactcaggaggctgaggcaggagaatcacttgaacccaggaggtggacgttgcggtgagccaagaacgcaccactgcactccagcctgggtgacagacggaaactccatctcaagaaaaaagaaaagcctaataaagttaaaaaaaaaaaaaaagtcagtaaaatctggtaaagtgaccaaataaattaagcagttctctttcctctctagccacatctgcatgaaggaccccgtttgctttttttcacatttgaaatgatttgtttacttttttaaaaagcctgtc

SEQ ID NO: 46852 - DNA, 601 bp, Human
cccaaatccaaacccttcccttcaccccacggcctggatgctggcaacaggcttctgctgcaggcctctcccagctcctgctcttgctccctagcacccagcaaagaggtctttttatttatttatttttttgagatggagtctcgctctactgcccaggctggagtaaagtggcgtgatcttggctcactgcaacctctgcctcctgagttcaagcgattctcctgtcttagtctcctgagtagctgggattacaggggtgcaccaccatgcctggctggtttttgtatttttagtacaracagggtttcaccatgttggccaggctggtctcgaactcctgacctcaagtgatccacctgccccggcctccccaagtgctgggatcacaagtgtgagccactgtgcccagctgggatcctcttaaactactctcctgccaaagccctccagcgggttcccgtcacactgcccaatgcagcatctaccatctctcctctgttcaccagtttcacctgtgctggtcttcccatctctctctctttttaagagatgggatcgcccaggctggaatgcagtagtgcaatgatggctcactaca

SEQ ID NO: 46853 - DNA, 601 bp, Human
tttttagtttttttagagacaaggtctctttctttcccccaggttggagtgcagtggcacgatcatggttcaccgcagccttaaactcctgggctcaaatgatccttctgcctcagcctccttagtagctgggactataggtgcacaccactgcacctggctaattaaaacaaaggggtttttttggtagatatggggtctcactgtgtttcccaggcttgtctccaactcctggcctcaagcaatcttcccaccttggcctcccaaggtgctgggattacaggcatgagtcacctgagcracccgtctacaggtggagatacattggtgctgatccaaccacaaagctgttcagctctcttggactagctgtgtatggatttgcaagagaagagtgaggaactgcagtatgaccaatgatcggtgcaaaaaccaaggtctgaagcccaaccttgacctttaaagagtttgctctcaccagggaaaccaacaagtcacagacagtaaacaaatcccgtattctgggttccgctaagatttggcagaccatctgcagccctacagaaccagggacatagactccaaaaactgaattttgaat

SEQ ID NO: 46854 - DNA, 601 bp, Human
cccaaatatgctgtacccaactcttttatttatttattaagacagagtctcgctcagttgcccaggctggaaagcaatggcgtgatctcagctcactgcaacctctgttcctgggttcaagcgattatcctgtctcagcctcctgagtagctgggattacaggcacccgcccatcatgctgggctaattttttgtatttttttagagacggggtttcaccatgttggccaggctggtcttgaactcctaaccttaggtgatctgcccaccttggcctcccaaagtgctgggattacaggcwtgagccactaggcctggccctgtatctcaactctttgatacaaagatcaattctcctttttgtcatctccatggtctcaagaacccagcagtgatgactctctgggaacccacccttcaccccaaatcccaggtgagagaacactcgaggaaagcttggtaggaccacgggacacttacgtcctgattgctcatgtcccagtacggcctctccccaaatgacatcacctcccacatcacaatcccgtaactccaggcatcactggcggaagtgaacttccggaaggcaatggcctccggg

SEQ ID NO: 46855 - DNA, 601 bp, Human
ggggcaggggcagactggcctgagaccctctggctctagcctcctgagtagctgggaccacaggcacgcaccaccatgcccagctaatttttttgtttttgttttgtagagatggggttttgctatgttggccaggctgctctcaaactcctgggctcaagcaatcggtccacctgagcctcccaaagtgctgagattacaggcgtgagccaccacctggccttcacatttctttttttttttttttttttttttgagatggaatttcactctgtcatccaggctggagtgcagtggtgcratctcggctcactgcaacctccacctcccgggttcaagcgattctcctgcctcagcctcctcagtagctggtattacaggcacgcaccaccatgcccagctaatttttgtatttttagtagacataaggtttcaccaagttgtccacaatggtctcgaactcctaacctcaagtgatctgcccacctcggcctcccaaagtgctggcattacaggcatgagccaccatgcccggccttcagatttctattccttctatttctgttattcaacctggggtgagaggagatcttgggagagg

SEQ ID NO: 46856 - DNA, 601 bp, Human
tggagaggaagaggaggttgctgatggctggaggctgagataaggggaaaaaagggagaggaggccccctgggtcagagagaggctgggaagaattagggagggatgtgcccaggccccgtggggcaggggcagactggcctgagaccctctggctctagcctcctgagtagctgggaccacaggcacgcaccaccatgcccagctaatttttttgtttttgttttgtagagatggggttttgctatgttggccaggctgctctcaaactcctgggctcaagcaatcggtccacctgagcytcccaaagtgctgagattacaggcgtgagccaccacctggccttcacatttctttttttttttttttttttttttgagatggaatttcactctgtcatccaggctggagtgcagtggtgcaatctcggctcactgcaacctccacctcccgggttcaagcgattctcctgcctcagcctcctcagtagctggtattacaggcacgcaccaccatgcccagctaatttttgtatttttagtagacataaggtttcaccaagttgtccacaatggtctcgaactcctaacctcaagtgatct

SEQ ID NO: 46857 - DNA, 601 bp, Human
gagaggaagagctgggtggagaggaagaggaggttgctgatggctggaggctgagataaggggaaaaaagggagaggaggccccctgggtcagagagaggctgggaagaattagggagggatgtgcccaggccccgtggggcaggggcagactggcctgagaccctctggctctagcctcctgagtagctgggaccacaggcacgcaccaccatgcccagctaatttttttgtttttgttttgtagagatggggttttgctatgttggccaggctgctctcaaactcctgggctcaagcartcggtccacctgagcctcccaaagtgctgagattacaggcgtgagccaccacctggccttcacatttctttttttttttttttttttttttgagatggaatttcactctgtcatccaggctggagtgcagtggtgcaatctcggctcactgcaacctccacctcccgggttcaagcgattctcctgcctcagcctcctcagtagctggtattacaggcacgcaccaccatgcccagctaatttttgtatttttagtagacataaggtttcaccaagttgtccacaatggtctcgaactcc

SEQ ID NO: 46858 - DNA, 601 bp, Human
agggaaatggagtgtgagaaagaaaaggccgaagtgggagaggaagagctgggtggagaggaagaggaggttgctgatggctggaggctgagataaggggaaaaaagggagaggaggccccctgggtcagagagaggctgggaagaattagggagggatgtgcccaggccccgtggggcaggggcagactggcctgagaccctctggctctagcctcctgagtagctgggaccacaggcacgcaccaccatgcccagctaatttttttgtttttgttttgtagagatggggttttgctatkttggccaggctgctctcaaactcctgggctcaagcaatcggtccacctgagcctcccaaagtgctgagattacaggcgtgagccaccacctggccttcacatttctttttttttttttttttttttttgagatggaatttcactctgtcatccaggctggagtgcagtggtgcaatctcggctcactgcaacctccacctcccgggttcaagcgattctcctgcctcagcctcctcagtagctggtattacaggcacgcaccaccatgcccagctaatttttgtatttttagtagacata

SEQ ID NO: 46859 - DNA, 601 bp, Human
cctgggacttcatgtgctggacactggccaagattttcttctggtgtcccgccagagtgactccgattcggagcaggtccctgcagaaggaaaggagagcttggtgagaccctaggttccctgtggccgctctcctcgcttggctcctgagacggtcctagcctcaggattgtaagccaatcagaaaagccagcgggggagggagaacagatgtcaacagttcccgggcagtttttttaagagctgggcagccatccttctgtgcaaccgcagaagggggtagggctggaggccagaggcrgggcctttggcttgggtgccagggaaggaaagaaaagagagaaaagcccgcaaaatgagactgggggaagaggctgcacagattgccgtagagggaaatggagtgtgagaaagaaaaggccgaagtgggagaggaagagctgggtggagaggaagaggaggttgctgatggctggaggctgagataaggggaaaaaagggagaggaggccccctgggtcagagagaggctgggaagaattagggagggatgtgcccaggccccgtggggcaggggcagactggcctgagaccctctggct

SEQ ID NO: 46860 - DNA, 601 bp, Human
cacaaagcgtagggtgagaaccttgggagcgactgggcccgtctttgctccctcggtggggttttgtctcctggcttcccccaagtgcgaggcagttggtctcgcccagccgggtcctgggcgcggcggcggcagccgcgtcactggcgggcgggatccctccgctctggggaggcagcgctggcggcggggctggggccactgaggaaatccatccgcgccgccgccgccgccgccgccgccgccgccgccgcctccgccgcggaggaagacagcgccgcccgcgcaccgccagcgaccyccgccgcagagtcccaccgccacaggtaccttcgctggcaaaaggagtcctctcgccccccagccccaatttcccccaggggaacctctcttccttcggtctcccggggctggcctcctgggagcggacgtaactccccagacctccgctcccttcccctcttgcccggtcgctcccaaacccggaaggggaactggggaaccctcgccccccaccgtgcgtgcgcttccccgcaccatcagcgaagtttttgcccgaccccagaccccagcccagccccgactgcctcttgctccctcg

SEQ ID NO: 46861 - DNA, 601 bp, Human
ggcgaatccactgaaaaattactcccgtcccaaaagagggctatgggtggacctagcttctggatctgcacccacaaatgcatttgcttacttgtttttctttttttcttttcttttttttttttttttgagatggagtctcgctctgttgcccaggctgaagtgcagtggcgtgatctcggctcaatgcatgctccacctcctgggttcaagccattctcctgcctcagcctcccgaatagctgggactagaggcgcccgccaccatgcccggctaatattttgtgtttttagtacagayggggtttcaccgtgttagccaagatggtctcgatatcctgacctagtgatctgcccgcctccgcctcccaaagtgctgggattacaggcctgagccaccgcaccctgccgttattttgtttttgaaacagggtctcgctctgtctcccaggctggagtgcagtggcataatctcggctcactgcaacctccgcctccccggctcaggcaatcctcccccgtcaagctcccaagtaactgggactacaggcactcgccatcatccccagctaatttttgtgttttctttggtagagacggg

SEQ ID NO: 46862 - DNA, 601 bp, Human
tgaacctgggaggtggaggttgccatgagccgagatcgcaccactgcactccagcctgggcaacagtgaaactctgtctcaaaaaaagtaaaaaaaaaaaaatagccgggcatagtggcacacatctgtagtcctagctacttgaaaggctaaggtgggaggatcacttgggtccaggagttggaggctgcagtgagctatcatctcggcactgtctgggtgacagtgaggccctatctcaaaaaaataaagccctgaacattgttgattccacagactcaaggtctttcagcaggtgaayccagcaacatatcaaaagagtaatcatacaccttgatcaaggttagcgttgagctcaggaagataaggaaatctattaacacaaattactatataaacattaaagaagaggctgggtgctgtggctcatgcctgtaatcccagcactttgggaagccgaagcgctttggcagatcgcttgagcttacgagttggagaccaacctgggcaacatggcaaaaccctgtctctactaaaaaatacaaaaattaatcaagcgtgatggcacacacctgtaatcccagctactcaggaggctgag

SEQ ID NO: 46863 - DNA, 601 bp, Human
ttaaaaattaggctgggcatggtggctcatgcctgtaatccctgcactttgggaggccgtggtgggtggatcatctgaggtcaggagtttgagaccagtctgcccaacatggtgaaaccccatctctactaaaaatacaaaaaattggttgggtgtggtggcaggcacctgtgatcccagctactcgggaggctaaggcaggagaattgcttgaacctgggaggtggaggttgccatgagccgagatcgcaccactgcactccagcctgggcaacagtgaaactctgtctcaaaaaaagtaaaaaaaaaaaaatagccgggcatagtggcacacatctgtagtcctagctacttgaaaggctaaggtgggaggatcacttgggtccaggagttggaggctgcagtgagctatcatctcggcactgtctgggtgacagtgaggccctatctcaaaaaaataaagccctgaacattgttgattccacagactcaaggtctttcagcaggtgaacccagcaacatatcaaaagagtaatcatacaccttgatcaaggttagcgttgagctcaggaagataaggaaatctattaacacaaattac

SEQ ID NO: 46864 - DNA, 601 bp, Human
aggtgtgagccaccatgcctgacctgtaatttaatttaaaagccctgagcaggctgggtgcggtacctaattcctataatcccagcattttgggaggctgaggtgggaggattgtttgaggccagtagtttgagaccatcctgggcaacatagggagacctcgtttctactaaaaaaaattaaaaattaggctgggcatggtggctcatgcctgtaatccctgcactttgggaggccgtggtgggtggatcatctgaggtcaggagtttgagaccagtctgcccaacatggtgaaaccccrtctctactaaaaatacaaaaaattggttgggtgtggtggcaggcacctgtgatcccagctactcgggaggctaaggcaggagaattgcttgaacctgggaggtggaggttgccatgagccgagatcgcaccactgcactccagcctgggcaacagtgaaactctgtctcaaaaaaagtaaaaaaaaaaaaatagccgggcatagtggcacacatctgtagtcctagctacttgaaaggctaaggtgggaggatcacttgggtccaggagttggaggctgcagtgagctatcatctcggca

SEQ ID NO: 46865 - DNA, 601 bp, Human
aggctggagtgcagtggcgcgatctcggttcactgcaagctccgcctcccgggttcatgccattctcctgcctcagcctcccaagtagctgggactataggtgcccgccaccacgcccagctaattttttgtgtttttagtagaaacggggtttcaccatgttagccaggatagtctcgatctcctgacctcatgatctgcccacctcggcctcccaaagtgctgggattacaggtgtgagccaccatgcctgacctgtaatttaatttaaaagccctgagcaggctgggtgcggtacctmattcctataatcccagcattttgggaggctgaggtgggaggattgtttgaggccagtagtttgagaccatcctgggcaacatagggagacctcgtttctactaaaaaaaattaaaaattaggctgggcatggtggctcatgcctgtaatccctgcactttgggaggccgtggtgggtggatcatctgaggtcaggagtttgagaccagtctgcccaacatggtgaaaccccatctctactaaaaatacaaaaaattggttgggtgtggtggcaggcacctgtgatcccagctactcggga

SEQ ID NO: 46866 - DNA, 601 bp, Human
cacaggtgtgagccaccacactgagcctcacatcctttgcttttctttcaaagcaatgattccagtcataattatgtagtcgtgaatgattgttagtttagtattggttttctccagtggattgtaagcaccatgagaacaaagttagactgttttagtctctatctcaccaccacctgcttagcttagtacctgccacgtagtagatgccccaaaatacttgttggataaatgaattaattacttcatcattgtcacctccagtccaggcactccacttccctggtcacaccctgcatctttttttttttttttttttttgagatggagtcttgctctgtttcacaggctggagtgcattggtgcgatctcagctcactgcaacctctgcctcccagtttcaagtgattctcctgcctcagcctcccgagtagctgggattacaggcatgcaccatcacacccagttaatttttgtatttttagtagagacaggatttcaccatgttggccaggctggtctcaaactcctgacctcagatgatccacctgccttgacctcccaaagtgctgggattacaggcgtgagccactgtgcctgg

SEQ ID NO: 46867 - DNA, 601 bp, Human
atgctgggggctgggagactggaggcagggggttaatgggctggattgccagagaggacctagaccccagggaatgcagagagaaggggctggaccccctggcctgggcagtgcctcccactcccagagaccaagagcggggtgggcctcttgaaccttgaggtccccagagaactcgttgaggttcccgatgtgcctgaggacgacgtccccgtagcggccgaagtcgaggggcagcaggcgatcgtggctgagccggatgaggagctgccctgcgagctgggccacggcctgggccacrgcgggcaggcggccttgcagcaccttatgcaggttctcataagtgtcctcctttgtgtgcaggaatgggtaggcctggtcgtcctgccaggacagggtggacgctggggcggaggcagacaggctgaaggactagcgctgtgtctggggcagggggaggacgtctcacctccataaaggagaactcgacggcagggactcccacaaaggccgtgaaggaataggcactgctgtccatgggtaggggccggatcctgggggcaggtgggttggagcgatctgtgggttcaggctcccccac

SEQ ID NO: 46868 - DNA, 601 bp, Human
cgtgcctgtactcccagctactagggaggctgaggtgggaggatcacttgagcccaggagttggaggttgcagtgagcagagatggtgccactgcactctagtctgggcaagggagaacgagcaagagcaataggtttgtaaatggccaagggggacaggcagagggcacaagcaggaaaatgcaaggaggagagataacatgagcctccaaggggtagccatgctggctctgaaaaccgtgagtgtgtgtgcacaagtggctctgtgtacactgcagttcccagctcaccccacactcaytgaggatgatcctgtttactattttgccctgcagacctttccccatggccacagtccctactcacccatttcttgacatcaaagggttgaggggttgagttcttggagtaagaaaatggaaggaagtggaggagttggaactggaggtggggtgtgggctgcaaaggattcaaagctaagcagaagggattggtgagggaataagctcttgtttaactttcacgtgacacctcctccaggcagcctttctggatttcacccatttcattatcagaaggaaaacagctctcttactctgaa

SEQ ID NO: 46869 - DNA, 601 bp, Human
agtcccagctactcaggaggctgaggtgaggtgagaggattgcttgagcccgggaggtggaggttgccgtgagcccagatcatgctactgcactccagcctgggcaacagagtgagaccgtctcagaaaaaaaaaaaacaaaaaaacaagcggcagtttgaatttggccaatgggcagtagttcaccaacccctggtctagagccataaaattcactgggtctggcccaatcctgtattgcaggctctgaagtcctgagtccttccctctccatccctgagcctgagtcatgcatcttttyctttttctttttctttttttttttttttttgagatggattttcgctcttgttgcccaggctggagtgcaatggcgtgctctcggctcactgcaacctccatctcccaggctcaagtgattctcctgcctcagcctcctgagtagctgggattacaggcgtgtgccaccatgcccagctaattttgtatttttagtagagacggggtttctccatgttggtcaggctggtctcgaactcctgaccccaggtgatccgcccacctcagcctcccaaagtgctgagattacaggcgtaagcca

SEQ ID NO: 46870 - DNA, 601 bp, Human
ctctccatggggcccctgttctggctctgctggtccacaccccgcttccaagtaaaaccagactgatttcactgccacacccgaattctggtctctccaccctgaaatgtcctctttactttgcatcaatccacatcctgcctgttcttcaagatccaagtcacagtctaaagccaaggtcagcaaactttttctgtgaaatgccagatagtaaatattttagattttgcaggccatgctgcttttattgcagctacttaacgttgctgctattacacaaaagtagccatagagagcgtgaaaaccaataagcatggctgtttcaataaaactttatttacaaaaacagggagcagaggctcacgcctgtaatcccagcaccttgggaagctgaggtgggagagtcgcttgagcccaggattttgagacaagcctggacaatatagtgagatcccatctctacaaaaaattttaaaaattagcggagtgtggtagtgtgtccttgtagtcccagctactcaggaggctgaggtgaggtgagaggattgcttgagcccgggaggtggaggttgccgtgagcccagatcatgctactgcactc

SEQ ID NO: 46871 - DNA, 601 bp, Human
tactcgggaggcagaagtgggagaatcacttgaacccgacaggcagaggttacagtgagccgggatcgcgccactgcactccagtctgggtgacattaagacactgtctccaaaaaataaagaaagaaaaataaataaaaataaaaactcccctttgctcacatcacctctctgctcaaaaacctctctaatttccttgatgctaagacccttaacatccaaacttctaatcctggtgttcgaggctccccacagttgatcgataacaccacatttggtggttccctcccctctgcctctycatggggcccctgttctggctctgctggtccacaccccgcttccaagtaaaaccagactgatttcactgccacacccgaattctggtctctccaccctgaaatgtcctctttactttgcatcaatccacatcctgcctgttcttcaagatccaagtcacagtctaaagccaaggtcagcaaactttttctgtgaaatgccagatagtaaatattttagattttgcaggccatgctgcttttattgcagctacttaacgttgctgctattacacaaaagtagccatagagagcgtgaaaac

SEQ ID NO: 46872 - DNA, 601 bp, Human
gttcaataccagtctgggcaacacagtgagacctcatttcaaaaacaaaaactcccagccgggcgcagtagctcacgcctgtaatcctagcactttgggaggctgaggtgagcagatcacttgatgtcaggagttcaagaccagcctggccaacatgatgaaaccccttctctaccaaaaaaaaaaaaaaaaaaaaaaattaggcatggttgtgcgcgcctgtagtcccagctactcgggaggcagaagtgggagaatcacttgaacccgacaggcagaggttacagtgagccgggatcgygccactgcactccagtctgggtgacattaagacactgtctccaaaaaataaagaaagaaaaataaataaaaataaaaactcccctttgctcacatcacctctctgctcaaaaacctctctaatttccttgatgctaagacccttaacatccaaacttctaatcctggtgttcgaggctccccacagttgatcgataacaccacatttggtggttccctcccctctgcctctccatggggcccctgttctggctctgctggtccacaccccgcttccaagtaaaaccagactgatttcact

SEQ ID NO: 46873 - DNA, 601 bp, Human
caactgctattttattattcttctattctaagacaactattattattattctcctcctcttccctcaacatcaaatctgtcaatttctccttctaaacacctgacatcggtccagtccccacctatgagcatttgctcccacctgccactctcaagacatttgcaatctgaccaaaatcactcctaaaaactctactttgttgtccagcatggtggctcctgcctgtaatcccagcactttgggaggccaaggtaggaggattacttgagctcaggagtttgagaccagcttgggcaatgkatggaaaccctcatctctacaaaaataaaaataaaaaattagtcgggtgtggtggtgtgcacctatagtcccagctactcaggaggccaaggtgggaggatcacttgagcccaggagttcaataccagtctgggcaacacagtgagacctcatttcaaaaacaaaaactcccagccgggcgcagtagctcacgcctgtaatcctagcactttgggaggctgaggtgagcagatcacttgatgtcaggagttcaagaccagcctggccaacatgatgaaaccccttctctaccaaaaaaaa

SEQ ID NO: 46874 - DNA, 601 bp, Human
ggcggacgttgcagtgagccaagatcgtgccactgccctccagcctgggtgacagagcaagactctgtctcagaaaacaaaaccaaacaaacaaacaaacaggccgggcacagtggctgatgcctgtaatcccagcactttgggaggccaaggtgggtagatcacgaggtcaagagatcaagaccatcctggccaacatggcgaaaccccgtctctactaaaaatacaaaaattagctgggtgtggtggcacatgcctgttgtcccagctactcagaaggctgaggcaggagaatagcttkaacccgggaggcggaggttgcagcgagccgagatcgtgccactgcactccagtctggtgacagagcgagactccgtctcaaaaaacaaacaaaaacaaatggcaactgctattttattattcttctattctaagacaactattattattattctcctcctcttccctcaacatcaaatctgtcaatttctccttctaaacacctgacatcggtccagtccccacctatgagcatttgctcccacctgccactctcaagacatttgcaatctgaccaaaatcactcctaaaaactctactt

SEQ ID NO: 46875 - DNA, 601 bp, Human
tgcagctgggcacagtggctcatgcctgtaatcccagcactttcagaggctgaggcgggtggatcatctgaggtcaggagtttgagaccagcctggccaacatggcaaaaccctgtctctactacaaatacaaaaaatttagccaggtatgctgatgtgtccctgtaatcccatctagtcaggaggctgaggcacaagaatagcctgaacccaagaggcggacgttgcagtgagccaagatcgtgccactgccctccagcctgggtgacagagcaagactctgtctcagaaaacaaaaccaaacaaacaaacaaacaggccgggcacagtggctgatgcctgtaatcccagcactttgggaggccaaggtgggtagatcacgaggtcaagagatcaagaccatcctggccaacatggcgaaaccccgtctctactaaaaatacaaaaattagctgggtgtggtggcacatgcctgttgtcccagctactcagaaggctgaggcaggagaatagcttgaacccgggaggcggaggttgcagcgagccgagatcgtgccactgcactccagtctggtgacagagcgagactccgtctcaaaaa

SEQ ID NO: 46876 - DNA, 601 bp, Human
ctctagggggtgatctcagatgctcacatcttttatttttagagacagggtctcactgtcacccaggctggagtgcagtggtgcaatcacagctcactgcaacccaaaccccagaggtcaagtgatcttcccgccttagcctcctgagtagttgggagtgcaggcacgtgccaccatacccagctgattttcagatgctcacatctttttaaggcctccatcattcactcacagagctcatctgtgcccctgatgtcaaccaggacctctgtggggacagatgccaaatctccccacccartgacccactggaatcctgccctccagccatctggacctccccactgggtttgggagcacctggacatatcagtaccgatctcttcccaaacctgggcgttgggcccacactcatgtggcccatggctttctgcaggtgtcaagctgtcaccctcaaaggggagtgagcatggggtgagcacaggctttgaaggtagactacctggcctccaatttcggctcttccacttactaactatatgatttcaggtaagtttcttagcctctcctagccccagtttctggatataatactagcaac

SEQ ID NO: 46877 - DNA, 601 bp, Human
ttcccccaccttcgtcctctggtctcttaagtctccccacccacccagatccttgaccccccatagaacccaagagagagccaagctcctgaacttgcctggtagctggattccaggaaggaattcgagagggattgtagggggaggagggggcagtgagtggagacttgggagtcagaatctgaagtagtttggaacaggggcagggctaaggtgtggagctcgcggagcctggcctccaggttcaatcagagggccatcgccactgcagctccctccatctctccaccccctccccccyaccgcctcgtggctgtgtccacatctggaagtagttaggcggctcctgtccctggactgccaggcagagtgaggcgggagtctggaaggggggccgaggaggattccgggaattcctgttggggtgggggtggggactcttggggttggagggatggtcgagttgccaggcccacttttcccttatctttgtgggagtctgggacaccccagccctgtcctggctggtggaagctgccccaggtctctcaaggcctttccatttcatcccccagcttccctccttggagtttcatcctca

SEQ ID NO: 46878 - DNA, 601 bp, Human
gtaaagatgaattaaattcaattaaaaatttcagtgactcacaaagattttcaagtttgtcagcaatcccatccttcctttagaaaagtaataaatatgtctgctcaaaagtttagagaggaatatgcctaacactgctttggtacttcagcatgacatatggaaaggaagtagtttttttaaggcaggttaattgaaaattctgagttgatagacaagctggtgatggtgagagacaattaaatgtaggataaactcagtcaagtgtttctcagtcacttgtatatgaaattttataatrtattttagttcaaattttatcttgatctttggtgaattttgagtctgcccagatttaatagctttctagtttgataatatggcatatgacagagaatgaagaacacaaaatgtaacaaaaattttaagcagaaacatctgattcatttatgttagtcagtgagcatttatgtctttcttacatagaatgagcatctaacaaatatttccattaatgaaaagttggaatgaaaatttaaatttgcatattttcttggagcttagtccttgacctatttatacacactctgtagttatttca

SEQ ID NO: 46879 - DNA, 601 bp, Human
tgcttgctagtatgtgcttggtctggctctgagtgccacaatgaaggggtgaggctaggtcaggtggtggcagtagtaattctacctcaatgagaaactgcggggctttggaactgcatgggacattcaaggcctaaaagagaaagaaaaaaattgtatctataatctttgggagccatacttccttatacttggatcttgactagtcaagtcaccccatcacaagcacctcaggaatcctccaccccacatcttcacctggcagttccctacctcaactagcagctccagactctccagctctgctgttgtgtcccccagttgctgatagagcctagaggcctccagaagtggaggaccccaggctgatccctctttcagggctgcaaccaagtacaacagtgctctctgtggatttccctaaagggataggaggacacgggcctcagctacccttacaaagcaaaaagctatacataatgcttgtggtttccccaatccaccctaggactgtctttaccatcttacggtgacaggaccccagtgctgtgtacacctggaccaacacaggccgtggacacaggcctgaggccgcttcatg

SEQ ID NO: 46880 - DNA, 601 bp, Human
ggcagatcattcacaaccattcccatcccagtgtccatcatctgccccctactcctgtgcaacccacaacagcagagtcatggtctttgtgtctgaggatatcggggaaaccagggaactcttgggagccctgcatacacactgtgtatatttgaacacctggatatatccctaggtatatatagcacaaccccaatcacccctcctgtctgagaacaccactcttacacttacgcccaagtatttcccatgggcctctctgtccttgcacatctatgcatagccgacgtcatgcaagtayacatacctgggcacatctgcacactgaggaggaagtcctgtaaggctttggtatcctggccgctggctacccattccagtccacgactaattagggcggctgcccgaagctgctgcagtgccgcatctgacttacatccctgctcacagttgaaagctgcccctggggaccactcccaaagtcaagaagtgtcttcccagcctcacagtcaccaaaaccccaaatcctcctctatttcttcttgtgtccacagtccctttctcttaagtctcctggtgggctgggacacattaaagggaa

SEQ ID NO: 46881 - DNA, 601 bp, Human
tcagttttggagaggaagagccaggctttagcctcccatctcaggggtcggggatttttgactctacctctccccacagatgagcagcagctgctcagggctgagcagggtcctggtggccgtggctacagccctggtgtctgcctcctccccctgcccccaggcctggggccccccaggtgagaagaaccctgctctacaacctcccaactctgacttgtgacttgccaccctcactgtggccccttcccatgcctaacttgtgacaccacccctgctcctgtcatccaacctgggtccyctctctaccctgttctctgacctctgtctccagattataacatgatgctttgatccagtgagccccccaccacccaggttttaacagtctgcttcttatctgtcattctcacaaagtggggaggggggtaaaggaagagccttacctcagaagtgccctccacaggggtccagtatgggcagccaggcaggtccgtgaagctgtgttgtcctggagtgactgccgggtaagtgccccacctgcctgttggtctgacactcatgaccctttcttgactctgcctagtcctcatgtcccgcc

SEQ ID NO: 46882 - DNA, 601 bp, Human
cctctctctaccctgttctctgacctctgtctccagattataacatgatgctttgatccagtgagccccccaccacccaggttttaacagtctgcttcttatctgtcattctcacaaagtggggaggggggtaaaggaagagccttacctcagaagtgccctccacaggggtccagtatgggcagccaggcaggtccgtgaagctgtgttgtcctggagtgactgccgggtaagtgccccacctgcctgttggtctgacactcatgaccctttcttgactctgcctagtcctcatgtccckcccctcccatccttgcccgctctgtccgtaatcctcacctctctatctgtcctaaccgtctaactatccttattcaacagaaaattcaactggtatgttttgagcatctgccaagtgccaggtctattctaggctctgggatacagcagtgctaatgccaggcaaggtgcctgccttcaaagagcttacatcttagtggggaagacaataagcaaaggagaatcttgccagatagtaatacctgcagggcagaaaaaccaaagtgagggatgtcgaagaggacaactgagtggttacttt

SEQ ID NO: 46883 - DNA, 601 bp, Human
tgcccgctctgtccgtaatcctcacctctctatctgtcctaaccgtctaactatccttattcaacagaaaattcaactggtatgttttgagcatctgccaagtgccaggtctattctaggctctgggatacagcagtgctaatgccaggcaaggtgcctgccttcaaagagcttacatcttagtggggaagacaataagcaaaggagaatcttgccagatagtaatacctgcagggcagaaaaaccaaagtgagggatgtcgaagaggacaactgagtggttactttttttttttttttttccgagagtctcactctgttgcccaggctggagtgcagtggtgcaatctgggctcactgcaacctctgcctcctgggttcaagcaattctcctgcctcagcctcccaagtagctgggattacaggtatgcgccaccaggcccggctaatttttttttgtatttttagtagagacggggttttaccatgttggtcaggctttgaactcctgacttcaagtaatccacccacctcagcctcccaaagtgctagattacaggcgtgagccaccgtgcctggcccgtggttaccttttaattggt

SEQ ID NO: 46884 - DNA, 601 bp, Human
ggtcactgaagacccaacacttccctgtgggccaggctttgtactgggtgctgggttgcagtggtgactgagagactgaatgtctgtcctgtggggctataactatgaggtaaagcacatctgtgggaagatagcaatggcttttaaaaaaataactttttttttttgagagggagtctcgctctgtcacctaggctggagtgcagtggtgcaatctcggctaactgcaacctccacctcctgggttcaagcaattcttctgtctcagcctcccgagtagctgggactacaggtgcccgcygccatgcctggctaatttttgtatttttagtagagatggggtttcaccatattgcccaggctggtctcgaactcatgacctcacgatctgcccacctcggcctcccaaagtgctgggattacaggtgtgagccacggcgcccggcctaaaaataactcttaggaaaaggagtgcctttcacctagaggcacattctcctacaaacactcatatacccagctgaggatagcagtgaatttgtgtctcaggagatgttaaagattggctggtatcaggactagggagcagcagcatcagata

SEQ ID NO: 46885 - DNA, 601 bp, Human
atggtctcgatcaccttacttcatgatccgcctgccttggccttgcaaagtgctgagattacaggcatgagcgcctggccagtgttaatgtattttatgcatggcccgagataattcttcttccactgtggcccagggtagccaaaaggttggacaccctggtctataccattcttttgaatggctgcagagtattctgttatataagcatacataatttaaacagttttatattgatgatattcaggatatttttcttttcactattacaaacagtgctacaatgaacatctttgtaggtttttttttttttttttttgagatggagtctcacactgttgctcaggctggagtgcagtggcgccctctctgctcactgcaacctctgcctcctgggttcaagcaattatcctgcctcagcctcttgagtagctgggattacaggtgcctgccaccatgcctggctaatttttttttttttttttttttggatttttagtagagaagggggtttcactatgttggccaggctggtgttgaactcctgaccttgtgatctgccctcctcggccccccagagtgctgggattacaggcgtgag

SEQ ID NO: 46886 - DNA, 601 bp, Human
ctggctcctttttttttgagatggagtctcattcttttaccccggctggaatgcagtggctcaatcttggcccactgtaacctccatctcccaggttcaagagattctcctgcctcagcctcccaagtaggtgggactacaggtgcccgccaccacgcccagctaatttttgtattttcagtagagacagggtttcaccatgttggccaggctggtctcaaactcctgacctcaggtgacccacccgccttggcctcccaaagtgctgggattacaggtgtgagccaccatgcctggtctsaagtatagttttttaaagaaagaagtctcactctgttgcccagactggagtgcagtgatgtgatcatagctcactgtagcctcaaactcctgggctcaagagatcctcccgtctccgtctcctaagtagttgggactacaagcatgtgccaccacacctggctaatttttgaaaatttttttgtagagatgggtctccctatgttgcccaggctggtgtcgaactcctggcttcaagcagtccttctctctgggactcccaaagttctgaggtgacatgcatgagccactgttccctacc

SEQ ID NO: 46887 - DNA, 601 bp, Human
ataagtaggtaagggttaatcatttaattcttgtaataaccttgttatcctcattttacaaatgagggcactggcctactgaagtttgtccttttccatactgaaaagctgaatttactttttttgctttactcttaactatacaatacaataccaaattaattatacagggtagtgctttggaacatgaataaaatctatttttaataaaagtatttagggaaagatggctgttatgcattgttggctgtgaatcagagtctcactatagctgtggtttctgtttgcttaggatatattygtggacagcattatagcaggtgtttcatagactggagagttcattatggctctagtttaatattttcataaaaaataaaaggagtttaataaaatccctttttttcttgggagggagtgtggtataatggaaaatttgggattctagagaactcttgaatctcgctaggtagtgactaaaactgtatctataagtaagtttcttaacttcactaagaatcatcttctggccaggtgcagtggctcgcgcctgtaatcccagcactttggaaggctgaggcatgtgcatagcttgagcaca

SEQ ID NO: 46888 - DNA, 601 bp, Human
cataaaaaataaaaggagtttaataaaatccctttttttcttgggagggagtgtggtataatggaaaatttgggattctagagaactcttgaatctcgctaggtagtgactaaaactgtatctataagtaagtttcttaacttcactaagaatcatcttctggccaggtgcagtggctcgcgcctgtaatcccagcactttggaaggctgaggcatgtgcatagcttgagcacaggattttgagaccagcctgggcaacgtgacaaaaccctatctctacaaaaaatataaaaattagctgggtgtggtggtgcatgcctgcagtcccagctttttggaaggctgaggtgggaggatcacttgagcctgggagattgaggctgcagtgagccatgatcacaccactgtgccctagcccagcctgggtgacagagtaagactctgtttcaaaaaagacaaaaaaatagagagagatgatactttagtggttttagttttaggtaaagttaaagcattaagttcagttaattgggtaacatcctaatttttctttacagttcactttagactgtaagagtcagttgcctaatgtaggaattag

SEQ ID NO: 46889 - DNA, 601 bp, Human
attctaggctgggcatgctggctcatgcctgtaatcccagcactttgggaggccgaggtgggcggatcacttgaggccaggagttcgagaccagtctggcctaacatgatgaaaccccatctctattaaaatacaaaaaaaaaaaaaatggtggcacatgtctgtattcccagatacttgggaggctgaggagggaggatttcttgagctctagatgtagagactgcagtgagccgagatcatgccactgcagtccagcctgggcgacagagcgagactctacctcaaaaaaagaaaaaaraaaaaaaaaaaacaacacagtaaaataaaactctaagccctccagctggctgaatggacctccccccttggccaagggaaacccaaagaaacctgaaaaactacttcagggcataaggagaaggggcatctgatatgcctcatcatacagtgttccctttggagtttagacacaactgaccagcattaacattaaaacagagatgttaagactgacaaaacatgactcttcatagcaccctactaggtgtagaccctactagatctgacatctcttaaggtctgataagagacattcacc

SEQ ID NO: 46890 - DNA, 601 bp, Human
ttctaggctgggcatgctggctcatgcctgtaatcccagcactttgggaggccgaggtgggcggatcacttgaggccaggagttcgagaccagtctggcctaacatgatgaaaccccatctctattaaaatacaaaaaaaaaaaaaatggtggcacatgtctgtattcccagatacttgggaggctgaggagggaggatttcttgagctctagatgtagagactgcagtgagccgagatcatgccactgcagtccagcctgggcgacagagcgagactctacctcaaaaaaagaaaaaagraaaaaaaaaaacaacacagtaaaataaaactctaagccctccagctggctgaatggacctccccccttggccaagggaaacccaaagaaacctgaaaaactacttcagggcataaggagaaggggcatctgatatgcctcatcatacagtgttccctttggagtttagacacaactgaccagcattaacattaaaacagagatgttaagactgacaaaacatgactcttcatagcaccctactaggtgtagaccctactagatctgacatctcttaaggtctgataagagacattcacca

SEQ ID NO: 46891 - DNA, 601 bp, Human
aatactacagcaatggaaattctctgtccgatattccggttagaaggtgctaccatctataggtcttactgcaaatagtaaagtgagtatagcaattcctgcaagtgtggtacagtagataatttccatgtaaaattttacttgccaagatatagaatctccctttggggatctatgaagtttcttggttttattttcccaaacagaaacatctgggttatgggcaccctattcactttcattacctggcagatgttgcaggataattgcccagaactagcatattgatccagctttttayattgcccattcctttttgtttcttccaggcttcaggagatcaccacttgattcacaggaataagcgggattagtctaaaatgtagtcaaaaaaacttaaaaacaatcattgagactagaatttagtgacaaatggatgataagctttggagcataatttttctctctccagtctttattttaggtaaaaacaaattatgataggattgtgttgtttgtataataaactttagtcttatacttggcctgattatttgcataaggtgcagaaagaatgatttctacataggccttttgaatt

SEQ ID NO: 46892 - DNA, 601 bp, Human
ctaagctgtatgatttagaccacctatttgcattttgacgacacttgcattttaccaattcttcagactatttttatttcttaaagattacagtcatgtgaactaaaaaatatttaagtgcttatttttctttaacccaattagagctctttttatagacattacacacaacacacatatagcaacacaaatagaagattcagcacttgtaacatttttcatttgccagtttctttttttctgttttttgagacagagtttcactcttgttgtccaggctggagtgcaaaggcgtgatccyggctcaccgcaacctccgcctcccaggttcaagcgattctcctgcctcagcctcctgagtagctgggattacaagcatgcaccaccacacccggataattttttatatttttagtagagatggggtttttccatgttggtcaggatggtcttgagctcccaacctcaggtgatccgcccacctcggcctcccaaagtgctgagattacagacgtgagccaccatgcccgacctgccagtttcttaattggattactcgtttcaggatggagcccttggaggaacagggccaggatagcat

SEQ ID NO: 46893 - DNA, 601 bp, Human
ggtgtctggtttacagtgtatagtctaaaacaaaggtggtaacagccccttcctaagatatacttccctcttgcctggggaccagaccaagaaactagccacaaaatgagaaaccatggcttaggagtcacgcagctggaggctacaagattttatcctcccttaactgcccaagatcagtatttaagatattttgtaaactctgcccttgatggatcagctggctctgcctagattgataaactggcttatctgatttttggcccttccccgggaactaacttagcacaagacacccacygttgtaaaatggcagagactaaaacaaagtattgccacgtggttacacgtcatgtttccaagtacatgaaacaagatggaggcctgtagccaagtttgttactgaccattttgttggactggcttgaacagcaggcttatagggtcctgggtctgcatcttaacctaaggtaccctttctttccacaggaccatacagaaagatacacgaagcacaccagattggctacagtttaagaccaacctcacaaatcccttttcattaattaaaacttaaccacaaatataaacaataatcctt

SEQ ID NO: 46894 - DNA, 601 bp, Human
aaggtggtaacagccccttcctaagatatacttccctcttgcctggggaccagaccaagaaactagccacaaaatgagaaaccatggcttaggagtcacgcagctggaggctacaagattttatcctcccttaactgcccaagatcagtatttaagatattttgtaaactctgcccttgatggatcagctggctctgcctagattgataaactggcttatctgatttttggcccttccccgggaactaacttagcacaagacacccaccgttgtaaaatggcagagactaaaacaaagtaytgccacgtggttacacgtcatgtttccaagtacatgaaacaagatggaggcctgtagccaagtttgttactgaccattttgttggactggcttgaacagcaggcttatagggtcctgggtctgcatcttaacctaaggtaccctttctttccacaggaccatacagaaagatacacgaagcacaccagattggctacagtttaagaccaacctcacaaatcccttttcattaattaaaacttaaccacaaatataaacaataatccttatcccttttgccagtttggatagggagagaga

SEQ ID NO: 46895 - DNA, 601 bp, Human
ggcagagtgaccttgacacgccatgtgctctccagtcctaggtcagagagagacctggaaatgccacgtgctctccagaccaagggcagagtgacctggaagttccgtttgctctccagaccaagggcagggagagacctgcaaatgctatatactcttcagaccaagggcagagagtgatgctcactgtcggggggagccttctgtttctagaaaatctcaaagacgccttcccttgagctatatcccctacaacgtttcctgatcttgccaaacaaaataactgaactgtaaaacttcrctcacatagcatacacagagagaataggagatatgacagtcgcagacaggaaaggaggaaattatgatagaaaagttggagatcctgttgccaacaccccatcaggtggtcagagactgggatcagtccagaagcctttggataacacctgaaggtagccccagccagaaatcctcagttgctctagaacctcttacagccccgcacaatggctaagtcctccatgaaaggaagctggttcaaacatggccaacatgcccagcaacccatgggtgctgggggattctccattttcttccc

SEQ ID NO: 46896 - DNA, 601 bp, Human
taatacagaaaattggtatcaaggagtgaagcattgctataaagatacctgaaaatgtgaaagtgacttgggaactgggtaatgggcagaggttggacgagtgtggagggctcagaagaagatagaaggatgagggaaaaattggactgtcttagagacttgttaaattgttgtgaccaaaatgttgatagtgatatggacagtgaaggccaggctgaggagttttcagatggagatgaggaacttactgggaactggagcaaagtcagttttgttatgtgttagcaaagaggttggaggyattatgtctctgccctggggacctagggactgtttttattattattattatactttaagttctagggtacatgtgcacaacgtgcaggtttgttacatatgtatacatgtgccatgttggtgtgctgcgcccgttaactcatcatttacattacgtataactcctaatgctatccctccccgctccccctactgcacgacaggccccagtgtgtgatgttccccaccctgtgtccattcccacctatgagtgagaacatgcggtgtttggttttctgtcctcgggatagtttgctcagaa

SEQ ID NO: 46897 - DNA, 601 bp, Human
actgtggttttgatttacatttccctaatgactagtggttgttatgcatattttcatgtatttattgaccatttatttatttttatttattttttgacatggagtcttattctgtaactcaggctggaatgcagtggttggatcatagctcactgcaaccttgaacttctgggctcaagcagtactcccactccagtctcctgagtagctgggactacaggtgtgcaccaccaccacgcttggctaattaaaaaaaaatatttttttctatgaactctgcagagaagaaattaatttttaattatttatttatttatttatttatttatttatttagtagagatggggatctccctgtgttacccaggctagtcacgaactcctgggcccaagtgatcctcccacctaggccacccaaagtgctgggcttacaggtgtaagccactatgcctggcctcattggccatttgtatatcttctttggggaaatatttattcagatcctttgcccatttaaaaattggattatttgtctttttattgaattgtatgtgttctttatgtatatgctagatacaaaactcttattagatatattact

SEQ ID NO: 46898 - DNA, 601 bp, Human
gaccatttatttatttttatttattttttgacatggagtcttattctgtaactcaggctggaatgcagtggttggatcatagctcactgcaaccttgaacttctgggctcaagcagtactcccactccagtctcctgagtagctgggactacaggtgtgcaccaccaccacgcttggctaattaaaaaaaaatatttttttctatgaactctgcagagaagaaattaatttttatttatttatttatttatttatttatttatttatttagtagagatggggatctccctgtgttacccasgctagtcacgaactcctgggcccaagtgatcctcccacctaggccacccaaagtgctgggcttacaggtgtaagccactatgcctggcctcattggccatttgtatatcttctttggggaaatatttattcagatcctttgcccatttaaaaattggattatttgtctttttattgaattgtatgtgttctttatgtatatgctagatacaaaactcttattagatatattacttgcaaacattgtctcccattctgtgcttttcgctttcttaatagtatcctttaaagtgcaaaagtt

SEQ ID NO: 46899 - DNA, 601 bp, Human
taactcaggctggaatgcagtggttggatcatagctcactgcaaccttgaacttctgggctcaagcagtactcccactccagtctcctgagtagctgggactacaggtgtgcaccaccaccacgcttggctaattaaaaaaaaatatttttttctatgaactctgcagagaagaaattaatttttatttatttatttatttatttatttatttatttatttagtagagatggggatctccctgtgttacccaggctagtcacgaactcctgggcccaagtgatcctcccacctaggccacycaaagtgctgggcttacaggtgtaagccactatgcctggcctcattggccatttgtatatcttctttggggaaatatttattcagatcctttgcccatttaaaaattggattatttgtctttttattgaattgtatgtgttctttatgtatatgctagatacaaaactcttattagatatattacttgcaaacattgtctcccattctgtgcttttcgctttcttaatagtatcctttaaagtgcaaaagttttaattttgatgaagactaatttatctacatattttttctttggttgc

SEQ ID NO: 46900 - DNA, 601 bp, Human
gatagaaactgttttccaacagtgggtatttgaatattaagtagtagtaaattagccaggtgtggtggcacacacctgtggtcctagctacttgggaggctaaggcaggaggattgcttgaaccctggaggtcaaggctgcagtgagccatgattataccactgcactccagcctgggtgacagagcaagaccctgtgtccaaaaaaaaaaaaaaaaaagtaaagacattgttttctttaaattttcaaacttctaaaaaagaacagagaataatatattgcatacccatgtagttgccamcttaatttaacaaatgttaatgatttgttacattagtcaagattaaaaaaatggtgtacagtggataaagttgaaattttctttactgtctcaatctctctttcccaagctgtagtcactctcaaagttggtgtgcattccttccttttagggttattattattctaaaatgtgtgcatatgtctatttgtctatcatgcagatattcattctcttatttttttctgaacgttttaaagctttagtgtcacatttagatgtttaatccatttataattcataattgtgttagcatgaggt

SEQ ID NO: 46901 - DNA, 601 bp, Human
cctagcattgggattgcaggatcatatcgtagctctatttttagtcttttgagaaacctccaaactgttctctatagtgactctaataattatattcctgccaacagtgtacaagggttccctttctccacatctttgccagcatttcttattgcttgtcttttggataaaagccattttaactggggtgagatgatacctcatagtagttttgatttgcattttgctgatgatcattgatgtttaacaccttttcatgtacttgtttgccatttgtgtgtctgtcttttaaatttttatytatttatttattttgagacgttatctcactctgtcacccaggctggagtgcggtggagcaaattcagctcactgcgaactctgcctcccgatctcaagtgatcctcccacctcagcttcctgagtagctgggaccacaggtgcatgccactatacccagctgattttgtgtatttttggtaaagacgagttttcaccatgttgcccaggctggtctggaattcctgagctcaagcaatccaccttccttggcctctcatagtgctgggattacatgcgtgagccaccatgcccggcctgt

SEQ ID NO: 46902 - DNA, 601 bp, Human
aactggaaaaacacaagaacccatatttattgtgttcttgtttgttgttgttgttattttgagacagggtctcactctgtcacccccgctggagtgtggtggtgctatctcagctcacttcaacctctgcctcccaggctcaagcgagtctcccaccccagccccccgagtagctaggatgacaggcatgtgccactacacccagctaatttttgtatttttagtagagatggggtttcccatgttggccaagctggtctcgaattccttaagtgatccacccactttggcctcccaaagygctgggattacaggtgtgagccaccatgcccggctgaatgtttcttttcttcttatattgatatttgtgtatgtgttataacaattccttcttttaatgttatggagtggcttttttagggaaagactttttttctgtagatgtatctatattgttgctggggaaaggtgttttggctttgattctgggtgggtgcagtagtgtagtctccgtatgatttcttcacctttactcggactagtttcttggcttctcagtggtgtaggctataattgttggcggaggctgtgacaagacttt

SEQ ID NO: 46903 - DNA, 601 bp, Human
ctgcctcctgggttcaagtgattcttgtgcctcagcctcccaagtagctgggattacaggtgtgcaccaccatgcccagctaatttttgtatttttagtagagacagggttttgcaacgttggccaagctggtctcaaactcctgacctcaggtgatctgtgcacctcccaaagtgctgggattacaggcttgagccaccatgcccagcctgataaatcttgtaaagtagacttacctttcctaaaagtttcctgtatacgatgtgtagtttaagttgaagcagtgttagttaacaataamacatataaaactgttgcctatgggtggaaattggcaggcaggcctggcaataatgtccttattacttggcctcatattgtgtgaaactgcattagtctaattatgattgtatctccaaagcggaaagaatggatagacaaaggcatttttctttcttttcccgccccccctccccactgaggtttaattgggatataagaaactgtacataattaatgtatacaatttagacatttatatacttgtgttaccatcaccataatcaaggtagtaaatatatttatcacctctaaaagttta

SEQ ID NO: 46904 - DNA, 601 bp, Human
ggtgctgcagtctccgcctcctgagttcctcagcctcctgagtagctgagattacaggcgtgcactaccatgcctggctaatttttgtattttttttatagtgacagggtttcaccttgttgcccaggctggtctcaaactcctggcctcaagtgatctgcccacctcggcctcccaaagtgctgggatttcaggcggaagccactgtggctggtctgatagtctaattatattatcccttcagcatttattagctatgatttgtctataaaaaaaattttctcaatcccagcactttggsaggccgagacgggcggatcacgaggtcaggagatcgagaccatcctggctaacacagtgaaaccccgtctctactaaaaatacaaaaaattagccgggcgtgttggcaggtgcctgtagtcccagctacttgggaggctgaggcaggagattggcgtgaacccaggaggcggagcttgcagtgagctgagattgcaccactgccctccagcctgggcaacagagcgagactctgtctcaaaagaaaaaaaaaattttttttctgttaccagctattcagttcacagaaatatagtctgta

SEQ ID NO: 46905 - DNA, 601 bp, Human
tttgctgctcatctttttaaagtattgatcttactcatcaactcttattattaatagttctgatactttaaagattcccttagattttctgtgcgactaggttttgcatctttaaattacagtttttattctcctagtccttacgctttttctaagtgttgaattgtttatacattatttatatatattatatataatatacgtatataatatataatatacatatattaatataatatatattaatatatgtatataatataatatattatattatatattaatatatgtatatattatattatattatatattaatatatgtatatataatataatatatattatatataatataatatatattatgtataatataatatatatattatatatatattatatatattttttcttagacagattcttactctttcacccaggctggagtgcagtggcactccagtgatccgcctgccttggactcccaaagtgctgggattacaggcgtgagccattgtgctgggcctgtttacgcatatatttttattaacagacttcattttttagacgttttagatttatagaaatattgagcagat

SEQ ID NO: 46906 - DNA, 601 bp, Human
ttgctgctcatctttttaaagtattgatcttactcatcaactcttattattaatagttctgatactttaaagattcccttagattttctgtgcgactaggttttgcatctttaaattacagtttttattctcctagtccttacgctttttctaagtgttgaattgtttatacattatttatatatattatatataatatacgtatataatatataatatacatatattaatataatatatattaatatatgtatataatataatatattatattatatattaatatatgtatatattataatatattatatattaatatatgtatatataatataatatatattatatataatataatatatattatgtataatataatatatatattatatatatattatatatattttttcttagacagattcttactctttcacccaggctggagtgcagtggcactccagtgatccgcctgccttggactcccaaagtgctgggattacaggcgtgagccattgtgctgggcctgtttacgcatatatttttattaacagacttcattttttagacgttttagatttatagaaatattgagcagata

SEQ ID NO: 46907 - DNA, 601 bp, Human
ttttaaagtattgatcttactcatcaactcttattattaatagttctgatactttaaagattcccttagattttctgtgcgactaggttttgcatctttaaattacagtttttattctcctagtccttacgctttttctaagtgttgaattgtttatacattatttatatatattatatataatatacgtatataatatataatatacatatattaatataatatatattaatatatgtatataatataatatattatattatatattaatatatgtatatattatattatattatatattaatatatgtatatataatataatatatattatatataatataatatatattatgtataatataatatatatattatatatatattatatatattttttcttagacagattcttactctttcacccaggctggagtgcagtggcactccagtgatccgcctgccttggactcccaaagtgctgggattacaggcgtgagccattgtgctgggcctgtttacgcatatatttttattaacagacttcattttttagacgttttagatttatagaaatattgagcagatatttatcccctccc

SEQ ID NO: 46908 - DNA, 601 bp, Human
gtattgatcttactcatcaactcttattattaatagttctgatactttaaagattcccttagattttctgtgcgactaggttttgcatctttaaattacagtttttattctcctagtccttacgctttttctaagtgttgaattgtttatacattatttatatatattatatataatatacgtatataatatataatatacatatattaatataatatatattaatatatgtatataatataatatattatattatatattaatatatgtatatattatattatattatatattaatatatgtatatataatataatatatattatatataatataatatatattatgtataatataatatatatattatatatatattatatatattttttcttagacagattcttactctttcacccaggctggagtgcagtggcactccagtgatccgcctgccttggactcccaaagtgctgggattacaggcgtgagccattgtgctgggcctgtttacgcatatatttttattaacagacttcattttttagacgttttagatttatagaaatattgagcagatatttatcccctcccccacccc

SEQ ID NO: 46909 - DNA, 601 bp, Human
tattgatcttactcatcaactcttattattaatagttctgatactttaaagattcccttagattttctgtgcgactaggttttgcatctttaaattacagtttttattctcctagtccttacgctttttctaagtgttgaattgtttatacattatttatatatattatatataatatacgtatataatatataatatacatatattaatataatatatattaatatatgtatataatataatatattatattatatattaatatatgtatatattatattatattatatattaatatatrtatatataatataatatatattatatataatataatatatattatgtataatataatatatatattatatatatattatatatattttttcttagacagattcttactctttcacccaggctggagtgcagtggcactccagtgatccgcctgccttggactcccaaagtgctgggattacaggcgtgagccattgtgctgggcctgtttacgcatatatttttattaacagacttcattttttagacgttttagatttatagaaatattgagcagatatttatcccctcccccacccca

SEQ ID NO: 46910 - DNA, 601 bp, Human
tgcatactcaaattcctcacttggccctgaggaacccacctatatgaaaacttggccctctgtatatgcaggtttcacatcctgcattttctatctgtctcattgaaaaagatccataagaggactcatgcagttcaagcttatgttatttaagggtcaacttaaaaccctcagtgtgtgtgtgtgtttatgtatatatatacataagcaatttaagacttattgctgagaacttaattgtgtctaccccccatttatatattgaagcctcaacactcaatattattatatttggagacakggcctgtgaggaggtgataaaggttaagtgaggtcataatctgatagggctggtgccctcataagaagaagagatagcagagctccatccctaccaagtgaggacacagtaagaaggtagccatctgtaagccaggaagaaagccctcaccaggaattgaatcagctagccagccccttgatcttggactttctagcctccagaactgtgagaaataaatttctgttacttaagacacccagtctaagtgatttcgttaaggcaatccaagaagactactgcagattttggtactaagag

SEQ ID NO: 46911 - DNA, 601 bp, Human
ctagccccagttatttggatatactcttaaaggtgatgggattctttaaaagtattgaggcaaactatctgcttttcccctttgtctcaggtcaagcctttctcttttagcattcagtaacaacattctgcattcacttttatcctgtgaagtttttgtctcatttggtaactgatatatttattttaaaatgttgtagggtaattattgtgatttattatgtccatctgttttttatcccccattttattaccatttctagcatttaggctgacttgtgcccatttcttgaaagaaaggwaaggcagagagcagaagaagtgatctttgtggttttaacttcccaaagcctaagattttaggagagtatgcaaagtgttctggacaaatattatgagagggagcagagtttcacctgaatctcccaatttctaagaagagcttcttttgacttgaatgagaggagagaaatgcaagagaatgaggagagaaagaaagaaagtgaccagggtagatacattgggaccttgtgtctgctttctgtgttagggcactggtgaagcagcaggagtcaaagaggggatggctaggtgttgtgtct

SEQ ID NO: 46912 - DNA, 601 bp, Human
tattatgcacatatatatacacatatatacacacatgtgtatatacacacacatatacatgtatatcttccagtgagaacctctgttcccaagaacatcaaattatttattcatttgctgtgtcctgtaatgtacacaaacaaattttaggattaatatacccagtgctattatcaacaataagacaacagtctttaagattcttgaaagtttttttttaaccttagaatataaactcacataagattacaaaaccaccagcacaccaaaaatttaacaaaattttataatgtcatcagtrtctatcctatattcaaatatccccagttttcccccaaactttcttgtcctttttgcaccattgtagaagttaatcaaggttcacacattgcatttgtatgtggtgtgatttgagtgaagatcgtctttttgcatgtggatttccagttgtcctaagaccatttgttaaaaaggcattttcggccaggcacggtggctcatgcctgtaatcccagcactctgggaggccgaggcaggtggatcacgaggtcaggagatcgagaccatcctggccaacatggtgaaaccccatctctactaa

SEQ ID NO: 46913 - DNA, 601 bp, Human
ggctaggtgcaatggcttgtgcctgtaatcccagcactttgggaggctgaagtgggcaggttgtttgagctcaggagttcgagaccagcctgagcaacatgatgaaacccgatctctacaaaaaatacaaaaattagcctggtgtggtggtgtgtgcctgtagtcccagctacatgggaggctgaagcgggaggatcacttcagcccaggaagttgagactgcaatgagccaagattatgccactgcactccagcctgggtgacagagtgagagcctgtctcaaaaaaaaaaaaaaaaaaaggcatagggaatagatggtttattttattttccctgttgctttccatagcaaagatctgtttcccaaaatcctggccttgagtacaatagaaatgtttcctctgtctgcactcaccctcctagaatgactttcacacatttattcctgggtcaagaacttctgcagtttatgtccatagaatatgttagtttcctcactaattttgaattcgttgtggtcactttttgtggtgttgtgaagagttatttttttcctcttccaacatactgagtccctttcttattttaaactttgtaaaa

SEQ ID NO: 46914 - DNA, 601 bp, Human
caacttattataatttatgttcagttacaattatacacaattaaccatgttaaaaatgtcagattaatgtatcaaagtttcatttgctagcaacacttaggtgtctatgctgagtacagtgtgtgttgtatatgcataaaggtcagttattaccataaaagcgtggtcatctgatggcttcttgttataggtttcattgggaggctgaggcgggtggatcacgaggtcaggagatcgagaccatcctgaccaacatggtgaaaccctgtctctactaaaaaatacaaaaaattagctgggygtggtggcgtgcgcctgtagtcccagctactcaggaggctgaggcaggggaattgcttgaacctgggagacggaggttgcggtgagccgagatcacgccactgcactccagcctggtgacagagcaagactctatctcaaaaaaaaaaaaaaaaaattagctgggcatggtggcactttcctgtaatcgcagctactcgagaggcagaggtaggagaattgcttgaacgctaggggcagatgttgcagtgagctgagatcacaccactgcactcgagcctgggagtgagagactgtctca

SEQ ID NO: 46915 - DNA, 601 bp, Human
aaaagcgtggtcatctgatggcttcttgttataggtttcattgggaggctgaggcgggtggatcacgaggtcaggagatcgagaccatcctgaccaacatggtgaaaccctgtctctactaaaaaatacaaaaaattagctgggcgtggtggcgtgcgcctgtagtcccagctactcaggaggctgaggcaggggaattgcttgaacctgggagacggaggttgcggtgagccgagatcacgccactgcactccagcctggtgacagagcaagactctatctcaaaaaaaaaaaaaaaaaattagctgggcatggtggcactttcctgtaatcgcagctactcgagaggcagaggtaggagaattgcttgaacgctaggggcagatgttgcagtgagctgagatcacaccactgcactcgagcctgggagtgagagactgtctcaaaaaaaaaaaaaaaagagagagaggaatgaaagtccctgacctcagggagctcaagtccagagaggaagaaacataagtagtaccatttgataagtgaatgggaacgtaagtacttgatattcaaggaatacagagaaagagaatgtaatacaaat

SEQ ID NO: 46916 - DNA, 601 bp, Human
aatactatagtgagcaactttatacacttttttttgtaaacatgttcaaatgaatctcccatcctctattacacagtatgtatttttcctctatggcactttctcagtttgtatgattatttgattaatatttgttcccttctttaggccatacatttcatgagtatacccattgttcataggtattttcctttgatttattaatatgcttatctgtgtatccatagtacctttgcccaataaatattagttgaataaatgcatttctataagtggaatcattgggttaaagaatatatayatttataattttgttagacactatcaaattgtataaaaatattttacctatttatatttctgctgctggtacttattttcacatttagcctcactggcccactcaacaacaccgtgccccccacccacctcttcaccccctctcctcttttccttttgttactttcttctacaaacatttttttgacacttacattccaggttttgttctaggtgtttaggatatatcagagagcaaaacaaagatcctgggtgggaagaaatagacaattaacataataaggaaataatataggatgtt

SEQ ID NO: 46917 - DNA, 601 bp, Human
gcagcgtgaacagctagttcaaaagctggtagctactgaaaaggagtaggaagagttttgctgggtcctgggaatgctgtttcttgatctgtgtgctggttacctgagtgtgttcacagtattcattgagcagtacaggccgggcgtggtgtttcacgcctgtaatcccagaactttgggaggctgaggccgggggatcacttgaggtcaggagtttgagacaagcctggccaacatggtgaaatcccatctctactaaaaatacaaaaattagccaggcgtggtggcatgcgactgtagsctgtagtccagctacttgggaggctgaggcaggagaattgcctgaacccgggaggcagaggttacagtgagctgagatcatgtcactgcactccagcctggttgacagagcaagattctgtttcaaaaaaaccaaaaaaacaaaaacgttgagcagtacggttatgatttgtatatttttctctatcttatacttcagtagagcttgcatatttaaaaatattagtggatgttgaacatttcaaaatgcattaatagtacttaaccaattcatggatatttttctttgacttattaatat

SEQ ID NO: 46918 - DNA, 601 bp, Human
gaagctggatattcatgcatagacttccatttccctctcctctcctacttaaatatcgggagacaatgacctgtggtggaatgttatatcctttcaggctggtttcttgacgactttgtgtgtgtttatgtgtgttacaaatttcaaaccaaagtcccagtcataatcctgacaagatctcctaatttttattccccagaggcaagtagtagcatcagccccctagtgtggccttctcctttggtccctttggctaaggagtgcagtgaccagaaggagaaggttcattctaggatgaacyagagtcaaggtgattggtgtgcattctgatttggctgattttcttgactaggaggatatgcagaacagactgctgtcttgggtttattggtctagcaaattgtgaatgccatttcagccaaaaacctgcttttgttaaggaaacaagaggctgaggacatggcttggctttccctgaagcagcccagctaaggccacctttgttctagagcttagagagtgggcagccagttctttgtggcaaaacatgtagccctaggctgacattactggttgtgttacccatcttacaggatctggt

SEQ ID NO: 46919 - DNA, 601 bp, Human
gttccttcttaggctgagccaaccaaacctgcactcagtttctctctgcaaagccagggcttttctcgtctagccgacatggtgctgtgggatagattatggaggcagtaagagatcgtcagtgacacattaaaaacacagttatttaattcaaattgaagtgttacatattttcctgaatttccctttttagtttctaatcaggcttggtgccaggaggtttactttttaggaaaactggaggtgattgcctctcactacttttttctgtttctctcctttgtctcactttattccttastatattctctctcttgccctctcctgcttttcatattctcttctactcccaacctcttctttccatggatgctttgtttcttaatatttgccctttatttctttagtgtagaaatgttgttagcctttagtaaagttgtagagtatctctgtttagcctagcaaaataaacaaaaagcagactattatttaggagtaataggtcacatgcagggagaaagtaaaacctgtggatttgggttgtgggcttctaactctggctgagctgccctctctggcctcaaaagtgataggattgtct

SEQ ID NO: 46920 - DNA, 601 bp, Human
tcagaacaacagatgcatcaagggctaaaaacagtgcttccaaagtctctttttcttaatatatcatcagaatgctttgtaagcagaatgctttgcatccctcttgtttgcttttgttttcaagctttgctactcctgccctggtcagtggactacttgctccaaatgtcaagtattaactaatacttgttcctgaccatttgaacattagcttctttctcatgttgatatttttcctcccggagttctaatccctctcctctccttttttatgttcacatgtaaccataaactcaaatargaaaagctcataagatcatcttacccctgtctcccatctgtacccacaaatgttattgagagtccaatgctcagattttcttccttacctataaaacccacatgtttgtgctctcttttagtggaattcttatctaccaacttgtctaatgaagccaaggggggtcatttccctattatcttcaatatggccccatgttttacaattctgtctggaattttctttttctagttcattaactcttttctgtttccgctgtatagatgcaggtccttatctcctgcctgagcaattgtaaaa

SEQ ID NO: 46921 - DNA, 601 bp, Human
tctgcaagtaaaaatgatgagagtctattggaagaaaaactctgtatagatctgtctcttttaccagatcaacaaaaaatatgtgccaaagatactccaggacatccttgtatagctggcagtagaactgcaaataaagaggtattttcaaagccattagaggaggacaaagttacaggtaatgatgatttccttgagccactcagaaaatcatttagccagtttttgctcacttcccctgagacttgttcaaaggaaagtttgtcagaacctgtgaaaattcgccaggtggaggaagatrgtttagaaaggggctctaagaaagatggtcattccttttcctttagtggaaaactaaatcttccattttttagaagtcttggtcattctgaaaagcaacaggagttaaaagagaaaggaagcatttttcctttgtttaaattttctttcactgacagcaaggttactgttaatgaccagagtttacgtggctcagcagtaaccactgatgaggagagcaaaaaaaattgccatgaagataccaaacatagttcaataaaatctagttctgttccaaatattcatagtgatctaggaaaat

SEQ ID NO: 46922 - DNA, 601 bp, Human
aagaaaaactctgtatagatctgtctcttttaccagatcaacaaaaaatatgtgccaaagatactccaggacatccttgtatagctggcagtagaactgcaaataaagaggtattttcaaagccattagaggaggacaaagttacaggtaatgatgatttccttgagccactcagaaaatcatttagccagtttttgctcacttcccctgagacttgttcaaaggaaagtttgtcagaacctgtgaaaattcgccaggtggaggaagatggtttagaaaggggctctaagaaagatggtcrttccttttcctttagtggaaaactaaatcttccattttttagaagtcttggtcattctgaaaagcaacaggagttaaaagagaaaggaagcatttttcctttgtttaaattttctttcactgacagcaaggttactgttaatgaccagagtttacgtggctcagcagtaaccactgatgaggagagcaaaaaaaattgccatgaagataccaaacatagttcaataaaatctagttctgttccaaatattcatagtgatctaggaaaatttgacagtacagaggaatttaaaaagaatga

SEQ ID NO: 46923 - DNA, 601 bp, Human
aaataaagaggtattttcaaagccattagaggaggacaaagttacaggtaatgatgatttccttgagccactcagaaaatcatttagccagtttttgctcacttcccctgagacttgttcaaaggaaagtttgtcagaacctgtgaaaattcgccaggtggaggaagatggtttagaaaggggctctaagaaagatggtcattccttttcctttagtggaaaactaaatcttccattttttagaagtcttggtcattctgaaaagcaacaggagttaaaagagaaaggaagcatttttccyttgtttaaattttctttcactgacagcaaggttactgttaatgaccagagtttacgtggctcagcagtaaccactgatgaggagagcaaaaaaaattgccatgaagataccaaacatagttcaataaaatctagttctgttccaaatattcatagtgatctaggaaaatttgacagtacagaggaatttaaaaagaatgaccagataaattgtcctgaagatgccaaacttaattcaataaaatctagttcagttccaaatattcatgatgatctagagaagtttgacagtataaaggaa

SEQ ID NO: 46924 - DNA, 601 bp, Human
atcaggcttttgaagagatgaacagtcctttctgttttgaatgggactctgacataaaagatttgtctaaaaattccagaaaacttcagccagtttattatatgttaaatcaaaatagatttctatcagccgatgcttgcttgtggcttgactcagaaaactcagtgataaatttttgccaaaaagatcaaaatgcaaacatcttggagtggagaacaaatccaaacagtgtcatttggtgtgacttaccatatgaatcattcaatcagttagcatttaatgaagattacttattaagagrtgatgtgtgggcagctaactcattatatggaaactctggtcctcttccaattaatgaggctaataattcactagaagaattacccattgacttaagttcttcatcagatcatgaaaagactacatgccccgtagttgatcaagaatcattaagaatggatgaaaactttgttttttcaagttttggttatgagtaccaggaatggttgtcatgtcttgaacatggagtgtggtggccatcagaggatggggattatggatattatatgtttcatgatggtcaatatatctattctcttct

SEQ ID NO: 46925 - DNA, 601 bp, Human
caaagaaaggccgtgtggttctgaagacgctgaatgtacattagatctcagaaatcagccccaaactattagtaatcatgtctcaagcagagatcaaattatagagagagataaaaaccagcctctagctgaagattcatcagttcacctttccagtttccattggcttcagtcttctgttgaagaagttaccactttggttcatcctgaaaatatgactaaaggctcacaacaagcagaagagacatcattagtgaacaaagtggcttcagtattttctgttttgggtgcctcagttggwagtactttgaagtttgataagagtgaatccttagaggctttggccatgcagaaagtgaatcagcagtcagatttagcagagctcacaaatgatggctttcagtcattaatcatgagtaagcaattagagggtaactccccaaatgtggaaaaaagtcttcttaaggattcagaaagacagatagtatccaatgttcagcatccagaattgatcaaaaatataaggcaagaattctctttaaataaaaacaaccatgtgaaaaagcaaagtttgttaaaatctggtttccaggtaagccaa

SEQ ID NO: 46926 - DNA, 601 bp, Human
ctagctcaagcattaagaaggatgcctctcatagtagttctacttttagtttcttcagcttgtcctttttggatcaaaaaaaggagacctctggggaaaaacaaagcatttcaactgttgttccagtgacctcccagccctgtaagaagacaaatgtttttgtagagagtggtagcacaatgaccagagaaagttccagtggtcatagagatagcatagcccaagaagtagttcatgaacagcaaatggcaccttgtatttccattaacaacaccattgaggttacctcccttgcagatgrgctcagtgtagacaaggactgtcaggaaaaactgagttccaatattgtaccagggacatcagtggatttccagatgaatgaattgcaaaaagacattattcctccttcaccagaatttcaggcacaggctgaaacattcctcactggcccagagaaccttgggatagctccccatgaagaagaggctttcaaccacaaagccttccccagtgactcactgtccaactctttttcacatgctaaacagttaattgaaaaattcaatgatttagacacttgtactaactgccaccaaaatga

SEQ ID NO: 46927 - DNA, 601 bp, Human
caaccctcagttgtgacaattaaaactgtctcctgacagatttcccctggcggggacagttgcccactggggtagagtgataagggatgggtgtgacttagagtttcaaatttcaagatctaataataaagcctctcactgaaacaccagagcactgaatgcagattacatggtaaaaattagggagtgactggtgcttctactttaccactggattaatagatgagtcgcaaacctttctgaagatattaacttattttctctcttcttcccttttttggtttttggtcatctctggtarctcatctaatagatgggacatccaggaggtgagctgtggaccaggcttcttattgggttgatgactcactgaaaaactgactctggctctccatagaccttagacttggcagtcactgttatcagggcagagttcctggtggagaagcagaagtgcccagcacaagtccttgtccttctctactggttgtgtcctctcaggtcctagctgtgagagtgaaacccagttctaccttggccagaagtgcccacaaatgttttacaacagttgacacatttagttggcatcagaaacgaccat

SEQ ID NO: 46928 - DNA, 601 bp, Human
attgttcattttactgaggttgttctagaagcagctcaaggaaccagatcatggcagtaaaagggctgtgtgttttttttcttttctttcttggcacttttcatgtaaaaaggaatgggtaagccttctaaaatacttagtggagcaggaagggtttgcaggaacaaaattctgccctaaggatgctatgcaaaagccccaagggaactgatcgttttaagaagtgcagtgagaggggttgaaaggcttattccacccctctctgcatggtttctatactacgtattgactcagggctctygccattgcctctagagtcctgatcccagactgttccagggagctaccacattgggtaaatgacaaaaacgagtaggaaaagagggaacagatgaaaagctaaaaggaattgtcattttagagatgaattattttcacattgagtattcagtactatgctgctcattgggtaaatgaaaaagaaggaaaagaaggaacagatgaggcgcagtggctcacgcctgtaatcccagcactttgggaggccgaggtgagcagattgcttgtgctcaggagttcaagacaagcctgggcaacatgg

SEQ ID NO: 46929 - DNA, 601 bp, Human
atttagctcccacttataagtgagaccatgcagtatcccatggtgtgtatatatatatatatacaccacatttttaaaagccaaacatctgttgatggacacttaggttgattccgtatcctttttttttttttttttttttttttttgagttcaggtcttgctcctttgcccagctggagtgcagtggtgtgatcattgcagctttgaactcctaggctcaagcaatcctcctacctgtgcctctttagtagcagggtctacaggcatgcaccaccatgcctggctaatttaaaaaaaawtttttttttttttttttgtagatgcagggtcttgctgtattgcccaggctggtcttgaactcctggcctgaagtgatcctcccactttggccttccaaagtgctgagagtacaggtgtgagccactatactcagcccataatatttttgctactgtgaatagtgctgcaataaacatatgggtgcaggtatctttttgatataatgatttattgaagttacatgtttaatgacaattggctgtcagtagtataatatctggcagatattaaaagcacaatcatgctcacatatgtgcaca

SEQ ID NO: 46930 - DNA, 601 bp, Human
ctcacccagatgctccaactattcacatttcacatttacttcattgccttccctccattatgatcaatctttttctgaatcatttgagagaaaattggagacatgatattctgtcattcctaaatcttcctttgtatttccctataaacaaggctacagttctgtataaccatgatataaccattcaaatctgccaaacaacaataacaacactattatcaagaccctatccatattttgccaaccatcccaacaatgtctctttttcctttctaatccagaatccaatccagaatgacaygttgcatttagtcgtgatatctctttagcttcgttcggtgtttcccatccttagcagttttaaatggtataggcttttcattttgtagcatgttcttcagtttgggtccattcagtgtttcctcatgtccggactgaggccatcctttcatggcaggaattacacaaaaaaaatgatgctgtgctcttttcagagcattgcgtcagaaagtacctgatgtcaacatgtcctaccatttataatgtcagccttgatgacttggttaagtttgcattggccaggtttctccactgtcaaggt

SEQ ID NO: 46931 - DNA, 601 bp, Human
cctcaagtgatccacctggctcagcctcccaaaatgctgggattacaggcatgagccaccacgcctggcctaaacaagcatttaaaatgaacatttatggaatgaatgtcataatacttactgattttttatttctaagttttttaaaagtaagggtcttgtaattcttcctataaagcaaagcaaagtaattagccttatccatgtaaaaggaaagctctgaattagaaaaataagaatatattggagaagacacagtttaagttatggccttttctttttcagaagtataataattcaatctctcaaaaagactagctgaaaacagttgccaaagcttggaatcatacagacagaggcatggtttacctaagagtaactaagaacttaattgaataagagaacaatagtaaagatattcttaacacaggtaaagtaactggcaactgattagaaatgtccaagaggagaacaagaagccagagtttaaagagggttctgataacagtttaagattgaagcagaaatgtaccatttgtacttaagatgagatttagtaacatattggttgaagttatgtgagagaaagaagttaagcaca

SEQ ID NO: 46932 - DNA, 601 bp, Human
ttcttgtagagatggagtcttcctatgttgcccagcctgatcttgaactcctgggctcaagcaattttcctgtctcaacctcccaaaatgctgggattacaggcatgagccctcatacctggctcctcttgttactattatgaataacgctgtgatgagcatcattgtgcatacatctgttttcatttctgattatttctttaacttaaaatagattaaattactgagttgaagggtataagtttttaaatttaaattttattttttatttttaattttattttttaaaatagagaccagktctcactacattgcctaggctggtcttgaactcttagcctcaggtgatcgtcctgtctgggcctcctgcaatgccatgattactggtatgagccatcacactcggcttcaggggtatatatatattttaagacttctgtcaaacttcttaatttattttcagaaaagcttttccggtttgtactttcagtatttgagtgtgctgtaccaacattaagtattcttattttagaaaatttttgccaatttgacagaagaatggtataccattgtttaatttgcatttctttgattatctgtg

SEQ ID NO: 46933 - DNA, 601 bp, Human
gatttgcatttccttagtaactaatgatgttgagtatcttttcatgtgcttattggccatttttatatcttctttggagtttagtagtctcctcttaaacataggggatacattcccagaccccaaatgggtacctgaaaccatggatagtaccaaacttcacatatactatgttttttcctatacatacatatgataaggtttaatttgttaattttagagacaggatctcactctgtcctgcaggctggaatgcagtggttcactgcagccttgaatcctgggctcaagcagtccttcyacctcagcttcctgagtagcttggactataggcatgcaccaccacacctggctaagtttctattttttagttttttgtagagacaagagctgtgttgcccaggctggtcttcaacttctgggctcaagtgatccttatgccttggtctcccgaggcactgggattgcaggtgtgaaccactgtgcccagccaatgtttaatttataaattaggcacagtaagagattaacaacataataaaataaaacaattataaccatatactgtaattaaagatatgtaaatatgatctctcaaaat

SEQ ID NO: 46934 - DNA, 601 bp, Human
tcattctccaaagccaccaactgagatgatccttccactgtattccaaagtttccctacaaaggaaaggaaaaaaccagagtgcctggcttctggttctgaattgtccccttccttccttccttccttccttccttccttccttccttccttccttccttccttccttccttcctccctcccttccttcccttccctttcttcctcccttccttccctttcttcccttccttctgttccttcctttccttcttttcttttcctttcttttccttccctttccctttcctttctttttgacrgagtctggctctgtcgcccaggctggagtgcagtagtgtgatctctgctcactgcaagctccgcctcctgggttcacgccattctcctgcctcagcctcccgagtagctgggactacaggcgcctgccaccatgcctggctaattttttttttgtatttttagtagagatggggtttcactgtgttagctaagatggtctcgatctcctgaccttgtgatccgcccacctcggcctcccaaagtgctgggattacatgcgtgagccacctcgcccagccccgaattgtcccctttcttcc

SEQ ID NO: 46935 - DNA, 601 bp, Human
cttccttccttccttccttccttccttccttccttcctccctcccttccttcccttccctttcttcctcccttccttccctttcttcccttccttctgttccttcctttccttcttttcttttcctttcttttccttccctttccctttcctttctttttgacagagtctggctctgtcgcccaggctggagtgcagtagtgtgatctctgctcactgcaagctccgcctcctgggttcacgccattctcctgcctcagcctcccgagtagctgggactacaggcgcctgccaccatgccyggctaattttttttttgtatttttagtagagatggggtttcactgtgttagctaagatggtctcgatctcctgaccttgtgatccgcccacctcggcctcccaaagtgctgggattacatgcgtgagccacctcgcccagccccgaattgtcccctttcttcccttgccttttaaatatctgataccactgagttcctgatttcaccttttcctcctctcatgggctgagtttgtccccattcccaccccaaagttcataatgttgaagtcttaaccttccccaggggttggatacctaa

SEQ ID NO: 46936 - DNA, 601 bp, Human
gatgttaatcacattgtcctggaattatgtgagcatttgccctcaagattatatatttcttaaaataatatattttgtatgattctttttgtattaagttcaaaaacaggaaaaagtaacctgtggtgtcagacatcaggatagtgattacctttgggggatggaatttgtagtgattagatatgagcacaggaggcttctggagttctggttatattgttttcttgatctagattctgtttacatggatgtaaaagtacacttttgacttgtttatgttataattataatgtatattatmattcaataaaaagtttaaataaaagctaaatgaaaaatagcattaaaatacagagtagagaaaatgtctgactttatatccctgatgcctggcacccactaaactctttgcagatgagtgagtgagtgagtgaatagagaagtgaatgaaagtttatcctcaaaaaaattaatttttctttacattggtaattaaattatagtctcaacagagcctgagttctccaccacttacggcctgtgtaaccttaggcttaggcaagttacccagccctttggaaacataattttttcatctctg

SEQ ID NO: 46937 - DNA, 601 bp, Human
ttcgactgcctctgggatgacagtgtgccctttgcagtgagcttctactgccaggtttggaaggctctccagagtatttcccaccccagaattctagacccatgctgtccaatgtggtagctactggccacatgtgactgctgagtacttaaaatgtggctagtctaatttgagatgcattctaaacataagatacatactagatttcaagaacttagtataggaaacaaatgcaagtatatgattaataattttttatattgattatatgttgaaataatactttggctattgggttagwtaaaatatattaaaattaattctacctgtttcttttttatgtggcgattagaaattttaaaatgacacatgtggttcacattatatttctgttagtcagtgctgctctaaactcacccatcactagcacaaggatcagggcagcttttccaactcggggtaggggatgggagccctgtcacagcatccctggggtaacaggaaccacagcaggatctctccctgccagtctcatacactggagagataccagctaattgatggtctggcagagaccggtgctgccatgcccccacactct

SEQ ID NO: 46938 - DNA, 601 bp, Human
cctgatcattttgatgattaacatcctgagaatccccatacctgctgtggccctagaaatccattcctcttagcccatattagccatacaacataattgatatatggcccagaaatgctctgtcctctgttgggggctcagagctcttggatttctgcttgctgggattgtttcacacaaactgggaagctgcttgatatatgtacatcgagtcctggccttttcccagaggtcccctggttgtttcctctaagccagatttgggttagaagcagtttttacaaggaatagttacattccyaatcacatttatttgataagtcagagagaaggataaaagaatcagccatttcaaaaaactgaggtgttttcctttctctttttcgttggtaggctggtggtgatgcaatgtggtttaagggatctactccctgcagtaattgttagctttccatcattaaagctttaatctttttgattaattcattttgttttgatgtgctcccttttcaaatgcagatagtccttgaaaggggctgccttatttttcccagccttaggcagtcctgaggaaaagagcacagaaaggtatggtttttgt

SEQ ID NO: 46939 - DNA, 601 bp, Human
gaccttgtctttactaaaaatcaaaaaacaattttttgtggtaaaatatacataacataaaatgtgttatttaaaccatgttttttctgaatattatgtggaacattttaaccatttaaaaatatatagttccataacatcaagtacattcgtattgttctgcaaccaccgttcatctccagaatgcttctcatcttgcaaaactgaaactctatacctattaaatagtaactcctcatcccatctcaccccagtccctggcaaccactactctactttctgtctctatgaatttgattgmtctaagtacctcatgtaagtggaatcaaataacatttgtccttttatgactggcttattccacttagcgtaatgtcctcaaggttcatctatgttgtaatgtgtcagaatttcactctgaaatttcactctggaatttttaaggctgcatcgtattccattgtacacatgtatcacattttatttatctgttcactcatcaggacacacattgcttccaccttttggctattgtgaacaatgctgctataaacagtggtatacaaatattttttgagtccctgctttcagtcttttggct

SEQ ID NO: 46940 - DNA, 601 bp, Human
gaatattatgtggaacattttaaccatttaaaaatatatagttccataacatcaagtacattcgtattgttctgcaaccaccgttcatctccagaatgcttctcatcttgcaaaactgaaactctatacctattaaatagtaactcctcatcccatctcaccccagtccctggcaaccactactctactttctgtctctatgaatttgattgatctaagtacctcatgtaagtggaatcaaataacatttgtccttttatgactggcttattccacttagcgtaatgtcctcaaggttcayctatgttgtaatgtgtcagaatttcactctgaaatttcactctggaatttttaaggctgcatcgtattccattgtacacatgtatcacattttatttatctgttcactcatcaggacacacattgcttccaccttttggctattgtgaacaatgctgctataaacagtggtatacaaatattttttgagtccctgctttcagtcttttggctatgtaccccaaagtggattgatcaaattttatggtaattctaattttttgaagaatcaccataccattttccatggtggctgcaccgt

SEQ ID NO: 46941 - DNA, 601 bp, Human
ttgtaatgtgtcagaatttcactctgaaatttcactctggaatttttaaggctgcatcgtattccattgtacacatgtatcacattttatttatctgttcactcatcaggacacacattgcttccaccttttggctattgtgaacaatgctgctataaacagtggtatacaaatattttttgagtccctgctttcagtcttttggctatgtaccccaaagtggattgatcaaattttatggtaattctaattttttgaagaatcaccataccattttccatggtggctgcaccgttttacrttcccaccatcagggcacaagggttccttccaatttctctacattttcttcaacacttgttattttctgttttgttttttttaagtaatagccattgtaatgggtatgaagtagagcacaaaagttttaaattttggtgaagtgcaatttatccatttttttcttgttttgattgtgcttttggtgtcatagctgagaaatcattggttaatctgaagtcagaaagatttgctcctattttttttatgagttttatagtttttactcctatatttaggtctatgattttttttttttttt

SEQ ID NO: 46942 - DNA, 601 bp, Human
tctcaatggatcctcccaccccagtctcaagtagctgcactgcacgtgcaggcacatgccaccactacaggcatatgccaccacacccagctatttttttcatgttttgtagagatgggggtctcactttgttacccaggctggtcttgagctcctgacctcaagctatccttcctcctgccttagtctcccaaagtgttgggattataggcatgagccaccatgaccagcccttagtataataggttcttaagaaatgaatccttgcaataaccctgggaggtagttgttcatatacctrtctttttatagttaaggaaatgtaggctcaaataagttgaacgtctcaagtcttttgactctcaataatggagttaagattgtattattgggtatactgaggggagtgctgatgaggaggtatgtcacttccttataaaatggactgtctggaacagtgagagagatcattcttagggggtcagggattttcctgcaaagcagttgttttgtagacatttataacttaacctgcaaactaaatctaagtggaaaaatcctaaggcattttagggagttgggaagcacagaaagtttgatt

SEQ ID NO: 46943 - DNA, 601 bp, Human
gagggcccagttgaagttaaaaatctgcatctagggcggggcgtggtggctcacgcctgtaatcccagcactttgggaggccgaggtgggcggatcacaaggtcaggagatcaagaccatcctggctaacacagtgaaaccctgtaaatacaaaaaattagctgggcatggtggtgggcgcctgtagtcccagctacttgggaggctgaggcaggagaatggtgtgaacccaggaggtggagcttgcagtgagccgagatcgcaccactgcactctagcctgggcaatagagcgagactcygtctcaaaaaaaaaaaaaaaaaaaatctgcatctatttgctctggttctcatctgtacaatggtgggacttgtcaaggcattatgtgttaaataccaatgagaaggatgaatgtaacttaggtgcactaggatggccttattaactcttgcttgggtgggcatcagagaaggcttcccagaactatgccttggaggaagagttggattttcctctatggaaaggaggtgtgagatgctatttcaggctaatggaacagaatgagtaaataaaaatttggggttttgagtatgtgacgtct

SEQ ID NO: 46944 - DNA, 601 bp, Human
ccagctacttgggaggctgaggcaggagaatggtgtgaacccaggaggtggagcttgcagtgagccgagatcgcaccactgcactctagcctgggcaatagagcgagactctgtctcaaaaaaaaaaaaaaaaaaaatctgcatctatttgctctggttctcatctgtacaatggtgggacttgtcaaggcattatgtgttaaataccaatgagaaggatgaatgtaacttaggtgcactaggatggccttattaactcttgcttgggtgggcatcagagaaggcttcccagaactatgcyttggaggaagagttggattttcctctatggaaaggaggtgtgagatgctatttcaggctaatggaacagaatgagtaaataaaaatttggggttttgagtatgtgacgtctttgtgaaacaagacaattagattgtaggaatgtatatggggtcaagaaagagggcagaggagaggaatttggggatttgggccagatcatggagagccgtgacggctctgtcaatggattgatttgattttaatctttaggcattatggggaaacctgtggagaacagaaggacacaatcaactttgac

SEQ ID NO: 46945 - DNA, 601 bp, Human
cttgccttaagagatacatattgtagtttctagaattagctacaaagttgtggcatcagttgcttcttcagtgatctttagtttttttcttctaataattgtaaaatacacacatgtcaatgggacatatccagactacttctgaatgtagctatgtagtagttttctaaatgattccctattgtctttcttccttttctttcaccttcgtccttagaagctgtcctaagtatagaacttccctcagtctggtagtctcattaaaaacaaagcctactgcctatgttcagggagctgtttyattagaaatcagcatattgagtggcctgtttcaactcctggacttgacccaatttgtggttccattctttgcctagatagctacaagtacctactttttctgttgggatatttctgtctttagaccagccgtggtatacagcccagctacccaactttcccaacgtctttgctctcattaaaaccaagtacatgagttctttgcattaaggccagagagttttttgttgcttatccatctcattttatagaagcgtcaccaaggcccaaagtgaagaaggaattttgggagaagacatag

SEQ ID NO: 46946 - DNA, 601 bp, Human
aatgataaaaatttgtggaattgaattgaaacaggcttaagagttaaagctgatcccagggcctccatcccatcctcccaggatgaccagaagccccattctgggtcataccttctgaggcacaaacaacccaaggaattttctgtagccttgtgggtagttgggggtgaagtgaggtccaggttctctcagagctctaaagctagaaatcgggtgtaaggattcagttaaatgtgaacccttttcccttattaccattttctgtttctgttttcttttttctctctattctatctattgkttttcctaaccacccctcttccctcttccccatttcctgctccactagtttctccctccttagttgaccgaatgaaagtatcatctgccattttctcttcatcatttttcttcccttccattatttcttaccatttgttcatcttctcctttctctctctttctttctttctttttttttttttttatagagacggagtccctgttacccaggctggtctcaaactcccgggctcaagtgatcctcctgcctcagcttcccaaagtgctgggattacaggcgtgagccaccatgcccgac

SEQ ID NO: 46947 - DNA, 601 bp, Human
tgtgcaagagtgtggctagcaaggcagccccagctctcagacttaactctctgggcttggcagatacatggggcccctgtgcaagagtgtggctagcaaggcagccccagctctcagacttaactctctgtgcttggcagatacatgggccctgtgcaagagtgtggctagcaaggcagccccagctctcagacttaactctctgggcttggcatatacatcgggccctgtgcaagagtgtggctagcaaggcagccccagctctcagacttaactctctgggcttggcagatacatggggcccctgtgcaagagtgtggctagcaaggcagccccagctctcagacttaactctctgggcttggcagatacatggggccccctatgcaagagtgtggctagcaaggcagccccagctctcagacttaactctctgtcctgcttgatttgactgaggcttcaatgcccttttcacttgccaagtgccctacttgtaggcctgctggcctctgcagccatccagggattatgtgggcttggggaggtgccaaggtatagaggttagcatggaatcatttttctccataatggctcttgaatg

SEQ ID NO: 46948 - DNA, 601 bp, Human
caagagtgtggctagcaaggcagccccagctctcagacttaactctctgggcttggcagatacatggggcccctgtgcaagagtgtggctagcaaggcagccccagctctcagacttaactctctgtgcttggcagatacatgggccctgtgcaagagtgtggctagcaaggcagccccagctctcagacttaactctctgggcttggcatatacatcgggccctgtgcaagagtgtggctagcaaggcagccccagctctcagacttaactctctgggcttggcagatacatggggcccctgtgcaagagtgtggctagcaaggcagccccagctctcagacttaactctctgggcttggcagatacatggggccccctatgcaagagtgtggctagcaaggcagccccagctctcagacttaactctctgtcctgcttgatttgactgaggcttcaatgcccttttcacttgccaagtgccctacttgtaggcctgctggcctctgcagccatccagggattatgtgggcttggggaggtgccaaggtatagaggttagcatggaatcatttttctccataatggctcttgaatgtgac

SEQ ID NO: 46949 - DNA, 601 bp, Human
cctggtgccggagaggcaagattgctatctgcaaacaacatgaaccataatacaaggatttgctaacaacctaacgctgtagacttggctaacagtttgatattataagaggtggggggagggggaaggggaagggcaggggaccagggagtagctaaccagtggtttgctaactgggtggggctgaagcatgtatatatcagagggtgtaaagatcaatatagagataagtggtcagttagggcttgggtagggagatgggatgcttgggctttaagggaaaggctggtggcccaggacraagaataaatatggaggaatgggattacggtatctgtgcaaggagcatagactgctctaagatggaaagcatatgagtagtgttgtggggggcttctgaacgactctgaagcctcctatacatgcttgggttgcagtggtgtgtgcccagggcctacaagccaaggacaaaacaggatccagtgacccttacgtgactgtgcaagtcagcaaaactaagaagcgtaccaagaccatttttggaaacttgaatcctgtttgggaggagaagttccatttgtaagtcacagagagctttgtc

SEQ ID NO: 46950 - DNA, 601 bp, Human
ggattccccctttacctccctgttgttattgttctgtgatgagaagtgccacctcaggcaagatccccatagaagagctaagagttccctttccttttctttcctttctcctcttctcagaccatcgggaaggtgctgatgcagtatgcagacatcttgtcaaaggacttcccagcctattgcacaaaggagaaactggtaggttcaggccctgggactcttacagaaagagagtggaagacatttgaatccttgcttttgaagctgtcctcagaattgagggttggggtgacactcctgwtgcctgattcccaccatggctttgcttcagatccatgccacaaaattacgagaacttgacagagttcctgtgagtctcatttggtacattatcctctgctaagctagacctttgcttagtcttttttttaatatatatataaaaactttagatattcagaaagttataaaggataatacattaatacttgagtacctaccacccagcttaaaaatgaaaacatttgcttttagtcaaggagaattatctgaactggccccagctcttagtgctgagggagaaacctatgtcatatgtgaa

SEQ ID NO: 46951 - DNA, 601 bp, Human
gattccccctttacctccctgttgttattgttctgtgatgagaagtgccacctcaggcaagatccccatagaagagctaagagttccctttccttttctttcctttctcctcttctcagaccatcgggaaggtgctgatgcagtatgcagacatcttgtcaaaggacttcccagcctattgcacaaaggagaaactggtaggttcaggccctgggactcttacagaaagagagtggaagacatttgaatccttgcttttgaagctgtcctcagaattgagggttggggtgacactcctgawgcctgattcccaccatggctttgcttcagatccatgccacaaaattacgagaacttgacagagttcctgtgagtctcatttggtacattatcctctgctaagctagacctttgcttagtcttttttttaatatatatataaaaactttagatattcagaaagttataaaggataatacattaatacttgagtacctaccacccagcttaaaaatgaaaacatttgcttttagtcaaggagaattatctgaactggccccagctcttagtgctgagggagaaacctatgtcatatgtgaag

SEQ ID NO: 46952 - DNA, 601 bp, Human; identical to SEQ ID NO: 35593

SEQ ID NO: 46953 - DNA, 601 bp, Human; identical to SEQ ID NO: 35594

SEQ ID NO: 46954 - DNA, 601 bp, Human; identical to SEQ ID NO: 35595

SEQ ID NO: 46955 - DNA, 601 bp, Human; identical to SEQ ID NO: 35596

SEQ ID NO: 46956 - DNA, 601 bp, Human; identical to SEQ ID NO: 35597

SEQ ID NO: 46957 - DNA, 601 bp, Human; identical to SEQ ID NO: 35598

SEQ ID NO: 46958 - DNA, 601 bp, Human; identical to SEQ ID NO: 35599

SEQ ID NO: 46959 - DNA, 601 bp, Human; identical to SEQ ID NO: 35600

SEQ ID NO: 46960 - DNA, 601 bp, Human; identical to SEQ ID NO: 35601

SEQ ID NO: 46961 - DNA, 601 bp, Human; identical to SEQ ID NO: 35602

SEQ ID NO: 46962 - DNA, 601 bp, Human; identical to SEQ ID NO: 35603

SEQ ID NO: 46963 - DNA, 601 bp, Human; identical to SEQ ID NO: 35604

SEQ ID NO: 46964 - DNA, 601 bp, Human; identical to SEQ ID NO: 35605

SEQ ID NO: 46965 - DNA, 601 bp, Human; identical to SEQ ID NO: 35606

SEQ ID NO: 46966 - DNA, 601 bp, Human; identical to SEQ ID NO: 35607

SEQ ID NO: 46967 - DNA, 601 bp, Human; identical to SEQ ID NO: 35608

SEQ ID NO: 46968 - DNA, 601 bp, Human; identical to SEQ ID NO: 26801

SEQ ID NO: 46969 - DNA, 601 bp, Human; identical to SEQ ID NO: 26802

SEQ ID NO: 46970 - DNA, 601 bp, Human; identical to SEQ ID NO: 26803

SEQ ID NO: 46971 - DNA, 601 bp, Human; identical to SEQ ID NO: 26804

SEQ ID NO: 46972 - DNA, 601 bp, Human; identical to SEQ ID NO: 26805

SEQ ID NO: 46973 - DNA, 601 bp, Human; identical to SEQ ID NO: 26806

SEQ ID NO: 46974 - DNA, 601 bp, Human; identical to SEQ ID NO: 26807

SEQ ID NO: 46975 - DNA, 601 bp, Human; identical to SEQ ID NO: 26808

SEQ ID NO: 46976 - DNA, 601 bp, Human; identical to SEQ ID NO: 26809

SEQ ID NO: 46977 - DNA, 601 bp, Human; identical to SEQ ID NO: 26810

SEQ ID NO: 46978 - DNA, 601 bp, Human; identical to SEQ ID NO: 26811

SEQ ID NO: 46979 - DNA, 601 bp, Human; identical to SEQ ID NO: 26812

SEQ ID NO: 46980 - DNA, 601 bp, Human
acccgggcactagatggccaagtcctccggtctggcccgcccgctgctggccctgctggccttgctggcccgacctgggtctccgaggggcaagggcggctggtgcatctgggccgcggtggtcacggcctgctcctcctcctcgggggtccctgccagggcgctcccctccagactgctgccgctcccatccagcagcaggggcgccgcgcccgcctcagcctcgtgcgcgagtggcggggagctgctgccgacggggctgggggctgcaggcgtggacgctgccgggtaagccttgagygccgggggctgccgctcggccgcctggttggcccagttctgctcagtcatcagcaggtggtggtggccgttgtagagcttggcggactggccctttccgcgcgcctcggtcagggctagcattttgaagtccgcggctggtggcggggccccggggtagcccacggcgcgggcctgtcccaggggcgcagcggtgtgcgcatagtagggtgggaacccgatggcaacggcgggcggccgggagctggggggcaggggcgggggatcggctgtccccagcggggcctcggaggcgtccggg

SEQ ID NO: 46981 - DNA, 601 bp, Human
gcttgataattggttgtgtttagtagatatttggagatgaggaacataaaaaatgcaaaatcagtacttttctgtaatgtcaacatatgtatactaacggaaagcagtgctgcttttacgtaataccagaatggttcttgttttgcttaacgatttagcttagagttgaacatttctttacttaaaaacagcaactagtgatgctgctatgtgctagacagtaagatgaagataacctgatgatttttaattggccttgactaaataagtacttttattatacagtaggaacatatgtaartgcttttagatccatttacaaagtattttgacagttaaaaatactttgcatatttatggcatatttctttagtgcatcctttctaatatctgttccctcccacctatccttttaaattgttgggaggaagatataaagtggtccctacttttccatgggctgggcttttgtatctcatgtggtgagacaatcctgaatcactcaagtatgacatatatgctgacatatgaacatttttaacttctgtgtggatatagagcttatattatctttgaacaacagtttttattttttcagttt

SEQ ID NO: 46982 - DNA, 601 bp, Human
ggtgaggctggtcttgaactcccgacctcaggttatctacctgcctaagcctcccaaagtgctgggattacagatgtgaaccactgcaccaggcctgaattcttatatgtctataattctttttttttttttggatacagagttttgctcttgttgcctaggttggagtgcaatggtgtgatcagggctcaccgcagcccctacctcctggtttcaagcgtttctcctgcgtagctgggattacaggcatgtgccaccacgccgggctgattttgtatttttagtatagacggggtttctscatgttggtcagcctggtcttgaactcctgacctcaggtgatctgcctgccttggcctcccaaagtgctgggattatggtcgtgagccaccgcgcccagcctgcttgtttttttacctaaagaaaaatttgcacttgttttaattagttataggaaaatcatgattataaaatttaacaagttttagctttataactttactatgaatattgtctcactttattttgatttttgtctgtcttattattgtatagtcctgtttcttagccaaataagtgttaactcctgcctaggaagtca

SEQ ID NO: 46983 - DNA, 601 bp, Human
tatcctccagaatctctgcatctttttctaacgatttcttcttttccctatacttttagaaagaaatccactgtctgatctgcactgtcaacactataacaaatctcttctgaggtcgctagtgacctaattgccaaatcttttaactgcttctttttgtcttaattctgtaacatttaaaatttttgcttctggggcttaatgtggtctcatagttatgaccacctccttcacttcccctcgctagactttcctttttttgagccagagttttgctcttcttgctcaagctggagcgcartggtgtgatctcggtccactgcaacctccgcctcccgggttcaagcgattctcctgcctcaacctcccgagtagctgggactacaggtgcactgggattacaggtgcgcgccactgtccctggctaatttttttgtatttttagtagaaatggggtttaaccatgttagctaggctggtctcgaactcctgacctcaggtgatctgcccaccttggcctcccaaagtgctgggattacaggcgtgagccaccgcaccagacctcccctcactagactaatgttgagacctttaagtgtcc

SEQ ID NO: 46984 - DNA, 601 bp, Human
ttaacagaataggagtcttgctgcatgggatattgttaagacttggtgggcctttgttaatataagagaaaattggtggcctttcagaatttaagtagtatttttgtagatacatatttaagagtgatttttgtgtgtgaactgtttattttttgtcatttattctatttgattgtggtttatctcattgattgtaggagctctttgccttcattttattacgatatgacaaaaattttcttttcataggatatcattgtttttggtatttttttcccccatatggtgtcttcttttcttaaaaaaaaaaaaaaagtatagtaacataagaccattttttaccatttttaagggtacacaattttgtgacattaagtacattcacagtttcttgtaaaaatcaacattatccattgccagaatgttttcatcatcccaaatagaaaccatactcattagcattccttgtctccccttcctcaagcccctggtaacttctgttctaccttctgtatcgaactacctcatgaatggaatcacaatatttgtccttttgtgtctggcctacttcacttagcataatgttttcaaagttcatcta

SEQ ID NO: 46985 - DNA, 601 bp, Human
agttagaattgactggaggtagaagagtggcggctacatggagtagattttactttgataatggagaagtggtcaacttctaattggattgtctttctttaaaggactaagtagatgttttctggttgaaacattatttctatgatatgtagaagtgaccaatattatttacagtctatgattttaagatagctgtcatagttgaatggttattctgtttcgagaagtagattgctgcagggatctaactgtggtaaagaaagacctattttaggctacactattttcttctaaggagatygaattgacacatagcagccaccagagggaactgtgatatcagttctagcttttctgccccagaagtggttttcttctgttttaagtatgccaaaacaaaggagccaaataacttatatattaaaagcctacacattttataacatctgtagatttgggctgagctgttacctcatttctgtgaaaatcattatgttgatcaggtactttccttatgacaagtgaatgttaaccgcaaattcagcttcattgtgttttttgttgttgttgagacggggtttcactctgttgcccaggctgg

SEQ ID NO: 46986 - DNA, 601 bp, Human
agaactatatagccagtatctcctcatcttttcagataatacactatgaaaattaggccaaaccactgtatataagccacttcaacttcctattcatcctatctacaatttaatctatagtctatacttgcccttcagttttacctcttctagttggttccccttgcattttgccccccaagtttgatctgtgagatcaaaatggttcttgttcagagttagtgatattaccacctgagcccatgatctgtctcatctccatttgctcagtaactttgtcctagaaattttctctctgtgtgtgtgtgtgtgtgtgtgtgtgtgtgtgtgtgtgtacgtatgtgttttcttttgagacagggtttgctctgttgcccaggctggaatatagtggcacaatcgtagctcactgcaacctcgaactcctgggctcaagtgatcttcctgcctcagcctcctaagtagccaggactacagatgtgcgccaccatgactggctgacttttaaattttagtatttagtagatttgaggtcttgttatgttgctcaggctggtctcgaactcctgggctcaagcagtcctcccacctcagcctccca

SEQ ID NO: 46987 - DNA, 601 bp, Human
gccccataggcagaggttgcagtgagccaggattgcaccactgtattccagcctgggtgacaaagtgagaccctgtctcaaaaacaaaacaaactctgtgactttttcatgacatgtctgtggatgtctctctctctctttaacctctcccccaattcctctatgtgtgtgtgtgtgtctatcggcgtttctctctcacatgcctctctctgacccattctgtcatcattttaggctcattatcctagggattgtggagaataatgtgaagtaactaaaatctaggcaatgtagaatgctrtatgaattgctagttatttttcttatttgtcgagtaatgtctgattattgaagactgcttagaaaatctataatttaaaacaagagctggtgccaagcatggtggctcatgcctgtcatcccagcactttgggagaccaaggcaggaggatcacttgagctcaggagtttcagaccagcctctgggcaacagagcaagaccttgtctctactaaagataaaaaaaaaactagccagggctggttgcggtggctcaagcctgtaatctcagcattttgggaggtcaaggtggacggatcat

SEQ ID NO: 46988 - DNA, 601 bp, Human
ataaaatcttggctatttatattggttcttggactaattgttaattgggaaaatttaccagctatcctttcatgaaatcccttgtatgaaattgaaggtttagacaaaatgattaggccttttctattcctaaaaaatttttttgatgttggaggaaataaaaatgtaaaactagggcaaatgtaaattgaaaatagagaagcaccatttttttcagtgtcaaggcaatagatgcccttaagttttgataggctcttttaactatgtattcaagtgacaagcctacaaaatagaacacccygaggagccactatttgtgtgggcaagagctgtttcttttagatatgttcaagcataatttttgattggaggccttttttcctttcttaagatggaattaccagttcttctagtgactttctttctcgttgattagatttttacccatttattgaaactggtcagttactgtgatgatagttaaataacagaattccagaatgcactctttattctaataagtttggtgtgttcttgtttttgtttctccaactaaggggtatgaatacagtcaggtaagatctgaatagcccctcgaaac

SEQ ID NO: 46989 - DNA, 601 bp, Human
ggttaatatacttagtgactgtaagttgaagccagtgctcatttaccattctgaaaattgtagggtccttaagaatgatgataaatgtactctgcctgtgctttatcagtggaacaacaaagccccgatgacagcatgtgtgtttacagcatggtttactgaatagtttaaactagtgttgagaccttttgttcagcagaaatgattccttttaaactattactgcccagtacacctggtcatccaagagctctgatggagatgtacaaggagatgagtgttgttttcatacctgctaccrcaatattcattctgtagcctgtggatcaaggagtaattttgacttttaagtcttactatttaagaaatacattttgtaaggctataactgccatagatagtgattcctctgatggatctaggcaaagtaaattaaaagccttctggaaaggattcgccattctcagtgcccttatgaacatttgtaattcatgggagaaggtcaaaacagcattattaaccagagtttggaagaagttgatttcaaccctcatgaatgatggtgaagggttcaagactttagtggaggaagtaattgtag

SEQ ID NO: 46990 - DNA, 601 bp, Human
tgtatttattcatttgaggtaggtcatttccgtgatataatgatggagttaagtctgggtaaacccgttgtaagttggaaatgtcttagaatgcacctttgacctaggtattttcaacttagaatgggtttatcaggatgtaactccattcttagggaacatctgtgtatgtagattattggcagtaaatttaagattttacatgtaatggtaaatgctatcagaatgattcctcttttgaatttatttcctctttgggagttggagaggggctgcaaatatttcaaacttttaaacctcrgcttgaagtggtcgtattgtttatatttaaattttaaggttaatgttgttatcattttttttttgagacggagttttgctcttgtttcccaagctggagtgcgttggcgtgatctcagctcactgcaacctccgcctcccaggttcaagcgattctcctgcctcagcctcccaagtagctgggattacaggcatgcgccaccacacccggctaattttttgtatttttagtagaaacggggtttcaccgtgttagccaggctggtctcgaactcctgaccccaggtgatccacctgcctc

SEQ ID NO: 46991 - DNA, 601 bp, Human
ctctactaaaaatacaaaaactagccaggcgtagtggcaggcgcctgtaatcccagctactcaggaggttgaggtgggagaatcgcttgaacccaggaggtggaggttgcagtgagccaaaatcatgccactgcaattcagcgtgggtgacaaagcaaaaactccatctcaaaaaaaaaaaaaaaacaacaacaacaaaaaaaacaatttctcaatccattttgcatatggtggaaattgtagctgtataatctccaaatgacttaatttagaaagcttcgagtttcattataagtgttamcagtttttaaagagatcttagaacactccaaattagaagtgattttactcagaaattagaggtgagtcagatctaagtatctatctttaattccttagcccattattactgttttatcatcataccattttttctaagataaaattatttgataattctttaagttgggcaacagtagtggggacaggacaggcagacatttttaaaagttggaatgagtttgtaagtcacaaaatataattgagaagcaacttttacataatgcttatttacctttcaatgtagcagctattctttatg

SEQ ID NO: 46992 - DNA, 601 bp, Human
tgcctacctgaaaagttaaaaaaaaaaaaccctttctttcaaaaaaatttctaagtctgtgttcctgttaatccagataaatgaattagtaatgagtaataagtgtttaaaattaggaagacttttaactgtagtacagttatcaagataatgaaatttacatcagtaaactattattgtcaggttagtcaatagagcgtattcaaattttgtctgttaatgtcccttacagcaaatgaaaaacaattatttcttgtctagaatccagtacaggatcataggctattattattcctcttctttttttttttttttttgagacagagtttcgctcttgttgcccaggctggagtgcaacggcaccatctcggctcaccgcaacctccgccccctgggttcaagcgattctcctgcctcagcctcccaagtagctgggattacagtcatgcaccaccacacccggctaattttgtatttttttagtagagatagggtttctccatgtcggtcaggctcctgacctcaggtgatccacctgcctcggcctcccaagtgttggcgttacaggcgtgagccaccgcgcccggcccattatttcttt

SEQ ID NO: 46993 - DNA, 601 bp, Human
ttttgtgtgtgtgtctaattttctagttgttaaaggtgggtgggaggtttaaatctaatttctgttagttgggagtggaagttacctctgctttaatctaaatagttccctagtttttgtttgtcttttatgacttgacattttgaataccactttggagagcatccctcaattcgtgtttgtttgatagttcctcaagattagattgaggtaatgcatttttggcatgaatacctcataagcggtgttgtgtccctcttcgtgcacatcaggaagcacatgatgtctatgttttccattrttgtgtgttaacttgtttaaggggatgtctgtcaggtttctccagggtaaagttgctatttttccctctgtatctgtttaagttaagcaaacttttcacccactatttttagcatctgttgtcaattagaaaaaaatccttaaattacaaagttagaataagtctgctaaaagaaaaattgtaaattaaacagtaatagagaaaagtaaaacatgatggtatatacatttttaaaccgttttttctctgcacagacaaatcttgcaatatgaagagatgatttccaggttttattgaata

SEQ ID NO: 46994 - DNA, 601 bp, Human
gctcactgcaacctccgcctcctgggttcaagtgatttcccctgcctcagcctcccaagtagctgggattacaggcgtgcgccaccatgctcagctaatttttttttttttttttttgagacggagtctcgctctgtcgcccaggctggagtgcagtggcgtgatctcggctcactgcaagctccacctcctgggttcacgccattctcctgcctcaacctcctgagtagctggtactacaggcacctgccaccacccccagctaattttttgtatttttagtagagacggggttttaccrtgttagccaggatggtctcgatctcctgacttcgtgatccgcccgccttggcctcccaaagtgccgggattacaggcatgagccaccacgcctggcctaatttttgtagttttagtagagacggggttttgccatgttgaccaggctggtctcgaactcctgaccttgggtgatctgcccgccttgacctcccaaagtgctagaattacagatgtgagccactgcgcctggccaacataggcctatttcactggtagacttggaatgaaaattatagtagggatgcagtggcacaaaaca

SEQ ID NO: 46995 - DNA, 601 bp, Human
gattggattatttattctcatgtgggagtggaaaaccaacaaaggatctatgtctttttaggtccaagaaaaattactgaagtcatattcctgatatattgtataagttcataatagtgtacagaatgtcactttgtttagctacgtacctagagcaattgtctttcctttttttgtcccatgtttctccctgtcctgtattatctgagaacgatattttctatcactcagtacctgtacatattagaatgtatcagtcatataccacattgtcatttataaaatgatacaattctgtaawtgttttttttttttttttttctttttttctcagagtcttgctgtgttgcccaggctggagtgcagtggcacgatctcggctcactgcaatctctgtctcctcagttgaggtgattctcctgcctcagcgtcccaagtagctgggaatacgggtgggcaccaccatgcccagctaatttttgtatttttagtagagacggggtttcaccatgttggccaggctggtctcgatctccagacctcaactgatccgcccacctcagcctcccaaagtgctgggattacaggcatgagccaccat

SEQ ID NO: 46996 - DNA, 601 bp, Human
taggggtggggcagggtgggaggtagtgcatggagtatatgataaaatggtatacaagatttagaagatgtagtattaacactgttcttgagccaaaatttattaggagctgttggtgagtcattcagtaactaagtcttaagtgaaaggtggtacccagaactggattacatgattttttttctgtctttttttttttttttttttttttttttgagatggagtctcgctctgttgcccaggctggagtacaatggcgtgatcttggctcacttcaacctccacctcccaggttcaagcrattctcctgcctcagtttcccaagtagctgggattacagatgcctgccaccacgcctggctaatttttgtatttttagtagagatggggtttcaccatgttggccaggctggtcttgatctcctggcctcaggcaatccgcccgcctcagcctcccaaagtgctgggatcacaggcgtgagccaccgcacccagcctggattacatgatttctaaagtactttggaaacctgaaatttcattttaacagtttaatgactggaacattttttagtttattatttgctttggtgctgtctcc

SEQ ID NO: 46997 - DNA, 601 bp, Human
ccttccttattctggtcttcacatgtctttgctaactgtaaagtaaatggtttagacttagtctgtagcctgctcaataatgagagaaaagctgcctccctggaagttttaacttgttcatacctgcttgggttaatatttgaaaagtagctctggctattgtgggtttgggcccaggagaaacaaattattactaatcatgttccattcaagggaaacaactcagtctcaggttcagcagcacgctgtgtgatggcaccaaattgaatacttcatccatgatacatctgttactattaargtgtgtggtaggaatgtgatggagcctacttgtttatactcaacaaagaatttttctttttgactgaaaatattattagtgccataatttttatctttctttagtttacctatgctgtattttccatcattttcttcccatttctccaattatgttagcaacaccagtctatcatcttatttagtgatacttttacttccattaagtaattttagggtagctaatggcactgaattttgtggagctatgtttaaatttggcagtgaattggttaaactaggcatccatggcctgtaggaa

SEQ ID NO: 46998 - DNA, 601 bp, Human
tgaggtggtcgtcatatacttaccaaggttcccattgtgcatttagaacaaagtgcatcagttctgcagcaaaacttgttcagatgactataagaagttgcattgcatagttacatattgcgaatactgtcaagaggagaagactcttcatgaaacagtaaatttctctggcgttaagagacctttctgtagtgaaggcaagttgcatatacagtgttgttcataacatttattgatatttaatgttttttgccaaaataatatatccagagtggctgcacaattttaatgtagctgaacmaaaaaaattgagtttacgtttctactgacttgtttcgttattttatatgtgtttgtagatctgggcttcaagatggttttatctctaaacatttggtaacctcttatttcattaaagttttagaataaaataaaagcattttcatgccatgttatttctaaacctacatgttgtggtctgaaagttggttttccaagtggtttaaaattgttttccattagctccattttccctgcccagcttactacctaacctgcaaaggttttcaatatgtataccagaaagaaaatcacatatggc

SEQ ID NO: 46999 - DNA, 601 bp, Human
gttagcaggtaattgttttggatacttgagatatattttaaaaacatcttgctcttttttggctttttgcctttttaattgtgagttttgggggactttaaaattgaaaagaacactaagtagagaccagaaacatttaatttgaaaccataaatgtgtgtatgtgtatgtgtcatactaaacccactttaaaaatttaacttttaggttcaggggtacatgtgcaggttttttatataggtaaatttaggtcatggtaaatgatgggtaaatgaccaaacatgacccaaatttaccaaartaaaaatttgggtcatgttgtactgattattttatcacccagatattaagcctagtacccattagttatttttcctgattctttccctcctcccaccctccactctttcataggccccagtgtctgttgttcccctgtatgtgtttgtgttctcatcatttagctcccacatataagtgaaaacatgcagtatttgcttttcttttcctgtgttagtttgctaaggataatggcctccagtcctatccatgttcctgcagggtatataatctcttttttattgctgcatagtattccatg

SEQ ID NO: 47000 - DNA, 601 bp, Human
gttgctttatagtgtcacttgtctgtgtacttaagtgtgtttttgtagtggttgttaatggtctttccatatttagtgcttccttcaagagctcttataaagcaggtctggtggtaacaaataccttcagattttgcttgtctgaaaaggatcttatttctgctttacttaatgatgcttagtttggtgggatatggaattctggttggcaggtggcactggtgttaaattaaaaaaaaagggttgaatattggcccccaatctcttctggcttgtagggtttctgctgagagatctgctrttagtccgatgagtttccgtttgtaggtgacctgacctttctctctagctgccttttaacattttttctttcatttcaaccttggagtatctgatgattatgtgccttgagaatgatctttttatgaagtatcatactggggttctctacatttcctgaatttgaatgttggcctctctagctaggttgggaagttctcatggatgatatccagaaatatgttttccaagttgcttatactctccccatctctttcagggacaccagttgagttatagatttggtctctttacgtaatgc

SEQ ID NO: 47001 - DNA, 601 bp, Human
ggggtgcacacttgttggctgtggtagggtgctagttggtgctggggtgcctgcctcccagcctgcacttgccacagtggtggatgcaatgtggctagggggtggagtggggaacccctgttggctactgtgcctgtggttgcactggtggtggtggtggtggcagggcgctggcaggtgcaggtctttgtgcattctcagagggctcttggtcgctcagggaggtggagtgtccactgttctgtgtgcctagttttgctctgggcagtgttgctgaaagggccaggttgtggtgggggcrgggctgactgctaaggctccaactgcagtgtcgttggtggggcaaggtgggggtgaagtgcactcctgctgcatgagtggcagggcagggtgcacacacacacgtgggtgctggctgggtgaggcaagcaaaacctgcctgcacatggcaaagggatgtgggaagtatccatgggccccaggggaagctgcagtgtggggagggaatgggtggcactgctgcgtgtctgtgggggccaccccactgggggtctccagtggtcaagttccgtctgccagggtagaagctatgatgggggct

SEQ ID NO: 47002 - DNA, 601 bp, Human
gattattaatggctttatgcatttatttttcaagtagagatctgaagatatatgttggtggctagaattttttgagtttaacaatttgggaaatacacagtgtgtcctggattttttttcctccaatttatttttcttttggtgtaatacatcaaattctacacttttgttagcattttaagagttttataggttgaaagtggccattgatgttactaatgactactaaagataagaggcagtgcttttgccactgcctggccttggcatgctgcatcttacagcagtcaccagtggtggrtcctgctatttctggcatccttatccgagggaagctctttgggagtcatttattggcaataaagtctctgggctagttcttgttgtgttacaaaagaacagattagtggttcctagctctgactactcattagaatcacctggcaacttttcaaaaccttccagtgcctgggtttcaacccaaaaattctgtatttttaaaaagttctggctgggcacgatggctcacgcctgtaatccctgcaacaaggcaagtggatcacctgaggtcagaagttcgagaccagcctggccaacatgg

SEQ ID NO: 47003 - DNA, 601 bp, Human
tttattggcaataaagtctctgggctagttcttgttgtgttacaaaagaacagattagtggttcctagctctgactactcattagaatcacctggcaacttttcaaaaccttccagtgcctgggtttcaacccaaaaattctgtatttttaaaaagttctggctgggcacgatggctcacgcctgtaatccctgcaacaaggcaagtggatcacctgaggtcagaagttcgagaccagcctggccaacatggtgaatctccatctctactaaaaatacaaaaaattagccgggcgtggtgrtgggcacctgtaatcccagctactcaggaggctgaggcaggagaatcgcttgaacccgggaggcagaggttgcagtgagccaagatcgcgccactgcactccagcctgggtaataagagtgaaactccatctccattaacaacaacaaaaaaaagttatttaggatgctgatatgtaaccagacatgagaatcactgatatagatgaaaattggtatttttacatttattctattcagtgtttgtttttgatgttaatagttggacagaatcctagaaaagtaagaatactttttccata

SEQ ID NO: 47004 - DNA, 601 bp, Human
atttaggatgctgatatgtaaccagacatgagaatcactgatatagatgaaaattggtatttttacatttattctattcagtgtttgtttttgatgttaatagttggacagaatcctagaaaagtaagaatactttttccatacccccccttatggaaataacattttaaaatcagataatttggaagtacgtaaagtattcacttgaattatctgattttaataccagacacttttatccatgctgagggtatgaaagatgactactccctattttatatttataaggcaactattagcrcgatattaaatatttttctcctcctacagcacttgaaccaaactatatgacagagggatagagggagcattattaatagggaaggataagtaaggctgccattgcagctgttgccttttgtcatataaagtcctctcccatcttttctttgtaagcttttggaatcttctaattctccacccataaacttcaaaggataggagcttagctgtataattttgggcaagttacttcactgttctttttgtgagtttctttatttgtaaaatcaagatgaatatagtacctacctcatgttga

SEQ ID NO: 47005 - DNA, 601 bp, Human
gaaatgcccttggccttaattcatccaaagagtgtgcaagcttgttattgtataccaatgccaagggcacctttaaatgcaaactcttgatacacagagctcaaaattcttgagcacttgcaggggaaaaccagaagtgtgtatcatttccattggaggtgggacaaaaaagcatggatgatacccaaaatattctgggattggtttcattgcttcatcctagaagttgaacactatcttcagggtgaaaacttagccttcaaagttttattactggataatgccccagttcattgctgtraagaacttggaagtgcccatcccaatgtaggagttcttttcatgcccccaaatactagtctcttctccagcccctcagacagggcattttaaaggctttcacggtgtaccacatgagggagctttgtaacaaggcttgtgaggctctcaatgccgacaaggaaaccaccatggatagactcctggaagcagtcacaatatgcatcttcttgattatggcgacacaacctgggggcagtataaagcagtccattgataactgttgggaagatgtttgatcagactgaaaaggtgttaaaga

SEQ ID NO: 47006 - DNA, 601 bp, Human
gcgctactgagaacatgccttgagatgcttaaaggatctgaggttaaaagctaagctgccaaggctgacacaatttttggagccactttgggtaagaaaatcactgacactgtcaacaaggcacaagagccagttctacaacctcggttttcatggggcacatcaaaggttgagaggtcagaccacacagcgcagtacctcatcacacattctgcagctccatccacagtgaaattttattaatgtttgttttgtttttgctttgttcttgagacaaagtctaactctgtcatccaggctrgagtgcagtggcaatatcttggctcattgcaacctctgcctcccagggtcaagagattctcctgcctcagcctctagagtagctgggactagaggtgggcgccaccatgtccggctaattatttatttatttttatttttatttatttatttatttttgtatttttagtagagatggagtttcaccatgttggccaggctggtttcgaactcctgaccttaggtgatccgcctgtcccggcctcccagagttctgggattacacatgtgagccaatgcccccggccagcttttgtaaaac

SEQ ID NO: 47007 - DNA, 601 bp, Human
acagataccattggggttttctgttttgattcctaatgataatatggattgatttcaggtgtaattattgaaacagatataattggttcagaccttttgaagaactctgacccagagacacagtccagcatgcctgatgtaccatatgaaccagatttggatatcgaaatagattttcccagaggtactcaaaacctttatgactatggaatttagttatggagtcaactgtggttatgatcatttaccatttgatgtttgtgtcattgccttttagcagtgttcatattttttattcttattattttttaaactcaccttaagagttaacttcatattttgttgttgtttttttttaaaaacccaccttaacagttaacttctggaatgagatcacttgagtccaggagttcaagaccagcctgggcaatgtggtgaaacactgtctctactaaaaatataaaaattagccaggcgtggtggtgcatgcctgtaatcccagctactcgggaggctgaggcaggaggattgcttgagaccaggaggtagaggttgcagtgagccgagattgtgctactgcactccagcttgggcagcagag

SEQ ID NO: 47008 - DNA, 601 bp, Human
atacaaaaattagctgggcgtggtggtgagtgcctgtaatcccagctactggggaggctgaggcagaattgcttgaactcaggaggcggaagttgcagtgagccaagactgcaccattgcactccaacctaggcaacaagagcaaaactctgtctcaaaaaatatatatatataaaaaatatataatatatataatacataaatataattttatatataatatacatcatgatgtatataatatataaatatatatttatatattatatacatcatgatgtatataatatataaatatatmcaatatataatataaatataattttatatataatatatattttatatatattatatagtttttatatatataatatatatagttagctttttttaaagatcctttgaaaattaagttcaccttcaaaggaaaaattattttcaggtcttttgtaaaataagtgtgccccatttttcattattttcttaatccatggatggctaatgagcacactgagtagaatgtaaaacattagtttttggaaaaaacatttaatagattgaatcagatttgtaccaagaccatttagatcttgtaatt

SEQ ID NO: 47009 - DNA, 601 bp, Human
aagtctttgtacttctgttaacggaaggaaagtcttgagtgttaattgtccaggttcttggcgttttgaacaaaggattggacaaaatgcgtaaacaacaaaggaacgaagcagcgaaagcagaaatttgttaaagcaagaaagcactgaatagggtgggaatgggcctgagcaagtggctctagggctgagttacaaagtcttcttggttttaagtactccttttgaggtccttattggttgccccttatctggatgaaggatttggtctaatactaataaaaggctgaggtgaattggmcccctgtgcagatgaagggatggtccctgcttggcccgtggccagtccagggcactctctctttccacctgagacctggcagaagggagaggattgtagggagagtagcctttgctatgtgggcatggggagatggggttttcctttctggttcagctttaggaagttggcattaattggccttaagttccctgcccccaggtgttttcccttgattcaccatgaatgactttaatttctctgcctccagaccccatctttctgcctcagttcaaacagtcatgctgccctggatccagt

SEQ ID NO: 47010 - DNA, 601 bp, Human
ttaatttttctcttgtattgagtctgagttgtattatttcctttcttaatttgctctctttttatccagtttcttaagatgtaagcttagataattgattttagtgtttcttctttttcaggaaagcatttaaaactaaaattttctctaaaactagtttacttacatcacgaatttttatatgttgtgttttaattttccttgacttaaggaaaatgctatcacaggaagttgaatctctggattgccttttattaaatgattatttaaataattaggacttcaataccgttaagaggtyttgagagctaagtggattgtgtaataaattatgaagtatgtcttaaatagtttttttttctctcagtttttgttgtagtaaaatatacataacataaaatttacggttttaagcatttttaagggtgcggtgcagtggcattaagtacattcacattgttgtgcaaccagcatcaccatctatctctagaactcttttcatcttgcagaactgaaactctgtactcattaaataataactctccatttccttctctactgagccctgtaagccacttttctactttctatctctatgatt

SEQ ID NO: 47011 - DNA, 601 bp, Human
tgatttgagagacttagaagtagaatctaatagccctcaaattatgaatgtcttatattcccaatatttaattttataaattgttatgtatattgtttgcacacagtgtttcttgctttagctagctctccgaaacatttgaccatatgtttgtcatattagtgacaatacttgtctgaacaaacatgccaatagtctgaacatatctaaaatacatgcttttcaactctctgttagctgtgttttatgagattttcattttgcttctcaagtactagtaccataatttctgtttaagtaratatctgtcaacgtgctgctttgccctacaaagcattttttatccataagaaacagggcctttgaaatgtgggtagtctgaaatgagaagtgttctgagtataaaatatatacaagatttcaaagaattggtatttttaaaatgttaaatatttttatattatatgttgggattacatgttttggatatattgggttaagtaaaatattatactttttaacttttaaaatgtggctactagaataaagttaaatgtataacatgttacatttttatcattcagtactgctctttacagat

SEQ ID NO: 47012 - DNA, 601 bp, Human
ctttctgtgatgattttttttttaagaaatctactcttcagacaggcctattctatctataagttgctgctcttcttcgcagcttctcctttgcctctgttcctgaaaccacacacaggatttcttctgtagattctcattggttgcaagggctttggtgctaagggagccatatgtgtatagattagatgtttgtaagttgtgactgcctatggtggaaaataacagcaacaataatatggcattgcttcccatactaccacaataagtaataaaacattttgtaattcattctgtaacaacagcagatcatttatcatggattgcctagagaaaccttttcaggaggattaagtgttcgcacttcatttaggaactgcttttagtagagctgagttgggaacttagtttttggtttattattgctaaggttctaaatgttacatagaaattttctctttgtactagatttacagatgaaaataattatttcagaatcatttccctcattttttattacacatgttgctttatgataaaagcaaaaaatataaattgctattctaaacttggggattttactttagtgattgttttatgt

SEQ ID NO: 47013 - DNA, 601 bp, Human
cttttttttttttatagtatttgtgtggaagtaatcgaaaagacaacatatttattgatcctggataccaaacatttgagcaagaattgaataaaatactgcgaagctggcaaccaagcatacttccagatggtaatgctattttcactaaaggtgttgctctcttgatattaggattgttatttttacagagtatgtttgaaaatattataattaagtcacttaaattagataacattttctgaacacttactcgagctcatctgcctttcatctcttgttgaattagaaacaaatgtgktcaataactagtgtttatgaagaactttgtaagaaatgtaatctactttctctggagtacgagactggatgttcatgtcttaagccttccagtggagcttctgatgtaaatttctcttaaaccactgttttcagtccgtgaagaaaatgtgtatgtatgtggagtcatcaatttttttcaggaatttaaattcctgaattttaattttaaaaggatttacactgttttctgaccactgtttgcttgtcctactgaagaacagaagcaaacatccagtcccttattccatagataatagtt

SEQ ID NO: 47014 - DNA, 601 bp, Human
accttgttggtattttaaaaattgagtttctattatgtagtgctgtaagaattttttaattttatgtgctgccatacatatttcatcaattctaagacattttcacatttcactatttctgaaactgggatgcacagtttaaattgttgcatcttgaaatcataattggcagtgtttcacttgcttaatggtagcattaaaataatgagtggtgtgtctattgatagtgtcttggatttagtgaagtagaattaaaattgtgggaaataatctctatctcagaaaataactttgagaataytttaatgacagaataatggagacagtggggcatagggggtctggtcatataacgtgattaatggggtctgaattattcttgaaaaaagaaaaagttgtggaaattttgtgaaattgactttttctctttttcctcccgcctccaaagtccacagaatcttaatcagaggatggatgttttttatttgcaaccagaatgctctagttctacagatagccctgtctggtatacgtctacttcactggaccgaaacaccttggaaaatatgcttgtacgggttcttctagtaaaagatattta

SEQ ID NO: 47015 - DNA, 601 bp, Human
acagcaggagggagtgcaggaagctttgaaaacacaagcagtgatttgatttgagaagctgtgtccagctggaggcatttttttttctttttgagaaggagtctcgctctgtcgcccagtctggagtgcagtggtgtgatcttggctcactgcaaactctgcctcccaggttcaagtgattctcctacctcagcctcccgagtagctgggattacaggcacccatcagcacgcctggctaattttgtgtttttagaagagacagggtttcaccatcttgaccaggctggtctccaactctygacctcaagtgatccacccaccttggcctcccaaagtgctgggattacaggcatgagccaccgctcccggccccagctagaggcatttttaaacctcttcccttccattggatgttgcctccactttaaataggggctgcatcttcaggacgcagactaggaaagacgcttctgctccaggttctggagtacctaagcttgacctgccctgggagtagggtggggaatggcacttcacgtttgatagagcggagtgtctgctactggtggaggcactcacgtttgatacagtggttggtg

SEQ ID NO: 47016 - DNA, 601 bp, Human
aataaataaataaataaataaataaaaattaaaaacaaagaagtggagcagaacttggtacgtgagggatggaggagacagtcgagggcccaagatccagaagaacaaggccggtgggggccactcaagcaagagtggccagggcagcccctctgaggaggacacctcaaaacagagactgggtagatgacaagggccagccgcacagagagatgacggggagcagacacagaggcagcagcatgtgcaccagcctagaggccagtggcccaggctgcactcagggagctgggtgagtgtrgagatgccgctgcaggaagtttcaggtgggatgtgttgagggcggcagggagagcgggcagcaggctgtggtatcacccaggagagctgtgacagggccctggcccagagaggcagcagggaagcaggcaggtccacgagggactgaggaagtaaaacaaacagggcttggtaatgggttgatgtcaaagcctgagtgagaggaaggtgtccctgtagcccctgggtggctggctcgagcagtcaagtcgatgggggtgccagttaacagagtgagtaagacctgcacgggggagttagc

SEQ ID NO: 47017 - DNA, 601 bp, Human
aaataaataaataaataaataaataaaaattaaaaacaaagaagtggagcagaacttggtacgtgagggatggaggagacagtcgagggcccaagatccagaagaacaaggccggtgggggccactcaagcaagagtggccagggcagcccctctgaggaggacacctcaaaacagagactgggtagatgacaagggccagccgcacagagagatgacggggagcagacacagaggcagcagcatgtgcaccagcctagaggccagtggcccaggctgcactcagggagctgggtgagtgyggagatgccgctgcaggaagtttcaggtgggatgtgttgagggcggcagggagagcgggcagcaggctgtggtatcacccaggagagctgtgacagggccctggcccagagaggcagcagggaagcaggcaggtccacgagggactgaggaagtaaaacaaacagggcttggtaatgggttgatgtcaaagcctgagtgagaggaaggtgtccctgtagcccctgggtggctggctcgagcagtcaagtcgatgggggtgccagttaacagagtgagtaagacctgcacgggggagttag

SEQ ID NO: 47018 - DNA, 601 bp, Human
tgctgccccaaagcagagaagagttgtctgtccatccccacagtcccaaggcttgtctgggaggaagcctcagtgccagaggggccccagaggtgagacaggctgggaggggtccctggggatgagtcttttccagagaagcagcttccaggggagacagttctaggctggagtggagccagccatcctcccacagcagcaccagccccgcgcccaggcccaggatggtcgggaaggatgagaacaccaccccaaacactgacaaatcagagaggccagggcaggggcatgaaggacagtktggccctgcagtcggagacccatgtttgagttctgactgtgggatctcacctggggccagtttcatcacctctgtgagcctcagtgttcttctctagaaaacagtaatgcattcaaacgcacgatttgccaggatggcaaacaagagagactgtccttttggggcttacaatttagtcagagggactgtcactcaataggtaaacaaagaagtggagcaggatgggcgtggttgctcatgcctgtaatcccagtactttgggagtccgaggcgggtggatcacctgaggtcaggtgttca

SEQ ID NO: 47019 - DNA, 601 bp, Human
gcatacagagtgatacaatggactttagagactcagaagggaaagagtgggaagggttgcggaaaaaaaactacatattgggtaaaatgtacactactccggtgatgggtgcactaaaatcttagacttcaccactaaacaatttatccatgtaaccaaaaaccatttgtactccaaaagctattgaaattaaatatatatataaaataagatctttcactgtctagaaatccaagaccccaaaccctgtgagccaagcccctacggcacaccacgactcacttagctctggttctgcctygcttgctaataatacattccgaaaacatgtagtgagcaccttatcttgatcagactgggtgccgaggccagaaaggtgaacaagactgggccctgcagagggagaagccctggccagtgggggttcccacattcctagaaaccattttccaagcagggaattaggtcttcagtgagggttagggctggcaaactttggttggtacaatgaacaaacagctcatgggaaatgagtggttagggggaactgtggaaatggcatttagtatataatagcctagtaaatcaagttctaaaaggc

SEQ ID NO: 47020 - DNA, 601 bp, Human
tcatgcagcttccacctctgagtgtgtggtccttgccccgaggatggcctttggaaaacagtctagcttccatccttcccctcctgagccctgagaacagcccatccttcacattaacaataagatccttcatacaacaaatatatgaaaaaatgttcaacatcactcgtcatcagggaaatgcaaattaaaaccacaatgagataccaccttatcccagccagaatggccattactaaaaagtcacaaaacaattgatgttggcacagacatggtgaaaagggaacacttatacactgcyggtgggaatgtaaattagtaccacccctatggaaaacagtatggagatttctcaaagaaccaaaagtaggtcaaccattcaatccagcaatcccactactgagtaaaggcaaagaagtcattctatcaaaaagacacccgcacgtgtatgtctactgcagcacaattcatgattgcaaagatatggaaccaacttaatgcccatcaaccaatgagtggataaagaaaatgtggtgaaccccatctctactaaaaatacaaaaaattaaccaggtgtggtggcaggtgcctgtaatcccag

SEQ ID NO: 47021 - DNA, 601 bp, Human
ctcgaaacccaatgcctcatccatctgtcgctcattcattcaacaaatagctgttgagccctagtgaatgtcaggcactgggacaaagtccttgtccatctggggcttgcggtcgagtaaaggacaccaacaggaagcaagaaaacaatagcatgatgtggcctcaggcagtttcaagggctgtgaagacaacccaggtgatgcaggggtccaggccgaaccaggagactcagatggggcggccagggcacctctctgaagagagagatgggagcgtgcaaaggaagcgaacccccaaagrcctgggcagtttcccaagcagaggacgaggcgaagaccaggctgtggaggctggaaggaacgtggcatactcgagaagccgccagagacccaggaaggccagggtctggtggcggaggaggtgtaggcaaggtcagtgaggaagaggaggcagatacacagaccctgtcatctcagggatcctaagggcacctgtgaaactaccaggcacagctacccagagcaggttcctgggttttgtgagctgaactctcctttctgagaagagtaccagaatccaaaccaggggctggccgggata

SEQ ID NO: 47022 - DNA, 601 bp, Human
tgttgccacctcctcccatccacccaagtcctcacagcaaagagatcctgcccattgacagctatcatgtattgaacactaattcatatcaggcaccacactaagtgttctactcacatggtctcatttaatctttcctgtcatcctatcaggtggacactattggctcagagaggttaggatgagtgcctgttaacacacagctggtgagtgctaaatccagaattagaatgcaccaaagcccgggctctaaccctcactactcaaaatatggtccgtggcccagtagcatcagcatccygtgggaccacgttagagctgatcatcctagacctgccgaatcagaacctgcatgttgacaagttcccaggtgacttacctactggtttcagtttgagaagtgctggtctaaaccactgctttccaaagcctgctggttgcaggttcctgtaaccagccctctcccatctctccaggcccttcccagctgcctggcttttgatctccaggtgaggcaggtactctgcccagccttggggaagaagccaggacatgaggctcaagggagtctccaggcccctccagtcagcccagacaacag

SEQ ID NO: 47023 - DNA, 601 bp, Human
acacacacacacacacacacactccagtttcctctctctgcttgttgccacctcctcccatccacccaagtcctcacagcaaagagatcctgcccattgacagctatcatgtattgaacactaattcatatcaggcaccacactaagtgttctactcacatggtctcatttaatctttcctgtcatcctatcaggtggacactattggctcagagaggttaggatgagtgcctgttaacacacagctggtgagtgctaaatccagaattagaatgcaccaaagcccgggctctaaccctcwctactcaaaatatggtccgtggcccagtagcatcagcatcctgtgggaccacgttagagctgatcatcctagacctgccgaatcagaacctgcatgttgacaagttcccaggtgacttacctactggtttcagtttgagaagtgctggtctaaaccactgctttccaaagcctgctggttgcaggttcctgtaaccagccctctcccatctctccaggcccttcccagctgcctggcttttgatctccaggtgaggcaggtactctgcccagccttggggaagaagccaggacatgaggc

SEQ ID NO: 47024 - DNA, 601 bp, Human
aagccttagaaaactaacacaggggccaggtgcagtggctcacgcctgtaatcccagcacttaggccaaggcaggaggatcgcttgaacccaggagttggagaccagcctgggcaacatggtgaaaccacgtctataaaaaaatacagaaattagctgggtatggtggtgcacacctgtagtctcagctacttgggaggctgagatgggaggattgcaagagaccaggaggtcgaggctgcagtgagctgtgacactacactccagcctgggtgacagagtgagaccctgtctcaaaaaawaataataataataattccagggctccagggagggggatagcaagtgccaaggccctgaggtgggagcatctccagcacatttgaggaaaatacagtcagctggcagagcagaagcaggatgaacacgggctgtgagtggtgagggtggacactggggatgtcagacaggctttggggccagatcacatagggccacccttgtggcaagcccttgataagagggagctcttccactttggacaagggtcccagttggaatgtgctgtagtgagtgggtgtggttggcccccatgatctctg

SEQ ID NO: 47025 - DNA, 601 bp, Human
ccccggacctatgaatgtgacctcgtttggaaatagagtctttgtagatgttgttaggtttagatgacttcacactggattagggaggaccctaaatccaatggctgaacccttataagaagaagacaacacagagacacacagacacacacaaggaagaaggccacgtgatgactgaggcggggtcaaggtcatgcagctacaagccaaggaaggccaaggattgccaacagatatgctagcagagaggcacagaaccttctccctcagagtctcagagggaaccaatcctgccaccttkatttttggacttccagctcctgagctataagagcataaatttctgctattttaagccactcagtgtgttatggaagccttagaaaactaacacaggggccaggtgcagtggctcacgcctgtaatcccagcacttaggccaaggcaggaggatcgcttgaacccaggagttggagaccagcctgggcaacatggtgaaaccacgtctataaaaaaatacagaaattagctgggtatggtggtgcacacctgtagtctcagctacttgggaggctgagatgggaggattgcaagagaccag

SEQ ID NO: 47026 - DNA, 601 bp, Human
aagccaggtctagtatcaccacatacagctgcacaggctgtgcactgcacaactcttgggttacctgtcacagagactataatgtgaaggacaacccctggtgttgtgtccaacagctgaaaggtccaatgcagaacagcaggcgtccctcccctgcctggctggaacacagtgcctcagacccatctggccactccaaatagtctctgctggacagggatgcactggggctggcagaggttgagtgccaagggaccctccacaagccttagtgtggcccatccacatttctagaacctaycctctgcaacagcagggagatggggcgtgggtggtgaaggaagttcttggctgagacaaaggtctcttcccactctcctcaaaaagcatgagcagggcttctgcaccctcagacttgggaaaataaaatctcttccattggatctggctggaggcctacagtgagcattccccttcttcctaacccctctgagccctccctcttccaaacccacagccccagggaaggggagtcatgggggctcttctaaggcccaagagatggaagaaaccaggaggagcctcctttacagctgccaca

SEQ ID NO: 47027 - DNA, 601 bp, Human
ggtgactctaaagtggggacagcaaggaggaaaagaatagggtaggaatctagcacaatgcctgaaacacagcagggtgcaataaatcctactgatgatgaagatgatgatgatgaactggaaaaggtagctttccccatcaccgaactgtaggctctgggaggacagaaggtgaatagctcgtatctcagagatttgtttagggctggacctggggcagggctgggaggagtcctctcctgaaaccaaacccaggatgcggtccatatattcctcagctctgggagaatactaaaaaagsgagtcactaggttgtcatcagagagtttgagatcttcttgggccagatgtccgccttcaggctcaaatgggagaagggggaaggtaggaggaagtgtgtagaaagcagacaccatttcccttgaatctgcccagtgccccatgtggggagaaggcggggcctcctcccctgagcactcagaggcctgagctcggcatcctcaccaacccagagatgtctgctctgtgcccagcatgagaaaaggaagaggttgccggctttatcacgcagaagaaggaaggcacactggcccccaccttc

SEQ ID NO: 47028 - DNA, 601 bp, Human
atcttccacttgcccctggatccctctccatcccactctgagtcctgggagattcctttgccctctgccttctggtccagttccatcagtggggaactgtggcaggaggtcagagggcaggagaagggtgagtggaggtgcagatcctcccagctccctcgcaacaggtactgcaggtgagcagtggctgcattcctccaccagaggccgcagccctgtccatggccctctcctatagcctgagctaccctgggttcttatgactgctggtcccttgcccctttagacctggagggtaagrgcttgcctacgtaactaccctgggatactccaccattattcattgttttctcttgactctgccagtgcttttgtaaataaatacatcgagtgtgccatccctttcctgctggaactctaactgacccagacaagaaaaagtatttgctatcgagtactgagcacttacctatgtgagccggcactttatccacattcctttgtgttattctgaccacagctctgcgcagccagtattggtatcatcagtctttcacattgagactcggggaggtgaaagaacacacttgatagcacgact

SEQ ID NO: 47029 - DNA, 601 bp, Human
ttattgtcactagttattttaagtccggtgctggaaactgtatacattaacattttaatgaggccgaatgctgctccaggctctcaccgacttctgtagttttctgaaaagacgctggataccttgcctaacccagtactctgcagtttccaagccaagctggatgtttccgcacttgcctacgctcacatgccctggaggctggttcgcacaatgactataatcacaagttctgaagtcgaggagagctaggctggaatcgcccttaccctcagtgtcctcattgcaaagtgggagtcaygggaataccctcctcacagggtcatggcaaggactggcaaatgtgctgaagatcttccacttgcccctggatccctctccatcccactctgagtcctgggagattcctttgccctctgccttctggtccagttccatcagtggggaactgtggcaggaggtcagagggcaggagaagggtgagtggaggtgcagatcctcccagctccctcgcaacaggtactgcaggtgagcagtggctgcattcctccaccagaggccgcagccctgtccatggccctctcctatagcctgagctacc

SEQ ID NO: 47030 - DNA, 601 bp, Human
cacacacgcatacacacacatacccccgcagagggagaccctcactgagtgagcagccagttctgtaaaaagcagccggatggggcgaaccttccctgggccatctgaaaaagagctttgccagtctttcctctcttttcttgcttcattgctcccagcctcttcctttcaaacaaaaatcctacaggatttaagttggctagatgctatgaacatagctacaagcttgaaatgtttattgtcactagttattttaagtccggtgctggaaactgtatacattaacattttaatgaggccsaatgctgctccaggctctcaccgacttctgtagttttctgaaaagacgctggataccttgcctaacccagtactctgcagtttccaagccaagctggatgtttccgcacttgcctacgctcacatgccctggaggctggttcgcacaatgactataatcacaagttctgaagtcgaggagagctaggctggaatcgcccttaccctcagtgtcctcattgcaaagtgggagtcatgggaataccctcctcacagggtcatggcaaggactggcaaatgtgctgaagatcttccacttgcc

SEQ ID NO: 47031 - DNA, 601 bp, Human
ggctagcaaagcaactatgtgttttcacatttcattattgggaatcatttagcaatcttcccggtgtcatctgcagacagatagacacagacagacgaatacacccctctgggtcccaagcagcctcatacaacacagtcatcagatgactttgcagttaatccattttccccttctaatccttttctgggaaattatcctgccaggtttaaatcttcccctttagcccttctgcagaggtggggtgtgtgtgtgtgtgtgtgtgtctgtgtgtgtgtgtgtgagagagagagagagagagtgtgtgtgtgtgcatgcgccatgacagggggaggaggaggagtgccgagacactgattcagttaatttcacaagtggaaacaagtgtatgtttcagaatgcctcccttttttttttttttaaactgtgatcatactttgctaaagttattttcacctgggaagctcacagtgccttttctgaccgtggcaaattaattaactgatggcagatttaaagatggagtaactggaaaaactaccggacccataaatcagaaacctcctttatgtcctggacaagaggtgaaacctgatacata

SEQ ID NO: 47032 - DNA, 601 bp, Human
gtcttgagaggataccgccagacccctgcagatgcagactccctcaagtggcctctgctgcgggcactcgcgggtggacatgttacatcgtgggcagggctgaggctccaggaggaaaatgcagcgtaggcgacatctggaagcagaaatgtggtagctccagaagttttcatctgtaatctttgttttgcaaggaacagggattttttttcttttcaaaaagtactccacttccttttagacctttcacaaatatttttgtaggagaaataaggagaaaaaaaaaaacccacagaatgcytgtcgcagctactcacttccaccatgaatcacagacacaaaaccacagctatgtggctagcaaagcaactatgtgttttcacatttcattattgggaatcatttagcaatcttcccggtgtcatctgcagacagatagacacagacagacgaatacacccctctgggtcccaagcagcctcatacaacacagtcatcagatgactttgcagttaatccattttccccttctaatccttttctgggaaattatcctgccaggtttaaatcttcccctttagcccttctgcagaggtggggt

SEQ ID NO: 47033 - DNA, 601 bp, Human
tgaagctcacaaggttaaatcactcactgtaggctgcatagctaagtggtggagctgagattcaaactcaggtttatttaagacataaattatttcacaattctgccctcacacgctactgcattttgtggagcctctgaccttgtcccaagaacatcaaaaaagaaagaaatgtggaattaatttttctcccctggaagggcgtggcctggctggggtcttgagaggataccgccagacccctgcagatgcagactccctcaagtggcctctgctgcgggcactcgcgggtggacatgtyacatcgtgggcagggctgaggctccaggaggaaaatgcagcgtaggcgacatctggaagcagaaatgtggtagctccagaagttttcatctgtaatctttgttttgcaaggaacagggattttttttcttttcaaaaagtactccacttccttttagacctttcacaaatatttttgtaggagaaataaggagaaaaaaaaaaacccacagaatgcttgtcgcagctactcacttccaccatgaatcacagacacaaaaccacagctatgtggctagcaaagcaactatgtgttttcaca

SEQ ID NO: 47034 - DNA, 601 bp, Human
ggaactagtgtccccattttacagaagagaaaactgaagcacagggagcctgctaacttgcccggggtcatccccagcagggaagtgctgggccagggtcttcaggctgagctctgtctgcctctgggggatgagattcccttccccaccctgctgctcacccttggctgtgaccagaaacctcccaggtctggaaacaccttcaagtgctctgggcaaattctcaaagtttctgatgaccgctgctgcatttctgaaaggctcagataacccccgaggcaggggacaagtaagagtgggyacggtgagactttgaacaaatgtacagaaccatgaaccaaataaaccacttttctttatattaaaaaaaaaaaaaagagtgggcacggtggctcatgcctgtaatcccagccctttggaaggctgaggtgggcggatcacttgaggtcaggagttcgataccagcctggccaacatagtgaaaccccgtctctactaaaaatacaaaaattagctgagcatggtggtgggcacctgtaattccccagttacttaggaggctgaggcaggagaattgcttgaacctgggagacagaggttg

SEQ ID NO: 47035 - DNA, 601 bp, Human
tctctgccccactatgacctatgagaaatttgcggcatgaaggaggaaggtagctggcccaagctcacgtatctcatgaacggcaaaacccacagtcctaaagctcaggactgccaggctctaaagctcatctcacccctcccatcactgcagccaaactccctccacaagctgccatggtgatgctgcattaactacaaggaagtgtatgaaaaccagaagtggctggagagctgcagccatgaaaagggaatgaaaatgcaaggcagggcctagggacctggcaagtgctacaggagaytggaggaggggctggaggaaggggaggagagacacctaggctgaggggattgagctaggactctttcccaaagccacagcaaacctggtatacaaacatctcaccaccactaacttggccatgagatgctcacctcctgaacccttgagttcccagctcatggccttcaggacccttccaccctccatgatgcgcccccacacatgcccatgcacaagcttagcaggtctggcttattgaacagcaaacacaggcctgactccagatgtgtttaccccactcgtgggcctgccccgacaa

SEQ ID NO: 47036 - DNA, 601 bp, Human
ggttactcctcccaggtccaatgacagaagccagctgtgctgaggggcagagatcagactataatgagatttgtccactggtatctcttcctctgggtatctgctggggcgtcagagtccttcccacacaacctgtcttgatgaaataattgctatacttactaaacacaggctgagcaccaggcaccaaacacacatgaccttataaaggtcccctaacaagaacctaagacataggtgtctctgccccactatgacctatgagaaatttgcggcatgaaggaggaaggtagctggcccragctcacgtatctcatgaacggcaaaacccacagtcctaaagctcaggactgccaggctctaaagctcatctcacccctcccatcactgcagccaaactccctccacaagctgccatggtgatgctgcattaactacaaggaagtgtatgaaaaccagaagtggctggagagctgcagccatgaaaagggaatgaaaatgcaaggcagggcctagggacctggcaagtgctacaggagattggaggaggggctggaggaaggggaggagagacacctaggctgaggggattgagctagga

SEQ ID NO: 47037 - DNA, 601 bp, Human
ccatgagtcacatccccagtgctctgaggctctgggcctctagctcttcctatggccacacctaggtctgaaaggactggattccccagcacacagaccccaggggatgaccctgccaggctgtgggtggggaggaggtagagccctggggcagtctctcctgtccagaccacaccctgccctgcttcccagacagctcaagggaacacagcattcctgtttcaggcagggagacggagggaggcatgagctctgcgtgtcggggttaatgtcagggaggggcacccagcccttgcctgcrgcccggtcccccctcaagggcagccctgaagtaggtgctgcctcagtttctaaagggtccagagactcctaggagccacatctctcccctccaccctccagccccctcatgtgttggtccactgtgaacacttttccaccgagcagccagcctttaggctgccgggctgccaagccctggcccctcgagatcctgcgcggcctttgttccctcctggcagggtaagagagccaggcaagagagccagagcgagctgcctgggcactgggctcacacccgggccacctcaggggcagaggc

SEQ ID NO: 47038 - DNA, 601 bp, Human
atcagtcagctccaggcaccccactcaccccacctggctgccatgagtcacatccccagtgctctgaggctctgggcctctagctcttcctatggccacacctaggtctgaaaggactggattccccagcacacagaccccaggggatgaccctgccaggctgtgggtggggaggaggtagagccctggggcagtctctcctgtccagaccacaccctgccctgcttcccagacagctcaagggaacacagcattcctgtttcaggcagggagacggagggaggcatgagctctgcgtgtmggggttaatgtcagggaggggcacccagcccttgcctgcagcccggtcccccctcaagggcagccctgaagtaggtgctgcctcagtttctaaagggtccagagactcctaggagccacatctctcccctccaccctccagccccctcatgtgttggtccactgtgaacacttttccaccgagcagccagcctttaggctgccgggctgccaagccctggcccctcgagatcctgcgcggcctttgttccctcctggcagggtaagagagccaggcaagagagccagagcgagctgcctg

SEQ ID NO: 47039 - DNA, 601 bp, Human
gaataggaaggatctaggagaaagctccaagagaggaaggcgttcccagaactctctctgctgccggccaaagcgcagaggctgctccttcctgcggctgcaggggcagctcacttcagcttaacatgccctgtgtttccctgatggcttggtctcccctgaggatctgggtgctggcaaggcagaggaaggcccttgcagagctctgctcctttctcctcctgtctggccaggcaggcccttggctgccaaacccctggggacctaagatagggagacgagtagggacagcatgttcaaygggcccagagcctggattggaatctgtaccttcttgttgcctggcacgctgatagggcatcatcaacattccctggtgcctatcctaaagggtcgagagccagccctctcccccgtgtccccaaggagtctcaagatcactcctgctgctgtgtctgcttggcgcacccacccaacctctttgccctcatcagtcagctccaggcaccccactcaccccacctggctgccatgagtcacatccccagtgctctgaggctctgggcctctagctcttcctatggccacacctaggtctgaa

SEQ ID NO: 47040 - DNA, 601 bp, Human
agcagccagaggaataggaaggatctaggagaaagctccaagagaggaaggcgttcccagaactctctctgctgccggccaaagcgcagaggctgctccttcctgcggctgcaggggcagctcacttcagcttaacatgccctgtgtttccctgatggcttggtctcccctgaggatctgggtgctggcaaggcagaggaaggcccttgcagagctctgctcctttctcctcctgtctggccaggcaggcccttggctgccaaacccctggggacctaagatagggagacgagtagggacrgcatgttcaacgggcccagagcctggattggaatctgtaccttcttgttgcctggcacgctgatagggcatcatcaacattccctggtgcctatcctaaagggtcgagagccagccctctcccccgtgtccccaaggagtctcaagatcactcctgctgctgtgtctgcttggcgcacccacccaacctctttgccctcatcagtcagctccaggcaccccactcaccccacctggctgccatgagtcacatccccagtgctctgaggctctgggcctctagctcttcctatggccacac

SEQ ID NO: 47041 - DNA, 601 bp, Human
tgaacagaatggtctcagttctaagtcttgctcccataaattcttctccaacctctggcgcctgctaccacttgtctgctagcacacgattaaacaaacgaacaagccgtaaattaatattaacggaaaaatgtggcaacagcctatcatacttcatcccacagtttgcgcttttcacggacacgtgcgtgtgcctatagctgggtttttttttttaattttttttatgcatacatagacaatcgtcatagtttctgctaataaaactgttcccagctctaatcatgaaattaagtatatygatatttcgtggtactccttatgacttccaggtgttctgacacctaaacagtttgagaaatgtaagaggaaagagaacaaagaagggcagagggggcctagggaacaccaacgcttaagaggcagacagagggagaggctctgaaggcatctggaagggagcagccagaggaataggaaggatctaggagaaagctccaagagaggaaggcgttcccagaactctctctgctgccggccaaagcgcagaggctgctccttcctgcggctgcaggggcagctcacttcagcttaacatgcc

SEQ ID NO: 47042 - DNA, 601 bp, Human
tggggtaataggccctggaaacacagcggcagctcctttacatcaataagttaagctttccaagatacactgaaaagtgaaagcacaacagcccaatcccaccactgactgtttttgtacagactatgacctaacaatggttttcacatgtttaaatggcggaaaagaaatcaaaaaaagaataatacctcaagacatgagcaaatgatatgaaattcaaatttaagcatctataaagtttaactggaacacagctgccctcctcatctgtgactggttttgctctccaatggcaccgctragtagttgcagaaaccatatgtcacagaaaatctaaaatatttactgtctggccatttatggaagtctgctggctcctggtgtagggcatgtgaactcctgtgtaacatacagaaaataaggatatatgttgcagttatttgcatattcataaagcaaccttggaaggataccctggaatattaataacagtggttacctacgtatgtggcagggtggagaacaggaagtgggaagtgggtgggtagggaataaactggtgctatatatatatttatatatatatttatatatatattta

SEQ ID NO: 47043 - DNA, 601 bp, Human
aaaaagaaaagaaaagaaaagaaaaataacataagaagtgcatggaggtgggaagcacaggccatgtttgaagaagaataagcaccatttgggtaaagcacagattagaggggagaggggggaagggaaatcattccaattcaatgcctatcaggtggcaggtatcatgctaagtgttttagctaatatatcatttacttgtccaaacaattctatgatcaaaaacccctgcttggccaaacccaccttaaagtaaaaagacaaatgacatggtgggaaaaatatgtgcaactcgtatcakagagaaaagatgagtctccataatatcagagttcctagaaacagaaatgtcagagaccaacagccttaaaagaaaaatcagcaaggaatatgaacaggtcacagaaaaaaaaatacaaatatttcttgaacccagaaaaatatgcttaacctttctccttgtaagggatgtgcaaatgaaaactatgctgaggtagcattttttaatccatcagattagaaaaaaacccaaaggtttaataacatactcatttgtgagactatgcagaaacagacgctctcggatgctgctggcaggaat

SEQ ID NO: 47044 - DNA, 601 bp, Human
gaaaaaaaaaaagaaaagaaaagaaaagaaaaataacataagaagtgcatggaggtgggaagcacaggccatgtttgaagaagaataagcaccatttgggtaaagcacagattagaggggagaggggggaagggaaatcattccaattcaatgcctatcaggtggcaggtatcatgctaagtgttttagctaatatatcatttacttgtccaaacaattctatgatcaaaaacccctgcttggccaaacccaccttaaagtaaaaagacaaatgacatggtgggaaaaatatgtgcaactygtatcagagagaaaagatgagtctccataatatcagagttcctagaaacagaaatgtcagagaccaacagccttaaaagaaaaatcagcaaggaatatgaacaggtcacagaaaaaaaaatacaaatatttcttgaacccagaaaaatatgcttaacctttctccttgtaagggatgtgcaaatgaaaactatgctgaggtagcattttttaatccatcagattagaaaaaaacccaaaggtttaataacatactcatttgtgagactatgcagaaacagacgctctcggatgctgctgg

SEQ ID NO: 47045 - DNA, 601 bp, Human
ggaggatcacctaaggtcaggagttcgagaccagcctgaccaacagagagacaccccatcaaaaaacacaaaaattagccgggcttggtggcacatgcctgtagtcccagctactggggaggctgaggcacgagaatcgcttgaacccaggaggtggaggttgcagtgagccaagatcaccccactgcactccagcctgggcaacagagtgagactcaatctcaaaaaaacaaaacaaaaaagaaagcaaactccctccgaggacttccaagaaagcgcctgggagagagaggtggctgarctgctggctcactgggagcctcgtcctgggtaccaggctggtgccatgctcaggttagtggcagcgccacagagcatcccagagaggtgaaaagagtagctcatgttctgcccagaccactgccacttttctgaacttgaccctgacaaagagctctccagtctggtcaggatggaaactcaaagtgttctttcttggtggtttgttgtcattgttatgttattgctgctgtcagttttttctctaattggtgctcagagctcatggcaccaagatcccagggttcaaatcccttaaggg

SEQ ID NO: 47046 - DNA, 601 bp, Human
gcatattattaatttttaatactttgctagctttgaataagcacaaagtggtacttcaatgttcttttcacctcccttctctcctttaaaaaattatttttgaggttaaaatatttcaggtatttatttaccacttgtgaaaatcctccgctcatgtcctttgacatcttaactgcttgaattgtctcatacatttggacacattctcttgatgtttattattgggcaggctgttctaaaaggcagcctctgttgtaaatactctgtcattgtcacaatgtctatgaaccactgtgtataygacagtgtctggactgtggtgggtgtaagcgtattgcagacatcaaagctgagagaggctcagtccttgcccaaggttatacaagagctaaatggggacaccaggatgccaacccagggcctgatccacaacctgtgtcctgcgccagccgacaaccagcccagaccccagtgggagctcagcctggaagcctctgctcaggcctcgggggcatcccttcccccagtaggtcccatgccaaccctccccactggtttccttgcccaagtgggataaggccctgggattctctccctcccc

SEQ ID NO: 47047 - DNA, 601 bp, Human; identical to SEQ ID NO: 18978

SEQ ID NO: 47048 - DNA, 601 bp, Human; identical to SEQ ID NO: 18979

SEQ ID NO: 47049 - DNA, 601 bp, Human
gatgttctgaacacagtaggggaggccaccatctgggatggggcggagcgagggcaagggctgagcgttgggtgtgttgggggaggggtacaattcgtgttctgcacgcacctgatccacagagctctgctcccgtgcccaccgccactgggctctagccctgtctgaaccgagctcaccagctgtatttggagcaggttccttgggcatcaggtgggctgagctctcaaggctggcacacaggtggaaccaggagtgcagcaagtgggcgagcaggtagctgcttcagtacagactctgkcctttttctcctgctccccacccttccagtggagggctcccccactctcagaagtgcttccaagatctggggatgtggtcatggtgcctgtcagccctggctgagggcaacaggcctagaatcctccattggcagcagccagccctggcatggacctcacagcctgcatctctgcacccctgatgggctccagagcttgggacaggcaggccctgtgctcccactgtcccctccaatcctataagtggcagatgtgacatataagtgaagaatccagagtggctctattttcattttcac

SEQ ID NO: 47050 - DNA, 601 bp, Human
agcagaggggaactgtgggctggtctagactgactcccgggccagctctccatgcaagttctgtggcattctggaacaaaagggatttacctatgccatgcaattaagacttcaaggcagtccttttccatgtcaggaatagtggcattctgttgcgaccttcttcaacagtccagcacagagcctcaaagccagaatgtgactgaagggaagccatgaagccactcccaggctgctcaccctatcactcccaccactgcctgatttgctagaacactttactggggatgacaaaggcttyccccagaagcataagcctattttatcagaggagaaataggggctcagagaggcaaagccactagtgccagggatgatctaggatccagaagtcctgtctgtcttgccaaccttccccaaacctgccctggcagcttgtcttttcttcctctgcttcttgtatagaagcttccttgtcatccccacttaaagaaatgtgcccaccccagccccaggttcaggcatgaagcgaggtgcctggcactctgtcaacacaaacaaggctccccaacgtcttgccccttctctatacaatgcccaa

SEQ ID NO: 47051 - DNA, 601 bp, Human
actcatcctaccccttgtggctcctcagccagatcaaggttatcacaaggggtaaggggtcagagagtagaaagaagagaatctgtgagacctggggagagagagtggctaagctgtgactcccacggatgcttcaaggaggccttgcagggctgcagtgtccttgcctttcagactcttagacttgggaaagccaaagcagctgcccaggatcagtggggaccgacctgaactccaaggagttcacatcacaaatgctcatgaagcatgcagggcggatgtggggaaccttcctggtaargacatcgggacatatggtcttctgattccctggccttggccctgtccaccctctgccgtgcctcggttgctcacaaactgaagaaagaagcagatgggcccctggctgcagcctgcccctgccctgctaactctccccctcggctgctgggactcccaaggaggcctcagtaaaggcaaactaatttctcgagacagttttggcgctgactccatgagtagagctgtggaggagaaagtgaagagtgtctggccacagggctgtttacaagctgtgccaatctcagcctgtgatgacagg

SEQ ID NO: 47052 - DNA, 601 bp, Human
aactgacaaaggaaatggtgtagaactcatcctaccccttgtggctcctcagccagatcaaggttatcacaaggggtaaggggtcagagagtagaaagaagagaatctgtgagacctggggagagagagtggctaagctgtgactcccacggatgcttcaaggaggccttgcagggctgcagtgtccttgcctttcagactcttagacttgggaaagccaaagcagctgcccaggatcagtggggaccgacctgaactccaaggagttcacatcacaaatgctcatgaagcatgcagggcrgatgtggggaaccttcctggtaaagacatcgggacatatggtcttctgattccctggccttggccctgtccaccctctgccgtgcctcggttgctcacaaactgaagaaagaagcagatgggcccctggctgcagcctgcccctgccctgctaactctccccctcggctgctgggactcccaaggaggcctcagtaaaggcaaactaatttctcgagacagttttggcgctgactccatgagtagagctgtggaggagaaagtgaagagtgtctggccacagggctgtttacaagctgtg

SEQ ID NO: 47053 - DNA, 601 bp, Human
agaactgacaaaggaaatggtgtagaactcatcctaccccttgtggctcctcagccagatcaaggttatcacaaggggtaaggggtcagagagtagaaagaagagaatctgtgagacctggggagagagagtggctaagctgtgactcccacggatgcttcaaggaggccttgcagggctgcagtgtccttgcctttcagactcttagacttgggaaagccaaagcagctgcccaggatcagtggggaccgacctgaactccaaggagttcacatcacaaatgctcatgaagcatgcaggrcggatgtggggaaccttcctggtaaagacatcgggacatatggtcttctgattccctggccttggccctgtccaccctctgccgtgcctcggttgctcacaaactgaagaaagaagcagatgggcccctggctgcagcctgcccctgccctgctaactctccccctcggctgctgggactcccaaggaggcctcagtaaaggcaaactaatttctcgagacagttttggcgctgactccatgagtagagctgtggaggagaaagtgaagagtgtctggccacagggctgtttacaagctg

SEQ ID NO: 47054 - DNA, 601 bp, Human
aaccaaagtgccgggcagaactgacaaaggaaatggtgtagaactcatcctaccccttgtggctcctcagccagatcaaggttatcacaaggggtaaggggtcagagagtagaaagaagagaatctgtgagacctggggagagagagtggctaagctgtgactcccacggatgcttcaaggaggccttgcagggctgcagtgtccttgcctttcagactcttagacttgggaaagccaaagcagctgcccaggatcagtggggaccgacctgaactccaaggagttcacatcacaaatgcycatgaagcatgcagggcggatgtggggaaccttcctggtaaagacatcgggacatatggtcttctgattccctggccttggccctgtccaccctctgccgtgcctcggttgctcacaaactgaagaaagaagcagatgggcccctggctgcagcctgcccctgccctgctaactctccccctcggctgctgggactcccaaggaggcctcagtaaaggcaaactaatttctcgagacagttttggcgctgactccatgagtagagctgtggaggagaaagtgaagagtgtctggccacag

SEQ ID NO: 47055 - DNA, 601 bp, Human
tggcagtgagtcgagatcatgcctctgtactccatgctgggcaacagagtgagaccatgtcttaaaaataaataaataaggcgcagtggctcacgcctgtaatcctagcactttgggaggccgaggcgggcggatcatgaggtcaggagatcgagaccatcctggctaacatgatgaaaccccatctctactaaaaatacaaaaaattagcgggatgtggtggcgggtgcctgtagttccagctacttgggaggctgaggcaggagaatggcgtgaacccaggaggcggagcttgcagtgrgccgagattgagccactgcactccagcctgggcaacagagcgagactccatcttaaaaaatatatatatatattatatatatatttgtatataatatatatatttatatattatatatatattatatatatttatatatattatatatatattatatatatttatatataatatatatatattatatattaaaaatatatatatttaaaatatatataggttatatatatatatatatttttttatatatgtaggttaaattcaggttaaatctccttgggagaaagtggaagtttagat

SEQ ID NO: 47056 - DNA, 601 bp, Human
gcaatatgccaaagacaaatagaaggaggcgccacattttcttggaagccccactcttccctgaggacacactgtgtgccaagcatgacatgtgacagcctgacatagggacagaccaagtgaggacataaattagtaacgcttaacttttttaagattaaaaaatgtaaactgaagttcaaaaatgttttcctgccaggactggcccgctccggatttgcacgttccatgtagggaccagggtccagcctagaaggccactcttgtggagacacacggggattctgaaaacgctgagaakgagatggaaagatgagagtgaggctgggagatgtgcacgtccctggcgtggggcctggtggtataaactgaggacagagaggagggaagaaagagaagtcctttggagaaactcagaaggcaggctgattagatgcagcctgtgaacattatgaggagcagaaggtgggaaagaatgatgcaaggctgctgccagagggctgaggaaagagaccaagtgcacatttgtccagtgcttcagaattgcaaggccatgggtacacatggtcatgtctgtttctcacaacaattatgccctaag

SEQ ID NO: 47057 - DNA, 601 bp, Human
ggatcctggggtacttgggggtcacatctgataggtcgtcacgatttttactttgtaataaggctgagtgacatggtaagaccccctgagaagggtcggcattgcgttttttaatgattgcttgtgattatgggactagtgtcattttgcatccacagtttctttgcaggagcttttaagagccacctctccattttgtgtgggttagttaacaccagaatacataactaaaaaatccagtaaacacagcactgtgaactgcactgtgttgcaatatgccaaagacaaatagaaggaggcrccacattttcttggaagccccactcttccctgaggacacactgtgtgccaagcatgacatgtgacagcctgacatagggacagaccaagtgaggacataaattagtaacgcttaacttttttaagattaaaaaatgtaaactgaagttcaaaaatgttttcctgccaggactggcccgctccggatttgcacgttccatgtagggaccagggtccagcctagaaggccactcttgtggagacacacggggattctgaaaacgctgagaatgagatggaaagatgagagtgaggctgggag

SEQ ID NO: 47058 - DNA, 601 bp, Human
tcacaacattcccccttactttacaaagaaaaaaaaaaaaaccaaagagttgacattaaataaaaacaggaaaaaaatctccattactttggaggaacagactagtgtgccaaccctcttgaaaagctctagcaggaggcatacttctgatcgccacctgtcttcacaggaaaaggcaggggaatactatcttttgtggaacaaaaagagaactcagctataagtctgacaattcttttgcctatagatagccagcaattctaagcaggcacgagcaattgccacagaccttattccatamaaagttccataaatataccatgatatttcaaaggtcttgctctataaaggtagctgcatgatggcttcctgtagcaatttgccgtcttctagctttgactcctttgtggcaatagcttgtctctgaatgctgcaccctccatctctgttaccttatcccaattcctttttctcccagtcataacatcagtagctacactttcagtgttgtttgctaaagcttattgtcatccaggaagtcatttactgttgagaatatatgtccactggttcatcctttagtggtttacaaaaagagagt

SEQ ID NO: 47059 - DNA, 601 bp, Human
agccatcgccctgggcagctgtgcttcctggttctcaccagactcctctcagcccacctcgcttttattaaaagcagtactaagtgaaataagacaggcacagaaagacaaatatcacatgatctcacttacatatgggacctaagaaaagcaaacccatagaagcagagtagaatggtagttaccagggcctgggggagaggggagatattgatcaaagggtacaacatttcagttagatacaggaggaataagttcaaaggatctgttgtacgacatagtgactatggttaataacagygtcttgtattcttgaaaattgctaagagagtagattttaagtgttctcaccacaaaaaataaatatatgaggtaatacacatgggtgcaatttagccactttacaatgtatacttatttcagaacaacagttgtgtaccagccaggcgcagtggctcatgccttaatcccagtgctttgggaggccaaggcaggtggatcacctcaggtcaggagttcgagaccagtctggctaacatggtgaaaccccatctctactaaaaatatgaaaattagctgggcatggcagcacatgcctgta

SEQ ID NO: 47060 - DNA, 601 bp, Human; identical to SEQ ID NO: 18980

SEQ ID NO: 47061 - DNA, 601 bp, Human; identical to SEQ ID NO: 18981

SEQ ID NO: 47062 - DNA, 601 bp, Human; identical to SEQ ID NO: 18982

SEQ ID NO: 47063 - DNA, 601 bp, Human; identical to SEQ ID NO: 18983

SEQ ID NO: 47064 - DNA, 601 bp, Human; identical to SEQ ID NO: 18984

SEQ ID NO: 47065 - DNA, 601 bp, Human; identical to SEQ ID NO: 18985

SEQ ID NO: 47066 - DNA, 601 bp, Human; identical to SEQ ID NO: 18986

SEQ ID NO: 47067 - DNA, 601 bp, Human; identical to SEQ ID NO: 18987

SEQ ID NO: 47068 - DNA, 601 bp, Human; identical to SEQ ID NO: 18988

SEQ ID NO: 47069 - DNA, 601 bp, Human; identical to SEQ ID NO: 18989

SEQ ID NO: 47070 - DNA, 601 bp, Human; identical to SEQ ID NO: 18990

SEQ ID NO: 47071 - DNA, 601 bp, Human; identical to SEQ ID NO: 18991

SEQ ID NO: 47072 - DNA, 601 bp, Human; identical to SEQ ID NO: 18992

SEQ ID NO: 47073 - DNA, 601 bp, Human; identical to SEQ ID NO: 18993

SEQ ID NO: 47074 - DNA, 601 bp, Human; identical to SEQ ID NO: 18994

SEQ ID NO: 47075 - DNA, 601 bp, Human; identical to SEQ ID NO: 18995

SEQ ID NO: 47076 - DNA, 601 bp, Human; identical to SEQ ID NO: 18996

SEQ ID NO: 47077 - DNA, 601 bp, Human; identical to SEQ ID NO: 18997

SEQ ID NO: 47078 - DNA, 601 bp, Human; identical to SEQ ID NO: 18998

SEQ ID NO: 47079 - DNA, 601 bp, Human; identical to SEQ ID NO: 18999

SEQ ID NO: 47080 - DNA, 601 bp, Human; identical to SEQ ID NO: 19000

SEQ ID NO: 47081 - DNA, 601 bp, Human; identical to SEQ ID NO: 19001

SEQ ID NO: 47082 - DNA, 601 bp, Human; identical to SEQ ID NO: 19002

SEQ ID NO: 47083 - DNA, 601 bp, Human; identical to SEQ ID NO: 19003

SEQ ID NO: 47084 - DNA, 601 bp, Human; identical to SEQ ID NO: 19004

SEQ ID NO: 47085 - DNA, 601 bp, Human; identical to SEQ ID NO: 19005

SEQ ID NO: 47086 - DNA, 601 bp, Human; identical to SEQ ID NO: 19006

SEQ ID NO: 47087 - DNA, 601 bp, Human; identical to SEQ ID NO: 19007

SEQ ID NO: 47088 - DNA, 601 bp, Human; identical to SEQ ID NO: 19008

SEQ ID NO: 47089 - DNA, 601 bp, Human; identical to SEQ ID NO: 19009

SEQ ID NO: 47090 - DNA, 601 bp, Human; identical to SEQ ID NO: 19010

SEQ ID NO: 47091 - DNA, 601 bp, Human; identical to SEQ ID NO: 19011

SEQ ID NO: 47092 - DNA, 601 bp, Human; identical to SEQ ID NO: 19012

SEQ ID NO: 47093 - DNA, 601 bp, Human; identical to SEQ ID NO: 19013

SEQ ID NO: 47094 - DNA, 601 bp, Human; identical to SEQ ID NO: 19014

SEQ ID NO: 47095 - DNA, 601 bp, Human; identical to SEQ ID NO: 19015

SEQ ID NO: 47096 - DNA, 601 bp, Human; identical to SEQ ID NO: 19016

SEQ ID NO: 47097 - DNA, 601 bp, Human; identical to SEQ ID NO: 19017

SEQ ID NO: 47098 - DNA, 601 bp, Human; identical to SEQ ID NO: 19018

SEQ ID NO: 47099 - DNA, 601 bp, Human; identical to SEQ ID NO: 19019

SEQ ID NO: 47100 - DNA, 601 bp, Human; identical to SEQ ID NO: 19020

SEQ ID NO: 47101 - DNA, 601 bp, Human; identical to SEQ ID NO: 19021

SEQ ID NO: 47102 - DNA, 601 bp, Human; identical to SEQ ID NO: 19022

SEQ ID NO: 47103 - DNA, 601 bp, Human; identical to SEQ ID NO: 19023

SEQ ID NO: 47104 - DNA, 601 bp, Human; identical to SEQ ID NO: 19024

SEQ ID NO: 47105 - DNA, 601 bp, Human; identical to SEQ ID NO: 19025

SEQ ID NO: 47106 - DNA, 601 bp, Human; identical to SEQ ID NO: 19026

SEQ ID NO: 47107 - DNA, 601 bp, Human; identical to SEQ ID NO: 19027

SEQ ID NO: 47108 - DNA, 601 bp, Human; identical to SEQ ID NO: 19028

SEQ ID NO: 47109 - DNA, 601 bp, Human
ctggagggcgcgccgggcgcccgggcgcagctggccgtcgtctgtctgggtgagtgggccgcgcgggccgggcaggtccgggtcccccgcatggcagtccgcgccgcgccctgaccgacctcctctccggccgcggcatcccgagccccccaccgcggtggctcccgcgcggagacccagagaggggccagcaccgcttgcccgcctggccccgggcctgggagggcgactctggtggcgcagccccggctcccgccccgctcggagtagcgcccggagcccgggctgagcgctggcaggmggcccttcgtgcaggcggcagccttcaacccggcccgcccgcgctgagcctggagacgagggggccccgggagctggggacaaaggccaggccggctgtcccctgaagaagaaactgtttccggcccggagttggggtgggggctggtgtaagccgcagatggggactcggggtgcggggcagggctggaggagggtgccagtgtggaggcggcttccaggggactcctgttttccctttgtgtctctcagcccccaggcaggcctgttcagtttaggagggtgcttgggttgggccagg

SEQ ID NO: 47110 - DNA, 601 bp, Human
caacctcggtgcggggtcatgtgtgctgggctctgagctgctgggtgctggcatccctggtgagcagagcagggggacaggcgctccatgcttaggagctttggcctggctctgtccagggggcctgggtgtcctgggtgggggcagcggttcctgcttcctggccaggcgggatctgacacacatcctgaaccccgggaagttgggtttccccccaccccccgactctgggcccgtaaccccccgggccagagcagaaggtgaaagtaagggccaaaccccacggaggtgggtgcttgargggtggctggggagttctgctttcctcctcaaagtcagcttggcacgggggaagaggatggttccgtcactagctgcgtgccctgtaaatggggattatcagaactgcctcccctcctgcctctgctgctgctgggcgagcaaagccccttggtagggggaagcccttcaaagttgtaggagcaggccagggtgcggtggcaggtgcctgtaatcccagcactttgggagaccaaggcaagagaattgctggaggccaggagtttaagaccagcctgagcaacacagtgagacctcatct

SEQ ID NO: 47111 - DNA, 601 bp, Human
tgagctgctgggtgctggcatccctggtgagcagagcagggggacaggcgctccatgcttaggagctttggcctggctctgtccagggggcctgggtgtcctgggtgggggcagcggttcctgcttcctggccaggcgggatctgacacacatcctgaaccccgggaagttgggtttccccccaccccccgactctgggcccgtaaccccccgggccagagcagaaggtgaaagtaagggccaaaccccacggaggtgggtgcttgaggggtggctggggagttctgctttcctcctcaargtcagcttggcacgggggaagaggatggttccgtcactagctgcgtgccctgtaaatggggattatcagaactgcctcccctcctgcctctgctgctgctgggcgagcaaagccccttggtagggggaagcccttcaaagttgtaggagcaggccagggtgcggtggcaggtgcctgtaatcccagcactttgggagaccaaggcaagagaattgctggaggccaggagtttaagaccagcctgagcaacacagtgagacctcatctctacaaaaataaaaaataaaaaaataaccaggc

SEQ ID NO: 47112 - DNA, 601 bp, Human
agggtcctggcactaccccgagttcctgtgtgcatcttttctacatcacaaaggagctgtttggctttggacaggcttcaacttgtctgagcctcagtttcctcatctgtaaagtgggtgaaataacaaggtctactcaaaacctgtctcttagtattccatgagccagtgaggcaagctcttagtgtggtgcctggcacgtggtggctttataccaccggcaagctgccgagggtcccgtggaattgacatcttgtgcctcattgcaggccatgagcttcctaggatttaatttataggrgtatgactgaggggtgacacagagaggcccatgccagggaaagaaggctttattaattttcttgaaaggaggggacatgctacgccatgcagggccacctgggaattactagatttggacaagcaggagcaggggtggaagaaaggtgtaagttagaagctgcatcacagcttccgtgggaaagtctcgacatccaggtgctgtggctcacgcctgtgatcccagcatttgggaggctgaggcaagagaatgcttgagccctggagtttgagaccagcctgagcaacatagtgaaactcc

SEQ ID NO: 47113 - DNA, 601 bp, Human
cttgtctgagcctcagtttcctcatctgtaaagtgggtgaaataacaaggtctactcaaaacctgtctcttagtattccatgagccagtgaggcaagctcttagtgtggtgcctggcacgtggtggctttataccaccggcaagctgccgagggtcccgtggaattgacatcttgtgcctcattgcaggccatgagcttcctaggatttaatttataggagtatgactgaggggtgacacagagaggcccatgccagggaaagaaggctttattaattttcttgaaaggaggggacatgcyacgccatgcagggccacctgggaattactagatttggacaagcaggagcaggggtggaagaaaggtgtaagttagaagctgcatcacagcttccgtgggaaagtctcgacatccaggtgctgtggctcacgcctgtgatcccagcatttgggaggctgaggcaagagaatgcttgagccctggagtttgagaccagcctgagcaacatagtgaaactccatctctacaaaaaaaatctgaaaattagctgggcacggtggcatgtgcctgtagtcttagctactcgggagactgaggcag

SEQ ID NO: 47114 - DNA, 601 bp, Human
tacgccatgcagggccacctgggaattactagatttggacaagcaggagcaggggtggaagaaaggtgtaagttagaagctgcatcacagcttccgtgggaaagtctcgacatccaggtgctgtggctcacgcctgtgatcccagcatttgggaggctgaggcaagagaatgcttgagccctggagtttgagaccagcctgagcaacatagtgaaactccatctctacaaaaaaaatctgaaaattagctgggcacggtggcatgtgcctgtagtcttagctactcgggagactgaggcargatgattgcttgagcccaggagtttgagattgtagtgggctatgacggctccactgtgctccagcctgggtgacagagcgagaccctgtctgtaaaaccaaaaccaaaacctgaggtcaaggtgcagcccgggagaacaatgggggcctctgacttgttcgttgcctgctgctctgctcggtggggcaggaggtgcctgggtttctagttctgtgcagggcccggcttgctggagaaaggacccggagctgtcaggcagcgggacccctgctgtggtcgaaggggaggcccagggtgcac

SEQ ID NO: 47115 - DNA, 601 bp, Human
tggaagaaaggtgtaagttagaagctgcatcacagcttccgtgggaaagtctcgacatccaggtgctgtggctcacgcctgtgatcccagcatttgggaggctgaggcaagagaatgcttgagccctggagtttgagaccagcctgagcaacatagtgaaactccatctctacaaaaaaaatctgaaaattagctgggcacggtggcatgtgcctgtagtcttagctactcgggagactgaggcaggatgattgcttgagcccaggagtttgagattgtagtgggctatgacggctccacygtgctccagcctgggtgacagagcgagaccctgtctgtaaaaccaaaaccaaaacctgaggtcaaggtgcagcccgggagaacaatgggggcctctgacttgttcgttgcctgctgctctgctcggtggggcaggaggtgcctgggtttctagttctgtgcagggcccggcttgctggagaaaggacccggagctgtcaggcagcgggacccctgctgtggtcgaaggggaggcccagggtgcacagaagctgtgctcactggctcctctggcaggcttgggcctctttccctctctctc

SEQ ID NO: 47116 - DNA, 601 bp, Human
gctactcgggagactgaggcaggatgattgcttgagcccaggagtttgagattgtagtgggctatgacggctccactgtgctccagcctgggtgacagagcgagaccctgtctgtaaaaccaaaaccaaaacctgaggtcaaggtgcagcccgggagaacaatgggggcctctgacttgttcgttgcctgctgctctgctcggtggggcaggaggtgcctgggtttctagttctgtgcagggcccggcttgctggagaaaggacccggagctgtcaggcagcgggacccctgctgtggtcraaggggaggcccagggtgcacagaagctgtgctcactggctcctctggcaggcttgggcctctttccctctctctctgccctgagctgtgctctcaggagcccggcctcctctgatgcttcgggctggctcaaggccgggccttgctcagcgctgacctagccccagccctgtctgctgtcctggtccacacaactgatggaggcccagtctcccatcccaatttccaggaaaaggctgactggcccagcctgggtcagatgtctgtggccatggtagagtcaggggaagggggaatgag

SEQ ID NO: 47117 - DNA, 601 bp, Human
cctgggcaggggcttcatgcagtttgcaggcagctggcagcttccccggcacgtctggggtgggactcccagctccccgtcgtcggattacaccaggcaggttggcgggggtattgatcaactttggaaattggatctgcaaattgtgctttctcaggccttgcagtgtcctctcaggaatatttgatgactctttggaccaggaaaggacactggcccgaaagtacctggtcattccttccctacttgtgtgggccaccatggctccgagggcccaggccatcttctgcctgagagaagkcaggtcacctccagctgaagctcagacagacctcttgacagcccccaacacctccgaacccctccctcttccccattatcccgcaaatcatgcagtcctcccatctgccctcactgcctgcccgctgctacacagcctgtcatgaacctcacctccatggagcattcctggagatccccctcctcattggcaacccctgaccctgtgccctaccacatgcacgtctgcctcaggtcaagcagggttcttgcctaggctgggcatggtggggcacacctgtagtctcagcactttgggagg

SEQ ID NO: 47118 - DNA, 601 bp, Human
aaggagtccctgcctagaacttgcagctccctgcacagagcccagcctccctcctgcctcccatcccctctgcatgaggctgggctgctgctgcacccaccatggtctctgccaacccgctttggagaagagcaaacagtttaaccaagtttccctgatgtggaaatttccggggggcccccaggggtgaggctgtttggaggcacccgttgtcagggttttgctgagaggcagggcagctggcagttgtcccttcctctgctcctgatgtggctggtggcctcccaacccctgatgaagrggtcagacataggtctatgagggagaagggttctggctgaagtgagtgggaagagagaaaggtggcaggtgacacctggcttttcccagaaagcgtgggtgagacacctggcccccaagggccccaaggagaggggcaggtctatgtctgtcccctaggggaggcctctggggctgagtaggaatggacagcgccttgccctgcccctggccttgtcctccaggacaggggacctcacaggtttttacccctcagcaaaaaggtgaacatgggaggttcccagccacgctgactcagagg

SEQ ID NO: 47119 - DNA, 601 bp, Human
ggtgagacacctggcccccaagggccccaaggagaggggcaggtctatgtctgtcccctaggggaggcctctggggctgagtaggaatggacagcgccttgccctgcccctggccttgtcctccaggacaggggacctcacaggtttttacccctcagcaaaaaggtgaacatgggaggttcccagccacgctgactcagaggctgacacttcagcttagcatgcgctttagagatgcaatgtgggggaccataccacttcagcctcactgggccttcccttctgtggaacctcctgttcrgccccctccaatgggaaagatctcttcttttggatttccttcttttttttaaatttttttggagaaaaagtcttgctgtgtcacccaggctggagtgcagtggtgtgatcttggttcaccacaacatccgcctcctgggttcaagcgattctcctgcctcggcctcctgagtagctgggatcacagacgcccagtaccacgcctggctaatttttatacttttagtagagacagggttttgccatgttggtcaggctgatctcaaactcctgacctcaaattatccccccgccttggcct

SEQ ID NO: 47120 - DNA, 601 bp, Human
caagtctagggggccctccttggcctcccgtacacaccacctccatgaagtcacaagttgtggccttgcccttggccatggccacccttggctggactcgatcccaccatgggggaggcctgtgctgaagcccccttccccccactgcaacccgcatcccaaccaaagatgggccggcctttctcggcctcctctcccgacagcggcctgcagtgggaagctggagcagcacacggagcggcgtggggtcatctacagcccggcctggcccctcaactacccgccaggcaccaactgcagytggtacatccagggcgaccgtggtgacatgattaccatcaggtaggggcacccgggggtgtcggaaggaatcaatgtgggcccacgtgcatggggtgggtgagaatgtgtgtgtgtgagcaggtgtggagggcacacgcctgagggtgtacatgtgtgtgagcaggtgtgggatcatgtgcatgtgtgtgagcatatgagtgaggcgtgtgtgagcactcgtgtgaacaggtgtatgggtgtgtgcatgtgtgtgagcatttgtgagtaggtgtgtgtgcatgcagatgtgtgtgtgtga

SEQ ID NO: 47121 - DNA, 601 bp, Human
atccagggcgaccgtggtgacatgattaccatcaggtaggggcacccgggggtgtcggaaggaatcaatgtgggcccacgtgcatggggtgggtgagaatgtgtgtgtgtgagcaggtgtggagggcacacgcctgagggtgtacatgtgtgtgagcaggtgtgggatcatgtgcatgtgtgtgagcatatgagtgaggcgtgtgtgagcactcgtgtgaacaggtgtatgggtgtgtgcatgtgtgtgagcatttgtgagtaggtgtgtgtgcatgcagatgtgtgtgtgtgaggtaggygtgtgtaggtatttgagcaggtatgtggtgtgtgcatgcatgtgaacacatgtaagtaggtgtgtgtgcatatgtgtgtgtgtgcatgtatgtgaacacatgtgtgcttgtgtacatggaaaagcccatgtcggagaagacataaaggacacatgtgagagactgcatgtgtgagcacatgtatgtgcacgagccatgcctgcaaaggtgcagagagcgtgtatgtgcgcatgcatgtaagataacaggtgtaaccatgtgtgaaccgtaagcatgtatgtgcacatgtgaatgcatgca

SEQ ID NO: 47122 - DNA, 601 bp, Human
atgggtgtgtgcatgtgtgtgagcatttgtgagtaggtgtgtgtgcatgcagatgtgtgtgtgtgaggtaggcgtgtgtaggtatttgagcaggtatgtggtgtgtgcatgcatgtgaacacatgtaagtaggtgtgtgtgcatatgtgtgtgtgtgcatgtatgtgaacacatgtgtgcttgtgtacatggaaaagcccatgtcggagaagacataaaggacacatgtgagagactgcatgtgtgagcacatgtatgtgcacgagccatgcctgcaaaggtgcagagagcgtgtatgtgygcatgcatgtaagataacaggtgtaaccatgtgtgaaccgtaagcatgtatgtgcacatgtgaatgcatgcacgcaagtgtgtccagtgctctgggtctccacgggcctctgtggcgaggtgcccaagctggacctcttcctggtttgagcctcgttcatggggtgtggggggtctcagtcactcagctctgccaggaaggcagggccagcacacaggccactgggaacacagcctgggactggtgggcatggtctgatgtctctgaggtggcagaggtgtcctctctgtcctgcagggg

SEQ ID NO: 47123 - DNA, 601 bp, Human
agctgcaatgcgtgaggatgtgatgggcatgggcagggtctatcctagtctctgtgcctcagtttccccaagggccaggtggttcagggccagtgtatctccggagatgacaagctgtcaacctgctgcagccttagccagccccgtgggcagtctcaccctcacttcccatgcctgggactttgtgctgggcccatcccagtggtcccgaggtggagggttctgggcccttgggccactgcccttttggggagggtgtcggggcagggggctcttgacttcctgctccacttcggcttckggctgggggtactgtgtgcactgatggagggaaggggagccgcagcagagctggaaatgacctgcgtggatgtcgcaattcttcatggagcctcccgtgcacacctggatggggacagtgtggggacagagtggctgggagtggaggaaccaggcagtctggaacatgaggagtgggggcagccggccgggacagggctggctgtcctggccgtggctccagcctgaccactccctgctggtcctcggccatggagatcccacctactgcctcatgtctgggtcctctccgcccccccgc

SEQ ID NO: 47124 - DNA, 601 bp, Human
ccgcccccccgcagcttccgcaactttgacgtggaggagtcccaccagtgctccctggactggctcctgctgggcccagcagccccaccccgccaggaggccttccgcctctgtggctccgccatcccacctgccttcatctctgcccgcgaccatgtctggattttcttccactcagacgcctccagctccggccaggcccagggcttccgtctgtcttacatccgaggtgatggaggctgcagggcaggcaggacaccacggagcacaccgtgcatgcccacaggctcccggcccacargggcggcaccctccacagggccccggctccctgtgggatgtcccctgaccgccctgtcaatctcaggacagtggcaggactgggcatgcggatgccttggacctctcaaggtcactggccccacttcccagtcttggctagtcctgggaactcacccctaaccccaggctcaggtcagggacagagcccaccctggtgttggaggggtctctgctgccacagtgatggggaaccacctgcccgcttttggccccaggccccctggccgaagggaggctcttctgtctcctgactgtcccc

SEQ ID NO: 47125 - DNA, 601 bp, Human
ggatgaggcgggctgccccgacctggcgtgcggccggcggctgggcagcttctacggctcctttgcctccccagacctgttcggcgccgctcgcgggccctcagaccttcactgcacgtggctggtggacacacaggactcccggcgggtgctgctgcagctggaactgcggctgggctatgacgactacgtgcaggtatacgagggcctgggcgagcgcggggaccgcctgctgcagacgctgtcctaccgcagcaaccaccggcccgtgagcctggaggccgcccagggccgcctcacygtggcctaccacgcgcgcgcccgcagcgccggccacggcttcaatgccacctaccaggtgaagggctattgcctcccctgggagcagccgtgcgggagcagtagtgacagtgacgggggcagcctgggcgaccagggctgcttctcagagccacagcgctgtgatggctggtggcattgtgccagcggccgagacgagcagggctgccctgcctgcccgcccgaccagtacccctgcgagggtggcagtggtctgtgctacacgcctgccgaccgctgcaacaaccagaaaagctgtccc

SEQ ID NO: 47126 - DNA, 601 bp, Human
cgtgcaggtatacgagggcctgggcgagcgcggggaccgcctgctgcagacgctgtcctaccgcagcaaccaccggcccgtgagcctggaggccgcccagggccgcctcaccgtggcctaccacgcgcgcgcccgcagcgccggccacggcttcaatgccacctaccaggtgaagggctattgcctcccctgggagcagccgtgcgggagcagtagtgacagtgacgggggcagcctgggcgaccagggctgcttctcagagccacagcgctgtgatggctggtggcattgtgccagcggycgagacgagcagggctgccctgcctgcccgcccgaccagtacccctgcgagggtggcagtggtctgtgctacacgcctgccgaccgctgcaacaaccagaaaagctgtcccgacggcgccgacgagaagaactgcttctcctgccagcccggcaccttccactgcggtaccaacctgtgcatcttcgagacgtggcgctgtgacggccaggaagactgccaggacggcagcgatgagcatgggtgcctggccgccgtgccccgcaaggtcatcacggcggcgctcattggcagcctggtg

SEQ ID NO: 47127 - DNA, 601 bp, Human
atttttattacctcactgttattactggaggccgcccaaatttgttttttgttttttttttttaaataaagaagcttgttttcatggaatggacttactagaacttttattattcagactacctagataaaattaagtaaattcgtttctttctcccaaattaaatattttgactacatgcaagatttaatcattcaaaattgccatgtatttgattatagaccagtagtataatccccctgccccaggccagattccaaaacaataaaccaaaacacacacacacctggcaacagaaatkatatgtattccgagactcattcattcattttggaaagggccagtgtttccagtggtttctccttgggattgtaactttacaactttaaaactaggtaagtagttttcccttgaatctaaagtataactactttgtagtagagaagtaatttatcttaaatcactataatgaagatttactcttaattttaaccaaaatgtttcatttatttgtgtaatgaagatgatcaaagcaacgccacctgtgatccttctgtcttttttactgtatgtggcacgtggctgtgtgattttcctaggg

SEQ ID NO: 47128 - DNA, 601 bp, Human
gattatagaccagtagtataatccccctgccccaggccagattccaaaacaataaaccaaaacacacacacacctggcaacagaaattatatgtattccgagactcattcattcattttggaaagggccagtgtttccagtggtttctccttgggattgtaactttacaactttaaaactaggtaagtagttttcccttgaatctaaagtataactactttgtagtagagaagtaatttatcttaaatcactataatgaagatttactcttaattttaaccaaaatgtttcatttatttgtgtaatgaagatgatcaaagcaacgccacctgtgatccttctgtcttttttactgtatgtggcacgtggctgtgtgattttcctagggaaaggagtgggctttccctgtgggttgagaacctctgtccccctcctctgaagtttccccagtttttcctgcttctctgctaggtgggtgccttagcatgcttgtcttctcatcgtgcttctaaacttctctgaaccggatttatactcttaggtcagtagctgtcaaagaagacactaagtagtgaaagtagctaatatttaccaaacccct

SEQ ID NO: 47129 - DNA, 601 bp, Human
ggaactggtactgataactgtcaccactgtatgcaatgctgcaggcaggggctggcaggtagtaaatgtgcaagatatagctgtggctgccacggctgctgctgctgcttttgtcgctgttgtcagcttttcttggcagccctgctgtctcataccccagtattggggctgaaggatttctttttaccaaagctgcctcttaggacagaagtccttgtcttgaatgcatactgggaagtcttcactctgtcaaacttttctgttctctgcctggtaatttccagacagaagagaacattcraagaacgaacttactttccttctttttttttattgagacagtcgtgcttgattgcccaggctggaatgcaatggcacaatctcagctcactgcaacctccgtttcccaggtgcaaccgattctcctgcctcagacctctgaagcagctgggactacaggtgcctgccacctcacccggctaatttttgtatttttagtagagatggggtttcaccacattggccggggtggtctcaaactcctgacctcaagtgatcctcccatctcggcctcccaaagtgctgggattacaggcatgag

SEQ ID NO: 47130 - DNA, 601 bp, Human
tcactctgtcaaacttttctgttctctgcctggtaatttccagacagaagagaacattcaaagaacgaacttactttccttctttttttttattgagacagtcgtgcttgattgcccaggctggaatgcaatggcacaatctcagctcactgcaacctccgtttcccaggtgcaaccgattctcctgcctcagacctctgaagcagctgggactacaggtgcctgccacctcacccggctaatttttgtatttttagtagagatggggtttcaccacattggccggggtggtctcaaactsctgacctcaagtgatcctcccatctcggcctcccaaagtgctgggattacaggcatgagccaccacacccggcccaatgagctttacttttctacataaggaaaataatggtagaaatgaaatagctgtgaaacttgttttgctatttttgtaccatgctaaaatgttaactactgcttatgtcggcatacacctgagagctgctgtgatttaagcctttttatttttctgggtatgatgtaactcctcccctacctcatccaagtagataagttcatggaggataaacatgacagctgc

SEQ ID NO: 47131 - DNA, 601 bp, Human
acctcaagtgatcctcccatctcggcctcccaaagtgctgggattacaggcatgagccaccacacccggcccaatgagctttacttttctacataaggaaaataatggtagaaatgaaatagctgtgaaacttgttttgctatttttgtaccatgctaaaatgttaactactgcttatgtcggcatacacctgagagctgctgtgatttaagcctttttatttttctgggtatgatgtaactcctcccctacctcatccaagtagataagttcatggaggataaacatgacagctgctgtytcttttatagctggttccagggaatatccactgaatataggaaagattgtcagttgctgtgtgctgccctggtgctggtggagctttcagccttcttctcagaggaaacaatttaaatgtttttgtgaaaccctagaggtctggggtttgtaggacagtcttgagcagagcaggcaaaggtgaagggagtggagcccagacgtgctgcctggagggaaacctgtcacctggagaggaaacggcacaggggaggcccagccgccctcgcctctcagtcccgcacgtctctgttagtggtag

SEQ ID NO: 47132 - DNA, 601 bp, Human
atttttctgggtatgatgtaactcctcccctacctcatccaagtagataagttcatggaggataaacatgacagctgctgtttcttttatagctggttccagggaatatccactgaatataggaaagattgtcagttgctgtgtgctgccctggtgctggtggagctttcagccttcttctcagaggaaacaatttaaatgtttttgtgaaaccctagaggtctggggtttgtaggacagtcttgagcagagcaggcaaaggtgaagggagtggagcccagacgtgctgcctggagggaarcctgtcacctggagaggaaacggcacaggggaggcccagccgccctcgcctctcagtcccgcacgtctctgttagtggtagtcatggttcttgtatttccatcatgttgaggcaattgaaggaaatatgaagattcattcatctcaggaaaagcaagaaatgtattaacagcaagagtagaagttcacttgcatggaagatactgtatagcgtatttatttcttagcgccagtgggagtagctgctaagcccaagattgtgttgtgaggtttgaataggtcaatgtgtgagtcatcaata

SEQ ID NO: 47133 - DNA, 601 bp, Human
tttatagctggttccagggaatatccactgaatataggaaagattgtcagttgctgtgtgctgccctggtgctggtggagctttcagccttcttctcagaggaaacaatttaaatgtttttgtgaaaccctagaggtctggggtttgtaggacagtcttgagcagagcaggcaaaggtgaagggagtggagcccagacgtgctgcctggagggaaacctgtcacctggagaggaaacggcacaggggaggcccagccgccctcgcctctcagtcccgcacgtctctgttagtggtagtcacggttcttgtatttccatcatgttgaggcaattgaaggaaatatgaagattcattcatctcaggaaaagcaagaaatgtattaacagcaagagtagaagttcacttgcatggaagatactgtatagcgtatttatttcttagcgccagtgggagtagctgctaagcccaagattgtgttgtgaggtttgaataggtcaatgtgtgagtcatcaataaagtaacatcaatcattttgttcccgattaatacgtttgctattttaggatgcgaaggactttaaagaagcttattattctgaaa

SEQ ID NO: 47134 - DNA, 601 bp, Human
gaggctgacacaggtgtgttgcactgagacccacacaccacccctcatgttgctgtctatgacgtgacattctacaaagttgactaactctcaggaaagttctgaacaaagccaagtatcatcatcttccttcaatttccatgtcgattgcattcctggaatagttcatgtatatttgaactgtgtaaaacatattttgagtttatatgtaagttgcaatcagtttgtaaatccaaaaattaaaaatagtggtttttcttttcttttttttttttttctttttttttgagatggaatttcrctctgtcgcccaggctggagtgcaatggtgagatctcggctcactacaacctccgcctcccgggttcaagtgattctcctgcctcagcctcctgagtagctgggattataggcatgcgccaccatgcccggctaattttgtatttttagtagagatgggatttcactatgttggtcagactggtcttgaactcctgacctcagatgatccgcctgcctcggcctcccaaagtgctgggattacaggcgtgagccaccgcacccggccaaaacagtggtttttctatcttcctgagcagtc

SEQ ID NO: 47135 - DNA, 601 bp, Human
cttccttcaatttccatgtcgattgcattcctggaatagttcatgtatatttgaactgtgtaaaacatattttgagtttatatgtaagttgcaatcagtttgtaaatccaaaaattaaaaatagtggtttttcttttcttttttttttttttctttttttttgagatggaatttcactctgtcgcccaggctggagtgcaatggtgagatctcggctcactacaacctccgcctcccgggttcaagtgattctcctgcctcagcctcctgagtagctgggattataggcatgcgccaccaygcccggctaattttgtatttttagtagagatgggatttcactatgttggtcagactggtcttgaactcctgacctcagatgatccgcctgcctcggcctcccaaagtgctgggattacaggcgtgagccaccgcacccggccaaaacagtggtttttctatcttcctgagcagtcaagggaaaagttcttcccatcgcaggcgtgtctgaatgcgggatggttggccgacctggccctgcccccccgccccaatacccttagcttcttcccaatctttttgacatcccagtccccccaac

SEQ ID NO: 47136 - DNA, 601 bp, Human
gtcgcccaggctggagtgcaatggtgagatctcggctcactacaacctccgcctcccgggttcaagtgattctcctgcctcagcctcctgagtagctgggattataggcatgcgccaccatgcccggctaattttgtatttttagtagagatgggatttcactatgttggtcagactggtcttgaactcctgacctcagatgatccgcctgcctcggcctcccaaagtgctgggattacaggcgtgagccaccgcacccggccaaaacagtggtttttctatcttcctgagcagtcaaggraaaagttcttcccatcgcaggcgtgtctgaatgcgggatggttggccgacctggccctgcccccccgccccaatacccttagcttcttcccaatctttttgacatcccagtccccccaacatttccaaaatgccctctaagtcaacacttccgccactgccagctgccaccccagagtgccctgtgcctggtaacgatcgttctcacagtcatggccgtagggaaggctctttgtggttcctgggggacttcgtgagattgcccacatgagcatttcttttggaactgagatacagtgca

SEQ ID NO: 47137 - DNA, 601 bp, Human
gattctcctgcctcagcctcctgagtagctgggattataggcatgcgccaccatgcccggctaattttgtatttttagtagagatgggatttcactatgttggtcagactggtcttgaactcctgacctcagatgatccgcctgcctcggcctcccaaagtgctgggattacaggcgtgagccaccgcacccggccaaaacagtggtttttctatcttcctgagcagtcaagggaaaagttcttcccatcgcaggcgtgtctgaatgcgggatggttggccgacctggccctgcccccccrccccaatacccttagcttcttcccaatctttttgacatcccagtccccccaacatttccaaaatgccctctaagtcaacacttccgccactgccagctgccaccccagagtgccctgtgcctggtaacgatcgttctcacagtcatggccgtagggaaggctctttgtggttcctgggggacttcgtgagattgcccacatgagcatttcttttggaactgagatacagtgcacatcgcctctgggggacatggggtggtgggtacacggaaccgaggtgagcctcccttgcgttgcgga

SEQ ID NO: 47138 - DNA, 601 bp, Human
tggttggccgacctggccctgcccccccgccccaatacccttagcttcttcccaatctttttgacatcccagtccccccaacatttccaaaatgccctctaagtcaacacttccgccactgccagctgccaccccagagtgccctgtgcctggtaacgatcgttctcacagtcatggccgtagggaaggctctttgtggttcctgggggacttcgtgagattgcccacatgagcatttcttttggaactgagatacagtgcacatcgcctctgggggacatggggtggtgggtacacggarccgaggtgagcctcccttgcgttgcggaggtgctagccttgtgccgtccgttcttgtccatgtctgtgcaggagaacatcacccggcccacttggttgctgtgaatagcaaactttagaggccactgcatctgagggttggggggtttgcagagaaaacaaaagttggtggctgtggctacttcctatagcaaagtggctcaggaaagggatcccgtgtcacagcctgggtacaccacggcccctccaggagcttgattccttcttagctcaggggaagaatcgcacaaggaccgaggcc

SEQ ID NO: 47139 - DNA, 601 bp, Human
tgacatcccagtccccccaacatttccaaaatgccctctaagtcaacacttccgccactgccagctgccaccccagagtgccctgtgcctggtaacgatcgttctcacagtcatggccgtagggaaggctctttgtggttcctgggggacttcgtgagattgcccacatgagcatttcttttggaactgagatacagtgcacatcgcctctgggggacatggggtggtgggtacacggaaccgaggtgagcctcccttgcgttgcggaggtgctagccttgtgccgtccgttcttgtccaygtctgtgcaggagaacatcacccggcccacttggttgctgtgaatagcaaactttagaggccactgcatctgagggttggggggtttgcagagaaaacaaaagttggtggctgtggctacttcctatagcaaagtggctcaggaaagggatcccgtgtcacagcctgggtacaccacggcccctccaggagcttgattccttcttagctcaggggaagaatcgcacaaggaccgaggcccctgcttgtctgtgaacaaactggcctttgtggccacttcaggcttcggctgcatcatatt

SEQ ID NO: 47140 - DNA, 601 bp, Human
gcgaaaatgaatgtgtgtaattaataggagaacttcctcctgtttgcagagtgctttacagctggcaaacggcttctctccctgaacagccccgtggggcgtcatttccatctgacatctgaggagagctgctgttcatggtccagtcctctgtccattggcccactgggtgtccctaatatgcgctaacaggctcctggcaaacggcgggcatggcagccacgaatctgcacatgagctgtatgccctgggtctcccctgggctctgcggggggaggtgggagccgcctctggttcacakgcggtgctttccaggctgcagggccttctcagcctgggtggaaggagtgacgtcagagtatttctcaggaactgcctgccctaaagttgtggctcataaaccccttccagcttctgtgtagaattctggacccctagggtatcaccacagattttaaaagcagagtaagaacatttcctgtgactgtagggtgagaggccctgggatctgtaattctacactaggctggaatcccagaaaagcttcaatgctcaggaaatgtatgagcagtgccaggatcccctgaaggagtgtggggct

SEQ ID NO: 47141 - DNA, 601 bp, Human
gtccattggcccactgggtgtccctaatatgcgctaacaggctcctggcaaacggcgggcatggcagccacgaatctgcacatgagctgtatgccctgggtctcccctgggctctgcggggggaggtgggagccgcctctggttcacatgcggtgctttccaggctgcagggccttctcagcctgggtggaaggagtgacgtcagagtatttctcaggaactgcctgccctaaagttgtggctcataaaccccttccagcttctgtgtagaattctggacccctagggtatcaccacagaktttaaaagcagagtaagaacatttcctgtgactgtagggtgagaggccctgggatctgtaattctacactaggctggaatcccagaaaagcttcaatgctcaggaaatgtatgagcagtgccaggatcccctgaaggagtgtggggcttttgaagcaagctgcccagcgagcctcccgcagcacctgctgtccctttgccagcagtcagggcccctgccccaccagtgttggttgtgtttctgttctttgaggagaccacatgatgatcttctggtaggagccacaagaaggatacaaat

SEQ ID NO: 47142 - DNA, 601 bp, Human
tttgaggagaccacatgatgatcttctggtaggagccacaagaaggatacaaatgccattagagctgctagagccccagacgtcactggaattggggttcagggtgttgggctgtccccacccttaggcagtactcccactgcctacaacacctccagcgcaggctgaggccatgcgaggatggaagcacatgtgggctaggccaggagggcgtgcgggagggctctccactctgcgctccgctggggtttctccttgtgtcctggtcaataacttcttctctctctggttctccttggcytgagcccccagcctgagccgggctgtccctgagttccctgacccggaagaagggacggccattatctttgggtgactgtcttcttatagctgggaatctctggggctctgagcgggaggcccatggggagccctggaagaacaggcatgggttagactgtttacctcactgccctgtgtgccctgccccggtagaagccgtttctgctgtgtggttctgtctagaactagagcccctcagggccctctgcatgccgtggggtccctttgcaaagcacctcctaacatgtgcttttatctg

SEQ ID NO: 47143 - DNA, 601 bp, Human
atagctgggaatctctggggctctgagcgggaggcccatggggagccctggaagaacaggcatgggttagactgtttacctcactgccctgtgtgccctgccccggtagaagccgtttctgctgtgtggttctgtctagaactagagcccctcagggccctctgcatgccgtggggtccctttgcaaagcacctcctaacatgtgcttttatctgtggctcgggatggggatggtgacttcttcacgcagtcttctgcaggcctctccagcctggctcccgagatgtcacgcatgggtccrtgcagcccagaaaagaccctgcagggggagaagggtcactttggtgcctatctccccagctggcctgtgggctgggtgcctggcagatggggctcccagggaggtgcccccatagacttgggctccacagcaggctgtggggctggcattaatgtggctgggagagcctggctgtctttttagccatttgtttcggaggccctgggggtcatacttgtgcttcctcgtgtatttttagatctcttatcaccgtacacaccacctccctatcagagggctgtcatattcacatatggtaaa

SEQ ID NO: 47144 - DNA, 601 bp, Human
tctcttatcaccgtacacaccacctccctatcagagggctgtcatattcacatatggtaaaataagacgcaacaatagaactcgagtcgtggttcggctttctaggattaggacaaggaggcaactttgatagtaaatggaatctttttttcccagccatccccaccctcaaagagtatcttgctgtaagacctagttcctgtaaaactctgtctgtggggtccctggccaggatgggtgggatcccagggaaagggccaggctgtgtgttctgaacaggaatggttctggaccaaccatygtgggcattcctgagaagccagggagcctggatcttgtcagaggagctcctccctctgctccatcctaaccccgcgggcagcagcaggaactgagagaggacacggtgggggcagcgctgcaaaacccagcagcgggccaccttccagcagcagaaagcatgagttttggttttggggctcttccatttccttccttcttttctttctttttaaatttttgctctttgttatgaaacagcagccagaccgagctatgcatgtcctgctgcacggcaggggcccttatcttgaacgactcc

SEQ ID NO: 47145 - DNA, 601 bp, Human
aactcgagtcgtggttcggctttctaggattaggacaaggaggcaactttgatagtaaatggaatctttttttcccagccatccccaccctcaaagagtatcttgctgtaagacctagttcctgtaaaactctgtctgtggggtccctggccaggatgggtgggatcccagggaaagggccaggctgtgtgttctgaacaggaatggttctggaccaaccattgtgggcattcctgagaagccagggagcctggatcttgtcagaggagctcctccctctgctccatcctaaccccgcggrcagcagcaggaactgagagaggacacggtgggggcagcgctgcaaaacccagcagcgggccaccttccagcagcagaaagcatgagttttggttttggggctcttccatttccttccttcttttctttctttttaaatttttgctctttgttatgaaacagcagccagaccgagctatgcatgtcctgctgcacggcaggggcccttatcttgaacgactccacatactgggcaaggaggtggcagggggaggggcttgtgggaacccagatctgggatgggactcagccaacagtttaa

SEQ ID NO: 47146 - DNA, 601 bp, Human
cagaccagcccccatgaaccctagcgagggccatgccaagaagccgctgttctaatctaatcagtggaggatccagcaagctcggatgggagggaaagaatgactcaacctgcaggccgtctggggtatgcacagtctcgtctcctgagttctctgaagccctttgcagtttttgctttgtatcctaaactccacaggcccgaaccctggcactgagcttgatccgctgcagcccagcccgttcctgtccccatgctggaagcagcctgtcaactcacttccttggtttcctgttgctctycccaccccatacctgctccccacatttctatcagagccctgtttctaaaacaaaagtcagattccgctgtgttcttaaaacccttcagtggttctgaattctttcaagacgaggttccagatacggaggctgagggcgagggtctgcaccccaggcgtctgcactccttgtcaccagctcctggtcgcagccaccccggctctgcttgtcctgtttcagggtccggcttagggctcctgtcctgcggatgccttccccagccccccggggttgggtcaagttctccagagcagcccccgc

SEQ ID NO: 47147 - DNA, 601 bp, Human
ttaaaacccttcagtggttctgaattctttcaagacgaggttccagatacggaggctgagggcgagggtctgcaccccaggcgtctgcactccttgtcaccagctcctggtcgcagccaccccggctctgcttgtcctgtttcagggtccggcttagggctcctgtcctgcggatgccttccccagccccccggggttgggtcaagttctccagagcagcccccgcccctgccacacgtttcttcccccatgtggtcctcatcacatgtacattgtcaccaggtgctttgcctgtttccckggagactgggcacccaaaccacatttcagaaatccctcccactgtctcaagcagtgctgagacagcatggcacgttcacagcacagtgcattcctgtggcctccccgggccacggtcagcccacaggctactcacagaaagtgacaggccgtgttcagaagctcttcaagcagtctgacgtggctgtggcccgtcatgagattttatattttacaaaagtgtcagtcgataaaggatttgtcctgcgccaccggagcactggcctgaggtgccctgatccccgagaacccctgcctgcac

SEQ ID NO: 47148 - DNA, 601 bp, Human
gaattctttcaagacgaggttccagatacggaggctgagggcgagggtctgcaccccaggcgtctgcactccttgtcaccagctcctggtcgcagccaccccggctctgcttgtcctgtttcagggtccggcttagggctcctgtcctgcggatgccttccccagccccccggggttgggtcaagttctccagagcagcccccgcccctgccacacgtttcttcccccatgtggtcctcatcacatgtacattgtcaccaggtgctttgcctgtttccctggagactgggcacccaaaccrcatttcagaaatccctcccactgtctcaagcagtgctgagacagcatggcacgttcacagcacagtgcattcctgtggcctccccgggccacggtcagcccacaggctactcacagaaagtgacaggccgtgttcagaagctcttcaagcagtctgacgtggctgtggcccgtcatgagattttatattttacaaaagtgtcagtcgataaaggatttgtcctgcgccaccggagcactggcctgaggtgccctgatccccgagaacccctgcctgcacagtcagcgctctccccaatgt

SEQ ID NO: 47149 - DNA, 601 bp, Human
accccaggcgtctgcactccttgtcaccagctcctggtcgcagccaccccggctctgcttgtcctgtttcagggtccggcttagggctcctgtcctgcggatgccttccccagccccccggggttgggtcaagttctccagagcagcccccgcccctgccacacgtttcttcccccatgtggtcctcatcacatgtacattgtcaccaggtgctttgcctgtttccctggagactgggcacccaaaccacatttcagaaatccctcccactgtctcaagcagtgctgagacagcatggcaygttcacagcacagtgcattcctgtggcctccccgggccacggtcagcccacaggctactcacagaaagtgacaggccgtgttcagaagctcttcaagcagtctgacgtggctgtggcccgtcatgagattttatattttacaaaagtgtcagtcgataaaggatttgtcctgcgccaccggagcactggcctgaggtgccctgatccccgagaacccctgcctgcacagtcagcgctctccccaatgtctgccatctgccgtgccctgtcaggctgctgtgccattcttcgcagtgtctc

SEQ ID NO: 47150 - DNA, 601 bp, Human
ggctcctgtcctgcggatgccttccccagccccccggggttgggtcaagttctccagagcagcccccgcccctgccacacgtttcttcccccatgtggtcctcatcacatgtacattgtcaccaggtgctttgcctgtttccctggagactgggcacccaaaccacatttcagaaatccctcccactgtctcaagcagtgctgagacagcatggcacgttcacagcacagtgcattcctgtggcctccccgggccacggtcagcccacaggctactcacagaaagtgacaggccgtgttcrgaagctcttcaagcagtctgacgtggctgtggcccgtcatgagattttatattttacaaaagtgtcagtcgataaaggatttgtcctgcgccaccggagcactggcctgaggtgccctgatccccgagaacccctgcctgcacagtcagcgctctccccaatgtctgccatctgccgtgccctgtcaggctgctgtgccattcttcgcagtgtctctggggaagaattttgtcgaaactctgcagatgttcttttttttttttttttttcaaggcagagtctcgctctgttgcccaggct

SEQ ID NO: 47151 - DNA, 601 bp, Human
tgccaggctcgatagcatcatgtccattcctgctcaagcatttgaaacgttctcacggagcagaatgtggcagaacagctacaagctgaaaaatacttatatggaggctgatttttttagtgcaaggaaggactccaacagctagaaccgttctgctatgatcttcattgtgttgggaaaaggtggactcccagcacggctgtgttttaaggggaagctgagggtgcgtgtgtgctgagaagtgactggacagcagttcgctgggattacagtcccagctccacgccagccagccctatgrcctcagatgggtctggcagcctctccaggccttcactttctgctctgtaaagcgaggggttgaactggaaacctggagtagcatccagctgttaacactctgctccatgcatctgtcagagctccagaaggaggctgactgcccagccctgccacctacaggctgtgtgaccttaggcaagttacttaccctctctgtgccttcgttccctcatatttaaactggggatggtaacagtctcggcctaatgaggctgttgcaaggaatacatggcatcatatccataaagctcttagaata

SEQ ID NO: 47152 - DNA, 601 bp, Human
taccaggcgtgcctgctcagacctgctggctcctgagaggggcttagaagcctcttgcctgcgcagatcgtcgtttctagctgcgaggagccaaaatgttcagggtctgagctttaaggtctaactgttgtactagaatctagatcctctggattaaagtggaaaagaagaacggattaatgagtttttaaactggccaaattgttttatttaaaaatatgtcccccgtggtttgtacagtgttgatcacacacgggctccaggtttcaggatatctagagcccgtgtgtgatagagagaygggaatgaacacatggatgaaacagccaggaagaaattcctccctgggaaaatggctagcaatgtgttgacacacctgctcaagccatttgcaagttattttcatcatcttgagctggagctaggagtcatttctgacagcataagggttctttaactcacagttatggtgtgactttttctgtgacctcagagacatagaagctgagacccccactcagtccatgttctcccgtgggccatgccctgtggggccaagggaccatccacactgagcccacccccaagagcttttcttctt

SEQ ID NO: 47153 - DNA, 601 bp, Human
tttgtcatttttagtagagatggggtttcaccgtgttagccaggatggtctccaactcctgacctcgggtgattcccccgtttcagcctcccaaagtgttgggactacaggtgttagccatcacaccggccccatattagaattgatttaaatatatacatattgatataagatataaccaattagaattgatttaaacatatacatattgatataagcagcttgttacaaagttgttgggcaaaagttcttgatttaaaaataactaagatgaattaaggcaagcagtcatcgatttgaatggccccctttaaaagcaaagcatccctttattcctttgattgaaaggaagcccttttctgttgcattttaattgtgcagtttaagaaccatctgttgctggactcccacgtctctgttgtaatattcccagccacacgaaaagaaaaataaaaaataagccaggcgtggtggcatgcacctgtagtcccagctactcaggacactgaggcaggagcattgcttgagcccaggagcctgaagcaatgatcgggccatgattgtccctgtgtgtagccactgcactccagctggggcaaca

SEQ ID NO: 47154 - DNA, 601 bp, Human
actcctgacctcgggtgattcccccgtttcagcctcccaaagtgttgggactacaggtgttagccatcacaccggccccatattagaattgatttaaatatatacatattgatataagatataaccaattagaattgatttaaacatatacatattgatataagcagcttgttacaaagttgttgggcaaaagttcttgatttaaaaataactaagatgaattaaggcaagcagtcatcgatttgaatggccccctttaaaagcaaagcatccctttattcctttgattgaaaggaagccsttttctgttgcattttaattgtgcagtttaagaaccatctgttgctggactcccacgtctctgttgtaatattcccagccacacgaaaagaaaaataaaaaataagccaggcgtggtggcatgcacctgtagtcccagctactcaggacactgaggcaggagcattgcttgagcccaggagcctgaagcaatgatcgggccatgattgtccctgtgtgtagccactgcactccagctggggcaacataatgagacccctatctctttcaaaaagtaaaaaaataaaaagtagttgctact

SEQ ID NO: 47155 - DNA, 601 bp, Human
cagctaacataatttgaggttatacaatctggtagcttggggcactggcattttaagttgttgattaaggggaaatgaatacgttttggaagaccagtgtttaaagggtagggttgatactttggtgtaaaaattgagaaacctgatccctgttttcatcggggtcacaagccatcccacctgcatgcaggcgtttctgagcaggctcagggttttcttgagggggccgctctgagaacaccgagaagggcaggaagctgaccggggttggtatcccccaaggaaagcatggagcgtgtayggagaggggaggtggcgaggagacaccagtgtcgggggcagccctgtccccacagcattatcagactccaggccagctctagcccaccctgagctctctttcttgaatggttcttttcagcacacagacggcgagaacccactacagcttactctagctgcgttccggggtctgtttaaaaggatatgagctcttttttaatggatttgttaggggagaataatgtacatattcttgggaaattcaagtgaaccttgaacttcttagggagaacctacactgatagaagaaaatggtgat

SEQ ID NO: 47156 - DNA, 601 bp, Human
tcagacacatttctgtgtactgaatgcttttgtcatctgcattttcctcaagaaatgtaaaaattgtttctttgagaagaaaagtaattctaaggcaaaattatatttcagaatgtggatagccttctgaaattatgtatggaaagaaaaagatgattttattagaaaacttaaaaaattccatacaaattaccacacattgagagattattagatattgagttaaaaatctgagtaaaaggacagtgatgatataaaatgaacctgccattcatccctaatgctcagagatcataaaatracgtgcctctctgtttcctagtattttgtagaagcagctgaggtttagaagtaaatacactgggcaggccagatacagaaaataaagacaagcaagtcagtgattcaagatctagcaaaaatgaagtcagaagtgagcgagttccttgagaatttatagaatttgtatacacgggagtctttcccataaatgaatttagtttgatacttaaaacatctgtgatagtttccttttataaatttagtttctagacaacaactgtatttttctcttagagcagatgagaaaatcagaataaga

SEQ ID NO: 47157 - DNA, 601 bp, Human; identical to SEQ ID NO: 31125

SEQ ID NO: 47158 - DNA, 601 bp, Human; identical to SEQ ID NO: 31126

SEQ ID NO: 47159 - DNA, 601 bp, Human
gatttatatgcataggcacgttggttgtttctttctcccgagatgaagtcatctttttttcaatacttatccacatcacaaagctcccaagccttgattagcacagttgtctcagcacattggtgttccacaggaatgcaaaggcgcgtctgccctttagtaagtctgtatccactgacacccatgctcctggtaaaatcggaacctctattaaagtagctgtaagttaattattattgagcaatgttttggcatagccactatagactgcctgctgaaaacctggaccaggactggatcygtaaggtctgccttcagccgcttttccttgtatcagttataattagatctctttaccactgataggcttaatggttaatcaacacaaatatggacttttccttaaacattccagaaaccttaataattatacttgaaaaaagtgtgagtttggggggaagtaaaatagaaaaactatgttttgctcagtgctttaaatcagtgaattaacctgagcatgtcagtttcttttactgcaggattgaaattacatctcaccgctagtaataaataaatctcaaagcagccactcgctttatta

SEQ ID NO: 47160 - DNA, 601 bp, Human
cttagggaccacatagagctgaaggcttgtttctcttcactgtggcaattaaatcctattactccttgacttcttatacatgcactgagtgtgcatgtaatttggcccttcccaatgataaaatgcagaggtgaaacacggttgctgtgctgtgaagccactctgtccttgtcagtgtccttgcagtgccaaaagcagatccgtagtgattttgccaaaaaactgtggttcaaatgtgaggccccgtgagggcttccttgctgtttgaaaccttctcctgagatgtagcctcagggatgcygttgtaaccgttacctcgggaccgtctgaccccactcaccccagaagagggaagatttatggatccaaaatagaataaatgcaaagctcaattgacaaagtctgtagacaaggcccagacatcacagctgttgagcaggcccaggagaagcttgagtccttgaaaccagtgaagaaaatgctgtttcagggatgagggggagcgaccgagagaggaggaaactcagacttagcggtatagaggatgtcagtcactttggcaggagaacttttaacggaaatattgagggcaaaacctggt

SEQ ID NO: 47161 - DNA, 601 bp, Human
gtgcctgctgctcagggccctggtgggctgtgtgtcctccgtgcgctgggttccctgggctctatgcttgcccctttgtaccaccgaacagggcactccccagagtgaggactggcatctcgctctatttctatgcggggccagtttctactgtttttatgtattttaatattatgaactttttacatttttgattgtaagatcgtatcttttatttattgactctgaaaacacaggccttcttcatttagctagaaaaaatgataaaccctaaaaaaggtggggaggtgatttatactaytctggaatttgtatggatgcctcctcagaaagtctagattttggattttctagaatttctcgagtttagattttctggaaaatctagatttttaattttcctttttgaaaattgatgacagtgcatctgttaacctttgcccttttgtaactaaaatggattatgtagaagaggaaataagatttatcaaactgtttcagactttgtgaattatagcagcctttgccatggaagtttattgaatgctactggattctgtggtagctaccattctgacataattctttttgtaaatacata

SEQ ID NO: 47162 - DNA, 601 bp, Human
gtattttaatattatgaactttttacatttttgattgtaagatcgtatcttttatttattgactctgaaaacacaggccttcttcatttagctagaaaaaatgataaaccctaaaaaaggtggggaggtgatttatactactctggaatttgtatggatgcctcctcagaaagtctagattttggattttctagaatttctcgagtttagattttctggaaaatctagatttttaattttcctttttgaaaattgatgacagtgcatctgttaacctttgcccttttgtaactaaaatggrttatgtagaagaggaaataagatttatcaaactgtttcagactttgtgaattatagcagcctttgccatggaagtttattgaatgctactggattctgtggtagctaccattctgacataattctttttgtaaatacatattagatcctagaaattatggaaaaatgcatttttgttaagattttaaagattgcttgtatttatgttttacttagcttttaaatttacttttggcaactctctttgctgttgttttttttttctgccatctttcttctgacagtcgcagcctgacttgga

SEQ ID NO: 47163 - DNA, 601 bp, Human
atagagttctcaaatttaatatggaaggatttctacactccttttgtttcagaacttcaaattgatttcttgatttgttttgagttacagcaaagataaatatatagtttgatagtcaaagttttatgaatctggatttataatctgtctggaaattcaatttttttttctactttaatgtcatggctgcaaaatatgtgctatacagcacccgtcccccggataaggaaccatgtttagcacctcccatatgccaggccccttccatgtggattcatgtatccacccagtcagctggtgmttcatgagggcactgttctaggtgcttgagatactcattttcatctcatttaatcctcacgatggctttgtaatgtatttattattatgcacattttcacggctgagaaaacagatgttcaagtgcattaaataattacttaaggtcacatgacggagcttctttgtggaatttggactcatgcccaggacctgatggcgtctccttccatttttaccagttgtgtagactgctcctcctttttctgtcccgagagctggttttgtctctgatgcttgacagctctattttgaatcagca

SEQ ID NO: 47164 - DNA, 601 bp, Human
tgaggccgggcgcgatggctcacgcctgtaatcccagcactttgggaggccaaggcgggcggatcacgaggtcaggagttcgagaccagcctgaccaacatgatgaaaccccgtctctactaaaaatgcaaaaattagccgggcgtggtgacgcacgcctgtaatcccagctactcaggaggctgaggcaggagaatcacttgaaccagggaggcagaggttgcagtgagctgagctcacactactgcattctagcctgggcgacagagcgagactctgtctcaaaaaaaaaaaaaaaaaagaaatgatctctgaatcttctgaattatggcccatagcatcacaatgtgccataattttcaaagaccctgaaccaggaactgaaaactcattgactcaggctgaatcactacccatcggcctggcatgtggcttcttgcaagcagaatgtccacagagccaccataaaaccagaaacagcctgacaaggaaatggccacaccaagcccaaatgttccaccccgtggagggacttggtgccactttaaaactaagagtggcatgtgacatgaagcctactgacttggttagcttgactgct

SEQ ID NO: 47165 - DNA, 601 bp, Human
gactcaggctgaatcactacccatcggcctggcatgtggcttcttgcaagcagaatgtccacagagccaccataaaaccagaaacagcctgacaaggaaatggccacaccaagcccaaatgttccaccccgtggagggacttggtgccactttaaaactaagagtggcatgtgacatgaagcctactgacttggttagcttgactgctgttccctcctgagctgcgggggagcagacggcggcagggatgcagtttgggagctgccaggacttgtactgtcctggactggtcattcatccsctccacaagaaaggtcaccttatacctggctggttggtccctgctgatttgtacctgtgaattcatttgtgtactgatgtcagtttttctcttttcttcattgaaacagacaaatggttatgatggagaattgtatggatcacagtccctgaatagaagatctggcagggttagtatagtaaatttgcatggctcaaaattcaaataggttgtttcaaagcttctagaactaaaaactaattgctaaatttaaatttagcttctttgctgtttttaaattttaaaatcggtctgtctttt

SEQ ID NO: 47166 - DNA, 601 bp, Human
cattcctatttacctatttagcattgcatgcactttaattatttattttttgagacaaagtctcgtgccctcacccaggctggagtgcagtggtgctatctcagctcactgcaacctctgcctcctgggttcgagcgattctcctgcctcagcctcccaagtagcttggattacaggcatccactaccacacctggctaattttttttgtattttttagtagagatggagtttcaccctgctggccaggctggtctcgaactcctgacctcaggtgatctgcgcacctcggcctcccaaartgctgggattacaggcatgagccatggcacccggctggatgcgacattttaaaaatgtatactcaagacacgtaaagatggccttcagggcatttgcactctgtggataagggctctccagtggacgggtggcagcaggctgtcacactccacccacctttctggcaccccagggctgagctatagcccgcaggcgggctgggctgaagaaagattgaaaattttgcaataaatggaattttagttacccaaggagataagacaaggagtttactgacaacgcagtgtgaaactcagtaa

SEQ ID NO: 47167 - DNA, 601 bp, Human
tgcagtggtgctatctcagctcactgcaacctctgcctcctgggttcgagcgattctcctgcctcagcctcccaagtagcttggattacaggcatccactaccacacctggctaattttttttgtattttttagtagagatggagtttcaccctgctggccaggctggtctcgaactcctgacctcaggtgatctgcgcacctcggcctcccaaaatgctgggattacaggcatgagccatggcacccggctggatgcgacattttaaaaatgtatactcaagacacgtaaagatggcctkcagggcatttgcactctgtggataagggctctccagtggacgggtggcagcaggctgtcacactccacccacctttctggcaccccagggctgagctatagcccgcaggcgggctgggctgaagaaagattgaaaattttgcaataaatggaattttagttacccaaggagataagacaaggagtttactgacaacgcagtgtgaaactcagtaattacgaatcgtgctagggatatgagattgtgaaaagcagtactagatacacccctggcatcaccaagacacaaacactgaaggtg

SEQ ID NO: 47168 - DNA, 601 bp, Human
ctctgcctcctgggttcgagcgattctcctgcctcagcctcccaagtagcttggattacaggcatccactaccacacctggctaattttttttgtattttttagtagagatggagtttcaccctgctggccaggctggtctcgaactcctgacctcaggtgatctgcgcacctcggcctcccaaaatgctgggattacaggcatgagccatggcacccggctggatgcgacattttaaaaatgtatactcaagacacgtaaagatggccttcagggcatttgcactctgtggataagggcyctccagtggacgggtggcagcaggctgtcacactccacccacctttctggcaccccagggctgagctatagcccgcaggcgggctgggctgaagaaagattgaaaattttgcaataaatggaattttagttacccaaggagataagacaaggagtttactgacaacgcagtgtgaaactcagtaattacgaatcgtgctagggatatgagattgtgaaaagcagtactagatacacccctggcatcaccaagacacaaacactgaaggtgaaaatacagcttagaatctccagttgttaa

SEQ ID NO: 47169 - DNA, 601 bp, Human
tggtctcgaactcctgacctcaggtgatctgcgcacctcggcctcccaaaatgctgggattacaggcatgagccatggcacccggctggatgcgacattttaaaaatgtatactcaagacacgtaaagatggccttcagggcatttgcactctgtggataagggctctccagtggacgggtggcagcaggctgtcacactccacccacctttctggcaccccagggctgagctatagcccgcaggcgggctgggctgaagaaagattgaaaattttgcaataaatggaattttagttaccyaaggagataagacaaggagtttactgacaacgcagtgtgaaactcagtaattacgaatcgtgctagggatatgagattgtgaaaagcagtactagatacacccctggcatcaccaagacacaaacactgaaggtgaaaatacagcttagaatctccagttgttaagaatctctgctgtactgtttgtgcctcgcgtctttagataaactagcgttcctgggctcctagtgttggctcggttgtgctgttccatgttcgccttttgaatgggatgggggtgcttttggagtcgtaaggaag

SEQ ID NO: 47170 - DNA, 601 bp, Human
tcctgacctcaggtgatctgcgcacctcggcctcccaaaatgctgggattacaggcatgagccatggcacccggctggatgcgacattttaaaaatgtatactcaagacacgtaaagatggccttcagggcatttgcactctgtggataagggctctccagtggacgggtggcagcaggctgtcacactccacccacctttctggcaccccagggctgagctatagcccgcaggcgggctgggctgaagaaagattgaaaattttgcaataaatggaattttagttacccaaggagataatacaaggagtttactgacaacgcagtgtgaaactcagtaattacgaatcgtgctagggatatgagattgtgaaaagcagtactagatacacccctggcatcaccaagacacaaacactgaaggtgaaaatacagcttagaatctccagttgttaagaatctctgctgtactgtttgtgcctcgcgtctttagataaactagcgttcctgggctcctagtgttggctcggttgtgctgttccatgttcgccttttgaatgggatgggggtgcttttggagtcgtaaggaagtgcttgtcact

SEQ ID NO: 47171 - DNA, 601 bp, Human
gagattccatctcagacaaacaaacaaacaaacaaacaaacaaatagaacaaatgaaaagaataggaactaaccaggtagagcctagaggggaagctcttcaaggtaagtagccatttgagcagagcagaggccgcgcagaatgggcagaacccaggagaggtgccatgtggctgagcacagggtgctgttggagctgttccgtgaacctggtgactccagtagcagctcccacgctgaaatcagaaaatgaaatctatgcaattcctctgcgatttcctttagccactcccatgtatcaytgacctcattaaaatgcttctagaagaaatagctctgacccttccccgccctgtccccaatttccagcccctattctcgtttccctcccggggggttggggggtatctttttcttgccagggcacttcttcctcacctcttcaccccttgtccaaccccttcatgtccagggagactgcagaaggtgctggcagctccatggcgcccactgcttgccacctttctcaacccttcccatagtcccccagtctgtaataaatccccccactgtaagctgatggcccttctgtcccccaatac

SEQ ID NO: 47172 - DNA, 601 bp, Human
cacccaggctggagtgcaagggcacgatctcggctcagtgcaacctacgcctcccaggttcaagtgagtctcctgcctcagcctcctgggtagctgggattacaggcacgtgtcaccacacccagttactttttgtgttttcagtagagacgggtttcaccacgttggccaggctggtctcaaactcccgacctcaggtgatctgcctgcctcggcctcccagagtgctaggattacaggcatgagccaccacacccagccattaataactttctgaatttccatcagattgcatacttaygtgtttgatatattaataaatggctgagcaaactagtatgtcctcaagggaaaatagggaaattaaagttcctttataccgggcaaagtttgacatcaccatttgtggcagtgtaagctcctgtttacccacgttgattaattaagtagcattttccagttaaccaattactctttcttctacttagcaacttttaaagggttataaaatatttaacattaaaactataattaacataatttgatattttatcccaaagtcacttcacataagagtaattttctaagcatcaagtatgag

SEQ ID NO: 47173 - DNA, 601 bp, Human
ccttacttccatgtcacagatgccgggctaaggaacttccacagccacgtggccaacaagagatggagccatgattcagacttaaagctttctgacttctgcacattagccacataactcctaaacataaggtgcacgtggaccgtggcgatatagactttcactttgttcttttctgcgtgattaggtccagttggaaggtttgagagctgcttttgcttagggaagctggggtgggcagtaagctctattcacaacagttcactgtgtctttgcaccataaaccagggcatgaatggcrtaggatggagaaggatttgctgcaggatgaagttttcctctctcttacatcaggaaaccctcaggcaaaattcttctgctttaaagtgttgacattaagtgttttccttattttcaacaagaatgccaaaaagtgaggctagtaatactggtgattttcttgtatatctcaaatgtggcattgatgctttacatgtgctgtgtacacagcagtattaatctgtgaatctgaaacaacgtcttgcccctgagtgtaagtgtatagtaaacatttatcaaataaaatagaggtggatgggtc

SEQ ID NO: 47174 - DNA, 601 bp, Human
ttgatggttattttagtctacagttgaaatcattcgttcattcaacaagtatttcttgagtttgccaggcctcatctggtcactagccctggtgaggaaacaaactaagagatggtatttgacatgagatcatgagcacccctgaagatctatatgagatcacaagcacccctgaagatctggatgagatcatgagcacccctgaagatctggatgagatctggagcacccatgaagatctggatgagatcttgagcacccctgaagatctggatgagatcttgagcacccgtgaagatccggatgagatcatgagcacccctgaagatatgggcttccttataattcgcaagcagggcacttcggcaggtccccagcagagcctgtgaggccagcagagggttctgtgcccagcacagtgcagggtgtccaggggctggaatggaggggccttcagcagtggcgaggcttgctatatggtgctgcgtgggtctctcttgaagatgctcctcaggacatgtcgggatcctaaatagtgttcaaatcctgcccccgccccaccatgccttgctcaggaagaatatgagaatgtttataataa

SEQ ID NO: 47175 - DNA, 601 bp, Human
aagatctggatgagatcatgagcacccctgaagatctggatgagatctggagcacccatgaagatctggatgagatcttgagcacccctgaagatctggatgagatcttgagcacccgtgaagatctggatgagatcatgagcacccctgaagatatgggcttccttataattcgcaagcagggcacttcggcaggtccccagcagagcctgtgaggccagcagagggttctgtgcccagcacagtgcagggtgtccaggggctggaatggaggggccttcagcagtggcgaggcttgctwtatggtgctgcgtgggtctctcttgaagatgctcctcaggacatgtcgggatcctaaatagtgttcaaatcctgcccccgccccaccatgccttgctcaggaagaatatgagaatgtttataataacgtgaaaatgtatctaagactagcagatgtgaacataaatcaaagttacaagggcgtagcttccagataatcgagttgctggtattttcctttaccagaagtgagaaagttcaggtaaatggatagacagatgtgtacatagcaaccacccaggtagaaggtaatctggcaatt

SEQ ID NO: 47176 - DNA, 601 bp, Human
ccaccatgccttgctcaggaagaatatgagaatgtttataataacgtgaaaatgtatctaagactagcagatgtgaacataaatcaaagttacaagggcgtagcttccagataatcgagttgctggtattttcctttaccagaagtgagaaagttcaggtaaatggatagacagatgtgtacatagcaaccacccaggtagaaggtaatctggcaatttaaaaagccatacataattttgtattaaccctaactctcattttgcttccacttggaaagatagtggagaagcaaaatttttsttcccttgctaaagcgccaagcgccctgtgcaagtcttcagtttctgtgccggaaggcagcttaagttctcaaaacagtcatttccacatccacggggtgactttctgtgtctacactaggtgtgactgcacacccaattgaacgggtgctttgtgttattttcttcttcctaactctgagaaattctgtgttcctctgataatgtgattggcttttttattcttagcgagcactgatttgaatatgcgtttgctgtctaaccctaactctcttttccttgccgtgcgtggctaacctca

SEQ ID NO: 47177 - DNA, 601 bp, Human
cacggggtgactttctgtgtctacactaggtgtgactgcacacccaattgaacgggtgctttgtgttattttcttcttcctaactctgagaaattctgtgttcctctgataatgtgattggcttttttattcttagcgagcactgatttgaatatgcgtttgctgtctaaccctaactctcttttccttgccgtgcgtggctaacctcaccacttactgcagcatgttttctgtcggcctctattctccttgctcctttgctgaccctgttcctttgtttctggctgcgtgtcctggcggyggctgtgtgggcagccctcggagtacagcggccacctcaactccagctcccgcgcctcctccagggccagctcggcccgggccagccctgtggtaagtcggcctcctggccttgctcctactcagtgtcaccctccctcccccttcccttatcctcctcttccaacgtctccaaatttagaatattactctgcggtgatattattaggattacattgctcaacttttcaaggaccgtaaaagaaattgttagctgtgcttagagatggggatcttagaggaggcaaactttatacaaagg

SEQ ID NO: 47178 - DNA, 601 bp, Human
tttaaaaatttgaagtattgactgttaatgctttgcttgaagtgttacctgtgatcagaccccgacagtgtttaaggtaaagcgtggcctgtagatcccgggacgctcccagtttggccccaatcattcgttaccctcctggttctcagatccttcgaaatgtgcagatttgcagccctgcatcctgcttgtcactcagcgtggcccaagttttgtttcagaaaataggagccctattaggtcatccccagcttgttaagtctcattattgtgtgttttcccctgggttgttggaatttgrcacagttttacctgatgtgatgcttgaaggcgaccctatgactctttttaaaggaagagtttgcaggacggttttggactggggcttgtgggaatggaggaggggaggtgggcacatggccggggaaacagctccaggctgcacgaccagaccagcgttcccaccctcaagagccagtgagaaaccttggggagaaaaagcaaagatgggcaaggcttccctgttcgtctccactcatatcaaaatttccagcctgagctgggtgtggtggctcacatctgtaatcccagcgtcatggga

SEQ ID NO: 47179 - DNA, 601 bp, Human
aaatcccatctctactaaaaatacaaaaattagccgggtgtagtggcgcatgcctgtaatcccagctacttgggaggctgaggctgaagaatcacttgaatacaggaggtggaggttgcagtgagctgagatcgcaccactgcactccagcctgggcaacaaggcaaggctccgtctaaaaaaaaaagaaaaaagaaaaaaaagaaagaaaagaaaatataagtatttacaattgacagaagaatgttgtggctttactttcagtgaatcccaaacacgcttaatgccctctgtaccctcygcctggttccagtgagacatgacaattggattttgttaagcattgtctttattcaagcatatgatgaagtctcaaaataacagggctcaatatagtcacttagagattgaaatgacacaaatttctttgtcatacgaaattgaccgaagagactgaaatgatacaaattcctttgtcatgtgttttctaaatttgtataaaatttactcacaggtttattagatgatcataaacagaaagatgtgagttcagccttcctgggcgtcctgggacctgatgggggtgggtgatctccttgta

SEQ ID NO: 47180 - DNA, 601 bp, Human
tgaatacaggaggtggaggttgcagtgagctgagatcgcaccactgcactccagcctgggcaacaaggcaaggctccgtctaaaaaaaaaagaaaaaagaaaaaaaagaaagaaaagaaaatataagtatttacaattgacagaagaatgttgtggctttactttcagtgaatcccaaacacgcttaatgccctctgtaccctctgcctggttccagtgagacatgacaattggattttgttaagcattgtctttattcaagcatatgatgaagtctcaaaataacagggctcaatatagycacttagagattgaaatgacacaaatttctttgtcatacgaaattgaccgaagagactgaaatgatacaaattcctttgtcatgtgttttctaaatttgtataaaatttactcacaggtttattagatgatcataaacagaaagatgtgagttcagccttcctgggcgtcctgggacctgatgggggtgggtgatctccttgtatctgctcttccttccctgaatcgattgctcaactagcaaaggtcagttgattgcgggctggttggcacgcttagggaacaaaggtcagtcccgcag

SEQ ID NO: 47181 - DNA, 601 bp, Human
tccgtctaaaaaaaaaagaaaaaagaaaaaaaagaaagaaaagaaaatataagtatttacaattgacagaagaatgttgtggctttactttcagtgaatcccaaacacgcttaatgccctctgtaccctctgcctggttccagtgagacatgacaattggattttgttaagcattgtctttattcaagcatatgatgaagtctcaaaataacagggctcaatatagtcacttagagattgaaatgacacaaatttctttgtcatacgaaattgaccgaagagactgaaatgatacaaattyctttgtcatgtgttttctaaatttgtataaaatttactcacaggtttattagatgatcataaacagaaagatgtgagttcagccttcctgggcgtcctgggacctgatgggggtgggtgatctccttgtatctgctcttccttccctgaatcgattgctcaactagcaaaggtcagttgattgcgggctggttggcacgcttagggaacaaaggtcagtcccgcagtgagggacaaggctgtcccccatctcatcctgggtgccttacatctgatgaaacctcccgtatgtggttcttag

SEQ ID NO: 47182 - DNA, 601 bp, Human
tagtcacttagagattgaaatgacacaaatttctttgtcatacgaaattgaccgaagagactgaaatgatacaaattcctttgtcatgtgttttctaaatttgtataaaatttactcacaggtttattagatgatcataaacagaaagatgtgagttcagccttcctgggcgtcctgggacctgatgggggtgggtgatctccttgtatctgctcttccttccctgaatcgattgctcaactagcaaaggtcagttgattgcgggctggttggcacgcttagggaacaaaggtcagtcccrcagtgagggacaaggctgtcccccatctcatcctgggtgccttacatctgatgaaacctcccgtatgtggttcttagaatgcagagaggtctctgtagagtgcagggcagttccctcgcggatgtgttacggtatcccttgattgatcgtgtcgagaatagaaagacggtgagcacaggcagcatccctggtatctgaagagagcctgggagacagaactaagctagctcatttccataatttccaaaactcatggtcctcttatactaaattgactccatttctgttttctgtcttggg

SEQ ID NO: 47183 - DNA, 601 bp, Human
cagggcagttccctcgcggatgtgttacggtatcccttgattgatcgtgtcgagaatagaaagacggtgagcacaggcagcatccctggtatctgaagagagcctgggagacagaactaagctagctcatttccataatttccaaaactcatggtcctcttatactaaattgactccatttctgttttctgtcttgggacatttacaccattgctggtatattttggatctcctgggacaacagaaagtgctagtggttgtgtttggccttgttgatgggaagaagccaggagagcctggrtaggactccccggtccttctgcctgggagggaggagcaacaggtcttgggcagggcctggtgtaagcgtggtggcaaaggtgaatgaccctccagtctggccttccttgaggtcatatggagcaggcagtgctctgaggcagggagtttcagaacccgggttcagatgtcacagctctcattcctggcttgggacatctagctgggcacataaacttcttgtgcttcccctggaaagaggggtcatgatacccttaaaaagcaaaaagaaacccccccaaaaaaacaaaaaaaaaacata

SEQ ID NO: 47184 - DNA, 601 bp, Human
ctggataggactccccggtccttctgcctgggagggaggagcaacaggtcttgggcagggcctggtgtaagcgtggtggcaaaggtgaatgaccctccagtctggccttccttgaggtcatatggagcaggcagtgctctgaggcagggagtttcagaacccgggttcagatgtcacagctctcattcctggcttgggacatctagctgggcacataaacttcttgtgcttcccctggaaagaggggtcatgatacccttaaaaagcaaaaagaaacccccccaaaaaaacaaaaaaaaaacatatggttactttatttctccttggctggggttagccagggatgggatacagttgttgtagcgagagctcatgggaaatgctcccaggccggggacttcgtcagggacacgtatccagggccagtatgagtgaggacagaggacaagaaaaatatgaagtcagggtcagccctgcaggctctgtagggagtcccgccctgggtttgggagatacaggtgcacaggtgagtgtgtcacacccatcagaggggagggagggagggtggtgctgttaaagggcagtagtaaccagaatgaag

SEQ ID NO: 47185 - DNA, 601 bp, Human
tcatatggagcaggcagtgctctgaggcagggagtttcagaacccgggttcagatgtcacagctctcattcctggcttgggacatctagctgggcacataaacttcttgtgcttcccctggaaagaggggtcatgatacccttaaaaagcaaaaagaaacccccccaaaaaaacaaaaaaaaaacatatggttactttatttctccttggctggggttagccagggatgggatacagttgttgtagcgagagctcatgggaaatgctcccaggccggggacttcgtcagggacacgtatcsagggccagtatgagtgaggacagaggacaagaaaaatatgaagtcagggtcagccctgcaggctctgtagggagtcccgccctgggtttgggagatacaggtgcacaggtgagtgtgtcacacccatcagaggggagggagggagggtggtgctgttaaagggcagtagtaaccagaatgaaggaagtgactgcttgtcccacttcgagaaaatgaaaatgcttcagtgtccagagaccaccaccagggacaagacttcaagttttctccacccacttggtcctcccagggtccttggga

SEQ ID NO: 47186 - DNA, 601 bp, Human
ttaggaaaatggcaggcagctggaacatggaaaacttagcgttttagcctcaccaggcatcgtgtgtacaggagcctagatagcaaactcctttagacacagtgttagaaagttggaattaataaaatatttaatgtgctccttgaagcatttgtttttgaaaggaaacttgacgtaaactaaacttccacagacgtgttttagaagtgactgtttccagtagattttcaatgatgtctgtatacactcagctgtggctgtaaaatacaacacacatactttgtaaacctgttagtgtgaygttttcaccctgacctgaaatgtttagtatcactcagaatacgagagtcatgaagctaacaggctgcaatgtgttcggcgctgtcgcccttcccgtgcaggaggccactgtctgcggggtccggtgctttcccgtcctgggctaaggtgggtgggcagagcagcctggaccgtctgcagccaccatgtcctctggacccctctctgcaccatgcccacctcctccaggcccccacaccatgccatgcagtggccgtgacagtgtttagaatcctttcttgtcttccatttcttcatcatt

SEQ ID NO: 47187 - DNA, 601 bp, Human
gtcccatcggagtctgccttggtactcatcttatcggagtctgccttggtgcctccaagtacacagttaggctgatgtggcatgcacatccgaaaaaataactctagatgtgcatttcgacacatcagcaaatgcagatggtatgggctgcagatggtatgggccacagctggagagagccgtcttcactgcggtatagctgggctgcacccaacgtgagaatggacatcagggcagagagccgtaagcagctgggattgtggaaagcgcccgtgaacacatggtcttggacagggcctcrggtgggtccttagcagctgtggctaagtgggcagagggaccaccccaccaccaccctgcccaaagggcttatttagcaaagaggggagagaggccagcctgcccctgactgcatcccactggcctgagggatgtggcctctctgcccccatttccactcctgctcttgggacacaggagactggttagatgagagtagaaagtttatttttgaacacccaggtgtggggtggctgggcgagaccatctgatggctttgggagccaggccgcagggtttagcttggatctgttgagtagga

SEQ ID NO: 47188 - DNA, 601 bp, Human
tggtgcctccaagtacacagttaggctgatgtggcatgcacatccgaaaaaataactctagatgtgcatttcgacacatcagcaaatgcagatggtatgggctgcagatggtatgggccacagctggagagagccgtcttcactgcggtatagctgggctgcacccaacgtgagaatggacatcagggcagagagccgtaagcagctgggattgtggaaagcgcccgtgaacacatggtcttggacagggcctcaggtgggtccttagcagctgtggctaagtgggcagagggaccacccyaccaccaccctgcccaaagggcttatttagcaaagaggggagagaggccagcctgcccctgactgcatcccactggcctgagggatgtggcctctctgcccccatttccactcctgctcttgggacacaggagactggttagatgagagtagaaagtttatttttgaacacccaggtgtggggtggctgggcgagaccatctgatggctttgggagccaggccgcagggtttagcttggatctgttgagtaggagacccttaaacatggccaccctgagctaagagctggtcttggattt

SEQ ID NO: 47189 - DNA, 601 bp, Human
gtatgggccacagctggagagagccgtcttcactgcggtatagctgggctgcacccaacgtgagaatggacatcagggcagagagccgtaagcagctgggattgtggaaagcgcccgtgaacacatggtcttggacagggcctcaggtgggtccttagcagctgtggctaagtgggcagagggaccaccccaccaccaccctgcccaaagggcttatttagcaaagaggggagagaggccagcctgcccctgactgcatcccactggcctgagggatgtggcctctctgcccccatttccrctcctgctcttgggacacaggagactggttagatgagagtagaaagtttatttttgaacacccaggtgtggggtggctgggcgagaccatctgatggctttgggagccaggccgcagggtttagcttggatctgttgagtaggagacccttaaacatggccaccctgagctaagagctggtcttggattttgctttcttttggattaaccgagtattttgtgggattccatttgatcccttaactggctgaccagctataactcctggttatgttgttttagtgttgctccaggtgtcgt

SEQ ID NO: 47190 - DNA, 601 bp, Human
tctgcccccatttccactcctgctcttgggacacaggagactggttagatgagagtagaaagtttatttttgaacacccaggtgtggggtggctgggcgagaccatctgatggctttgggagccaggccgcagggtttagcttggatctgttgagtaggagacccttaaacatggccaccctgagctaagagctggtcttggattttgctttcttttggattaaccgagtattttgtgggattccatttgatcccttaactggctgaccagctataactcctggttatgttgttttagtgwtgctccaggtgtcgttggaggagaagttgaaggtacaaggagtttgcaggagggaaggtggcagttaatgagccttcctggtgggaccggatggtgagggcaggggcatctggcccagcgtggactcgggccatagatgggaagtggtcatttggaggtcaccatctctctgacaccctgaccatagcacctgcacccctgtgctgagctgcaggtccccggcaccagcgtctgtgcagctcaggtgttgctgagccgtggcctccgcagctctccatcaggatttctcaagcttcatta

SEQ ID NO: 47191 - DNA, 601 bp, Human
gtcccaggtcatctctcagatcttctgaatcaaacatatggtctgcagttgccgcgcatgtctttggccgattttctgacaatcaaagtgaagaagttctgagctacgggaagttgggttgaaggcatgatggggaaaacatgattagttgacagcttttcccagagagtttttagacaaactcaaccttggtaaccttctcagtgggcttatgataagaaccttcaatgtgccaaaaaataaaaaaagcagcactccaggtagttaatctttgtttaaaaaacccttccccccacccagycctgcaaacaaacaaacaaacaaaaaaaggagaaaaaaagaaacctgtcttttgttggatgctgagccgagaaagaagtaacaccactgccggcctctgcctcttgtcccgagacaccctcatggtgcagggctctctccagggtccgttcctcatgtgcaccctctcttgtagttccacagcccgctgtgggtcccactgagactcctacctgaggacaggagaagagggtcctcagggacgtccaaatgaggacaagagaagaaggggcctcacagacatccaaataggagaagtgtg

SEQ ID NO: 47192 - DNA, 601 bp, Human
aaacaaaaaaaggagaaaaaaagaaacctgtcttttgttggatgctgagccgagaaagaagtaacaccactgccggcctctgcctcttgtcccgagacaccctcatggtgcagggctctctccagggtccgttcctcatgtgcaccctctcttgtagttccacagcccgctgtgggtcccactgagactcctacctgaggacaggagaagagggtcctcagggacgtccaaatgaggacaagagaagaaggggcctcacagacatccaaataggagaagtgtgaaaagctaaatttggagkgtcccatttttctgcttctaaattacaaaggaagcaaatgttttgttttgttttgtttatcattcatagccccatcttcatgttatccatttaatgcttttaaagtatttaatattttgtctgttttcgtctacaggtagaagagagaccagaaaaagattttactgagaaggtaaggaatcgttcataaacctagagggtcccaaaagttgtggatgaaattgataagaaaatatgttgcttggttttttttaataaggatgttccccagcgagggaactggactagaaagcggcccac

SEQ ID NO: 47193 - DNA, 601 bp, Human
ccactgccggcctctgcctcttgtcccgagacaccctcatggtgcagggctctctccagggtccgttcctcatgtgcaccctctcttgtagttccacagcccgctgtgggtcccactgagactcctacctgaggacaggagaagagggtcctcagggacgtccaaatgaggacaagagaagaaggggcctcacagacatccaaataggagaagtgtgaaaagctaaatttggagtgtcccatttttctgcttctaaattacaaaggaagcaaatgttttgttttgttttgtttatcattcrtagccccatcttcatgttatccatttaatgcttttaaagtatttaatattttgtctgttttcgtctacaggtagaagagagaccagaaaaagattttactgagaaggtaaggaatcgttcataaacctagagggtcccaaaagttgtggatgaaattgataagaaaatatgttgcttggttttttttaataaggatgttccccagcgagggaactggactagaaagcggcccacctaacctggtatcaccttcccggaggtaggccaccgggagtcctgtccggtgtgcgttagatcctg

SEQ ID NO: 47194 - DNA, 601 bp, Human; identical to SEQ ID NO: 31127

SEQ ID NO: 47195 - DNA, 601 bp, Human; identical to SEQ ID NO: 31128

SEQ ID NO: 47196 - DNA, 601 bp, Human; identical to SEQ ID NO: 31129

SEQ ID NO: 47197 - DNA, 601 bp, Human; identical to SEQ ID NO: 31130

SEQ ID NO: 47198 - DNA, 601 bp, Human; identical to SEQ ID NO: 31131

SEQ ID NO: 47199 - DNA, 601 bp, Human; identical to SEQ ID NO: 31132

SEQ ID NO: 47200 - DNA, 601 bp, Human; identical to SEQ ID NO: 31133

SEQ ID NO: 47201 - DNA, 601 bp, Human; identical to SEQ ID NO: 31134

SEQ ID NO: 47202 - DNA, 601 bp, Human; identical to SEQ ID NO: 31135

SEQ ID NO: 47203 - DNA, 601 bp, Human; identical to SEQ ID NO: 31136

SEQ ID NO: 47204 - DNA, 601 bp, Human; identical to SEQ ID NO: 31137

SEQ ID NO: 47205 - DNA, 601 bp, Human; identical to SEQ ID NO: 31138

SEQ ID NO: 47206 - DNA, 601 bp, Human; identical to SEQ ID NO: 31139

SEQ ID NO: 47207 - DNA, 601 bp, Human; identical to SEQ ID NO: 31140

SEQ ID NO: 47208 - DNA, 601 bp, Human; identical to SEQ ID NO: 31141

SEQ ID NO: 47209 - DNA, 601 bp, Human; identical to SEQ ID NO: 31142

SEQ ID NO: 47210 - DNA, 601 bp, Human; identical to SEQ ID NO: 31143

SEQ ID NO: 47211 - DNA, 601 bp, Human; identical to SEQ ID NO: 31144

SEQ ID NO: 47212 - DNA, 601 bp, Human; identical to SEQ ID NO: 31145

SEQ ID NO: 47213 - DNA, 601 bp, Human; identical to SEQ ID NO: 31146

SEQ ID NO: 47214 - DNA, 601 bp, Human; identical to SEQ ID NO: 31147

SEQ ID NO: 47215 - DNA, 601 bp, Human; identical to SEQ ID NO: 31148

SEQ ID NO: 47216 - DNA, 601 bp, Human; identical to SEQ ID NO: 31149

SEQ ID NO: 47217 - DNA, 601 bp, Human; identical to SEQ ID NO: 31150

SEQ ID NO: 47218 - DNA, 601 bp, Human; identical to SEQ ID NO: 31151

SEQ ID NO: 47219 - DNA, 601 bp, Human
cgaaccacagggtgaggcactcccgccaggttagcagctcccacaaatgggagttctaactccagccctgcccctcactagctgtgccacctacagtaattcacctcatctcatctctctcctggcccatttcctcctttgtaaatcgggaatcccagtatctcccccaacctcaggaagcgttaaggattttcaattaagatgtctttaaaatgtgtgggacaaggccaagattaaaacgctagcaactcgtaacccctaaaccctggaaaaccctgcaaataggcggccctgtaagacytcaagattttggaaagagtggggactgggccccactccaaaagcaacgactggtgttttcggagggactgattacagggggtcgaaatgcttccaacatggccaggaaatagtttggtttatcaaatcctcggtacccagtgaatccccggaaactgtaagcaaacttgtgatggtttcaaggcttcgctcaactcctaaaaggctaaaagtgcatttcacaagtcctcttcccattttcaatgcctacaaaaatgagagcatctaggctcaaacacatccatttctgtatagacacaag

SEQ ID NO: 47220 - DNA, 601 bp, Human
cccaccactcacacccaggttcagtcagggcaaaaaacaacacatgccccagaaactggggcagccaggccagtcttgaccccttctagtcttgaatcaccctcccaccaaaatctgctttggaaattactgcctaggtcagactaagaaaaaccagacaagaaaagtcttttatttattttttgagatggagtctcactctgtcacccaggctggagtgctatggcgtgatcttagtccactgcaacctccgcctcccaggttcaagcgattctcctgcctcagcctcccgagtagctgsaattacaggccctcgccaccacacctggctaatttttttgtatttttagtagagacggagttttgccatgttgaccaggctgttctcgaactcctgacctcaggtaatctgcctgcctcagcctcccaaagtgctgggattataggcatgagcccccactcccggatggaaagtcttttagaaagaccagagactccaacccataccattaagaaccgactgctccttcctaagagaagtatcttacacccaccgacaaaagcctctggtcatcaggagaaagattaactctcttccgcc

SEQ ID NO: 47221 - DNA, 601 bp, Human
gaatctagaccaggatggcaacaaaatcactatttccaaccagaaatcgtggacacacaaggacacccaggagtcaactttggaagcccaacacctggcctctgagcccagtacctgatgggtccaaactcctgcaaggcctccacaaggtctgcttccaccacaccgtcaatcaggcccctgatgtggacaactggggaggcaggggttttgtgcgggtcatcgtagttctcctgagaaaggaagcaaaaacaagaattattttcttgctgtacaagatgacgccccactggcctctgtrctgttgtagacccagtcagataaaacagttggaggtcatccgtgaaggatgcacaggaaagactaggggcagcaattgaagccaatcagcccagaaggattctgggtcagcagaacagtggtcctgagtgggtgatcacttgcccactggctcttgctgtagcttctgaggaaggtataacggagggagggccacacaagtcccaaatcttacgttcttccagggacccccctctcttcccactggtccactcgaccaaggaaacatgggaaaagagtagctggaaaaggagatacactg

SEQ ID NO: 47222 - DNA, 601 bp, Human
aaagcagagcggccacagaatctagaccaggatggcaacaaaatcactatttccaaccagaaatcgtggacacacaaggacacccaggagtcaactttggaagcccaacacctggcctctgagcccagtacctgatgggtccaaactcctgcaaggcctccacaaggtctgcttccaccacaccgtcaatcaggcccctgatgtggacaactggggaggcaggggttttgtgcgggtcatcgtagttctcctgagaaaggaagcaaaaacaagaattattttcttgctgtacaagatgacrccccactggcctctgtgctgttgtagacccagtcagataaaacagttggaggtcatccgtgaaggatgcacaggaaagactaggggcagcaattgaagccaatcagcccagaaggattctgggtcagcagaacagtggtcctgagtgggtgatcacttgcccactggctcttgctgtagcttctgaggaaggtataacggagggagggccacacaagtcccaaatcttacgttcttccagggacccccctctcttcccactggtccactcgaccaaggaaacatgggaaaagagtagctg

SEQ ID NO: 47223 - DNA, 601 bp, Human
ctcgattacagctctgccctgaaagtccatcagtggctttttcctgcccctgccccaagcatcgcaacgctgtctaggatgccctaaaagcttcttccaatgtctattccaaacccgtctgcttgccagccactttgcaatcctcaggtctttcaatttctccatccaacacaagctccttctgactttacaacctttgcagaggctgtttcctccaccttgagtataagctcctatttgctcataggacatcacctcctcagcaaccttcacacatgccccaccttttttttttttttttggatatggagtctcgctgtgttgcccaggatggaatacagtggcacagtctcggctcactgcaatctccgcctcccaggctcaagcgattctcctgcctcagcctccagagtagctgggattacaggcgttcaccaccatgcctggctattttttgtattattagcgacagggtttcaccacgttggctaggctggtctcgaactcctgacctcaggtatctgtccacctcggcctccgaaagtgctgggattgcaggcatgagccactgtgcccggccccatatccccttttaaataaa

SEQ ID NO: 47224 - DNA, 601 bp, Human
gtcctcacagttaatcgggaccactagaaaaacatgcctggcccacaccaagtgctcaacccatagtgagaagcagagcctgggccatgtttttaactgtgggacataacccaccagtaaatcatttagtgaagcatgacagaaaactgtacaggaatcagaaatcaaatcagccattttcaccattttgtctgttacacacagacgtgtgtgatctatggatggctgtgtctacagtcacaaggtaaaatactccttcagctgggttacaacagagcagtgccggctctggagccaggcrgtctggctctgagtcctgcttcacataaaggctatgtgaacctgggcgcgttatttaagccccgtcctccacttcccctgtccatctcattaaggattaatgtgagaaattacacaggtcactacatgtaaagcatctttaacagtgcctggtaactaacaacacttcacctgtgttacgaactactctaagtaatgggccaagtcatgagctgcacaaaggcccccaagacccagacgggtttaatgttaagcaaaatgccgcctggtctcaggtagacactcagccaccgctagcccc

SEQ ID NO: 47225 - DNA, 601 bp, Human
gatggctggctgcttggagacactgcagcaaggaagaaaggggagcctttgtcatacccaaagttgtccctgaagctttcccctgtggcctccagaggcttagcttgccctgtgtgccttggggcattgctctacacctgaggcaaggctgactcactttctcctgtggtgtcagagacacgtctgggaacacacctgccacatcccatttctgtgtgagtcaacacctcggcctcactgtgctcctctgctgggccccattcccctccttttctctcccctgtacctctgctgccctccygagcctgagcacctaccagacattcagcttctgcccaaacatgaagttgttgttgaggtgggtaatggcccggtctacagcgtagccatcagccatctccaccatggcggcccccggcttgcttttcatgaatttcaccttggggagagtagctgcagtcagcacctctgtccagctgccagggtcccctctcctgcccctcccaagttagtgataataacccctgctctggcctcccatgtcctcacagttaatcgggaccactagaaaaacatgcctggcccacaccaagtgctcaac

SEQ ID NO: 47226 - DNA, 601 bp, Human
tggctctcccatgaggagcacaggctgctctcctgatgagcaggtcccacctgcctgtgtcaccaacagtgcgaagatcccggggtcctatctcaagggcaggaaggacatccctggcctgaagccagccaacccattaggtcaccaggttgatgcctgcaggacacacagatactcacttgggtttttcatctggtaatggttcaggaagcccagagtctccagggcatcgctcttggattcccactccagcagtccagaggagctgcgctcacctgattgcaaaccaaggggaaaagtmaaggttttagactcacccaataggaactaggcagctgcccaccaaccaccatgcaattagggcaaggaggtgggcacactcgactcacttttgcctgagaatactttcacagaagatggccgcttcactcccagctcatcgcagatctgcaaaagaaaacaggtagtaaatgaactctgaaacaaaagggccgccacacaggattcaagcagaccaggccctgcatgactcagtacttgaagttttcaggagaaaaggcttgtagattttatcacataccctaaggcatccctgtgtcat

SEQ ID NO: 47227 - DNA, 601 bp, Human
gcttcaagatgagccaattaccaattatgcacggcgtttctccttctcttccttcattcccatagagaatcccattcctatctccttcgccagcccaaggcaatgggcctctcccagcaactgggtgggcaagttttacctgctggatagtgttgcctctttcctaggtaacagagtggctttcctacctaagccagtctctgatgcaaagaagagaatgccacctccctggaggacaagcctgagcaactcccaagctggcagagtgagtggcagcaggcagtcaggctggctctcccawgaggagcacaggctgctctcctgatgagcaggtcccacctgcctgtgtcaccaacagtgcgaagatcccggggtcctatctcaagggcaggaaggacatccctggcctgaagccagccaacccattaggtcaccaggttgatgcctgcaggacacacagatactcacttgggtttttcatctggtaatggttcaggaagcccagagtctccagggcatcgctcttggattcccactccagcagtccagaggagctgcgctcacctgattgcaaaccaaggggaaaagtaaaggttttaga

SEQ ID NO: 47228 - DNA, 601 bp, Human
ctgggccaggcgcagtggctcacgcctgtaatcccagcactttgggaggccgagatgggaggatcacttgaggtcaggagttcgagaccagcctgaccaacatggtgaaaccccatctctactaaaaatacaaaaattagccagtgtgctggcacatgcctgtaatcccagctactcaagaggctgaggcaggagaatcgcttgaacctgggagacagaggttgcagtgagccaagatcatgccattgcactccagcctgggcgacaagagcaaaactccatctcaaaacaaaaaaaaaaacaaaaaaaacaaaaacagaaaagaaaagaaaatgaagcacagagaggtatagtcactttcactctttcaccaacacagagctggggagtggcagagctgggattttaactcggggacccggctctgagcctgtgatctgaattcctgccattgcacccatcagcttcagtctaatgtccaactcagggactgcctctcacggtgagccctccctgaaccttctggcccccacgtccccactcctgatctgccccagattcatctctggctattgggtggggcagaaaaagagtcccctct

SEQ ID NO: 47229 - DNA, 601 bp, Human
tctcaaactcctgacctcaggtgatccacctgcctcggcttcccaaagtgctgggattacaggtgtgagacaccgtgcctgacattttttttcttgagacagggtcttgtgttctcaccctgtcccccaggctggagtacagtggccacgatggtggctcactgcagcctcaacctcctgggtcaactgattctcctgcctcagcctccctagtagctgggactacaggtgcatgccactatgcctggcttttttttttttttttttttttttgtagagatggggtctcactatgttgccsaggctggtctcaaactcccgggctcaagcaatcctaccacctcggcctctcagagtgctgggattacaggtgtgagttgctgtacccagcccaccttgccttcttagaccacctcctccaccctcttcccaacttccagttatgactgttacaagtctgccacgggccaggccctgtcctatgcactttgggtctccctgctcccctcctggccctgaagatcatttccctcatgcagccagagggtccctgtgtacacccatgacgcatcatattccgcacccctgggcacaccagcat

SEQ ID NO: 47230 - DNA, 601 bp, Human
agaccttgtagtgctcagccaggactatgaagaccagctcaaaggcggcaccctttttgaagggcatgctcctcttcctctcctcgctgccccacttcccgccctgcaacgtgttgaagaccaccttgtcccagccgtcaaaccgcggattgaagtggaaggcgacgtctgagcccggatcctgcccaaccacaaagttcacgaagaacctggcgggacacaaagggctcattcccctggtgccacctcccggggcctgggggcctcctccaggaagccctctccctgccgccctgtcctsggcctccctggcccggacctcagcaccagctctgaggggcaaccttggcactgtgggccacagcgtggagaggacctgagttctgaggggggcagattcccaccaccacaccttcgctcacagcctttccttcttttttttttttttttttttgagatggagtcttgctctgttgcccaggctggagttggagtgccgcgatctcagctcactgcaacctccgcctcctggattccagtgattctcctgcctcagcctcccaagtagctgggattacaggcgtgcaccaccacgtccggc

SEQ ID NO: 47231 - DNA, 601 bp, Human
gaggccagcctgggcaacatggtgaaaccccatctctactcaaaatacagaaattagctgagcgtggtggcacgcgcctataatcccagctactcgggaggctgaggcaggagaagctcttgaacccagcaggcagaggttgcagtaagctgagatcatgccactgcactccagcctgggcaacagagtgaaactccatctcaaaaaaaaaaaaaaaaaaaagaaagaaagaaagaaaaggaaggaaggcgggaaggaaggaagcagccaagatggcgccactgcactccagcttgggaarcaagagagaaagcatgcagaccttgtagtgctcagccaggactatgaagaccagctcaaaggcggcaccctttttgaagggcatgctcctcttcctctcctcgctgccccacttcccgccctgcaacgtgttgaagaccaccttgtcccagccgtcaaaccgcggattgaagtggaaggcgacgtctgagcccggatcctgcccaaccacaaagttcacgaagaacctggcgggacacaaagggctcattcccctggtgccacctcccggggcctgggggcctcctccaggaagccctct

SEQ ID NO: 47232 - DNA, 601 bp, Human
ggggctgggcgtggtggctcacgcctgtaattccagcactttgggaggccaaggagggcagaacacctgaggtcgggagttcgaggccagcctgggcaacatggtgaaaccccatctctactcaaaatacagaaattagctgagcgtggtggcacgcgcctataatcccagctactcgggaggctgaggcaggagaagctcttgaacccagcaggcagaggttgcagtaagctgagatcatgccactgcactccagcctgggcaacagagtgaaactccatctcaaaaaaaaaaaaaaaaraaagaaagaaagaaagaaaaggaaggaaggcgggaaggaaggaagcagccaagatggcgccactgcactccagcttgggaagcaagagagaaagcatgcagaccttgtagtgctcagccaggactatgaagaccagctcaaaggcggcaccctttttgaagggcatgctcctcttcctctcctcgctgccccacttcccgccctgcaacgtgttgaagaccaccttgtcccagccgtcaaaccgcggattgaagtggaaggcgacgtctgagcccggatcctgcccaaccacaaagttca

SEQ ID NO: 47233 - DNA, 601 bp, Human
agggggaaggaaggaggggaggaaagaggagagaacagagaaagaggaaggaaaaagaggaaaaagaaggaaggggctgggcgtggtggctcacgcctgtaattccagcactttgggaggccaaggagggcagaacacctgaggtcgggagttcgaggccagcctgggcaacatggtgaaaccccatctctactcaaaatacagaaattagctgagcgtggtggcacgcgcctataatcccagctactcgggaggctgaggcaggagaagctcttgaacccagcaggcagaggttgcagtragctgagatcatgccactgcactccagcctgggcaacagagtgaaactccatctcaaaaaaaaaaaaaaaaaaaagaaagaaagaaagaaaaggaaggaaggcgggaaggaaggaagcagccaagatggcgccactgcactccagcttgggaagcaagagagaaagcatgcagaccttgtagtgctcagccaggactatgaagaccagctcaaaggcggcaccctttttgaagggcatgctcctcttcctctcctcgctgccccacttcccgccctgcaacgtgttgaagaccaccttgt

SEQ ID NO: 47234 - DNA, 601 bp, Human
tctctccactattatcctatgaccctgccacatccccctctctgagaaacacccaagaatgatcaataaataaaaataaataaataaataaataataaaataaaataaaataggcaggaaagaaggaaaagaaaagaaagaagttgacataaaaagtggggatggaaaaaggaaataaatgaaggagggaaggagagagaaggaagaagagaggagggaagggggaaggaaggaggggaggaaagaggagagaacagagaaagaggaaggaaaaagaggaaaaagaaggaaggggctgggygtggtggctcacgcctgtaattccagcactttgggaggccaaggagggcagaacacctgaggtcgggagttcgaggccagcctgggcaacatggtgaaaccccatctctactcaaaatacagaaattagctgagcgtggtggcacgcgcctataatcccagctactcgggaggctgaggcaggagaagctcttgaacccagcaggcagaggttgcagtaagctgagatcatgccactgcactccagcctgggcaacagagtgaaactccatctcaaaaaaaaaaaaaaaaaaaagaaaga

SEQ ID NO: 47235 - DNA, 601 bp, Human
aaaagcgctaaaagaggatttttaaaaataggcaggaaacggccgcccttcgtctgggaggtgaggagcgcctctgcccggccgccccgtctgggaagtgaggagcgcctctgccaggccgccctgtctgggaagtgtacccaacagctccgaagagacagcgaccatcaagaatgggccatgatgacgatggcggttttgtcgaaaagaaaagggggaaatgtggggaaaagaaagagagatcagattgttactgtgtctgtgtagaaagaagtagacatagaagactccattttgttcygtactaagaaaaattcttctgccttgagttgctgttaatctgtaaccttaccctgtgttccctgagacatgtggtgtgtcaactcagggttaaatggattaagggctgtgcaggatgtgctttgttaaacagaggcttgaaggcagcatgctccttaagagtcatcaccactccctaatctcaagtacccagggacacaaacactgtggaaggccgcagggccctctgcctaggaaaaccagagacctttgttcacgtgtttatctgctgaccttctctccactattatcctatgaccct

SEQ ID NO: 47236 - DNA, 601 bp, Human
tctttacaaaaatatacaaaaattagccgggcgtggtggtgtgcacctagagtcccagctactccggaggctaatgtgagaggatcacctgagcccggggaggttgaggctgtagtgagctgtttgcatcactgcactccagcctgggcaacagagcgagacccagtctcaagaggaaaacaaaaagtacacgttttgcaaaaaacacaaagtggtaggaggaaatacacatgaaatgtattacaagactctcagcagtagggtaatgggactaaggaaaagcgctaaaagaggatttttraaaataggcaggaaacggccgcccttcgtctgggaggtgaggagcgcctctgcccggccgccccgtctgggaagtgaggagcgcctctgccaggccgccctgtctgggaagtgtacccaacagctccgaagagacagcgaccatcaagaatgggccatgatgacgatggcggttttgtcgaaaagaaaagggggaaatgtggggaaaagaaagagagatcagattgttactgtgtctgtgtagaaagaagtagacatagaagactccattttgttccgtactaagaaaaattcttctgcc

SEQ ID NO: 47237 - DNA, 601 bp, Human
aataataataataataataataataataataataataataaattgataaactcaatttaattgtatgttatttatttttaatgattgtgttaagcaacctctagggaattcattcactatcgtgtgttctttgcctttccttatcctcactttctgactcaccttacacacttcctcctactccaggaagcacttccttcctgacccatgactagtcaagcccttcctgtaggctcccaaacctcctgtatactccatatcccagcccctgcccctctgcctgtgccctccctatcacagmcctgaccatttctgggctgtcactctctgatgccatgtctgtgagcccagtgaggtcagggcccagagatatctcagtcattcctgtctccagccctgggcctgacccctctgcctgcctccacccaccctcctgtcctggccctgatccctctgtctgggcccaaacccaactgcaacccttcagcctgggcctccccatcccggccttgatcccttgcagtgatgggtctgtcttcccagtgggatcccttgatcatcactgggctcttggcataactcagcagagggagatgcttgg

SEQ ID NO: 47238 - DNA, 601 bp, Human
ggactttgggaggctgaggtgggtggatcacctgaggtcaggagttcaagaccagcctggacaacataggaaaattcctcccctctgtctttacaaaaaatttaaaaactagctggggctggtggtgcgtgcctgtagtcccagctactcaggagactgaggtgggaggatcacttgaacccaggaagtcaagaatacagtaggctgtgattgcaccaccacactccagcctgggtgacagagccagaccctgcctcaaaaataataataataataataataataataataataataataataaattgataaactcaatttaattgtatgttatttatttttaatgattgtgttaagcaacctctagggaattcattcactatcgtgtgttctttgcctttccttatcctcactttctgactcaccttacacacttcctcctactccaggaagcacttccttcctgacccatgactagtcaagcccttcctgtaggctcccaaacctcctgtatactccatatcccagcccctgcccctctgcctgtgccctccctatcacagacctgaccatttctgggctgtcactctctgatgccatg

SEQ ID NO: 47239 - DNA, 601 bp, Human
tctgcctctctctctgtcttggccacacctcagcgcaggggcttccttctgccaaacacttttatttatttatttgagatggaatttcgctcttgttgcccagggtgccgtgcagtggcacgatctctgctcacctcaacctctgcctcctgggttcaagtgattctcctgcctcagcctccggtgtagctgggattacaagcatgcgccaccacgcccagctaattttgtatttttaatagagatggggtttctccatgttggtcaggctggtctcaaactcccgacctcaggtgatccrctcgcctcaccctcccaagtctaacacctttaacttttactctctctctttctctctgttaccttctcttttctcctccttgtaattaactccattctgccttgacttctattctcagccagctattctgaaggccttttaaaagtagctttatatagccgggcgtggtggcaggtgcctgtaatcacagctacttgggaggctgaggaagaattccttaaacctgggaggcagagggtgcagtgagctgagatcatgccactgcactccaacctgggccacagagcaagactccatcta

SEQ ID NO: 47240 - DNA, 601 bp, Human
cactagggaggaagaccctcacctatcagcaagtacttacagggtaaggtggcatcatcgggggtccctgtgggcacagaaagagaaagcggttatgagagggtccccagatttgcgactgaaagatgtcgagagtgcctgccctggggtggcccaccaccaccaccactatgccagagaactctggcatcaaagggtggcaccccgatcacagattcacggagaggggcaccccatgttctgggatcgctgatgcccagtgagtcaccccaaagctttaggacaatgcttggtccatttygttctctgtgcccttccccttgctgtcttcctgctgtcccggggccctcactcgctgatcttgatctcagtttctgcctctgtccctgtgtctctgcctctctctctgtcttggccacacctcagcgcaggggcttccttctgccaaacacttttatttatttatttgagatggaatttcgctcttgttgcccagggtgccgtgcagtggcacgatctctgctcacctcaacctctgcctcctgggttcaagtgattctcctgcctcagcctccggtgtagctgggattacaagcatgcg

SEQ ID NO: 47241 - DNA, 601 bp, Human
ttgaaggttgggggtccttccatggtctgtgaagtgaggaagaagcgatattattctccaagagtcgacagatatctatgacacacccattagactccggcgtttctctaggtgctgggttagtacaccttgggctgcaacccctcttagctccccctaccccaattctcaccattcccactcctcacccggggccctcccagccctcccactcacgggcaggctgttcagctgttgatggcaatgtccgggaccctgaacgatggacagaaggcaggaagggtgagaggggctgagggamcccactagggaggaagaccctcacctatcagcaagtacttacagggtaaggtggcatcatcgggggtccctgtgggcacagaaagagaaagcggttatgagagggtccccagatttgcgactgaaagatgtcgagagtgcctgccctggggtggcccaccaccaccaccactatgccagagaactctggcatcaaagggtggcaccccgatcacagattcacggagaggggcaccccatgttctgggatcgctgatgcccagtgagtcaccccaaagctttaggacaatgcttggtccat

SEQ ID NO: 47242 - DNA, 601 bp, Human
tttgagatggagtctcgttctgtcaccaggttggagtactgtggcacgatcccggctcactgcaacctccgactccctggttcaagcgattctcctgcctcagcttcctgagtagctgggattacaggcgcgcgccaccatgcccagctaatttttgtatttttagtagagacagagtttcactatgctggccaggatggtctcgatcgatctcctgacctcgtgatctgtccgccttggcatcccaaagtgctgggattacaggcgtgagccaccatgtccagcccaagaacaaattttstgagaggtcccactcctcctggaaaacatccccaattccttctgctccctaaacctgaccacgaactctatctacccttcccctacctcccaccccaaaaccctcagcccactccctttctggctgtctcagattccctggagatccgtgccccctccccaccatccatctctgtttccccaagccataccgggttgaaggttgggggtccttccatggtctgtgaagtgaggaagaagcgatattattctccaagagtcgacagatatctatgacacacccattagactccggcgtttc

SEQ ID NO: 47243 - DNA, 601 bp, Human
tggctaacttttgtcattttagtagagacggggattcatcatgttgaccaggctgatctggaactcttgacctcaagtgatccacctgccttggcctcccaaagggctgggattataggcatgagccaccgtgtctggccaagaataaattttctttttcttttctttttcttttttttttttttttttttttttgagatggagtctcgttctgtcaccaggttggagtactgtggcacgatcccggctcactgcaacctccgactccctggttcaagcgattctcctgcctcagcttccygagtagctgggattacaggcgcgcgccaccatgcccagctaatttttgtatttttagtagagacagagtttcactatgctggccaggatggtctcgatcgatctcctgacctcgtgatctgtccgccttggcatcccaaagtgctgggattacaggcgtgagccaccatgtccagcccaagaacaaattttctgagaggtcccactcctcctggaaaacatccccaattccttctgctccctaaacctgaccacgaactctatctacccttcccctacctcccaccccaaaaccctcagc

SEQ ID NO: 47244 - DNA, 601 bp, Human
ttttctttcctgtctttttttcttataagagatggggtcttactctgtcacccaggctggagtgcagtggcatgatcaagcctcactgcagcctcaaactgctgggctcaagcaatcctcccatctcagcctcccgaagtgctgggattacaggcgtgagccaccacgcccagccttgcaggaacaaaggaacaaattttgtttttttttttaggcagagtctccctctgacgcccaggctggagtgtagtggcataatctcagctcactgcaacctctgcctcctaggttcaagcaattytgctgcctcagccttcctagtagctgggattacaggtgtgcgccaccacacctggctaacttttgtcattttagtagagacggggattcatcatgttgaccaggctgatctggaactcttgacctcaagtgatccacctgccttggcctcccaaagggctgggattataggcatgagccaccgtgtctggccaagaataaattttctttttcttttctttttcttttttttttttttttttttttttgagatggagtctcgttctgtcaccaggttggagtactgtggcacgatcccggc

SEQ ID NO: 47245 - DNA, 601 bp, Human
gttcttcgagctgtgagccctccttgcagcctcccgaaatatggcacaggctgtgggaagagaacggggggtcccattctctctcagcttagcagagccagatgtgggaagaaattttctttttcttttcttttctttcctgtctttttttcttataagagatggggtcttactctgtcacccaggctggagtgcagtggcatgatcaagcctcactgcagcctcaaactgctgggctcaagcaatcctcccatctcagcctcccgaagtgctgggattacaggcgtgagccaccacgccmagccttgcaggaacaaaggaacaaattttgtttttttttttaggcagagtctccctctgacgcccaggctggagtgtagtggcataatctcagctcactgcaacctctgcctcctaggttcaagcaattctgctgcctcagccttcctagtagctgggattacaggtgtgcgccaccacacctggctaacttttgtcattttagtagagacggggattcatcatgttgaccaggctgatctggaactcttgacctcaagtgatccacctgccttggcctcccaaagggctgggattatag

SEQ ID NO: 47246 - DNA, 601 bp, Human
aaaataggaaaattaaaaaaaagaatgttagctccatgagaccaaggattcatctgttaaacaaatattctttacacattaccacgttccaggctccgtttaggtgctagtgataaaggcagtgaagaaaacaaacaaaaacttaagcccttgtggagcatacattttagtggagctaaataaacagattgataagaccgcaaggaaggaaagaaatggaaagacaggaagaaacaaagaaagacacgcagaaagaaagaaacatagaaagtaagaaaaggaaataaagtcagaggtagttaagtactttggagaaaaataaagcaggaaaatgaggcaatagataaacaagataagagcatttcaaggagaaggaactgcagttgcaaaggcccagatgagggattgtactgggttttttgtctgttgtgtttactgctgtatgcccagtgatgcaagcagggcctgatccaggaggcactgaatattgatctcaaccagctttatagtctcgttaattttcattaaatttcattaattaattttggtttcattaatttttttttactttctattcaattggtctctgttctgacttttt

SEQ ID NO: 47247 - DNA, 601 bp, Human
gtggagctaaataaacagattgataagaccgcaaggaaggaaagaaatggaaagacaggaagaaacaaagaaagacacgcagaaagaaagaaacatagaaagtaagaaaaggaaataaagtcagaggtagttaagtactttggagaaaaataaagcaggaaaatgaggcaatagataaacaagataagagcatttcaaggagaaggaactgcagttgcaaaggcccagatgagggattgtactgggttttttgtctgttgtgtttactgctgtatgcccagtgatgcaagcagggcctgayccaggaggcactgaatattgatctcaaccagctttatagtctcgttaattttcattaaatttcattaattaattttggtttcattaatttttttttactttctattcaattggtctctgttctgacttttttttttgaaacgaagtctcactctgtcgcccaggctggagtgcagtggcatgatcatggcttactatagccacaacctcctggctcaagtgatccttgcacctcagcctcctgagtagctgggaccacaggcacatgccaccatgcctggcaaatttttaaatttttttg

SEQ ID NO: 47248 - DNA, 601 bp, Human
ttgagctcaagcattcttcccaccttggcctcccaaagtgctgggttacagggatgaaccactgtgcccagacagtctctgccttttaattagtgtttagaccatttacatttaatttgatattgatatgattgtgtaaatttatcccatgtctattatatatattctacttacctatgttttctttttcctccctcctttttgccttttattgggtatagtttttgttacttttttttcaatcctgctccttctgtatagtgtttttcattttatttcttttttttttttttttttttttgagatggagtctcgctctgtcacccaggctggagtgcagtggtgcaatctcggctcactgcaagctccgcctcccaggttcatgccattctcctgcctcagcctcccgagtagctgggactacaggcacctgccacttcgcctggctaattttttttgtatttttagtagagacggggtttcaccgtggtcttgatctcctgaccttgtgatccgcccgcctcggcttcccaaagtgctgggattacaggcgtgagccaccgcgcctggcctcattttatttcttttgtttgcttattag

SEQ ID NO: 47249 - DNA, 601 bp, Human
tatagtttttgttacttttttttcaatcctgctccttctgtatagtgtttttcattttatttcttttttttttttttttttttttgagatggagtctcgctctgtcacccaggctggagtgcagtggtgcaatctcggctcactgcaagctccgcctcccaggttcatgccattctcctgcctcagcctcccgagtagctgggactacaggcacctgccacttcgcctggctaattttttttgtatttttagtagagacggggtttcaccgtggtcttgatctcctgaccttgtgatccgmccgcctcggcttcccaaagtgctgggattacaggcgtgagccaccgcgcctggcctcattttatttcttttgtttgcttattagatattcctctttttgttatgttagtggttgctttaaggtgggggttggcaaactatggcctccaggcaaaatctagccagccatctgcttttgtatggttgtgagctaagaatggtctttacatttttaaacagtttctaaaaatcaaaagaataataatattatatggcaagtgaaagtgttgtgagctaagaatggtctttacatttttaaaca

SEQ ID NO: 47250 - DNA, 601 bp, Human
gggaggctgaggcagaagaatcgcttgaacccaggaggtggaggttgcagtgagccacgatcgtgtcactgcgctccagcctgggcgacagggcaagactctctctcaaaaaataaaaattaaaataaataaataaataaatattcttgaatattattctgggatggagttaaattactcggaagtagtttgagtctttccagttttgcttttatgatttgttaggtgggtgttgagcagtgccccatctacagttaattattccccactattgaggcaagaccttcctgagtatcccacycgatagcctgtgatgatgtttttccagcctggctggtgggaacactcactattcctggccctgtgtgagtaacgagcacttttctgaaatccttttggatggttttcccatccccacagactcacaggcatggctgatccgtattctccggaatacacaagagaacctcctgcagttccccagcaatctctcctttggcaactctctttgttttgtactctgtcctgtgactctagccacgctggcctccacagactcttcctccatatccatctcctgacctcagacaacctgatgcgc

SEQ ID NO: 47251 - DNA, 601 bp, Human
actcacaggcatggctgatccgtattctccggaatacacaagagaacctcctgcagttccccagcaatctctcctttggcaactctctttgttttgtactctgtcctgtgactctagccacgctggcctccacagactcttcctccatatccatctcctgacctcagacaacctgatgcgctctgcttggattcccctctctgcaccgtggctttgaaactctctcaagacaataagctgtggcagtcaagtgtggggcccacctcgtgtttcctgtctttcaggggtcactgtgattcaytgcacgatgtccagtgtcttcaacactgttgcttcatataccgtatttcgtctgactcttgtttgtttgtttgtttcacgtgggagtgaattctggtccatgttacttcattttgggcagaagtggaaatcccactgaataaacattgattccacgaatttgctgatgaaactctgacctctgacctcccagatagctgacagggggttccagaactgtggtcacaaggcctagcatacagtaggcgccccatgtttgttcaatgaaggaatgcaagaggacttgaactttgccctctca

SEQ ID NO: 47252 - DNA, 601 bp, Human
cctacctcgctcagggccctgaccgtactcccgacaccaaccatacccctgtcgccttgtaccccgattccgacttggagaaggaagaagaggagagtgaggaggactggaagctgcagctggaggctgaaaactacgagggtgagggtcgtcaccagggaaggactcagctcctgggctaggcgagagcacctggccctgggctcagcttccctgatttgagactgagctccttgggaaatcatgcctaggcttcaggagcccagacatcgggaccagggacctccactcagggcccagwtgattgagaattggatatgtaggacccaggacccccacctggaggccccaggtcacttgggatgcagacctgtcacccacagacccagagctgccaggatccagttgtcgggcccccgggctccccacctgcagagtgtattgcagacccctaccctacccaggaccggggaatgcagagctcaggccctctgtgaaactctggcaccccaggctcccagcaatgggcagcagggttcagagacagccctcctcagcctcatgggaagaagggctcatctgcccacagccctgacatcca

SEQ ID NO: 47253 - DNA, 601 bp, Human
gatatgtaggacccaggacccccacctggaggccccaggtcacttgggatgcagacctgtcacccacagacccagagctgccaggatccagttgtcgggcccccgggctccccacctgcagagtgtattgcagacccctaccctacccaggaccggggaatgcagagctcaggccctctgtgaaactctggcaccccaggctcccagcaatgggcagcagggttcagagacagccctcctcagcctcatgggaagaagggctcatctgcccacagccctgacatccaagtttctgctcccytgcctataagcccagccacctgagaccagacccctcctcagatggactgacgtcattcaggacccagtgttcagggcctgcctctcgcccccaggtcacaggcttttcagctacttggtaccttttttttttttttttttttttttgagacagtctcactctgttgccaggttggagttcagtggcgtgatcttggctcactgcaacctccacctcccaggttcaggtgattctcctgcctcagcctcccgagtagctgggattacagggattacaggcacatgctaccatgcccagctt

SEQ ID NO: 47254 - DNA, 601 bp, Human
ggcaggcgcgaaccctgctgcccgcatgtacggtggccgcaccccactcggcagtgccatgctccggcccaaccccatcctcgcccgcctcctccgtgcacacggagcccctgagcccgagggcgaggacgagaaatccggcccctgcagcagcagtagcgacagcgacagcggagacgagggcgtgagtcaggaggagagacagggcagcccagctggggggtcaggatagaccggcaggcaagaagcccaagaagataattaggcaccgaccttgggctgctgttagagaactcaggcrgcagcgccagtgacacggggcactagtcaggagagacctggacaggggtggtgggaagagcttgggcagaagtggctgaaaaactaaggcagtggcaaaggtagaactcaggcaggggtggagaaaaggcgttggtcgcagtgattggtgaacacagcgggggtgggtggtagcgctgggggtgattttaggcagcaagaattggagaactcacactgcgaaaagaaaaccttgggtggcagtgatttgaacaccggcagtgctggggcaggacccgagccagcggtggggagagatata

SEQ ID NO: 47255 - DNA, 601 bp, Human
ctggggggtcaggatagaccggcaggcaagaagcccaagaagataattaggcaccgaccttgggctgctgttagagaactcaggcggcagcgccagtgacacggggcactagtcaggagagacctggacaggggtggtgggaagagcttgggcagaagtggctgaaaaactaaggcagtggcaaaggtagaactcaggcaggggtggagaaaaggcgttggtcgcagtgattggtgaacacagcgggggtgggtggtagcgctgggggtgattttaggcagcaagaattggagaactcacrctgcgaaaagaaaaccttgggtggcagtgatttgaacaccggcagtgctggggcaggacccgagccagcggtggggagagatatagtcagagaacccagcaatacagatccgtccttgggcaaggcgcggtgctggatgatgggtgcggaggaatttgggtaaaggcagagggaaggggtggaggagggccagctcagttgccgaaactctggagtggcggctggctagaaattggtctgtagaaatgaccttgaaaatggagttctggccaggtgcggtggctcacgcctgtaatccca

SEQ ID NO: 47256 - DNA, 601 bp, Human
ccggcaggcaagaagcccaagaagataattaggcaccgaccttgggctgctgttagagaactcaggcggcagcgccagtgacacggggcactagtcaggagagacctggacaggggtggtgggaagagcttgggcagaagtggctgaaaaactaaggcagtggcaaaggtagaactcaggcaggggtggagaaaaggcgttggtcgcagtgattggtgaacacagcgggggtgggtggtagcgctgggggtgattttaggcagcaagaattggagaactcacactgcgaaaagaaaacctygggtggcagtgatttgaacaccggcagtgctggggcaggacccgagccagcggtggggagagatatagtcagagaacccagcaatacagatccgtccttgggcaaggcgcggtgctggatgatgggtgcggaggaatttgggtaaaggcagagggaaggggtggaggagggccagctcagttgccgaaactctggagtggcggctggctagaaattggtctgtagaaatgaccttgaaaatggagttctggccaggtgcggtggctcacgcctgtaatcccagcactttgggaggccgag

SEQ ID NO: 47257 - DNA, 601 bp, Human
ttctggccaggtgcggtggctcacgcctgtaatcccagcactttgggaggccgaggcaggcagatcacgaggtcaggagttcgagaccagcctggccaacatggcaagaccctgtctctactaaaaatacaaaaattagctgggcgtggtggcgcatgcctataatcccagctacttgggaggctgaggtaggagaattgcttgaacctgggaggtggaggttgcagtgaacctagatcacgccactgcattccagcctgggcaacagagcgagactccatcttaaaaaaaaaaaaaaaaraaagaaagaaaagaaaatggagttctgagagctaggaaactgggaggttgagccaggagcaggggaacttgggctttgaggcgagacctaattcttagggtgctctatgaggacatgggtggtgggcaaagtgacagccgcctgagcccctctgcctggtcccctttgcccccaggatgaatacgacgacattgtggttcacagcagccgcagccaaacccggctgcctcccaccccagcctcaaaacctcttcctgacgacccccgccccgtgtgatttgtttcattgttaatataatt

SEQ ID NO: 47258 - DNA, 601 bp, Human
gagaccagcctggccaacatggcaagaccctgtctctactaaaaatacaaaaattagctgggcgtggtggcgcatgcctataatcccagctacttgggaggctgaggtaggagaattgcttgaacctgggaggtggaggttgcagtgaacctagatcacgccactgcattccagcctgggcaacagagcgagactccatcttaaaaaaaaaaaaaaaaaaaagaaagaaaagaaaatggagttctgagagctaggaaactgggaggttgagccaggagcaggggaacttgggctttgaggygagacctaattcttagggtgctctatgaggacatgggtggtgggcaaagtgacagccgcctgagcccctctgcctggtcccctttgcccccaggatgaatacgacgacattgtggttcacagcagccgcagccaaacccggctgcctcccaccccagcctcaaaacctcttcctgacgacccccgccccgtgtgatttgtttcattgttaatataatttccagtttaataaacaaaaccctagttctgacaaccagagaccagactgatcttgtcttcccagtcctccgggtccttctgg

SEQ ID NO: 47259 - DNA, 601 bp, Human
gcgcggccccggaaaccagtgaggccggcgcgcgcccgccggaagccgcgaccccgacgcgccccccattgccctcggcgccggaagtggtcgcgggtcgttctgcttcctgcccgaggggcgtgcgcgggtcaggggcggccgcggaggcggaagcatccatggcggagggcggcagcccagacgggcgggcagggccgggctccgcaggtaacgtgcgcgcggccactgggccgcggggcgtgtggggatggcgaagggctggctccggcgtccctgccgaggtcctgcgtcctcgtcycgggctggccgggtccacggggcagccagggagccgcaccctgcaggccgggggtggggttcagcgcggctcgcagtgctgggcgaccccaccacggacgcgctgccctctcctcggcctcgagtgcagtccccgcgctagattttctttccggtggaacttgctcgtaacttccttcccgttagccgatacagatttgatatgacccaaccgcaaaagtaggacgtgggccaccttccagctctgagcgcacggatcaggaaagccagccagagggtagccctagggagggcaggcact

SEQ ID NO: 47260 - DNA, 601 bp, Human
ttgaagttgcttttgaatctggagctggggaaagattctgagtctactttgagcagggccaggaatggatagcacagaggccagcagagggggcccagaagagggctcagcaaaagtcctgtggccgccatttacctgttggttattgccctacacctgaatctttcccactccgactttgaactttttcactctgtagtaaccgcaactgtggagtaattacaggggaggatagttactgaaggaagactggggtggtggcttaaagagctgttcatgccggcttgttgatctgcggcgrgtctggttgtgggatcagcatgagcaactcagtggactgtcaaaccctgcagagccgggacacttactcatcacccccgtttcacctgtggttgagtctcatgtacagtagtactgaaaagagattaattttaatataaaaaacaatgtcagcatctggaaagagcccccttatggagggggtgctttatacctgcctgtctggtctcacactaggacagcatggcagagcagggacttgaatccaagtggtctgagtttttgctctttacttacacacgaatctgtgtaactattttta

SEQ ID NO: 47261 - DNA, 601 bp, Human
agattctgagtctactttgagcagggccaggaatggatagcacagaggccagcagagggggcccagaagagggctcagcaaaagtcctgtggccgccatttacctgttggttattgccctacacctgaatctttcccactccgactttgaactttttcactctgtagtaaccgcaactgtggagtaattacaggggaggatagttactgaaggaagactggggtggtggcttaaagagctgttcatgccggcttgttgatctgcggcgagtctggttgtgggatcagcatgagcaactcartggactgtcaaaccctgcagagccgggacacttactcatcacccccgtttcacctgtggttgagtctcatgtacagtagtactgaaaagagattaattttaatataaaaaacaatgtcagcatctggaaagagcccccttatggagggggtgctttatacctgcctgtctggtctcacactaggacagcatggcagagcagggacttgaatccaagtggtctgagtttttgctctttacttacacacgaatctgtgtaactatttttacaaaactcttaaatcttcaggagtttattttg

SEQ ID NO: 47262 - DNA, 601 bp, Human
cacgaatctgtgtaactatttttacaaaactcttaaatcttcaggagtttattttgggttatgatgtgaggtgaataactcaattatttcctaataagtatctgattgtacaaatgctgtttgttgaatactcttttccattctcgctgattgtgatgccggtttatcacattcaggcataccttggggatagtgtgtgttcagttccagaacactgtaataaagtgaatactgcagtaaaccaagtcacatgaaatttttggtttcccagtgcatatataagttatgtttacatgatacyatgatctattaagagtgtaataggccaggcgccagtggttcatggctgtaatcccagcactttgggaggccgaggcaggcagatcacgaggtcaggagatcaagatcatcctggctaacatggtgaaaccccttctctactaaaaatacacacacaaaaaattagccaggtgtggtggcgggtacctgtagtcccagctacttgggaggctgaggcaggagaatggcgtgaacccgggaggcggatcttgcagtgagccgagatcacgccactgcactccagcctgggccacagagtgag

SEQ ID NO: 47263 - DNA, 601 bp, Human
ctgattgtgatgccggtttatcacattcaggcataccttggggatagtgtgtgttcagttccagaacactgtaataaagtgaatactgcagtaaaccaagtcacatgaaatttttggtttcccagtgcatatataagttatgtttacatgatactatgatctattaagagtgtaataggccaggcgccagtggttcatggctgtaatcccagcactttgggaggccgaggcaggcagatcacgaggtcaggagatcaagatcatcctggctaacatggtgaaaccccttctctactaaaartacacacacaaaaaattagccaggtgtggtggcgggtacctgtagtcccagctacttgggaggctgaggcaggagaatggcgtgaacccgggaggcggatcttgcagtgagccgagatcacgccactgcactccagcctgggccacagagtgagactccgtctcaaaaaaaaaaaaaaaccaagtacaataataccattatgtctaaaaatgtacacgttttaatttaaaaatactttattgctgaaaaatgctaaccatcatctgagctctcagtgagtcacaatctttttgctggtgg

SEQ ID NO: 47264 - DNA, 601 bp, Human
aatactgcagtaaaccaagtcacatgaaatttttggtttcccagtgcatatataagttatgtttacatgatactatgatctattaagagtgtaataggccaggcgccagtggttcatggctgtaatcccagcactttgggaggccgaggcaggcagatcacgaggtcaggagatcaagatcatcctggctaacatggtgaaaccccttctctactaaaaatacacacacaaaaaattagccaggtgtggtggcgggtacctgtagtcccagctacttgggaggctgaggcaggagaatggygtgaacccgggaggcggatcttgcagtgagccgagatcacgccactgcactccagcctgggccacagagtgagactccgtctcaaaaaaaaaaaaaaaccaagtacaataataccattatgtctaaaaatgtacacgttttaatttaaaaatactttattgctgaaaaatgctaaccatcatctgagctctcagtgagtcacaatctttttgctggtggagggtcttgctccagtattgatggctcctgacttatcgggggctatggtaattcttagatgacagtgaagtttgccatatc

SEQ ID NO: 47265 - DNA, 601 bp, Human
agagtgtaataggccaggcgccagtggttcatggctgtaatcccagcactttgggaggccgaggcaggcagatcacgaggtcaggagatcaagatcatcctggctaacatggtgaaaccccttctctactaaaaatacacacacaaaaaattagccaggtgtggtggcgggtacctgtagtcccagctacttgggaggctgaggcaggagaatggcgtgaacccgggaggcggatcttgcagtgagccgagatcacgccactgcactccagcctgggccacagagtgagactccgtctcaaaaaaaaaaaaaaaccaagtacaataataccattatgtctaaaaatgtacacgttttaatttaaaaatactttattgctgaaaaatgctaaccatcatctgagctctcagtgagtcacaatctttttgctggtggagggtcttgctccagtattgatggctcctgacttatcgggggctatggtaattcttagatgacagtgaagtttgccatatcgtctggctcttcctttgatgagatttctctgtagcatgagacgttgtttgatggcattttacccacagtagcgcttctttaaaaa

SEQ ID NO: 47266 - DNA, 601 bp, Human
ggcgccagtggttcatggctgtaatcccagcactttgggaggccgaggcaggcagatcacgaggtcaggagatcaagatcatcctggctaacatggtgaaaccccttctctactaaaaatacacacacaaaaaattagccaggtgtggtggcgggtacctgtagtcccagctacttgggaggctgaggcaggagaatggcgtgaacccgggaggcggatcttgcagtgagccgagatcacgccactgcactccagcctgggccacagagtgagactccgtctcaaaaaaaaaaaaaaaccragtacaataataccattatgtctaaaaatgtacacgttttaatttaaaaatactttattgctgaaaaatgctaaccatcatctgagctctcagtgagtcacaatctttttgctggtggagggtcttgctccagtattgatggctcctgacttatcgggggctatggtaattcttagatgacagtgaagtttgccatatcgtctggctcttcctttgatgagatttctctgtagcatgagacgttgtttgatggcattttacccacagtagcgcttctttaaaaattggaatcagtcctct

SEQ ID NO: 47267 - DNA, 601 bp, Human
gggaggccgaggcaggcagatcacgaggtcaggagatcaagatcatcctggctaacatggtgaaaccccttctctactaaaaatacacacacaaaaaattagccaggtgtggtggcgggtacctgtagtcccagctacttgggaggctgaggcaggagaatggcgtgaacccgggaggcggatcttgcagtgagccgagatcacgccactgcactccagcctgggccacagagtgagactccgtctcaaaaaaaaaaaaaaaccaagtacaataataccattatgtctaaaaatgtacacrttttaatttaaaaatactttattgctgaaaaatgctaaccatcatctgagctctcagtgagtcacaatctttttgctggtggagggtcttgctccagtattgatggctcctgacttatcgggggctatggtaattcttagatgacagtgaagtttgccatatcgtctggctcttcctttgatgagatttctctgtagcatgagacgttgtttgatggcattttacccacagtagcgcttctttaaaaattggaatcagtcctctctaaccctgctgctgcttaatcaactaagtgtatgt

SEQ ID NO: 47268 - DNA, 601 bp, Human
ccgtctcaaaaaaaaaaaaaaaccaagtacaataataccattatgtctaaaaatgtacacgttttaatttaaaaatactttattgctgaaaaatgctaaccatcatctgagctctcagtgagtcacaatctttttgctggtggagggtcttgctccagtattgatggctcctgacttatcgggggctatggtaattcttagatgacagtgaagtttgccatatcgtctggctcttcctttgatgagatttctctgtagcatgagacgttgtttgatggcattttacccacagtagcgcttytttaaaaattggaatcagtcctctctaaccctgctgctgcttaatcaactaagtgtatgtggccttctaaatcctttgttgtcattatgacagtgtccacagcatcttcaccaggagtggatttcatctcaagaaactgctttctttgctcatccattcaagtttgatcatgcgattgcagcagttcagtcacatcttcaggctgtaattctagttctcttgtgatttccactgcatctgcagttacttcctccatttaagtcttgagcccctcaaagtcatccatgtgggttggaatta

SEQ ID NO: 47269 - DNA, 601 bp, Human
tttagaatattttttgtgacatctgataacaaaatcccaaagaaatgggtcacgctttatttaaaattccttgattattgaatcttttaatccaagtacttggtgttttttctgcttattctgttcttttgtgttgtttttgagttttatagtcttcattaaatgggctggatttatatttatgtacatgtgtttttaaccttcgtttttattgaggtgggacttctctatggtcaagtgcacctgtctgaggagtttcttaggcaggcctccctgtggccgttgcccagggcagcgtggkagggagtcacccgtgtagcagatagcagcatttgctcagccgttggattttgccgtatgtcttttttgtagtgaaggagatgactatgttctccttcatagttgcccagtattaagatattcccaaataccagtactaagatatttgctagattctttgatacaatattgattcaatctgctgatattttcttttttctttttctttttttttttgagaccgagtctcactcagtcgccaggctctggagtgcagtggcgcgatcttggcttactgcaacatctgcctctgggtccaagc

SEQ ID NO: 47270 - DNA, 601 bp, Human
gagagctgagtctggacaggttcctctgccgctcttggccaggggtgtagcccccgtgccaccttagtgattccttcaggccatcatttgtgcagtgttagaggttgggggcctacatagtcacctagtcctggtgaggatgctgaggcctagagaggcccagcctcaagccttcacagatggtaactggggaagagcagcctaggggctcttacccagactcccgggcgagtgcgctgttcatttggcactgcctcccaggcagacccttcccacctttgtagaggaaggcacttcagayggcagtcaggaaatctaagaactagagatcttagttttggtgctgatcattctgcaggtgccttgagtttcctgtctctggaatggggctcgtaatgcctgccctgccatgccccggtcccgcaggggaaaggtgtgagagcatttcagaaggcagagcccaggtggaggcgttattaaccagagggggaccgtgtccatgctgccagggtgaggggggcagtgcagcccgtccctgtcctgcggctgcctctcatgagcccccttgtgttcctcctgcagccgcatcaacgagaagtct

SEQ ID NO: 47271 - DNA, 601 bp, Human
agagcagcctaggggctcttacccagactcccgggcgagtgcgctgttcatttggcactgcctcccaggcagacccttcccacctttgtagaggaaggcacttcagatggcagtcaggaaatctaagaactagagatcttagttttggtgctgatcattctgcaggtgccttgagtttcctgtctctggaatggggctcgtaatgcctgccctgccatgccccggtcccgcaggggaaaggtgtgagagcatttcagaaggcagagcccaggtggaggcgttattaaccagagggggaccrtgtccatgctgccagggtgaggggggcagtgcagcccgtccctgtcctgcggctgcctctcatgagcccccttgtgttcctcctgcagccgcatcaacgagaagtctgtctggtgctgtggctggctcccctgcacaccgttgcgaatcgcggccactgcaggccatgggagctgtgtggacttcctcatccggaagggggccgaggtggatctggtggacgtaaaaggacagacggccctgtatgtggctgtggtgaacgggcacctagagagtacccagatccttctcgaagctggcg

SEQ ID NO: 47272 - DNA, 601 bp, Human
agaagtctgtctggtgctgtggctggctcccctgcacaccgttgcgaatcgcggccactgcaggccatgggagctgtgtggacttcctcatccggaagggggccgaggtggatctggtggacgtaaaaggacagacggccctgtatgtggctgtggtgaacgggcacctagagagtacccagatccttctcgaagctggcgcggaccccaacggaagccggcaccatcgcagcacccctgtctaccacgcctctcgcgtgggccgggcagacatcctgaaggccctcatcaggccagtacwgtggagctcgcctggctcctgcagccactttatttttcttctctgtattttgcagtttttctgtctttagaattcggctctttagatgactcgcctgttttgctggcctttgtaaagagctgcctcttggctttatcaggtctctttgttttttggcttacctgttcctttatatttacttttatctttttctaatttttagttttttttcccttttgagttgactgcttattcattttttcttaagaatgcaaacttgcaacgttaatttaccttttactatagttttgaccatcctct

SEQ ID NO: 47273 - DNA, 601 bp, Human
ttttcattttggggattctttgacgtaaaaaaattattattattattatttttgtttagtttttgaggtggggtcttactttgttgcccaggcttgagtgctgtggcgtgatcatagctcactgcagcctcaaactcctgggctcaagtgaccctcctgccttagcctccttagtagctgacactacaggtgtgcaccacaatgctggcttcttcttattttttaatgtcagactacattgttgtgaatgcttgaaacaagtacatgaccatgggtgttttgtttacatattatactttgwtaggttagcactctctctctctcttttttttttttacatttttgtcattggatctgccagaaatttaaagaattctgttagtctctgatcacatttttgattttgccattttttccccttgtactttgaataggttttgctttgaaaattttgatgctaattgagctcataaaagttcctgcttacatattatgctctatcaaaacaagagtactattagttttatttaaggcccatttacatggcattatgtaatatttagttttaaccctagggagtttcagtagttctgtttgtgct

SEQ ID NO: 47274 - DNA, 601 bp, Human
cgtaaaaaaattattattattattatttttgtttagtttttgaggtggggtcttactttgttgcccaggcttgagtgctgtggcgtgatcatagctcactgcagcctcaaactcctgggctcaagtgaccctcctgccttagcctccttagtagctgacactacaggtgtgcaccacaatgctggcttcttcttattttttaatgtcagactacattgttgtgaatgcttgaaacaagtacatgaccatgggtgttttgtttacatattatactttgttaggttagcactctctctctctyttttttttttttacatttttgtcattggatctgccagaaatttaaagaattctgttagtctctgatcacatttttgattttgccattttttccccttgtactttgaataggttttgctttgaaaattttgatgctaattgagctcataaaagttcctgcttacatattatgctctatcaaaacaagagtactattagttttatttaaggcccatttacatggcattatgtaatatttagttttaaccctagggagtttcagtagttctgtttgtgcttgtgtagaaccatttgtctagga

SEQ ID NO: 47275 - DNA, 601 bp, Human
cctccttagtagctgacactacaggtgtgcaccacaatgctggcttcttcttattttttaatgtcagactacattgttgtgaatgcttgaaacaagtacatgaccatgggtgttttgtttacatattatactttgttaggttagcactctctctctctcttttttttttttacatttttgtcattggatctgccagaaatttaaagaattctgttagtctctgatcacatttttgattttgccattttttccccttgtactttgaataggttttgctttgaaaattttgatgctaattgarctcataaaagttcctgcttacatattatgctctatcaaaacaagagtactattagttttatttaaggcccatttacatggcattatgtaatatttagttttaaccctagggagtttcagtagttctgtttgtgcttgtgtagaaccatttgtctaggagtttttgctttttaatacagtgaacattattgctatagctgatgttggggtctgtttctgttatctttctgttttgtaactgtttccatttgatatcttttcttcttatatgttgtttttttctttcctcttccattatact

SEQ ID NO: 47276 - DNA, 601 bp, Human
tttaatgtcagactacattgttgtgaatgcttgaaacaagtacatgaccatgggtgttttgtttacatattatactttgttaggttagcactctctctctctcttttttttttttacatttttgtcattggatctgccagaaatttaaagaattctgttagtctctgatcacatttttgattttgccattttttccccttgtactttgaataggttttgctttgaaaattttgatgctaattgagctcataaaagttcctgcttacatattatgctctatcaaaacaagagtactattagwtttatttaaggcccatttacatggcattatgtaatatttagttttaaccctagggagtttcagtagttctgtttgtgcttgtgtagaaccatttgtctaggagtttttgctttttaatacagtgaacattattgctatagctgatgttggggtctgtttctgttatctttctgttttgtaactgtttccatttgatatcttttcttcttatatgttgtttttttctttcctcttccattatactaggtttacagtcttattttattttattttttttgagacagagtcttgcagtgttgc

SEQ ID NO: 47277 - DNA, 601 bp, Human
gctttttaatacagtgaacattattgctatagctgatgttggggtctgtttctgttatctttctgttttgtaactgtttccatttgatatcttttcttcttatatgttgtttttttctttcctcttccattatactaggtttacagtcttattttattttattttttttgagacagagtcttgcagtgttgcccaggctggagtgcagtggcgcgatcttggctcactgcaacctccgcctcctgggttcaagcagttctccttccttagcctcctgagtagctgggactacaggtgcccrccaccatggccagctaatttttgtatttttggtagagatggggtttcaccatgtcagccaggatggtctcgatcttctgacctcgtgatccgcccgcctcggcctcccaaagtgctggtattacaggcgtgagccacagtgcctggcctacagtcttattttaatcatactaacggttgcctttttttttttctttttcaaccagattgtttttatttttcatgtttctagtgacttctttccagcaaagatgcttttttccctcttttactctggagaccaaattgctctgcatttgga

SEQ ID NO: 47278 - DNA, 601 bp, Human
aactgtttccatttgatatcttttcttcttatatgttgtttttttctttcctcttccattatactaggtttacagtcttattttattttattttttttgagacagagtcttgcagtgttgcccaggctggagtgcagtggcgcgatcttggctcactgcaacctccgcctcctgggttcaagcagttctccttccttagcctcctgagtagctgggactacaggtgcccaccaccatggccagctaatttttgtatttttggtagagatggggtttcaccatgtcagccaggatggtctcratcttctgacctcgtgatccgcccgcctcggcctcccaaagtgctggtattacaggcgtgagccacagtgcctggcctacagtcttattttaatcatactaacggttgcctttttttttttctttttcaaccagattgtttttatttttcatgtttctagtgacttctttccagcaaagatgcttttttccctcttttactctggagaccaaattgctctgcatttggacagggtgcagtttaggtagctggttctcagggaaatttttctgtattgaaaaggattaggtaagggttctg

SEQ ID NO: 47279 - DNA, 601 bp, Human
agagtcttgcagtgttgcccaggctggagtgcagtggcgcgatcttggctcactgcaacctccgcctcctgggttcaagcagttctccttccttagcctcctgagtagctgggactacaggtgcccaccaccatggccagctaatttttgtatttttggtagagatggggtttcaccatgtcagccaggatggtctcgatcttctgacctcgtgatccgcccgcctcggcctcccaaagtgctggtattacaggcgtgagccacagtgcctggcctacagtcttattttaatcatactaayggttgcctttttttttttctttttcaaccagattgtttttatttttcatgtttctagtgacttctttccagcaaagatgcttttttccctcttttactctggagaccaaattgctctgcatttggacagggtgcagtttaggtagctggttctcagggaaatttttctgtattgaaaaggattaggtaagggttctgttgttataggctgcagccagggtggctctgatgagcagggacctgggattccctttacccagcacagaatatggtctttaaattaggtactgagaatatgttt

SEQ ID NO: 47280 - DNA, 601 bp, Human
ttaaaaagttttctatattctaaattctaagataattgacacttggatagtagagtgatacggttaagttactgaacagtgatgttttctggaaataacttagcttctgccttccctgtgccagttcccccttagggctctcatctttcactgttgcaattttctgtccctctgtaagtcacctccattttgttatttgtaaattcacttgatatgtattgcccatattttagaaaaaaggtacagagtggtatttctgtatgtgcaaaagttatattgatttattgagttctcccagtgsttccttgccagtgatattaaaagcaatagaggaatttggaaaatattcaggattaaaattaactggatctcatccagtatatttttatgagtggatgaagggctatctttcccacagctcagctaataccagattgtcatattgcccaaaattacaaacgttttggaagattttccctaagaataagcagaaaaaaaccatcactgcttgagatctagttttcctttgcttaattggttgggtgtatgaaatgaaatatcaatttcttgttggctctgtgtgttttagaatacttcccct

SEQ ID NO: 47281 - DNA, 601 bp, Human
ggccttacctgttggcgagcgctgtgattgcggcatggaaggtgacgcagttctgtcctccctgcaccctgcgtgttctggtcccgtcatcgctgctccccacatattgtcctttcctattacaaatgaaatactttggtggtgacgaatcttgtgagacattgtgggactgtgtgggctgatgaaagctcaagaaaacaggtgccaactctaatgttgactcagattagagtcatgtcatgcgttttgggcaggaatcgcaaagggaggttgtgttcgcattcccctcttatcaggctgygtgtgatcgcagtgtgtccattactgccgatactcacttccgttatttgattaaggtggtgcctgccatgtttcgctcccgtaaagctattccttttctctctgtaagtagtattttgaggagaggtgctttacaaccatgtatatgtcctgttcatctcagatttttaatttgttcatttattaatttgttagtatagactcatggtttctgatattatccaatgagttataattcattattattgttacttattttgatattcgtattgtctcagtttgtctactgagagctgcttca

SEQ ID NO: 47282 - DNA, 601 bp, Human
gcttcaagccatctctgtccttttaacatgaccttagtcattctgtgagcagctcctcactttctcctgtaacaagatattctcggctcatcttgcactttgactgcctcagtcctggaataagtcatttctcctaggagtcctggtttcttttagtgaagaatggtgtgcagaaccctatatttggacactaggagtgcctattgcttttggggtatcactgttttcatgccctcctattggaccaagctaaggttgtatgtacattccacatttctgtttatatttctttatatacatkgacaggagttcacctggctacctttaatccaggctcatgccacaaggttcatcctagttttctgcctttcgcgtttactattctcctttcaccagtgagaaacccagttcccctgccctccacatactgcctgtgttgtcctgttgtcccctgtgtggcaccagccagccccccttttgctgcctcttcccatacatggctcctgacctgtttgggctctcacctctcatgccaggtggccttctcaccttgtcaggactctgactctgagccagggccccctcattgactgatccctgt

SEQ ID NO: 47283 - DNA, 601 bp, Human
ttttaacatgaccttagtcattctgtgagcagctcctcactttctcctgtaacaagatattctcggctcatcttgcactttgactgcctcagtcctggaataagtcatttctcctaggagtcctggtttcttttagtgaagaatggtgtgcagaaccctatatttggacactaggagtgcctattgcttttggggtatcactgttttcatgccctcctattggaccaagctaaggttgtatgtacattccacatttctgtttatatttctttatatacattgacaggagttcacctggctrcctttaatccaggctcatgccacaaggttcatcctagttttctgcctttcgcgtttactattctcctttcaccagtgagaaacccagttcccctgccctccacatactgcctgtgttgtcctgttgtcccctgtgtggcaccagccagccccccttttgctgcctcttcccatacatggctcctgacctgtttgggctctcacctctcatgccaggtggccttctcaccttgtcaggactctgactctgagccagggccccctcattgactgatccctgttcagagtgaaaatgattggt

SEQ ID NO: 47284 - DNA, 601 bp, Human
tatgtgagatttgtttcctcccatcgggctgtcactggggattaggaggggcggcctaggggttacctcactcatggctgtgtacatgcccacgtggagagctgtgtgacgctgccctgccgacaagctgtgcgtcctggcctggggccttccaggtgaacgtgacgctgggagtggtctgtgctaatcatgggagtctggatgtttagtgtgcctgaaaagaaagatgtcctagtgggcagcgcatcatggcgccagctggatacctgattgagttcatgcgtttctttttgctttcaatttttttttttttttttgagatggagtctcgctctgttgcccaggctagagaagtggcatgatctcagcttactgcaacctctgccccctgggttcaagcaattctcctgcttcagtctcctgagtagctgagattacaggtgcccgccaccacacttagttaatttttgtatttttagtagagacggggttttgccacgttggtcaggctggtctcgaactcctggcctcaagtgatctgcctgccttggcctcctgaagcgctgggattacaggcatgagccaccgcgcttggccaagg

SEQ ID NO: 47285 - DNA, 601 bp, Human
tgctctgaaatagtttaaatagccttgggattattggacctttaatggtttgaaggacttcccttaggaatttttctgtgtgcggggattccaagttctttcctgctaccttatcttgctgaacgtagtgaagctatctgatctgtggagtctcctacagcgcctggtgtcactgaatcaaggccttctgctcagggtggctgtgggatttgttggatctgtgggatctgtgggctgtggtcagtcccctgcacagtctgactttccctttcttccctgcaggtacggggctgatgttgaygtcaaccaccacctgactcctgatgtccagcctcgattctcccggcggctcacctccttggtggtctgccccttgtacatcagcgcagcctaccacaacctccagtgcttccggctgctcctcctggctggcgcgaaccctgacttcaactgcaatggtcctgtcaacacacagggattctacaggggctcccctgggtgcgtcatggatgctgttctgcgccacggctgtgaggcagccttcgtgagcctgctggtagaatttggagccaacctgaatctagtgaagtgggaatcgctg

SEQ ID NO: 47286 - DNA, 601 bp, Human
gaagaaaagtggaccctgaggccttgcaggtctttaaagaggccagaagtaagtggcttgagttcagctctgacttgtgggctgggttgattgaatgaatcaagatgtagcaataaacaaaaaacaaaaacctccacctgagcacttggccaaaatcttcagttagaactcgcagttttccagatggttgttcagattgatcttctctttttaaattcctgaataccaagaactgatatcagggaatctctaaaagtacatgtgtgttgtcagaactcctagaattatgctcgcgctctctttttttttttttttttttttgaggcagggtctggttctgtcacccagactggagtacagtggtgcagtcatggctccctgtagccatgacctcctgggctcatgcaatcctcccacctcagcctcccaagtagctgggactgtaggtgcacaccatgcccagctaatttttgggttttttgtagagatgaggttttgctgtgttgcccaggcttgtgttgaactcctgggctcaagtgatctgcccgcctcagcctcccaaagtgctgggattacaggcacgagccactgctttggccta

SEQ ID NO: 47287 - DNA, 601 bp, Human
agagattggaattgatccatagcttggtcttgttatccgaggctctctgggattcagacattgacctcatgtgttgtctttaacctcctgcccacatgtcaccccctcccaccgctcccagtctgggtcttgagacatccaagttgataacctcttccttctccctgcctctcaaaggactttaaattcattgtgtttttgttactggatttccctaaaccagttcattaaagcatgctcctgtgtagccttcccacaaatagttaatgaatggtcagctgggagctgtactgatagaagmagcagcttgcgttcaggactgttccactcctcagcttcctcgctaatcgagacagaacttggctgcgctcttttcattgggggcaaagtcgtcagcctgtgcccctcaagcagtgctcagcctgtgttccccaggcactggtggagcttcagggattgactaagggaaggggctgacagaggctgggcgtccgcggcccgcacctgctggggccttcagtggtccactctgatttctttctctagtgcattaaacatggtcgagttgtgatccagggagcagatgccctgggttaacgag

SEQ ID NO: 47288 - DNA, 601 bp, Human
cattaaagcatgctcctgtgtagccttcccacaaatagttaatgaatggtcagctgggagctgtactgatagaagcagcagcttgcgttcaggactgttccactcctcagcttcctcgctaatcgagacagaacttggctgcgctcttttcattgggggcaaagtcgtcagcctgtgcccctcaagcagtgctcagcctgtgttccccaggcactggtggagcttcagggattgactaagggaaggggctgacagaggctgggcgtccgcggcccgcacctgctggggccttcagtggtcyactctgatttctttctctagtgcattaaacatggtcgagttgtgatccagggagcagatgccctgggttaacgaggctggaaaggtttcgctctttcctgcgacagaaggagcagataagaagaccttcctccctggggcctgctctcctcatccatcaggaaaagccatcactttgtgtttcactgagcgttttgaagttggtagtgagcattggtgcacttctggctggcagtcccagctgccttttctctctataactggaatagaatgaaccttcctctatccctctctttcttcc

SEQ ID NO: 47289 - DNA, 601 bp, Human
ggttgtaaaatgtttcctattggacctaaaagggtgcctggctcttagttgattacctcctggatctggaaagaaaggaagcaaaataaaggggggagggtattctctatagaatgtggatttttcccacaagagactttgcagggcaatttcaaggtatggcaaggaaatatattttggggctaaatatcttttccttgtctcataatgttaatgccagagtcagactgaaaaataagtcacaatatatagggtcaaataaaacccatctgatgagaatttatggtttgtagggcatgaytccctagaccccttaggtaggaatttgggcaagataaaaaatcagagcttagtcctcattacagagaaaacaagactggccatgagttgataactgttgaaactgggagtctggtatgtggagggttactttattctacttttttatgtttgaaattttccattgtaaaaagcttaaaaatggacgtagcatcctgttttttatctaaatggagaaaactacatcaactcaaaatctcttgaagttttgttaaataaatataaatgtttgctgaagaccttatccttgccaggaaataat

SEQ ID NO: 47290 - DNA, 601 bp, Human
tcccactgcttcacttgactagcctaaaaaaataaaataaaaaatgagtgcatagttacagcaatagcacagtatagtaagcaagaaagagaatataaatgatgcagttagaaatggggaaaaggccaaaaattggggtagtagtagaaacagaaagatcaataaggaggttatcagagtagtccaatggcaatgacggtgaggaagagtggagacagagaaaacagatttaaactgtttttggaagtagaggtgacaggatatgctgaagcatgaaatatgagtttgaaggaaagacagatgagattaaagataattattaaagacaaaaatcagtacttcctacctcagcatacaaggtcctcagaatgattccagtttaattcttctaatttcaactctcatgaacccaattcacttagcttaccttccagtcctactaaaattctcaccattcacctagcatcccacgctctttcagtatgttccctctttctgaaatgctccaattcctcattaaatcccaatcatctttcaagactcagctgaaatgtcacctctgtgaagctttccacaaatctcacaggcataattagtcacg

SEQ ID NO: 47291 - DNA, 601 bp, Human
cctctaatcctatctactcaggaggctaaggcacaagaaccacttgaacccgagaggcagagtttgcagtgagccgagatcgcaccactgcactctggcctaggagacacagtgagcctttgtctcaaaaaataaaaattaaaaaaaaggtgactcacgtgccgttaaaggcattcagttttataagggaagcagggcataaaagttcagaaaatttgcagcctgacaatgtgatagaaaaaaaaaaattctgaagaaaaactcaagccagctgcaggaatttgcataagtaactaggagyccaatgttaatccccaagacaatggggaaaatgtctccagggcatgtaggaagtcttcacagcagccccacccatcacaggcctgcaggcctaggagaaaatggtttcttgggccaagccggggatcccccagctgtatgcagcctaggggcttggtgccctgagccccagcagctccagccttggctgaaaggggccaatgtaaagctcaggccgtggcttcagagggtgcaagcccaaagccttggcagcttccacatgttgctgagcctgcaagtgtacagaagtcaaaaattgggg

SEQ ID NO: 47292 - DNA, 601 bp, Human
ggagggacccggtgggaggtaactgaatcatgggggcgggttttacccgtgctgtccttgtgatagtgaataatctcacaagatctgatggttttatcaggggtttccgcttttgtatcttcctcattttctcttgctgctgccatgtaagaagtgcctttcacctcccaccatgattttgaggcctccccagccatgtggaactgtaagtccaattaaacatctttttcatctcaatctcgggtatgactttatcagtagcgtgaaaacagaccgatacagtaaattggtaccagtagartggggtgttgctgaaagatactcgaaaatgtggaagtgactttggaacagggtaacaggcagaggttggaacagtttggagggctcagaaaaagacaggaaaatgtgggaaagtttggaacttcttagagatttgttgaatgactttgatcaaaagcctgatagtgatatggacaataaggtctgggcggaggtggcctcagatggagatgaggaacttgttgggaactggaacaaaagtgactcttgttatgttttagcaaagagactggtggcattttgcccatgccctagagatctg

SEQ ID NO: 47293 - DNA, 601 bp, Human
gacagagtgtgaaacaacagactcagggtgaaagaacttcaggaagcaggacattagtgccagaatgaagagcaagcaaagaaactggtacaaaaaggcaaatctagataagcattgacttacaaaatcaaacataataacaataaggattaaaaaaataaggattataaagtcaaagtgtcaccaaaatgctacataacaaaaaacatgagaggggtgggccttgcattgcttgagaaaacactttgattagcttagaagtttagtttcaatatatacatgaaaaagttattttttttttattctaaaggaatagaaacttcttcatgtgtcactctgatgtggtttgacagtgtccccactcaaatctcatcttgaattcccgtgtgttgtgggagggacccggtgggaggtaactgaatcatgggggcgggttttacccgtgctgtccttgtgatagtgaataatctcacaagatctgatggttttatcaggggtttccgcttttgtatcttcctcattttctcttgctgctgccatgtaagaagtgcctttcacctcccaccatgattttgaggcctccccagccatgtggaactgt

SEQ ID NO: 47294 - DNA, 601 bp, Human
acaggaaaagagctcggggaaccaccaaactcgagtacaatctgcaacacaggctgagtgggcgggtcacctccagtggaaggcccaggaccaggtgaggtccaggcgtggggatgttgctggctgtggaggtccctggttggcaaagtggccaagaaaaatcctgcgtcactataaaacaagtatgctttacatgttttaaaacaatgaaataggccagggacggtggctcatgcctgtaatcccagcaatttgggtggccgagacaggcggatcatgaggtcaggagttttgagaccaycctggccaagatgttttgaaaccccgtctctactaaaaatacaaaaattagctaggcatggtggcatgtgcctgtagtcccagctactcgggaggctgaggcaggagaactgcctgaacccgggaggcagaggttgcagtgagccgagattgtgccactgcactccagcctggcaatggaacaagacttcgtctcaaaaaaaaaaaagaaaagaaaaacaatgtaataaattgaaacacaaagaacatgacagctttaaaaaacataaccaaacagaacttctagaagccattgagataa

SEQ ID NO: 47295 - DNA, 601 bp, Human
aaaacctgtgttcctgtctggcatgctttctctgactgatccccacccttcacctattttacttatatctaccctttcctaattgcttttctacactgctatgcccaactttgagtggtgcctttgctttagcctttctttgcatactcagcaatcagcacacactcccctattctgagcccataaaaaaccccggacacagccatactgacagagagagagaaaccacctggagtcccctttcctcttccatcgctcaataaaattcttctctgcccatccagacccttctaattgtcartgtatcctcattcttcctgaacacaggaaaagagctcggggaaccaccaaactcgagtacaatctgcaacacaggctgagtgggcgggtcacctccagtggaaggcccaggaccaggtgaggtccaggcgtggggatgttgctggctgtggaggtccctggttggcaaagtggccaagaaaaatcctgcgtcactataaaacaagtatgctttacatgttttaaaacaatgaaataggccagggacggtggctcatgcctgtaatcccagcaatttgggtggccgagacaggcggatcat

SEQ ID NO: 47296 - DNA, 601 bp, Human
aaattcaaaattcaacatttcagggggaaaaggaaggaaaaatactgaccctaaagctggagagaaaataacaaatcatattaaaccctccaaaaacattatatatgaggaaagtgaaaatcgcctggtggcaattgaacaggccctggagacaaaaactcattatctgaggaatttaaaagggagcaaagaccacctggtggccatcaaacaggccatttggaggataaactccttatctagggaatttagaaataattaaacttccctggtatataaagttgacatctgattccaggcmtctttcaacttttataagtaactaaaatttctatacatctctggaatgccatgttgaaactcattttacaaccctaagctcccactttaaggtccataaatagccctaaggaaaaagccaaggctgaatgctcagtcctctcattgaggcaccccgctggaaccttttgcagagttcttcctaataaactcctttttcaaacctatactgttgttggcaaattctttttaccaacccagaagttgaccacttcccagtgccagggctctgatacctcacctggcaatataatagaaatat

SEQ ID NO: 47297 - DNA, 601 bp, Human
attcagacagcaaggtgcatggtgtcatgctgctgaagcatgactgtagaaggaggggaaattttcctgagaagcatatataactgtaaacttggagcacaagtaaatatagtgctctaatttatactactcacatacaacaggaaccctcaattctagaaataaacacaaacattgctttggcccaaggtggtagacaatggctccccaaagatgctcaagtcctaatacccagaagctatgaatatattatcttatatggcaaaaaggattttgttaatgcaattaaggatcttcacaygggaagattatcctggattatccaggtaggccctaatgtaatcacaaagttccttaaaatggggaggcaaaaaattcaaaggcagaagaaggagatggaatgagaagcagagtctgaagtgatgcactctgaagttggaggaagggccatgagccaaaggattcaggtgacctctagaaactggaaaagataaggaaaccgattttcccctggaacctccaaaactaatgcagcactgcctacaccttgacttcgtccccgtaagactcattttgaacttctgacctacagaactgtaaa

SEQ ID NO: 47298 - DNA, 601 bp, Human
aagggttaatttatttattgaatctcccatatggtcaacgatatacatctggcaagatggccagggttacaaattctgaccatgatcatggaacaatgtaagtttctggtcccaccagtcatatactattatattgagtcatacatccagaaagtatttactgagtacctactatgtgccaaccatctcagagcagacaaagtgtacactaacacaaggcttccaacatttccttcaaagcagctctcatggcttaagggaaagcttatgctaggggaagccaggagagagcttacagtcrtcctatataaacacaaaatgtttaattttcatgggtcatcctaacaaaaaaatctggtatattttgcatcttattccactgtatatccatgttttaaataatattcttaaatgtattctatttaattgaaagtatcaacacagatttatggtttttagtgtttcagatcttggtttctaaatatcactctcaaatacatagaggcaaggctcttgtagaaatacctaatgtaaacctctttcatagaggtaagtggttgattctatagcaagagcaagaaaaatatcagcataggaaaac

SEQ ID NO: 47299 - DNA, 601 bp, Human
tccatgaatggaaaaatctttaaaaattgaaaaggtgaaaagcaaatcaaacgagttctgtgaaaactttcatatactaatcctcatagaaatgaacagtaagctttcttcaacactaccctattaccaaatagcatttgtgaagtgtctaccctcatatggtgctctgccaagtaacaaaggtaaggaaggtccttcatatgacaagatgatgccaggatatgtgctaactgctgttgttctagatgtgatggtgaactgaaagggttaatttatttattgaatctcccatatggtcaaygatatacatctggcaagatggccagggttacaaattctgaccatgatcatggaacaatgtaagtttctggtcccaccagtcatatactattatattgagtcatacatccagaaagtatttactgagtacctactatgtgccaaccatctcagagcagacaaagtgtacactaacacaaggcttccaacatttccttcaaagcagctctcatggcttaagggaaagcttatgctaggggaagccaggagagagcttacagtcgtcctatataaacacaaaatgtttaattttcatgggtca

SEQ ID NO: 47300 - DNA, 601 bp, Human
ttgttttaaaatattaaagaaaatatcaagtagcattcattctccatgaatggaaaaatctttaaaaattgaaaaggtgaaaagcaaatcaaacgagttctgtgaaaactttcatatactaatcctcatagaaatgaacagtaagctttcttcaacactaccctattaccaaatagcatttgtgaagtgtctaccctcatatggtgctctgccaagtaacaaaggtaaggaaggtccttcatatgacaagatgatgccaggatatgtgctaactgctgttgttctagatgtgatggtgaaytgaaagggttaatttatttattgaatctcccatatggtcaacgatatacatctggcaagatggccagggttacaaattctgaccatgatcatggaacaatgtaagtttctggtcccaccagtcatatactattatattgagtcatacatccagaaagtatttactgagtacctactatgtgccaaccatctcagagcagacaaagtgtacactaacacaaggcttccaacatttccttcaaagcagctctcatggcttaagggaaagcttatgctaggggaagccaggagagagcttaca

SEQ ID NO: 47301 - DNA, 601 bp, Human
gtgccacacacttttaaacaaccagaactcacgtgaactgagtgagaactaacttatcatcaaggggatggtgctaaatcattcacgagggatgcactcccatgatccaaacatctcccaccaggccccacctactaaactagggattacatttcaacatgaaatttggaggggacaaatatccgagccacatcacagcccattacaatcaattgaaaaacaattttttcaaaaaaaaaagttgttgttaaagtgttgtttaaaaaaacaacaacaacaagtacatcttctgtaagaaaaytgcatgcaattaagccagccccatggtgtaatggtcaacaccctggactctgaaaattgcatgcaattacaagcaaagaccactacctctctaccgaatctcccatctcccacaggtggatatagacatatggcaatcaagctagcgatgagttttataactccataaaactgtatgtggattatgactagtttttgtccaggaactatgagcaaagatgatatatgccactccaggtccaggacttaaaagaacaaaagtctatccactctctatctcctctctgaaagctggaacctg

SEQ ID NO: 47302 - DNA, 601 bp, Human
gacattaaaagaggctctatttcatttaaatttggttgaagtactacaaagagtcatgacatctccctggtgacaaataatagaataggctagaaaatatactggacttactccctacacaaattctcatttactgtaagttccacatacttgctacacaagaaagctgagctcctttcaccatctcctcattccaagaccaaggaaagtgggcctctatgacaaggtatgcagaagcaattctaatgtcagagaggaagaccaggatcttatttgcttttattaattgacaagcaaaaartgtatatatatttctcacgtacaacatgttgttttgaaatgttacttggttttaagagagccctatgaatctacaagaagttgctttggcaatcagatcagcctgccagaaagaaataccagatcgtgttcgcagtcattagggctggagagagattttcctgtgtttgagttattactcattccacattagtccacccattcaaatccgtttatagacaaccaaggcaggtagatgaacaaataatacacaaaggttgccctcaatttttgtttccctctgtgatctcatctgttttca

SEQ ID NO: 47303 - DNA, 601 bp, Human
acacttaattgagtagtgcctggtcctgattactaaattaaccttttctaaaatgtaccccatcaaaatgagctattattaataggtctcccaagaaaaaacaatgcacagtgacaaaataaacttggaaaatgctaggttgaaaaatttaaacaacaccaacaaaaaaagatttgtttatatgatggcttctcagcacgattaaatatgttaatgtctgttatagctctccaagagggaattatagcagtaggcagaatttctcaaattcagttaaccaacaaacatgttttttttttttaaagtatattaaaggattagggcttaatagagcatctgttgagaaacgctggcttaatccatgttaagtagaacaacaaaaataggttactaaatacgttgagtttggcattttatattcactattctcacaagaatccagagactggtgctacaattatccccgttttacaattagggagaaaacaacaacaactgtgaagctgaatattgtctaactctctcagctaggaaatggcaaaacccagatttaagaccagggacaatcaggcaccaaagcctctgctctttccactaaata

SEQ ID NO: 47304 - DNA, 601 bp, Human
ccaagctatggtctacagccagcactcaaaggggagaggaacccacactttcagagcattgatagggaacatggctgcaactgtgaggaaacatagcggaggcacacaaccaagcaagaatctatcaactaaccagtacacttaaatgccacctactggatgacacgccaaagcttcaagaccaaaaatactcactaacatacgtacctctcttaaaccaaagacaagaagtcagcttccaataaagaccctgtacgaagcctcggtcctgtgaaaataaccagaaaagaagtctactgaytgtactcactctacactttagttaaaggaatacccacaggcagatatgggaaagaatcaatgcacgaactcgggtaactcaaatggccagtgttgtatgtccttcaaacaaccacaccagttctccaacaagagttcttgaccaggctaagccgcctgaaatgacagaaatgcaattcagaatatggaaagaaatgaaaatctttgagattcaggaggatggagaaacccaacccaaagaagctaagaatcacaataaaataatacaagagctgaaggatgaaacagctggaaaaaaaaa

SEQ ID NO: 47305 - DNA, 601 bp, Human
attaaaaagattgtcaatacctggtattgatgtggatggccagaatgctcatatattttggtgaacatacaaaatggtacaagcactttctaatatctggtagttttttaataaataaatatatacccaccttatgatcgagtaatttcaatttctaggaaattacacatgagaaaagcatatactgacaaaaatacttgtacaagtctttccacagcagctttattaatagccccaaactgataataatccaagtatccatcaacaggagaatgaataaacaaactgtcgtatatccatraaatgggatactattcaccaatagaaaggaataatcacctgctatatacaacataaatgcatctcaaaagcattatgctgagtgaaagccttggccaaagagtacatactatatgataccatttatataaaattatggaaaaagttaatctatgatgaaaaatatcacaagactgggagtggggtcaggacttgactgtgactttccaggcaacctggctaaagaagctgcgactccaaagaagtgggaggttagacccccatacatacccctaggaaaggggctgaattcagaggactg

SEQ ID NO: 47306 - DNA, 601 bp, Human
attttgttattgttgttttgagaatctacactacattttctcatggaagtactaaatatgcctaaatataaggtgaccctcacatacacttcccaaaaatgaggtgcaaaaaagagtttctgatcaaagtaaatacatgaatatttaagcacagactaaacagttaaatatctacttatttactctcttgacttacacagtttgaattattatatgaaatgctactttacaaatactgcttgtttctctatactcatttcatgcaacaatattcaaactgaattttcactgcatcttcaayatcagtgtctttgtcatcatgagaggcactttttgagtcatgtatactgattaagtcatgtacattgattaaatcaatcaatcaatgcaatggtgcttggcacatgataaatgcttaacaagtcttagctaactgaatacaattttctggactacatcatcctcctttccaaacatctaaattcttttgcgatacagcagtttctgatcttctgtatgatgctctcagcagaaatttcatttcaagccacatgtaccaatctgcataagagtaggacagatttttttaaatctgtcttat

SEQ ID NO: 47307 - DNA, 601 bp, Human
gtgagactccgtctcaaaaaaaaaaaaatagtagcatgttagagcccagagagacttctgagatcgcctagtccaaacccttccaaacacgtttcattaatggcaaaacatagactcaaaatagagacatcccttgctcagtatcacatagcaagtcaaggactataaccctagtctccatgtggttctcagtttgcttgcctctagcagatacccctttcctatttgctgctttaaactacaatgctagggggaaaacacacacaacacacacacacacacacacacacacacacacacacagaaagaaaatgaggttgtcagaaatatgtattaaataaataaggcttttaagtcagtgagtgctgatgataacctcctgtataatgtaaaactttgtgacaactattttggccctagcccctttcatataatttcaagtttgtgaacatgatccaaaagattaaggatgccagtcttgctggggctaagtgagatattgttagtcctatttacccatgttgccagcacttactatagatagcccttacaaatggattttctgtactttctctactttcctgatgttctcaaggctttt

SEQ ID NO: 47308 - DNA, 601 bp, Human
gtaagaaagaagaactctcacacactgttggtaggaatgcaaatcagtacagccattatggaaaacagtacagaagttcctcaaaaaattaaaaataaatctatcatatgatccagcaatcttcaccctcactactgggtatatagccaaaggaaatgaaatcagtaggttgaagagacatctgcactcccatgtttattggagcactattcacaattgcgaaaatatggaatcaacttaaatgcccatcaacaaatgaattaacaaggaaaatgtggcatatatacacaatagaatactrcacagccataaaaaaaattaaatcctgtcatttgtgacaacatggatgagcctggagaacattatattaagtgaaataagctgagaacagaaagaaaaatactgaatgatctcactcatatgtgaaatctaaaaaacttgatagtggttaccagagactggggagaacaggagggaggggaagatgaggagaggttggtcaatgggtataatgttacagttaggtaggaggaatacattctggtactctatcacacagtaaggtgagtatagctaacaataatgcattgcatatttcaaa

SEQ ID NO: 47309 - DNA, 601 bp, Human
gtttgtgtgatttaagtgtgaattaatatattgcacctttttatagtctgttcaagatctaaaactagaaacaatagctacttttatttccccacataaactatgaaactattacatggtaagaaagaagaactctcacacactgttggtaggaatgcaaatcagtacagccattatggaaaacagtacagaagttcctcaaaaaattaaaaataaatctatcatatgatccagcaatcttcaccctcactactgggtatatagccaaaggaaatgaaatcagtaggttgaagagacatcygcactcccatgtttattggagcactattcacaattgcgaaaatatggaatcaacttaaatgcccatcaacaaatgaattaacaaggaaaatgtggcatatatacacaatagaatactgcacagccataaaaaaaattaaatcctgtcatttgtgacaacatggatgagcctggagaacattatattaagtgaaataagctgagaacagaaagaaaaatactgaatgatctcactcatatgtgaaatctaaaaaacttgatagtggttaccagagactggggagaacaggagggaggggaa

SEQ ID NO: 47310 - DNA, 601 bp, Human
atttgccttaccttttatgaaactgttgtgagataaggaagctaacatatatgaaaagtagtttataaactctaaaaggttaatcaaagataagatactaatcaggccgggcacggtggcttacacctgtaatcccagcactgtggtaggccgaggtgggtggatcacttgaggtcaagagttcaagaccagcctgaccaacatggtgaaacctagtctctactaaaatgcaaaaattagctgggcgtggtgatgggcacctgtaatctcagctacttgggaggctgaggccagagaatcrcttgaacccaggaggcggaggtagcagtgagccaagatcgtcccattgcactccagcctgggcaacaagagcaaaactccgtctaaaaaaaaaaaaaaaaaactactcaaaaataagatattgttaaactgcccacagctcaacagtcaactcaaaacctgtatacctaggttttctgcattcacatgacaaaagcccattggccatataagcacataatagcatcgctattaacagcattaagaatgaagagtcataatatgaaaggtgatttatatattttctacagaattgttcaca

SEQ ID NO: 47311 - DNA, 601 bp, Human
ataacacaatgaacactacaaaaaaaaatgagggacaatgatagaataacactcaaatgtcaagaaataaaatgccatatttactgttatagtaattctaataaaatctagtgaagaaacaaattgataacattaatgttacatgaatatttttgagatctaggaaaccaaagtgaggaaaacacccactttgttctatcctagatttatcacttaggaaacacttggcaagtcatttaatctctctgattcaccacatataaaatggggatcagtccatttgccttaccttttatgaaaytgttgtgagataaggaagctaacatatatgaaaagtagtttataaactctaaaaggttaatcaaagataagatactaatcaggccgggcacggtggcttacacctgtaatcccagcactgtggtaggccgaggtgggtggatcacttgaggtcaagagttcaagaccagcctgaccaacatggtgaaacctagtctctactaaaatgcaaaaattagctgggcgtggtgatgggcacctgtaatctcagctacttgggaggctgaggccagagaatcacttgaacccaggaggcggaggt

SEQ ID NO: 47312 - DNA, 601 bp, Human
tggtatccaataaatgcttaattaataatggtttatacgtgcagactatttttgtttcaaatgcgaaacaaacttgttgcgaaaaacacaaaaaataaggccaagaaaaaaacacggtattgtaaattagaaagtccgagttaagtgaaaaaaagaagtgccttattaaaaataacacaatgaacactacaaaaaaaaatgagggacaatgatagaataacactcaaatgtcaagaaataaaatgccatatttactgttatagtaattctaataaaatctagtgaagaaacaaattgatawcattaatgttacatgaatatttttgagatctaggaaaccaaagtgaggaaaacacccactttgttctatcctagatttatcacttaggaaacacttggcaagtcatttaatctctctgattcaccacatataaaatggggatcagtccatttgccttaccttttatgaaactgttgtgagataaggaagctaacatatatgaaaagtagtttataaactctaaaaggttaatcaaagataagatactaatcaggccgggcacggtggcttacacctgtaatcccagcactgtggtaggcc

SEQ ID NO: 47313 - DNA, 601 bp, Human
ctgtgcccctcacgacacctaccacactgctctatagatgtggtatccaataaatgcttaattaataatggtttatacgtgcagactatttttgtttcaaatgcgaaacaaacttgttgcgaaaaacacaaaaaataaggccaagaaaaaaacacggtattgtaaattagaaagtccgagttaagtgaaaaaaagaagtgccttattaaaaataacacaatgaacactacaaaaaaaaatgagggacaatgatagaataacactcaaatgtcaagaaataaaatgccatatttactgttayagtaattctaataaaatctagtgaagaaacaaattgataacattaatgttacatgaatatttttgagatctaggaaaccaaagtgaggaaaacacccactttgttctatcctagatttatcacttaggaaacacttggcaagtcatttaatctctctgattcaccacatataaaatggggatcagtccatttgccttaccttttatgaaactgttgtgagataaggaagctaacatatatgaaaagtagtttataaactctaaaaggttaatcaaagataagatactaatcaggccgggc

SEQ ID NO: 47314 - DNA, 601 bp, Human
tcttccttactccaattacactcatcactctattataccatgctcccataatacacatatgcagtttaccttgcatgtatttatccattcctttttaatagtcctttagttttccagtatatcctttatcttccaaatcagactgtaattccttgagggaataccttagcaccgctccttctgtgcccctcacgacacctaccacactgctctatagatgtggtatccaataaatgcttaattaataatggtttatacgtgcagactatttttgtttcaaatgcgaaacaaacttgttgcraaaaacacaaaaaataaggccaagaaaaaaacacggtattgtaaattagaaagtccgagttaagtgaaaaaaagaagtgccttattaaaaataacacaatgaacactacaaaaaaaaatgagggacaatgatagaataacactcaaatgtcaagaaataaaatgccatatttactgttatagtaattctaataaaatctagtgaagaaacaaattgataacattaatgttacatgaatatttttgagatctaggaaaccaaagtgaggaaaacacccactttgttctatcctagatttat

SEQ ID NO: 47315 - DNA, 601 bp, Human
ggctcccattcagtctgcctgctttatgaatttctgtgatattttatcctccacagaacccactattttcactgagttgccacactgctcaatacctggcagaatgccttgtatgtgattggtcttggcaagtaaaaatctgctagttgactaacagtagccctaacagtagcccttccttatatcaaataccccacaaaaaaatcttccttttcctgtctctaaaccaaaccaccttccttatttactaatcttctggtttcatctccacctactttccaacatggcatctctaactccraatttatcaattctaattgtcaaatcatgacagtttggttcatatcatttgtttcttctgtccttttcttcccactctgcataatatcacaattcttccattctcaaacataatcacatactttagcaaactactttaagaaaaagtttaaatttaacttccaattagtcttccttactccaattacactcatcactctattataccatgctcccataatacacatatgcagtttaccttgcatgtatttatccattcctttttaatagtcctttagttttccagtatatcctttatctt

SEQ ID NO: 47316 - DNA, 601 bp, Human
ggcagggctcatcacttgctagttaaaagcccttggctacaaaataatcaacagtaatacccaggtagtatgccgtgagccttgggtgagattctgagacatgctggcttcaggtgagacccagtacattcccagctgtggtatctatggcaaaagacttctgtttgagaaaagcagagagaaaagtaaaggggactttgtgttgtgtgttaaacaccaactcagacacaggggtgcagagcaccaagcaggctcttgggaactcaagtcgaggcctaggctcttagaaagcctttctggrcctaccctcggccagaggggagcccactgccatgaagggtaaggcccaggcctggaagcattcaacacaagcttactgaagggtacttggggtttaagtgaacatcaggggtggcctggcagaactcccagttgaccagtggctgtggtggccactgggagaggctgagagaagtcaaattatccttgtttgcagatgatataattttatatttggagaatcctaaagaccccatcaaaaacctattagactgacaaatttagtaaagttgcagggtataaaatcaacatacaaaattaa

SEQ ID NO: 47317 - DNA, 601 bp, Human
aagatagcaaatatgaaaaagatattgagagatacagaagagagaatgctaagttctaaaacttacctacttagggttccaaaaaggcgagaagagaaaaggaagaaaaaacaatacttataaagatattggctgataaatttccaaaacaataaacataaatttacagacagaaaaagcacaatgtatttagttgaaccataggataatgtaggtctaaaatggttgaataatgttaatttcatatggttcaacctatactaagcaagataaatacaaagaaattaacacctaagattcrctgtagtaaaaatatagaatacaaaagacaaactatattaaaaacaatgtgagagaaaaaaagatatctttgtaacttgtcataataaaaaatgacaaagtaggctgacactgaacttttcagtggcaaaaatggaacacaaatgacaatggaataaaattttaaagtattaacaaaaattgtcagcctagcattgtttactcagtaaacttccactcaagagaaaaaagaagaaaaagttattttcagatacacacaactagaaagcatttgccaccagtagatgtaaactagaggaac

SEQ ID NO: 47318 - DNA, 601 bp, Human
tataaatctcacatcttcaattttccacatacaacagtcaggaaaatttcatctgaggttcaacaattggtaaaaacgtgtttggtggtgataatttacatgatttatttacatacataaatttataccacaagctacaagtgaaacatattcatccttcatcttttagcaattctaccacattaaaggaaaaaattagatcaaatctaggccacagaataatgaaaggctgaattatctagaaggttgacagttaaatgccctcctttaacaaaattaagtaacaatctctgggcagttyacatctacacataaaaaaaaaatgtgaagtttgttcccactgatactgctccaattaacaggttataaatacctgacgtagtatataaaacttattccaaactagaatgtagttataaaggctactatgttaccaaccacacaaataaacaaataggtcagttaaggcttaaaaaggacttctgtttggaaaatatattgtgagcgttttaaagtctataaactgcatatatatcctgtgcaatgtgccagaaaatgtatcaaccaattaatttacattagggaaaactgtaaagcttgc

SEQ ID NO: 47319 - DNA, 601 bp, Human
atctccctctctctctctctctcgttcctgctcttgccatgtgatgtgcctgctccaccttcagcttctgtcataattgtaagcttcctgaggcctccccagaagccaagcagatgacggcaccatgcttcctatggtgctgcatccttcctaaaggctgcagaactgtaagccaattaaacctcttatttttataaatagcccagtgtcaggtatttctttatacgagtgcaagaactgactaatacagaaaacttgtacagaggaatggggcattgctataaagatacctgaaaatacrgaagcaactttagaactgcacaatgagcaaaggttggaagaaattagaggacccagaagaagatagtaagatgagggaaagtttaaaatttctcagagacaggataaatggctctgatcaaaatgctgacagttatatggacaatgaagtccaggctgaggaggactcagatggaaaagaggaacttattgggaactggagcaaaggccacccatgttatgcctaagcaaagaccttggctgcgttctgttcatgtccgggggatctgtggaagcttgacttgagagtgatgatttaggg

SEQ ID NO: 47320 - DNA, 601 bp, Human
taacaggtgatgggatttcagttaattcttgtaacaaaaaataatacttatgttattttctaaaatttctagatatgagatatttcttccatatcaaagacataattttaatgcttacaccaacaaggaaagtgattaaattatggcatatacatcctcataccagacaatacagccatctaaatttctttaaagtatgcatatatgtactcatttatacacagttacctgtacaagcatgtaaaatgtaggaagacatgcaaccaacttaacaatgattaagggtggaatatgaaggtgyggaatggtgcttctatttctttataaaattgaggaggatatgcgtatgtgcacattattccccccatattcttattctttttctaactactaagatatggtatacaagaatttgctcatcaatggctactcagtatctcctatatgctttggcaccttgctaaataaccctcacaaattagcccattggttcaaatgccaacacatctaaaactgtcctgttccttaaatagattttactttgtgccagactacagaatcaaaacatgagtaataagattcaaagaaaggactgcaagaa

SEQ ID NO: 47321 - DNA, 601 bp, Human
tccctaacacttcccactaggtcccaactccaacactgggggatcaaatttcaacatgagatttggaggagataaatatctaaaccatgtcaacagccatccatcgcttaacaacaggtctgagaaatgcaccattaggcaatttcattgttgtgtgaccatcatagagtgtacttaacaaacctagctgacatgacctatgacatgcctaggctatatgctatatagcctattgttcctaggctacaaacctgtgcaatgtgtgactgtactgaataccatagacaaacgtaacacaatrgtatttgtgtatctgaacatatctcaacaacatagaaaaggtacagtcaaaatacagtaatagaatcttataggaacaccatcatatatgtggtctgttgttgactgaaatgtcactatgcagcacatgactgtaaaaatatttgtcaaaactttcatactattttattatattaagcaagcgtgaatctactgcctaatttggagggagggcagaggatggagcatgaagagatccagaaataaaaacgaggaagagtaaaagctacattaattatttcagtcctaacagagttctttt

SEQ ID NO: 47322 - DNA, 601 bp, Human
taatgattatttaagtattcaattcttagcagaacaagagggcatcctgccagagaggacctcaaagtaccttgcactatgcttttgtgctttgctgctttcagtgtcctcatttttactagcttgatttctgatagtatcttttcctcatgccatttcaacatacaaacaatatgctccaaactgacattaaggaattaaactcaatttaatctggcaaacttagctttgtatcactatagaaaatatccctacttatggagatatgtcacccatagctcctttgatatcttccaggggkagcaaactgcacagaagctctaatttaatctgcaaggttgacagattcgtatttcttaacctcactatataagggtacttctaaaacctttccgaatgcaataggccaattttattagtacatttctagtattaagactatctctctaaagaatggctaaagtgaacagcagaaatatttggtttgttcaattggctgtgaatattaacaagcatcaatgtgtttattagggccttaaaataccatttccaaagtttacatgtccaaggaaaattattttctaccccagtaactattcag

SEQ ID NO: 47323 - DNA, 601 bp, Human
ccataaccattaaaccatacctaacatgccttaaagtgtgtctgtgtatgcatacatagacaaaactcatatggctatcaaagaatgttagaaattcactaaggtactggtagtaacagacacatgaaccactcctactctcacgaggtccctcttgtgaccaagagtacgtacttgcaagacaggtttagggcctcaatctttggacagggaagcagtctgttttcaaagaggacatagtcaatgggtagaagaaaattagatcaaaactagtacaagtccccaaggtcaaagttcctawttaaatttcttttacagttttgtttttaaaaaacctctgacgtagaaaaggctgattttattgaaatgtctagtttctaatttaacatcataactggcacgctttagtcttgcaaaaagtagcatataaacatatatactgttttctattcctacattctagggaaaaatgcctcaactttgatggatgggcctctgaaatccactctcttattcccagtcctcacagaaactttgtgataatactatttttaaaaaacacacaaagagacagagagacgctttcccataacttaatttc

SEQ ID NO: 47324 - DNA, 601 bp, Human
tcgagaccagcctggccaacatggtaaaacgctgtctctactaataatacaaaaattagccaggtgtggtggcatgcacctgtagtcccagctacttgggaggctgaggcataagaatcccttgaaccagggaggcagaggttgcagtgagccgagatcatgccattgcactccagcctgggcgacagagactctgtctcaaaatagaaaataaaaaaaataagttttttaaaaaagaaagaaattccataaccattaaaccatacctaacatgccttaaagtgtgtctgtgtatgcatayatagacaaaactcatatggctatcaaagaatgttagaaattcactaaggtactggtagtaacagacacatgaaccactcctactctcacgaggtccctcttgtgaccaagagtacgtacttgcaagacaggtttagggcctcaatctttggacagggaagcagtctgttttcaaagaggacatagtcaatgggtagaagaaaattagatcaaaactagtacaagtccccaaggtcaaagttcctatttaaatttcttttacagttttgtttttaaaaaacctctgacgtagaaaaggctg

SEQ ID NO: 47325 - DNA, 601 bp, Human
aatgaaagtgtctctttattcagtatctttattgtcaaaacataagaactattatatacatatgcattcgtactaattttaaattataaaaatagggccgggcgcggtggctcaggcctgtagtcccagcactttgggaggccgaggcaggcagataatctgaggtcaggagtttgagaccatcctggccaacatggtgaaaccccatctctactaaaaatacaaaaattagctgggcatggtggcgggcgcctgcagtcccagctactcgagaggctgaggcaggagaatctcttgaacycaagaggcagaggttgcagtgagccgagatcgcgccactgcactacagcctggctacagagcaagactccgtttcaaaaaaataaataaataaaataaaaaattataataactgaactgtattaatgctttagaaactgaaaacataaaagaatctttgaaaatagcttccaaattcataagtgcaatatgtaaggcaatgttttcatttctaaaattatgcatgtgggattctatatatgaaaaatgaacagtaggtctttgccttaaccggagtttttcctaaaggtgacaagaggcc

SEQ ID NO: 47326 - DNA, 601 bp, Human
aatacagttatagatgccgagatacagggacatctataactacttatagtaaatcatcaaaaaattacctgattttcaacaatatgatttattaacagtggatatatactatatggaaaaaaaacacaagaatgtaaagaatgttaagaactagtgtgaatgatgggaaatattatagaagaagtttaataatgagacagaattgtgataattcatttaaatatcctcttaattttaaatgagaacataagaagtattttgtgctcttggaaaggtatatggttacatgtgcacatacatytttcatattgcttctcatttgtttttcccccataccagtctttgttagaaagggaagctatgtgtagctcataatggcagcatttgttctctgtcacctctgtattttcttcatgtatcttatgcccaagtgaaaaaaaaaagtgatttgtaagaagtgccacacaaaatgagtattgatataaagactcctctgtatgctattcttatcagtcattccgatagtctttaaaaaaaataagttttggttgggggtgtaaggattacttggtgtcaacgagcaatagtggaaatctttttt

SEQ ID NO: 47327 - DNA, 601 bp, Human
tcaccagatgtcaggagttcgagaccagcccggtgaaaccttgtctctactaaaaatacaaaaattagctgagcatggtggtgcacacctgtaatcccagctacttgggaggctgaggcaggagaatcacttgaacctggaaggcggaggttgcagtgagctgagattgtgccagtgcactccagcctgggcaacagagcaagactctgtcaaaaaaaaaaaaaaaaaaaaaagaaagaaagaaagaaagaaagaaagaaagaaagaaagaaagaaagaaagaaagaaagaaagaaaaaaagaaaaggaaaggagaaaggagacgggagaggagactggaggacaggaggcaggaaggccaaagtcaaagaagatgatgtgaagacaggagtagacgtcagaatgatcccactgttggaagtggggcacatgccaaggaatgcaggcagcttctatatgctagaaaagacaaggaacagattctcccctagtggcccgagaagaaatgcagccctgccaaccagttttaaacttctgacctccaggatggtaagataataaatttgtgttgttataagctactaagtttgttatggcacca

SEQ ID NO: 47328 - DNA, 601 bp, Human
cagatcaccagatgtcaggagttcgagaccagcccggtgaaaccttgtctctactaaaaatacaaaaattagctgagcatggtggtgcacacctgtaatcccagctacttgggaggctgaggcaggagaatcacttgaacctggaaggcggaggttgcagtgagctgagattgtgccagtgcactccagcctgggcaacagagcaagactctgtcaaaaaaaaaaaaaaaaaaaaaagaaagaaagaaagaaagaaagaaagaaagaaagaaagaaagaaagaaagaaagaaagaaagaagaaaggaaaaggaaaggagaaaggagacgggagaggagactggaggacaggaggcaggaaggccaaagtcaaagaagatgatgtgaagacaggagtagacgtcagaatgatcccactgttggaagtggggcacatgccaaggaatgcaggcagcttctatatgctagaaaagacaaggaacagattctcccctagtggcccgagaagaaatgcagccctgccaaccagttttaaacttctgacctccaggatggtaagataataaatttgtgttgttataagctactaagtttgttatggc

SEQ ID NO: 47329 - DNA, 601 bp, Human
gtttcatggaagccaagagtacaaacttatataatatataattatataatatattatataatacgtattatatatagtatataatatgtattacatattatatatagtatataatacatactatatataatacataatatgtaatacgtaatacataatatataatacatgaaattaatatataatacatataatatatactatatattaattatataatacatataatatataatatattaattatataataacataatatataatacattacataatatattatatattaattacatawtatataatatatataacagcatatatgaagtatatataatatataaataataagtatatataatatatagcatatatatctaatatatatattatatatatactatatattataaagtatatatataccagcatatatgaaagtatatactagcatatatgaaatagaaagtagtatatatatatatactagcatatatgaaatagaaaatgcttgtgtgtgcgtgtgtgtgtgtgtgtgtgtgtgtgtgtgtgtgtgtgtctgtgtctgtttaaaaaaaatgttgccagcagcagtggg

SEQ ID NO: 47330 - DNA, 601 bp, Human
tacacagagtcatctagtgagtatgcccaaagcaaggcatactgtgggctgagggaaaaatactgaggagccctgatatttaaggactgggtaaaggaacaagagcccactaaagaagtagagaggaaacagccagagtcatgaggggaaccaaagggcagtttcatggaagccaagagtacaaacttatataatatataattatataatatattatataatacgtattatatatagtatataatatgtattacatattatatatagtatataatacatactatatataatacataatatrtaatacgtaatacataatatataatacatgaaattaatatataatacatataatatatactatatattaattatataatacatataatatataatatattaattatataataacataatatataatacattacataatatattatatattaattacataatatataatatatataacagcatatatgaagtatatataatatataaataataagtatatataatatatagcatatatatctaatatatatattatatatatactatatattataaagtatatatataccagcatatatga

SEQ ID NO: 47331 - DNA, 601 bp, Human
catttgacagatgtccagcaggaagcttagcatgtgggccagacactcctgggagatacagaagtgtctgtcaccaagatttatgcagaattgatatcatgagactacacagagtcatctagtgagtatgcccaaagcaaggcatactgtgggctgagggaaaaatactgaggagccctgatatttaaggactgggtaaaggaacaagagcccactaaagaagtagagaggaaacagccagagtcatgaggggaaccaaagggcagtttcatggaagccaagagtacaaacttatataatrtataattatataatatattatataatacgtattatatatagtatataatatgtattacatattatatatagtatataatacatactatatataatacataatatgtaatacgtaatacataatatataatacatgaaattaatatataatacatataatatatactatatattaattatataatacatataatatataatatattaattatataataacataatatataatacattacataatatattatatattaattacataatatataatatatataacagcatatatgaagtatat

SEQ ID NO: 47332 - DNA, 601 bp, Human
cctagcacaatatgttgtacttggttaataaatagtcttgttccattaggtgagcagtaagattatgagcatttcaaatcaggtatctcaccttctgcttctaatacttatagtacatagcttaggtctagacacagtgatgtataatgtatacttattgactcctatttactgaaatagcctcaagaaatatgttgtagaatgcatgatatctaatgctggaaacaaaaaatttgaaacaaataagtgaaagagcaggtaaagtagtccttaactttagtctcataaataaacaaaatamattgaaaatttatacatgaaaaaagttcagtaattggatttagaatttagaattcaaggtgctatggtttcaatgtttgtgtctccccacaattcatttgttgacatatgcaatacaaaagtattacctcttaatacctcaagtagacccacaatgcaaaagttattaagaggtaggggctttggaagatggttaggtaacaagagctctgccctcataaatgggattagtgctcttaaaaaagggttcaaggaagcttttttatccccttgcctgtatgaggacacacagaaggtgcca

SEQ ID NO: 47333 - DNA, 601 bp, Human
cctatggtaagggaatatcttattcatctttacgtaccatgaaatgcctagcacaatatgttgtacttggttaataaatagtcttgttccattaggtgagcagtaagattatgagcatttcaaatcaggtatctcaccttctgcttctaatacttatagtacatagcttaggtctagacacagtgatgtataatgtatacttattgactcctatttactgaaatagcctcaagaaatatgttgtagaatgcatgatatctaatgctggaaacaaaaaatttgaaacaaataagtgaaagarcaggtaaagtagtccttaactttagtctcataaataaacaaaatacattgaaaatttatacatgaaaaaagttcagtaattggatttagaatttagaattcaaggtgctatggtttcaatgtttgtgtctccccacaattcatttgttgacatatgcaatacaaaagtattacctcttaatacctcaagtagacccacaatgcaaaagttattaagaggtaggggctttggaagatggttaggtaacaagagctctgccctcataaatgggattagtgctcttaaaaaagggttcaagga

SEQ ID NO: 47334 - DNA, 601 bp, Human
taatggagaaggaagagggaaaagtggggatggttaaagggtgcagaacataaatagaatgaataagatctagcatttgatagcacaacagggtgagtacagtcatttacagtgtactttaaaaataactaaaagagtataactggaatgattgtaacactgagaaatgataaatgcttaaagtgatgggtatcccatttaccatgatgtgattactccacattgtatgcctgtatcaatatatctcatgtacccaataaatatatacgcctagtatgtacccataaaattaaaaaaaaaattaaagaacagaacagtttgtcttcttatgtaaataaacccccctctatgcactatctctgcattaagaaaataagcaacccacataggaaatgagctgcaaggaaacagaacaggtatgagtaaataaatggttgcatgaacaaaagtaacatgcaaagaaaataaagatatataaatcaatggaagaaaatgatcaagattcaagtgcacatgcaaatcctacaataaaaatcaccttcacttcatataaaagaaaatgcaaaaggcttcttttatcatttacacagaaaatatgcca

SEQ ID NO: 47335 - DNA, 601 bp, Human
ttttggggtgatggaaatgttctaaaactgatggtggtgatgtatggacaattctacaaatatgctaagagacaatgaattgtacacttcaaatgggtgaatcatatggtatatgaatgatatctcaataaagttattattaaaaaaatagtaaatacaggattaaaactttgttgtcctaactcacatcctaatgctttgtcttattggattaaaaaattaatgacaaccaacaaatatcaaaaatgaagtcataacagtgaatgccattttgagcacatgttctctcatttaagagcaygtgtcttttatgcgtgttaggcattgagctaggagctggggatatacacatgaagtagacttagttcttactctccttccttgtttttggttccctaatatagggcctagcacacgacagatgctcagtaaataatttctgaattgatgttattgtattttcaggtatgatcaaagtacgatgtgcttataaaaaggtccaacattactaatctcaatgcataaagcctatttcttgctaatttgataatcatttatttgcctctcttctttaaaactgttataattaaattttctgttt

SEQ ID NO: 47336 - DNA, 601 bp, Human
aagggtaaaaaatttcaggtggttaaaacattggaaagggctaattatattgtgacttggtgtgctcacactggcaagtacagagagaacaaagtgaattatttaaaatatttctatgtttagttaacatacatcaacacaaacaaaattaaacatttcatcaatatagtactttaatgtttttaggatgtatgcctactcataagctgaaagtagcatataacactgggtgagtgtacaagcactgggatccaaaagagttgagtttaattcttggctcaagaacttactagctatgggrcctctggacaagttattcagccccttcaggacttagcttccttatctataaatgggtatatcacaaatacttatctcataagattgttttgaggaccaaataagataatatatatgagatgctaaggatagaatctgacacacagaaagtgctcaaatgaatggcagctacagaaaatatgacatctaaaattgctcgctctctctcaaaggcatgagaaaacaaatggcactaccgtatgtgaacaacctgatagttcaatctatacagttagctctcaacttaataatgggctgtata

SEQ ID NO: 47337 - DNA, 601 bp, Human; identical to SEQ ID NO: 28208

SEQ ID NO: 47338 - DNA, 601 bp, Human; identical to SEQ ID NO: 28209

SEQ ID NO: 47339 - DNA, 601 bp, Human
agatcagtaaaatcataagcatcaacggggagcaatcgtttttgtttttcttttttaaaaaaagcaaatacccacacctgtggctgatatcgggaatgaaagaggggacatcactacagatcctacggtgaataaaaggctagtaagggaagatagagaacacagtctgggtgctggaggtgctcattgctcctgggttggtcatggctaacctccctaactcagatctttagacctataataggattgcaacctctgaggtcaggctgcctgtgtttgagtcccagcttgagcattttcyagctaagtgatcttgggtaatttattgctgtcttcctgagcctcctttgccttgttaaaaaagcagagatgagccggcatggtggcacacacctgtaatcccaacaatttgggaggctgaggtgggtggatcacctgagctcaggagttcgagaccacccagggcaacatggtgaaacccatctctactaaaaatacaaaaaaaaattaactgggtgtggtggtgcatgcctctagtcccaactacttgggaggctgaggcaggagaatcccttgagccccagaggtgaaggctgcagtg

SEQ ID NO: 47340 - DNA, 601 bp, Human
gtaaaatcataagcatcaacggggagcaatcgtttttgtttttcttttttaaaaaaagcaaatacccacacctgtggctgatatcgggaatgaaagaggggacatcactacagatcctacggtgaataaaaggctagtaagggaagatagagaacacagtctgggtgctggaggtgctcattgctcctgggttggtcatggctaacctccctaactcagatctttagacctataataggattgcaacctctgaggtcaggctgcctgtgtttgagtcccagcttgagcattttccagctamgtgatcttgggtaatttattgctgtcttcctgagcctcctttgccttgttaaaaaagcagagatgagccggcatggtggcacacacctgtaatcccaacaatttgggaggctgaggtgggtggatcacctgagctcaggagttcgagaccacccagggcaacatggtgaaacccatctctactaaaaatacaaaaaaaaattaactgggtgtggtggtgcatgcctctagtcccaactacttgggaggctgaggcaggagaatcccttgagccccagaggtgaaggctgcagtgagctga

SEQ ID NO: 47341 - DNA, 601 bp, Human
cccaattcccttctctctacccagttcttcccatgcctgtctctgctctcttatccaggggagcacctaggctagtgaagtcagtatgcctggttcaaatcccggccagctgggtggcctcaggcaaatgacttgacctctctgcccttcttgtagcctcatctgcaaaaatgtggatcaatcaccttgggccaggcccggtggctcacacctgtaatcccagcgctttgggaggccaaggcaggtagatcacttgaggccaggagttggagaccagcctggccaacatggtgaaaccccrtctctaccaaaaacacaaaaaattagctgggtgtggtggttcgtgcctgtaatcccagctactcgggaggctgaggcagaagaattgcttaaacctgggaggcggaggttgcagtaagccgagaccgtgccactgcattccagcctgggcaacagagcgagactctgtctaaaaaaaaaaaaaaaaaaaaagggatcaggatcaccatggtctctatgccatggttgctgtgaggacttggaatagcacctggtggccgggcgcagtgtctcacgcctgtaatcccagcactttgggagg

SEQ ID NO: 47342 - DNA, 601 bp, Human
tgctctcttatccaggggagcacctaggctagtgaagtcagtatgcctggttcaaatcccggccagctgggtggcctcaggcaaatgacttgacctctctgcccttcttgtagcctcatctgcaaaaatgtggatcaatcaccttgggccaggcccggtggctcacacctgtaatcccagcgctttgggaggccaaggcaggtagatcacttgaggccaggagttggagaccagcctggccaacatggtgaaaccccgtctctaccaaaaacacaaaaaattagctgggtgtggtggttcstgcctgtaatcccagctactcgggaggctgaggcagaagaattgcttaaacctgggaggcggaggttgcagtaagccgagaccgtgccactgcattccagcctgggcaacagagcgagactctgtctaaaaaaaaaaaaaaaaaaaaagggatcaggatcaccatggtctctatgccatggttgctgtgaggacttggaatagcacctggtggccgggcgcagtgtctcacgcctgtaatcccagcactttgggaggctgaggcgggcagatcacttgaggccagaagtttgagaccagc

SEQ ID NO: 47343 - DNA, 601 bp, Human
ggtctgagggaggaggagctggggcctggactcctgggtctgagggagaggggctgggcctggactcctgggtctgaggtaggagggcctggggtctggactcctgggtctagaggaggaggggcggtgtctccgctgggacttgggcctgtgtcctctggccctggctggcggggcagccgcagggagctagtggaagctgtgactgctccatgctggctcgcattgatgggtgggggaggtgtgtgggtgaccacgtggtgggagcgggcaggagccgcacgtctgggcaggcaggaargatgggaagggagagatgaagagggacagggattccgaggcagtgagacagcgacgcagggagacacaaggcctggagatgaggcagagcctgggcaggggaggcagagcccgggcaggggaggctgggccctgcgagctcctggctctgcgtctgggccacagatggggccgagaaggggatgggaagggaatctgggtgggggccaaggccaggcctggaatttataaacagctgtgcaaggagagtggcggggggtggattccagccggggcctccgggcgtgctgagccctcacca

SEQ ID NO: 47344 - DNA, 601 bp, Human
agtgcatcttttgtgtaactgtgtgtgattacgtctgtgtgtgtgcctttggatttgggagggcatgggaggttatgtgtgtgcgactgtgtctgtgtgggtgtgcatgcatgtgtgcctctgtacctgtgtgttcgtgcaggtctctgtgtctatgccgtgtgtgcatctcacattatctttgtgattgtgtgaccacaaacatctgtgtaggtcccagattgtgaacacgggtatgtctgggagcctgcatcttgtagtaattggctatgtttgtgtctggatgtgctactgggggtgtgtgtgtgtgtgtgtgtgtgtgtgtgtgtatgcgagctcatgtgtgtggctgcctctgcatgtaagatgtgtgaacacacgcatgtgtgattgtagcatagtaaagccctcaaatctgggctctgctacttttatttatttatgttatgctacttttttttttttgagatggagtcttactctgtcttccaggctggagtgcagtggtgcgacctcggctcgctgcaacctccgcctcctgggttcaagcaattctctgcctcagcctccggagtagctgggattacaggcgcctgccacc

SEQ ID NO: 47345 - DNA, 601 bp, Human
tgggcagattacctgaggtcaggagttcgagaccagcctgggcaacatggtgaaaccctgtctatactaaaaatacaaaaattagctgggtgtggtggtgcttgcctgtaatcccacctactcgggaggctgaggcagaagaattgcttgaacccaggaggtggaggttgcagtgagccgagctcatgacactgcactccagcctgggcgatagagtgagacttggtctcaaaaataaacaaacagaaaaacaaaacacacacacacacacacacacacacacacacacacacacacacastgggaataataatactagcggcctcatagttgtcctaaaggttaaattagttaaaacatacaaagcacttagaaggtgcacacttgtgtgtgcacacagtaggcgctatggaagtgccaacaatgcctgttttcgctgggtgagtgccgttgtgggcccaaggttcctttttgccacgtctcccatcccacactgactcaacctctctcccttcttccctccccgccccatgagacacactttccgaatctgggccagtatgtgtgtttgtggagacaccgggagggagggggggctcca

SEQ ID NO: 47346 - DNA, 601 bp, Human
agtgccaacaatgcctgttttcgctgggtgagtgccgttgtgggcccaaggttcctttttgccacgtctcccatcccacactgactcaacctctctcccttcttccctccccgccccatgagacacactttccgaatctgggccagtatgtgtgtttgtggagacaccgggagggagggggggctccagttgctgtccctccagtgacttggcccttcctcccccaaaacaacggcccccaaccccatcccggtccctgcgttgcccgcaaggaggctgcttcctctcaggcaggatgggygcaagcaccagctccccggaggagcataggggcccatgggactcctcttctgtcgcctcttacctgtgtgtcttgagtaagtcccctaacttctctctctttttttttttttgagacggagtttcgctcttgttgcccaggctggagtgcagtggcaggaccttggctcactgcaacctccgcctcctgggttcaagtgattctcctgcctcagcctcccgaatagctgggattacaggtgcccaccaccacacccagctaatttttttgtatttttagtggagacggggtttcactatg

SEQ ID NO: 47347 - DNA, 601 bp, Human
tgtcttgagtaagtcccctaacttctctctctttttttttttttgagacggagtttcgctcttgttgcccaggctggagtgcagtggcaggaccttggctcactgcaacctccgcctcctgggttcaagtgattctcctgcctcagcctcccgaatagctgggattacaggtgcccaccaccacacccagctaatttttttgtatttttagtggagacggggtttcactatgttggtcaggctggtctcgaactcctgacctcaggtgatccacccgcctcagcctcccaaagtgctgggrttgcaggcgtgagccaccacgcctagctagtcccctaacttctctgtgcctcagtttcctcatctggaaaatggggtcagaacagtgcccacctcctggggttgttgtgaagagtcactgagtgagctctagctggagggcatgaagtcagtaaatcagggctagctccttgttctgccagttaactcttcgtcctccgggttcccactctgccttccctcctcctggaagtcctccttgacccccaggctgggggttgggtcaggcactggccctgggctcccacagctccctggatcc

SEQ ID NO: 47348 - DNA, 601 bp, Human
tgcaggcgtgagccaccacgcctagctagtcccctaacttctctgtgcctcagtttcctcatctggaaaatggggtcagaacagtgcccacctcctggggttgttgtgaagagtcactgagtgagctctagctggagggcatgaagtcagtaaatcagggctagctccttgttctgccagttaactcttcgtcctccgggttcccactctgccttccctcctcctggaagtcctccttgacccccaggctgggggttgggtcaggcactggccctgggctcccacagctccctggatcccyctgcccaccctgggctgaccactcaggggccaggtctgtgtccccagtgggctgagagatgtaaggacaaagctgaaactgcctcagcctccacacacacagcagggaccacagagggtgcttcccagtgggtgacatcaccatgacttgctgagtgcttaccgtacatccagcactgtttttaaaaaaacagtttcattgaggattaacgtacacgccataaaaactcaaccattatggccgggctcagtggctcatgcctgtaatctcagcactttgggaggctgaggtgggcggata

SEQ ID NO: 47349 - DNA, 601 bp, Human
ctcttcgtcctccgggttcccactctgccttccctcctcctggaagtcctccttgacccccaggctgggggttgggtcaggcactggccctgggctcccacagctccctggatccccctgcccaccctgggctgaccactcaggggccaggtctgtgtccccagtgggctgagagatgtaaggacaaagctgaaactgcctcagcctccacacacacagcagggaccacagagggtgcttcccagtgggtgacatcaccatgacttgctgagtgcttaccgtacatccagcactgtttttwaaaaaacagtttcattgaggattaacgtacacgccataaaaactcaaccattatggccgggctcagtggctcatgcctgtaatctcagcactttgggaggctgaggtgggcggataatgaggtcaagagatggagaccatcctggccaacatggtgaaaacccatctctactaaaaatacagaaattagctgggtgtggtggcacctgtaatcccagctactcgggaggctgaggcaggagaattgcttgaactcgagaggcagaggttgcagtgacctgagatcgcgccactgcactcc

SEQ ID NO: 47350 - DNA, 601 bp, Human
gcttcccagtgggtgacatcaccatgacttgctgagtgcttaccgtacatccagcactgtttttaaaaaaacagtttcattgaggattaacgtacacgccataaaaactcaaccattatggccgggctcagtggctcatgcctgtaatctcagcactttgggaggctgaggtgggcggataatgaggtcaagagatggagaccatcctggccaacatggtgaaaacccatctctactaaaaatacagaaattagctgggtgtggtggcacctgtaatcccagctactcgggaggctgaggsaggagaattgcttgaactcgagaggcagaggttgcagtgacctgagatcgcgccactgcactccaacctgggcgacagcgagactccgtctgaaaaaaaaaaaaaaaaaaaagctcaaccatttttttttttaaagagacaaggtcttgctctgtctgcaggctggagtgcaatgacgcaatcatggctcactgcagcctccaactgctgggctcaagtgatcctcttgcttcctcctcctgagtagctgagactacagatgcatgccaacatgtgtggataattttttattttattttt

SEQ ID NO: 47351 - DNA, 601 bp, Human
caatgccaggcattattttaagctctttatatatattagctcatttatattcttttaatcttcacaacagtctttttttttttttgagacagagtctcactctgtcgcccagactggagtgcagtgatgctatctcggctcactgcaacctctgcctcccaggctcaagcgattctcgtgcctcagccttctgaatatgtgggaccataggcatgagccaccaacaccgggctaatttttttgtatttttagggctaggctggtcttgaactcctggcctcaattgatctgcccacttcascctcccaaagtgctgggattacaggtttgagccatcacacctggcttcacaacagtcctatgatttgcattttacagaaaagaaaacacaagttcagagaggttaagctacttgcctaaggtcacacagtggatgggggcagaggagggactcaactccaggtcttccagacagctaagtcagggggtctcaatcgcttctctctgctctcctcagcattgcttgttggtgaataaatgagtgaagaagcaaaggtgagaatgagtggatgaaggagtgaatgaggaaatgaatggtgaa

SEQ ID NO: 47352 - DNA, 601 bp, Human
tatctcggctcactgcaacctctgcctcccaggctcaagcgattctcgtgcctcagccttctgaatatgtgggaccataggcatgagccaccaacaccgggctaatttttttgtatttttagggctaggctggtcttgaactcctggcctcaattgatctgcccacttcagcctcccaaagtgctgggattacaggtttgagccatcacacctggcttcacaacagtcctatgatttgcattttacagaaaagaaaacacaagttcagagaggttaagctacttgcctaaggtcacacagyggatgggggcagaggagggactcaactccaggtcttccagacagctaagtcagggggtctcaatcgcttctctctgctctcctcagcattgcttgttggtgaataaatgagtgaagaagcaaaggtgagaatgagtggatgaaggagtgaatgaggaaatgaatggtgaaaggaatgaatgaatgagcatgggaacccatggctgggatgggtgcttcataagagcaagaatcttgtctgtgtgttctctgcggtatcccaggctcccaggacagggcttggcacacatgagactctcag

SEQ ID NO: 47353 - DNA, 601 bp, Human
ctcccaggctcaagcgattctcgtgcctcagccttctgaatatgtgggaccataggcatgagccaccaacaccgggctaatttttttgtatttttagggctaggctggtcttgaactcctggcctcaattgatctgcccacttcagcctcccaaagtgctgggattacaggtttgagccatcacacctggcttcacaacagtcctatgatttgcattttacagaaaagaaaacacaagttcagagaggttaagctacttgcctaaggtcacacagtggatgggggcagaggagggactcamctccaggtcttccagacagctaagtcagggggtctcaatcgcttctctctgctctcctcagcattgcttgttggtgaataaatgagtgaagaagcaaaggtgagaatgagtggatgaaggagtgaatgaggaaatgaatggtgaaaggaatgaatgaatgagcatgggaacccatggctgggatgggtgcttcataagagcaagaatcttgtctgtgtgttctctgcggtatcccaggctcccaggacagggcttggcacacatgagactctcagtaagtattgctaaataaatgcaaaa

SEQ ID NO: 47354 - DNA, 601 bp, Human
gagacagaataagtaaacagacataaaataacaatgaaggctgggtgcggtggctcacgcctgtaatcccaacactttgggaggccgaggggggagcagatcacttgaggtcaggagttcgagaccagcctggtcaagatggtgaaactgcgtctctactaaaaatacaaaaattagccaggtgtggtggcgggcacctgtaatcccagctacttgggaggctgaggcatgagaatcacttgaacccgggaggcagaggttgcagtgagctgagattgtaccactgcactccagcctaggygacagaacgagactctgtctcaaaaaaaaaaaaaaaaaaaaagatgaatttattacatcttaggcgcttcacagcacccgtctcccatgactcttgtttgattgtggccacagattgtccccttctctcactcctttcctctgtcctcatctcccattcccttcccagcgtcccctgcacttcacgctggtggcctcagtcctgtgcacttgctgctccctcttcctggaaacctcttctgccttcttccccctcccacctggccatccacaaggctcactccctcctcacccctttcaa

SEQ ID NO: 47355 - DNA, 601 bp, Human
ataaaataacaatgaaggctgggtgcggtggctcacgcctgtaatcccaacactttgggaggccgaggggggagcagatcacttgaggtcaggagttcgagaccagcctggtcaagatggtgaaactgcgtctctactaaaaatacaaaaattagccaggtgtggtggcgggcacctgtaatcccagctacttgggaggctgaggcatgagaatcacttgaacccgggaggcagaggttgcagtgagctgagattgtaccactgcactccagcctaggtgacagaacgagactctgtctcaaaaaaaaaaaaaaaaaaaaagatgaatttattacatcttaggcgcttcacagcacccgtctcccatgactcttgtttgattgtggccacagattgtccccttctctcactcctttcctctgtcctcatctcccattcccttcccagcgtcccctgcacttcacgctggtggcctcagtcctgtgcacttgctgctccctcttcctggaaacctcttctgccttcttccccctcccacctggccatccacaaggctcactccctcctcacccctttcaagactctgctcaaatgctccctt

SEQ ID NO: 47356 - DNA, 601 bp, Human
ataacaatgaaggctgggtgcggtggctcacgcctgtaatcccaacactttgggaggccgaggggggagcagatcacttgaggtcaggagttcgagaccagcctggtcaagatggtgaaactgcgtctctactaaaaatacaaaaattagccaggtgtggtggcgggcacctgtaatcccagctacttgggaggctgaggcatgagaatcacttgaacccgggaggcagaggttgcagtgagctgagattgtaccactgcactccagcctaggtgacagaacgagactctgtctcaaaaawaaaaaaaaaaaaaaagatgaatttattacatcttaggcgcttcacagcacccgtctcccatgactcttgtttgattgtggccacagattgtccccttctctcactcctttcctctgtcctcatctcccattcccttcccagcgtcccctgcacttcacgctggtggcctcagtcctgtgcacttgctgctccctcttcctggaaacctcttctgccttcttccccctcccacctggccatccacaaggctcactccctcctcacccctttcaagactctgctcaaatgctcccttctcag

SEQ ID NO: 47357 - DNA, 601 bp, Human
ccctcctcacccctttcaagactctgctcaaatgctcccttctcaggaaggctgtccatgccctcctttgaatgaatataacttcccccatatgcgtccttctttaccctaaccctgttgtcctttcctttcctttcttctcctctcctctcctttctctctttctctgtttctctttctctctttctttctctttctctttctttttctttctttctttttttttttttttgagacagggtctccctctgttgcccaggctggagtgcagtggtgcgatatcagctcactgcaacctccrcctcccgggttcaagcgattctcctgcctcagcctcctgagtagctggggttacaggcgtgtgccaccacacccagctaattttttgtatttttagtggagacggggtttcaccatattggtcaggctggtctcgaactcccgacctcaggtgatccgcccgccttggcctcccaaagtgctgggattacaggcgtaagccaccacacccagccaatcagggctctttgaattccttcactgatttatccccagtgcccggaacagaattggtgctctgtaaatatttattgaatgaatg

SEQ ID NO: 47358 - DNA, 601 bp, Human
tttttctttctttctttttttttttttttgagacagggtctccctctgttgcccaggctggagtgcagtggtgcgatatcagctcactgcaacctccacctcccgggttcaagcgattctcctgcctcagcctcctgagtagctggggttacaggcgtgtgccaccacacccagctaattttttgtatttttagtggagacggggtttcaccatattggtcaggctggtctcgaactcccgacctcaggtgatccgcccgccttggcctcccaaagtgctgggattacaggcgtaagccaycacacccagccaatcagggctctttgaattccttcactgatttatccccagtgcccggaacagaattggtgctctgtaaatatttattgaatgaatgacattgaacaaacagttgcattgaacaaaatctcctctatgcctggcctggtgttgggtggtgcaggagacacaacagtgaccacgatggttccagtcctgtcctgctggggctcccagtcctaaataatgaaggcagttccagggctcagtcctcactggggctcctggagaggagacagatccatccccaggcaccgatga

SEQ ID NO: 47359 - DNA, 601 bp, Human
tctttctttctttttttttttttttgagacagggtctccctctgttgcccaggctggagtgcagtggtgcgatatcagctcactgcaacctccacctcccgggttcaagcgattctcctgcctcagcctcctgagtagctggggttacaggcgtgtgccaccacacccagctaattttttgtatttttagtggagacggggtttcaccatattggtcaggctggtctcgaactcccgacctcaggtgatccgcccgccttggcctcccaaagtgctgggattacaggcgtaagccaccacrcccagccaatcagggctctttgaattccttcactgatttatccccagtgcccggaacagaattggtgctctgtaaatatttattgaatgaatgacattgaacaaacagttgcattgaacaaaatctcctctatgcctggcctggtgttgggtggtgcaggagacacaacagtgaccacgatggttccagtcctgtcctgctggggctcccagtcctaaataatgaaggcagttccagggctcagtcctcactggggctcctggagaggagacagatccatccccaggcaccgatgaccca

SEQ ID NO: 47360 - DNA, 601 bp, Human
ctcctgagtagctggggttacaggcgtgtgccaccacacccagctaattttttgtatttttagtggagacggggtttcaccatattggtcaggctggtctcgaactcccgacctcaggtgatccgcccgccttggcctcccaaagtgctgggattacaggcgtaagccaccacacccagccaatcagggctctttgaattccttcactgatttatccccagtgcccggaacagaattggtgctctgtaaatatttattgaatgaatgacattgaacaaacagttgcattgaacaaaatctyctctatgcctggcctggtgttgggtggtgcaggagacacaacagtgaccacgatggttccagtcctgtcctgctggggctcccagtcctaaataatgaaggcagttccagggctcagtcctcactggggctcctggagaggagacagatccatccccaggcaccgatgacccagtgtggtcagagctggggcggggtagctggggcaggcagagagggcttctttggaggagagggcatctgaggggaaatgtcagtgttgaacccagtgtagacagtgtgctaactcaattagaggctg

SEQ ID NO: 47361 - DNA, 601 bp, Human
ctcatgctctcctccaaagataccaggccttcctggactctctgggaggaggcattcaccctcctcccagtgcctcagtttcccatctgtacgatggagggtgtggacgaatcctctggctctaagtcctttggctgaagtgatagctgttagaaggggagattttatgatgctgtgatacgtaaggccaagatcttgggagggtctgattctatagacgccaagatgccctgaaccttcagaccacattctctgcagtggcccagtgacattcattcagcagttgccgatcgcatgtggyactcctctaggctctggggatacagcagggaacacagataaattccttttctcatagaattactttttagtggggaagcaaacattaaacaaatcaatggttatgaagaaaaatgaagcggaggaaagaggggctggcgagggactattttagagcgctctgaaggagaggaaggggtaagaggaaggggtgagccgagtggcgatcgggtggaagagcagtccatgcagtgagaacagcatgtgcaaaggccctggggcagccatgcacttgatgtgtttgaactgagagcctaacggg

SEQ ID NO: 47362 - DNA, 601 bp, Human
cctgggcaacagagtgagactccctttcaaaaagaaaaaaaaagtgatttctagagccggacggggtggctcccgcctgtcatcccagcactttgggaggccgaggcgggtggatctcttgaggtcaggggttcgagaccagtctggccaacatggtgaaagccagtctctactaaacatacaaaaattgaccaggcatggtggcacgtgcctgtaatcccagctactcgggaggccagggcaggaggattgcttgaacccggaggtggaggttgcagtgagacaaggttgcgccactgtmctccagcctgggtgacagagtgagtgagactccgtctcaaaataaataaataaataaaaataaaatttctagatttctggcctcaactgggaaggcagggctggggatgcccttttcagagatgggcacagctgagggcgacacagctctgagggctaggctcaaattccacttagggcatcctggtatggagctatccaggaatgttgacagggcaattagctctgagtcctgagctggagggagaggcttaggctggtatgcagattcgggagtggacctcttggaggggtgtttaaa

SEQ ID NO: 47363 - DNA, 601 bp, Human
ttctggcctcaactgggaaggcagggctggggatgcccttttcagagatgggcacagctgagggcgacacagctctgagggctaggctcaaattccacttagggcatcctggtatggagctatccaggaatgttgacagggcaattagctctgagtcctgagctggagggagaggcttaggctggtatgcagattcgggagtggacctcttggaggggtgtttaaaactgggagggactcagctcacttagttagcagagaggaggagcccagggtgagccccagcaggaggaggccatgrggctcacagtgtggcacctccgcctgcagcacctgtaacttgtcagaaatgcaaattcccatctgggcagtggctcttgcctgtaatcccagctacttgagaggctgaggcgggaggatcccttgagcccaggaatttgaggctgcagtaagttatgatcgcaccactgcactcctggctgggtgatagagcgagaccctgtctccaaaaaaaaaagaaaaaaaagcaggccaggcgcggtggctcatgcctgtaatcccagcactttgggaggccacggcgggtggatcacctgagatt

SEQ ID NO: 47364 - DNA, 601 bp, Human
aaaagaaaaaaaagcaggccaggcgcggtggctcatgcctgtaatcccagcactttgggaggccacggcgggtggatcacctgagattaggagttcaagaccagcctggccaacatggagaaaccccgtttctattaaaaatacaaaaaaattagccgggtgtggtggcgcatgcctgttaatcccaactacttgggaggctgaggcagaagaattgcttgaacccaggagttggaggttgcagcgagctgattgcaccactgcactccagcctgggcaacagagcgagactctgtctcgaaaaaaaaaaaagactgggcacggtggctcacacctgtaatcccagcactttgggaggccaaggtgggcagatcacgaggtcaggagtttgagaccagcctgaccagcatggtgaaaccccatctttactaaaaatacaaaaattagctgggcatagtggcgcatgcctgtaatcccagctactcaggagcctgagacaggagaattgcttgaagccgggaggcggaggttgcagtgagccgagattgtgctactgcactccagcctcggtgacagagcgagactccgtctcaaagaaaaa

SEQ ID NO: 47365 - DNA, 601 bp, Human
gggcaacagagcgagactctgtctcgaaaaaaaaaaaagactgggcacggtggctcacacctgtaatcccagcactttgggaggccaaggtgggcagatcacgaggtcaggagtttgagaccagcctgaccagcatggtgaaaccccatctttactaaaaatacaaaaattagctgggcatagtggcgcatgcctgtaatcccagctactcaggagcctgagacaggagaattgcttgaagccgggaggcggaggttgcagtgagccgagattgtgctactgcactccagcctcggtgacrgagcgagactccgtctcaaagaaaaaaaaagagagagagagagagaaaaagaaataaaagaaatacaaattctcatgccccagcccagaccaagtaaatcagaatctctgggagtggggcctgcagcctgtgttttaacaagctccctggtggaccctgatgcaggctgaggtgagaacccttcccacaggttcacgcttacatcatcagctacctgaagaaggagatgccctctgtgtttgggaaggagaacaagaagaagcagctgatcctcaaactgcccgtcatctttgcgaagat

SEQ ID NO: 47366 - DNA, 601 bp, Human
agcctgaccagcatggtgaaaccccatctttactaaaaatacaaaaattagctgggcatagtggcgcatgcctgtaatcccagctactcaggagcctgagacaggagaattgcttgaagccgggaggcggaggttgcagtgagccgagattgtgctactgcactccagcctcggtgacagagcgagactccgtctcaaagaaaaaaaaagagagagagagagagaaaaagaaataaaagaaatacaaattctcatgccccagcccagaccaagtaaatcagaatctctgggagtggggcckgcagcctgtgttttaacaagctccctggtggaccctgatgcaggctgaggtgagaacccttcccacaggttcacgcttacatcatcagctacctgaagaaggagatgccctctgtgtttgggaaggagaacaagaagaagcagctgatcctcaaactgcccgtcatctttgcgaagattcagctggaacatcacatctcccctggggactttcctgattgccagaaaatgcaggtgggaagctgcccaggagggaatgttgggggtgggtgatgggaaggttggtttctggaagctctga

SEQ ID NO: 47367 - DNA, 601 bp, Human
atagttccgtgggagcatggttttatgagtcaggctaggggagtgaagagaaaacccaaaataacagtggctaaattaagatagagagtttttctttctttcctccataaaaagtcccagaaagtgatccaggactggtttggtgctttacagagccagggatctagtccccttctgtcttatttctcttccatgcctggcctccaggcccaaggaacttcatggtacaaaagggctgtgaaggctccagccattgtgtctgcgttccagccagcaagaagttgggaagggggccaggcayggtggctcacgcctgtaatcccagcactttgggaggccgaggcgggcggatcacgaggtcagcagatcaagaccatcctggctaacacggtgaaaccccgtctctactaaaaatacaaaaaattagctgggtgtggtggtgggcgcctgtagtcccagctactcgggaggctgaggcaggagaatggtgtgaacccgggaggcggagcttgcactgagccaagatagcgccactttactccggcctaggcaaaaagagcgagactccgcctcaaaaaaaaaaaaaaaagaaaaggaagtt

SEQ ID NO: 47368 - DNA, 601 bp, Human
acagtggctaaattaagatagagagtttttctttctttcctccataaaaagtcccagaaagtgatccaggactggtttggtgctttacagagccagggatctagtccccttctgtcttatttctcttccatgcctggcctccaggcccaaggaacttcatggtacaaaagggctgtgaaggctccagccattgtgtctgcgttccagccagcaagaagttgggaagggggccaggcatggtggctcacgcctgtaatcccagcactttgggaggccgaggcgggcggatcacgaggtcagsagatcaagaccatcctggctaacacggtgaaaccccgtctctactaaaaatacaaaaaattagctgggtgtggtggtgggcgcctgtagtcccagctactcgggaggctgaggcaggagaatggtgtgaacccgggaggcggagcttgcactgagccaagatagcgccactttactccggcctaggcaaaaagagcgagactccgcctcaaaaaaaaaaaaaaaagaaaaggaagttgggaaggggaagaaaagagtagtctctttaagaacactgtttattttattttcatttatttat

SEQ ID NO: 47369 - DNA, 601 bp, Human
gctaaattaagatagagagtttttctttctttcctccataaaaagtcccagaaagtgatccaggactggtttggtgctttacagagccagggatctagtccccttctgtcttatttctcttccatgcctggcctccaggcccaaggaacttcatggtacaaaagggctgtgaaggctccagccattgtgtctgcgttccagccagcaagaagttgggaagggggccaggcatggtggctcacgcctgtaatcccagcactttgggaggccgaggcgggcggatcacgaggtcagcagatcragaccatcctggctaacacggtgaaaccccgtctctactaaaaatacaaaaaattagctgggtgtggtggtgggcgcctgtagtcccagctactcgggaggctgaggcaggagaatggtgtgaacccgggaggcggagcttgcactgagccaagatagcgccactttactccggcctaggcaaaaagagcgagactccgcctcaaaaaaaaaaaaaaaagaaaaggaagttgggaaggggaagaaaagagtagtctctttaagaacactgtttattttattttcatttatttatttgaga

SEQ ID NO: 47370 - DNA, 601 bp, Human
cactgtccagtatggtagccactagccacattcaaatggaatgttaacgtgtatttcttttttctttttttttgagatggagtcttgctctgttgcccaggttggaatgcagtggcaagatcttgactcactacaacctctgcctcccgggttcaagcaattatcctgcctcagcctcccaagtagctgagattacaggcatccgccaccacgcccagctaattttgtatttttggtagagatggggtttcaccatgttgtccaggctggtctcaaactcctgacttcaggtgatcctccygccttagcctcccaaagtgctgggattgcaggcatgagccactgcgcccggcctgtatttcattttaattaatgtaaataagcacatgtggctagtggctgccatactggacaggctaacagtagaagctgcacatgcaacctgtgcttgcctcagtggacttgaacttagtcatactctggctgccagggaatccaggttgcaacctaggatccccaacccttcagagtcgtgatcagctggcctctctgccttggctcaggaaattcacatagggctgtgaaaggaatccattttcgc

SEQ ID NO: 47371 - DNA, 601 bp, Human
caagtagctgagattacaggcatccgccaccacgcccagctaattttgtatttttggtagagatggggtttcaccatgttgtccaggctggtctcaaactcctgacttcaggtgatcctcctgccttagcctcccaaagtgctgggattgcaggcatgagccactgcgcccggcctgtatttcattttaattaatgtaaataagcacatgtggctagtggctgccatactggacaggctaacagtagaagctgcacatgcaacctgtgcttgcctcagtggacttgaacttagtcatactytggctgccagggaatccaggttgcaacctaggatccccaacccttcagagtcgtgatcagctggcctctctgccttggctcaggaaattcacatagggctgtgaaaggaatccattttcgcagagactgtcctggtgcagtctgggccacttagagtagcccgtgtgagaagcagtgtgacgccaagcccacccctacaccccaaagtgacttcttcggtggggagggggtggtcccaggaacccctgatgatctgatcatctcaaatctcacctccaaatttggcagccagccactcag

SEQ ID NO: 47372 - DNA, 601 bp, Human
aattaatgtaaataagcacatgtggctagtggctgccatactggacaggctaacagtagaagctgcacatgcaacctgtgcttgcctcagtggacttgaacttagtcatactctggctgccagggaatccaggttgcaacctaggatccccaacccttcagagtcgtgatcagctggcctctctgccttggctcaggaaattcacatagggctgtgaaaggaatccattttcgcagagactgtcctggtgcagtctgggccacttagagtagcccgtgtgagaagcagtgtgacgccaagyccacccctacaccccaaagtgacttcttcggtggggagggggtggtcccaggaacccctgatgatctgatcatctcaaatctcacctccaaatttggcagccagccactcagtcctttctgtgtggtgtggtagcactgtgacaggaattaagctttcttaactttcttttttctctccccccctgcacacttttttgttttgagacagggtcttgctctgtcacccaggctggagtacagtgtggtgctatcttcgctcactgcaacctctgtctcctggggttcaagagattctgtct

SEQ ID NO: 47373 - DNA, 601 bp, Human
taatcccagctacttgggagtctgagccaggagaatcgcttgaacccatgagacggaggttgcggtgagctgagatcgcgccattgcactccagcctgggtgacagagcgaaactcgtcaaaaaaaaaaaaaaaaaaaggaaagaaaagaaaagaaatagggttttgccatgttgtccaggctggtcttgcactcctgggctcaagtgattctcccacctcagcctcccaaagtgctgggattacaagtgtgagccacccaagcctgctgagtttttttttttttaacttttaatgttgtrcgtgctggctgggcagctggagttgggtagagggcggttagggttctaggctggtgtggatgctctgagaaagctatacttgatgcgaaaatattgaaatccttctctgctagctggcaaagggccgctgctctcactcatcagaggggccccagcctccccaccctccagtaattctggggcacaggagaaagcctctgggaccttgttgcccaagtatcttctcattggtgggtgcccgagcggaacaggttgttcagatgttcaaatacttctgcatgtgtcagtaaagagctgcca

SEQ ID NO: 47374 - DNA, 601 bp, Human
aattctggggcacaggagaaagcctctgggaccttgttgcccaagtatcttctcattggtgggtgcccgagcggaacaggttgttcagatgttcaaatacttctgcatgtgtcagtaaagagctgccactctggctgggtacagtggctcacacctgcaatcccagcactttaggaggttgcggtgggaggatggcttgagctcaggagttcgagaccagcctgggcaacatagcaagacttggtctctacaaaaaatttttaaaactagttgggcgtagtggcgcacacctatagtcccrgcgaattgcgggggctgaggagggaggatcacaaaaatttagctgggtgggtggtgtgtgcctgtggtcccagctacttgggagactgaggccagaggatcgtttgaggctgggagttggaagctgcagtgagctatgttggcaccactgcactctagcctaagtgacagagcgagaccctgtcaaaaaaaaacaaaacaaaacaaaacaaaaatggctgggcgcggtggctcatgcctgtaatcccagcattgggaggctgaggcgggcgaatcatgaggtcaggagttcgagaccagc

SEQ ID NO: 47375 - DNA, 601 bp, Human
cctgtaatcccagcattgggaggctgaggcgggcgaatcatgaggtcaggagttcgagaccagcctggccaacatggtgaaacgctgtctctattaaaattacaaaaattagctgggcatggtggcgcatgcctgtaatcccagctacttgggaggctgaggcaggagaatcgcttgaaaccggaaggcggacgttgcagtgagccgagattgtgccatttgcactccagcctgggcaacaagagcaagactctgtctcaaaacaaacaacagtaaaaaaaccccacaacagctaccccctgagcttctccagtgtcctgataccaccttgcagcctgagggcctcagggatggcgccgcttgaattctgggtgcccctgtcccccaccacaggagctgctgatggcgcacgacttcaccaagtttcactcgctgaagccgaagctgctagaggcactggacgagatgctgacgcacgacatcgccaagctcatgcccctgctgcggcaggaggagctggagagcaccgaggtgggcgtgcaggggggcgcttttgagggcacccacatgggcccgtttgtggagcggggacctgacgagg

SEQ ID NO: 47376 - DNA, 601 bp, Human
tgggaggctgaggcaggagaatcgcttgaaaccggaaggcggacgttgcagtgagccgagattgtgccatttgcactccagcctgggcaacaagagcaagactctgtctcaaaacaaacaacagtaaaaaaaccccacaacagctaccccctgagcttctccagtgtcctgataccaccttgcagcctgagggcctcagggatggcgccgcttgaattctgggtgcccctgtcccccaccacaggagctgctgatggcgcacgacttcaccaagtttcactcgctgaagccgaagctgctrgaggcactggacgagatgctgacgcacgacatcgccaagctcatgcccctgctgcggcaggaggagctggagagcaccgaggtgggcgtgcaggggggcgcttttgagggcacccacatgggcccgtttgtggagcggggacctgacgaggccatggaggacggcgaggagggctcggacgacgaggccgagtgggtggtgaccaaggacaagtccaaatacgacgagatcttctacaacctggcgcctgccgacggcaagctgagcggctccaaggccaagacctggatggtggggacc

SEQ ID NO: 47377 - DNA, 601 bp, Human
ccgcctcaggccatgtcaccttattgcaggttcctctccgtcccctcggcccgagctctgcgtgccctaacccgccacctccgagcgtgactccttcgtcctctcagcctaggtcccggccgacccctcagcccggttctcacccaaagaggccagagaagaaggactgcgagttcttcactttgcgctccgcctcggccaacagcgccatcgcctccgcttccttcccggaattgtccatggcggccacaaagggactcagcaaagcgcctgaccctgaccctgggaagactcagccgckgccgggccgcggaacacagatcggtaaaactcgcccggctgcgttgacgtcgcaccggcgcgcgtcgcttgcggccaggaaccacgtgactagcgctggccaaccagcggcctcgtaacgccgcgcccgctccgccggacacgcccccaccagccgccgcacgccgcccgtgactcgtgaccccccaatcggcgtcaagagacctcaacgcatgcgcacataccggcgaacggcgctccactctctccccagcgctctgtacctcacctcccacgtgaccctgtggaaggcaatggcagt

SEQ ID NO: 47378 - DNA, 601 bp, Human
tgagagccttcaaacagactcccctagagctccgaaaagcctctggacctggcttctctcccggactccctccgtccccccaggccggtcccctccaaggcttcaggacgtactccctcggtccaggttctcccccgcccgctggcctgtcttcggcctgggtccccttcctcgcctcaagatagtgtcgcctcggtccgtgtgtcctcagcccaaatcccttccgccatgtcagaccgtctctcctcaaaccgtgttgccccggcccaggctcttggccctcagcctgcgtcccctctgycgcctcaggccatgtcaccttattgcaggttcctctccgtcccctcggcccgagctctgcgtgccctaacccgccacctccgagcgtgactccttcgtcctctcagcctaggtcccggccgacccctcagcccggttctcacccaaagaggccagagaagaaggactgcgagttcttcactttgcgctccgcctcggccaacagcgccatcgcctccgcttccttcccggaattgtccatggcggccacaaagggactcagcaaagcgcctgaccctgaccctgggaagactcagccgcg

SEQ ID NO: 47379 - DNA, 601 bp, Human
tatccaacctcaaacaaggggcgtggcctagagcccttttcctgttccttcctctcttgtaaagatccctctccttcgtgtcttaccagcctctgccaggctcctaccacagtctcttcccatccccaggccctcctcccaaacccccttctccagccttctgcagatgttcccagtcccaccaccgtccccaggctctgcttctgagtggccaccacacactgttctctctacaagcccactagtcctttcccaggtctcctctcagtttccacaacctccccttgaccctttcgggtcrtcccatcagcacagatcccaccacctcccacaccaccgccccctgccaaactcccttctccttcctctgcccagagcctcatgctcctctcaaccctactaagtcttcgtggatcccttttctgttccctttcagctcctcttagcacactcatgtttctcagtctctccctctcctgacccctcccagacctctccgctcgggcgtccaccttgaacccccatcagctctctgcacgctccgaacctgtttccttctggaagtcacattaacaacagctaacactctcagagatgtaac

SEQ ID NO: 47380 - DNA, 601 bp, Human
gtagttaggaagtctccgtctttttgcttccagagcagaagtttgagctgcgcccccatcaccaaggggaggaacaggtatggctttgagcttctcctaactggctggtgctgtcgccttcagtggctgctggtgcatcaaagccccctagcgtctggcagcccagaaataatgaagagcaagggtggcatctgagcaccaaggcaggcgacagcacagacacccatcgccttgcgtcccaggtgcgggctctctgacttgccctttgacaggggcagaggcccctcaatgtgggatgctgtcattgctggggttcccaaaggggaagggagaggcaccaaggacaagctgagccgcaacgctcccttctccagtcccggcagctaccaaggaccttgaataaaggtgggttatgaaatgttgaacacaagcaaacccagatcagagaggaggaggtgcctgagtgattcccgcccgccaagcaggtcctcccaagctggcctctggctgtgctcccagctcccaggcacacaagctccggtcaggccagcctcccatcctccctgccctctgccctaacctcactcatactcccacagca

SEQ ID NO: 47381 - DNA, 601 bp, Human
gttctcaaagacccttgcctctcagtagccccatcccaaaaaggagacggaaatgtttgtatggccaggcagcaaagtcctatccatcaggaaagccaggaactctcggattccccagaaaccttgtgtgccctcaggaaagactccactctgagactgggcaagagatgccaagttttcagttgtggatcttggcagctggcagggcactgtgattcaccagggtgcccactggaaatggcgccggggtttctgcacgctctgcagaggaaggcggtctggagagaaatctggaagctcrtgcccacaccagtctcagccaaggccctgggcaggccctgtacagacaagctggccctcccagggtcccgccgttattgcctacaggtagttcaaacaggaactgatttgtcaagatctgatcttaggaatgcactgtttgtatacagaacaccctctgccacctatttctccagcacttctagctcaacttccaatgacaatacctactaataaagatgacagtgagcccttaataaacattagcagagccaggcaacgtgctcccaccacttcccacacatcgtctcatttatcctta

SEQ ID NO: 47382 - DNA, 601 bp, Human
ttatgtgtaactaggcataagactccacaccttgcagggctgctgaagcacgagcaatcttgcaggcagcaccccacggcgtgcccagcagagagctggccacaccacgggcgttcagtaaacgagagcatccctctcatcaggccccgcagaggaccgattccaggcacgcttccctacttcagaatagcagcatgggcttcatctccatcccagattagctaagtaatgctcctccttcggcttccagagtcctggcctcccatgccccaccccttactgcacaatgctcaaaatacayacaggcccacggcccttcgagatgagctcagagccaggatctcacctgccacacggcacacagcctggcaggcgccctgtttcttattttcttatacggatgccctcctgcaccccaacgggattacatttcaccacagaccaagggcgaatgtacttcctttttcttaaaaggtgttctcaaagacccttgcctctcagtagccccatcccaaaaaggagacggaaatgtttgtatggccaggcagcaaagtcctatccatcaggaaagccaggaactctcggattccccagaaacctt

SEQ ID NO: 47383 - DNA, 601 bp, Human
acacaaaggaagagaaatacgctcaaaggggtgcctgccacccaggaatgggaattctagagagtttcttgtggtggtaaaaataaaataaaataaaataaaataaaataaaataaaataaaataaaataaataaaataaaataaaataaaataaatgctgacagtagtcagacaggcctggcctcagcgccagctcatcgtgtgccagcctgcgtttccttatgtgtaactaggcataagactccacaccttgcagggctgctgaagcacgagcaatcttgcaggcagcaccccacggcrtgcccagcagagagctggccacaccacgggcgttcagtaaacgagagcatccctctcatcaggccccgcagaggaccgattccaggcacgcttccctacttcagaatagcagcatgggcttcatctccatcccagattagctaagtaatgctcctccttcggcttccagagtcctggcctcccatgccccaccccttactgcacaatgctcaaaatacatacaggcccacggcccttcgagatgagctcagagccaggatctcacctgccacacggcacacagcctggcaggcgccctgt

SEQ ID NO: 47384 - DNA, 601 bp, Human
tgccctccagcctgggcaacagaacaagaccctgtctctcaaaaaatgaaaaatgaaataaaatggagacaatgaatctggcctgggaggagtctttgtgaggattagaaatgacacatagtcaatacttggcacagagcgcagaatggaaaaggtgctcaatggttgctattacacaaaggaagagaaatacgctcaaaggggtgcctgccacccaggaatgggaattctagagagtttcttgtggtggtaaaaataaaataaaataaaataaaataaaataaaataaaataaaataaaataaataaaataaaataaaataaaataaatgctgacagtagtcagacaggcctggcctcagcgccagctcatcgtgtgccagcctgcgtttccttatgtgtaactaggcataagactccacaccttgcagggctgctgaagcacgagcaatcttgcaggcagcaccccacggcgtgcccagcagagagctggccacaccacgggcgttcagtaaacgagagcatccctctcatcaggccccgcagaggaccgattccaggcacgcttccctacttcagaatagcagcatgggcttcatctc

SEQ ID NO: 47385 - DNA, 601 bp, Human
caactctactaaaaattagccaggcatggtggcatatgcctacagtcccagctacttgggaagctgaggtgagaggatcacttgagcccaggaggttgagactgcaatgagctatgatcgcgccactgccctccagcctgggcaacagaacaagaccctgtctctcaaaaaatgaaaaatgaaataaaatggagacaatgaatctggcctgggaggagtctttgtgaggattagaaatgacacatagtcaatacttggcacagagcgcagaatggaaaaggtgctcaatggttgctattayacaaaggaagagaaatacgctcaaaggggtgcctgccacccaggaatgggaattctagagagtttcttgtggtggtaaaaataaaataaaataaaataaaataaaataaaataaaataaaataaaataaataaaataaaataaaataaaataaatgctgacagtagtcagacaggcctggcctcagcgccagctcatcgtgtgccagcctgcgtttccttatgtgtaactaggcataagactccacaccttgcagggctgctgaagcacgagcaatcttgcaggcagcaccccacggcgt

SEQ ID NO: 47386 - DNA, 601 bp, Human
aggagggaggacaaggtccctgcctgcccccacccctcctctagattaaagaagccagggagcctgtactgcctaggcttccctcatctcacgagcagaggctgctctctgctggagctgcgtggagcatcctctaggcaaaggagtatgaattaagccagccccctaccgagcctgccagtaacaagccaacaggcagaaggaacgtcagaaaaagttaaggctgcctgtggtgcagggtccaccctggcacagggagccgggggccaccagccctgctagtccactgactgcactggarctgggagctgccagaggctcagcatcctgaaggcaccgccaccagtatcacctggaagcgggaaaccaccagctgcctcccgccactctgcagtgggccttgcctgaccaagcagagtatgagttcctgcagggcggggcctgagcccagctctgctttcccatctctccacaagccccagttaacaacggtgaaagaataaagtgtcacaggctaactgcccagctctgaaatcgccacaggaccctcttgtgacatgcctgtctgggcaaagacaaggggtagaaagagaatgacttt

SEQ ID NO: 47387 - DNA, 601 bp, Human
gagtctcaggtctcccaaacacagccaccaacctcagggactgccatatggaaggctgggcactgccaggaatacacagatgcctgatgggacctgggccagggggttgtgcagggcagagtcttagccccctccttccttcctccatccaccaggcacttcctggctgccagaaatacaccatgccctgagacccaccacctgcagctcccgaaggacctcacgaggcagggtggacaaagtcaggcccccatttcgggtcctggactcactctatctctcttgcctctgtggaagccayagccacaggcctacggtttcctcctcagacttaaggcccactgccccaagtctccagtcagcaccctcagtggggaaggtgtcctagggcccgtcacatgcctgtgtcttccctgtaagcccacctcctgcacggctctcgagaccatgtgccttaatcacggctggcgcatggcgttccctgcctcccaggcactcccctggaaggagcccacagctcctcacgagagccctttgggtgctgcccttgctttacaggcgaggaagctggggctcagagagggcggagggcttgtccaag

SEQ ID NO: 47388 - DNA, 601 bp, Human
ccttctttttgagtgtgactaagtcctatccagctccatgcactctctgaaaaagcacagaccctggatgggcagaaatgacccacgtcactgagtggcccacagcgggcaatcaacaatgagcagagtcagcccagccgggtttatttcaggacggacacaaagcctaccagctgcccgggctgaaactctgtgatcccaggctaagcacagccaaccctgcacggggtcaatgattctgtggggtggaaaggccagagggattaacacctgctcaggccccaggcttgcctccttcttmccctgcaccccgcggtcttgcccattaccatggccaggggatgacaggagatctccagggtcccatcctcttcttttagaaatgggagtgaagtccccaaagggggaaagtgacgtgcctaggttccagtggaagatcctgaagaagccattcacatacacatttattcacctggggaacaggtatccgagcatttattacgtgccaggagataacaacagtacacgaaaggaaaatctagctgggcctcctctcctgagggcctgggtggcagcgcatgtgacagctgactgtccctcc

SEQ ID NO: 47389 - DNA, 601 bp, Human
acaaggatgttcagcatagcattatttaaaacagcaaaaccccccaaaaacttattgtccaacagtagggatacactgggagatagacaggaatttgaaaacataaagggtaccctgtttgggcagcttcactctggcttcttgacctccacatgtacataatgagcctcctcttgacttgggggacctcattagtacctcaaacccgtaagtcccactgcattcttctgcccttaataatacaaccaggcttagcccgcgaggtctgtagtctctgtaactgctcaaactcccaatatcyacataatcagtagaataaaatccacacactctggagtcccaccaaatggatttcagggcctctcttcactggcataactagtgtttagtttatttttaaggaagagaaaagggaggagtgggtactttcccattcaaatcatcctcaccatcccatcccacaccctgtgtcaactggcccaacattatacctgggaacttgtccacaccaaccccagctgtggaggggctcaaaggtaattttgggagctgggatgtgagcattccttccctctgcactgcggattcagtgtgtccaacc

SEQ ID NO: 47390 - DNA, 601 bp, Human
gtttgtacatcttttcgagaaaaaaaatatatacatatatacacacacgtgtacatatatacacatgtgtatatatgtgtatgtgtatatatgtgtgtatatatctatacatttacacatacacagacacacacacacacatatttttaagtattaggatttatatttggccctgtggtccagcaatgaattacatctctagcaatttatcctaaaaaaactaatcagaaaagttacaaggatgttcagcatagcattatttaaaacagcaaaaccccccaaaaacttattgtccaacagyagggatacactgggagatagacaggaatttgaaaacataaagggtaccctgtttgggcagcttcactctggcttcttgacctccacatgtacataatgagcctcctcttgacttgggggacctcattagtacctcaaacccgtaagtcccactgcattcttctgcccttaataatacaaccaggcttagcccgcgaggtctgtagtctctgtaactgctcaaactcccaatatctacataatcagtagaataaaatccacacactctggagtcccaccaaatggatttcagggcctctct

SEQ ID NO: 47391 - DNA, 601 bp, Human
tctcttaaggtgaagcctgcagaaggagggccaggtgtgggaggcagacttattcactggacatcccgtatttgtactgtctgaatttttttttaactgtttgtacatcttttcgagaaaaaaaatatatacatatatacacacacgtgtacatatatacacatgtgtatatatgtgtatgtgtatatatgtgtgtatatatctatacatttacacatacacagacacacacacacacatatttttaagtattaggatttatatttggccctgtggtccagcaatgaattacatctctagmaatttatcctaaaaaaactaatcagaaaagttacaaggatgttcagcatagcattatttaaaacagcaaaaccccccaaaaacttattgtccaacagtagggatacactgggagatagacaggaatttgaaaacataaagggtaccctgtttgggcagcttcactctggcttcttgacctccacatgtacataatgagcctcctcttgacttgggggacctcattagtacctcaaacccgtaagtcccactgcattcttctgcccttaataatacaaccaggcttagcccgcgaggtctg

SEQ ID NO: 47392 - DNA, 601 bp, Human
ggtggttcatggctcctgtaatcccaacactttgggaggccaaggttggcggattgcttgagctcaagagttcgagaccagcctgggccacacggcaaaaccccaactctacaaaaaatacaaaaaattagcagggtgtgatggtgcacgcctgtagtcctagctactagagaggctgatgtgggaggatcacttgagcctgggaggcagaggttgcagtaagccaagatcacaccattgaactccagcctggacgacgacagagccagaccttgtctcaaaaaaaaaaaaaaaaaaaaaagagaaagagagtgaaaataatagaaacatacatgtttatataaacataggatatttctgggcaaatacacaaaaacctagtaacagcatttttctcttaaggtgaagcctgcagaaggagggccaggtgtgggaggcagacttattcactggacatcccgtatttgtactgtctgaatttttttttaactgtttgtacatcttttcgagaaaaaaaatatatacatatatacacacacgtgtacatatatacacatgtgtatatatgtgtatgtgtatatatgtgtgtatatatctatac

SEQ ID NO: 47393 - DNA, 601 bp, Human
tcggctatccaggagaaagcaagcattctgctccagtgccgggcacagacgtgcccctacccctcacccttcacctgtgaagccagcttcccccaggcctcttgagtctgtggcccccgcccctgcatacaatggcacactcacttcgggcagaccagctccctccgggagtactggggtagatactgggtgcttgctggggtagtggggcgaagagttcctgaccccaccacaaccccagggtctgacagcctcttctacttcctgcctgggatactaggggcccactgggtcccaggcrcgctacaaatcccctttccccgggagactgcaaagcattctgggggactagcccagtttaagacatcgtgttgctttcgcagaggcagccttaatcctgtgccttgcactctgtggttgctcaataaagaccttgcagccctggagtgtgtcattaccagctcaggactgggcatatatatcacacagccatacaaagaaatgggaagcactattttaaagtgtagatataagatgttcccatttgtgtttaaaaaaaaaagagggtgggctgggtgtggtggttcatggctcctgtaat

SEQ ID NO: 47394 - DNA, 601 bp, Human
acatttggctttattcacaacgtattttgtgaaaactcaggaataactctttgaattttggggaaaccaacaacattctcaaaaacgatgataatcaattttattgtgcacctctgcaccctgcctccatggtcccaccaccaggttccctctcctccacagtcagaagttcctccctgcattcaaacactgggtctcttgccgtatttccttaattcaatcttggtgacatgaaagatgtatgatgaaatgagcctcgaaagggctcaacacactggcttgttggacttcttgggcctgyagggagctccaaacagatctccagcctccctgagcccaaggggctcctccccacccctctcctctgtgaagctatcctgcctcactggggcaggttaaacactcaggctctgcagtcagagccttggtttctgaatcttggttctgtcacttactagttctggcatcctgggcaagagactaagccaagcctcagtttccaaatctgtaaaatagggatatttatagactgacccttagggctgctgtgctaacgcaattaaatgatgagcacttaggactcaacaaacagcagccatga

SEQ ID NO: 47395 - DNA, 601 bp, Human
ggcgcggtggctcatgcctgtaatcccagcactttgggaggccgaggtgggcggatcacgagatcaggagatggagaccatcctggacaacatggtaaaactctgtctctactaaaaatacaaaaataagctgggcgtagtggcacgtgcctgtaatcccagctagtcaagaggctgaggcaggagaatcacttgaaccagggaggcggaggttgcagtgagccaagatcgcgccactgcactccagcctggcaacagagcaagactgtctcaaaaaaaaaaaaaaaaaaaaaaaaaaaawtttcaagaaaaggggatattaccggggggaaatggcctagggcttttctttgaagagtttgggggcagaggtaacaaattttaggggaaaagcaacacctatgtaattaaaaaataagctttttttctctagaggaattttctaagtttgggagcataaaaatacaaaaaacatttggctttattcacaacgtattttgtgaaaactcaggaataactctttgaattttggggaaaccaacaacattctcaaaaacgatgataatcaattttattgtgcacctctgcaccctgcctccat

SEQ ID NO: 47396 - DNA, 601 bp, Human
agaggcctcgctggcccgagtctgccctgagcagcagccatggttgggtaactgaggaaccaataacacatatgagcatcacccttccccacccagagccaccaaggtggcagcaggccaccctctgcgagagggagaggaattcgggagcccagtcgggcctcaggcacactccagctgccacttgggggcaggtccttctggagggagtcctggaggaagccctagaagtgctgacccaagacagaggccttctaggctgctgaggagaccagtgatgaggacggccccagggtaccggccacctgcttggggaagccaggcaaggttccaaatcgggcctccagcgctgtctcacaaggcacccggccaagggcagaggctgtggggagcccagggcaggcaggggcccctggactgatgaaagccaagggtgtcctgactggaagtttatcacacaccaggtgccgcgctgggcatgactgcatcatctcacagcagtctctgctttaacagacgaggaaacagaggcccaaaagactgacttgcccaggatcacaggggaggcagggtcctcccagaccacccaccacctgcgctg

SEQ ID NO: 47397 - DNA, 601 bp, Human
agcagcttctgctcctgcaccaggaggacctggacctctggcacgaggaggctggatgtcatcaacactgagccctcagtgtgctctccactgccccctcttcctcgtagctcagcagtcgggagccctctgctcagtccctttaacctagtcctgccacccaccagctcctcaaaggttttgccaaaaaacctgaacacaccaggatggcactgaggaagaactgggctacctttgttgtactatctcttgcaagattttaaatttgggaaaggcttttttttgacaagttatttggagragagagaaaagcatgagtgggaggcattttctagcagacagaaatgagctctcagggggtattttttaagaacaccattttagcacatctcaggaggacaggggtgttgtggggagggaggcctgggttggggagagggaaaggcagggagcttggacaggccacagggcatgggctctgagcttcagcctgggcatctgaaagttcctggtcaccgtgggggtctccatggtcacccaggccatgttcgcctgagaagagggtgctaccaagaagcgccggggctgggctcctctcaag

SEQ ID NO: 47398 - DNA, 601 bp, Human
gtagatctcgattgctcgcatcaaacagttaatggcctctggagagaaagggaggtgggaggagacatgagaaagtgaagtcgtttcagcagaagctgaggagaggaggcggacgcaggcgcacctggctgccagcagagagatcaataggcgctcagagctgccagcgctgccacacactctcaaggggctgggaagaaggggacggaatccctgagccccaggaaatctggtgagagggctgactctgcagactgtgacttgctgggcacatgcttctgggggagcccttctctcctcrggctgccaggatgctaccagcttcccacaaccccagggacagggcacagcagtgctaggccaggatgatggccagactcccacggtgttttaagacagacctgccaaggccctgctcttgaaggactgagctgctggcaaaggggaaggaggcatgggaggcggccaaaccagcatctgaggtggtcttggaggcaacagggtgccaggttctacctgggctctgccaccatctctgcaggatcctgagcagcttctgctcctgcaccaggaggacctggacctctggcacgaggaggct

SEQ ID NO: 47399 - DNA, 601 bp, Human
cggcaggcggtgggaacatgagaggcggcgcccgcccctctctcccagggggccagctgcctgcctttttctcggccatcacccagggctccgtgcacgctggggggaccccatgtgacactccctccctcccactgtggatgaggaccatcgggccatggggtggggtgcccacggccaccctgggcctcttggcacttcttcccattccctccctctgggttctttagccagcctcactctgggcccctccaggaagctctgcgaggggtgtgggaggggcacagccagggagagagayggtgctggcacggcatggagtcgtaggtggagaacattcagccaggctgaagacagggtggggggatgacatggcaagggatgtcgggggagaggcagagggtgagccgggggaggggtggttccagaacaaggtgccggggcttaggaggaggcacaggccctgagagggggcagggtggaagccgccatccccacctgtccccacctgttcgtagatgtcaatggccttctgatactgctccagcagcgcagcgtaaccagccaccttcagcagacacttgttggctgagctgtgtgg

SEQ ID NO: 47400 - DNA, 601 bp, Human
agatatggaaaaggccactcctgagtgccatgggacacgggggagagaagccacggcctgctgggcatcccctccctgagctcctggctgagttgccacccactgtctggggcaggaggaacaggatggcattttcactgtcctcagttaggggcttccattcccaaggggcacctagggagaaatgcttgacatgtgccattagaggagtgaatcaggacctgagccggacaccactaagcccgggaatgctgggaacagagaaagggaagggagagagagccgcgtgggcggctccaccaggcagagggaagctggcacctctcccatgtcctcagctccactctccttctcaccccttccctccccgtctgtgcctcctgggtgcccaaggcgcccactgtgagtctcacacactcacctgggggactcaaggaaccctggtcttcagaggcagacagatgtggctctgaacaccagctctgtccctgaggggccaaggccgagcctcctgacctccccaacctcagtgccaccatctataaaatggggagaacactccctgcgcctcttggcgctacttgtaaggtttctggggtga

SEQ ID NO: 47401 - DNA, 601 bp, Human
ggggacaaaagtgggagagagagagaaaccggcctcatgactcagctggtcaggagatagggggccagatgctgaccccaaatccccggcagcacccctagcaaataggtctgtatcaaagattctgtacagctggttttgggggtgaagggcacctatgggggcttaaataaatggacagggggcaagggatgtagcgagaacagagggtgactgtccggccagcagcctgggcctctggcgcccctgcatgctgacccccggtgccacctgcccactgtggcccgcgggactccccagrtgggaaaggagggaagctctccagcaagtctcggccccacctctctctgagcagatgggacaggaagacgggcactggggggctgggtggggcttagcgcaggtcctcctcatcgccctggatggtcttcttgatgcgcagcagcatggtggtgagccactggtccagccgggagatggagtcgtattccttcacctgagggcacaccaggtgataggctggccatgctccccccgttcccaaccctgcagcccaagggcacttgtcccaaggttttcaagatctgtctctgtcacccct

SEQ ID NO: 47402 - DNA, 601 bp, Human
tggagcccgatccaccgaggagagcaggaggcggccgtggaaaccgtcaataaaaattaacagaccgaccagaacacagcctcagttactgatcaacccgagccccgcccgacccgactctccctcctcgggacaccccggggggaaggtggatagaaagccggactgtccgaggccctcccttcagccccggccaggtcctgacccaacagtgagctccccacggcttctcccggccactgcaactcccggcgaggccctaagtgactcggagcgtccgtcggaagggcagcctccgggyctcctgcctcactccgggaggcgagtgcgcggcccccgagcccgcggtgctgggtccgagagcggggagccctcgtctcgccgtctgcaggacccacctgcccgcacgcatgctaaggggtccagacccactctagggctgcgcctcttctgacaccacagactgcacggaccacgtttaacagacttttaaaagtgactgaacccaagaaaaacttctcaggaaaacggaaagaatgcgaaacatctccagcctctcccgcttcctattcccagggagggcctcgcgcaggaagcgctc

SEQ ID NO: 47403 - DNA, 601 bp, Human
cctttggcgcccctccctcccagcaggaccccaggccccacctctggaccaggccccacacgttccaagacaaagacacccccatcggaagccccgaggaatgctagatgccgctgagagggttcaagggctgctgtgtgctttccagtaagttggaaacgcctcggagaggctgaaactggcaaactcacaggcctgggccagagcttccacccgggtaggggtgggcccccaagagggtgcctctcagcagagtggagcccgatccaccgaggagagcaggaggcggccgtggaaaccrtcaataaaaattaacagaccgaccagaacacagcctcagttactgatcaacccgagccccgcccgacccgactctccctcctcgggacaccccggggggaaggtggatagaaagccggactgtccgaggccctcccttcagccccggccaggtcctgacccaacagtgagctccccacggcttctcccggccactgcaactcccggcgaggccctaagtgactcggagcgtccgtcggaagggcagcctccgggcctcctgcctcactccgggaggcgagtgcgcggcccccgagcccgc

SEQ ID NO: 47404 - DNA, 601 bp, Human
ccagtgtcacggcggccctgaggttccggccggacacagatgaagccaaatactgaaaacagaccctcgagtcctctcgctttcagagtctggggccccctatgagcacaaggcggggctgcgcaggcccaggggaaaggggtcagagccagccgcctcaggtggaaaccacgcgatcagaaaacacagcagtgccaggaccggaggaagggaggacgggaggaagggaggatgggtgcacctgagacgcagggcctccaaccttcgcctcccacaggaagtcgcttcctgtctgctctcycctccagctcagaggctgggggagcccaggagccgaccccgtccaggacaccagggctggtcctcccccaagctggagagtggccaagcgcccatgcggctcccatgtgctggctgcacaaaccttaaaaagggcatcttggaccctgtctttgactggagtggtgggcggggccgcttcctctgagcggtcctcttggccgcctgcctgaagccctaatctcattcccatgggcaagtggcctggcattgcccacaactgtctgcggcagcaaactccatgcctgcccaggcggcacag

SEQ ID NO: 47405 - DNA, 601 bp, Human
ccaatcccacaagcactcagggcgtcaccaaacaagcaatcgagcagccacaagggccggaaccaggaatcactcagggtccacaggcccggcgcccacccaaatggcacctgttcagtccccaagactttagggtcagagaatgaacagtgtccagtgtcacggcggccctgaggttccggccggacacagatgaagccaaatactgaaaacagaccctcgagtcctctcgctttcagagtctggggccccctatgagcacaaggcggggctgcgcaggcccaggggaaaggggtcagarccagccgcctcaggtggaaaccacgcgatcagaaaacacagcagtgccaggaccggaggaagggaggacgggaggaagggaggatgggtgcacctgagacgcagggcctccaaccttcgcctcccacaggaagtcgcttcctgtctgctctcccctccagctcagaggctgggggagcccaggagccgaccccgtccaggacaccagggctggtcctcccccaagctggagagtggccaagcgcccatgcggctcccatgtgctggctgcacaaaccttaaaaagggcatcttggaccct

SEQ ID NO: 47406 - DNA, 601 bp, Human
ccaccggccggccctgctcccacttgggctgcctggggtcccagacccccaacccatacccacacccacacttccacggcagggcagcctgagcgcagacccagcccatggacgcgcacggcaccccacagctccacgaccaaaacactgctcctttttccaaattctggaagccctgggtactcagccagtgtggggctgggaggctctcagctacggagggcaccacgtacactatctccacggccaactctgctgtggacgtggcctcactgtgctgccggcggccctgggcacaggyctggggcctcagccaccagccagcagggcagaggaccccctccatggagccagcccccccagcagcacacggcagggcccaggcagccgtcctcacttctggtggcctcgcaagagaaccaaattatagcgctgcctccctcactctcgcaggagcccctcctctcctgttttccagcccggaaaagaaacccgacctccgtctctgcacacgcgagactgaggactagagacacggcctcccgcccagtgatccgctggtatcgcggccgtgactagggccgggggagctccacagcgg

SEQ ID NO: 47407 - DNA, 601 bp, Human
gtccgcatactgcagcagggcctggaactggttgttcttggtgaaggtgatgatcttcaacactgtgccgaacttggagaaaatctgcaggtcccgggccacagcatgagctcctgcccggtgcccaccagccctgccaggcccctcccgtgtgcctgtgcccacagcaatagcagccgacctgccctggcggtgatgggaccacctcacctggtgcagcacatccagggtcacagggtagaagaggttctccacgatgatcctgagcacggggctctgcccggccatcgccatccctgcrtccacggccgccgccgaggcagccaaggccaggttccccgactggaccgagttcaccgcctgcagggccgcctgggcccgctgtgggaggcacagccgtgagtccccggcccctgcggctgggcccacccccgaggtccccgggctgctggggtccgccgcggggccacgcaccgcctggttgggagagctgtcggtcttcagctccttgtggttggagaactggatgtagatgggctggccgcgcagcacaggggtcaccgaggtgtagtagttcaccatggtgttggcagcctcctcc

SEQ ID NO: 47408 - DNA, 601 bp, Human
cgccggggctccggactgagcggccctaatagaccactctgcacactggcgccgcgtcgggcagcctcttaccgaaggccgcggccatggtctggtccagcgagggctggctgtccccggaaggcaggtctgggcgtgtgtagtcacggctcttgtcattgttgtacttgacgttgaggctggtgagcttggaaaagtcgatgcgcagcgtgcagcaggcgttgtagatgttctgcccgtccagcgactgaggggagagggaccgtgagacgtcgccgggccagggccagggcgggcgccrtcccgggagccccactcaccagcttggcgtgctgggcgctcacggggtccgcatactgcagcagggcctggaactggttgttcttggtgaaggtgatgatcttcaacactgtgccgaacttggagaaaatctgcaggtcccgggccacagcatgagctcctgcccggtgcccaccagccctgccaggcccctcccgtgtgcctgtgcccacagcaatagcagccgacctgccctggcggtgatgggaccacctcacctggtgcagcacatccagggtcacagggtagaagaggttctcca

SEQ ID NO: 47409 - DNA, 601 bp, Human
ctcgagccacaggggctgcccacaccccgccgcgctaaccctgtgtgtcccgctgaccagcagggcggcctgctggggctctgaactgcgcgccctgctcagctccaagtaatttttagattgcctttgggtaaccaaaaaataattcattctgcgtatcatgcaagagaaaacgcgaaccaagatgtgaattcaggaaaagaggaaaactcaagccatcttggaaaaggagggtctcagcgctgcagcagaggggctgccagggcagaggcgcagacacagcgaggggcggcgctgctcmgggacccgagcccgagcacaacatcccctgctcgctcttccgggaggaacggcggcgcggaggaaaagcccacgtacctctgggttgaggttgctgaccagcaatacagaatttcctgcccccgccaggcccgggatggcgatccgacctgccgccgcagctgccgccgccgccgaggggatggccaggggggccagggcgccgtggacgttcggaacggaaaggcctggaaaagcaggaggtgagatgagcggcggcgcccccgactccaccgcagagtgggagaggccgacgctcccc

SEQ ID NO: 47410 - DNA, 601 bp, Human
ttctgggaaataacggatccaccagttaagtgacaggctctcgagccacaggggctgcccacaccccgccgcgctaaccctgtgtgtcccgctgaccagcagggcggcctgctggggctctgaactgcgcgccctgctcagctccaagtaatttttagattgcctttgggtaaccaaaaaataattcattctgcgtatcatgcaagagaaaacgcgaaccaagatgtgaattcaggaaaagaggaaaactcaagccatcttggaaaaggagggtctcagcgctgcagcagaggggctgccrgggcagaggcgcagacacagcgaggggcggcgctgctccgggacccgagcccgagcacaacatcccctgctcgctcttccgggaggaacggcggcgcggaggaaaagcccacgtacctctgggttgaggttgctgaccagcaatacagaatttcctgcccccgccaggcccgggatggcgatccgacctgccgccgcagctgccgccgccgccgaggggatggccaggggggccagggcgccgtggacgttcggaacggaaaggcctggaaaagcaggaggtgagatgagcggcggcgcc

SEQ ID NO: 47411 - DNA, 601 bp, Human
cccgaggggaatttaaccattctgggaaataacggatccaccagttaagtgacaggctctcgagccacaggggctgcccacaccccgccgcgctaaccctgtgtgtcccgctgaccagcagggcggcctgctggggctctgaactgcgcgccctgctcagctccaagtaatttttagattgcctttgggtaaccaaaaaataattcattctgcgtatcatgcaagagaaaacgcgaaccaagatgtgaattcaggaaaagaggaaaactcaagccatcttggaaaaggagggtctcagcgmtgcagcagaggggctgccagggcagaggcgcagacacagcgaggggcggcgctgctccgggacccgagcccgagcacaacatcccctgctcgctcttccgggaggaacggcggcgcggaggaaaagcccacgtacctctgggttgaggttgctgaccagcaatacagaatttcctgcccccgccaggcccgggatggcgatccgacctgccgccgcagctgccgccgccgccgaggggatggccaggggggccagggcgccgtggacgttcggaacggaaaggcctggaaaagcaggagg

SEQ ID NO: 47412 - DNA, 601 bp, Human
tggggtaagaggtgcccgacctgcactctggaaacgccagaagtccacacaccgacgcggtaggacagccaagcagagcccttgcccgcccccggccccatgagccccccggcccagcactcacgggatgttggagaggtgcagcgtggccgagggcgggaatatgttctggaagttcttggagcccggcttcttgaagcggtgcaggggtgagttgccgtagtccttggtcaggccctggtcctcctggccctcgcggggcagctgcacgttctggtgcttcgagagcgtgatgcggatsggcttcccgtgcagcttgtgcccgttcaggtggctcatggctgggggagcagcacccgcgtgaccaggcgcccgagagggaacgcagcccccgcccctgccccctccaccccggggccgccccggcctcttacccagctgggcctggttgccgtccgccatctgcactagggcgttctccttcttattgaacaggatcttcacgcgctgcacgtcaccgtagacgccttcaaaagcccagggatggggcctgagtctcctgctgcctgccccgcccatctccccgtcagccccggccccg

SEQ ID NO: 47413 - DNA, 601 bp, Human
gccaggccccttgttgattttctgataacatttcacaagtaacgtgttaaatatcaaagggcttactactggttgacatgcttggggccagatgtacctgcatttccaaatacttgcattatgtaatttttacagacagggtcttactctgccgcccagcctggagtctggcagtgcaatcacagctcactgcaacctcaacctcctgagcgcgaagtgaacctcccacctcaacctcccaatccggaagagctgggacctgacgtgcacaccaccactcctagctaattttaaccaattkttcctgtagagacagaggtctcactttattgctcaggctggtcttaactcttgggttcaagcaatcccctgcccggccccccacagtactgggattataaaggtgtgcattaggccaggcgtggtggctcccacctgttatcccagcactttgggaggccgaggcgggttgatcacaaagtcaggagatcgacaccatcctggctaacacagtgaaaccccgtttccactaaaaatacaaaaaattagccgggcgtgctggcgggcacctatagtccctcccagctactcgggaggctga

SEQ ID NO: 47414 - DNA, 601 bp, Human; identical to SEQ ID NO: 47402

SEQ ID NO: 47415 - DNA, 601 bp, Human; identical to SEQ ID NO: 47403

SEQ ID NO: 47416 - DNA, 601 bp, Human; identical to SEQ ID NO: 47404

SEQ ID NO: 47417 - DNA, 601 bp, Human; identical to SEQ ID NO: 47405

SEQ ID NO: 47418 - DNA, 601 bp, Human; identical to SEQ ID NO: 47406

SEQ ID NO: 47419 - DNA, 601 bp, Human; identical to SEQ ID NO: 47407

SEQ ID NO: 47420 - DNA, 601 bp, Human; identical to SEQ ID NO: 47408

SEQ ID NO: 47421 - DNA, 601 bp, Human; identical to SEQ ID NO: 47409

SEQ ID NO: 47422 - DNA, 601 bp, Human; identical to SEQ ID NO: 47410

SEQ ID NO: 47423 - DNA, 601 bp, Human; identical to SEQ ID NO: 47411

SEQ ID NO: 47424 - DNA, 601 bp, Human; identical to SEQ ID NO: 47412

SEQ ID NO: 47425 - DNA, 601 bp, Human; identical to SEQ ID NO: 47413

SEQ ID NO: 47426 - DNA, 601 bp, Human; identical to SEQ ID NO: 47402

SEQ ID NO: 47427 - DNA, 601 bp, Human; identical to SEQ ID NO: 47403

SEQ ID NO: 47428 - DNA, 601 bp, Human; identical to SEQ ID NO: 47404

SEQ ID NO: 47429 - DNA, 601 bp, Human; identical to SEQ ID NO: 47405

SEQ ID NO: 47430 - DNA, 601 bp, Human; identical to SEQ ID NO: 47406

SEQ ID NO: 47431 - DNA, 601 bp, Human; identical to SEQ ID NO: 47407

SEQ ID NO: 47432 - DNA, 601 bp, Human; identical to SEQ ID NO: 47408

SEQ ID NO: 47433 - DNA, 601 bp, Human; identical to SEQ ID NO: 47409

SEQ ID NO: 47434 - DNA, 601 bp, Human; identical to SEQ ID NO: 47410

SEQ ID NO: 47435 - DNA, 601 bp, Human; identical to SEQ ID NO: 47411

SEQ ID NO: 47436 - DNA, 601 bp, Human; identical to SEQ ID NO: 47412

SEQ ID NO: 47437 - DNA, 601 bp, Human; identical to SEQ ID NO: 47413

SEQ ID NO: 47438 - DNA, 601 bp, Human; identical to SEQ ID NO: 23108

SEQ ID NO: 47439 - DNA, 601 bp, Human; identical to SEQ ID NO: 23109

SEQ ID NO: 47440 - DNA, 601 bp, Human; identical to SEQ ID NO: 23110

SEQ ID NO: 47441 - DNA, 601 bp, Human; identical to SEQ ID NO: 23111

SEQ ID NO: 47442 - DNA, 601 bp, Human; identical to SEQ ID NO: 23112

SEQ ID NO: 47443 - DNA, 601 bp, Human; identical to SEQ ID NO: 23113

SEQ ID NO: 47444 - DNA, 601 bp, Human; identical to SEQ ID NO: 23114

SEQ ID NO: 47445 - DNA, 601 bp, Human; identical to SEQ ID NO: 23115

SEQ ID NO: 47446 - DNA, 601 bp, Human; identical to SEQ ID NO: 23116

SEQ ID NO: 47447 - DNA, 601 bp, Human; identical to SEQ ID NO: 23117

SEQ ID NO: 47448 - DNA, 601 bp, Human; identical to SEQ ID NO: 23118

SEQ ID NO: 47449 - DNA, 601 bp, Human; identical to SEQ ID NO: 23119

SEQ ID NO: 47450 - DNA, 601 bp, Human; identical to SEQ ID NO: 23120

SEQ ID NO: 47451 - DNA, 601 bp, Human; identical to SEQ ID NO: 23121

SEQ ID NO: 47452 - DNA, 601 bp, Human; identical to SEQ ID NO: 23122

SEQ ID NO: 47453 - DNA, 601 bp, Human; identical to SEQ ID NO: 23123

SEQ ID NO: 47454 - DNA, 601 bp, Human; identical to SEQ ID NO: 23124

SEQ ID NO: 47455 - DNA, 601 bp, Human; identical to SEQ ID NO: 23125

SEQ ID NO: 47456 - DNA, 601 bp, Human; identical to SEQ ID NO: 23126

SEQ ID NO: 47457 - DNA, 601 bp, Human; identical to SEQ ID NO: 23127

SEQ ID NO: 47458 - DNA, 601 bp, Human; identical to SEQ ID NO: 23128

SEQ ID NO: 47459 - DNA, 601 bp, Human; identical to SEQ ID NO: 23129

SEQ ID NO: 47460 - DNA, 601 bp, Human; identical to SEQ ID NO: 23130

SEQ ID NO: 47461 - DNA, 601 bp, Human; identical to SEQ ID NO: 23131

SEQ ID NO: 47462 - DNA, 601 bp, Human; identical to SEQ ID NO: 23132

SEQ ID NO: 47463 - DNA, 601 bp, Human; identical to SEQ ID NO: 23133

SEQ ID NO: 47464 - DNA, 601 bp, Human; identical to SEQ ID NO: 23134

SEQ ID NO: 47465 - DNA, 601 bp, Human; identical to SEQ ID NO: 23135

SEQ ID NO: 47466 - DNA, 601 bp, Human; identical to SEQ ID NO: 23136

SEQ ID NO: 47467 - DNA, 601 bp, Human; identical to SEQ ID NO: 23137

SEQ ID NO: 47468 - DNA, 601 bp, Human; identical to SEQ ID NO: 23138

SEQ ID NO: 47469 - DNA, 601 bp, Human; identical to SEQ ID NO: 23139

SEQ ID NO: 47470 - DNA, 601 bp, Human; identical to SEQ ID NO: 33269

SEQ ID NO: 47471 - DNA, 601 bp, Human; identical to SEQ ID NO: 33270

SEQ ID NO: 47472 - DNA, 601 bp, Human; identical to SEQ ID NO: 33271

SEQ ID NO: 47473 - DNA, 601 bp, Human; identical to SEQ ID NO: 33272

SEQ ID NO: 47474 - DNA, 601 bp, Human; identical to SEQ ID NO: 33273

SEQ ID NO: 47475 - DNA, 601 bp, Human; identical to SEQ ID NO: 33274

SEQ ID NO: 47476 - DNA, 601 bp, Human
cagggaacatagggaaggccctgaagagagcggggaggccttggccaccccgacccctgacccctccacgcagaccagagggcaggccaccgccacctgggatatgggtccatgcacaccccaccatcctgcacacgctgggccttcctgccgtgaccagagccagacaaaccctcgcctcgccctgcccccggggccatccccccaggataatggggggtttattcccacgccctaatgctgggattcatcactgcggatttgcagagctgcacccccaggctgatctcccgctgacccrctcagccatctgaggcggggcccaggggccgcctgtcctggtggggtcttggagcagctcctccccgaccagtcctctcggggaccccaggggacataacagatcctggctttggggagcatctcgtctgtctcccctcacacggggcctccccagctgaagacaattcagaaacacagacctgcaagtcagcagcagcaggagacggcagggcggccacagggcacttagccctggaactggaccgagggcagtcaggaagccgccagcctctctccacccgacacctgccctgtgccc

SEQ ID NO: 47477 - DNA, 601 bp, Human
cctggggattacgggggtcagagcagaggggcctaggagaagggacaggtggggtggccaccctgagggtcccttgtggggctgggcctgcccgttccaaccacaatgcctccaagcagggcttggggccgcaaccctcgtcgtcaccagccagaggtcagaaggaagaagggcgcccacgcatgtcccctaccaaggggaaaccgaggcctggggcagaggggaccccagagccctgcagggcgtcactgtctctgccggtgcaccccaaccctctccaccccaaccctctccttgcccaacactagactgagtgaccttgggagaccctctcctgcctctcgccctggggagggggaggcagctccagaagacaggaccccagagaggggacctggggtcaggggaaggcccaaagcccaaccccactccccctcacactctgtgcagccgcgtccggcagccctttccccatccggccaccatagggacccaggcgggccccagcactccccgggcaccctgtgccctccttgtccaaccccagtgctgagcagggacaggcccccctcagctgtcacagaaacatcagtgaccatca

SEQ ID NO: 47478 - DNA, 601 bp, Human
ctgtctcaaagaacaaaacacaacaaaacaaaaacctctgggctctggggccaagggctcttgctgaaggggaggttccagactggggtctgagcccacatggcctgcgtgtgcctgactcagacaagggagggtcttgaatttccagcacaaagattcataggattttgccattaacactgggggctaggccaaacacactggctcatgcctataattccaacattttgggaggctgaggtaggaggatcgcttgagcccaggagttcaagaccagcctgggtaacatgagaccctctgccacacacacacacacacacacacacacacacacacacacacacacacacgggaccccttcccatccctgtaccaactcagccttcttagttcttgaggttttcttttttgagacagagtctcactctgtcgcccaggctggagtgcgatggcacaatctcggctcactgcaagctccgcctccagggttcacaccattctcttgcctcaccctcccgagtagctgggactataggcgcccgccaccacgcccagataatttttttttttttttgtatttttagtagagacggggtttcac

SEQ ID NO: 47479 - DNA, 601 bp, Human
agtgaaaccccagctctacaaaaaatacaaaaaaaaaaattggctgggcatgatggcacgtgcctgtagtcccagctactcgggaggctgaggcaggagaatcgcttgaaccagtgaggcggaggttgcagtgagctgagatcacgccatggcactccagcctggcaacagagtgagaccccatctcaaaaaataataatacaaaaattagccgggcgtggtggcgggcgcctgtagtaccagctactcgggacgctgaagcaggtgaattgtttgaacccgggaggtggaggttgcagtragccgagatcgtgccactgcattccagccggggcaacagagcgagactctgtctcaaagaacaaaacacaacaaaacaaaaacctctgggctctggggccaagggctcttgctgaaggggaggttccagactggggtctgagcccacatggcctgcgtgtgcctgactcagacaagggagggtcttgaatttccagcacaaagattcataggattttgccattaacactgggggctaggccaaacacactggctcatgcctataattccaacattttgggaggctgaggtaggaggatcg

SEQ ID NO: 47480 - DNA, 601 bp, Human
aaattaccagcctctccctgccccgagattatacccaaagaaatgaaaacaaggacggacgagcaccccgccgtgttcacaccagcttgattgcggacgacaaccaccccaccgtgttcacaccagctcgactgcggacgacgaccactccgctgtgttcacaccagctcgatccacagtagcaaaaaggcagaggcagcccaggtgcccatcaccaaacggagggacaaacacggcgcgacccgtccaccatggaacacgactcagccacgaaaaggagtgaggctctgacccaggccayggcgcagatgccccttgaggacgtcacgttcagtgagagaagccatttctttttttttccgagacggagtctcaccctgtcgcccaggctggagtgcagtggcaccatctcggctcactgccacctccgcctcccaagttcaagcgattctcctgcctcagcctcctgagtagctgggattacaggcatgagccaccactcctggctcatttttgtatttttagtagagacagggtttcaccatgttggtcaggctggtctcgaaaccctgacctcatgatccttctgcctaggcctcgc

SEQ ID NO: 47481 - DNA, 601 bp, Human
tggcgggccagacacggtgctgggagtgccgcgtccacacaggaggtcatagagggtcagcaaatggctactggacagatgcccaaccctttcgctatcgagaaaatgaaaatcaaaacgactcggagcaaacacgggtggctccttaaaaagacataaaattaccagcctctccctgccccgagattatacccaaagaaatgaaaacaaggacggacgagcaccccgccgtgttcacaccagcttgattgcggacgacaaccaccccaccgtgttcacaccagctcgactgcggacgactaccactccgctgtgttcacaccagctcgatccacagtagcaaaaaggcagaggcagcccaggtgcccatcaccaaacggagggacaaacacggcgcgacccgtccaccatggaacacgactcagccacgaaaaggagtgaggctctgacccaggccacggcgcagatgccccttgaggacgtcacgttcagtgagagaagccatttctttttttttccgagacggagtctcaccctgtcgcccaggctggagtgcagtggcaccatctcggctcactgccacctccgcctcccaagttca

SEQ ID NO: 47482 - DNA, 601 bp, Human
atggcgggccagacacggtgctgggagtgccgcgtccacacaggaggtcatagagggtcagcaaatggctactggacagatgcccaaccctttcgctatcgagaaaatgaaaatcaaaacgactcggagcaaacacgggtggctccttaaaaagacataaaattaccagcctctccctgccccgagattatacccaaagaaatgaaaacaaggacggacgagcaccccgccgtgttcacaccagcttgattgcggacgacaaccaccccaccgtgttcacaccagctcgactgcggacgaygaccactccgctgtgttcacaccagctcgatccacagtagcaaaaaggcagaggcagcccaggtgcccatcaccaaacggagggacaaacacggcgcgacccgtccaccatggaacacgactcagccacgaaaaggagtgaggctctgacccaggccacggcgcagatgccccttgaggacgtcacgttcagtgagagaagccatttctttttttttccgagacggagtctcaccctgtcgcccaggctggagtgcagtggcaccatctcggctcactgccacctccgcctcccaagttc

SEQ ID NO: 47483 - DNA, 601 bp, Human
gcgtatggcgggccagacacggtgctgggagtgccgcgtccacacaggaggtcatagagggtcagcaaatggctactggacagatgcccaaccctttcgctatcgagaaaatgaaaatcaaaacgactcggagcaaacacgggtggctccttaaaaagacataaaattaccagcctctccctgccccgagattatacccaaagaaatgaaaacaaggacggacgagcaccccgccgtgttcacaccagcttgattgcggacgacaaccaccccaccgtgttcacaccagctcgactgcgggcgacgaccactccgctgtgttcacaccagctcgatccacagtagcaaaaaggcagaggcagcccaggtgcccatcaccaaacggagggacaaacacggcgcgacccgtccaccatggaacacgactcagccacgaaaaggagtgaggctctgacccaggccacggcgcagatgccccttgaggacgtcacgttcagtgagagaagccatttctttttttttccgagacggagtctcaccctgtcgcccaggctggagtgcagtggcaccatctcggctcactgccacctccgcctcccaa

SEQ ID NO: 47484 - DNA, 601 bp, Human
cttccccccaggcgcctgcaggaccagccctgggcactcctccctggggggcaagggtgcccacacctcaggctggtgccttcccccaggcacctatgggaccagccccgggcattcctccctggggggcgagggtgcccacacctcaggctggtgccttccccccaggcgcctgcaggaccagccctgggcactcctccctgggggcgaggggtacccacacttcaggctggtgccttcccccaggcacctatgggaccagccccgggcattcctccctggggggcgagggtgcccacasctcaggccggtgccttccccccaggcgcctgcaggacaagccctgggcactcctccctcgggaccaggctcccaccccaggaaggccacccagccccgagggagcccaacgcccactgcgctgccctagcccaggtcccttcctcaggcccaactttgaccccgtgtccttgaagatgcaggagacctcacaaggcccaagaggtggctcaaaatagattaagtgcttcacatgaccagagagggacaatgtgcctggcacaaggttggcgttaaaaaaatagacaggacaggacagcag

SEQ ID NO: 47485 - DNA, 601 bp, Human
ctcaggccagtgccttccccccaggcgcctgcaggaccagccctgggcactcctccctggggggcaagggtgcccacacctcaggctggtgccttcccccaggcacctatgggaccagccccgggcattcctccctggggggcgagggtgcccacacctcaggctggtgccttccccccaggcgcctgcaggaccagccctgggcactcctccctgggggcgaggggtacccacacttcaggctggtgccttcccccaggcacctatgggaccagccccgggcattcctccctggggggcragggtgcccacacctcaggccggtgccttccccccaggcgcctgcaggacaagccctgggcactcctccctcgggaccaggctcccaccccaggaaggccacccagccccgagggagcccaacgcccactgcgctgccctagcccaggtcccttcctcaggcccaactttgaccccgtgtccttgaagatgcaggagacctcacaaggcccaagaggtggctcaaaatagattaagtgcttcacatgaccagagagggacaatgtgcctggcacaaggttggcgttaaaaaaatagacag

SEQ ID NO: 47486 - DNA, 601 bp, Human
gctggtgccttcccccaggcacctatgggaccagccccgggcattcctccctgggggacgagggtgcccacacctcaggccagtgccttccccccaggcgcctgcaggaccagccctgggcactcctccctggggggcaagggtgcccacacctcaggctggtgccttcccccaggcacctatgggaccagccccgggcattcctccctggggggcgagggtgcccacacctcaggctggtgccttccccccaggcgcctgcaggaccagccctgggcactcctccctgggggcgaggggyacccacacttcaggctggtgccttcccccaggcacctatgggaccagccccgggcattcctccctggggggcgagggtgcccacacctcaggccggtgccttccccccaggcgcctgcaggacaagccctgggcactcctccctcgggaccaggctcccaccccaggaaggccacccagccccgagggagcccaacgcccactgcgctgccctagcccaggtcccttcctcaggcccaactttgaccccgtgtccttgaagatgcaggagacctcacaaggcccaagaggtggctcaaaa

SEQ ID NO: 47487 - DNA, 601 bp, Human
cattcctccctgggggcgaggggcacccacacctcaggctggtgccttcccccaggcacctatgggaccagccccgggcattcctccctgggggacgagggtgcccacacctcaggccagtgccttccccccaggcgcctgcaggaccagccctgggcactcctccctggggggcaagggtgcccacacctcaggctggtgccttcccccaggcacctatgggaccagccccgggcattcctccctggggggcgagggtgcccacacctcaggctggtgccttccccccaggcgcctgcasgaccagccctgggcactcctccctgggggcgaggggtacccacacttcaggctggtgccttcccccaggcacctatgggaccagccccgggcattcctccctggggggcgagggtgcccacacctcaggccggtgccttccccccaggcgcctgcaggacaagccctgggcactcctccctcgggaccaggctcccaccccaggaaggccacccagccccgagggagcccaacgcccactgcgctgccctagcccaggtcccttcctcaggcccaactttgaccccgtgtccttgaagat

SEQ ID NO: 47488 - DNA, 601 bp, Human; identical to SEQ ID NO: 21120

SEQ ID NO: 47489 - DNA, 601 bp, Human; identical to SEQ ID NO: 21121

SEQ ID NO: 47490 - DNA, 601 bp, Human; identical to SEQ ID NO: 21122

SEQ ID NO: 47491 - DNA, 601 bp, Human; identical to SEQ ID NO: 21123

SEQ ID NO: 47492 - DNA, 601 bp, Human; identical to SEQ ID NO: 21124

SEQ ID NO: 47493 - DNA, 601 bp, Human; identical to SEQ ID NO: 21125

SEQ ID NO: 47494 - DNA, 601 bp, Human; identical to SEQ ID NO: 21126

SEQ ID NO: 47495 - DNA, 601 bp, Human; identical to SEQ ID NO: 21127

SEQ ID NO: 47496 - DNA, 601 bp, Human; identical to SEQ ID NO: 21128

SEQ ID NO: 47497 - DNA, 601 bp, Human; identical to SEQ ID NO: 21129

SEQ ID NO: 47498 - DNA, 601 bp, Human; identical to SEQ ID NO: 21130

SEQ ID NO: 47499 - DNA, 601 bp, Human; identical to SEQ ID NO: 21131

SEQ ID NO: 47500 - DNA, 601 bp, Human; identical to SEQ ID NO: 21132

SEQ ID NO: 47501 - DNA, 601 bp, Human; identical to SEQ ID NO: 21133

SEQ ID NO: 47502 - DNA, 601 bp, Human; identical to SEQ ID NO: 21134

SEQ ID NO: 47503 - DNA, 601 bp, Human; identical to SEQ ID NO: 21135

SEQ ID NO: 47504 - DNA, 601 bp, Human; identical to SEQ ID NO: 21136

SEQ ID NO: 47505 - DNA, 601 bp, Human; identical to SEQ ID NO: 21137

SEQ ID NO: 47506 - DNA, 601 bp, Human; identical to SEQ ID NO: 21138

SEQ ID NO: 47507 - DNA, 601 bp, Human; identical to SEQ ID NO: 21139

SEQ ID NO: 47508 - DNA, 601 bp, Human; identical to SEQ ID NO: 21140

SEQ ID NO: 47509 - DNA, 601 bp, Human; identical to SEQ ID NO: 21141

SEQ ID NO: 47510 - DNA, 601 bp, Human; identical to SEQ ID NO: 21142

SEQ ID NO: 47511 - DNA, 601 bp, Human; identical to SEQ ID NO: 21143

SEQ ID NO: 47512 - DNA, 601 bp, Human; identical to SEQ ID NO: 21144

SEQ ID NO: 47513 - DNA, 601 bp, Human; identical to SEQ ID NO: 21145

SEQ ID NO: 47514 - DNA, 601 bp, Human; identical to SEQ ID NO: 21146

SEQ ID NO: 47515 - DNA, 601 bp, Human; identical to SEQ ID NO: 21147

SEQ ID NO: 47516 - DNA, 601 bp, Human; identical to SEQ ID NO: 21148

SEQ ID NO: 47517 - DNA, 601 bp, Human; identical to SEQ ID NO: 21149

SEQ ID NO: 47518 - DNA, 601 bp, Human; identical to SEQ ID NO: 21150

SEQ ID NO: 47519 - DNA, 601 bp, Human; identical to SEQ ID NO: 21151

SEQ ID NO: 47520 - DNA, 601 bp, Human; identical to SEQ ID NO: 21152

SEQ ID NO: 47521 - DNA, 601 bp, Human; identical to SEQ ID NO: 21153

SEQ ID NO: 47522 - DNA, 601 bp, Human; identical to SEQ ID NO: 21154

SEQ ID NO: 47523 - DNA, 601 bp, Human; identical to SEQ ID NO: 21155

SEQ ID NO: 47524 - DNA, 601 bp, Human; identical to SEQ ID NO: 21156

SEQ ID NO: 47525 - DNA, 601 bp, Human; identical to SEQ ID NO: 21157

SEQ ID NO: 47526 - DNA, 601 bp, Human; identical to SEQ ID NO: 21158

SEQ ID NO: 47527 - DNA, 601 bp, Human; identical to SEQ ID NO: 21159

SEQ ID NO: 47528 - DNA, 601 bp, Human; identical to SEQ ID NO: 21160

SEQ ID NO: 47529 - DNA, 601 bp, Human
tgtccgccctcgtcacgtgcggcctaatgagggccttggcgcccagatgaaagcggtgggaaggacagggggtgattacctgccctaatggtggtgattcaggcggcagccagcgggcccgggcccccttcccagtgccccccgcccggcggggacaccgactcccctggcctccaggtacccacatcccctgctgtgcccagcctctcctcttgctcctgacattccacaaacactgagggcctacctcagtgtgctcggcagaccctggggacagagacgcccgctccgtgacgtcctsggccctgtggggacccagctccgccacccctgtcagtgtgaccctgggcaggtcccatcccttctgtgtgcctccttgtcctcacctgccagatggggtgtctgggaagaagcagagggggccccgactcaggcagccctgactggattctgtgatgtcaggagtccggaggtcagccccccgccgcttccgccatgcagctgggcctgccccagcccctctggagcctcagtttcccacctgcagatgggtggccccacccacagggttgtaccacacggacgcttctctgcccctgag

SEQ ID NO: 47530 - DNA, 601 bp, Human
ccacaaggtgcccgattagtgaccagcgaatgcacgaagggcaggagagccctcagctagccctcacccccatcaccgtccagctggggaaaccgaggcttggagagaggcagagactgttccaggtcaggcagcggagccaggcctctgccccggcccgaggccaccccgcctggccatgcccgccatggatggaccggcccagccagtcccctgtccgccctcgtcacgtgcggcctaatgagggccttggcgcccagatgaaagcggtgggaaggacagggggtgattacctgccctratggtggtgattcaggcggcagccagcgggcccgggcccccttcccagtgccccccgcccggcggggacaccgactcccctggcctccaggtacccacatcccctgctgtgcccagcctctcctcttgctcctgacattccacaaacactgagggcctacctcagtgtgctcggcagaccctggggacagagacgcccgctccgtgacgtcctgggccctgtggggacccagctccgccacccctgtcagtgtgaccctgggcaggtcccatcccttctgtgtgcctccttgtcctcacc

SEQ ID NO: 47531 - DNA, 601 bp, Human
gcaagctccacctcccggcttcacgtcattctcctgcctcagcctcccgagtagctgggactacaggcgcccgccaccacacccggctaatttttgtatttttggtagagacggggtttcaccgtgttagccaggatggtctcgatctcctgacctcgtgatctgcccgcctcggcctcccaaagtgctgggattaccgacgtgagccactgcacccggccaaccgttcactgttctgtgcacccacctgcgcccttgttcacgtgtctaactgctgcgcgcctctgctctgggagccccrggagggtgggcgtctctgtcaccactgggtcccccatgcggagcacagcacccacaaggtgcccgattagtgaccagcgaatgcacgaagggcaggagagccctcagctagccctcacccccatcaccgtccagctggggaaaccgaggcttggagagaggcagagactgttccaggtcaggcagcggagccaggcctctgccccggcccgaggccaccccgcctggccatgcccgccatggatggaccggcccagccagtcccctgtccgccctcgtcacgtgcggcctaatgagggcc

SEQ ID NO: 47532 - DNA, 601 bp, Human
cgcctcccctcccctggcaaggtgcctcccaacaccgccgttcactgttctgcacacccacctgcacccttgttcacgtcattcactgttcttttttttttttttttttgagacggagtctcgctctgtcgcccagggtggagggcagtggcgcgatctcagctcactgcaagctccacctcccggcttcacgtcattctcctgcctcagcctcccgagtagctgggactacaggcgcccgccaccacacccggctaatttttgtatttttggtagagacggggtttcaccgtgttagccrggatggtctcgatctcctgacctcgtgatctgcccgcctcggcctcccaaagtgctgggattaccgacgtgagccactgcacccggccaaccgttcactgttctgtgcacccacctgcgcccttgttcacgtgtctaactgctgcgcgcctctgctctgggagccccaggagggtgggcgtctctgtcaccactgggtcccccatgcggagcacagcacccacaaggtgcccgattagtgaccagcgaatgcacgaagggcaggagagccctcagctagccctcacccccatcaccgtcc

SEQ ID NO: 47533 - DNA, 601 bp, Human
ggaatgcaggggagccgccacccacctcccttctccctcactgctgggcacctagtcccagccaagcccttggtggtggcaggcagccagcggggatcgagtcccagctctgccctcccagctgggcagtcctaggtcagcatctccttcgccaagtctcagtctcctactctgcacctcgggtgtgagcgtgacccctgccttctggctgctgccgggaggatgggcgaggtgagccggtggacaccacactctcccacggtcccgggatgtccactcggggtgaagcgtgaggagctcsggatgccccaggcctcagtccccctccaaacaaggatgaatctccgctcttacacccaggatgtcggcgcccgcgcccacccctcccatccagggacccaccgagagcgctgggcctcagtgtcccccctgcatcccggctcccactcacctactgacagggcccccagggccagcaccagcagtgaagacacgcaggcctccatgccgctgtggagacccagtgtgggtgctggccccggccccgagcctccccacacgcgcttcctgtgggggaggtgaggtgacggtcacagccccg

SEQ ID NO: 47534 - DNA, 601 bp, Human
aggcaggtggatcacgaggtcaggagatcgagaccatcctggctaacacggtgaaaccccgtctctactaaaaatacaaaaaattagccgggcgtggtggcgggcatctgtaatctcagctacttgggaggctgagacaggagaatcgcttgaacccgggaggcagaggttgtggtgagccgagatcgtgccattgcactccagcctgggcaagaatagcagaactccatcttaaaaaaaaaaaataggccgggcgcggtggctcacgcctgtaatcccagcgctttgggaggccgaggcrggcggatcacctgaggttgggagtttgagaccagcctgaccaacacggggaaaccctgtctctactaaaaatacaaaattagcccggcatggtggcaggcgcctgtaatcccagctactcgggaggctgaggcaggagaatcgcttgaaaccaggaggcggaggctgcagtgagccgagatggcaccatcgcactccagcctgggtgacaagagtgcaagtctagctgtgcctgcaagctgcctgcaccctgggcctttgtctgtctcacttagctgcctgcgtacctttcccccaccgg

SEQ ID NO: 47535 - DNA, 601 bp, Human
tagtctttaaataagtaaattgtatagtgcataatttcctaataaagctgtacaaaaattattttaaatcaatcataaatataaaaggattgatttcataatgtaacgtaaatcagctcaaaatcttctctgaatccccatcatgctttgaaaatcaagtccccgcttgcgggccgggtgcagtggctcacgcctataatcccagcactttgggaggtcaaggtgggcagatagcctgaggtcaggagttggagatcagcctggccaatgtggtgaaaccccgtctgtactaaaaatacaraaattaaggccgggtgcggtggctcacgcctgtaatcccagcactttgggaggccgaggcaggtggatcacgaggtcaggagatcgagaccatcctggctaacacggtgaaaccccgtctctactaaaaatacaaaaaattagccgggcgtggtggcgggcatctgtaatctcagctacttgggaggctgagacaggagaatcgcttgaacccgggaggcagaggttgtggtgagccgagatcgtgccattgcactccagcctgggcaagaatagcagaactccatcttaaaaaaaaaaa

SEQ ID NO: 47536 - DNA, 601 bp, Human
tcccttcacttggggccccaggctcaaccacagtgatttgtacaggggttgacacatgccaatcctcctaagtgtgccccaactttagagagccaagccctctttccatgggactgaggagggtcaatctttccaccttgtgagacaggcttcctggtagtgcagcagagctgggagacagatgggctccacagcacctcctgtgagcacctggatcaagccgcacctgaagccaggcctcctcctagactttgcagttacacaagccggcaggtccctttttgttactttgaccatcttratctgggctctgtatgacggaccagtcctgaggtagggcaactccatgatgggtcatttagcggcttcctgatccccgggaaccaggtcgattcccgagccactctcgaaggccggcttcgacctcctggccacaggtggcaaacacccccacctgaccctccttccttatagcagaagcccccgcctaagttgggtccatcagcaggtgaatggacagacacaatgcactctgtccacaccaggactgtggctcagccgtgaaaggagccaggctctgacccaggctgcggtgtggaag

SEQ ID NO: 47537 - DNA, 601 bp, Human
ttcacgaaaaccagccctgggaattcccttcacttggggccccaggctcaaccacagtgatttgtacaggggttgacacatgccaatcctcctaagtgtgccccaactttagagagccaagccctctttccatgggactgaggagggtcaatctttccaccttgtgagacaggcttcctggtagtgcagcagagctgggagacagatgggctccacagcacctcctgtgagcacctggatcaagccgcacctgaagccaggcctcctcctagactttgcagttacacaagccggcaggtcsctttttgttactttgaccatcttgatctgggctctgtatgacggaccagtcctgaggtagggcaactccatgatgggtcatttagcggcttcctgatccccgggaaccaggtcgattcccgagccactctcgaaggccggcttcgacctcctggccacaggtggcaaacacccccacctgaccctccttccttatagcagaagcccccgcctaagttgggtccatcagcaggtgaatggacagacacaatgcactctgtccacaccaggactgtggctcagccgtgaaaggagccaggct

SEQ ID NO: 47538 - DNA, 601 bp, Human
agcttcacgaaaaccagccctgggaattcccttcacttggggccccaggctcaaccacagtgatttgtacaggggttgacacatgccaatcctcctaagtgtgccccaactttagagagccaagccctctttccatgggactgaggagggtcaatctttccaccttgtgagacaggcttcctggtagtgcagcagagctgggagacagatgggctccacagcacctcctgtgagcacctggatcaagccgcacctgaagccaggcctcctcctagactttgcagttacacaagccggcagrtccctttttgttactttgaccatcttgatctgggctctgtatgacggaccagtcctgaggtagggcaactccatgatgggtcatttagcggcttcctgatccccgggaaccaggtcgattcccgagccactctcgaaggccggcttcgacctcctggccacaggtggcaaacacccccacctgaccctccttccttatagcagaagcccccgcctaagttgggtccatcagcaggtgaatggacagacacaatgcactctgtccacaccaggactgtggctcagccgtgaaaggagccag

SEQ ID NO: 47539 - DNA, 601 bp, Human
tcacccctgccccagacttctgcccggccctggccccaggcaagggctgtgtgtccaaaaatccaaccccaagcctacagcttcacgaaaaccagccctgggaattcccttcacttggggccccaggctcaaccacagtgatttgtacaggggttgacacatgccaatcctcctaagtgtgccccaactttagagagccaagccctctttccatgggactgaggagggtcaatctttccaccttgtgagacaggcttcctggtagtgcagcagagctgggagacagatgggctccacagcrcctcctgtgagcacctggatcaagccgcacctgaagccaggcctcctcctagactttgcagttacacaagccggcaggtccctttttgttactttgaccatcttgatctgggctctgtatgacggaccagtcctgaggtagggcaactccatgatgggtcatttagcggcttcctgatccccgggaaccaggtcgattcccgagccactctcgaaggccggcttcgacctcctggccacaggtggcaaacacccccacctgaccctccttccttatagcagaagcccccgcctaagttgg

SEQ ID NO: 47540 - DNA, 601 bp, Human
cctgctccttcttcccccgccggaccgtcttggctggagcagaagtcacagctctgccgcttcccggctgtgtggtcttgcgcaggttgctaaacctgtctgagcctcagtttctgcacctgagaaacgggacccctgccagtgcttccccgccccccagcccctgacaggactccccagagaacgggagagccaggaacctgcccggcggctgccctggccccggccctcccgccagcctcattcccccagccccacccgggcgcccctcaccttgcagggagcctggtccttggagtcrgccgccaggcagaccatgctgggggagaggctgccgttccagaagcggctgttgttacacatgcgggtgtccagcacttggaggtccagctcccgcagcacccgggacaggcgcccgccctggtgggtcagcccccagccggccatgctgcaccgagtccctgctgccaccacctggcgcttactgggcagggccaacggccggatggtccggctgggcttcactttcccgtccagctacgagtgacaggaaggggcaggtgagcagggggagggggtgagagtgcgggggcggggggcg

SEQ ID NO: 47541 - DNA, 601 bp, Human
ccccatcaccccagggcatcaggccgatcggccggtgaccttcctgatccaggacacgtaaggcgccacagcggtggccacgggaggcttgaagatgtcagtgcagaccctggagctgaaggacaggactccggccaacacccggcctttgccacacaccaggggcccgcccgagtcaccctgcagggacgacacaccgcagctcagcctctgcgcctgctgaggggacgaggggagcagggcccgccgaggggagcagggccaggcctgttatccccaggctcaaggagacacaggggcygctcccggcccacgcgcgtcccctccccatctcccgctggccctgtgaaccctgctccttcttcccccgccggaccgtcttggctggagcagaagtcacagctctgccgcttcccggctgtgtggtcttgcgcaggttgctaaacctgtctgagcctcagtttctgcacctgagaaacgggacccctgccagtgcttccccgccccccagcccctgacaggactccccagagaacgggagagccaggaacctgcccggcggctgccctggccccggccctcccgccagcctcattccccc

SEQ ID NO: 47542 - DNA, 601 bp, Human
taatataatataattgaaaaattaaataattctaattatttttaaattttacgttaaatttctgtacctttttaatgtatctaattgtcataaaagctaaggatagtagctaaggatagtaattaaggaactgttccagttagtttagtaccaggcaatgaggtttcagatacttaatctgttaaaaaagactatacaaaaaggtatggagagtgtttttaatttggcatttatcgcacaaaatgtgtgtcaacatcagttaccttatacaagaaagtgactagtaagaacatagcttttkttcatgaacttcctgaaatagtttcaataacaattcatctactagttagttatgcacttccataaggcaggtcaaaaagacagttaattttccattaaaatccatttaattttacttttcctaatttaaaaactattccattaaaatccatttaccttttatctcggtgtctgaagatgaagtacagccaaatgttgtgcttatcagaaaggtatataagcatccgatagccaagcaaacgaaagccatttctccgagatttaaaaccttgatattgcctctctatgaaggaaaaatata

SEQ ID NO: 47543 - DNA, 601 bp, Human
atagagccagagggcattccagaaggtaatgcaaacaaaggtataaaaggcaataacacgggtgagaaaaaaatgtagagatggatctaaattgagtggagcattcacattggtaatagtagacagtatggcagcctagattttatcctggggcaatgagtagacacaggaggtttttgaacaagagagtggtatatgaaaatggcaatataggaagataaagctggctacagtgtgcagaatgaataaaaaggggagagattggaaggggagagattgggagcagagcgaccgtcatttkggaagcaatggcaatcatccaggtgtggaatgagggaagcctaaagtagagctcttacagtagagatggtaggtacttaacagatgtgcaaccttgcaaaggagcatcagaacatggtgatcatgttaccctaaaacaattaagaaattaagaagatacacgagtcacaatgtccaagtttaaaagcttcagtgacagttaacaaaggagggagtcagaaaaaaattcagtttaatagataactgattttttaaaaaaacaagaatataaaatatgtcaaaattgtttaagttctaaatt

SEQ ID NO: 47544 - DNA, 601 bp, Human
tagccaggtgtggtggcacacgcccataatcccagctgctcgggaggctgaggcatgagaatcgcttgaacccaggaggtggaggctgcagtgagccgagatggcaccactgcactccagcctgtgtgacagagggagactcttgtctcaaacaaacaaacaaaaaaaaaaacaaagtaatagctcaagaaaaacaaaacagaagctgacatgatcagttaaaggttaatgaaactggggagcagatgagccttgaaaaagatggataaaaattggtgaaagaaagatagagccagagggsattccagaaggtaatgcaaacaaaggtataaaaggcaataacacgggtgagaaaaaaatgtagagatggatctaaattgagtggagcattcacattggtaatagtagacagtatggcagcctagattttatcctggggcaatgagtagacacaggaggtttttgaacaagagagtggtatatgaaaatggcaatataggaagataaagctggctacagtgtgcagaatgaataaaaaggggagagattggaaggggagagattgggagcagagcgaccgtcattttggaagcaatggcaa

SEQ ID NO: 47545 - DNA, 601 bp, Human; identical to SEQ ID NO: 36962

SEQ ID NO: 47546 - DNA, 601 bp, Human; identical to SEQ ID NO: 36963

SEQ ID NO: 47547 - DNA, 601 bp, Human
gaagtggaaaaacaaagcttttatttttgctaaaggctcagcaattgaaaggatggagaaaaaggtaatgtcaaagagtctacaggctacaattaatagaatcatctcttcctcccctatggaaacttaacttctccagaattttgtttgtccttgatttgactgttgttgtttttaacaaaaataaactggatgtacatctgtctctccacatgccccccaaccatctccatcagcccaaagtataaactcatagagtagggtttgtcttaaccatcatgtcctgagggcctgacatacktgacagatgaaggaagaagatagttgaatgaattaataaatgaatgagatgcccacatattattttaaagttcctagccaattacagttgtaaggcagtatgtgagtgcggtggcgcgatctcggctcactgcaagctccaccttccgggttcacgccattcttctgcctcagcctcccaagtagctgggactacagtcacccaccaccacgcctggctaattttttgtatttttagtagagacggggttccaccgtattagccaggatggtctcgatctcctgacctcatgatccgccg

SEQ ID NO: 47548 - DNA, 601 bp, Human
tgcactaatctccaaggaattatgctgagtgaagtaaagtcagtctccaaaggttatatactgtgtgattcatttatataagcatttttgaaatgacaaaattatagacatgaaaaacagatcagtggttgccaggagtcagggatgaagggagatggctacatctataaaaagacaacaaaaaggatccttgtggtgatgcaattgttctgtatcttgactgtggtagtgcttatataaatctacacgtgataacattatgtagaactaaatacatacatgcaaatgactgcattaaagstgacgaaatctgagtaaggttgatggattgcatcgatttcaattttgtagttgtgatgttacactatacttatgcatgaggctattattgggggaaattagataaagcgtattatttcttacaactatatgtgaatctacaactatctcaaaataaaaagttaaaagggaaagaaagagtatataagaccagccaatggtagaagtggaaaaacaaagcttttatttttgctaaaggctcagcaattgaaaggatggagaaaaaggtaatgtcaaagagtctacaggctacaattaatag

SEQ ID NO: 47549 - DNA, 601 bp, Human
acagtccatagaggaaaaattaataaactggacctcatccaaattaaagccttttgctctgtgaaattccctgtgaagaggttggaaagacaagctacagactgggagaacatattttcataccactacctgacaaatgattagtattaagaataaaaaggccaggggcggtggctcacgcctgtaatcccagcactttgggaggccgaggcgggtggatcatgaggtcaggagatcgagaccaccctggctaacacggtgaaaccctgtctctactaaaaatacaaaaaaaaaaaaaaaattagccaggtgtggtggcgggtgcctgtagtcccagctacttgggaggctgaggcaggagaatggcgtgaatctgggaggcagagcttgcagtgagattgcaccactgcactccagcctgggcaacagagcgagactccgtctcaaaaaaataataaaaaactcttaaaactcaccaggttaaaaaaaaaatccaaatagaaaatggacaaaagacatgaactgatatttcactgaagatacagagaatggcaaataaacacatggaaaaatgatcaacatcattggcgatcagaaaaat

SEQ ID NO: 47550 - DNA, 601 bp, Human
ccaggcccattgattttacatttgacaagtaatgtgagtataaaacccttttagatggctggtgcggtggctcacacctataaccccagcactctgggaggccaaggcgggcggatcacgaggtcaggagatcgagaccatcctggctaacacggtgaaaccctgtctctactaaaaatacaaaaaaattagccaggtgtggtggagggcgcctgtagtcaggagaatggcgtgaacccgggaggtggagcttacagtgagccgagatcacgccattgcactccagcctgggcaaaagagygagactccatctcaaaaaataaaataaaataaaataaaataaaactcttttagatttttatattttttccacgtatcttgtatagtcatcttacccacatttaagcggacagtatttttttttgcaacttgttttcattaactcttctcaaaacaatttgtttcatcataatgaatctaatgtaaccatcacccagcttcaacagttattcatatgtgctgaattgtgtttcttccatactacccacaacccacctccatccctcaccccttgtataatgttaagcaaatcccagacatc

SEQ ID NO: 47551 - DNA, 601 bp, Human
aattcagttttgactcaattttgcagattttcactggagactgatcatcaaatgaaacactgcagacttttcaatatactacttagcttaagaaatcccatagtcagccaggcgcagtggcttactcatgtaatcccaacattttgggagactgaggcaggcaaactgcttgagctcacaagttggagacctgcctgagcaacatggcaaaaccctgtctctacaaaaaatacaaaaattaactgggcatggtggcatgagcttgtggtcccagtacttaggatgcttatgtgggaggatygcttgagcccagaaggtggaggttgcagtgagccgaggtcacaccattgcacttgggtgaaagaagtgaaaccctgtctcaagaaaaaaaaaaaaaaaaaaagaaagaaaagaaatcccatagtctacaatttgttgtttaaatatgtctcttaagtacagactagatctcagattattggtttttaaaattcaatgtacactctggctatagactctaagttcactgccactcctcctcatctttggtaatgtcctagtatggcatccacctccacttttaagctggcagtgccctaag

SEQ ID NO: 47552 - DNA, 601 bp, Human
ttcagggctgctaatgcctgaaagtagaagggaatgacattgaggttcagagccttgtgccaagcccagacagcatcctggtctttctgcagcaatggggcagtgccggtaagagcaagggaaaaaaatggtctggcaatagcaggacatggccctaaccctggccaaaaatcaaactcaacacaatttccaatagtttatactcacagccgtgtccaaccctttgaatgcgaggacatttttgcttatctctggtggtagatatcgtgaaaattatgtatacacctttaattttttttttaagctcatgagttatcattagtgttagcatattttatgtgtagcccaagacaattcttcttccaacatggtccagggaagccaaaaggctggataaccatggttgagaggatcatcccacagaactgttttatgcaactcaaacaggtaactgcgcaactttgattttaactaaagaggtagaagtcataagcaaagtccacaattctaagatttggttttctgtcctaaacaaattcctactcactcctcacaatgcaaaagtaacattttcccatgatttcatgacaaaacgttacag

SEQ ID NO: 47553 - DNA, 601 bp, Human
caacatggggaaaccttgtctgtacaaaaatttgcaggccgtggtggcacacgactgtagtctcagctactccagaggctgaggtgggaggatcgcttgagcctgggaggtggagggtgcagtgagctgagattacgccactgcactccagcctgggcgacagagtgagaccctgagaaaagaaagaaaacaaaaagaaaggaagaagggagggagggaaggaggagagaagagagaagggaagaaagggagagaggaaggaagggagggaaggagggatgaagggaagaagggaagaagrgaaggggaagggaaagggatgggaaaggaaagaatttgatgcagtgaagagtgctaaagcaacatcagcagcttgtctataacgtgccactgggtggcaccactgtccttagctagtcactacagatatggaaccaggatagaggaccatcaggctctcttgcagagcttaggtgaaaactcagaagtctatctctaccgtactgacacacagatgcaagtcactatagttaaagttctctgcatatgtcatcaacacaaggatatgtcttcaggatgttgtgcttatcagagactcctg

SEQ ID NO: 47554 - DNA, 601 bp, Human
cattaggggaaattgggtaaaggacccatggaaatggtgtatgatttttgcaactctattgtgagtctaaaatttattttttttaaaaaagtaaaaatgccctctaaaaaagaatatagtttcatattcccaccggcagtatattaatatgcccatttccccatatctcctccaatactggattgaactgtttgatagataccaaaaacactgtcttaattttttgcttttcactattagctaatgaacatatgaaaatatttcactggctgggtatggtggctcacgcctgtaatcccarcactttgggaggtcgaggtgggcagaacacttgaggtcaggagttcgaggtcagcctggccaacatggtgaaaccctgtctctagcaaaaatacaaacattagccaggtgtggtggcaggcacctgtaatcccagctattcgggaggctgaggcaggagaattggttgaatctgggaggtggaggttgcagtgagccgagattgcaccactgcagagcgagactccatctcaaataaaaaaaaaaaaattcactatgtctgaatttcttagacatattagataaatattgtggggttttt

SEQ ID NO: 47555 - DNA, 601 bp, Human
agatcttgttccaaatactattctccaagaaaaagaaccagagctctttggagcagttgattacggggctgaggcaggaaatattcaagatgaggttagtgttatctggtgccaaggaataaaaaagtgctgaatttttttaaatggagacatgtgaaaaggacacaggggccaacccaaaaagagttcccaatggccacagctggtattaacacaatctgggcaacaaataacaataatactagattatatcccacagagtaaaataatacccacgagtccatactaatataaatgaacratcaaataagtaaatgagggagaagagactaatcttcctcatagaagaattctaataaatgtagaaggaataaaggaaatagaaatctccattagaacaccacaggaataattactacaggcaaaatccatcagtgaatgctaatgctggtgagcaaaagctgaaactggacattacattgtctcaaagtatctcccccaaatatgtattaataaaaagtgtgtggatattacttcattgcaaaggggaaaatgataacattactgtggaaaaacacagctgataccatcttaactaggt

SEQ ID NO: 47556 - DNA, 601 bp, Human
ttcagatttataaaatgcccctaaggggtgagtaccaccttaccctcaattgagaaatcttcaggcttaaggctgaaaatatataaagaaacagaaaatagcttttgaagagcctgtactttagttggatttaaaatgcattgtatgttttttagttattgatgttacataaatttaatcttttatacatatttgccttaagtcttagagaaagagaaatgctttctaggtaatcctcatagtgcttagtacagacacacacacacgcatgcacacacacacacacacacacacacacacagtaggcaaggctcaaagaacattcaggtgagaagaaaccagagagatcatttagtctagaggttttcaaattctttctgcaggtagtgagggggtcatgggtcatccatttgaataaaatcttatatagatataaaaacacaagcgtagatgaaagcaaaaagcatagctgctctggtagaggaggctatgacagcccctgaagggactccttggaacttccagttcagctgaatatttgaaccactgatattgtctgagccctcatcttacagagaagcaaatgaatggcagagcacaa

SEQ ID NO: 47557 - DNA, 601 bp, Human
aggaaaaataaaaacaaaaaacaaaaaacaaaaacaaaagaatattaacaagttgatagcacaattgatttaaatactcaggtctttattagtttacacaattaattacagaaagctgaaataactggtctgaaaggctggcattttccatttgtaatcattattgacgtaaatgtctttgagcacatcaacttctgaatttatttttttctaggtttctaggtgtactggtactctgcatatcattctgtgagttgaataacaaccttaatgcttacacaaatgcatgaatatgatattyaagtttgtcaaaactttggtagaatagggtatgccaataataagatttctcttaaacatgtgcatgtaaactagacatctttaaatagtgttaggtttatatccaaaggggggggtggggcagaaactatcaacttagatttatttctcaaaggtcaacccagaaaccttattctgagttcttcattaaggtaaatttctcaggtaatgctatttactatctactatttcccacatgggagcaatacaattgtaaaatcatttcctacatgtccactttgtgctcaaaactgcaccagtt

SEQ ID NO: 47558 - DNA, 601 bp, Human
atgtgtataaacttcttaggcctcagtttctcatctctaaaataagacagctggacagattgtggttactaaccactagtgggtatcagaatcacgtgcagaacttaaataaaatattatttctgaaccccctttctgaaaattcagattcaatatgtctgggatagaacaaagctccacaagtgattctcatatatgcccctgattgaaaaccactggatctgatctttaaggtgacttcaatgctaacatttgaaggtgataagttttaaacagaaccctggagcttccactttcaagrcagtgtatagtgctagcctagtaaccacttttccttccgagaatataccaaaatggctaagaagccacatatatatcatcagaatgaaatacaagtttaacaggattatcacatttaaaaatctttacacaaattatttacatttttatataccagttaaaataacatttttttaaaacagtgagctataccactgaaacaaagatagttacacttaaactggctaattttaatgctttttaaagatatagtcatagtttataaaccaagcaaataaggactgcatatttcctctgatga

SEQ ID NO: 47559 - DNA, 601 bp, Human
cctaagattttaatgaacacatttgctgtgatttcaacaaggtaaaattattttaaaatgtagacatatctaagagtattactttttaaaaggtccaagtacgatcaataaattatataaacaatcctcttatgttcatattcatattctgtactcaccggaacagcagccataagtgtgggcttcagtacagtacagtctcctttgcttccttttttaattttgctggactatattaaagaaaaaataaatatgatcaggaaaaccaaccttaaaacatgttgtaattcaagtattaatracaaatacagaagttacacttggaatttgagcttttattgctctgtgattatctgttaacaactatcataacctacaagtctcaaatgtaagtattttagtgctacagataactgcttctagcacatttcaccttccttagaggagaaaccttgatccaggataacaagagaatgacattgtgatgaatcaaacattcttattaataacatactatcaaatatagcacagactattactacattttcaaaaaaacttgattaagacagatataacactaaaacaaaattgaaggtgattt

SEQ ID NO: 47560 - DNA, 601 bp, Human
cttccctagtatggtacctaagattttaatgaacacatttgctgtgatttcaacaaggtaaaattattttaaaatgtagacatatctaagagtattactttttaaaaggtccaagtacgatcaataaattatataaacaatcctcttatgttcatattcatattctgtactcaccggaacagcagccataagtgtgggcttcagtacagtacagtctcctttgcttccttttttaattttgctggactatattaaagaaaaaataaatatgatcaggaaaaccaaccttaaaacatgttgyaattcaagtattaataacaaatacagaagttacacttggaatttgagcttttattgctctgtgattatctgttaacaactatcataacctacaagtctcaaatgtaagtattttagtgctacagataactgcttctagcacatttcaccttccttagaggagaaaccttgatccaggataacaagagaatgacattgtgatgaatcaaacattcttattaataacatactatcaaatatagcacagactattactacattttcaaaaaaacttgattaagacagatataacactaaaaca

SEQ ID NO: 47561 - DNA, 601 bp, Human
ctgaatataattcatctcttggactttgctcataacattcttataaattctatccatgatttcctgaaagttaaacaaaatattcaataatctgaaaggaatggagacagtctttagttgaagataccttacttgcaacatcttgggtaaaagtctttagcataatggacatatttgtttctttaattatgtaattaatttcactgactacttgttcactacttcaaaaagactaaggacagatataggggtttcttcagttctatacattaagttaatctaaatttttttttttttttttgagacggagtctcactctgctgcccaggctggagtgcagtggcgggatctcggctcactgcaagctccacctcctgggttcatcccattctcctgcctcagcctccccagtagctgggactacaggcgcctgccaccacacccggctaattttttgtatttttagtagagacaaggtttcaatgtgttagccaggctggtgtcgaactcctgacttcgtgatccgccacctcggcctcccaaagtgttgggattacaggcgtgagccaccgtgcccagccaagttaatctaaatttttaa

SEQ ID NO: 47562 - DNA, 601 bp, Human
cctcccagcagggccttgacctttttaaacagtaaccttaataaagggaggataaatgattttaatgtacgcatacattattcttggcaacacactaatttataagctctgggaaagattcctcaactggttgaacatctcaatgtcagaatcacggtgagaatgagaggttaacaaggcaacaactagtaacgccttgtaaaaatgccagaaaaaactctttaaaaatgaagaaagataatgtgtagcatcgggaaactatgctgacacaagtaaatgaaagaaaacagacatcagaggwaaaaaaattttaattatctttggaacatttaatcacctatcttatctcacttccaataaaaaatgcttccccatccccactcctcagcatcacatttaaaataagttatattcatatacttactacactattttatgaatacaataaatcagaaaccttcatgcaatggaggtcactttttttagttagaaatgacattttttaagctcaagtgtcttgattcaaaagtctattttagtttttcttcatgaaactaaattttataaataaatcttaaatatacactcaattattaaaatt

SEQ ID NO: 47563 - DNA, 601 bp, Human
ggaaaagaaaatacatagaggtgagaccaagaatgccttcataagaaacagtaagaagactggtgggtctggagagaagagccaggcattgtgtatatgtggggaataatggaaaatgatgttggataagtacactagcatcagattaaagatgtcaaagctaggtaaagaggtgtttagatttgatacatcaggtatcaagcagtggatgaggtggatgcatctaatagaaggatacaggataaatcagaagtgatgtaatgtaggcagacacagctgttacaaggctgttaggtcaggscaggcgcagtggctcccgcctgtaatcctaatactctgggaagctgaggtgggtggatcacctgaggtcaggagttcgagaccagcctggccaacatggtaaaaccccgcttctactaaaaatacaaaaattagtcaggtgtggtggcacacgcctgtagtcccagctactcaggaggctaagggaagagaattgcttgaacccgggaggcggaggttgcagtgagctgagattgtgccactgcactccagcctgggcaacagagcaagactctgtctcaaaaataaaaaggctgttagg

SEQ ID NO: 47564 - DNA, 601 bp, Human
tagtaacaaaacctacttcatacagggatatgctgtgaggattaaatgagatgatacatggacaatgcttaacacttcttggcacaagctaagccttcaaaagatgttagctgctgttgtcaaacatcatcatgatgatgatatccatttgcaatttgtgattattgctagcaataaacaaatatttatggacagcccattatgtaaacagcacatgagagataaggagaccctgcactcaatgaccttacaaatgaactgggaagaaatgcatgtgaaacaattcagagaacatttaaayactaaactgcatgggcactgaaggtaagcacaatagtagcttagagacttaaacaatgaatgtaaaatgaagtagttaggaaagacattattgaaaagtgggcattaaaagatggttgtgatcaataagcaaaaaggacattccaagagaagggaaaagaaaatacatagaggtgagaccaagaatgccttcataagaaacagtaagaagactggtgggtctggagagaagagccaggcattgtgtatatgtggggaataatggaaaatgatgttggataagtacactagcatcagatta

SEQ ID NO: 47565 - DNA, 601 bp, Human
ttcttgccagtcttttagcttaatttcacagcaaataagaggtgctccaactctgccagtagtatagtcagttactgtgagggaaaaagtaacagagatattagcataccacattccagatttgtaccaatgcactgggaatattagagttagaaccagagtcagaaaaatgacaaaagaaggagtgcaaagtgtgatcatttttcagtatttcaactccacttcaatagtgcaatggattccattgttgttacatcatttttgcttttcatggttatattttatgtaattaagtacaaaatatctgttaaaggaggagagatggctccaccgttatctacctaagcttgtcataagatagattttgattggaattcctgctctaccactcattggctatgtaacatggacaagtaacttagcctctctaagcctccatttcctcatctatgaaatggagatagtaacaaaacctacttcatacagggatatgctgtgaggattaaatgagatgatacatggacaatgcttaacacttcttggcacaagctaagccttcaaaagatgttagctgctgttgtcaaacatcatcatgatgatg

SEQ ID NO: 47566 - DNA, 601 bp, Human
acacatcttcctcttcagagactttatatttgcctgagatggtctttctcaataaagttgtgtgtcacttccatactttatccatatgtctgctcaaataccaccaccccggagaggacatccctgaccactcataacaaaagagaagggggaggagccaagatggccaaatacgaacagctctggtctacagctcccagcctgagcgacacagaagacgggtgatttctgcatttccatctgaggtaccaggttcatctcactagggagtgccagacagtgggcgcaggtcagtgggtgygcgcaccatgcgcgagccgaagcagggcgaggcattgcctcactcgggaagcacaaggggtcagggagttccctttcctagtcaaagaaacgggtcacctggaaaatcgggtcactcccacccaaatactgtgcttttccgacaggcttaaaaaacggtgcaccaggagattatagcccgcacctggctcggagggtcctacgcccacggagtctcgctgattgctagcacagcagtctgagatcaaactgcaaggtggcagggaggctgggggaggggcgcccgccattgcccaggctt

SEQ ID NO: 47567 - DNA, 601 bp, Human
acacatacacacacatcttcctcttcagagactttatatttgcctgagatggtctttctcaataaagttgtgtgtcacttccatactttatccatatgtctgctcaaataccaccaccccggagaggacatccctgaccactcataacaaaagagaagggggaggagccaagatggccaaatacgaacagctctggtctacagctcccagcctgagcgacacagaagacgggtgatttctgcatttccatctgaggtaccaggttcatctcactagggagtgccagacagtgggcgcaggycagtgggtgtgcgcaccatgcgcgagccgaagcagggcgaggcattgcctcactcgggaagcacaaggggtcagggagttccctttcctagtcaaagaaacgggtcacctggaaaatcgggtcactcccacccaaatactgtgcttttccgacaggcttaaaaaacggtgcaccaggagattatagcccgcacctggctcggagggtcctacgcccacggagtctcgctgattgctagcacagcagtctgagatcaaactgcaaggtggcagggaggctgggggaggggcgcccgccatt

SEQ ID NO: 47568 - DNA, 601 bp, Human
gttgtttcagttggatagttttagtctatgtggttattaaaatatacatacatatacacattatttatactcacacacacacacatacacacacatcttcctcttcagagactttatatttgcctgagatggtctttctcaataaagttgtgtgtcacttccatactttatccatatgtctgctcaaataccaccaccccggagaggacatccctgaccactcataacaaaagagaagggggaggagccaagatggccaaatacgaacagctctggtctacagctcccagcctgagcgacrcagaagacgggtgatttctgcatttccatctgaggtaccaggttcatctcactagggagtgccagacagtgggcgcaggtcagtgggtgtgcgcaccatgcgcgagccgaagcagggcgaggcattgcctcactcgggaagcacaaggggtcagggagttccctttcctagtcaaagaaacgggtcacctggaaaatcgggtcactcccacccaaatactgtgcttttccgacaggcttaaaaaacggtgcaccaggagattatagcccgcacctggctcggagggtcctacgcccacgg

SEQ ID NO: 47569 - DNA, 601 bp, Human
acacctgtaatcccagcattttgggaggccaaggtgggcggatcaccaggtcaaatgatcgagaccattctggccaacatggcgaaaccctgtctctactaaaaatatacaaaaattagctgggcacggtggcacgcgcctgtagtcccagctactcgggaggctgaggcgggagaatcgcttgaacctgggaggcagaggttacagtgagccgagattgtgccactgcactctaacctggcgacagagcgagactccgtctcaaaaataaaataaaataaaataattttaaaaattagcyaggcgtggtggtgggcgcctgtaatcccagctacttaggaggctgaggcaagagaatcgcttgaacccaggaggcggaggttgcagtgagctgagattgtgccaatatcactccagcctgggtgacagagtgagactcttctcaaaaaaaataaaaataaaaaaaaagaagagatgctggaagcaactccatggactcccaggacaacagggctgagaggcggcagagcaggggccgcctggtgcccgtggagtctgcctgggcagtcagtgagcatgtcaggaaggattaacggtgggc

SEQ ID NO: 47570 - DNA, 601 bp, Human
ggccgggtgctccctgccacctcctatccccatgctggtgtgggggctgctaggctttgaacctgtgggaatggttgcagccacaaatgccagccaggactgggcagaggctggcaccccagcctggggcttccccctgtcctaggagctctctccaccttgccctcccctgctgccctgaatccagggttgggtcacagccagatgagggtcactgaggtccctccaaatcctcaggctgctctcagccctttgctgtgtgcaggaagtctgggagatgggactccagcctcctggctgytggccccttgggcttcgagggctgcctagaggaagagtctggtgctagggacaggggcaggaggaggctgggtccagcaggcagagcactgggggctgtggagaaggccctggtcgggagggggaagacctgggctctagatcagtgctgccactgccgggccatgtgcccccaggtaagcctctgggttctggactcagttttcccatctgcaaaatgaagcctttccaactcttacacgttgtgggttcttttaattaatttatttaattacatatatatatatatatttatatatat

SEQ ID NO: 47571 - DNA, 601 bp, Human
tgtattttttgcagagatggggtcttgctatgttgcccaggctggtcttgaactcctggactcacacgatccacctgccttggcctcccaaagtgctgggattacaggtgagccaccacgcccagcccagtgccccatgtttgggcctttcttctttgtcctgcctgggcttgggaggaggtcacccaggacagaggccccttactccagccctgcccagcctgagctcactgctgcctttccatgaaggtgagatgaacgggcagcaggccaggttttgtacacagatgaaaatgcaggtatgaagagggagcttttgtaagatgggtttgcaaaactctgccacaacctgtgccctctgctctgaggggatgctgggccgcccgctcttgggtccctaagccttgactgcctgctcagggctggttgatggggccacagtctggggggcccctatcctcttcccttcccatgccgggtgcggcccacacctgcccgtgactcaggagaatttcacgcctgcctgcccgctggccctctgagtcaggccctggccagctgggaggggcagcacctgagcagtgggtcagcaccgtcctcc

SEQ ID NO: 47572 - DNA, 601 bp, Human
ttgtattttttgcagagatggggtcttgctatgttgcccaggctggtcttgaactcctggactcacacgatccacctgccttggcctcccaaagtgctgggattacaggtgagccaccacgcccagcccagtgccccatgtttgggcctttcttctttgtcctgcctgggcttgggaggaggtcacccaggacagaggccccttactccagccctgcccagcctgagctcactgctgcctttccatgaaggtgagatgaacgggcagcaggccaggttttgtacacagatgaaaatgcagraatgaagagggagcttttgtaagatgggtttgcaaaactctgccacaacctgtgccctctgctctgaggggatgctgggccgcccgctcttgggtccctaagccttgactgcctgctcagggctggttgatggggccacagtctggggggcccctatcctcttcccttcccatgccgggtgcggcccacacctgcccgtgactcaggagaatttcacgcctgcctgcccgctggccctctgagtcaggccctggccagctgggaggggcagcacctgagcagtgggtcagcaccgtcctc

SEQ ID NO: 47573 - DNA, 601 bp, Human
ttttttgtattttttgcagagatggggtcttgctatgttgcccaggctggtcttgaactcctggactcacacgatccacctgccttggcctcccaaagtgctgggattacaggtgagccaccacgcccagcccagtgccccatgtttgggcctttcttctttgtcctgcctgggcttgggaggaggtcacccaggacagaggccccttactccagccctgcccagcctgagctcactgctgcctttccatgaaggtgagatgaacgggcagcaggccaggttttgtacacagatgaaaatgcaggaatgaagagggagcttttgtaagatgggtttgcaaaactctgccacaacctgtgccctctgctctgaggggatgctgggccgcccgctcttgggtccctaagccttgactgcctgctcagggctggttgatggggccacagtctggggggcccctatcctcttcccttcccatgccgggtgcggcccacacctgcccgtgactcaggagaatttcacgcctgcctgcccgctggccctctgagtcaggccctggccagctgggaggggcagcacctgagcagtgggtcagcaccgt

SEQ ID NO: 47574 - DNA, 601 bp, Human
agtaattttttgtattttttgcagagatggggtcttgctatgttgcccaggctggtcttgaactcctggactcacacgatccacctgccttggcctcccaaagtgctgggattacaggtgagccaccacgcccagcccagtgccccatgtttgggcctttcttctttgtcctgcctgggcttgggaggaggtcacccaggacagaggccccttactccagccctgcccagcctgagctcactgctgcctttccatgaaggtgagatgaacgggcagcaggccaggttttgtacacagatgaaaatgcaggaatgaagagggagcttttgtaagatgggtttgcaaaactctgccacaacctgtgccctctgctctgaggggatgctgggccgcccgctcttgggtccctaagccttgactgcctgctcagggctggttgatggggccacagtctggggggcccctatcctcttcccttcccatgccgggtgcggcccacacctgcccgtgactcaggagaatttcacgcctgcctgcccgctggccctctgagtcaggccctggccagctgggaggggcagcacctgagcagtgggtcagc

SEQ ID NO: 47575 - DNA, 601 bp, Human
tcctgagtagctgggattacaggtgtgggccaccatgcctggctaatttttcttcttttttcgtagagacagggttttgccatgttgcccaggctggtctcgaactcctgaactcaagcaatccacccaccttggcctcccaaagtaattttttgtattttttgcagagatggggtcttgctatgttgcccaggctggtcttgaactcctggactcacacgatccacctgccttggcctcccaaagtgctgggattacaggtgagccaccacgcccagcccagtgccccatgtttgggccwttcttctttgtcctgcctgggcttgggaggaggtcacccaggacagaggccccttactccagccctgcccagcctgagctcactgctgcctttccatgaaggtgagatgaacgggcagcaggccaggttttgtacacagatgaaaatgcaggaatgaagagggagcttttgtaagatgggtttgcaaaactctgccacaacctgtgccctctgctctgaggggatgctgggccgcccgctcttgggtccctaagccttgactgcctgctcagggctggttgatggggccacagtctgggg

SEQ ID NO: 47576 - DNA, 601 bp, Human
cctcctgagtagctgggattacaggtgtgggccaccatgcctggctaatttttcttcttttttcgtagagacagggttttgccatgttgcccaggctggtctcgaactcctgaactcaagcaatccacccaccttggcctcccaaagtaattttttgtattttttgcagagatggggtcttgctatgttgcccaggctggtcttgaactcctggactcacacgatccacctgccttggcctcccaaagtgctgggattacaggtgagccaccacgcccagcccagtgccccatgtttgggsctttcttctttgtcctgcctgggcttgggaggaggtcacccaggacagaggccccttactccagccctgcccagcctgagctcactgctgcctttccatgaaggtgagatgaacgggcagcaggccaggttttgtacacagatgaaaatgcaggaatgaagagggagcttttgtaagatgggtttgcaaaactctgccacaacctgtgccctctgctctgaggggatgctgggccgcccgctcttgggtccctaagccttgactgcctgctcagggctggttgatggggccacagtctgg

SEQ ID NO: 47577 - DNA, 601 bp, Human
tcgcagctttttggggttcctcctttgcctctcaacctctcacaatccaaacaagaccactattaaatgctaccttcacctttctgggatgcctttcctgatcccttaccagaatgccccaatgcgcccctctaccgttttttttccttctctttttcctttttttttttttttgagagggagtctcactctgtcacccaggctgcagtgcaatggcgtgatctggctcactgcaacctccgcctcccaggttcacgccattctcctgcctcagcctcctgagtagctgggactacaggckcccgccaccacgcccggctaattttttgtatttttagtagagacggggtttcaccgtgttagccaggatggtctcgatctcctgacctcgtgatccacccgcctcggcctcccaaagtgctgggattacaggcgtgagccaccgcgcccggcctttttttttttttttttttgagacggagtctcactctgtcacccaggctgcagtgcagtggcgtgatcttggctcactgcaacctctgccttctgggttcaagggattctcctgcctcagcctcccgagtagctggcattacagaca

SEQ ID NO: 47578 - DNA, 601 bp, Human
tttttagagatggttgtctctatatgttgcccaggcaggccttgaacgcctgagctcaagtgatccgcctgccttggcctcccaaagtgctgggattacaggcgtgagccactgcgtccggctattttatttatttatagagacagtgtctcactttgttgcccaggctggagtgcagtggtacgatcatagaccactgcagcctcaaactcctgggctcaagtgatcctcctgcctcagcctcctagagcagctgggactacagatgcaccccaccatgcctgactaattaaaaaaaaawttttttttagagatagggtcttgctatgttgccctggcttagttttctttatgtatgttttttggggttggagctgtagtggaaccagtcccagccccactgggcatctgggtctgaccttagctgctccactaagggcttaacaggacactggccacaggcctgctcccatccaactccactggggccacaggagggaccctacccaggatggagtgagggcaggcacagaccaaacagtgcagggtcggggggtactgttcactgggacaagagatgaggaagatgctggatttaagt

SEQ ID NO: 47579 - DNA, 601 bp, Human
tgcagcctcaaactcctgggctcaagtgatcctcctgcctcagcctcctagagcagctgggactacagatgcaccccaccatgcctgactaattaaaaaaaaatttttttttagagatagggtcttgctatgttgccctggcttagttttctttatgtatgttttttggggttggagctgtagtggaaccagtcccagccccactgggcatctgggtctgaccttagctgctccactaagggcttaacaggacactggccacaggcctgctcccatccaactccactggggccacaggagkgaccctacccaggatggagtgagggcaggcacagaccaaacagtgcagggtcggggggtactgttcactgggacaagagatgaggaagatgctggatttaagtgggcaatgagggtgcctagcagaagaggggactcttaacctgggtcttgatggatgagtagaagttctctgcatgggaaggggtggaggtcatttcaggcagaggaggaagcattaaacagcatggtgtatctcaaggagagcagctggagcatgagtaaggggggctggagtagggggcagggcatgatgttgggt

SEQ ID NO: 47580 - DNA, 601 bp, Human
gagcccaggtcgtttgagctgggtgctcttggctgctcacttgccttcttcctgtctaggccccttataggttcacctggcactgggacttgaagtagttatggcctgaggtctcacttacctgggctggcagttttctgagttcgttcatctctacccagcccccgtggggccttgcgctcagtggctgtgtgcagaatgaaccagtggagagaaagggctgcacgtagcgctcaggatcctggggttgggtttgtggctgagtggaccaggggctgactgagtggagcccgtggctctrtctctccctggggtcccacctggaagcccaaggccctcagaaaaggggtttccttgcctgtcatggccctaccctccaagctgtgtcctggatcttggcagtgtccccctgagcgccctggctcagacatctcctgcctgaccgtagctgagccacgtgcctttgtcctttattgcagcttcatggcggctgaagagatgcattggcctgtccctatgaaggccattggtgcccagaacctgctaaccatgcctgggggcgtggccaaggctggctacctgcacaagaagggcggtaccc

SEQ ID NO: 47581 - DNA, 601 bp, Human
tggcagttttctgagttcgttcatctctacccagcccccgtggggccttgcgctcagtggctgtgtgcagaatgaaccagtggagagaaagggctgcacgtagcgctcaggatcctggggttgggtttgtggctgagtggaccaggggctgactgagtggagcccgtggctctgtctctccctggggtcccacctggaagcccaaggccctcagaaaaggggtttccttgcctgtcatggccctaccctccaagctgtgtcctggatcttggcagtgtccccctgagcgccctggctcagmcatctcctgcctgaccgtagctgagccacgtgcctttgtcctttattgcagcttcatggcggctgaagagatgcattggcctgtccctatgaaggccattggtgcccagaacctgctaaccatgcctgggggcgtggccaaggctggctacctgcacaagaagggcggtacccagctgcagctgctgaaatgtgagtccctggggtggtagggtgcacagtaggagggcatgggggcagggctagccatgtaagtaagcatcctctccaagcctctgcttcctcacatggtgtgccctct

SEQ ID NO: 47582 - DNA, 601 bp, Human
tccctggggtcccacctggaagcccaaggccctcagaaaaggggtttccttgcctgtcatggccctaccctccaagctgtgtcctggatcttggcagtgtccccctgagcgccctggctcagacatctcctgcctgaccgtagctgagccacgtgcctttgtcctttattgcagcttcatggcggctgaagagatgcattggcctgtccctatgaaggccattggtgcccagaacctgctaaccatgcctgggggcgtggccaaggctggctacctgcacaagaagggcggtacccagctkcagctgctgaaatgtgagtccctggggtggtagggtgcacagtaggagggcatgggggcagggctagccatgtaagtaagcatcctctccaagcctctgcttcctcacatggtgtgccctctggattttcccattccctctctggtggctggcacccctggagaagcagaggttgacttccctagcccccaggactgtagcagggtccggggtggtgcacagtgctggccagctggcaaggggagctgcagcctgcagccaggacctggggaccacaggtggccaggtaggtctggcctc

SEQ ID NO: 47583 - DNA, 601 bp, Human
cctatgaaggccattggtgcccagaacctgctaaccatgcctgggggcgtggccaaggctggctacctgcacaagaagggcggtacccagctgcagctgctgaaatgtgagtccctggggtggtagggtgcacagtaggagggcatgggggcagggctagccatgtaagtaagcatcctctccaagcctctgcttcctcacatggtgtgccctctggattttcccattccctctctggtggctggcacccctggagaagcagaggttgacttccctagcccccaggactgtagcagggtcyggggtggtgcacagtgctggccagctggcaaggggagctgcagcctgcagccaggacctggggaccacaggtggccaggtaggtctggcctctggtgctgccctcactgaatccgtgaatgttcagtgagttagttggtcacttcgcccacagtgaacctatgtgtcaagtcctggctgggtgctggacctctggagctgcacaagacccaggctctggcccccaggacagctggctgggaggaagaagcagccctcaggcttgagagatacccaaatgctgagatactgaaggccaaga

SEQ ID NO: 47584 - DNA, 601 bp, Human
tcgaactcctgacttcaagtgatcctgtcttggcctcctaaagttctgggattacaggcatgagccaccgcgcctggcctatttattatttttatgtctcactctgtcacccagactgcagtgcagtggtgcgaacacagctcactgcagcctcgacctcctgggctcaaatgatcctcccacctcagcctcccaagtagctggaactacagatgtatgccaccgtgtccggctaagttttgtattttttgtagagatggggtttcacatgttgctcaggctcaccccatcttttattttyagagacagtctcactcttgtcacccaggctggagtgcagtagcacgatcttggctcactgcaacctctgactcccgggttcaagcaattctcctgcttcagcctcctgagtagctgggatcgcaggcgtgagccactgcacccggccttagtccccctcttttagctctggggtagtgggagcctccaacagccctgcagcacccagcaagtcagctgtggcctccctgggcctctggtcctggctctgccttgcctcatgctggctccacacagccccccaaatctacctcttctttgt

SEQ ID NO: 47585 - DNA, 601 bp, Human
ggcctatttattatttttatgtctcactctgtcacccagactgcagtgcagtggtgcgaacacagctcactgcagcctcgacctcctgggctcaaatgatcctcccacctcagcctcccaagtagctggaactacagatgtatgccaccgtgtccggctaagttttgtattttttgtagagatggggtttcacatgttgctcaggctcaccccatcttttatttttagagacagtctcactcttgtcacccaggctggagtgcagtagcacgatcttggctcactgcaacctctgactccygggttcaagcaattctcctgcttcagcctcctgagtagctgggatcgcaggcgtgagccactgcacccggccttagtccccctcttttagctctggggtagtgggagcctccaacagccctgcagcacccagcaagtcagctgtggcctccctgggcctctggtcctggctctgccttgcctcatgctggctccacacagccccccaaatctacctcttctttgtgggcagccaggcctgccctcgggtggcactctggggctagccagtgtgcctacaattttttccgtatttggcccc

SEQ ID NO: 47586 - DNA, 601 bp, Human
tgcactgctgctcccacgaagcccacccagcacccctcttccatgcccctccatgcccccttacgcctgcctgggcatgaagctcactactgggagcatcagcagccagggcccacccagatctgccctcttccgttggggcgtggtgctggtgccgagacgtgttcacaggggggtgctgtgggaaggccatccctatagctgtgaaccaggccgtgacccctggcgctgtgcccccagggtgatgcgggcggctgaggagaccacgtccaacaacgttttccccttcaagatcatccayatcagcaagaagcaccgcacgtggttcttctcggcctcctccgaggaggagcgcaaggtgactgggggtccgaggacgagtgcaaggtgactgggggtgtgggcctgcaggcaccaggctggacctgccttgggggctcgctggtcctggggcgctggcctctcagccccgggcaaagagaaggtgtggctgggacacaggcagctgggtgggtgctgccccagctccatccccatgcccagagcctggtgccagcgcccacacaaggaacatgctgtcctgggaggtgcccctgtgggc

SEQ ID NO: 47587 - DNA, 601 bp, Human
gtgtgcatgcatctctctgctcctgtctacctccagccccatctgtcacatctgtttctgtgttgccgccatgggtagttcctgttaggggatcatgtgtgtttatacgcctgccaccagggaggcctggcatggcagcagctgggcactttgggttcccagccccctacgcccaccctggctcactcagagtgagaccagaatgattctcctggcggggcgccactgggcagtctgagccttggcagcctcccccgtgagctggcccgacgtgcagcagatactctctggattgggactycctggcccgagacgatgtggagggaacaaaccttcctgtcctttcacaggtggggacaggaggcccagggagggctgggcacagccaaggctgccctgcaggtccctgcctgactccgggctcccgtcccctggtccaagctgttcagcctcgggcccagcccagagtcgcccaagccctcttgaggcaggagcaggtggagacgtgggcacagtcagggcggccatccttgtgggccagaaggggcacctagtggaggcaccacagcctccagttcttctgtctgtccttgtaactgtg

SEQ ID NO: 47588 - DNA, 601 bp, Human
tctgtgtttgtgtgtgcatgtctgcgtgttgctctgtgtgtgtgtgcatgtccacgtgttgctctgtgtgtgtgcatgtcctcatgttgctctgtgtgtgtgtgcatgtccgcatgttgctctgtgtgtgtgcatgtccgcgtgttgcttgtgtttgtgtgtgcgtgtccgtgtgtcgctcgtctgtgtgtgaacatgtgtgcttgtcctgtatctgtgtttatctgtatacttccatgtctgtgtgacagagtccttgtgtctgtgtgtctacatgtctgcgcgtgtccctgtgtctttktgtatatatatccatgcctgtgtgcctgtgttcctgcgtgtgcttgtgtgtgcacgtgtgcatttgtgtgtttgtcagagtatgtgtgcatgtgtgtgtctgtcagcgtatccatgtgtgcatgtgtgtgtctgtcagcgtatccgtgtgtgcatgtgtgtgtctgtcagcttaaccatgtgtgcatgtgtttgtcagtgtatccgtgtgtgcatctgtgtatctgtccatgtatccgcgtgtgcctgtgtgtacctttgtgtgagcatcaagggacctcccaggcctggtgctcaccgt

SEQ ID NO: 47589 - DNA, 601 bp, Human
gtgttgcttgtgtttgtgtgtgcgtgtccgtgtgtcgctcgtctgtgtgtgaacatgtgtgcttgtcctgtatctgtgtttatctgtatacttccatgtctgtgtgacagagtccttgtgtctgtgtgtctacatgtctgcgcgtgtccctgtgtctttgtgtatatatatccatgcctgtgtgcctgtgttcctgcgtgtgcttgtgtgtgcacgtgtgcatttgtgtgtttgtcagagtatgtgtgcatgtgtgtgtctgtcagcgtatccatgtgtgcatgtgtgtgtctgtcagcgkatccgtgtgtgcatgtgtgtgtctgtcagcttaaccatgtgtgcatgtgtttgtcagtgtatccgtgtgtgcatctgtgtatctgtccatgtatccgcgtgtgcctgtgtgtacctttgtgtgagcatcaagggacctcccaggcctggtgctcaccgtccgccccaacgcaccctgcattgcagcgactccagctcggacacagacagcttctacggcgcagttgagcggcctgtggatatcagcctttccccgtaccccacggacaatgaaggtgaggtctttctccgcatccactgc

SEQ ID NO: 47590 - DNA, 601 bp, Human
tgtgtgcatgtgtgtgtctgtcagcttaaccatgtgtgcatgtgtttgtcagtgtatccgtgtgtgcatctgtgtatctgtccatgtatccgcgtgtgcctgtgtgtacctttgtgtgagcatcaagggacctcccaggcctggtgctcaccgtccgccccaacgcaccctgcattgcagcgactccagctcggacacagacagcttctacggcgcagttgagcggcctgtggatatcagcctttccccgtaccccacggacaatgaaggtgaggtctttctccgcatccactgcccgttygcctctccccacctggcctcctcttggccgctgtggaggagagggaggtgtgttcggctgtgctccttgctctggccctttggcagtgcgcagtagcatccctgggctctggccttcagcggcagggtctggactcacagtcctcccagcaggtgcttgccccttgcctcctggactcagccccatgcatggagcattgctcggagactgggcctgggccggtttggctctcaccacccccctctccccatgcagactatgagcacgacgatgaggatgactcctacctggagcctgact

SEQ ID NO: 47591 - DNA, 601 bp, Human
acaggcacatggcgataagtggcaggtggagccggggtggccctgggggttaagcatggggaaggaaggacgctgaggagcgcgcaggctcagggcaggtccatgtccccatggctgccagcttgtgtggacactgctgcaggccaggtcgttgtcccaccccaccccatcccatcccagtgtccacctacctcctgcagcacatggcctagtcaaagagacaggctgatacaggtggtcacacgtggatgacggaagcacgagctgggtggggaggacgtgtctctgtcctcctctgtcscctccctcccttcctccctccctattgtctctccagccccctcatcttgtcaatttcctcatgtctggggctgatccttgatccttccattttccctgcgtccgccctgcctccttgttttccagcctcctgttctcactgacttggcctctgctgaccccagcccctgaccccgtatcctctctgcctcccatcccctcccaccttcaggctcccgggtccagcccctcttctcctgccgctccctccctccttccctctggggtcccagtgccaacagtccttcagcccaccagggtc

SEQ ID NO: 47592 - DNA, 601 bp, Human
tctgtcccctccctcccttcctccctccctattgtctctccagccccctcatcttgtcaatttcctcatgtctggggctgatccttgatccttccattttccctgcgtccgccctgcctccttgttttccagcctcctgttctcactgacttggcctctgctgaccccagcccctgaccccgtatcctctctgcctcccatcccctcccaccttcaggctcccgggtccagcccctcttctcctgccgctccctccctccttccctctggggtcccagtgccaacagtccttcagcccacsagggtctgcgggccgcttgcctcagtttccttccatgcagagctcttgtctcacagtgttcaccatgcctgtcccttcgcccacacactactgccttccgtcttagcctggctggccaagccttggtgaactcagactccgtctgcccagccctgagctgcagcccagtgaggctagagatgggcctggggagccaccagtgctcctgcatgctactgctccactcaccctccctctgtacccccttcatcctctccccgagacatttctcgtccaggacgcctgtggcctccccattcc

SEQ ID NO: 47593 - DNA, 601 bp, Human
gggctgctgggtgggcaggctgtggggtgggcctaccatgggttgcactcctggttggcctggctgaccactgccagcagaggatagtgttggcccagtctctgtcagggtccaacccgggtctctttgctctgcagatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggckgctgaggactccaagagggacccactgtgcccgaggcgggctgagccttgccccagggtacctgctaccccccgaaggatgagcgatccccctctgagcaccatgcccaccgcacccggcctccggaaacccccttgcttccgggagagtgccagccccagcccggagccctggacccctggccacggggcctgctccacttccagtgctgccatcatggccactgccacctccagaaactgtgacaaactcaagtccttccacctgtccccccgaggaccacccacatctgagccccca

SEQ ID NO: 47594 - DNA, 601 bp, Human
gaccagtttgtcccccactcccacagagttacgccaatggctgtggtcaaaggcatctgggaccccaggtgggcttcctgccttgcctggcaggcaaagggtccaggaactggaggggcaggtttcgcatgggtgtgctggccggcacgcgcacccccgaatgcccttgcccacggtgcccttctcccagggctctgcgaacacctctgagatgcctgctgcctgtgtggaagtgcctctgagcagcccttgtcacactcgtggttctagttcaccaagggctgcagagatgcagatgttyggaagtcacgtttttccatgactgtggggatagcggttccagggctcagcctcacccacaggctggcctcccatgctggcgtggcccgttaatcctccctagagcctttgaggctttgctgagcaggaccggctagccacacagggaggcgtgcagggacgccatgggcgtcctttggggtcacactgcattgttcatccagttcacgtccactcccctgtggctctgagtgggctgtgatttggccatgaccggacctcccctccccacgagcatccagagcacttgttgacggtgtga

SEQ ID NO: 47595 - DNA, 601 bp, Human
ccagttcacgtccactcccctgtggctctgagtgggctgtgatttggccatgaccggacctcccctccccacgagcatccagagcacttgttgacggtgtgatgacactgagcttgggaaccctggactcccttgccagcatccatggcagccctgacccctgactccggtgtcgggcgattcctgctgtcccagggcagtcagcacgagccctacccggatctctgttgtcctgagctttttagggtcacaggggccatagcaggcagcttgccgtcctcacacagagggtggagtgggsaggggagcagagggtggccgccccgtgtctgacagtgaaatggtcctgccttcctctccctgcccctccaggcgatcaccccccgatgggcagagtttcaggagcttctcctttgaaaagccccggcaaccctcacaggctgacactggcggggacgactcggacgaggactatgagaaggcaaggctgagcggcaagcctgggtcccagtggccagtaggtggacaggtggtgggaaagccataggccagggcggcccctcacagaccgtcctgagcaaggaccccccgagaacccggg

SEQ ID NO: 47596 - DNA, 601 bp, Human
tgaggcataggcagcgggtagactgagactggcacctccaggataccgccctccccttcccctccaccatcgctcaccccccacccctcctgctcagcctccctcctctcgtggcctacctttgtcctccactgaccctagtggggatgggcggtcagccatagaccctgggttgcttgtcttgtctttttctttttgcggggacaggggtctcactgtctttctcaggctggtttcaaattctggggctcaagcaatcctcccacctcggcctcccacagtgctgggattacaggcgtgrgccaccgtgcctggcctaggttcatttcctgaccttgtctgaagtgctctgggtgcaggctcctggacatggaggacggaggggaagtgaggtgggaacatggagagcacaggcctgatgcggaggccaccttgggggcaccaccgacagccaggggccagcctggtgatgccgctgttgatgctgctgccttgttttacagacggggagactgaggcctagagccgcagagtggcctggccctgctgacgctcccccttctcttcccccacaggactctaagttctacctggagggcga

SEQ ID NO: 47597 - DNA, 601 bp, Human
ttaagaggacctaaactaaagtgggatgaaaaaggagagattaagtagatactttaagagaagacttaacagaatttgtagtcaggttccaaaaaagaacctcaggcttctgacagccctaacagatgggcaacttaaaagtgttagccaaagtttgaatataggtccacataaaagagagaaaggacaaaattcatccctcctgagacgtagtctttactcttctctgccaaaccatgcacattactgtcttcatcttgatgcatttaacatttattgaatagttactataagccaggtkctccaagctaccaggatgaacatagtgtccaccctcaaggagcttaattacaggccagtcaggtagacagacaaggtgactaacagttcacaaagcatgacaagtgctgtagtggagcaatgcatacaatacagaaagggtacagaagaggaatgcatctccacctagcaggcaagggcatcagggaaagtttctaagaaaagctgaaggttgagttaactcttgaaggatggacaggagttaaccaggcaaaagagctaagaaggtcactctaggcagaggaagaagcatggagacttt

SEQ ID NO: 47598 - DNA, 601 bp, Human
cttgtcattattccctaaacaatacagtataacaactgtttacatagtgtttacattgtgttcagtgttgtaagtaatctgcagatggatttaaagtatacaggaggatgtgcagaggttacatgcaaaaactgcaccactttatataagggacttgagcatcaatggatttggctatcctttgggggtcctgagaccaatcccccatagatattgagggacaacggtatatattttcatttatatgaaaataagaccggaaaggctgacatagtttgttacttataatttcactgactaactcacattaccctagatcagtagttttcaaatgcagggtggggagtcctgggagggttccacaaaccctttggggggctgtatttttgaaataacactgagatactgtttgctgtttttactctcctaggcccatgaatgtaaaggctacatgaccaatgtgatggcatcatcactcaacagaatgtatgcttgtatagccctgtactttaaaaatttctccattttaacttctcctatagtaaatatcaatgaatataacccacataaaccaaagctctttggaatcctccatttttta

SEQ ID NO: 47599 - DNA, 601 bp, Human
aatttcataataatggccttgttgtgtctttttatgcattacgctggacccagtatggtagttttcaatctgttctaggaaattttcttgacttatgtatttgatcatttcccccccagtgttttctgtgctctttctgaaactcctattaacagcatgttagagctcctgagttgattaattttgttgaaatttctggaagagtttttttatcttctaatgtcttctgtctatctacctacctacctacctacctacctatatccatctacccacccacccattcatctctgtgtgtgtrtgtatgtgtgtgtgtgtgtgtgtgtgtgcacgcgcatatctatgagttcttaattgttccttttaatttttttttttttttggtagagacagggtctcactttatcaggcatgagccactgtgcctggcttgtgccttttaaatggcatgttattcttgtttcattgatgcagtatattcttatttctctgaaaatactgaatttagggcttttgtttttttggtagtttttgtggcattttctctattccatgagtttctattttttccatggtttaggagttttcatctctatcattt

SEQ ID NO: 47600 - DNA, 601 bp, Human
ggtcctattccattctgattttgtattctttatacataacctgcttttttgccccctctggaagatattaggatcttttattactggttttcttaaatttcataataatggccttgttgtgtctttttatgcattacgctggacccagtatggtagttttcaatctgttctaggaaattttcttgacttatgtatttgatcatttcccccccagtgttttctgtgctctttctgaaactcctattaacagcatgttagagctcctgagttgattaattttgttgaaatttctggaagagtgtttttatcttctaatgtcttctgtctatctacctacctacctacctacctacctatatccatctacccacccacccattcatctctgtgtgtgtgtgtatgtgtgtgtgtgtgtgtgtgtgtgcacgcgcatatctatgagttcttaattgttccttttaatttttttttttttttggtagagacagggtctcactttatcaggcatgagccactgtgcctggcttgtgccttttaaatggcatgttattcttgtttcattgatgcagtatattcttatttctctgaaaatactgaattt

SEQ ID NO: 47601 - DNA, 601 bp, Human
ataggcaggggtggtggtaagaatacctccttgaggttttattcagttgaaaactatgttttcaactcttggcatgggatgccactgactagattggcatattctcttcaagagcccccaaaactacagagtattctcacctgggaaagtgctttcttaatggcttcctcatatggaggagaaaagagtaacctatgtattctcatacaaattacatctgtcatagaaaatgctaccattgaacaaaatctcaaatattaagaaatcatctaattttaacagatgataaaagcaatagtaktattaaatattaatatttatggatgttttaaactgtattcactatattcatacatttatagatatattataaatatactaatttttctaagggaaaatatctctttccaataatcaactaggtttttgcaaagtatttttctctaatgcccctctcctgtttgcatttctttcagttaatgtggcaacttacaggctggttgttgccagtgatgaccaaattttcatttcgccttcctcctactgtgcttttataaagagggtggatcactcccatgtcagatacttgcttaaatcgaag

SEQ ID NO: 47602 - DNA, 601 bp, Human
gtcatttaattttactttctttaaattgttttttgttgttggttttttttttttttttttttttttttgagacggagttttgctctgtctcccaggctggagtgcagtggcgcgatctgggttcactgcaatctctgcctcctggtttcaagcgattctcctgcctcagcctcccgggtagctgggattacaggcgcccgccaccacgcccaggtaatttttgtatttttagtagagacggggtttcgccatgttggccaggctggtctcgaattcctgaccttgtgatccacccgccttrgcttcctaaagtgctgagattacaggcgtaagtcatcgcgcccggcctaaattgcttcttaaacagctttttcaaaaaagcagtttaattgataaaattatttctaatgattggcttatacactttagaactaaccactgatattaacgaagttataaagctaattatctttttaatactaggttattttcctttaacagtagagaaactgatatgtgtatatgtatatttcaaagtatttaaatatttgtcatattaactacaaggtagaatgggacaagaagtggcaggtagaaaaaa

SEQ ID NO: 47603 - DNA, 601 bp, Human
agttcagaggagaggttaaagcacaattccaaatttgggaggcatcggcttacagagggtatttaaagcaaagagagaaaattggttataaataatggagatggttaactgattatgcagtggtagtatatggaatagacagtaattcttaagtgactagttttccaatttgttccaatgctgccatcttgtggtcatttaattttactttctttaaattgttttttgttgttggttttttttttttttttttttttttttgagacggagttttgctctgtctcccaggctggagtgcagkggcgcgatctgggttcactgcaatctctgcctcctggtttcaagcgattctcctgcctcagcctcccgggtagctgggattacaggcgcccgccaccacgcccaggtaatttttgtatttttagtagagacggggtttcgccatgttggccaggctggtctcgaattcctgaccttgtgatccacccgccttagcttcctaaagtgctgagattacaggcgtaagtcatcgcgcccggcctaaattgcttcttaaacagctttttcaaaaaagcagtttaattgataaaattatttctaa

SEQ ID NO: 47604 - DNA, 601 bp, Human; identical to SEQ ID NO: 35329

SEQ ID NO: 47605 - DNA, 601 bp, Human
ccactgcatctgagatcagagcaccaagctcagcagaaccaggctgaattccgcatgggtcctgtgacctcagcccacgtggggacctacagatgctacagctcactcagctccaacccctacctgctgtctctccccagtgaccccctggagctcgtggtctcaggtgagggccctgatcttgtcctctccgagctcaaaggctcagctcaggccctgcccccagcagagctctgggacaataatgaatgaggggagtgaagcgggagggtccacaggggagggtccagcccatgggagrgtggaaataggcagggacctcccacccctggctcccacccctgaagtctcagtaaagagcatgaagggctgggaggagacgggggcgggggggcgggtggtgaacctcagagatgtgattagactgagggtggaagacggagaccccacccgctcccctcctgatgtctccacctcagaatcagagcctctgggggtcccaaaccctatgtcctgaccccatgggtgacaaaaccagccactcccagctcaagagaagtttctagactcatctcaatgctacctccaatattcagggtct

SEQ ID NO: 47606 - DNA, 601 bp, Human
cagggacctcccacccctggctcccacccctgaagtctcagtaaagagcatgaagggctgggaggagacgggggcgggggggcgggtggtgaacctcagagatgtgattagactgagggtggaagacggagaccccacccgctcccctcctgatgtctccacctcagaatcagagcctctgggggtcccaaaccctatgtcctgaccccatgggtgacaaaaccagccactcccagctcaagagaagtttctagactcatctcaatgctacctccaatattcagggtctgatttccagggmagcagcggggagggtggacagtaagggtgtggtctgcgtggcttcctggggcttcagggatggggcaggtgttccctccgtggtgttcagaggggagggaggtgtctgaggttcagcattgatgagcggagcagagggatctttccccctccctgagcaggattcccaggagccgtcacctctcatgggggagccagggtcaggggagatcacagtcaggtacttggtctaggagtcaggtgggaggagcccggggaggtggggctgggtctgtgatggctcagcctctccttgggaggt

SEQ ID NO: 47607 - DNA, 601 bp, Human
cctcccacccctggctcccacccctgaagtctcagtaaagagcatgaagggctgggaggagacgggggcgggggggcgggtggtgaacctcagagatgtgattagactgagggtggaagacggagaccccacccgctcccctcctgatgtctccacctcagaatcagagcctctgggggtcccaaaccctatgtcctgaccccatgggtgacaaaaccagccactcccagctcaagagaagtttctagactcatctcaatgctacctccaatattcagggtctgatttccagggcagcagmggggagggtggacagtaagggtgtggtctgcgtggcttcctggggcttcagggatggggcaggtgttccctccgtggtgttcagaggggagggaggtgtctgaggttcagcattgatgagcggagcagagggatctttccccctccctgagcaggattcccaggagccgtcacctctcatgggggagccagggtcaggggagatcacagtcaggtacttggtctaggagtcaggtgggaggagcccggggaggtggggctgggtctgtgatggctcagcctctccttgggaggtggaact

SEQ ID NO: 47608 - DNA, 601 bp, Human
agagaaaatgtctccaattttctaccaaaatcaatagctggcacagctctgcaggacccccagcccctggccttgtcctgcaggatgtgtgatgagtagaggaaggagaacaggctgggtggggaggatttggggtccaggcctgacttggacactgggaagatgctggggctgatggaggaggaagagaggcaggtgagttggagagaggacagatggacagtgtattggcagctctcatttctcatttccaagagcccctgagtataagcccttcacccacacctgcggggtccctggrccatctcaagacaagagaggaggctgcttgggcctcggtgggatctgactgtgatgaggctggagtccaccccagatgtgctcctttagagagaagcaccccagctgtgggtgccgctcacactgcccctcctgtgctcacctggaggcctctgtgctcagggcatccctgagaataaggaggggccctgcacctgctccctggacaagtcaggcaagtattcacagcacgtctttctgtttaactcatttctactctgcattttctgtatgcacttgtcctttgttactttttttctaa

SEQ ID NO: 47609 - DNA, 601 bp, Human
tatttaaaaatccttatttatactcccctttaattgagtcttgatttaatttatacattcaatgtagaaacaaatttctcattaatatcaactcttcctccttcacacattaaaaatgaagattttcttaatgaatttaagacatgttttgaaattttactcctaagaatattgtatgctcattttaacttaaagaattattcaacatctttaacaattgataagtgaggtatttgatttctttttatatatatatatattttattattatagtttaagttccagggtacatgtgcacaaygtgcaggtttgttacgtaggtatacaggtgccatgttggtttgctgcacccatcaactcgtcattcacattagtatttctcctaatgctatccttctcccagccccccacccctagactggccccggtgtgtgatgttccccgccctgtgtccatgtgttctcattgttcaactcccattatgagtgagaacatgcggtgtttggttttctgttcttgtgacagtttgctgagtgatggtttccaggttcatcaatgtccctgcaaaggacatgaactcatcctttttaacggctgcata

SEQ ID NO: 47610 - DNA, 601 bp, Human
tcttcttgctttatttcattaatttgatcttcagtcactgatatcctttcttccacttgatcgaatcagctattgaagcttgtgcatgcatcacgaagttcttgtgccgtggttttcagctgcatcaggtcatttaaggtcttctctacacggtttattgtagttagccattcatctaaccatttttcaaggtttttagcttccttgcaatgggttagaacatgcttctttagcttgaagaagtttgttattaccgaccttctgaaacctacttccatcaacttgtcaaactcattcttcmtccagtcttgttctgttgccggtgaggagctgcgatcctttggaagagaagaggcactctgtttttggaattttcagcttttctgctctggtttctccccatctttgtggttttatctacctttggtctttgatgttggtgacctagggatggggttttggtgtggatgtcctttttgttgacattgatgctattcctttctgtttgttagttttccttctaagagtcagacccctcagcagcaggtctgttggtgtttgctggaggtccagtccagccagaccttatttgcctgggtat

SEQ ID NO: 47611 - DNA, 601 bp, Human
aagagacttcagcctagagcaggggacagtctagtaaatacaggatttcagtgcaatggaatttagttccatggtcaaggacatgtagatgctatctgaaacaccaacttgggtcttcaaagattagtaagaggttgccagatagagggaaggagagaagagagaaagactttcctcaaaaaggacacatatgcaaaagaatgaagctgaaaagagtttggtggcctcacagtgcctgcatgagggagaagaagttgatgagataagcagtgagcagatcataaagaaccatatttgccaycctaacgagcccaaccttacttctgaggccattgaggactccaggcagagcttttaggcactggagtaatgtggtcatgtttgtgaaatatcactctgagtgtaggatgttcagggtgaagcagagtgaggaggaagaaggggagttgtcaggattggaatatggaggagtcctcatttgatcatgactatgaaaggatttatagaggtcaggggtcatgaggtccacttagaaaacatatttttcccaggacagtgctcatgaggtccacttagaaaacatatttttcccaggacagtg

SEQ ID NO: 47612 - DNA, 601 bp, Human
ataccttctacttccctctccctatatgtcttccaaaggatgtgctgctgagccatgaatgactgaagggccagcagctatggaaggaggggcaacattaaggggagcagagaatccttccctggatagtccagcattaacagcatcttcagacccacccaccgccaaagcccttcctgcttttactgcctcagtctttcaaaacaagtgtgaggccccactctgccaggccttacctctcctaggttcatgttcccaagcctaccaagcctaccaagcctaccaagccagctgggccatygctcccctctctacagcccaagtgtgaatgcgcatgccattggggagcaggacgtgtgcatggtccttcacctctttgatcccactggcattgtggacctgtgaatggggtgcagggggccagaagaggaagaagcagtgcagcagtttgtccagagccctcaggacctggctagagtttgcattatcagatgatcatatgttggaatattatgatctccccagataaaccttggcctggttgttctgtggctctggacatcctgggagcccagtcatgcccctgtctgccccaatgccc

SEQ ID NO: 47613 - DNA, 601 bp, Human
agcagtgcagcagtttgtccagagccctcaggacctggctagagtttgcattatcagatgatcatatgttggaatattatgatctccccagataaaccttggcctggttgttctgtggctctggacatcctgggagcccagtcatgcccctgtctgccccaatgcccagcaatcacagcacccctccttcaaaagactgctgttgtactctttgtgcgcccagtgcaagtagctttgacatgatgacattacctccttaacacaaccttgaggaaaggcccagacagtagaagcctggggmccctccctcctgtgtgtctcttccccatattttcaatgttttggaaaaaggtcccatacagaaatcagacagcatcaactcctgctgtatttgattcaatttctcttctcttgtcccttaatgttctgctctggtatttgtaaagaatatggcattgaggccaggtatggtggctcatgcctgtaatccccaaggtgggcagatcacgaggtcaggagatcgagaccatcctggctaacatgctgaaacccgtctctactaaaaatacaaaaaattagccaggcctagtggcacacgcct

SEQ ID NO: 47614 - DNA, 601 bp, Human
tatgactgtgtcacagttgattgacatttaggcattaccagttttgcttcctatgagcagtggaagagtcacaaagacagtttttagaagtactttcacaccaagcctgggtgataactgtgagctcatgtgtggtactctccaactgaagctccttttatattaataatccattaatgagggtaatcaattcgtgttggcatgagctctatgaaaatacatagcataatatgggctccggccttgcattcatcagaattaggaggatcattagggcgcctgtcaaactcccctcctcgcygcccatcctcatgttccattaggtaactctacagacttagagaaaatacttttctttttctctaacggcagccctcaatgacttttctttctgttttgggctttttctttcatgaacatcacaaacgtagacactccgtttggggcacttttttttttttttttgaaacagtttcattcttgttgcccaggctgcagtgcagtggcaggatctcggctcactgcaacctccccacctcccgggttcaagcgactctcctccctcagtctcccaaatagttgggattacaggcacctgcca

SEQ ID NO: 47615 - DNA, 601 bp, Human
ggtgtcgatgtgctaatttacgatgattaatgccgccttgttgattttcatttctcattaggaaaacttagcaagactccagagggcctttgcgaggaagtgggaattcatctttatgcaagcagaagcacaagtaaagtaggtgaacttgatagagaccttttcagagaggaaaagactctggaatttggaaatggtgtgaaggtgggattgtcaaagtgaagtttccagatggcgttagtatttctaatagggcctgagagcaactgagtagaaattaaagtcaggatggataagtttygtcttcataatcaatgcttctctaaagcaatttcagaaatgtgtgtttcagcagacaagggagatcctcccaaaggtagaactctggttataagaaggtgtacctatttccccaagagatttccagttattttctgtgttcaaaggctgaaatcccattttacccgttggactggagattttgtcttcatgggaaaacaggttggagttttaggaagaacaacaagtagcccctgtcttcttttccctgacaggggaggagtttagaaccaacagaaaaagaaggcacagaagtcagaca

SEQ ID NO: 47616 - DNA, 601 bp, Human
atacaaaattagctgggcatagtggtacatgcctgtaatcccagctactcaggaggctgaggcaggagaattgcttgaacccgggaagtggaggttgcagtgagctgagatcgtgacattgcactccagcctgggcaacaagagcaaaactccctctcaaaaaaaaaaaaaaaaacaagattatagggcgtgacactggatatgtggccccaggtgaaaattaaatctgcccttcctgtacagaggtgtgtatctataggcctcctctccccagcatctccaccccaccccaccagggcakaggtgacccctgtaagttttctgcatgcagagagcagctatcctgagcacaggctgacccagatgggggcccagagagggagagtctgaacttcttcaatttcttctttcaagtctaccaattagttaagtcatttttcctccacaaaggacaagagatgaaaggaagaaaaaagttggaagggtttttcccagatttttttctcctggatacatagtggacatttcttcctctctaaggaaacatgaggaatgggtactctatgttccccaccccacaaacatcgttgtcaaccagatc

SEQ ID NO: 47617 - DNA, 601 bp, Human
atcttataatttgtatatgcagtatcctttttgataagggggcatatcaatggataattcagtttttaataatccaaatcttaatacttcagatgaacagctgcattcttattcttcccttaggccaccatgttcattacacatgtatggcaatctgtaatctagcctaaaacaagttctcttaccatgtgtggaattcctgaggttttcggggggggaattatacacccctatttcacagctctgcagagagcaggcaccatgcaggtaccaatggccttgtgttcacttagcccctagmaacaggagcaaacgctggagcaagtgtcagaagggaaaacagaatacagagcttcttatttccttcctctctttactctttcaggattgaccggaaaaaagacaagacagaaaggaaaattttggatagtcaagaacgagccttttgggatgtccacaggcctgtggtgagaaagcgctactcaattctctagatttttttttcttaattgttcatttttatctctataaagaaaagaccgtctttagccaccaggtgtctcattcttaagaaaatcgctcagctttgtggaactggttt

SEQ ID NO: 47618 - DNA, 601 bp, Human
aaccccgtctctactaaaaatacacaattagctgggcacagtggtgcatacctgtaatcccagcttcttgggaggctgaggcaggagaatcgcttgaacccaggaggcagaggttgcagtgagcagagatcgcgccattgtactccagcctgggcaacaagagcgagactccatctcaaaaaaaaattccaaagagtggagatgtgtccccaaacattcctatttcttgtgatgaccaattagctctctctcatgtatgcattaaaaaaaaatacacgcacacacacacacacacacacactagacatggcgtatgtatataaacttctttaatctacttacatattttgttcgtcactgacttaacaatatccactgtattatattttaaaatgttagtcctaaaatgtcctcatttcatcttcaagagccccataattctaacattacagaatttcatggagtcacatccaccttatctgagcccttctgcattttgatgattttgactacacattgcatgcccttcagtgtttcatttctttcccattgcaaagattgtgtttagtctttccgtaatacgaggaacagctttaaatgt

SEQ ID NO: 47619 - DNA, 601 bp, Human
acatgtggaaaaacttaggccagaaaactgtttaacttgaaagggaaaccctgaaatgctgccatcccagttttgtaccagatgggaatctgctgaccaacggaaatgtagaggggatcttttgtgcatactctttggcagtggctcttgaactttctttattcagaatcatttggggcatttgataaaagtgcagatttccaaacccacccacaaagattctgatgcagtaagtccagggggcgaggggatactcagcaacgtgtcttttccaagcacacccaggtgattctttgcaggyggtctatggaccatatttggagaaacactgagatacaaggaggctattttcagcccaataaaagataggatttgggttatagtggtaccccaaagatgagatgacatgccttaagaggcagcattctcatcattgaagaaataaaagcagagaccaatctcttattgtcatgaggggattcacgaaattggatgagtcattggactagctgacccctaagccaccctccaattctgtgggtggatgatcctctgtgcttgcttcttctcctagtccgtgtatggcgtgactgaagagtcc

SEQ ID NO: 47620 - DNA, 601 bp, Human
cggggctcggggctcggtggcccacacctgtaatcccagcactttgtgaggctgaggcaggtggatcatctgaggtaaggagtttgagaccaggctgaccaatatgatgaaaccccatctctactaaaaatagaaaaaagttagccgggcttggtggcgtgtgactataatcccagctactcgggaggctgagacagcagaatcacttgaatctgagaggtggaggttgcagtgagctgagatcatgccgctgcactccagcctaggcaacagaatgagactctgtctcaaaaaaaaaaaagaaaaaaagaaaaaaaaaccacacagaaaaaaagctatttgatgattccagtcaagcatgccaaggacatgggtgtgacgtgcctgtgaaaggtgggcagaggaggggtcactggggattgttcaaaacaggtatttatggggcacatttcacctgtccatgctgttgctaagctacgtagaaaatacattgcctttaaattttggaaagcaagacttaaatcacaccacagtataggaggagatgagacaaaggctaaattgcagaatatgaatcttgtatgatagggatgtccagagg

SEQ ID NO: 47621 - DNA, 601 bp, Human
aacaggtatttatggggcacatttcacctgtccatgctgttgctaagctacgtagaaaatacattgcctttaaattttggaaagcaagacttaaatcacaccacagtataggaggagatgagacaaaggctaaattgcagaatatgaatcttgtatgatagggatgtccagaggcacaagtaatttgctggagggcagagctgagggagttggagatgtctggccagaggaggtatttggatcttggtggaaatgcaggatttgggtttgtggagcgaggggaaaaaaataattttagttkggtcttaacatctgtgttctctattttcccagataacatttttgaacgcacagatcgacagacattgtttgaaaatgtccaaagtggctgaaaggtatgttttcctttaataatattactactttcttctaatttaacagggaagaaatgttacagggttatggttaacgaatgtgttcaatgccaagagttagactgtagttattccttagactggggtgcagaaaaacccacaggctccatgtgagtataactaagataacagacctcccttgagtgatgtcaagaaatgttccgttg

SEQ ID NO: 47622 - DNA, 601 bp, Human
gccaagagttagactgtagttattccttagactggggtgcagaaaaacccacaggctccatgtgagtataactaagataacagacctcccttgagtgatgtcaagaaatgttccgttgctaaggctttacagggggtggccacgggaccttgtcaatcaaggaagaatgtcctttaaagctacataatgcacctttgccttcagcctctggattaattcaaatggaaattgctcccctttcagctataaaatgcccagattcactttataggggaaaagaaattatgtgtgtcctttgaggtgctggctgcatagacaggaggggactggatcatcgggaagtgttccgcctccacacgccatcaaccactgaactgcatcgaatcagctgtaaagaaaatatttggcccctccagcctggcttccacagcggtgtgtgtgcttcattctgcaccagtagctagttccactccgttaactcatgggagactcaattttatcaactaaatggtctgtttttttaactcttccgtgaagatgggagaccacatggggaatctatatggaataaatctaaccaggcagctcagtagtgaacatt

SEQ ID NO: 47623 - DNA, 601 bp, Human
cctgggtggggtgaaagtcactcccattgagaatgactgacactcctgctttttctatgcaaatgtgctggaaagttgccctggctggagctcagcttacactgaggtactgatcactctggagtcgctgtttcagctagctgtgtaggctgcagaatcacctcatacctcctctctcatcatgtgtggcttctggccagagtaccaggctctgaaaatgctttttaggtctcactgtggttcctttgccccagaaaggtggctgtgagtgaaacagcagcatggcctcaactctcttggkgtcatccatggcctgtgaggaaccacgagcttctttctctgtgaactagggacagaaatggctgtcctagtatactttgagggtcggtgtgctagcaatgctcatgtctggccttggaaggtggaagagctctttagggtttgcaatttagaaagagcgtatatatgggagcatctgtttctttggatctatttgctcaggtccagtggttctaagtaccgtaatccaggtgagggagggggttaaaaaatggaaattcccaagcctcagccctagggattcagattcagtggttccagg

SEQ ID NO: 47624 - DNA, 601 bp, Human
ttcgtgtgtcacagctgactgctgaattgattttttttagcatcatctcacttgcctgtatctgagattgccgctgctccctgaaattggatgctggttcttcctccacctcctgaccctcagtgatcatgaaatgtaattaatgaaatgagataagacagcaagggactggatacccctaagggtctattaaaaacctgctagggtgatagaggtttgggaacttaatgtctaattatagtttcaggggaggaaaaaagagggtcacagaagtcattacaactttgcttttatgggattycagaaaccatggggtctttgctcctcctttctcctagcctgttctaggtgacagaaaaaaaaaaagaccggaggtatcattacagccagggtgactgtatctagaccaagatatggaatctgtagcatgtggaaaagaaggggcctccatacctggcctggtgtaagctcttcttcctgcagggctgaattcaccttcatgctccttcactcatcccaagtttctctattgaatgtgttttctctgggtgacttgcaattaaggagttctctttttatattttccctacttcccaccttc

SEQ ID NO: 47625 - DNA, 601 bp, Human
ttgctcctcctttctcctagcctgttctaggtgacagaaaaaaaaaaagaccggaggtatcattacagccagggtgactgtatctagaccaagatatggaatctgtagcatgtggaaaagaaggggcctccatacctggcctggtgtaagctcttcttcctgcagggctgaattcaccttcatgctccttcactcatcccaagtttctctattgaatgtgttttctctgggtgacttgcaattaaggagttctctttttatattttccctacttcccaccttctccaagtgaaaaaaaaaragctagattaattaattaattgctaggaatcaaactttcttctttcctctccgcagtgctgctctgcttctcattttcctttctaatcagatccttcctgtcctggttctctgttgtgcatcacagttcagaaactgcatgtagcagagcgaggcgtgccagcatgctctcctcttcaccccctttaatattccgattccaggtcttctcatgtagaggctctgatttcataatgaatgctttagtgcatttgtactgtatttctaaagtaggactaatggtcgtatcccataatgcttt

SEQ ID NO: 47626 - DNA, 601 bp, Human
tgctcctcctttctcctagcctgttctaggtgacagaaaaaaaaaaagaccggaggtatcattacagccagggtgactgtatctagaccaagatatggaatctgtagcatgtggaaaagaaggggcctccatacctggcctggtgtaagctcttcttcctgcagggctgaattcaccttcatgctccttcactcatcccaagtttctctattgaatgtgttttctctgggtgacttgcaattaaggagttctctttttatattttccctacttcccaccttctccaagtgaaaaaaaaaaagctagattaattaattaattgctaggaatcaaactttcttctttcctctccgcagtgctgctctgcttctcattttcctttctaatcagatccttcctgtcctggttctctgttgtgcatcacagttcagaaactgcatgtagcagagcgaggcgtgccagcatgctctcctcttcaccccctttaatattccgattccaggtcttctcatgtagaggctctgatttcataatgaatgctttagtgcatttgtactgtatttctaaagtaggactaatggtcgtatcccataatgcttta

SEQ ID NO: 47627 - DNA, 601 bp, Human
atcccaagtttctctattgaatgtgttttctctgggtgacttgcaattaaggagttctctttttatattttccctacttcccaccttctccaagtgaaaaaaaaaaagctagattaattaattaattgctaggaatcaaactttcttctttcctctccgcagtgctgctctgcttctcattttcctttctaatcagatccttcctgtcctggttctctgttgtgcatcacagttcagaaactgcatgtagcagagcgaggcgtgccagcatgctctcctcttcaccccctttaatattccrattccaggtcttctcatgtagaggctctgatttcataatgaatgctttagtgcatttgtactgtatttctaaagtaggactaatggtcgtatcccataatgctttagattccaggcctcgtttttgttggattttgtttgtttgtttgtttgttttcctggatagtagtttcccatagctgcaggccatacttcactgtccctttttcctggagcctagccatgtcagtatctcttcatcttctccccacctgctccatatatgtgtccttagctctagggattcctcctaggcattgct

SEQ ID NO: 47628 - DNA, 601 bp, Human
attttgtttgtttgtttgtttgttttcctggatagtagtttcccatagctgcaggccatacttcactgtccctttttcctggagcctagccatgtcagtatctcttcatcttctccccacctgctccatatatgtgtccttagctctagggattcctcctaggcattgcttaactcaggatggacagcatttcttcttcctccaacttgtcatagttttgtgtggtttttttttggtggggggcggtcacatctatacaatttgtagcaaaattataagtcttttgttaagagagaaaggmtaaaatctacaacttttatttttgtcatattttctcaagtggttggactgtatgtttactaaattctctttcattatttccttcccctccatgtttatcaaaggtagaccctaattagcaatctaaattgggaaggttttgcattaataactgtcctcctaccaggattggttactattgttagaagctgtgactttgctgttagctcagctctaacaactctctgagatccagagagctgtttgctatttaatggcatagtaggctctgaataatggctactaaatgactgaccacaga

SEQ ID NO: 47629 - DNA, 601 bp, Human
aagacccattcttcctctctggtcctgcccactttccatgctgaccttattctctttcatgacagacatgtgttaggaaacatgacaccaccagcccttgaactttgtgactatacaactttgatatggtttggctgtatccccacccaaatctcatcttgaattgtagttcccataatccccacacgtgatgggagggacccagtgggaggtaattgaatcatgctggtgttttcccccatgctatgctcatgatagtaagttctcatgagacctgatggctttataaagggcttcccccttcattcagttctcattctccttcctgtcaccatgtgaagaaggacatgtttgcttccccttcccccatgattgtaagtttcctaggcctccccagccatgctgaaccatgagtcaattaaacctctttcctttataaattagccagtcttgggtatttcctcatagcagcaggagaatggactaatacaagcttctactgctgaagctggggaaagaagatatgaacctcacttgcgtcaggtatctgttcctggacaaatcaaccatggccaggagcagggcttataaataaatacat

SEQ ID NO: 47630 - DNA, 601 bp, Human
ctctagctaccaggcataaggcacctccagcccagactaaagagacaggagagcaaggaaagggtaaggagtccttgctttcatttcttgtgctgtttctgcacagtctgatgatgttgagaagcataagggaagaggagatcgccttccctctctgcccagcgtggggtgttctttcacctcctctcagtctttggctaccccagctgtgaagttaaccctctctgctactctctctgggaaggatcaccctcccctcccaccaagaagctgggagagcagttgaggcagcagactgctraatgcccaggtcacccatgggaaactccaagatgcactttgctgtctcctgtcttttccatgcaatgatgatggcaaataggacaaatgagggtgcatagattcatgaacactgggtttatttgcgtgggttgtgatagtggcagcaaaataaaacatggcggtgccattatgcaccttttatctactgccacactctcctccaggtgactttattttctacatagataaatatagtaagaaatacataataatacatttattttttcacataaattgcagtcaaactacacctgtggta

SEQ ID NO: 47631 - DNA, 601 bp, Human
caaggaatgcagggagcctctagaagctggaaaaaggcaagcaaatgaattcttccctagagcctccagaaggaacatcgccctgctgacaccttgattttagctcagtgagacccatttcagacttctgactcttagaattataagacaatacatttgtattgttttcagctgctaaatatgagataatctgttccagcagcccttagaaacaaatataaaaccccagtctctccccttctcatagaatctgaaggccaaattgttcatcctctttgtctttaatataccagcatctccragcaccccgctgactaggagtgcctcttatagccccaatacgtgtatgtctcattctgatgattcaatacttccttttcccatcaataaaatacaacattcaaaatatgtatgcccatctaattttactgtttcctttacaaagcctctgactttatttatgtaacttaacaaaatagatttccctcttctaatacaataaatttcccttccgaccagtaccactcatctctgacactggccagcagattagttgctcgtaatgactttggctttgttgcctggttcaggttgtcaggac

SEQ ID NO: 47632 - DNA, 601 bp, Human
ttgcctggttcaggttgtcaggactttctgtgttccttctccacgtgttcctctatagcatgtcttgacgcctcttgcctagaccttttttagcgaaggcatgacatggcacaagctcccaggaacaatttcattcatgcttaatgcctgttgcaaagtcatattttttgctcttatgttgggtggtcacaaaaatctcaccttgggctctcaaccacattctcctaaaccaacatcaccatgagctctcaccacctctcttccacccacttctctaatgatattccaggatttttcttaragagatctggctatgagcctgtatttcattacagcttaaataatcatattatttcccatttccttagttgctctctggacttttaagattctactgccttaggctggtcagcggacagctgccttcattgccatgcatatagtaataggcagccggagcctgcaggctcctcttgggaccaggtgctggctgaactctcaccacagcctctcctgagccttccctattgtcccctcagcccagcactcactcagggctccatatggggacttgtccacaggacctgacctggctggttgg

SEQ ID NO: 47633 - DNA, 601 bp, Human
tgctagaacacatttggggaggggtctgataaaaaccccagcctgtctcattgaaatctaaggaagcaagagggaggaggggaggacatttcatttttcaatccctatgttctacttcagggaaatctatttctggtcttaaaaaaaaattccccaataacgtaattaattaaaagaggtcctaccttttgccttgagctgccaagtggatgtcttttatttgagattcaaagctaactaaggctgagattattggaatggccagggcagatgtcctgggaggacaaagggggcccccccmccggctgtttgctcatctcagattttgagaatgccatggatgctgaaatgcctcataattgggagaaccccccaatatgtcatcgtgactcagatcctctggggcacctcagtacaactcgtcaccccctgaacaggatttcggttttctgctgctggcttgtctttgtgctgatctgagcaaaggagacaggtagcccagtgttctctctgtatccccacatccagcttgctctctcacattccctgtagtgggttgaatagtggagccccaaaagataggtcctaggccttacctgtg

SEQ ID NO: 47634 - DNA, 601 bp, Human
ctagaacacatttggggaggggtctgataaaaaccccagcctgtctcattgaaatctaaggaagcaagagggaggaggggaggacatttcatttttcaatccctatgttctacttcagggaaatctatttctggtcttaaaaaaaaattccccaataacgtaattaattaaaagaggtcctaccttttgccttgagctgccaagtggatgtcttttatttgagattcaaagctaactaaggctgagattattggaatggccagggcagatgtcctgggaggacaaagggggcccccccaccggctgtttgctcatctcagattttgagaatgccatggatgctgaaatgcctcataattgggagaaccccccaatatgtcatcgtgactcagatcctctggggcacctcagtacaactcgtcaccccctgaacaggatttcggttttctgctgctggcttgtctttgtgctgatctgagcaaaggagacaggtagcccagtgttctctctgtatccccacatccagcttgctctctcacattccctgtagtgggttgaatagtggagccccaaaagataggtcctaggccttacctgtgaa

SEQ ID NO: 47635 - DNA, 601 bp, Human
tgccagtgcagctggtttatggatcacacttccagtagcatgagatggcacctctgactaatttctctgcctgttcagcattaagctaattggccattattgccctttgcaattcagtagtaggaattgtggctctgactttgctgttgtgggagaagatgctgacacacaagctggcaatgcttaaggaaaaattttattgtggatcgataaccataaaaatattcataccttttggtcaaataattctgcttatggatatgcattctaaataaataacccagaagatgaaaaaaaaaaatctgtgtgaacaacggtgttctaccacagcactatgtatattaaaaaagaaaaaatctgtgtctaataaaaaggaaacgattaagtaaattgtaataaagtcactcaatgcaaccaagacaatattgtagacatatgttcatcttctccctttcctcaaatgcaacatgtcactaaaggaacaaaaatggcatgaactcacaaggttaacaaactattaataatttcaacacatttgtccaagatacaaagtttacgtaattggggaacataaccacaggcccctatgtctgtatttgtt

SEQ ID NO: 47636 - DNA, 601 bp, Human
gactaatttctctgcctgttcagcattaagctaattggccattattgccctttgcaattcagtagtaggaattgtggctctgactttgctgttgtgggagaagatgctgacacacaagctggcaatgcttaaggaaaaattttattgtggatcgataaccataaaaatattcataccttttggtcaaataattctgcttatggatatgcattctaaataaataacccagaagatgaaaaaaaaaaatctgtgtgaacaacggtgttctaccacagcactatgtatattaaaaaagaaaaaatctgtgtctaataaaaaggaaacgattaagtaaattgtaataaagtcactcaatgcaaccaagacaatattgtagacatatgttcatcttctccctttcctcaaatgcaacatgtcactaaaggaacaaaaatggcatgaactcacaaggttaacaaactattaataatttcaacacatttgtccaagatacaaagtttacgtaattggggaacataaccacaggcccctatgtctgtatttgttattttttatttttttaattggtcagcgagtacaaggtatcaaagtaaaatcttac

SEQ ID NO: 47637 - DNA, 601 bp, Human
aacatgtcactaaaggaacaaaaatggcatgaactcacaaggttaacaaactattaataatttcaacacatttgtccaagatacaaagtttacgtaattggggaacataaccacaggcccctatgtctgtatttgttattttttatttttttaattggtcagcgagtacaaggtatcaaagtaaaatcttacaatttttatacatttctgtatgcctgaaatatttcaaaatttaataaaaaagaaagtgcatagggacagagtaaagaacattctaacctacatgttgggggcagaagtratgtgacaaagtgagccagttttcgcaacaaagcctggccttggctcttgaaggcactagggaccatggaaagcaggaatgaggcatggggctaacagcagaggaatggtcaagtctgtcacaggagactttgcacccctagatctcctgccctactaggaaacaatccttcccacctaccaccactgcaggagatgggcagttttttcttgagagaaattgagccacatacgctcagaactcagacacatcagatctcataagaggccacctgaaaataagagaattaatggaagctct

SEQ ID NO: 47638 - DNA, 601 bp, Human
aaagaaagtgcatagggacagagtaaagaacattctaacctacatgttgggggcagaagtgatgtgacaaagtgagccagttttcgcaacaaagcctggccttggctcttgaaggcactagggaccatggaaagcaggaatgaggcatggggctaacagcagaggaatggtcaagtctgtcacaggagactttgcacccctagatctcctgccctactaggaaacaatccttcccacctaccaccactgcaggagatgggcagttttttcttgagagaaattgagccacatacgctcagawctcagacacatcagatctcataagaggccacctgaaaataagagaattaatggaagctctacgcactgaactgtggggcctgtagggatggaaagtgtgatacctttcctcatctaccataaggattacggccaacactgctataacaaaagaggttaacaagagaaaagcataaatgcatttatttcatcagtttcacatgacacagaagccttcagaaatgaagactcaaagacccagggaaaactgtatttgtgcttaggttccatgaagaatgggaagccttgtagaaatgtgatt

SEQ ID NO: 47639 - DNA, 601 bp, Human
gccttgtagaaatgtgattggacaaaagggtgtgatctactggtaacagactgaggggaggaaacccagcaaggcctgtctgttcagattcttcttagtgtctctgagtagcattcctacctcccaggtaggacctctctggaatgagggttttcaagggagaagggagcgagtgacctttctaggttttgtggcttgctttgcaggagaggcattctagtttctatgacccactttggcgaaaaagaattcttgtttctatgacttacgtcgggggagaaaaagggatgggagacggggkcaggagagaaggtgaaagccttggcttctgaggcccttccattctcctttagttcaaagtactcagcatgccaacatactatactttagggtatcatgttctgagccccaacagaccctcagcccctccccgaccctgctctcaggcctccaggagccagacatatatacccacaggcaagagactgtcaaagtacaacctgtgggccaaaccatactccattctgtttttgcaaataaagttttattagaacacagtcacacgcattcatttgcaagctgtctatggctgcttttatgc

SEQ ID NO: 47640 - DNA, 601 bp, Human
aaagtactcagcatgccaacatactatactttagggtatcatgttctgagccccaacagaccctcagcccctccccgaccctgctctcaggcctccaggagccagacatatatacccacaggcaagagactgtcaaagtacaacctgtgggccaaaccatactccattctgtttttgcaaataaagttttattagaacacagtcacacgcattcatttgcaagctgtctatggctgcttttatgccacagcagtagagctgagtagtggcaacagacaccatctggcccacaaagcctaaratatttactatctaggccctgcagaaaaagcttgccaatgcctgccctagggaaaaatagacgccccagaggaaagactccagatccctcatttggagctcccattaaaatactggtaaacttccctatgacaatgaagcccatcagtgacaagccccatccacacgcccactgagccgccaagcaggtttcagtacctcagtcttaagtacaaatggatgtccaaagattttccagacactccaggaaggctcagcgtgaaagagtataatcaaaataaaccgacagaaaaaaggaact

SEQ ID NO: 47641 - DNA, 601 bp, Human
tcaggatgtccaatattgaactggaaaaaaaatataggacaagcaaacaaaggaaacaaagggtttaaaattagtgatgaatactataaaattcctgataattattttcttatctatcacacactgtgcccagcatagtaaataacaacaaccagcaagggccatcatgaaattgcagaacactctagcaataaagagatgattctaagttgacagagagaaaagaaactgaaccaaagaacgagaatcaaaatggatccaggcttctcaatagtaacactgcataccagaaaaaaaaaaacatggagtgatgcctacaaatttctaaaggaaagagatttttcacctagtgttctgtgtctagcactatcagtcaagtatggagataaaagcatttttagacttgcaaggattctcatgcatcctttattaggaaactactaaaggatgtgcttcaacacaatcagggagtaaaagcaagagatagacatggaatccaggaaacatgggcttttcaacacagaagtgaaggaagtcccaaaaagatcattttccatcaagtctgtagagcaaatgatccagtttcgagcaagaagactaa

SEQ ID NO: 47642 - DNA, 601 bp, Human
gtcaagtatggagataaaagcatttttagacttgcaaggattctcatgcatcctttattaggaaactactaaaggatgtgcttcaacacaatcagggagtaaaagcaagagatagacatggaatccaggaaacatgggcttttcaacacagaagtgaaggaagtcccaaaaagatcattttccatcaagtctgtagagcaaatgatccagtttcgagcaagaagactaaagacttcaggaaagaggatctctgggaaacaagaggacagaactgctcaattatttgatgtgtttaaggtakaaaaaaatgattgctagatgttttacaggtttgttaaaacacttgcttggaaaaagcagtatgatatttagctgaacagcaaacaatttttatctagtttaataatgttacactgaccattgatttaacaaaaattgtaacacaaatctatttggaggatcacgtaagaaaaggagggagttgaggactggtgaatagaaagataaattcttgtctaaaataaaaaaatcaggaatagatataaaagcgtataatttagaaatatataggtagcttttagaaaaaacataaggtggaaag

SEQ ID NO: 47643 - DNA, 601 bp, Human
aatttttatctagtttaataatgttacactgaccattgatttaacaaaaattgtaacacaaatctatttggaggatcacgtaagaaaaggagggagttgaggactggtgaatagaaagataaattcttgtctaaaataaaaaaatcaggaatagatataaaagcgtataatttagaaatatataggtagcttttagaaaaaacataaggtggaaagtagatgcctctctgagaagggatgggaggaaaaaataattgcttttgcttttttagtatatataatcatttggtactattttatyattctaactattcacatacattttgataagaataaaaattagtctaaaataaattatatcaatctataagatcaacatatctattagatcataattataactagaaaagttgcttttttggaaaaaaatgcaaatgtttactccttgtggtctgctgatatttaaaagtctttatcataagaaagtccttccgttgggaatgctgagctggcagtctggtggagctgtagtgtcttttgtgtgttccagatgcctcgagaatcagtctttgtgggagggtggaacacaaacagttttgac

SEQ ID NO: 47644 - DNA, 601 bp, Human
tgttttaattaaaaacatcatcgatttaaacaaacaagagtgaagtatataaaatagtgaagttacctttgcctcccttaaatcccattcttcccagaggtatgttaacttgatatattttaaaccaacatttttgaacttgtatttctatgaacatttaaagaataactagtatatagtacgtatcttctttctaatatttctgatgagccctaggtagttccttctaagtcaagaacttaactctttctttaactcaggattttttttctcttttttaaaaattattgctgctttttttccattctatcctcacttttcaggaaatccttttttaagaagtctgggcctctgggatggagttgctacatcttttatattttctctattataatttccatcttttagtctttttattctatattcaaaggatacaatttcctgaattgctcttcagaatcactgctttgattttcactggtgtccattctgtgattttatactttagagagtttttcttttcccactgagtgttgggagagtggttgataatcaagcttttcatttccaagacttcttaatacttcttggactgttcttt

SEQ ID NO: 47645 - DNA, 601 bp, Human
tttaaaccaacatttttgaacttgtatttctatgaacatttaaagaataactagtatatagtacgtatcttctttctaatatttctgatgagccctaggtagttccttctaagtcaagaacttaactctttctttaactcaggattttttttctcttttttaaaaattattgctgctttttttccattctatcctcacttttcaggaaatccttttttaagaagtctgggcctctgggatggagttgctacatcttttatattttctctattataatttccatcttttagtctttttattytatattcaaaggatacaatttcctgaattgctcttcagaatcactgctttgattttcactggtgtccattctgtgattttatactttagagagtttttcttttcccactgagtgttgggagagtggttgataatcaagcttttcatttccaagacttcttaatacttcttggactgttcttttcttagtagcctgctctgttctattggtgtttatcatgttactccccctggagatgtgatatagatttttttcatagtttatattttttccatattttcatatctcctctctatttct

SEQ ID NO: 47646 - DNA, 601 bp, Human
ccccaccctcccaaacgcttcatgagaggaggggtttggtgggtgtgggtgaaggtttgtgggaaaggagagacagtgagaatgcaggactcccttaggaattcctgccaatctcaggtgggctttggacttcactgggctgggtgaaggggtccaggcaggctcgttatgatttccagggcccaggatgtcaccgacaatgtctaaattctgcaaggtggagaatatactgagtctgccgtggggaggttacagacagccaaatggaggatggccatagcagctgaatagaatcacggayaagatgacataggatatacaataaatagcagaaaattgtgctttaattctttctccttctcagacaagctattcgatctggaagtccaaggataagaaagttatattcagaggggaaaaaaaggcaactgttttaaaggatgggcaaactacacctcaagtttatgcaacatagtgagctgtgatcgcaccactccactcccgcctgggtgacagaacaagacccctaaagaaaaagagtaaattctgagaagtaaagtttaattaaagaaaatagtgattgccagggcttctcattgag

SEQ ID NO: 47647 - DNA, 601 bp, Human
agcccaagccgttggagaggccatgtgcagacagtctggtcagtagcctctgctgagctcctggtcagcaactagcatcagctgttaggtgatgagccctcctggatgcacagcccagtcaaatctccaaatgaccccacctccagctgccatccaactacaaccatgtgatccccaagtgagaaccacccagtggagcctagtcaacccataggagagtgaaagagactaataaatggcttttttaagcccctggattttaggatggtttgttacacagcgtaaataactgggccaggcrcggtgacttatgcctgtaatcccagcactttgggaggccgaggcaagcggatcacgaggtcaggagtttgagaccagcctggccaacatggtgaaaccccgtctctactaaaaatacaaaaattagctgggcatggtggcaggcagctgtaatcccaggtactcgggagcctgaggcaggagaatagtttgaacctgggaggcggaggttgcagtgagctgagatcgtgccattgcactccagcctgagcgacagggtgagactccatctcaagaaaagaaaggaaaagaaaagaaaaag

SEQ ID NO: 47648 - DNA, 601 bp, Human
cagtagcctctgctgagctcctggtcagcaactagcatcagctgttaggtgatgagccctcctggatgcacagcccagtcaaatctccaaatgaccccacctccagctgccatccaactacaaccatgtgatccccaagtgagaaccacccagtggagcctagtcaacccataggagagtgaaagagactaataaatggcttttttaagcccctggattttaggatggtttgttacacagcgtaaataactgggccaggcgcggtgacttatgcctgtaatcccagcactttgggaggccraggcaagcggatcacgaggtcaggagtttgagaccagcctggccaacatggtgaaaccccgtctctactaaaaatacaaaaattagctgggcatggtggcaggcagctgtaatcccaggtactcgggagcctgaggcaggagaatagtttgaacctgggaggcggaggttgcagtgagctgagatcgtgccattgcactccagcctgagcgacagggtgagactccatctcaagaaaagaaaggaaaagaaaagaaaaagaagtaactggaccactcttcattggagtattcaggaccct

SEQ ID NO: 47649 - DNA, 601 bp, Human
cagctgccatccaactacaaccatgtgatccccaagtgagaaccacccagtggagcctagtcaacccataggagagtgaaagagactaataaatggcttttttaagcccctggattttaggatggtttgttacacagcgtaaataactgggccaggcgcggtgacttatgcctgtaatcccagcactttgggaggccgaggcaagcggatcacgaggtcaggagtttgagaccagcctggccaacatggtgaaaccccgtctctactaaaaatacaaaaattagctgggcatggtggcagrcagctgtaatcccaggtactcgggagcctgaggcaggagaatagtttgaacctgggaggcggaggttgcagtgagctgagatcgtgccattgcactccagcctgagcgacagggtgagactccatctcaagaaaagaaaggaaaagaaaagaaaaagaagtaactggaccactcttcattggagtattcaggaccctcaggttgttcttgaggtattaaataaaattatgattgtttctttagtagccttggctctgagatggggacattggattattttctttttaaggaattgcctta

SEQ ID NO: 47650 - DNA, 601 bp, Human
cccatattgcagctttctgtggggaccccatcccaagtcactgggcaggagcatcctgatctacctaaattgaagagacgagttgatcctttaaaactgttctgctctcctactacatgtcccttgaactctgggcctatggtgcaagtggcagccctgatgaactctgaattgcttttgagtaattcttccattgtcttgaagaatagttcctggattctgttaagatgactcatccatactaatatacttatcaaacagtcacttggccacactattagtggtctcattttttgcataygaatagacaaagaatttttcagatcttcaggttctggtttctttttgtgcttaacaattctgtctttaagtcacgttttactataagtagtcaggaagagccaacctgcaccttcaacacattgcttagaaatttcctcagctaaatatttaatttcgttgcttgcaagttttacctttcacagaatactagaaccaaataaaattcagccaaattctttgccactttataacaaggatcaacttttctccagtttctggtgatatatgtctcatttatgtctaaaactcatcagaatgg

SEQ ID NO: 47651 - DNA, 601 bp, Human
tcctctggtaaagagtaaatggttgggtccatccttggtcatagcatgaccttggcagaaagagacaatgtcctgcagtctctggggcttaaatttactgccagcctcaaccccaggggaattcttccacaaacagtatttttggttcccttgaaagttattgagtttgattaggtctgtggcttgcgtttgagagaatccaggatttgtcttcatgtcttgttgtgaaaggcctagcctggtactttggaagaggtgtttcatggagtctcccattgtttgacctgatggggttagtctrccaccatgaccctattggactatgctggaaatgcagagttgcaagccagaggctccctgacctccaggctcatgatctattggtcatcatcattgtaattagaagatactgctgttgctgattatgtgtgttggtgaagaagtagttgggtttggatgcggtatgtctagagctgcataccaatatagtagccactagccacatgtagctatttaaatttaaatttgaatcatttaaaattaaatgaattttaaaattcagttcatcagtcacactagccagttttcaacagcccaatag

SEQ ID NO: 47652 - DNA, 601 bp, Human
gcaggaaattacactggacagcgccagtctacagttatttgctttcccaagctttccacgcacacaagctcctttttttttttttttttttttttttttttttactaagtggaattttccaagtattgagaatatgtcagctccataataagaggaaacatgatttaatctcttactgtctgttggaaataataaaatatatgcatctattttttaaaagaggaaaaatgagtattgctagaccaatgtttcccaatttgtaatgtggacataaatcacctagggttcttgttgaactgtmggttctgatttagcaggtgcaggtggggcctatggttcttcttctggttcacagaccacaccttgaatagggaagagttgtagcatgtgacttgtgagttaggaccttatcactgtttaaagggccaaggacataaatacagcaagtgaactttaaatggaaagacagaagctgaaggaaatactcttatcgcccaacaccagaagaattagaccaatgcccattctttagtctgaatgtgagacagcatagcaaagatgagctatgcagcatggcagaattaagaactggggccgggtg

SEQ ID NO: 47653 - DNA, 601 bp, Human
tggttcttcttctggttcacagaccacaccttgaatagggaagagttgtagcatgtgacttgtgagttaggaccttatcactgtttaaagggccaaggacataaatacagcaagtgaactttaaatggaaagacagaagctgaaggaaatactcttatcgcccaacaccagaagaattagaccaatgcccattctttagtctgaatgtgagacagcatagcaaagatgagctatgcagcatggcagaattaagaactggggccgggtgcagtggctcacacctgtaatcccagcactttgrgaggctgaggcgggtggatcacgaggtcaggagattgagaccatcctggctaacatggtgaaaccctgtctctactaaaaatacaaaaaaattagccagacgtggtggtacgcacctgtagtccccgctattcgggaggctgaggcaggagcattgcttgaacccggcgggcagaggttgcagtgagccacaatcacgccactgcactccagcctgggcggcaaagtgagactccatctcaagaaaaaaaaaaaaaaaagacctggtgccctctggagccttgctgtctagatttgattc

SEQ ID NO: 47654 - DNA, 601 bp, Human
gccaaggacataaatacagcaagtgaactttaaatggaaagacagaagctgaaggaaatactcttatcgcccaacaccagaagaattagaccaatgcccattctttagtctgaatgtgagacagcatagcaaagatgagctatgcagcatggcagaattaagaactggggccgggtgcagtggctcacacctgtaatcccagcactttgggaggctgaggcgggtggatcacgaggtcaggagattgagaccatcctggctaacatggtgaaaccctgtctctactaaaaatacaaaaaaattagccagacgtggtggtacgcacctgtagtccccgctattcgggaggctgaggcaggagcattgcttgaacccggcgggcagaggttgcagtgagccacaatcacgccactgcactccagcctgggcggcaaagtgagactccatctcaagaaaaaaaaaaaaaaaagacctggtgccctctggagccttgctgtctagatttgattcttgacttcattacttcctagctgtgtattcttaggcaaactaccatgagacctcaccttccctatctggaaaatgggaatcatactagtac

SEQ ID NO: 47655 - DNA, 601 bp, Human
tcttatcgcccaacaccagaagaattagaccaatgcccattctttagtctgaatgtgagacagcatagcaaagatgagctatgcagcatggcagaattaagaactggggccgggtgcagtggctcacacctgtaatcccagcactttgggaggctgaggcgggtggatcacgaggtcaggagattgagaccatcctggctaacatggtgaaaccctgtctctactaaaaatacaaaaaaattagccagacgtggtggtacgcacctgtagtccccgctattcgggaggctgaggcaggagmattgcttgaacccggcgggcagaggttgcagtgagccacaatcacgccactgcactccagcctgggcggcaaagtgagactccatctcaagaaaaaaaaaaaaaaaagacctggtgccctctggagccttgctgtctagatttgattcttgacttcattacttcctagctgtgtattcttaggcaaactaccatgagacctcaccttccctatctggaaaatgggaatcatactagtacatttttcacagagcagttgtgaggactcagtgggttaacagatgtaaaatgcttgagacgg

SEQ ID NO: 47656 - DNA, 601 bp, Human
ggtgaaaccctgtctctactaaaaatacaaaaaaattagccagacgtggtggtacgcacctgtagtccccgctattcgggaggctgaggcaggagcattgcttgaacccggcgggcagaggttgcagtgagccacaatcacgccactgcactccagcctgggcggcaaagtgagactccatctcaagaaaaaaaaaaaaaaaagacctggtgccctctggagccttgctgtctagatttgattcttgacttcattacttcctagctgtgtattcttaggcaaactaccatgagacctcacyttccctatctggaaaatgggaatcatactagtacatttttcacagagcagttgtgaggactcagtgggttaacagatgtaaaatgcttgagacggtgtctagcacacggtaagcactgtgcatggttgttaaatcaataagtgcatgtaacattctgcttctaacaagagaatatgctttactctggatgtgtcaatacatttctgaccagttgtacatcacttggcttgaaacaggaccataatttctcccctgaggattgaggaaggggtgggaggtggaggatagtgtgttttgatg

SEQ ID NO: 47657 - DNA, 601 bp, Human
aaaccctgtctctactaaaaatacaaaaaaattagccagacgtggtggtacgcacctgtagtccccgctattcgggaggctgaggcaggagcattgcttgaacccggcgggcagaggttgcagtgagccacaatcacgccactgcactccagcctgggcggcaaagtgagactccatctcaagaaaaaaaaaaaaaaaagacctggtgccctctggagccttgctgtctagatttgattcttgacttcattacttcctagctgtgtattcttaggcaaactaccatgagacctcaccttcyctatctggaaaatgggaatcatactagtacatttttcacagagcagttgtgaggactcagtgggttaacagatgtaaaatgcttgagacggtgtctagcacacggtaagcactgtgcatggttgttaaatcaataagtgcatgtaacattctgcttctaacaagagaatatgctttactctggatgtgtcaatacatttctgaccagttgtacatcacttggcttgaaacaggaccataatttctcccctgaggattgaggaaggggtgggaggtggaggatagtgtgttttgatgaaag

SEQ ID NO: 47658 - DNA, 601 bp, Human
cggcgggcagaggttgcagtgagccacaatcacgccactgcactccagcctgggcggcaaagtgagactccatctcaagaaaaaaaaaaaaaaaagacctggtgccctctggagccttgctgtctagatttgattcttgacttcattacttcctagctgtgtattcttaggcaaactaccatgagacctcaccttccctatctggaaaatgggaatcatactagtacatttttcacagagcagttgtgaggactcagtgggttaacagatgtaaaatgcttgagacggtgtctagcacacrgtaagcactgtgcatggttgttaaatcaataagtgcatgtaacattctgcttctaacaagagaatatgctttactctggatgtgtcaatacatttctgaccagttgtacatcacttggcttgaaacaggaccataatttctcccctgaggattgaggaaggggtgggaggtggaggatagtgtgttttgatgaaagattgggtccatgaagcatcctgggttatagtactagtgaaaaaattagagtcaaaagttgagtccataattgataggaatggtccagggagtttaatcaatggc

SEQ ID NO: 47659 - DNA, 601 bp, Human
ccccaaagcaaagagcccagccaacagcgagtaaaaagatggggcttctctttcgatgagatattgaaggaccaggtggggcgggaccagtttctacgattcctggagtccgaattcagttcagaaaacctcaggtaaatctctcaaagtttgagctgtgtgcggaatgtgtgtgaagaaatttgcataatcggtctctccatctctctctctctcaatgaaacgttatcagggttcaaattcaaatgccagctaatctggctgaggttgaaatggagaagaacaaattaaaatatgtaaytctgtcaccaccataatagcacctactaacaccagcatgtttcagttcaagtctatatgacctttgtgcgactaattggaaataagtcttcaataataattagtcaaacggatttgacaacatcattcattaagtacagccatagaaccagggagcttcagagtggagaggcatctcagaggctgtctcctcaaaacttcccagtctggggtcctgaatatctgagaagctaaacggaagagggagaagtcagtgggctcatttcagaatttcaaagagcaaagtaaatatcactcagta

SEQ ID NO: 47660 - DNA, 601 bp, Human
ttctctttcgatgagatattgaaggaccaggtggggcgggaccagtttctacgattcctggagtccgaattcagttcagaaaacctcaggtaaatctctcaaagtttgagctgtgtgcggaatgtgtgtgaagaaatttgcataatcggtctctccatctctctctctctcaatgaaacgttatcagggttcaaattcaaatgccagctaatctggctgaggttgaaatggagaagaacaaattaaaatatgtaactctgtcaccaccataatagcacctactaacaccagcatgtttcarttcaagtctatatgacctttgtgcgactaattggaaataagtcttcaataataattagtcaaacggatttgacaacatcattcattaagtacagccatagaaccagggagcttcagagtggagaggcatctcagaggctgtctcctcaaaacttcccagtctggggtcctgaatatctgagaagctaaacggaagagggagaagtcagtgggctcatttcagaatttcaaagagcaaagtaaatatcactcagtaactggtgatgtaactgtagcagctacgtaacagtagcagctaata

SEQ ID NO: 47661 - DNA, 601 bp, Human
ctctctctctcaatgaaacgttatcagggttcaaattcaaatgccagctaatctggctgaggttgaaatggagaagaacaaattaaaatatgtaactctgtcaccaccataatagcacctactaacaccagcatgtttcagttcaagtctatatgacctttgtgcgactaattggaaataagtcttcaataataattagtcaaacggatttgacaacatcattcattaagtacagccatagaaccagggagcttcagagtggagaggcatctcagaggctgtctcctcaaaacttcccagwctggggtcctgaatatctgagaagctaaacggaagagggagaagtcagtgggctcatttcagaatttcaaagagcaaagtaaatatcactcagtaactggtgatgtaactgtagcagctacgtaacagtagcagctaataaaaacatgcttttttcttttagaacgacttctgtcgactccaaatagtggttactctgatcatctgacgccagtgagaacacctgattgttcctattggtctataactaatacttgatgagggaaatgtattaataattactatttaataggagaaaaaa

SEQ ID NO: 47662 - DNA, 601 bp, Human
gccagctaatctggctgaggttgaaatggagaagaacaaattaaaatatgtaactctgtcaccaccataatagcacctactaacaccagcatgtttcagttcaagtctatatgacctttgtgcgactaattggaaataagtcttcaataataattagtcaaacggatttgacaacatcattcattaagtacagccatagaaccagggagcttcagagtggagaggcatctcagaggctgtctcctcaaaacttcccagtctggggtcctgaatatctgagaagctaaacggaagagggagragtcagtgggctcatttcagaatttcaaagagcaaagtaaatatcactcagtaactggtgatgtaactgtagcagctacgtaacagtagcagctaataaaaacatgcttttttcttttagaacgacttctgtcgactccaaatagtggttactctgatcatctgacgccagtgagaacacctgattgttcctattggtctataactaatacttgatgagggaaatgtattaataattactatttaataggagaaaaaaataagatattcaaaacctcaggtccaatatgagaggaagaaa

SEQ ID NO: 47663 - DNA, 601 bp, Human
atggagaagaacaaattaaaatatgtaactctgtcaccaccataatagcacctactaacaccagcatgtttcagttcaagtctatatgacctttgtgcgactaattggaaataagtcttcaataataattagtcaaacggatttgacaacatcattcattaagtacagccatagaaccagggagcttcagagtggagaggcatctcagaggctgtctcctcaaaacttcccagtctggggtcctgaatatctgagaagctaaacggaagagggagaagtcagtgggctcatttcagaattycaaagagcaaagtaaatatcactcagtaactggtgatgtaactgtagcagctacgtaacagtagcagctaataaaaacatgcttttttcttttagaacgacttctgtcgactccaaatagtggttactctgatcatctgacgccagtgagaacacctgattgttcctattggtctataactaatacttgatgagggaaatgtattaataattactatttaataggagaaaaaaataagatattcaaaacctcaggtccaatatgagaggaagaaaagggggtgaattgaaaggaaaagtc

SEQ ID NO: 47664 - DNA, 601 bp, Human
agaaaagggggtgaattgaaaggaaaagtctccttggttatgaaaaatttgggaacttgtttatttagacttttatggtattagatgaagaatcagaaatctgcagaaaatgtgacttatctgagacttatctagtgatcttagcaaactggtgactttttaatgggtaagatggaatctctctctttcttttttctttgtaccagattttggtttatatagtagagtaacacccatcttccagtgctgttttctttaaagatgtcttaataatgtttcaatattgtattactttaaaaaytcagagcatgtgctgcgggcaaaggactgcccctccaaagttaatgtgcaacatccatgcacttatttgaagttgagaccatcggtcccatacgtcaatcaagtgatatttatgctacacctgtgctgtatcaagccctgtgagagtctgctgagagatgcaagtcaagatgtgtgatctttgcctgtaacgaccttgtaggtccttgaggaaaaaacacaagaaatgattaaatcattgaatgtctataaatgagtgtaaactctaagaaccatttcgaaagcatttaaaggagaagaa

SEQ ID NO: 47665 - DNA, 601 bp, Human
agaaatctgcagaaaatgtgacttatctgagacttatctagtgatcttagcaaactggtgactttttaatgggtaagatggaatctctctctttcttttttctttgtaccagattttggtttatatagtagagtaacacccatcttccagtgctgttttctttaaagatgtcttaataatgtttcaatattgtattactttaaaaactcagagcatgtgctgcgggcaaaggactgcccctccaaagttaatgtgcaacatccatgcacttatttgaagttgagaccatcggtcccatacrtcaatcaagtgatatttatgctacacctgtgctgtatcaagccctgtgagagtctgctgagagatgcaagtcaagatgtgtgatctttgcctgtaacgaccttgtaggtccttgaggaaaaaacacaagaaatgattaaatcattgaatgtctataaatgagtgtaaactctaagaaccatttcgaaagcatttaaaggagaagaatcaaagctgaagtagttaaatcataagctggactttgaagaatacacaggataatagtagacgaagaagcaggagagagaatattccaagctgg

SEQ ID NO: 47666 - DNA, 601 bp, Human
gaaaggaaatagaatagcagggaggaaaaggatagccaagagcctctaaaatcctctctggatgcccaaattccatttttatgatattcagcataactggatacatggtgggtgagagagaagctcagtcgtaaatcacataactgtaggactcttcagtcacccatcacagggcagccttttccccgttccattgcgttcatcccttcagctgcagatatcatcttagcaccaaccgtggcacagggctggcggatttagagctgactgagtaaatatcagggtggccaggcatggctayacagatgcacctccactgtggctcatgccatggaggcccctgggagttgtgcaatatggcacaacttgaggatcctgccaacctgtcatgttggccgtgctggagtcgtcccttctccgcaggattggtgaggggcccaggccactggcattggagcatggcaggaaaaagcctgaccagaactcacctgggtaaattacaaagtgcttctccacttcctctgtcctcctgtgctccctctcatctctccagtgaaagggctgcttagatcataacattcttgcacaacccacggggtgc

SEQ ID NO: 47667 - DNA, 601 bp, Human
agggagaagcaattaaaagagaacacagtggggcaccaggttcatctcgagagctcttgtctctggcagttgccctgagtccaaggaagacctcagaaggttcactaggcccagcaggatccaccacttaccaaacccatgattaataggaacagaggtgactcccacgacaccacaaccatctgcagtgtttcagtcactgcccagtgaacagaactcagcttcagtggtgctgggggtggttactaacgtaggcaccccggaattttagccccaccgggaactaaaccaagtttaagcyctgctgcctacgtctctggttgaccagcagagggcatagaaacactttcttctctcctggagtttgctttttctctgggagcgaaccaaaagctgtattttctaacccatgaaaattctagtttatgaaaagatatgtaaactggtgactgagggcctgcccagacctcctggtaggatggagaatgatcaagggccaaatggtttgtcttacccagccagccttgagaaaatcctcttccttgaaagcctctagggagaaaggaggctcccactggggcagcccctggatggtcctcca

SEQ ID NO: 47668 - DNA, 601 bp, Human
ctactcaggaggctgaggcaggagaatagcttgaacctgagaggcggaggttgcagtgagccgagatgtagccactgcactccagtttgggtgacagatcatgaccctgtctcaaaaaaattgattatgaaatttgtatttccatcagctccggtcatctctatatccagctgagtgatgtacattttcatgtggcacccaaatcatcctgcaaaaaggaccctgagccctcaggaaccgcagggagcctgcagagctcccagggtcctcagggccttcccacaggggctcagcagctccycctcagtgctgacagaggtgacagaaagtgacctcccatgtggcattgattgagggggcaggaaatcacccaggtgtcatccatttgtgtgagaagttgcaggggcccagggggcgtgggaagacgctgacccagaaggttgcttccagccagggattcagcccagacggcctccctctgtgaacctggttctcctgtctgcctagcatggggctgaggaagcctcactgacttcgtctctggacatttgaccccttctgggccttggaaaagccaacactggcttcttcctatagagcc

SEQ ID NO: 47669 - DNA, 601 bp, Human
acctactctcttactcactgatgggggagctggcctgtccatgcacagggcaaaggatatgacacccagacctggatcctgctgcaaggctgccttgggaaccatccttaagacccggtagctgttgtccaagctttggctctggctgctgctgctctcagcagaaaagagctcactgctcccatgcgatgctgagggattaaacagaggcaaatacggaagtgagcagatttttctctcttgctctctgcagaaggagaaccattctgcagagaagttttcaacatatgcctcttcagcwttgctccagatgcgtccgtcttcactctgaaacccatatattgagcacctactatttgccaagcaccgtgctgagcactgatgtgaattggctcagtttctccatctataataggaatggctggttcattcttacacagatagtctttatgattccaggacactgcctgcttctgggatctctcctccattttgatgccatcacttgatcccaactagatttgacaaagggtctcacactgtctgcatggtggcatgtatgtagcactggggttctcaaccaggaatgagttcatctccc

SEQ ID NO: 47670 - DNA, 601 bp, Human
aggcttgtaataagtcagtgatagaatctggaaaccagaacacagcattggggaagtgggtgtagtgagttagcagggccatgagtcaaacccacatctgtctacctctgaagcccacactgataaccacctctctacactgcttccgcagtgatctccagctctgcagtgaatattttttaagcacatctatattccaggctctgcgctatgtgataagataccacaaagaacaggcaaaacccctgttctcaccgaggttgagtgggagacagacaagtaaatgggcaacttcaacagygtgaaaagtgccccaaatgggtgaaccctaggttaaagcaagcctgcaggagggactcccaaccctgtaggacacaattaagatgctcacagatgctagtgatgctggctaaagaaacaggaaccaccctaaccagcagactaaattttgacggctgggaggtgccatttctaaaaataagcattgggttggtttcttacttcctggcccctaatttctatttcctgtcaccatcccacacccagtgacagggcttaagattttgcttatctccttgaccccacttacttctctcacctc

SEQ ID NO: 47671 - DNA, 601 bp, Human
agacatgaggatgtcttaagcatccccatcttcttcattatctgctaggattagtctcccatgaattcaaataaaacactcttcctaagccaatccctattttcagaccaatttcctattgcttctgaagtgtatttccaccataaatatacaaagtgttcctttctagcagagtgaccttggacaagttgcttaaattccctgagtcttcctttcctcatctgtagaacagggatacaatggagcctacacataggggtggaatggggaccaggtgaaaggaagcatgtcaaccactaaygatgtctggcccacaataagacagagtaaatactaccatcttatttttctaatgtcactaatattctctttttaagccgtagtgtttaatgtatttggtaaaaatttttaaataatttcacataaccttagcacccagagataacccctattttggtgtattttcttccttgatttatgtgtgtagctacgtgtaaggtctgctcaggctgctaccacaaaatagcacacactgggtggcttaaactacagaaatttatcacagttctcgagactgacaaatccaaaattaaggtgtcag

SEQ ID NO: 47672 - DNA, 601 bp, Human
agacacaacattcattccacaacagggcgattttgcaaatagcgtgatcctgtaacctgccttttacctaaaacaggggtcagttaaaaaactatacttttcctaaaaagagccagatagtagacattgcaggctttgtgagtcatgtggtctatgtcacaactattcgattctgcatacaaaagcagctacaatgcaacaacatagcaatgtaaacaacataaatgaggacctatggctgtgtttatttatgaacagtgaaatccaatttcatataatttttcacaaaatacaattcttcttttagtttttttcagccacttaaaaacataaaaactgttcttcgctcatgggatgtaaagatctagatcacaggtctgtatctgtagatttgaatcacagactgtagtttgtgaccctgtgctaaataaaatctagcacatggtcatgaaaattattgaaatgcttcaagaaatccagaaagctacaggatagaggattgggcataaaggatcttcagtttttgggggagagtaagttagaggagacttggttttgacgcagccatggcaacacagcaatctgaattgtgaatgtttct

SEQ ID NO: 47673 - DNA, 601 bp, Human
ggtggtcgcactgagacctggagaagttctagtccctagagaaaggccaagagtctgggagttccttctagaattatccatttaagttctttaaactttctcttctcggtttgcctctctgttaaatggggatgttaacacctcagcccatggggctcaggggctctgggtggcttcctcagctggtcatgatggttctcataaaccccctgcagtggtcatatgctttaatattagtgctcagtagcctgagagaaagtacagccagatttatggattcactggaagcagggactggggktggggtgcagcctctctccaatgggttttgtttcttatttgaccacacgcattgttagagccaagttaattgcctgtatttgcttcctgtggaaatatttcacaagacaccctgttatcgtgggcccagcatttgtacttgtgttttgctgatccgtttagcttttttgaaaattttgggccaagaccaaatcttccataaaggtctgtgggctgtgaccatagtcctcagctgtttgctgtgttgttccaatttcatagatttagccttgtgaggggagaaaaatatataggccatgat

SEQ ID NO: 47674 - DNA, 601 bp, Human
aagggccttgaccttttgtgccttagtttcctcatctgggtgatgggggtgatgtcttctttacagcccgctaaggatttcagagaaatcagatgagctaatagccctgaaaaatctttgaaaaagtaaaaagtgctatatatttgtaagtgtgaactcacaaaaattaatgactttagtactctctggggtttcgtaattctaagctggatccaaaagaaattctctcaaaatatctgcccttagatgggaaaaaatgccagaaaaggatgtaagaactgaattttcaggtcctggaatrcatcctaaggaatttgagcttctcatcctgaagacagtagcaaagcattgcaggcttttacctggaagatggtgaatcccatggtgatgggcatagtaggctggagccaagagagagttctgaaccctggggcatgtcatataaagctctgctggcagttgttggtggagagaattaaaccacaggaagtattgagaaccttcagcttccttgtagggcatttgtctctttccaaagccttcacaggctctagatgagatagaaatcaaatgccagcacagtggctgcctggcttccatt

SEQ ID NO: 47675 - DNA, 601 bp, Human
attggaaatctgtcctttaagtggactgatagtggaataggacaagccagtccagccccattggctttgatccttgcagtttcccacctcaccttcctactcgtcccagccccactgctttcctgacctgtggtacctgctaagatgccccaccctgccctgtacctggagtgtctgggccttccagacctctggatttgaaagttatttcatgggagcagaaatttggtcttctttaccttttataagttcctgcatcacaaaggtaatgctgaatgctgaatgtcagctaaatgctgayaattcattccagaattataacattttcagctgtgcctatcaaagaagcgggggacaatttgtcccttagctttcaactttggagagacaaccttggggagtacacctagtagatagtcaagaaaagcaggttaaattaaattcctacaatgtgccgattcagcaaaacttggaatacccactaagtgtcagatgttctaggcgctgtgaatatacaaatgcgtagggaggttcctttccttaagcggccctgggtctgacttaccacagctctgcttggccttgatgaactcacaaaagg

SEQ ID NO: 47676 - DNA, 601 bp, Human
agaaagataccgtcaagtccacatccgccatgagcagacaagaagcctctagcaaaacgtttatattattacctaagtgtagatgtttaaatgcaacttgattaaggaatgcaaggtttctaccatttgctttgtttaaaagccaaagcccagtagagtatgattttaggtttgcccagattattcagaagtagaagtcttcccagctgttcatctttgctccagtggtggaggtggcggcattgcgtgccagtatcacaagaccacaccaagtttcctggtattaatcctctattggaargcatttcctggtagactctcatgccagacatattttaataaggaattctgtgacactgcttgctctgggggttgctcattttatcctgtaggtggttttatttttgggagatgaacagcagagggagggatgcattttgcagagaataaatcagtcatttgtgatccagttctgtttattaccacacagactagtagttcctgacagctactgagagaagacgtcaaagagttcaattccaaaatttcttggttgctacatctaagcatagattccttataccaaaccccatgacctcct

SEQ ID NO: 47677 - DNA, 601 bp, Human
atggtggtcaagggctagcagtgggattggtgtggtgagaccacctcatgggactcatgctccagtaggttgtgttcttattctcttatctttctccccacaccatcctcaccttggtatctggctttggagttggccatatgacatggagaagatgagagtggtgtccaaactgctcctctgacccacatgggcctcctgagagtggacaacctctctctgctgccctttcctccttgccccttgattgtctttctcctctgattgatcagactgtgaagctgcaagaccagaccccccsctccctgcaatcccacagaattaggagacatatttctgtctctctacacagatctttccactttgatgaggatctttctggttgagagaccaccattccccacttgtagcaggataggtcatccccaggtatacacattcataccctgtgcctgtacttcatctctgcagcccttagctgaattggctaaatgcgtctctgtgcaaagtctatcttgcctagttggatctaagctttatgacattagaggccgatttgtcttattcaggctgttatctcagcgtctgacacagtgccctg

SEQ ID NO: 47678 - DNA, 601 bp, Human
aatcccacagaattaggagacatatttctgtctctctacacagatctttccactttgatgaggatctttctggttgagagaccaccattccccacttgtagcaggataggtcatccccaggtatacacattcataccctgtgcctgtacttcatctctgcagcccttagctgaattggctaaatgcgtctctgtgcaaagtctatcttgcctagttggatctaagctttatgacattagaggccgatttgtcttattcaggctgttatctcagcgtctgacacagtgccctggcacctagyaaatgctcaataactatttgctgaatattattttgattcagtgtttagacatctgctttatcctgctctattttgattgacaagttctttctcttcatgaaccaggcttttccctcctacaatgagtctataagaattagctagatcagaggggaatttggtgctgagccagaagagctgtctaggggaggtttcctcacttcttatggggcagcagaggggtattgtgagatattgagaagtcagaacaagaagcagggaactgttgctttggagaagggtctggagaggttccaggca

SEQ ID NO: 47679 - DNA, 601 bp, Human
agcctgggcaacagagcgaagactccatctcaaaaagaaaatgttagaacaatttaaagagacaacaaatgaaaccaaagaccaatgatacccctcagcctgggctctgagaccattagggatggctgagccaagattttcatgctcctctgagctgagtgtaatcctcattctccttctgtgcagagagcaggaacttgatgcagtcataaacccaagcaagtatggagccagtaaacttgctgaacattaaattccaaccggcatttcagtgaacatgtatattcgactaatatctgascctgtgctagacagtatgcatctgtaaaagataaacacatactgttcctcaaggcacttaaacaagagtgagctggatttttgtctgaaattttcagaaaaacacttagtgaagtgtgttcacactaagtttgttaaatcagaatacgtctggactatccaagtagtctcagaaccaggccactattggaggctgggcgcggtggctcacgcctgtaatcccagcactttgggaggctgaaacaggtggatcacttgaggccaggagttcgagaccagcctggccaacatggggaaaccc

SEQ ID NO: 47680 - DNA, 601 bp, Human
ggataaatcaagccatttaacatatgcgtggtctcatacacttattgtttgtagtgagaacacttaaaatctactctcagcaattttcaagtatataatatattgtttttaactgcagtctgtagtcaccgtaatgttcaagagacctcttcaacttattcttcctctctaattatgtggtgtcctttgaccaatgtcttcccagtccttctcactccccacagcccctggtagaatggccattctgctctctgcttctgtgagtgtgattgtcttagattccatatacaggcacatctcrttttattgcacttccctgtattatgccttatagattctgtgttttttacaaattgaaggtttgtggcaaccctgcatcaaacaagtctatcagcaccatttttccaatagcatgtgcttactttgtgtctgtgtcacagtttggtaattcttgcaacattaagcttttttagtatgattatatgtttatggtgatctgtgattggtgatctttgatgttactattgtaattgctctgggggtgcccaactgcacccgtataagacaatgaacttaatacatgttgtgtgtgtgtgttttc

SEQ ID NO: 47681 - DNA, 601 bp, Human
caatggccaccctctgtgagccagaggataagaataacaggccgacaatgccagctgcagggcccaggactggcctgacttgagccaagtgtatgccacccaggctggccacagggttcaagctgagtcctgccatccccagaatagagacttggtatggtacccggggccaagcatgagtccttcagttcctagtacaagaagaaaggccagcccaactctgtggtgttatgtcgtttgtgttgtattttccttctgcaacctcatatctgtcttctggcagccagctgagctgacaagrggcctggctgccaaggaagccccccaacttcatccacacaggcggctgcctttggcctgtcccctctgctttcagcacagtccgcagacccacagacctcaggctgcctctttagctccctcatttcagttatttgctgggtgtatgtttgtgtctatgtgagtgtgtgcactctccgaacttctcagcctcgggctcaggaccctggaacgggatccaggatacactagcaggtatttgagcggtcattctactctcccggaacccctgcagctaggaaatgtggggtgaaaggaaagt

SEQ ID NO: 47682 - DNA, 601 bp, Human
gggaatctcaagagagaaaacagtcctaaggcagactcatggatgagtagataacttcgcttccccggcagccccttcctgacgtccctcccacaccctgctggctctcagagccagtctgttctgtgtcaggacttggggggcccccagggccccagggccacaaccaccagggctcctgcctgtgggcacggcaggttgaaagcagcaagcaagctgctcaaacccaccgactgtggtcctgcagcaaagtcatgatggttctgatccaagccccgcaagcaccattcatggcccccgsagaagcaaagcccccctctctgctccctgctccaaggaggcggcaccatttctcgtgggcttctgtcttctgtctctcccgttgactcttccaacagctctggctgcttctcttttcccatttttcgccccattttgctttggtttttgttattctttagctgcagctgctgctgtttgggaaccacgtataagctgaagattttttttttctgtatttttctccctacccttttttttttttcctaaagccagaaagtgagcaaggtcgtagaacttccctagaaaagttcactcgcag

SEQ ID NO: 47683 - DNA, 601 bp, Human
attgacttgcctttgttccacctctgttgaggaggaaaatccttgtaaaacctgactactgtgtgactggtatacgtatttcatccttttaagaaaaagtctaaggctcctgggttgaaagcagcctagtcatttacgtgtcgtagctagatgcattttaagtgcatttaaacattatcttgaatttgctacatgtaaacctcaaataactctagtgggtggcaattaattaaacatcggtatccatcccttcccttcctcggtcttccctctctgtggcctttcctcatgagaaatcagwatgtgcagaacacaaggcctgcgggtgcctggtctatcttcatggctgctttgccaatggccgtgtggctccgcacaccaagaagctgccacgggctgtcagagtcaaggcttctgggacttccttcactccatgatggcctgagagaaggtagtgggatcccatctctctctgtttgtctcttttgaggactggctactgtgcgggtggaggatggttagggattttgctgacaagccaagggtgcctgtgtaagcagagccttgacagcccccggaagctcttgagggtgaccgtgca

SEQ ID NO: 47684 - DNA, 601 bp, Human
gcagaacacaaggcctgcgggtgcctggtctatcttcatggctgctttgccaatggccgtgtggctccgcacaccaagaagctgccacgggctgtcagagtcaaggcttctgggacttccttcactccatgatggcctgagagaaggtagtgggatcccatctctctctgtttgtctcttttgaggactggctactgtgcgggtggaggatggttagggattttgctgacaagccaagggtgcctgtgtaagcagagccttgacagcccccggaagctcttgagggtgaccgtgcaggccrcgggtgtgagaggggaagcctggtacttggacaaaacgtccagacattttcaggctgtttttcaagagaagtgagtatcaagaaaggcaagaatggtctcgcgaagctctgtgaggagcatttattgatttcctttcatcccagaagtggtgttggcttgggggttctcccaaggtctgttagcaaagcatttggaacaagaaagcaccaagacacccctaagtgtctgaagtgcacacatgggagagcttccagagggagtttcagagtgagctgaaggagaaaagtatcctaagctcc

SEQ ID NO: 47685 - DNA, 601 bp, Human
gcctcacagatgcccagctgaccaggcaaaacacaggctgggtttcagcccctattgatcctcagctgccctggtgcagtgaataacccacgccactgtacatggccacccttgtccgaggagcctgtttcagaaagagctgtaacacacagcagcttctccagggcccccaatacatggcctcaggtcatgtgatttggagcctgtctctgcctaatcctgctcatggggaagcttcctttcacagtggctgtaacatatgaaaaccacagtaggagaaatctggctagtcactgtgggytgcctttgcttcaccttccagctgttcttcagattctttggtgggaagtctcaggcattactgaccagggagaggaggtgccttctctcactgaagactctttcctgttgcttggtgatgtctagcctgccactctctgctatcttcctggttttgcagttgacagaggacaataggagcatgaaggtggccagagctgaaatgctcaccctcccactgcttcttgagacagagtctcactctccgagcctggagtgcagtggcacaatcttggctcactgcaacctctgcctcctaggt

SEQ ID NO: 47686 - DNA, 601 bp, Human
caggtgctgaccggaagtggagggctaaggctctccgcaggggagggggcaggcaggcaatcagggcagtcagccaaccggcagaagcagctcctgcccccaggaaggcggtgttgttttcccctcctcctcaaggtttcatggggaacagccttgcaccctggtggaatgagttcccaaatacctagactcagcagaatccccagagggctttgacctcagttgaaatgatctttctgtgcctctggcaagggccaattggctaaaaatctttccaaagggttagtttttattgcaaacrgtccttggactcctttgggaccactgggtcacaaacattagtgccagcctctcccatctcagagcactgagatccagctgcagtgaaaccctggccctggctggagctggagggagacttccatcgaagtgtttgggaaggaaagcagggaaacctgcctctctggagcagcaagtgcatgtcctgggactctgagacacctcagcagccctcctgcagactggctcctgcttccagcctcagcttgctagctatgtgacctcaagcaaatcactagccctctctgagccctggttttct

SEQ ID NO: 47687 - DNA, 601 bp, Human
tcctgcttccagcctcagcttgctagctatgtgacctcaagcaaatcactagccctctctgagccctggttttctcctctgaaatgacttggactaggtcgtctcgatggtcccttccagctagcggtgttctgcaggtctgtgcttccctctgtcctgagatttctgagttatataactcattccttagaatgggagaggagctgtcttcttgcccagttagttacctgattcagaagtgcctgccagcctgtgaggctgggaaataaactgtggatagacttgagttgggtgtatttayaaagcctggacatgcactggcaggagaactgagtgccccaggctccccacacctacaccacaggccctgctcagttgttcagggttcactcgtccacggtgagtcgccggagggtcagggaggactcacagagaacagggtgagtgccctacacccttcagcttgccagttctgcagtccccacccttccggtctggatgcccagctgtgtgtgtgtgtgtcaggtggggtcagctgggcagaaaggtggaccccagggtcggtgttgccgcatcactgcatgcactgtggggtcccagg

SEQ ID NO: 47688 - DNA, 601 bp, Human
agttacctgattcagaagtgcctgccagcctgtgaggctgggaaataaactgtggatagacttgagttgggtgtatttacaaagcctggacatgcactggcaggagaactgagtgccccaggctccccacacctacaccacaggccctgctcagttgttcagggttcactcgtccacggtgagtcgccggagggtcagggaggactcacagagaacagggtgagtgccctacacccttcagcttgccagttctgcagtccccacccttccggtctggatgcccagctgtgtgtgtgtgtgtcaggtggggtcagctgggcagaaaggtggaccccagggtcggtgttgccgcatcactgcatgcactgtggggtcccaggggccctatgggtataggaaggaatgaaatgtgagcacttgggaatctcagcacactctgctgctcacctgctaccaggctttctggttccccagggaaccctgggccagcttgttgctgtcctcttttagcgatgggaaataagagtatgagagacagtgttatcctgtttacaatcagtggtgaagtccgtggttaagaccaggttacaactcctctatg

SEQ ID NO: 47689 - DNA, 601 bp, Human
gtgaagtgagtatattcagcgtcttcatggcaggggagagggtgtattaatccgtctatgtccgctggaaaggcagtctctgagcgggccacaagggttcagccatggcccatccaataacctttttgatgacttggatgaagagacaaacattccaaccacattcaaagatccagacctccaaagtgtggctcatttggtagataatggaattatatttggaaagcatttcccgcagctgggatgatgggtcaaaaacagatagcattttaccagatcatatttgtgtgtgtgtgtgtgygcgcgtgtgtgtgtgtgtgtgtgtgtgttttaaattcagtttcccaactacaggatggcatttgtagcctttcctaaaaatcaagtttaaaaaaaaaaaatttcttgggttgtaattgacgataagcttagtgtaagcaaatgcagaatgcagctgctttccaaagggcaactttaggctatataacaaaagtgggaaaggaaaagtgttccattgctttttgttgctctaagcaatattaagtcttggttctaagcccccacattatcaggaactttaacatctagagacaattgagag

SEQ ID NO: 47690 - DNA, 601 bp, Human
tgagtatattcagcgtcttcatggcaggggagagggtgtattaatccgtctatgtccgctggaaaggcagtctctgagcgggccacaagggttcagccatggcccatccaataacctttttgatgacttggatgaagagacaaacattccaaccacattcaaagatccagacctccaaagtgtggctcatttggtagataatggaattatatttggaaagcatttcccgcagctgggatgatgggtcaaaaacagatagcattttaccagatcatatttgtgtgtgtgtgtgtgcgcgcgygtgtgtgtgtgtgtgtgtgtgttttaaattcagtttcccaactacaggatggcatttgtagcctttcctaaaaatcaagtttaaaaaaaaaaaatttcttgggttgtaattgacgataagcttagtgtaagcaaatgcagaatgcagctgctttccaaagggcaactttaggctatataacaaaagtgggaaaggaaaagtgttccattgctttttgttgctctaagcaatattaagtcttggttctaagcccccacattatcaggaactttaacatctagagacaattgagagagaaga

SEQ ID NO: 47691 - DNA, 601 bp, Human
agctgggatgatgggtcaaaaacagatagcattttaccagatcatatttgtgtgtgtgtgtgtgcgcgcgtgtgtgtgtgtgtgtgtgtgtgttttaaattcagtttcccaactacaggatggcatttgtagcctttcctaaaaatcaagtttaaaaaaaaaaaatttcttgggttgtaattgacgataagcttagtgtaagcaaatgcagaatgcagctgctttccaaagggcaactttaggctatataacaaaagtgggaaaggaaaagtgttccattgctttttgttgctctaagcawtattaagtcttggttctaagcccccacattatcaggaactttaacatctagagacaattgagagagaagagctagagagagaaagtgaccctggaagccacgtcggaagaggctggagtaaaaatgtctagccccccagcagacttgatggccaccgtgagctctttgcatttgtcttcaagagtggacacttccgggttgctccagagagcaaggctagaacaaatggctagaagatagataggtagatactaaaaatattctaacaataacagaatattccaacaatagactatgtcc

SEQ ID NO: 47692 - DNA, 601 bp, Human
agaatgcagctgctttccaaagggcaactttaggctatataacaaaagtgggaaaggaaaagtgttccattgctttttgttgctctaagcaatattaagtcttggttctaagcccccacattatcaggaactttaacatctagagacaattgagagagaagagctagagagagaaagtgaccctggaagccacgtcggaagaggctggagtaaaaatgtctagccccccagcagacttgatggccaccgtgagctctttgcatttgtcttcaagagtggacacttccgggttgctccagaragcaaggctagaacaaatggctagaagatagataggtagatactaaaaatattctaacaataacagaatattccaacaatagactatgtcccctcaaagggcaacgagctccatgtctagccgtttagaagctgaatggccaaggatagtgcagagtaggtttctacaccggatcccatgatcttttgcaactggaattctatgctgccccaaatacttgttaaatggatccgactgcatttcattctgtggtttataaataagtcctggaaaaggagaatgaattataaggaaggagtt

SEQ ID NO: 47693 - DNA, 601 bp, Human
ccggatcccatgatcttttgcaactggaattctatgctgccccaaatacttgttaaatggatccgactgcatttcattctgtggtttataaataagtcctggaaaaggagaatgaattataaggaaggagtttgctgagattggaggagagggatctgaaagactcaggactagactccgccttgagggagaaaaagccacaagatgacacactcaaagcaagggaaaccgtcaggaagtggaattactgcccttcacatgtcatccttgccttcttttctgttttttgttttttttttttggcatttgctgccgcagcagctgagctctgggcaacagggctctctctcccgaatgtctgaaaggaggtcagcaagtggaggacacaggcgcccactggcacagggcattggcaaccatcgtgcagtgagccccagcacagccagggtggccatgtgcgtggggcgtcctggcccaaggttgaagaaaactcatcctgtcatagttcccatccggaaagggtgttttgttgaaagcaaaaaggatcataaagtcatttgccttttacccaatgccagttccagattccaggtaaatgagc

SEQ ID NO: 47694 - DNA, 601 bp, Human
ttttaaagtcaactcagagagttagtttttctgcatttcctggaaatgaagggactgtggtgcccagcaggccagcttctgttctatggtcgatttcctggggcccctaagcacttcccgggaagctgtgggaactggggggcttgtcagcctgtaaggtgctgggaggtggggagggccaccaggcaaatggtgcacgtgttgtggggatctggcatttggccgcctactgagttgaaggactcgaaggtgcctcctgctaccagagacagataaggaatgggtctacccaagataagargatgaaatccactcctccaaatgtagccctccatgtgacagaaacactcacctctcagctgtctgcttgcctggagccaccctgagcaatgcaacctcaacaagtccagttgctccgtcagtccaataaacagaggtttctcttttttaaccacttattccaaagcgaggtagtggaggagtcagaagcacgtggcaggggatgctttgaaattccttgataaaccggacccctggggtgggcactcctactgcctatagtaccgacagaaacagaagtggagaagttgtttatttccaa

SEQ ID NO: 47695 - DNA, 601 bp, Human
taacagcatccttaggcttcatttcctggtgaaagcttccataactcttcctctgtgggccctgggccaaatcctgcaggaaacgtagcaatctcacatttctacacactacaccatcaggggagaaaaaagctgggaaaccgcccatcctctgtcccatggggaccaaaagcatctcagcagcacgtgaaaagagcctgtagggaaataaggttctctgtagctaagagttccaatgacctaagtttctgtccaggtatctcctgaaaacgctgcttagtctgttccctggtgtacttcytccggttaggaatccatgtctgataagtgcctgctaaattgcattcctgatagtggggaagaaagaaatgagccggccctctttgcatatgcatccaaatgggcatggacattcactgaattgttatgcttttgtggggggatgagaggtcagcaattctaggctccgccttttcagctggctaaaccaaggaccccaagaaatgtacgtgttttgggtgaacacatttgcaagagataagtgtcctcaggaggatggggtcagagtcctcataggtcctcaggagaatcacatactgcc

SEQ ID NO: 47696 - DNA, 601 bp, Human
tctttataccactgtacatgagaaggtaggggtcgggggggcggggtggggggtgctgttgcaagaaaaaaaaatccattacgtttattttgatcaaatttattattttttaaacaggttcagttttaagtattcatgaatgtaccatttattaattctttaatcagtgaacgtctcttttttgattaattcacttttcatctatcccttgacttttttaaaaaaattggggtattgttttatgtttgtgatatagcttcctatttaaaaggggtcaaataaaaaaatattttaaaaccayataaaatgcccttaagcccctgcgagagttgaggaaggttgccaaggccctacaagtaacacagaccccaggaatgggtcagccacaggctcccgcccctcctcactgcggaagggtgagaaagacaggaatggcctctcttccttcccatgctgctctgacctacctctgttgtggaggaaccataacgggttccatagcccggtttttccatttcctatgccccaccttgtttcacagagttgagttaatagagggtgataagaaatagagaatttaaaaagtgttttgaaattattc

SEQ ID NO: 47697 - DNA, 601 bp, Human
taaaaaaattggggtattgttttatgtttgtgatatagcttcctatttaaaaggggtcaaataaaaaaatattttaaaaccacataaaatgcccttaagcccctgcgagagttgaggaaggttgccaaggccctacaagtaacacagaccccaggaatgggtcagccacaggctcccgcccctcctcactgcggaagggtgagaaagacaggaatggcctctcttccttcccatgctgctctgacctacctctgttgtggaggaaccataacgggttccatagcccggtttttccatttcmtatgccccaccttgtttcacagagttgagttaatagagggtgataagaaatagagaatttaaaaagtgttttgaaattattctaggttaagtgtggattttcccaccatcccctgccagcgtttctcagacatctcagactgcactctctctccccagttttagacatcattgaggaagaagatgccacggaattctttgcattcccttttaaaatcatttcttttgctttgctcagtggagaaggagcaccaggggcagcaaccttccgggagtcacccgatgaagtcaggcaggcctt

SEQ ID NO: 47698 - DNA, 601 bp, Human
aaatattttaaaaccacataaaatgcccttaagcccctgcgagagttgaggaaggttgccaaggccctacaagtaacacagaccccaggaatgggtcagccacaggctcccgcccctcctcactgcggaagggtgagaaagacaggaatggcctctcttccttcccatgctgctctgacctacctctgttgtggaggaaccataacgggttccatagcccggtttttccatttcctatgccccaccttgtttcacagagttgagttaatagagggtgataagaaatagagaatttaaaaagtgttttgaaattattctaggttaagtgtggattttcccaccatcccctgccagcgtttctcagacatctcagactgcactctctctccccagttttagacatcattgaggaagaagatgccacggaattctttgcattcccttttaaaatcatttcttttgctttgctcagtggagaaggagcaccaggggcagcaaccttccgggagtcacccgatgaagtcaggcaggcctttggcttctcccatcctgctgaacccaagccaggatcccctacctttccacctggctcttgggctcc

SEQ ID NO: 47699 - DNA, 601 bp, Human
ggccctacaagtaacacagaccccaggaatgggtcagccacaggctcccgcccctcctcactgcggaagggtgagaaagacaggaatggcctctcttccttcccatgctgctctgacctacctctgttgtggaggaaccataacgggttccatagcccggtttttccatttcctatgccccaccttgtttcacagagttgagttaatagagggtgataagaaatagagaatttaaaaagtgttttgaaattattctaggttaagtgtggattttcccaccatcccctgccagcgtttctcmgacatctcagactgcactctctctccccagttttagacatcattgaggaagaagatgccacggaattctttgcattcccttttaaaatcatttcttttgctttgctcagtggagaaggagcaccaggggcagcaaccttccgggagtcacccgatgaagtcaggcaggcctttggcttctcccatcctgctgaacccaagccaggatcccctacctttccacctggctcttgggctcctgacccttattctcagcaagtctcccccaaccccaccccaggcctctaattccacacatata

SEQ ID NO: 47700 - DNA, 601 bp, Human
ttattctaggttaagtgtggattttcccaccatcccctgccagcgtttctcagacatctcagactgcactctctctccccagttttagacatcattgaggaagaagatgccacggaattctttgcattcccttttaaaatcatttcttttgctttgctcagtggagaaggagcaccaggggcagcaaccttccgggagtcacccgatgaagtcaggcaggcctttggcttctcccatcctgctgaacccaagccaggatcccctacctttccacctggctcttgggctcctgacccttatyctcagcaagtctcccccaaccccaccccaggcctctaattccacacatatacatcctttatgaacttgagcaccatctattcaaaggtgaccttcaggctccttgagagcacgactcatctctctctggggcctccacttcttgcctgctaagttgcatggtgagctgtattcaacgaaacacgatttttcatgagcagggatggaaaatgcctgtgtgtcacaccaaagggatccgtttgcatcaatggaggctagaaatagtgttccacattagttctgttgcgagttcgaattcccc

SEQ ID NO: 47701 - DNA, 601 bp, Human
tctcagacatctcagactgcactctctctccccagttttagacatcattgaggaagaagatgccacggaattctttgcattcccttttaaaatcatttcttttgctttgctcagtggagaaggagcaccaggggcagcaaccttccgggagtcacccgatgaagtcaggcaggcctttggcttctcccatcctgctgaacccaagccaggatcccctacctttccacctggctcttgggctcctgacccttattctcagcaagtctcccccaaccccaccccaggcctctaattccacacrtatacatcctttatgaacttgagcaccatctattcaaaggtgaccttcaggctccttgagagcacgactcatctctctctggggcctccacttcttgcctgctaagttgcatggtgagctgtattcaacgaaacacgatttttcatgagcagggatggaaaatgcctgtgtgtcacaccaaagggatccgtttgcatcaatggaggctagaaatagtgttccacattagttctgttgcgagttcgaattccccaacagaggaatccaggttcctcctgtactggagggggaagcattgaa

SEQ ID NO: 47702 - DNA, 601 bp, Human
ttccttcaggatcatccaaactggagacagagatgagagtaaagagacggggcagtgccctggagggtacaggcaggagctcccctctctctgggcacagcggattcctcgggagcttcctgcaagcctataggggcatgcactttggggcagctcatctctgaacacaggtagcctctactatcagatttcactttgatcactgaaaactacaggagtctcagctcttcagaagggaagcagctgctgagcaagtgtgattgcagtatttcttccccaaagccccgggccaggcatctasccatgcccgcatcctgcatgattaaccgccttccagtctgagcctgccctcactcacgcgggaggtcactgggtagcgagtagattgcagctgggctgagctgcctctcaagccgacctgaaccctcatgacctccatctttagcagcaagctggcatttggtaaatgcgcgaaagcaggagtggggagagggagacaaaaatgccaagcagcaccgcctgggttgctgagaggttgggaacaatcccaagggtggcccctaagctggtcagctgcaccatcctaccctgaaatcctggg

SEQ ID NO: 47703 - DNA, 601 bp, Human
agctcccctctctctgggcacagcggattcctcgggagcttcctgcaagcctataggggcatgcactttggggcagctcatctctgaacacaggtagcctctactatcagatttcactttgatcactgaaaactacaggagtctcagctcttcagaagggaagcagctgctgagcaagtgtgattgcagtatttcttccccaaagccccgggccaggcatctagccatgcccgcatcctgcatgattaaccgccttccagtctgagcctgccctcactcacgcgggaggtcactgggtagygagtagattgcagctgggctgagctgcctctcaagccgacctgaaccctcatgacctccatctttagcagcaagctggcatttggtaaatgcgcgaaagcaggagtggggagagggagacaaaaatgccaagcagcaccgcctgggttgctgagaggttgggaacaatcccaagggtggcccctaagctggtcagctgcaccatcctaccctgaaatcctgggaaataaaagcagtcgggggaagcgaggagcgggcagtgacaggctggccacaggtccttggagtcagagcggtgagg

SEQ ID NO: 47704 - DNA, 601 bp, Human
agtggggagagggagacaaaaatgccaagcagcaccgcctgggttgctgagaggttgggaacaatcccaagggtggcccctaagctggtcagctgcaccatcctaccctgaaatcctgggaaataaaagcagtcgggggaagcgaggagcgggcagtgacaggctggccacaggtccttggagtcagagcggtgaggctgagctccaggatttagtcaggaagagaataattagcaccttcaagcccagcccagcccagcccattctgtagaaaggggaagggttgagggtatggaagcckcagggccaaattcacctaaaacaaatagacacataatcctccagaaatagaatctccaacctccctcaacccacagtcccctctccagccaaaataaccttgttaataggaatgaggctgcagtgaaggtttgggcaactggtaaacctcacctcctttgtctctgggctttgaatgtactcattggcaacagactcttattcagaagcttgagtgattttttttttcccatccaccagctaaatgagagccccaaacgctgtggatagcaaactcagaacatatatatttgggtacata

SEQ ID NO: 47705 - DNA, 601 bp, Human
gttaataggaatgaggctgcagtgaaggtttgggcaactggtaaacctcacctcctttgtctctgggctttgaatgtactcattggcaacagactcttattcagaagcttgagtgattttttttttcccatccaccagctaaatgagagccccaaacgctgtggatagcaaactcagaacatatatatttgggtacataatgtgtgatttgtggccctggcgaaggagggatgggaggaggaggaggacctgatattggtgtgtggtggttatcacagcaataagtggcacctaaaaggaragcaaacttcctttgtgcctttcataggacagggatggacataggtaaccgggggtaggggaggtttgtaagagctctcacacaaggaggcccctaggctcagcagccccgtgtttccccagcaaggatgccccacacccccatgtttcctgccttcaggcctgccccaggaaggcacattcccgagtgacaaatgcctcacactctatgtaagaaagggcactcaaggagagtcaccgctgggtgtgtgccacagaacccggggctggggggagcccttgaaggtcagcctctgccttc

SEQ ID NO: 47706 - DNA, 601 bp, Human
tgaattattgactgagtctaaaccaagagggaggctggtaccttagccaagcagccattcagtttgctccttgagttaagactggtagaccctggaatgtagccaggcccacccttggttggctcagagcccagtgagagagaaaacagaaggccacagagaacaccagggcaagtgatagagattcaagggggtgagccttgggctgggggatcctcctgcttacctcctgagaaggccttcccccaggcctcctgagatggcaactctctttctctgtgtgtgtgtattctagaaaacyacagcttccctccctggccccatgagaaagccaagccggaccagaaaacacagagtcaccagaagtctttatctgttgcctaagaaacatgctgagggctgaaaactgctccgggtccaagagaaaggccagctgtctgctctcctcgcaagcaagtagtacaggaagtggagggcccattcaccacccaaaacgcgtagtctaagcaaacccagcttcaacattgtcccctccagcctccttccatccagatcaccacctgtaagcccttcttctcataatcccctaggatttactggg

SEQ ID NO: 47707 - DNA, 601 bp, Human
tatgatgtgcctcccttgagtgtgggctggacctagtgtcacttctaagattaggttacaaaaagaatgtggcttgagtcttggacgccctctctcaatctcaatctctctctctctcgctcattcactctgagagaagccaactgccgtgttgttagctgccctagggagagacccatgtggcaaagaactgatgtctctggccaacagccaaggaggacctggggcctgccaacagcaacatgagcaaacctggaagcagattctccccacgtggggccctgagatgactgcagccccragagagaccctgagctgcaggcacccagctaagtcacacacaaattcctgccccagagacagtatatgtttgttgttttaaactcctaactttggagtcatttgatttgcagcagcagattactaatcactgagcataagcatggcactgtgcaatggactctataagaaatgcctctccaatttcccagaacagggagtaaaaacttttgatcattagaaatgtgacagggtggttgggcacagtggctcatgcctgtaatcccagcactttgggaggccaaggcaggcggatcacttg

SEQ ID NO: 47708 - DNA, 601 bp, Human
cctggtacttttttttacgccctgcgttggagatttgaacagtagaaagatcaagaagggggaggggatacagagccctgaagagcggttttttttgcttgttttgttttgttttgatacaaagtctcattgcaatgcccaggctggaatgcaatggtgtgatctcggctcactgcagtctctgcttcccgggttcaagcaattctcctgcctcagcctcctaagtagctgagattacaggcacgcgccactacgcctggctagtttttgtatttcttttaattaattaattaatttattwatttatttatttattgagacagagtctcactctgttgcccaggctggagtgcagtggtgcgatctgggctcactgcaacctccccaccccccaggttcaagcaattctcctgtctcagcttcccgagtagctgtgactacagagcacgccaccatacctggccaacttttgttttgttttgttttgttttgttttgttgagatggagtcttgctctgtcgcccaggctggagtgcagtggcgcgacctcggctcactgcaagctccgcctcccaggttcacgctattctcctgcctcaac

SEQ ID NO: 47709 - DNA, 601 bp, Human
tgcacctggtacttttttttacgccctgcgttggagatttgaacagtagaaagatcaagaagggggaggggatacagagccctgaagagcggttttttttgcttgttttgttttgttttgatacaaagtctcattgcaatgcccaggctggaatgcaatggtgtgatctcggctcactgcagtctctgcttcccgggttcaagcaattctcctgcctcagcctcctaagtagctgagattacaggcacgcgccactacgcctggctagtttttgtatttcttttaattaattaattaattwatttatttatttatttattgagacagagtctcactctgttgcccaggctggagtgcagtggtgcgatctgggctcactgcaacctccccaccccccaggttcaagcaattctcctgtctcagcttcccgagtagctgtgactacagagcacgccaccatacctggccaacttttgttttgttttgttttgttttgttttgttgagatggagtcttgctctgtcgcccaggctggagtgcagtggcgcgacctcggctcactgcaagctccgcctcccaggttcacgctattctcctgcct

SEQ ID NO: 47710 - DNA, 601 bp, Human
aagttggccaagcttggcttccctgaccatcataggcagccagtgtcatttccctgactcccagattccaggaacagaaggaaatgcaaggggcaaagggcctgtcctagcccctcgaagctggctctgccctccttctcctttgacggtaataaaaattgtcataacacacctatgagcacctcctaggtcagacacactacccaacatggcagggagtatgcaggtcaccatcctcaagggactcagaacatggtgggggcccagatacagaacagactaggggtgatgacacacaggrtgaatacaacagttggtgtgttttggggtgacaaggccttactagtgagccacagaaacccacatctgtgcaaataaattgtccccaacctgacattttgggcagaaacaagtgcctgtgccagtacaggtgggctcccatgaccttgctgctgagtaaccaggcatctcactgtgccaccaactgatgggcaggaagaagtggcagttctgctttatctcgttttccagagggatatctgctgcctgcacctggtacttttttttacgccctgcgttggagatttgaacagtagaaaga

SEQ ID NO: 47711 - DNA, 601 bp, Human
tataaagtttaacaaaattgttttattgacatgattctgtaatttggcaactcacattcaggtctcttactgctaaccacagcatctagcagcagtcctgaaatactgacacatttcaagacaattttttactaactctaccatttgaaagatcaataaacactaaggtgttcttgtgatgtctcttattcaaaagtcatattccatcccagtgtagttcccaaacattttcaagtcacatttctaaatctttaatcttccataacatatctggaatgaaaacaagcaaaaagtggtttcygacagccattgataaaaactggtgttgaaggataaggaattatttgtggagatggtaagattacacctcagaagagagtacatgaagacacggtaaaattacaagagaataacattagaaacaaacctcagcaaaataacttggctctatgatagggcttgagttagaagtcaaagattatacatactctaggaaagccccaactttgattctgatacaagaagggtagaaagtggagatgggagcaaataatgtctgttataatgacagattacctaggaaatattggcctaaaactac

SEQ ID NO: 47712 - DNA, 601 bp, Human
ataaattctgactctcacacgtaacctctaaggtggatattatctctttcgcagatgaaaaaactgaagttcggaaaggttaatctgcttatggttactgtcaggaagtgactgagaattgaaaccaatctgcctcatatcaaagaccacactttttccacagtaccatctattactttccaaatatgtctgatagaatcacataacactcctaccaaaaataaaaatccctagactcttcccttccagacccaatattctgattgggtcaaaagtcacatacacacatacacacatacayacacacacacacacacacacacacacacacacacaatcttacacagaagatacctgaaggatacttaagagcatctgttgctacatgttatatttaaagcttaattttattaataaaatctaaatagctttatagcagattagaaacctaagccagacacagctattagagatttgaaagatttctttctgagtatacagctggcctaatatcctgggcctttaacctgttgacagtataaactccagctggaattctgctttagagtaatattatttatttaaattatttagaatagta

SEQ ID NO: 47713 - DNA, 601 bp, Human
tcacatttataaatgtatcaccaataataaatatatatataacatacatatcttatttctaatctcatgagtattattgtaacaatctttattcatccccagtaagttctcttttccatgctccgtagttgttgtgcctgtctttaggtactccactttatcctcacaaccaacatttttttgcaaataaccacagttgtcaactctgagagaaaaaaatgtcatggaatataaactgctttaccttccctcccttttatttttggatttacttatatatcttcagtatttttaccatctstcaatggaggaaagcttccaaaaactaaccatttacttctgagtgcatctcctccagtctcctctgcaattcactgtatttctacctcgcttcaggctccttaaacatagcctacaaatctgaattagtctatccacctgaggatgtgaatccttatttcttcttctctctcaatgtctgatggcatctatttctttccttcctcaactaatgttttgaaagactcctttacattaactatctttacgttacctcccattcattattcaaactaccacaatccaggctttcctacacact

SEQ ID NO: 47714 - DNA, 601 bp, Human
ctgtgatatattctgcatattgtcatcacttgggactgtatcacctctgaaattctgaactgtaaaattcttctcttaccactgccatcaatcatttcatttctcccatccttactaaatttgttttttggcctctggttgtaatatattgcttcccacccctccatagctccctatgactccatttccttccttatttgccagaactacatagtcaatcattttgaacatactccaacaaacacctttaatcatctctacagtgtcccttgccaacccaggttcaattaaattgtttacyttcttcacactgcctggagctactggagaaaaatcacatttataaatgtatcaccaataataaatatatatataacatacatatcttatttctaatctcatgagtattattgtaacaatctttattcatccccagtaagttctcttttccatgctccgtagttgttgtgcctgtctttaggtactccactttatcctcacaaccaacatttttttgcaaataaccacagttgtcaactctgagagaaaaaaatgtcatggaatataaactgctttaccttccctcccttttatttttgga

SEQ ID NO: 47715 - DNA, 601 bp, Human
aaccctgttgaaatgccactctttccttagaaatcctcaactacagttcactcctgaccttatctattctaaagaactttacctcctgcacctccatctaattcagcaacctactcactgtgatatattctgcatattgtcatcacttgggactgtatcacctctgaaattctgaactgtaaaattcttctcttaccactgccatcaatcatttcatttctcccatccttactaaatttgttttttggcctctggttgtaatatattgcttcccacccctccatagctccctatgactccmtttccttccttatttgccagaactacatagtcaatcattttgaacatactccaacaaacacctttaatcatctctacagtgtcccttgccaacccaggttcaattaaattgtttaccttcttcacactgcctggagctactggagaaaaatcacatttataaatgtatcaccaataataaatatatatataacatacatatcttatttctaatctcatgagtattattgtaacaatctttattcatccccagtaagttctcttttccatgctccgtagttgttgtgcctgtctttaggta

SEQ ID NO: 47716 - DNA, 601 bp, Human
ttgtcagtgcattagatggtatgaaagaaaatgtagacgtgtactatacctatatctattcctattacctaaaagaccttttcttgaatcatggttaaaatattccatggctttagaattgataaaagatttaaactattttcaaagaatggtaaatataacaagaagataaaagacataataaaaacaacctatcttgcttttatctatcagaagtctaccagtacttggagaacagagaattcattcaaatcacaactactgagcacattccatgcaacacttcagtgcaggcttttayggcttttacagcttcctttgtttccttaagaaatcacacacgagaccaattttacttttatataatttgagataattttgaaagttcatgtaatacactgtaaagttttgaaggggggactccaactttacacctaaatctaaatggaatcttgaaacaggcttgttttactcatatcccacatacatccatttcactatctctacattcctccagtctatagtcataactctgcaaaccactccaatctgttatcctgctttctcatgatcatcatattcaagtttatctttcctgata

SEQ ID NO: 47717 - DNA, 601 bp, Human
aactccttcctatcaatagaatgtaccagtttaaaaatttttagtaggaatatatcttttattttataacagaaatcaagggacaaagagaatttgatcatccatacttcctactcttattggttgtcaaaatgtagccacataaaactgttcattcattttcaacttaacaaaatttcatttttggctgggtgcagtggctcacacctgtaatcccagcacttagagaggccaaggagggcagactgcttgagtccagaagtttgagaccaccctgggcatagaaaccctgtctcggccrggcgcggtggctcacgcctgtaatcccagcactttgggaggccgaggcggatggatcacgaggtcaggagattgagaccatcctgcctaacacagtgaaaacctgtctctactaaaaatacaaaaacttagccaggtgtggtggtgggcacctgcagtcccagctactcaggaggctgacacaggagaatggcgtgaacacgggaggtggagcttgcagtgagcagagatcatgccactgcactccagcctgggcaacagagtgagactccatttcaaaaaaaaaaaaaaaaaaagaaac

SEQ ID NO: 47718 - DNA, 601 bp, Human
gcattaactccttcctatcaatagaatgtaccagtttaaaaatttttagtaggaatatatcttttattttataacagaaatcaagggacaaagagaatttgatcatccatacttcctactcttattggttgtcaaaatgtagccacataaaactgttcattcattttcaacttaacaaaatttcatttttggctgggtgcagtggctcacacctgtaatcccagcacttagagaggccaaggagggcagactgcttgagtccagaagtttgagaccaccctgggcatagaaaccctgtctyggccaggcgcggtggctcacgcctgtaatcccagcactttgggaggccgaggcggatggatcacgaggtcaggagattgagaccatcctgcctaacacagtgaaaacctgtctctactaaaaatacaaaaacttagccaggtgtggtggtgggcacctgcagtcccagctactcaggaggctgacacaggagaatggcgtgaacacgggaggtggagcttgcagtgagcagagatcatgccactgcactccagcctgggcaacagagtgagactccatttcaaaaaaaaaaaaaaaaaaa

SEQ ID NO: 47719 - DNA, 601 bp, Human
atgaatctcaaatgcactaagctacatgaaagaagccagactcaaaaagttatatacactattttactccatttatataatattctagaaaagacagtattgtagggatagacaacagatcactggttgccagggtttaagagttgacgagggttcaactacagaggtagtaagtaaaaaacttactacagcacaagtaagttttttatggaaaactgttatgtatcttgattctggtggtggttacaaaactctatgcgtttatcaaaaatcacagaactgtttataaaaattttactgyatattaaaaaacaattttcaaaaataggcaaaggtagttaagaaaaaaggcaatttggaaggtctaaaaaataatcaaaataacagaacatgctgggcgcagtggctcacgcctgtaatcccagcactttgggaggccgaggcaggcagatcaccagaggtcaggagctcaagatcagcctggccaaaatggtgaaaccccgtctctaccaaaaatataaaaattagccgagcacggtggctcacacctgaatctcagcactttgggaggccgaagcgggcagatcacctgaggtcagga

SEQ ID NO: 47720 - DNA, 601 bp, Human
gtcttctcaacaaatggtactggaaaacctagaaagtgatatgcaaaaaaaaaaaatttcacccatacctcacactcatataaaaacctgagtcaaaatgggtcacacacctaaaagtaaagagatcacaggagaaaattttcatgaccttggtttaggcaaattcttagatacagcacaaaagtacaatctatttttttttaaagcgatgaattcatcaaaagcaaaagcttttgttccgccgaagacattgttggagaatgaaaagacagctacagactgcaaatatatattagcacgwatctgccaggggacttattttcagaattatatgaagaactctcaaaactcaacaagaaataacaatttttaaataggcaaaatatttcaatgaacactttaacaaagaggtacaaatggcaaataagcacatgaaaaggtgctcaatatcattactcatgagggtaatgcaaattaaaaccacaatgagatgctactatgtatcttttagaatgactataatttctataactaaccatatcaagtcctgcaaggatgctaagcaactggatctctcatgcattgctggctggaatgcaaa

SEQ ID NO: 47721 - DNA, 601 bp, Human
tgtattttatgtactagcagtgaacaactggaaatcaaaatttaaaaaacaataccatttacaatagcgccaaacccaaagaaatacttatgtataaagctaataaaacatgagcataatctatatgctacgcaaaaaactacaaagctctaacaaaaaaaacgtcaaagacctaaatacatggagactatgtcatgttcttggtttagaggacttaatattgttaagatgtcaattctctccaattcatctgtaaattgaatgtaattccaatcaaataccagtgtttcttatagatatytgacaagctaattctaaaatttataaagaaaggtaaagaaattagaacagccaaaacaatcttgaaaaataagaaaaaaattgaaaggctcaatatacctgatttcaaaacttactataaagctacagtaggctggacacagtggctcacatctgtaattccagcactttgggaggccgagatgagagaatcgcttgagcccaggagttcgagaccaacctgggcaacacagcaagaccctgtctcctttttaattaaaaaagaaaaaaaagctacagtaaactagacattatgatattt

SEQ ID NO: 47722 - DNA, 601 bp, Human
aatattcacagcagctttatttatacagaccaaaatgtccatcagcaggtaaatagataaacaaatgtggcatatccatataataaacattattcagcaataaaagggaatgaactactgatgcaacaacattgttgaatctcaaaatcatagtaagtaaaagaaaaaggggctggccaagcacggaggctcacacctgtaatcccagcactttgggaggctgaggcgggtggactgcttgagctcaggagtttgagagatgaaaccctgtctctaccaaaaatacaaaaattagccaggmgtggtgatgcgcacctgtggcccaagctacttgggaggccgaggtaggaggatgagtggagcctgggaagtctgggaaggctgtagtgagccatgatcatgccactgaactccagcctcagtgacagaatgagaccctatctcaaaaataaataaataaaaaataaaacaagaagacaaaaaagaatgcacattgtatgatttcatttagataaaactctagaaaaagcaaattaatctatagtgccagaaagcagatcagcacttgcacagggaagtttctggaaatgatgagtatgtt

SEQ ID NO: 47723 - DNA, 601 bp, Human
ttaaaaaaccggatcttgagagaactcagcaccaacctgtgaagttatctgcccccatgatccaatcaccttccacgaggccctacctccaacactggggattacatttcaacatgagatttagaggggacacataccccaactctttaaaagactatactaaatgttgacaagtatgtagcagaacagaatctatcctacagtaccatgagatcataaaataatagtacctccacttttggcagtttctcagttccttaaatgcatttccatggattgtcccacaaccacaaaaaaaaaagaaaggaaaggaagctaaacatacacatgacatatgaccaaggcattccactcaggaatttttactcaaaaaaaaaaaaagtgtatgtccccaaaaagacctgaacaagaatattcacagcagctttatttatacagaccaaaatgtccatcagcaggtaaatagataaacaaatgtggcatatccatataataaacattattcagcaataaaagggaatgaactactgatgcaacaacattgttgaatctcaaaatcatagtaagtaaaagaaaaaggggctggccaagcacggaggct

SEQ ID NO: 47724 - DNA, 601 bp, Human
agtttagaaatatgttgagttacattcattgcatttttggatgttaaaccaaccttacttaccttcctgggaaggacaatgtacttggccatgtgtgtctttcttttcatgtttttgttggacttgataggctaaacgtctgtttagaagttttatatctatgttcatgaggaacatttttctgtagacttttcttttagaatatctctgtctggttttggcctcagggtaacgatggcctcataaagtgagctgggaagggttcttttctcttgattttctagaagagtttgtgtagaayaggcattacttcttccttaaattttgtaagaatacaccagtaaaggcatctgggcctggaattttctttgttggaagtttttaaattacaaattcaatttacttaattgatatgggacttttcaagtcatctattttatcttggttaagctttacagtttttgtttttcaaggaatttgtccactttaaggtgttgaattacaggcatacagtttatagtattcattaatcattcttttactatctttaaaacctcttagtctcatcacctgtttcattcctgaaacttaatttatctct

SEQ ID NO: 47725 - DNA, 601 bp, Human
gtgatccgccagcctcggcctcccgaggtgccgggattgcagacggagtcttgttcaaagtaaatttcagagaaaaatacaggtcaattttataatgataaagaggtcaatcacaaaaatcctgaaaatttatatacctaattacagagtgccaaaatacatacagcataagctgcatgaataaatacacaaacccaaaattatagtcaatccatagaaatgcatttaaggaactgagaaactgccaaaagtggaagtactattattttatgatctcacactactgtaggatagattctgytctgctacatacttgtcaacatttagtatagtcttttaaagagctggggtatgtgtcccctctaaatctcatgttgaaatgtaatccccagtgttggaggtggggcctcgtggaaggtgattggatcatgggggcagataacttcacaggttggtgctgagttctctcaagatccggttttttaaaagtgtgtggcacctctcccaacccccttgctcctgctctgccatatgagatgcctgctccttttcatcgtccaccatgattataagctgagtcctccccagaagctgagcagat

SEQ ID NO: 47726 - DNA, 601 bp, Human
atcctctcctccccctccccctccccctccctctccctctacggtctccctctgatgccgagccgaagctggactgtactgctgccatctcggctcactgcaacctccctgcctgattctcctgcctcagcctgccgagtgcctgcgattgcaggtgcgcgccgccacgcctgactggttttcgtatttttttggtggagacggggtttcgctgtgttggccgggccggtctccagctcctaaccgcgagtgatccgccagcctcggcctcccgaggtgccgggattgcagacggagtctygttcaaagtaaatttcagagaaaaatacaggtcaattttataatgataaagaggtcaatcacaaaaatcctgaaaatttatatacctaattacagagtgccaaaatacatacagcataagctgcatgaataaatacacaaacccaaaattatagtcaatccatagaaatgcatttaaggaactgagaaactgccaaaagtggaagtactattattttatgatctcacactactgtaggatagattctgttctgctacatacttgtcaacatttagtatagtcttttaaagagctggggta

SEQ ID NO: 47727 - DNA, 601 bp, Human
tttgagacggagtctcactgtcgtctaggctggagtgcagtggcgcaatcttggctcactgcaacctttgcctccgcctcccaggttaaagcaattctcctgcctcagcctcttgtgtagctgggattacaggtgcatgccaccactcctggattctttttaaagcatggaaatagaaatagtttatagacctacaaagctcaattttcagacgattacacatttttggaactggaaaatatgtgaaaaatcagctggcctgtcctttgctcagattaaaaggaaaggaaaaaaaaaaaaacctaacgctgagagaggttttaagcaactctctcaaggtcacccagcttcaaacattggtttactatcctttatactgtatcacactgctcctacagcagtaggagctcctattacttattctaaaaggcaagatgcttctatttatcagggaatcttcttcttattagtaagcaccatatcttatgcaacattatgatcttactaatgccaggattttaaaggccagatgaatacatttattcaacaaatatttattgaacaccaagtagatgctaggcactgtgacagcactgaggat

SEQ ID NO: 47728 - DNA, 601 bp, Human
ttacaaaaatgctaattttttttttttttttttgagatgaggttttgctcttgttgcccaggctggagtgcaatggcacgatctcggctcactgtaacctctgcctaccaggttcaagtgattctcctgcctcagcctcccaaagtgctgggattacaggaatgagccaccgcacctggcctaaaatgctaattcttaggctttaaaataaaaattaacattgagaatttttttttttttttgagacggagtctcactgtcgtctaggctggagtgcagtggcgcaatcttggctcactgyaacctttgcctccgcctcccaggttaaagcaattctcctgcctcagcctcttgtgtagctgggattacaggtgcatgccaccactcctggattctttttaaagcatggaaatagaaatagtttatagacctacaaagctcaattttcagacgattacacatttttggaactggaaaatatgtgaaaaatcagctggcctgtcctttgctcagattaaaaggaaaggaaaaaaaaaaaaacctaacgctgagagaggttttaagcaactctctcaaggtcacccagcttcaaacattggtt

SEQ ID NO: 47729 - DNA, 601 bp, Human
caactttctgatgttaccatgatattttccacatagggtgttatgaagattaaattaaaagagaatgtatgtaatgtgccttgctaatagccggtatacaataattatctttctcttcatttgttccttgtagtctattatttcattgcatatcaacacatattttccattttatagcaaaatctttcaagttaaacatcaggaatttagccatttggaataactggtattataaactaagtgtttctatcttaaattacatttaagtaggtgcaaaagtcaaacatcgactgggcgcagyggctcacgcctgtaatcccagcactttggggggccgaggtgggcagatcatgaggtcagaagattaagaccatcctggccaacatggtgaaaccccgtctctactaaaatacaaaaaattagccaggcgtggtggtgtgcacctatagccccagctactctggaggctgaggcaggacaatcactcgaactggggaggtggagattgcagtgagccaacatcgcgccaccgcactccagcctgctgacagagcgagactccatctcaaagaaaaaaaaaaaaaaacaaaagtcaaatatc

SEQ ID NO: 47730 - DNA, 601 bp, Human
cactaaatccacccttcttcctttcactttaaaatcttaatggtttcatttcaattatattttacatacatttgttgttaatttcaaggccattcatgattttataatgaaaaatttttgtaaatcgaacttttttacagatattatcctgagacaaataacatatgtatgacatgcaagttttcttagccactaacaaggctatcggccttgaataatcaacttactctaaaactatgattaatgtgttcaagaaaagaaagtagaaagctggatgaaaaaacgaagaatttcaaaagaraactggaatctattttaaaaaacagcaaatggacaccctagaattgaaaaatacagtatctcatattaaaaactcaggtcacagaagataggtgcaaatccttctataaaccaccacaccaatactatgttctaaatatttacagagaaatgaatgtcagccagctgttgacaaaacacattttctaagcattctagcatatctttacagtgctacctctgcatttttaaggctcaaagtttacatttttatgagtatcctcttttatgatgaaaacttagtaatgcggtttaattttaa

SEQ ID NO: 47731 - DNA, 601 bp, Human
ctcgcctcactccatgaggagatcaacatacaacctcggtcctcagaccaaccagcccaaggaacatctcaccaatttcaaatcgggtaagcggtcttttcactctcttctccagcctctctcgctacccttcaatctccctgcccttccaattccagttctttttcctctctagtagagacaaaggagacacattttatccatggacccaaaactctggcgccagtcacagactcgggaagacagccttcccttggtgtttaatcattgcagagacgcctgcctgattattcacccacawttcactggtgtctgatcactgcagggacgcctgccttggtcattcacccacattcccatggtggcaagtcaattgcggggatgcctgctttggctcctcacccacactgcagcccagggctgctccccaccaccccgcttctccgtgtctctacctttctctttaaacttaccttcttcactatgggcaaccttccaccctccattcccccttcttctcccttagcctgtgttctcaagaacttaaaaccccttcaactcacacctgacctaaaacctaaatgccttattttcttctgca

SEQ ID NO: 47732 - DNA, 601 bp, Human
gcctatcccaaaacctgtaagaactaatgataatcccaccaccttttgctgactctctttttggactcagcccgcctgcacccaggtgaaataaacagccttcttgctcacacaaagtttgtttggtggtctcttcacactgacgcgtgagacatttggtgctgaagacccgggtcagagggactccttcggaagaccagtcccctgtcctcgcctcactccatgaggagatcaacatacaacctcggtcctcagaccaaccagcccaaggaacatctcaccaatttcaaatcgggtaagyggtcttttcactctcttctccagcctctctcgctacccttcaatctccctgcccttccaattccagttctttttcctctctagtagagacaaaggagacacattttatccatggacccaaaactctggcgccagtcacagactcgggaagacagccttcccttggtgtttaatcattgcagagacgcctgcctgattattcacccacaattcactggtgtctgatcactgcagggacgcctgccttggtcattcacccacattcccatggtggcaagtcaattgcggggatgcctgcttt

SEQ ID NO: 47733 - DNA, 601 bp, Human
gaagtatcatgtgctatttgttaaaagtaatatttttagatagaaatacgctaaaaaaaattgctaaaattttgtgaatcaaaaatatcctctagtactgagcagtgtcttaataggtgctaatcttaaacagaatttcatcaagtttacgatctaggctagtgagagaatattaacttgtttaggttatactggttatgaattatgaaagatagggattctctctctgcagaaaaaaagaaacatgtacacaaacatgcacaatttaaagggggttatctactaactctgagtaccattkcagaaaatactaacattttaaaaaactaaaattaagttttgaggtccccatctgacccatcttctgcctgacctatttccactaagcaatcatcccactcggtctcaaagggttcttttggtttcaataatctagtcaaataaaaatgcgcttgggttggggcagggtgcaggaagggtctccttgaatttgggcagcaaatatgtcactattattgttaaaaaaaaattatccaaaaaattaagagataaaaattaataaatatagtttcaactgaccacagaatattagaaaaactgt

SEQ ID NO: 47734 - DNA, 601 bp, Human
attattcacttctgctcattctggattaatatgaaattttatattccagtgatgtgcagaaaattaaataattatatcacagtattatgctacgtgaaaagcctagattcaccaaaaaacaaaaaaaaaactagaatatgatttctcaaaaggatttttaaacaaattcctttcctgtacattaaagcaccttttaaaattttaatatgaacattaacttttaaataatctagatatattaaaacacccactgaagtatcatgtgctatttgttaaaagtaatatttttagatagaaatamgctaaaaaaaattgctaaaattttgtgaatcaaaaatatcctctagtactgagcagtgtcttaataggtgctaatcttaaacagaatttcatcaagtttacgatctaggctagtgagagaatattaacttgtttaggttatactggttatgaattatgaaagatagggattctctctctgcagaaaaaaagaaacatgtacacaaacatgcacaatttaaagggggttatctactaactctgagtaccatttcagaaaatactaacattttaaaaaactaaaattaagttttgaggtccc

SEQ ID NO: 47735 - DNA, 601 bp, Human
atattcataatcttgtttttaacttatatttttcaaataagaatgctattcatctttagacatctgtgtaaattgaatttgttaagtaaaacaatgtctttagctgtaagttattagggagaaaccatatataatttaaaatgaattattttaacataagagaacttaagaggaaattatattattcacttctgctcattctggattaatatgaaattttatattccagtgatgtgcagaaaattaaataattatatcacagtattatgctacgtgaaaagcctagattcaccaaaaaacaaaaaaaaaactagaatatgatttctcaaaaggatttttaaacaaattcctttcctgtacattaaagcaccttttaaaattttaatatgaacattaacttttaaataatctagatatattaaaacacccactgaagtatcatgtgctatttgttaaaagtaatatttttagatagaaatacgctaaaaaaaattgctaaaattttgtgaatcaaaaatatcctctagtactgagcagtgtcttaataggtgctaatcttaaacagaatttcatcaagtttacgatctaggctagtgagaga

SEQ ID NO: 47736 - DNA, 601 bp, Human
ttacttaaagaaaaaaatgtagttaccaccatcatttcatcagaagtttaaacccatgctataataagaatagatctcattatgatatatagacacatacatacacacaattttaaaacttaaaaatatttactttaacttaaatcaactactagtatttgaataaaagataattacaaagtataaatcttgaattccaaaatatttaagtaggaattctgaatttcttctctgtttataattaggagtttaatgatagggcttggtataataattgtatcttacaatatttaagaattakaaaacaaacaagccctgatatgccacattctgaataagcatataaatataaaatatttctacacacttcacagtctgaagtaaaagctgtgaattagcaccatctaattttgctataagacttctttcctgcttgacaggtgaaaaaaaaagcacttgcacgtgcagcttaattaatcattgcacttgacatctcaatgatttacagtgaggagcaggtgagaacatacaaaaccagaaaggaacccttgatttgagtggaacatttctagcacactaaggtgacaagtatatagattct

SEQ ID NO: 47737 - DNA, 601 bp, Human
tatagttctatctggaattcatagcattgggataacttttatgttttcctttccaaagtaaatttagaaatgcatgaaaaaattaatacctcagttttaagcttagtgtttgtgttataaatgtagtaaatatttttttcactaaattctttacatctcctatccatccctctccccaaaatatatacataaaccctctatctaagatgaaaatacaagactagtctcctcacctcaaaatgagttactcaaatgtgttatgattataaagaagtatcaagtgtctttctcatcatcatamattaacatgtttgatgtagtaaagataaaatctacattatttggttcattgaataaagctagtctaagacattttaaaaatattttttatgttcaaggctagaaataggatttgactgtgggataatgaaagaacaggaaaatgctaacagacaaaaatgattttatgataatttacaactaaacactgttttaatcaatattttacacatacacacgcacacatctatgatggctatattgttttaaagaatagacaaaattcctcagaaatgttgtaacaggtacttcacaaaggctc

SEQ ID NO: 47738 - DNA, 601 bp, Human
gaaacttatttgacaaacaaagcatatagttcagaatgttttggaaggttataaattattttatgaataaattatagtcatatagttctatctggaattcatagcattgggataacttttatgttttcctttccaaagtaaatttagaaatgcatgaaaaaattaatacctcagttttaagcttagtgtttgtgttataaatgtagtaaatatttttttcactaaattctttacatctcctatccatccctctccccaaaatatatacataaaccctctatctaagatgaaaatacaagastagtctcctcacctcaaaatgagttactcaaatgtgttatgattataaagaagtatcaagtgtctttctcatcatcatacattaacatgtttgatgtagtaaagataaaatctacattatttggttcattgaataaagctagtctaagacattttaaaaatattttttatgttcaaggctagaaataggatttgactgtgggataatgaaagaacaggaaaatgctaacagacaaaaatgattttatgataatttacaactaaacactgttttaatcaatattttacacatacacacgca

SEQ ID NO: 47739 - DNA, 601 bp, Human
gaatatatatatatatattttttagtatctccaatgttcaaattataatcaaggataattattttcttttaacaaaattaaattcctgtaagttaaagaaaagttgaagaaaagagggacacatggttaaaaaggcccaaattcattagataaaatgaattttatttgctagtttaacttttaaaattcatttttataaattttttaagctacattattctcactttcaactatcacaaatatatatatatactctaagaaaatccagcagaacacattttttctccccagcttattattwttttttttaaagagaggtgggtattgctatgttacccaaactgtctttgtactcctagacgcaagtgatcctgctgcctcagcctccccagctagactactggcatgcccactacacccagctttttcctggcaattgaaatatttattttatctttactactcttctgggtatcttctatgatggagtgaaaataatataatggctttagcagaagtgcttaattatctaaaaattcaaggaaacttatttgacaaacaaagcatatagttcagaatgttttggaaggttataaattat

SEQ ID NO: 47740 - DNA, 601 bp, Human
catttgtctgagtcacagtgctctgggggacattctcaggggctggaggcctccagggacacaggactgtcctctgctaggtaatctacaaattggcttctccagccaaggaagcagggactagaagagccggaggacagccacctcctcactgtctgtcctggatgcctccatgaagcctgatgatgggatccttctcaaggcaggaggccagagcacgaagagatctccaaggtggagattaaaggatagaggctttggcattaaactgagcaaggattatactggaatttcctgggcrtttaacagctgtggaacaggataggggacagggcctgtggtactgacccctcccacactgacctgtgtggctcacaggtgtaaggaccagcccagcaaccacaccagacataaaacctcgaaccgctttgcccttgggactgttctgtccctgctggactctgcagcctgctttgtctcactaaattgttcctgtctgggctcggtttggggccatgccctttactatgtgttcccagtggacagtcccctgggttcccctctgtcccttcatagcctcatccctttgcttgacatcgtc

SEQ ID NO: 47741 - DNA, 601 bp, Human
aggcaaggctggatccccccaagattgggggagctccttggcacaaccttctggaggtaagtgggcatgtctggggtgcgcgggcagccctgcctttcacaacacgctcataacatactccacacccctccaggactcggggtgaagtattacatcgacccctccacctacgaggacccctgtcaggccatccgagaacttgcccgggaagtcgatcctgcttatatcaagattgaggaggtcattgggacaggtacagcagggccaaagcagggatcagagcgacggggctcccttgtgscctccgctggccagagtcccatccaaacacagcaggacgctgtgagccttgatccccaccccaacctacacctattttcccaggctcttttggagaagtgcgccagggccgcctgcagccacggggacggagggagcagactgtggccatccaggccctgtgggccgggggcgccgaaagcctgcagatgaccttcctgggccgggccgcagtgctgggtcagttccagcaccccaacatcctgcggctggagggcgtggtcaccaagagccgacccctcatggtgctgacggagttcat

SEQ ID NO: 47742 - DNA, 601 bp, Human
aagtcgatcctgcttatatcaagattgaggaggtcattgggacaggtacagcagggccaaagcagggatcagagcgacggggctcccttgtgccctccgctggccagagtcccatccaaacacagcaggacgctgtgagccttgatccccaccccaacctacacctattttcccaggctcttttggagaagtgcgccagggccgcctgcagccacggggacggagggagcagactgtggccatccaggccctgtgggccgggggcgccgaaagcctgcagatgaccttcctgggccgggcygcagtgctgggtcagttccagcaccccaacatcctgcggctggagggcgtggtcaccaagagccgacccctcatggtgctgacggagttcatggagcttggccccctggacagcttcctcagggtcagtccagcctgggtgaaggaggagggtccttgggtccaggaaagcttccaggagacgaggtcctgtatctttgcttcttaccaccccaccttccatggtctccgtccttccttcccagccattttctgattcgacaccctccccctctcatgctgttgtctgctgtgcagtatg

SEQ ID NO: 47743 - DNA, 601 bp, Human
agactgtggccatccaggccctgtgggccgggggcgccgaaagcctgcagatgaccttcctgggccgggccgcagtgctgggtcagttccagcaccccaacatcctgcggctggagggcgtggtcaccaagagccgacccctcatggtgctgacggagttcatggagcttggccccctggacagcttcctcagggtcagtccagcctgggtgaaggaggagggtccttgggtccaggaaagcttccaggagacgaggtcctgtatctttgcttcttaccaccccaccttccatggtctccrtccttccttcccagccattttctgattcgacaccctccccctctcatgctgttgtctgctgtgcagtatgttgaggtctccccgtctccgatcactgacctctgccccctgccccttcccctcagcagcgggagggccagttcagcagcctgcagctggtggccatgcagcggggagtggctgctgccatgcagtacctgtccagctttgccttcgtccatcgctcgctgtctgcccacagcgtgctggtgaatagccacttggtgtgcaaggtggcccgtcttggccacagtcctcagg

SEQ ID NO: 47744 - DNA, 601 bp, Human
agttccagcaccccaacatcctgcggctggagggcgtggtcaccaagagccgacccctcatggtgctgacggagttcatggagcttggccccctggacagcttcctcagggtcagtccagcctgggtgaaggaggagggtccttgggtccaggaaagcttccaggagacgaggtcctgtatctttgcttcttaccaccccaccttccatggtctccgtccttccttcccagccattttctgattcgacaccctccccctctcatgctgttgtctgctgtgcagtatgttgaggtctccccttctccgatcactgacctctgccccctgccccttcccctcagcagcgggagggccagttcagcagcctgcagctggtggccatgcagcggggagtggctgctgccatgcagtacctgtccagctttgccttcgtccatcgctcgctgtctgcccacagcgtgctggtgaatagccacttggtgtgcaaggtggcccgtcttggccacagtcctcaggtgagagcacagccttggggacacagcctggggccttgtggcatgccccagcaggtgctggggtcgggggtgagctggaatctgg

SEQ ID NO: 47745 - DNA, 601 bp, Human
attccccctcccaccttctcctcaccaggttaaaacttacctcattagcagcatccctctacaaggtgcatttaactataagtatactgcctgcctatgtgacgacaatccaaaaaccttctactgggacttttacaccaacagtaagtacagaagttgtccaaggagggaactacccaccagccaccagggaggagaaactataaacagaaacatggctgcgaaccgagcaggaccaggacctcagggcagaaggacagaagggagggagggaagagcatggggagagcagatggggaargcacccaggttctaagacagaggcattgagtgcaaaaagttgatacaggagacaaatttgcaaaggatttggggaaactgaaccccagggggcagatgcctgatatgagtagaaaagacaggacatggccggggtgtctgagagatgatctccgtccctgtctttttcaggaactgtgcaaattgcagccgtcgttgatgttattcgggaattaggcatctgccctgatgatgctgctgtaatccccatcaaaaacaaccggttttatactattgaaatcctaaaggtagaataatggaa

SEQ ID NO: 47746 - DNA, 601 bp, Human
aagggcaggccaaaggccctctaaagaaaacaggaactgggtaggcagagagaagactcccaaagaatgctgtcatggaaaccagaggaagagaacgatttaaggagcgaatactactggtaaactaatggaagaaatctgctgcaccactggttagtatcccagctgcagtgttatatgtgatcgttattactgctttgacgtattcgaaagtgattcattcttaaataggtttttttatttgtatagctctttttcttgtagccagtttttcctgaaagtcttgggtaatggaaatatkacagtaaaaagaagaaaaaatggagtttcagactcatttttccaaacctcagattcattggctgcttccaacccacttcatctgttttaggatcccacctgctatcttagttctcccagttcttccaggacccagctcttccctcttctaactataaatctctcacccaatagcatctgcaagccaagtgcatccattccatagatgtgtggtatttcactgactctaagatacacattttttccctccctttttttttttttttttttttttggacggagtctttgctgtgtcacccag

SEQ ID NO: 47747 - DNA, 601 bp, Human
aagaagcgcctaggtagatatgatcagaaggataagtggaggaggcagaacttaagctggccttgaaggatagaagttactgaagcagagaggagtggtgaagccaccctaggcagggagaacagtatgtggacaagaaatgtgtgtgttataaaccaggtagttgcaatgggtgtcataatttggtacactgggcatctgcacagaatgctctcttcctggtgggatctccctagagagtcaactcgtttatcatatagctatttggcaagcaaagaaacagaaccaaaaaaaaaaaaaagatccttttttctttccctatcaaatctttcttacttaagagaggaattccatttaaaaacaggaaatagtataattagtcttagagactcctcttcccctgatagtgctgcagtgaacatgggtattctcactgcccagatgttttcacttttctctttgttattaagtttttattgcatctacttcatgaggttactagttctagaattatgatttaccctatgttaggaaacgtactcttcaaagtggaaatttccttttaccatgtggtattgtttttttagcttgcatttgggtc

SEQ ID NO: 47748 - DNA, 601 bp, Human
attccagttacggatttttgatctgtctttttcctgtccttcttattttatctcctttctttcactctttgttcttttcacttgttccatatacttccctgtttacctacacttccatgcttgcctcctttcttcttacttcttaccattcttgggtcatgcaggatagcagaacagaatccgtgttggcctttgactcttccttttccgtgagctgctgctgcccctctttctctcatgcagtctgttttactcctttaagagccaggactgcaggacgaggattaaaagacacataggygtgcttctcatcctggaggaaaataatagtaattaagagccctaactttggagtcaaattctgacttcaccatttactagtaacgtgaagttaaagaagttaaatggcatccctccatctcagtttcctcaatataaaatgaaaatagtccttgtacctacttcataaggtgcttgtgatggttaaatgagattatgcatttaagggcttacatagctcagtacctggctcacagcacatccacaaaatatgccagctgtaactcttaaaacacgatcagtgccgtaaagggcttatagt

SEQ ID NO: 47749 - DNA, 601 bp, Human; identical to SEQ ID NO: 17728

SEQ ID NO: 47750 - DNA, 601 bp, Human; identical to SEQ ID NO: 17729

SEQ ID NO: 47751 - DNA, 601 bp, Human; identical to SEQ ID NO: 17730

SEQ ID NO: 47752 - DNA, 601 bp, Human; identical to SEQ ID NO: 17731

SEQ ID NO: 47753 - DNA, 601 bp, Human; identical to SEQ ID NO: 17732

SEQ ID NO: 47754 - DNA, 601 bp, Human; identical to SEQ ID NO: 17733

SEQ ID NO: 47755 - DNA, 601 bp, Human; identical to SEQ ID NO: 17734

SEQ ID NO: 47756 - DNA, 601 bp, Human; identical to SEQ ID NO: 17735

SEQ ID NO: 47757 - DNA, 601 bp, Human; identical to SEQ ID NO: 17736

SEQ ID NO: 47758 - DNA, 601 bp, Human; identical to SEQ ID NO: 17737

SEQ ID NO: 47759 - DNA, 601 bp, Human; identical to SEQ ID NO: 17738

SEQ ID NO: 47760 - DNA, 601 bp, Human; identical to SEQ ID NO: 17739

SEQ ID NO: 47761 - DNA, 601 bp, Human; identical to SEQ ID NO: 17740

SEQ ID NO: 47762 - DNA, 601 bp, Human; identical to SEQ ID NO: 17741

SEQ ID NO: 47763 - DNA, 601 bp, Human; identical to SEQ ID NO: 17742

SEQ ID NO: 47764 - DNA, 601 bp, Human; identical to SEQ ID NO: 17743

SEQ ID NO: 47765 - DNA, 601 bp, Human; identical to SEQ ID NO: 17744

SEQ ID NO: 47766 - DNA, 601 bp, Human; identical to SEQ ID NO: 17745

SEQ ID NO: 47767 - DNA, 601 bp, Human; identical to SEQ ID NO: 17746

SEQ ID NO: 47768 - DNA, 601 bp, Human; identical to SEQ ID NO: 17747

SEQ ID NO: 47769 - DNA, 601 bp, Human; identical to SEQ ID NO: 17748

SEQ ID NO: 47770 - DNA, 601 bp, Human; identical to SEQ ID NO: 17749

SEQ ID NO: 47771 - DNA, 601 bp, Human; identical to SEQ ID NO: 17750

SEQ ID NO: 47772 - DNA, 601 bp, Human; identical to SEQ ID NO: 17751

SEQ ID NO: 47773 - DNA, 601 bp, Human; identical to SEQ ID NO: 17752

SEQ ID NO: 47774 - DNA, 601 bp, Human; identical to SEQ ID NO: 17753

SEQ ID NO: 47775 - DNA, 601 bp, Human; identical to SEQ ID NO: 17754

SEQ ID NO: 47776 - DNA, 601 bp, Human
ctgatatctattcatcccattgtaggcaatataatttatcctgagcatattttttctttttatctctgtgccttccctgaaagtatccatttacccaaagagaggccccctcccactctttccccatcaaaaaaagagggcagaggggtgcatttacttttcccagattctaattgatagtgtcaacacattctttaggttcccttgcactggaaatgcatgtctatcttatatgttcttattcccaaatcctcaccaccatccaccaacttcctgggacgcacttccaacctcctactcagtttcagctcatccttctggttttcctctcagtcctggcagttttcctctccagcctccatctgcaggaactttacttccactgccaattaactcagctctcctcttcttccagcatatcctttgtacttacccactttttctcttatgcacagtgatgaagccctctctcacttctcaccccaccatcctacccctttcattccaccatcatccatcatctccaatcatccatctctaacatcccacttgttccaggtcaacttgcttgccatggttcaaggtttcaatggagaagcaa

SEQ ID NO: 47777 - DNA, 601 bp, Human
ctcctccccagagcctgggtgccaggaattctggacctctagaaaggaagcatgggagtgaggactaaactctgattttttttatcttgccccaaattcctatcaaaggggtctggggagtcatgccctatatcataagttctcatcagatgggttttatttaacccatgtaacatgatttactttctaacctgattctggcataacattacgagacaaagaagaaaacaaaaatattttaccccaaaacatgtttctttgccacattttgaaatggccctgcaaagctgttctttgtggrggaaaatttgcatctgtaaagcatctctattagctattaacatatctcattaacatagctagatcttttgattaactaagatctgaataggaaacatttgtcacctattgtctctaagggcagccactataagacttcaaaagaacttcggtctccgcaatctttatcttaccctgaacattccctttctatctatcccagatctttagacaaactcaagcaactgtcaatccggaaatgtttaaattcacctgtaccctggaagccacccccacccctttgagttgttccacctttctg

SEQ ID NO: 47778 - DNA, 601 bp, Human
atttaccagagatgcgccagcctccaagctttaaaggagagagagggggctgagcataaggatccgtggagcccatcccccattgtctggatcggctcttacacagctgctactgcctgacctctgccctgcgcccttcgattcctctaggaagccacatctatccttttttatctgccttctcccaaggtcctgatactttcatagggcataaccatttccatctccatctccctcctagaaattggggggccctaggaagaagacccaccctctagaaaaaaaaatggcagccctaagyatgcattggtcccatatgttatgtatccagaaaagttaatatcccaacttttctcacctcctcaataacttgtctgaggggaccagtccctgcagcttcaatggcaagtgtatccatgcaggagttgtagaactggaaggctttctcctccccagagcctgggtgccaggaattctggacctctagaaaggaagcatgggagtgaggactaaactctgattttttttatcttgccccaaattcctatcaaaggggtctggggagtcatgccctatatcataagttctcatcagatgggtt

SEQ ID NO: 47779 - DNA, 601 bp, Human
tttcctatatcacacaggtgtcctctcttcccaacctgcaaccttcctctaagggatgattggctagagttggaggcaggccaggtccaactgtgtcttcgccagtgcatccctcacctggatgactggtgtgtgtggagaggcaggatgaggtcctaggtaggctctgaagaaagggaaatggccatactgactcatcagaagtctcagcgttcggttaaagtttaaggaagtccatttaccagagatgcgccagcctccaagctttaaaggagagagagggggctgagcataaggatcygtggagcccatcccccattgtctggatcggctcttacacagctgctactgcctgacctctgccctgcgcccttcgattcctctaggaagccacatctatccttttttatctgccttctcccaaggtcctgatactttcatagggcataaccatttccatctccatctccctcctagaaattggggggccctaggaagaagacccaccctctagaaaaaaaaatggcagccctaagcatgcattggtcccatatgttatgtatccagaaaagttaatatcccaacttttctcacctcctca

SEQ ID NO: 47780 - DNA, 601 bp, Human
ttcccttaaggtagggttgtttcctatatcacacaggtgtcctctcttcccaacctgcaaccttcctctaagggatgattggctagagttggaggcaggccaggtccaactgtgtcttcgccagtgcatccctcacctggatgactggtgtgtgtggagaggcaggatgaggtcctaggtaggctctgaagaaagggaaatggccatactgactcatcagaagtctcagcgttcggttaaagtttaaggaagtccatttaccagagatgcgccagcctccaagctttaaaggagagagagrgggctgagcataaggatccgtggagcccatcccccattgtctggatcggctcttacacagctgctactgcctgacctctgccctgcgcccttcgattcctctaggaagccacatctatccttttttatctgccttctcccaaggtcctgatactttcatagggcataaccatttccatctccatctccctcctagaaattggggggccctaggaagaagacccaccctctagaaaaaaaaatggcagccctaagcatgcattggtcccatatgttatgtatccagaaaagttaatatccc

SEQ ID NO: 47781 - DNA, 601 bp, Human
acctccctcaaaaaggatttccagatgctgctgccaccatgaagaaggcccttaggtccaagcccctggaagaaagccactgctttcaggtggtagccacccaggtatcaggggaggcagagagcccaacaaagagccactctttcatgtccccaaccccaacacccccttgatttcctgacaccagcagaaatgctcttagacattgtttcccataagagctccagcatcttcacaccacacctgaggaatggcccctcctcttcctttcttcccctaagcatccccagccttcaccatsttcatctcctcatctcatgtgcctcctcctcctgcccacagtcctcagctgctaaaaagacatacatacacttaactgtcttctgtgtctgggtcttccagcatcttctacagctcagaggctcttgactggctggtgttctactctcaggaaaccccgtgtcttggctgaccctgcgttcctcatgtcgtgtgtatcctcccttactcgtgctcccaagacacatccttcttgatccctccatcctctctgtgccacccaccccacgcttctctgcccgcacaggtggcaggttcctct

SEQ ID NO: 47782 - DNA, 601 bp, Human
caagttatcctgagcaaatagtgtaagcatcatgacaaagaaagggcagttttgataatatcagagttttatatttgagctcaaacacccagcaagaagccagagaggtagtcaggctgggagatgtgtgcctgaaggtctggcacgtggcatcttggttttcaagttaaactttgtctgtccaacttgcctgcttctatggaaagccaagacatggaggggcatctaccatcacggccccctccctgagagagagatgccgacatttacccctcaaaagagtagatactcctttcgagtrtctgggcaaatacacccgctcctctcctcaccatgggtggttgctctgtcagttcccgcagtttctggctgagctttctgcgtgcctcctggaattgactgtccagggctggagaaagggtcaccaccagccctaagatcatgtggctctgcagaaagtccctatggagacaaaagagacccacacatataccccaggaatctggggatgcttcaagaagagcctctccttgtgtaagtcaccttgatactcgtgaaggcagctccttctcctctgtattaataagtgttttaacatgca

SEQ ID NO: 47783 - DNA, 601 bp, Human
aagacctgcccacggggaaggtaggaaggctgccactaatactctccccgcaggagctaggctggtcctgggaatggagggggtttatgtgcatcccactacaggaaacagaccaaagaggccagtctggtagtcaccgaagaaaaaactcccgaacccaccagttaaagaggttatcattttggaggttgctgcaggcctggctgtccacatctgtgttctattgaaccttgaggtctgctaaccttgagtcttatttttatttttattttgtaacagagtctcactctgtgacccaggytggagtgcagtggtgcaatctcggctcactgcaactttcacctcccgggttcaagtgagtcttctgcttcagtctcccaagtagctgggattacaggtggctaccaccagagatgaagttttgccatgttggccaggctggtctcaaactcctgggctcaagtggtccatctgccttggcctcccaaagtgctgggattgcaggcaagagccaccgcacctggccaaccttgtctctgataaagagaagaggctcagattcttctcatgctgcatgagttggagctctgaaacaacagga

SEQ ID NO: 47784 - DNA, 601 bp, Human
acacggtaaatggagacacacactcaaggaacccagggacaggaggaggtagctggcctgagggaaagctgagctggaactgataaataccagctaatatgctaatttgggttaggcaggatgaagcctcaaaactttattcctgtgatttttttacttcccaaagacctgcccacggggaaggtaggaaggctgccactaatactctccccgcaggagctaggctggtcctgggaatggagggggtttatgtgcatcccactacaggaaacagaccaaagaggccagtctggtagtcacygaagaaaaaactcccgaacccaccagttaaagaggttatcattttggaggttgctgcaggcctggctgtccacatctgtgttctattgaaccttgaggtctgctaaccttgagtcttatttttatttttattttgtaacagagtctcactctgtgacccaggctggagtgcagtggtgcaatctcggctcactgcaactttcacctcccgggttcaagtgagtcttctgcttcagtctcccaagtagctgggattacaggtggctaccaccagagatgaagttttgccatgttggccagg

SEQ ID NO: 47785 - DNA, 601 bp, Human
actgcagaggcaggaggccatggacaaacatccaagagggcagtgccagctgaggacctcaagaatgagaaacagaagagacagatgctgagaaggtcttggcggtgggcttgcatggctttaaaaacttgaccaaggcataaacccagagatgacacggtaaatggagacacacactcaaggaacccagggacaggaggaggtagctggcctgagggaaagctgagctggaactgataaataccagctaatatgctaatttgggttaggcaggatgaagcctcaaaactttattcctgtkatttttttacttcccaaagacctgcccacggggaaggtaggaaggctgccactaatactctccccgcaggagctaggctggtcctgggaatggagggggtttatgtgcatcccactacaggaaacagaccaaagaggccagtctggtagtcaccgaagaaaaaactcccgaacccaccagttaaagaggttatcattttggaggttgctgcaggcctggctgtccacatctgtgttctattgaaccttgaggtctgctaaccttgagtcttatttttatttttattttgtaacagagtct

SEQ ID NO: 47786 - DNA, 601 bp, Human
agagtagaactgggttttagatgccatattgtttgctaggaaaagaggacacaagacaagactcagtgtataaattcatagagctggaagacttccagccaagtcagagaggagagaatagaacaggaaggtggagggctttcactgcagaggcaggaggccatggacaaacatccaagagggcagtgccagctgaggacctcaagaatgagaaacagaagagacagatgctgagaaggtcttggcggtgggcttgcatggctttaaaaacttgaccaaggcataaacccagagatgacayggtaaatggagacacacactcaaggaacccagggacaggaggaggtagctggcctgagggaaagctgagctggaactgataaataccagctaatatgctaatttgggttaggcaggatgaagcctcaaaactttattcctgtgatttttttacttcccaaagacctgcccacggggaaggtaggaaggctgccactaatactctccccgcaggagctaggctggtcctgggaatggagggggtttatgtgcatcccactacaggaaacagaccaaagaggccagtctggtagtcaccgaa

SEQ ID NO: 47787 - DNA, 601 bp, Human
gaagtcaaggactgaaaaggagctggaaaacacagggacccacatcgttgtattcttgtcgggccagctctggcttcagggcccattctgaagcccccatctccacctgcagttgagcaacctggagagagacacagaagaggctaggaatactctccgagtctaccagaggaaatttctcccactcgttgccctgtcccagcctctcacattgttgccagtgtgagtatacagcccagtggcttccctacttagcatgtgcctgggggggcctttggcatttgcttccaatccccatctmgcttgttccaatactccattccctgcacaggctcccacaccagccaggacgcctggcctgaccttgtcctgggccatgttctgggtctcctcattcatccagggaaggtttctgaggcgagtgatgagggcatcccggatcgcagtgaataatttcatggcctgtgggagtgaggtccagggacagggggacaggatcaggagaggcctcagcctggccctgcccacagcttctgacccttggaaaagggcttggccccaaggagctgcctgggctggagctgctgctagaggagcagct

SEQ ID NO: 47788 - DNA, 601 bp, Human
tacagtgtggatatttccccatcaaccccagccagcaccagagtaaggacagagctaagtcacccagggaaaactgattgtccaacaaagacttaggagggtcagagaagtgacgagaagtcaaggactgaaaaggagctggaaaacacagggacccacatcgttgtattcttgtcgggccagctctggcttcagggcccattctgaagcccccatctccacctgcagttgagcaacctggagagagacacagaagaggctaggaatactctccgagtctaccagaggaaatttctcccaytcgttgccctgtcccagcctctcacattgttgccagtgtgagtatacagcccagtggcttccctacttagcatgtgcctgggggggcctttggcatttgcttccaatccccatctcgcttgttccaatactccattccctgcacaggctcccacaccagccaggacgcctggcctgaccttgtcctgggccatgttctgggtctcctcattcatccagggaaggtttctgaggcgagtgatgagggcatcccggatcgcagtgaataatttcatggcctgtgggagtgaggtccagggac

SEQ ID NO: 47789 - DNA, 601 bp, Human
cccttgctcactggttctgcactgactagttgatctgagccagaagaaagagtacttcccagaagacctatagatgtcctaaaatggaggatctctggggtaggagggggatccccaagttgccgtctattcagtggggatgcgaagggcagaaagccatgcaactgtacttgtgtcaggaatggtggaaggaaaacttgaggacatgttttctagtctgccagtacacataaactgtggcccttgacacttgcatacctgcagcgcgatggctagccccccaacgtctgcagcattctcyaagaatgtgagggagtcattgaaggaggttctgctaggtaatggaaaggcagcataatggcgcttcaggcacaggtgagcttcctggagggcatggttgtcacaggcgaggcagcccccaggcagtactgttgaaaatgggacaagagaacatacagcaagagaacatagggttggtgctgcctaggtgaggatgtgggtggtaccacagactgaatcagctcccaggagcatggcaaagttcccaggactgccccacctcaaaccctcaaataacctccctttcccctccaggcctccc

SEQ ID NO: 47790 - DNA, 601 bp, Human
aagtagctgggattacaggcgcccgccaccaagcccagctaagttttgtatttttagtagagacggggtttcaccatattggccaggctggtcttaaactcctgatctcaagtgatccgcccacctcggcctcctagagtgccaggattacaggtgtgagccactgtgcccaaccacaggctcatttttaaggcatctgtattttgggggtatgagaggaaaaaaaagttggtctcctcctctcctggaggaacttgggaatagagttttttctaccttttgagttgtgggggtgctgaaytaggtagaagaacctgtagtcatctgaggggtgattccaaggggtagggagggaagagaaaagataacagtgaggacatctgcagaagagggtttggggtatttgacggagtgtctgaagaggggacttccatgagcttcagtaataaggcgttcaactgacataaagcaagctgtggcgggaggtggccgctgcctacctgggcatagcttcgaaagaagatctgctgggggctgaggtccaggctgggcaggacagtctccccatggtgccgtaacagcctcttgctgtatgcctggg

SEQ ID NO: 47791 - DNA, 601 bp, Human
ttggaagatatttcttgtgtaaacacaccatcaccaccaccgtcaccaccattagctggataacctatgacctttgggcaaattaaagaactagtgacagatgaatacctcatttcagtttccagtagaccagctgaagggaagagattcacatttggtgggtcttttttggttgtagcccatcttttgtggtcatccagtctagcggtgtccaaagtacagtacatataaaacaatccatgggattataagaagaaaatattagagatcatgtttatctcatcatttaaaatttctattktcatacattttcagatatatttcatattttaatatagctgtgcagatatataatacataaagaaatcatgcagtggccacatatttaaaattttttgccaggtgcagtggttcacacctataatctcagcactttgggaagctgaggcaggaggattacttgagcccaggagtttgaggctacagtgagctatgatggtgccactgcacttcagcctgggtgacagagtgagactgtttctctaaaataattaattaatggataaataaaaataaattttaaaaagtttactgataactt

SEQ ID NO: 47792 - DNA, 601 bp, Human
atataatacataaagaaatcatgcagtggccacatatttaaaattttttgccaggtgcagtggttcacacctataatctcagcactttgggaagctgaggcaggaggattacttgagcccaggagtttgaggctacagtgagctatgatggtgccactgcacttcagcctgggtgacagagtgagactgtttctctaaaataattaattaatggataaataaaaataaattttaaaaagtttactgataacttatacaatcaaaaaaatctgatggctgctggaccaatttaaaaccagayagaagccacatggtaatgcccctgaagattgtagggcttagattatagtaaaacttagattatagtaaaaaggagttattttcttacaataaaggcatagaaagcttacattttgaggaaatgacaaaatatctaaccaatcttgagaagcattattatttctagatcacacagcttttaaaaaaaggaagttttgttgggcgtggtggctcaagcctgtaatcacagcactttgggaggctaaggggagcggatcacctgaggtcaggagttcaagaccagcctggccaacatggtgat

SEQ ID NO: 47793 - DNA, 601 bp, Human
agtgtctgtcattcctctctttgtgtctatgttttctcatcatttagctcctgcttgtaagtgagaacatgtgatatttggttttctgttcttgcattagcttgctaagggcgatggcctctgactctgtccatgtcctcgcaaaggacaagatcttgtataacctcattaatattcttcaaagtaacttttttttctgataacaaaagtaatatacgtatgaaatttggaaaatacaggtaagctccaaaaaaattttaaaataatctatgatcctccatctcctgagaataaccattawtgttttcattatatattaggttagtctatttgtgtatgtgtgtgtatacttttaaaaaatggagtcatactgtattaatccatgttcacactgctctaaggatctacctgagactgggtaatttatgaagaaaagaggtttaatggacccacagttcagcaggcttaacaggaagcatggctaggaaacctcaagaaacaggatcatggcagaaggcgaaggggaagcaagaaggtcttaccatggcagagcaggagacagagaaggggcaagggccacacattttcaaacaaccagatc

SEQ ID NO: 47794 - DNA, 601 bp, Human
atttagctcctgcttgtaagtgagaacatgtgatatttggttttctgttcttgcattagcttgctaagggcgatggcctctgactctgtccatgtcctcgcaaaggacaagatcttgtataacctcattaatattcttcaaagtaacttttttttctgataacaaaagtaatatacgtatgaaatttggaaaatacaggtaagctccaaaaaaattttaaaataatctatgatcctccatctcctgagaataaccattaatgttttcattatatattaggttagtctatttgtgtatgtgygtgtatacttttaaaaaatggagtcatactgtattaatccatgttcacactgctctaaggatctacctgagactgggtaatttatgaagaaaagaggtttaatggacccacagttcagcaggcttaacaggaagcatggctaggaaacctcaagaaacaggatcatggcagaaggcgaaggggaagcaagaaggtcttaccatggcagagcaggagacagagaaggggcaagggccacacattttcaaacaaccagatctcgtgagcactcactcactatcaccagaacagcaaggggga

SEQ ID NO: 47795 - DNA, 601 bp, Human
tgatcctccatctcctgagaataaccattaatgttttcattatatattaggttagtctatttgtgtatgtgtgtgtatacttttaaaaaatggagtcatactgtattaatccatgttcacactgctctaaggatctacctgagactgggtaatttatgaagaaaagaggtttaatggacccacagttcagcaggcttaacaggaagcatggctaggaaacctcaagaaacaggatcatggcagaaggcgaaggggaagcaagaaggtcttaccatggcagagcaggagacagagaaggggsaagggccacacattttcaaacaaccagatctcgtgagcactcactcactatcaccagaacagcaagggggagatccgccccatgatccaatcacctcccaccagacccctcccctgactcgtgggaattacaattcgagatgagatttgggtgggaacacagagccaaactatatcacatattgttttgtaatattttgtcacttcatattgtgaacattttccatgtcttaagtataattcttcagcatcatttttaatggccacataatattaaatgatgtgaatgtgccaatatttt

SEQ ID NO: 47796 - DNA, 601 bp, Human
taagtataattcttcagcatcatttttaatggccacataatattaaatgatgtgaatgtgccaatatttttaagcaatcccctagtgctcaacattaatttgtttacatttttagctattataagccatactgcaatgaccatttgtctactcctttacttttgcatatatctttgattagtccttgggataaattcctaggagaggaatagttgaattcaaaagatgtgttgttttaagacttttgatacatatctttgtggccttatgtaaatgattaaatttttatgagttctctcaycaagaaattctggaaagggaaaatatggaccaaaaatgagattctatttattttataactgaattttagactctgggaccctcccctaaaagtctgttcatctcttttagtcaagactgttgacagcttttccacaacagccagcagacttcagttaccattatccacttttttcatgcattttatttcccctgtttctgcaatacattccttaaaccaaataccaactcctccctctatacctgttttccataactatattgggattactggtatatctatcacttccaggtccttttc

SEQ ID NO: 47797 - DNA, 601 bp, Human
ctgataattagtttcagtaaaaagatggatagaaacattgttgaagcattactttctttattttacaatctgtgttctttcattaccagtactatccactttatttttctatggataatcaagacttggctgaacatagttgaatagcacaggcatgaggtagaggttggtagaggataattttattttttattgcaatactcggaatactttgtatttgagtgccaaatgtatttgtattttagtaattaatctgtttatcatcttataaaaatactaataggcattatttctaaaaaayatagtgagttacaatgtaagtatcctaaagcaatatgaaaagaaaggatttttaaacaaattatttgggaatcattaaatagcaatgtggaaaaaaataatttatatctgtcctcataccatacaccaaaataagtttcagatgaaagtaaagattaaatttttaaaaatgaactatagataacttttagaaggtagactaggcagtggaagaaattacaaaggaaataatagacaatgatatagaatactttgttcaaaaataataaaattaaaagaaaaaggcttataaaaatattct

SEQ ID NO: 47798 - DNA, 601 bp, Human
tctttattttacaatctgtgttctttcattaccagtactatccactttatttttctatggataatcaagacttggctgaacatagttgaatagcacaggcatgaggtagaggttggtagaggataattttattttttattgcaatactcggaatactttgtatttgagtgccaaatgtatttgtattttagtaattaatctgtttatcatcttataaaaatactaataggcattatttctaaaaaatatagtgagttacaatgtaagtatcctaaagcaatatgaaaagaaaggatttttwaacaaattatttgggaatcattaaatagcaatgtggaaaaaaataatttatatctgtcctcataccatacaccaaaataagtttcagatgaaagtaaagattaaatttttaaaaatgaactatagataacttttagaaggtagactaggcagtggaagaaattacaaaggaaataatagacaatgatatagaatactttgttcaaaaataataaaattaaaagaaaaaggcttataaaaatattctcatttgtatcaaagaaatatagaaggagtttcttcaagtttatgtgaacaatgg

SEQ ID NO: 47799 - DNA, 601 bp, Human
ctttatttttctatggataatcaagacttggctgaacatagttgaatagcacaggcatgaggtagaggttggtagaggataattttattttttattgcaatactcggaatactttgtatttgagtgccaaatgtatttgtattttagtaattaatctgtttatcatcttataaaaatactaataggcattatttctaaaaaatatagtgagttacaatgtaagtatcctaaagcaatatgaaaagaaaggatttttaaacaaattatttgggaatcattaaatagcaatgtggaaaaaaataatttatatctgtcctcataccatacaccaaaataagtttcagatgaaagtaaagattaaatttttaaaaatgaactatagataacttttagaaggtagactaggcagtggaagaaattacaaaggaaataatagacaatgatatagaatactttgttcaaaaataataaaattaaaagaaaaaggcttataaaaatattctcatttgtatcaaagaaatatagaaggagtttcttcaagtttatgtgaacaatggaaggctaatagataaatgaacaaaggggttttgacaattcatgc

SEQ ID NO: 47800 - DNA, 601 bp, Human
cacaggcatgaggtagaggttggtagaggataattttattttttattgcaatactcggaatactttgtatttgagtgccaaatgtatttgtattttagtaattaatctgtttatcatcttataaaaatactaataggcattatttctaaaaaatatagtgagttacaatgtaagtatcctaaagcaatatgaaaagaaaggatttttaaacaaattatttgggaatcattaaatagcaatgtggaaaaaaataatttatatctgtcctcataccatacaccaaaataagtttcagatgaawgtaaagattaaatttttaaaaatgaactatagataacttttagaaggtagactaggcagtggaagaaattacaaaggaaataatagacaatgatatagaatactttgttcaaaaataataaaattaaaagaaaaaggcttataaaaatattctcatttgtatcaaagaaatatagaaggagtttcttcaagtttatgtgaacaatggaaggctaatagataaatgaacaaaggggttttgacaattcatgcaaagcagattatgaatattaaacaaatgtgagcaccggcagttaaacta

SEQ ID NO: 47801 - DNA, 601 bp, Human
tactttgtatttgagtgccaaatgtatttgtattttagtaattaatctgtttatcatcttataaaaatactaataggcattatttctaaaaaatatagtgagttacaatgtaagtatcctaaagcaatatgaaaagaaaggatttttaaacaaattatttgggaatcattaaatagcaatgtggaaaaaaataatttatatctgtcctcataccatacaccaaaataagtttcagatgaaagtaaagattaaatttttaaaaatgaactatagataacttttagaaggtagactaggcagyggaagaaattacaaaggaaataatagacaatgatatagaatactttgttcaaaaataataaaattaaaagaaaaaggcttataaaaatattctcatttgtatcaaagaaatatagaaggagtttcttcaagtttatgtgaacaatggaaggctaatagataaatgaacaaaggggttttgacaattcatgcaaagcagattatgaatattaaacaaatgtgagcaccggcagttaaactagtgcaaagttataaaacactaaactaaaatagaaccaaaaaagaattgataacacttact

SEQ ID NO: 47802 - DNA, 601 bp, Human
gtttcagatgaaagtaaagattaaatttttaaaaatgaactatagataacttttagaaggtagactaggcagtggaagaaattacaaaggaaataatagacaatgatatagaatactttgttcaaaaataataaaattaaaagaaaaaggcttataaaaatattctcatttgtatcaaagaaatatagaaggagtttcttcaagtttatgtgaacaatggaaggctaatagataaatgaacaaaggggttttgacaattcatgcaaagcagattatgaatattaaacaaatgtgagcaccrgcagttaaactagtgcaaagttataaaacactaaactaaaatagaaccaaaaaagaattgataacacttactgccaacatgttcataccttgctattgtgagcgaaactatcaaaatccttttggacagaatttggaatgtatgtattcctggagccaggaaactgtcctctttaaccaaggaactgaatctggggatatacttatgcagaacaggtaagagggtacagaacaactattagaacttataataaaaataggaactacatgaaggatacatgatatgtgaaaaagtagaaaa

SEQ ID NO: 47803 - DNA, 601 bp, Human
catggaggtgaaagtgagatttcatgagccacttattaatacttgtcctctatagaaaccctaaagatagttaaaatagccaacgctatcacttgctgtttcctcccaaatctcacttggtatcatgtgtttcttgggtgattttaaatttgtcagctatttgtatttgagagagatttgcttttatctagcatttattcaatttcagtagagtggaaacctttaatactgctcatatcaggagaacgggatgaaggcccacggcataaaccaccctcattttatatactttttgctctaygtagttatattttgaaggttaggttttagcaattgtaatgagaaaacattttattaagaatctacaggatttcttttctcttaaggtagagaaaattagagaagagggaagtgtagctcacttctagaggcagataaattgtttcatcaatgcagtggatggtgagttgatttgctttcaagaccagagtatctttgaagctaactcaacactactttgttccatgttctgcaaacactggcttttgagtgatctgaggagaatctctcatgacctttcacactggcatcatttttctca

SEQ ID NO: 47804 - DNA, 601 bp, Human
gaagcactaataatgccaccacttagaaatgacccttcttaaatttctggtgcaaaaaaatattcaaactctaaggaaaaagaaacttgaaaatactacagctatataagtaagcatatcatgactaatgactaatggctctctcaattacttttgagaggcaatgtcatataggagagaaagcactcttcgtaaaattggccaatcctgggattctaggcccagttctaccagttatcagttatatgattttaggagaatttacttaaccaccctatgccttagttttttcatctttaartaactataataaggccatacctgtagggttgttgtaaggattgaacatatgatatatgtaaagtactatgctagtgtatggtatatagtaagtcctcaataaaaggtaaatattaatgtaagtagtatgcataatgaagttcttaggagagtatcattaaaaaattcattagcagcccggcgcagtggctcacacctgtaatcccaacactttgggaggccaaggcgggtggatcacctgaggtcaggagttcgagaccagtctgaccaacatggtgaaaccctgcctctactgaaaaat

SEQ ID NO: 47805 - DNA, 601 bp, Human
ctgggattctaggcccagttctaccagttatcagttatatgattttaggagaatttacttaaccaccctatgccttagttttttcatctttaaataactataataaggccatacctgtagggttgttgtaaggattgaacatatgatatatgtaaagtactatgctagtgtatggtatatagtaagtcctcaataaaaggtaaatattaatgtaagtagtatgcataatgaagttcttaggagagtatcattaaaaaattcattagcagcccggcgcagtggctcacacctgtaatcccarcactttgggaggccaaggcgggtggatcacctgaggtcaggagttcgagaccagtctgaccaacatggtgaaaccctgcctctactgaaaaatacaattagccagacatggtggctggtgcctgtaatcccagctacttgggaggctgaggcaggagaattgcttgaaccccagaggcagaggttgcagtgagctgagatcgtgccattgcactccagcctgggtgacagagcaagactctgtctcaaaaaaaaaaaaaaaaaaaaaaaaaaaaaaaattagcaaagattcactgagcat

SEQ ID NO: 47806 - DNA, 601 bp, Human
tgccaagcagtcagatctgctgcatcaacctcatttatcaatgggataacagaggttacttcaatatcacctgaacagcctaagattcacttaacaaaacaaagttggccgggcgcagtggctcatgtctgtaatcccagcactttgggaggccaaggcaggcagatcacttgagcccaggagtttgagaccagcctgggcaatatagtgggaccctgtctgtaaaaaaaaattttttttaattagctgaatgtggtagcacaggcctgtagtcctacctacttaagaggctgaggcaggkggattgcttgaacccagaaggttgaggctgtgttgagccatgttcatgctactgccctccagcctaggtgacagagtgagaccctgaaaaaaaaaggaaagaaagaagaaagaaagaaagaaagagacaaaggtaacatctgaagtgatcaaagaacaatcaatccttgtgtagtagatacatattttgtattaggttctgttagcatcccttcttaaacattaacgtgtaatggcaggtacctttagagtatagcctctggttttcctagatctccttccaagcaatgtcaaacattca

SEQ ID NO: 47807 - DNA, 601 bp, Human
ggccgggcgcagtggctcatgtctgtaatcccagcactttgggaggccaaggcaggcagatcacttgagcccaggagtttgagaccagcctgggcaatatagtgggaccctgtctgtaaaaaaaaattttttttaattagctgaatgtggtagcacaggcctgtagtcctacctacttaagaggctgaggcagggggattgcttgaacccagaaggttgaggctgtgttgagccatgttcatgctactgccctccagcctaggtgacagagtgagaccctgaaaaaaaaaggaaagaaagaagaaagaaagaaagaaagagacaaaggtaacatctgaagtgatcaaagaacaatcaatccttgtgtagtagatacatattttgtattaggttctgttagcatcccttcttaaacattaacgtgtaatggcaggtacctttagagtatagcctctggttttcctagatctccttccaagcaatgtcaaacattcagctttcttaacctaatgattgttgagttattgatagtaagtcatatgttatattcatttcacaaagtgattgttttcaagagtctgtgaacatatttttctagcct

SEQ ID NO: 47808 - DNA, 601 bp, Human
ggattgcttgaacccagaaggttgaggctgtgttgagccatgttcatgctactgccctccagcctaggtgacagagtgagaccctgaaaaaaaaaggaaagaaagaagaaagaaagaaagaaagagacaaaggtaacatctgaagtgatcaaagaacaatcaatccttgtgtagtagatacatattttgtattaggttctgttagcatcccttcttaaacattaacgtgtaatggcaggtacctttagagtatagcctctggttttcctagatctccttccaagcaatgtcaaacattcasctttcttaacctaatgattgttgagttattgatagtaagtcatatgttatattcatttcacaaagtgattgttttcaagagtctgtgaacatatttttctagcctagatgattcttttcataatattgcctgggatccctaacagaaggaggagagtcaaagtttaaagggtggaagtgctgagctctaaatagatattatctcttctgcctgaatctttcccttgagttctctccctcactagccttttaatgttgccctaggcttaaacaaataagtggtaagtggctttagaggaaa

SEQ ID NO: 47809 - DNA, 601 bp, Human
ggtgcgtaagatcactgttagaccgtttctatgtggaacaagttaaaacatagtcgaataggaggctgagtaccttcaaaaatgtttatgttgatatacttaagcatattacattatacctgccgtatttattagttctctgtaatgataattaatcatttgtttgtagctgccagacacttgggttcaccaagctttcctaagagacatataaccggaacttgaaaaaaaattattaaaaatcaagataagaattctctgtagcctagaaaatgataggagagtaatagaaatagctttrtggcatttgacaggcacatcagggcaggggaaaatgaagactaattatacttcttcataacctgctattgttataagatcatcatcaccttcatatgatcagtgccgtaagccatgacctcaaaattctttcatcacttacagcagctgaagagataggcatgggttggtagctggctgaaggctttaactggatgtcttacagatactctgctaacttctctagaaagtttcaaaggaaggcatgtatacccataagcgataagacatagagaattacatatagtaatttttcttctca

SEQ ID NO: 47810 - DNA, 601 bp, Human
ctgggcaacatgatgaaaccccgtctctactaaaaataaaaaaaattggtggccaggagcggtggctcaagcctgtaatcccagcactttgggaggctgaggcaggcagatcacctgaggtcaggagttcaagaccagcctgaccaatatggtgaaaccctgtctctactaaaatacaaaaattagctgggtgtggtggtgggcacctgtagtcccagctacccgggaggctgagacaggagaattgcttgaacccgggaggtggaggttgtggtgagccaagattgtgccactgcactckaacctgggtgacagagcgactctgtctcaaaaaaaaaaaaaaaaaattagcctggcgtggtggtgcacacctgtaatcccagctatttgggatgctgagacaggagaatcacttgagcctgggaggcagaggttgcaccactgcactccaacctggatgacagagcgagactctttcttaaaaaaaaaaaaaagtgtatattttcatattcttttgtgattcataagcatgactgggtgttcccactcacgggtgagatgtgcctccctccaaccttgttacgacgtcaccacattacct

SEQ ID NO: 47811 - DNA, 601 bp, Human
caagtgattctcttgcctcagcctcccgagtagctggcattacaggcatgcactactatgcccagctaatttttgtatttttagtagagacgcggtttcaccatgctggccaagctggtctcgaactcctgaccttggtgatccacctgcctcagactcccaaagtgttgggattacaagcgtgagccaccgcggcctggccaaattattattattttttatttttgagagggagtctaactctgtttcccaggctagagtgcagtggtgcaatctcggctcactgcaacctccacctccygggttcaagcagttctctgcctcagtctcctgagtagctgggactacaggcgcgcgccaccatgcccagctaatttttttgtatgtttagtagagacagggtttcaccatcttggccaggctggtcttgaactcctgaccctgtgatccacccgccttggcctcccaaattattcttaatgatctaaaacaacacagtatccagcctgcacaaacttcagaaaagtgtgctctttgtcccggaatggaagggtcccacagaaaaggcaccagacacagcacagcatatagatagccagag

SEQ ID NO: 47812 - DNA, 601 bp, Human
tggcattacaggcatgcactactatgcccagctaatttttgtatttttagtagagacgcggtttcaccatgctggccaagctggtctcgaactcctgaccttggtgatccacctgcctcagactcccaaagtgttgggattacaagcgtgagccaccgcggcctggccaaattattattattttttatttttgagagggagtctaactctgtttcccaggctagagtgcagtggtgcaatctcggctcactgcaacctccacctcccgggttcaagcagttctctgcctcagtctcctgartagctgggactacaggcgcgcgccaccatgcccagctaatttttttgtatgtttagtagagacagggtttcaccatcttggccaggctggtcttgaactcctgaccctgtgatccacccgccttggcctcccaaattattcttaatgatctaaaacaacacagtatccagcctgcacaaacttcagaaaagtgtgctctttgtcccggaatggaagggtcccacagaaaaggcaccagacacagcacagcatatagatagccagagtgaacaaaacaaacaaaaattgtctatgtgcatc

SEQ ID NO: 47813 - DNA, 601 bp, Human
ctatgcccagctaatttttgtatttttagtagagacgcggtttcaccatgctggccaagctggtctcgaactcctgaccttggtgatccacctgcctcagactcccaaagtgttgggattacaagcgtgagccaccgcggcctggccaaattattattattttttatttttgagagggagtctaactctgtttcccaggctagagtgcagtggtgcaatctcggctcactgcaacctccacctcccgggttcaagcagttctctgcctcagtctcctgagtagctgggactacaggcgcgygccaccatgcccagctaatttttttgtatgtttagtagagacagggtttcaccatcttggccaggctggtcttgaactcctgaccctgtgatccacccgccttggcctcccaaattattcttaatgatctaaaacaacacagtatccagcctgcacaaacttcagaaaagtgtgctctttgtcccggaatggaagggtcccacagaaaaggcaccagacacagcacagcatatagatagccagagtgaacaaaacaaacaaaaattgtctatgtgcatcatagagaaacctgtagactag

SEQ ID NO: 47814 - DNA, 601 bp, Human
aaacaggctagctgggtggagtggctcacgcctgtaatcctagaactttgggaggccaaggtgggtggatcacttgagatcaggagtttgagaccagcctgaccaacgtggtgaaaccctgtctctactaaaaatacaaaaaatcagccaggcatggtagcaggtgcctgtagtcccagctacttgggaggctgaggcagaagaattgcttgaacctaggaggaggaggttgcagtgagctgaaatcacaccactgtactccagcctgggtgacagagcaagactctgtctcaaaaaaaatataataaaaataaataaataataaaaataaaaagaagcagaggcaaaggaaaagtaaaaacattagaactaaaaattgttcacaaattatatgccgtaagattctgtagacgtggattacagatttggctttgagcttctagtgtctaagcaaaggaggaaataaacaattacaaggttcacaatggccataggaaaaataaacactggctatgtaagagaagcagggctatttctagtaatctctgttttcaaaatgatttcttggctaccaatcactttaagaggagtgtgtagttag

SEQ ID NO: 47815 - DNA, 601 bp, Human
tggctcacgcctgtaatcctagaactttgggaggccaaggtgggtggatcacttgagatcaggagtttgagaccagcctgaccaacgtggtgaaaccctgtctctactaaaaatacaaaaaatcagccaggcatggtagcaggtgcctgtagtcccagctacttgggaggctgaggcagaagaattgcttgaacctaggaggaggaggttgcagtgagctgaaatcacaccactgtactccagcctgggtgacagagcaagactctgtctcaaaaaaaaaataataaaaataaataaatartaaaaataaaaagaagcagaggcaaaggaaaagtaaaaacattagaactaaaaattgttcacaaattatatgccgtaagattctgtagacgtggattacagatttggctttgagcttctagtgtctaagcaaaggaggaaataaacaattacaaggttcacaatggccataggaaaaataaacactggctatgtaagagaagcagggctatttctagtaatctctgttttcaaaatgatttcttggctaccaatcactttaagaggagtgtgtagttagttccccaaattgaatgaagaa

SEQ ID NO: 47816 - DNA, 601 bp, Human
aaaaaaaataataaaaataaataaataataaaaataaaaagaagcagaggcaaaggaaaagtaaaaacattagaactaaaaattgttcacaaattatatgccgtaagattctgtagacgtggattacagatttggctttgagcttctagtgtctaagcaaaggaggaaataaacaattacaaggttcacaatggccataggaaaaataaacactggctatgtaagagaagcagggctatttctagtaatctctgttttcaaaatgatttcttggctaccaatcactttaagaggagtgtgyagttagttccccaaattgaatgaagaaagaaattgataaaatgatttatttcagtataactcctatttttaaacattatttttattatttatcatcacattttgggttagataagcaaaggattaatctcttttcaaaatatatttgtagcctgggcaatatagtgaaaacccatctctacaaaaaatttaaaaattagccaggcatggtagtatgagcctatagttcaagctactcaggaggctgaggtgggagaatcacttaagcccagaaggtcaagcctacagtaagccatgatca

SEQ ID NO: 47817 - DNA, 601 bp, Human
agcagggctatttctagtaatctctgttttcaaaatgatttcttggctaccaatcactttaagaggagtgtgtagttagttccccaaattgaatgaagaaagaaattgataaaatgatttatttcagtataactcctatttttaaacattatttttattatttatcatcacattttgggttagataagcaaaggattaatctcttttcaaaatatatttgtagcctgggcaatatagtgaaaacccatctctacaaaaaatttaaaaattagccaggcatggtagtatgagcctatagttyaagctactcaggaggctgaggtgggagaatcacttaagcccagaaggtcaagcctacagtaagccatgatcacaccactgcactccagcctggaccacagagcacaaccctgtctcaaaaaataataaaaatttaaaaaaactatatatttattgtatatacacacacacatatatatatttgcatagtgttttcatggtttataatatcttagggggaatccattatcacatctttgatcctggcaaaaactgtgtgggatacgtaacaagtattgttattttatgtaaggaaaactag

SEQ ID NO: 47818 - DNA, 601 bp, Human
tttctagtaatctctgttttcaaaatgatttcttggctaccaatcactttaagaggagtgtgtagttagttccccaaattgaatgaagaaagaaattgataaaatgatttatttcagtataactcctatttttaaacattatttttattatttatcatcacattttgggttagataagcaaaggattaatctcttttcaaaatatatttgtagcctgggcaatatagtgaaaacccatctctacaaaaaatttaaaaattagccaggcatggtagtatgagcctatagttcaagctactcrggaggctgaggtgggagaatcacttaagcccagaaggtcaagcctacagtaagccatgatcacaccactgcactccagcctggaccacagagcacaaccctgtctcaaaaaataataaaaatttaaaaaaactatatatttattgtatatacacacacacatatatatatttgcatagtgttttcatggtttataatatcttagggggaatccattatcacatctttgatcctggcaaaaactgtgtgggatacgtaacaagtattgttattttatgtaaggaaaactagagattagccc

SEQ ID NO: 47819 - DNA, 601 bp, Human
tcatcacattttgggttagataagcaaaggattaatctcttttcaaaatatatttgtagcctgggcaatatagtgaaaacccatctctacaaaaaatttaaaaattagccaggcatggtagtatgagcctatagttcaagctactcaggaggctgaggtgggagaatcacttaagcccagaaggtcaagcctacagtaagccatgatcacaccactgcactccagcctggaccacagagcacaaccctgtctcaaaaaataataaaaatttaaaaaaactatatatttattgtatatacayacacacatatatatatttgcatagtgttttcatggtttataatatcttagggggaatccattatcacatctttgatcctggcaaaaactgtgtgggatacgtaacaagtattgttattttatgtaaggaaaactagagattagcccaaagtcatggggctaggactcgaacctagaatttctgaaccaaaggttactgcattctacctcattatgtgaaggtaggggactcacaatgaatcctgcctttcctccatggacggtataaatcaatccttcattataaacttcaaaacagctc

SEQ ID NO: 47820 - DNA, 601 bp, Human
gtactccagcctgggcaacaagagcaaaacaccgcctcaaaaaaaaaaaaaaagaaaaaagaaagaaagaaaagaaaaaacacgtgtcagaatattatccttatagtggctcctggtaaaactgctgaagagaaaagagaaaaagaagataagaaagctgtaatgtacatacacctgaattaggattactgctgaccttcaagaaagtattatcttctttgaagtagaaaagctgaagtacagacgtgggaggttaaataccacaatgagcctatgatagaactcagcctagagagaaccytttctctaagtgtgtcacctagtagctccaagtaagtataatttaatgattctgttagcctctactgtactacaaaccatctcaaaacttttatttttatttttattttttgagacaaggtctcactctgtcaaccaggcaggagtaccgtggtctgatctcggctcactgcagccttcacctcccgggctcaagcaaccctcccacttcagccccccaagtacctaggactacaagcatgcaccaccacacctggctaatttttgttttttgtttttgtttttttggtagagatgtggt

SEQ ID NO: 47821 - DNA, 601 bp, Human
caagtacctaggactacaagcatgcaccaccacacctggctaatttttgttttttgtttttgtttttttggtagagatgtggtttcaccatgttgcccaggctggtctcaaactcctgggctcaagcgatctccctgcctcggcctcccaaactgctgggattacaggcatgagccattgcctggccccatcccaaaacttatggcttagaacagtaagcatttatgtgtatgtagctcatgattctatgggttggcaatttgggccaggcagttctactggctttgactgggctcactcrtgtgtctgtggtgaattgtcaggtcagctgggaggctggctggtcctaggacggtctcattcacgcacctgaccactggctggctattagctagagcaccttgcttctcctccacgtggcctctatccctccagcaggccaccttgggcttgttcacatagtgttctcagggtaacaaatgtagcgagagagcaagtcccaatgcacaagtgatttccaggcctgtgctgcattattcctgctaatgttccatcggccaagcaagtcacaggccaacccagattctcgggattgagaaat

SEQ ID NO: 47822 - DNA, 601 bp, Human
aaacttagatctccccacaactgtgtctttaaatagtcaggcttgcccctattgtttgttactatttctaagaaattattatgtaagtaaagtgtttgctttcagaggaaataagatgaggtaggaggttgacttcatggcatttcctgcattctttgatacacattcagatcaattcccttagcactatcgcccatctgttcagatacatgtaggtatcggggcactggatgagaaatctttatcttctgttagtaatcagaaaaaacacttaacccttttgtgaaatgaaagagaatayagtactcgctaggaaatctttcgaactttaagatatggttgcaatcacagctttgcttctccttttttttttttttttttttttgagacggagtcttgctctgtcttacccaggctggagtgcagtgtcgcaatctctgctcactgcagcctccacctcccgagttcaagcaattctcctgtctcagcttcccgagtagctgggactacaggcgtgtgccaccacactcggttaatttttgtatttttagtagagacaggtttcaccacgttggccaggctggtctcgaactcttcacct

SEQ ID NO: 47823 - DNA, 601 bp, Human
tgaaagagaatatagtactcgctaggaaatctttcgaactttaagatatggttgcaatcacagctttgcttctccttttttttttttttttttttttgagacggagtcttgctctgtcttacccaggctggagtgcagtgtcgcaatctctgctcactgcagcctccacctcccgagttcaagcaattctcctgtctcagcttcccgagtagctgggactacaggcgtgtgccaccacactcggttaatttttgtatttttagtagagacaggtttcaccacgttggccaggctggtctcraactcttcacctcaggtgatccacccaccttggcctcccaacgtgctgcggttacaggtgtgagccaccgtgcacagccaactttgcttcctttacaataaaactgtacgtagcataattttgaaaagcaatttctgatgatggtattaagtcacaagccattaagacggtcaatataagtttacatatttggaaaaacttccagttctgaacagatgttacttaagtcctcctaaaacgtcacttctgaagccagtcacacattttgagaacctaccacttgcagagccctgtgcaggg

SEQ ID NO: 47824 - DNA, 601 bp, Human
caggtgatccacccaccttggcctcccaacgtgctgcggttacaggtgtgagccaccgtgcacagccaactttgcttcctttacaataaaactgtacgtagcataattttgaaaagcaatttctgatgatggtattaagtcacaagccattaagacggtcaatataagtttacatatttggaaaaacttccagttctgaacagatgttacttaagtcctcctaaaacgtcacttctgaagccagtcacacattttgagaacctaccacttgcagagccctgtgcagggcagctaagttgctacagtcgggttcctcacctgaaccgctcccagattatcaagacacccatagcatggagcattaaaactgaactcagaaaaggttgtcttgggaaaagaataggaaagaaaaggagaggagagaacaggagaggaggtcagaataggagagaagaggggagaagaaaactgagtacattaagcatctatcttagctcaggctgctacaacaaaatgtcacacactgggtggcttagaaacagcagaagttagtctcacggttctggagactgagaagtccaaggcaccagcagagttggtg

SEQ ID NO: 47825 - DNA, 601 bp, Human
ggtgatccacccaccttggcctcccaacgtgctgcggttacaggtgtgagccaccgtgcacagccaactttgcttcctttacaataaaactgtacgtagcataattttgaaaagcaatttctgatgatggtattaagtcacaagccattaagacggtcaatataagtttacatatttggaaaaacttccagttctgaacagatgttacttaagtcctcctaaaacgtcacttctgaagccagtcacacattttgagaacctaccacttgcagagccctgtgcagggcagctaagttgccacagtcgggttcctcacctgaaccgctcccagattatcaagacacccatagcatggagcattaaaactgaactcagaaaaggttgtcttgggaaaagaataggaaagaaaaggagaggagagaacaggagaggaggtcagaataggagagaagaggggagaagaaaactgagtacattaagcatctatcttagctcaggctgctacaacaaaatgtcacacactgggtggcttagaaacagcagaagttagtctcacggttctggagactgagaagtccaaggcaccagcagagttggtgtc

SEQ ID NO: 47826 - DNA, 601 bp, Human
gtgatccacccaccttggcctcccaacgtgctgcggttacaggtgtgagccaccgtgcacagccaactttgcttcctttacaataaaactgtacgtagcataattttgaaaagcaatttctgatgatggtattaagtcacaagccattaagacggtcaatataagtttacatatttggaaaaacttccagttctgaacagatgttacttaagtcctcctaaaacgtcacttctgaagccagtcacacattttgagaacctaccacttgcagagccctgtgcagggcagctaagttgccacwgtcgggttcctcacctgaaccgctcccagattatcaagacacccatagcatggagcattaaaactgaactcagaaaaggttgtcttgggaaaagaataggaaagaaaaggagaggagagaacaggagaggaggtcagaataggagagaagaggggagaagaaaactgagtacattaagcatctatcttagctcaggctgctacaacaaaatgtcacacactgggtggcttagaaacagcagaagttagtctcacggttctggagactgagaagtccaaggcaccagcagagttggtgtct

SEQ ID NO: 47827 - DNA, 601 bp, Human
gatccacccaccttggcctcccaacgtgctgcggttacaggtgtgagccaccgtgcacagccaactttgcttcctttacaataaaactgtacgtagcataattttgaaaagcaatttctgatgatggtattaagtcacaagccattaagacggtcaatataagtttacatatttggaaaaacttccagttctgaacagatgttacttaagtcctcctaaaacgtcacttctgaagccagtcacacattttgagaacctaccacttgcagagccctgtgcagggcagctaagttgccacagwcgggttcctcacctgaaccgctcccagattatcaagacacccatagcatggagcattaaaactgaactcagaaaaggttgtcttgggaaaagaataggaaagaaaaggagaggagagaacaggagaggaggtcagaataggagagaagaggggagaagaaaactgagtacattaagcatctatcttagctcaggctgctacaacaaaatgtcacacactgggtggcttagaaacagcagaagttagtctcacggttctggagactgagaagtccaaggcaccagcagagttggtgtctgg

SEQ ID NO: 47828 - DNA, 601 bp, Human
atccacccaccttggcctcccaacgtgctgcggttacaggtgtgagccaccgtgcacagccaactttgcttcctttacaataaaactgtacgtagcataattttgaaaagcaatttctgatgatggtattaagtcacaagccattaagacggtcaatataagtttacatatttggaaaaacttccagttctgaacagatgttacttaagtcctcctaaaacgtcacttctgaagccagtcacacattttgagaacctaccacttgcagagccctgtgcagggcagctaagttgccacagtcgggttcctcacctgaaccgctcccagattatcaagacacccatagcatggagcattaaaactgaactcagaaaaggttgtcttgggaaaagaataggaaagaaaaggagaggagagaacaggagaggaggtcagaataggagagaagaggggagaagaaaactgagtacattaagcatctatcttagctcaggctgctacaacaaaatgtcacacactgggtggcttagaaacagcagaagttagtctcacggttctggagactgagaagtccaaggcaccagcagagttggtgtctggt

SEQ ID NO: 47829 - DNA, 601 bp, Human
aaagaaaaggagaggagagaacaggagaggaggtcagaataggagagaagaggggagaagaaaactgagtacattaagcatctatcttagctcaggctgctacaacaaaatgtcacacactgggtggcttagaaacagcagaagttagtctcacggttctggagactgagaagtccaaggcaccagcagagttggtgtctggtgagggcctgagttctggtttataggtgatgccttctcactgtgtcctcacgaggtggaagggtgaacaagctcccttgggcctatttgataagggcamttttctcattcatgagggctctgccctcatgacctaattacttccccaaagccccacctcctaatactgtccctttgcagttaagatttcagcatatgaatttggagggaacacaaacattcagaccatagcagcattttttcatattcacttcttcttcttccacatttttcccaacataaaatttctcttctccttaaatagctccaaatctgctattttgctacctcctagaattttctcggtatttataagtcaatttgtctctggatctgaaagtgagactacctctagctaata

SEQ ID NO: 47830 - DNA, 601 bp, Human
atctatcttagctcaggctgctacaacaaaatgtcacacactgggtggcttagaaacagcagaagttagtctcacggttctggagactgagaagtccaaggcaccagcagagttggtgtctggtgagggcctgagttctggtttataggtgatgccttctcactgtgtcctcacgaggtggaagggtgaacaagctcccttgggcctatttgataagggcacttttctcattcatgagggctctgccctcatgacctaattacttccccaaagccccacctcctaatactgtccctttgcrgttaagatttcagcatatgaatttggagggaacacaaacattcagaccatagcagcattttttcatattcacttcttcttcttccacatttttcccaacataaaatttctcttctccttaaatagctccaaatctgctattttgctacctcctagaattttctcggtatttataagtcaatttgtctctggatctgaaagtgagactacctctagctaatatgaactggctagtgaggtactacaaatagtaagagacctttagtctaaactccatcctgtcacttcatactgtgtggtc

SEQ ID NO: 47831 - DNA, 601 bp, Human
tgacctaattacttccccaaagccccacctcctaatactgtccctttgcagttaagatttcagcatatgaatttggagggaacacaaacattcagaccatagcagcattttttcatattcacttcttcttcttccacatttttcccaacataaaatttctcttctccttaaatagctccaaatctgctattttgctacctcctagaattttctcggtatttataagtcaatttgtctctggatctgaaagtgagactacctctagctaatatgaactggctagtgaggtactacaaatagyaagagacctttagtctaaactccatcctgtcacttcatactgtgtggtcttggctaagtcactcagttacactaaacctcagcttattcaccaaaacaatgaagataatcctatcttcccttccttagggagtttctgtgaggagcaaatgaaaagataaaactgcaaatgcattgtagaccatcaagaacagttgattgtaagatgtcattattcttggctggccacagtggctcatgcctgtaatcccagcactttgggagaccgagatgggtggatcatttgaggtcaggagttcaa

SEQ ID NO: 47832 - DNA, 601 bp, Human
ggagtttcgctcttgttgcccaggctggagtgcaatggcatgatcttggctcgctgcaagctctgcctcccgggttcaagcggttctcctgcctcagcctgccgaatagctggcattgcaggggcaggccaccacacccagctaatttttgtatttttagtagagacagggtttcaccatgttggccaggctggtcttgaactcctgggctcaagcaatcctctcacctcagcctcccaaagtgctggaattccaggcatgagccaccacacccacaatagcaattagggattgctattatttttttttaattttaaaaatatatataggcaaggatgtagagaaactggaacccttatacactgttggtgagaatgcaaaatggtgcagctaacatggaaaacaatagggagactcccaccaaattcaaaatggagctacctgacgatctggagagatactttttaacatgaatctaaaggtagtagaataatttcaggagaagattatatagatacatttagttacaaatctagccttcactggaaattatgtctcactggcttctggagatggaagatagtctatacataatatgagg

SEQ ID NO: 47833 - DNA, 601 bp, Human
tgtgcctttatctttgtcctatattgaccaaacattcaattcagcacctttctttaaaaaacaaaacagggccgggtgcggtggctcatgcctgtaatcccagcactttgggaggccaaactgggtggatcatttgaggtcaggagttcaagaccagcctggacaacaaggtgaaatcccgcctctactaaaaatacaaaaattagccgggtgtggtggcacgttcctgtaatcccagctactcaggaggctgaggcaggaggatcacttgaacccgggagacagaggctgcagtgagccratatcacgccactgcactccagcctgggtgacagagcgagactccgtctcaaaaataataataaataaataaacaaattttttttaaagcagtcattcaaagcctaggtgaatgtcagagacctcactgaaagtttagaaaatttaaagaagtttacattttgaacaacttcaaccatgtattagacatccatccctgctctaaaaattttgtcaaactactagattgcttggccatactctctctttcctcctcctccttctctcctttctgttatttccctcaactccaaattcccgt

SEQ ID NO: 47834 - DNA, 601 bp, Human
tatcacgccactgcactccagcctgggtgacagagcgagactccgtctcaaaaataataataaataaataaacaaattttttttaaagcagtcattcaaagcctaggtgaatgtcagagacctcactgaaagtttagaaaatttaaagaagtttacattttgaacaacttcaaccatgtattagacatccatccctgctctaaaaattttgtcaaactactagattgcttggccatactctctctttcctcctcctccttctctcctttctgttatttccctcaactccaaattcccgtayagcttcttatatttctattctaatttcctgctgttcatgcctgtagggtcttctactctaggtattttctcaagatactttcccaaacaaagcctaggaggaattctgggcccaaaaagatgttcgtaatctcacatgcacacatacgtttccatgtggttatcagagctgtttttttctggccaggcgatctcagccaccatcttgccttaaagtgaactcttttattccaaaagtgatggccagcatgccggctgtgatgttcctcatagccagtgctggaggaaaactcggaaaaac

SEQ ID NO: 47835 - DNA, 601 bp, Human
gatgtgctatgcacaggtccctgcccctggcgaggtatacaaataagtggagttgccacagagcaagttataggagaacatgcacttggcagtcatttgctgcatagggaaggggtccccatttcaagaagagcacggggtgaagaccggggagccgattgccccctggggaaatgtattggctgctgaaagtggtgtaaggtactcctgatggtggcaagaaaaccctgggaatcctgaccaaataagcagctactgaaaacaagcaggacttctgtcattgtattatgttggggaaatsaaagtgagtattagtgtctcagtgcatgagctgaagagcagaatgaagtcaggttaatttgaatttagtatttcctttttttttttttttttttttttgtgagatggagtcttgctctgtcacccaggctggagtgcagtgacatgatctcagctcactgcaacctccgcctcccggattcaagtgattctcctgcctcagcctcctgagtagctgagactacaggtgcatgccaccatgcccagctaatttttgtatttttagtagaaatgggatttcactatgttgcccaggctggtc

SEQ ID NO: 47836 - DNA, 601 bp, Human
cctgagtagctgagactacaggtgcatgccaccatgcccagctaatttttgtatttttagtagaaatgggatttcactatgttgcccaggctggtctcgaactcccaacctcaggtgatccacccaccttggcctcccaaagtgctgggattacatgcctgagccaccgagcccggctgtttgtttgttttttaaacctgaatagcagtcttgttattcaaatagctaaatgtggcagaatctgtggtagaattagccggtgaaaatattctgcctatcctttctgtctgcaatgactgargtgtggcttttgcctttattctgcaggcgtgagcaagcagtggaaaagaagtatcctgggacctacaaacgacaccctgttcgtcctatcatccatcccaatgccatggagaaactcatgaaaaggaaaggagtgcctcacaaatctgggatgcagaccaaacggtgagacacctgtacaaacgcagtattcagataaatagggaaagacccacccacaaatccattctcacatgatggcggatgtggcctcttctttagctcatcagatgactgtagagatactcagtactctaggtaa

SEQ ID NO: 47837 - DNA, 601 bp, Human
ctcttctttagctcatcagatgactgtagagatactcagtactctaggtaaaacagagtaagaaggtgagggagtatcacaaactttaggaatctagcttttacatctgtggcataaatatttattgtcttagcatggaaagagaaataaactgggggccagacagacctggatgcaaatcctggacctgccttataagctgtgtgagttgacctctgtcaaccccagtgtcctcatggataaaatggtacaattacagcacatgagatttctttttatttttctgacctctaggacacasaattgggttagtcataattcttgatttacaacacaatagaccatgcatggcttacttttattcacacatttagttcgttctttttaataatgtggaaagtacctgcaaactcactgtattagtcccttcttgcattgccataaagaaatacctgactgggtgcggtggctcacgcctgtaatcccagcactttgggaggccgaggtgggtggatcatgaggtcaggagatcaagaccatcctggccaacatggtgaaaccccatctctactaaaaatacaaaaattatctgggcgtggtg

SEQ ID NO: 47838 - DNA, 601 bp, Human
gcaacagtgagaccctgtctctgaaaaaaaaaaattattttaaaggtctgagcctccccactccataccctgactcttccctggatgatgccatcataggacatatagcactttatttcatattcaggactgcctttggagaggcaggctagcatagtggttctaagtgtaaagcctggaatctgactgcctgaatgcaaattgtagcattccacttactgtgggacctggcaagccacttaacctctctgtaaaatggggatgataatagcatctgtctcatagtgttatcatgaggacyaaatggattaacagatgtattaataaagtacttaccaccgggcgcagtggctcatgcctgtaatcccagcactttgggaggccgaggcagatggatcacaaggtcaggagatcaaaaccatcctggctaacacagtgaaaccctgtctctactaaaaatacaaaaaattatccgggcatggtggcacgcgcctgtagtcccagccgctcaggaggctgaggcaggagaatcgcttgaatccgggaggcggaggttgcagcgagccaagatcgtgccactgcactccagcctgggcgacag

SEQ ID NO: 47839 - DNA, 601 bp, Human
ccacccccagactcatcccactctctcccagcattttgtctgggaagagagactaccccatctttaccaccccctagaaatgagctgcaataacaggaacatgagacttcgcaaatctctggaaaataatatccaaatgaaattaagtctcactgaacatttcaatcaagaatggcagggatctattttattgaatattctagctactgtaacattgatatttatttttgtttgacattttaacactttgtactgcaaagagtgaactatatatgagatagagagacaataatttcttgcaaaaaaaaaaagagataaaagaaagaacagaaaaaaagaaataagtggaatttaagagcaacatccttgggaatttgtggggccgggaggtattattgctgcttgaacaggggaccaggtcttttggccataagtgactaaagaagagccagagcaagacattgaacattttagaacacaaagaacagcaaaagaaaagcaattccaggcaacttgtgaacagaccatattcacttcaaccagcttgtccaggtggcttacggaaatgacctagaaaagtctggtgaccagatacttgcac

SEQ ID NO: 47840 - DNA, 601 bp, Human
ggccttacgaagcgcggcccgctgcgggtcgggtccgcgttgccgcgcggcttctccgccattttgtgcctctggcagctcgcccagcccgccagcccaagatggctgcggcggaccttcgcaggagagcaacgccgaaataagatatcgctcccctcccccaacaccgcggggacgcagcggccattttcatcttccccctcttataacgggaaaaacggccgtctcgggcagaagccacataaacccgccgggggcctccctccttcacgaccaaaggcactaaggcactatccacaarggctttttttggttaaatgctgtctcccttgcctgccctcccggcttcagacttcggagcctaaaacgcccctgcctcctggcccgaggccgacgggcctagaaaaagatgcaaggagctaggaccacacagccaccccctaccgcagctctacgtacccgctcgccgtagttctgctcgccgctgtcgctcatgactcctggctgctgtcgccggtcgatgtgcttcaatcgaagctgccaacctcttgcaccttccttaaggaggctccgccgcagccccgcacgacgcgccggtcgc

SEQ ID NO: 47841 - DNA, 601 bp, Human
tcggctttacaaaaataatagccagtattctatcagagtatctgctgggtcaaaacattttctttaacatctggtccatacatcagtgtctccttagtttctggattcctttagtaaagactcactcgtagaaactcattacaatattgagaggctcagaacattacactgcgtgcaagaccaacatacaaatctcacacaacctatacgctgtgaccattattgggctctaaagattaccctgcacttcatcaactttttattcaacttcttgtaattgtgacttaaaggccaggagtgyctctttttacaaagaaatggtgctagtcaacccctttacaaaatgcaagcaattttgggggaagagtcttgaatccggagatgaaaacgagatcttacttttgaaagtggtttggccagatcaggttaagcctgctaattagacccctatagacagattttagtgttaatctattacctttgagaggggggaaaaaataaatcccacagaccaacgagggatgagggacacaccagttctttaaatgtcattatattcacccaaatgtattctattgagtgatcaaactgagaataattt

SEQ ID NO: 47842 - DNA, 601 bp, Human
cagaagatgagaaaaactgcagaatttgaaaagcagtttgatgggttggtgtccagatgctgctattcatctctaatgataaagattacgtgcctatgttgcaatcacatcggctttacaaaaataatagccagtattctatcagagtatctgctgggtcaaaacattttctttaacatctggtccatacatcagtgtctccttagtttctggattcctttagtaaagactcactcgtagaaactcattacaatattgagaggctcagaacattacactgcgtgcaagaccaacatacaartctcacacaacctatacgctgtgaccattattgggctctaaagattaccctgcacttcatcaactttttattcaacttcttgtaattgtgacttaaaggccaggagtgcctctttttacaaagaaatggtgctagtcaacccctttacaaaatgcaagcaattttgggggaagagtcttgaatccggagatgaaaacgagatcttacttttgaaagtggtttggccagatcaggttaagcctgctaattagacccctatagacagattttagtgttaatctattacctttgagagggggg

SEQ ID NO: 47843 - DNA, 601 bp, Human
tcaacacaatttttgttaaaatgtttctaggggatacaactagaatccatttaacattaaacatgcacaaactcattaagttgactgacaaggcaatattttaaaaattgggagggacaggggcaaagaaaacctcattaatcctgttatggaaaggtcaatgctcatatcaatataataaggactatatttttttctggcagccaaactgtctaccagaagagtaaatggataagtaaatcctcaaaaactggagaatagtgtctggaaaaaaacatcatctgaaattagttgtaggccygtgcttataaaaactctcttgtaaatatagcacagactgttaaatttacattcataaaacagtcagtactccccaacaaaagcaaatataaatatcttttgacttttcagaagactaccttttaacctaatttctaaccacaaaaattagagaaaaaggggccccttatccaaactgtcaggtaacaatctatgttgataacatcaatctcaatgtaacctccaaaacccaattcaaagcaaagattttgggggaatttcaagactgtaatttgctacagtgaagaacttcttttggttt

SEQ ID NO: 47844 - DNA, 601 bp, Human
aaaaccagaagatcaactcttgggctaatgttatgtacatttagttaagagaccctagttagaaataaacagaaacttgtcctatcaacacaatttttgttaaaatgtttctaggggatacaactagaatccatttaacattaaacatgcacaaactcattaagttgactgacaaggcaatattttaaaaattgggagggacaggggcaaagaaaacctcattaatcctgttatggaaaggtcaatgctcatatcaatataataaggactatatttttttctggcagccaaactgtctacyagaagagtaaatggataagtaaatcctcaaaaactggagaatagtgtctggaaaaaaacatcatctgaaattagttgtaggcctgtgcttataaaaactctcttgtaaatatagcacagactgttaaatttacattcataaaacagtcagtactccccaacaaaagcaaatataaatatcttttgacttttcagaagactaccttttaacctaatttctaaccacaaaaattagagaaaaaggggccccttatccaaactgtcaggtaacaatctatgttgataacatcaatctcaatgt

SEQ ID NO: 47845 - DNA, 601 bp, Human
aaccatcgttaatctggcaagtgctgtgatgtctttcctaacaaaaggataatttccagtctagttttagagtcaattattgtttatttaatccgaaaatttttaaatatgtttttatttaagggagttacagtaattggctttctttaaatctccatcactaaaatgcaatgggaaatgttttctggcagcacaaatgtaatcatggaatcagaatgcccaagcaggtttccttagggcctcctaaaacttcgatacagacagggcacttagatgcagaagatacaagaatagaggccayagctctagctatcacaactgttttcaatgtggataccttcctgctgttacttcattaccccttcctaacctggttccttctcttatagtctaagaacaaaaccattactaaattattataaatattagatttaattcaactcagctaagttcaagtggctactttataaaaccagaagatcaactcttgggctaatgttatgtacatttagttaagagaccctagttagaaataaacagaaacttgtcctatcaacacaatttttgttaaaatgtttctaggggatacaactagaatcca

SEQ ID NO: 47846 - DNA, 601 bp, Human
acatatttctaagaggaaacaaaaatagtatcactttgctctatttaagaaaatttaggccgggtgcagcaactcacgcctgtaatcccagctctttgggaggccgaggcgggcagatcatgaggtcaggagatcgagaacatcctggctaacatggtgaaaacctgcctctactaaaaatgcaaaaaattagccggacgttgcgacacgcgcctgtagtcccagctactcgggaggctgaggcaggagaactgcttgaacccaggaggcgaaggttgcagtgaactgagattgcaccatmgcactccagcctgggcgacagagcaagactccgtctcaaaacaaaacaaaaacaaaaccaaacaacaacaaacaaaaaatttaaaaatggacttgactaagatttagttttacctgtaatggttgaacttctactatgagaaaaatgccctaatgaggagcatttaatcaatcaacagtcaagtttatggcacaaacctaagtgctgaagactttccactaatacaagtgtttctttgacaagtgaaaaactgccaattatatttattttgaaaataaacttactaggtaggtctcccca

SEQ ID NO: 47847 - DNA, 601 bp, Human
cacatatttctaagaggaaacaaaaatagtatcactttgctctatttaagaaaatttaggccgggtgcagcaactcacgcctgtaatcccagctctttgggaggccgaggcgggcagatcatgaggtcaggagatcgagaacatcctggctaacatggtgaaaacctgcctctactaaaaatgcaaaaaattagccggacgttgcgacacgcgcctgtagtcccagctactcgggaggctgaggcaggagaactgcttgaacccaggaggcgaaggttgcagtgaactgagattgcaccaycgcactccagcctgggcgacagagcaagactccgtctcaaaacaaaacaaaaacaaaaccaaacaacaacaaacaaaaaatttaaaaatggacttgactaagatttagttttacctgtaatggttgaacttctactatgagaaaaatgccctaatgaggagcatttaatcaatcaacagtcaagtttatggcacaaacctaagtgctgaagactttccactaatacaagtgtttctttgacaagtgaaaaactgccaattatatttattttgaaaataaacttactaggtaggtctcccc

SEQ ID NO: 47848 - DNA, 601 bp, Human
atcccacatatttctaagaggaaacaaaaatagtatcactttgctctatttaagaaaatttaggccgggtgcagcaactcacgcctgtaatcccagctctttgggaggccgaggcgggcagatcatgaggtcaggagatcgagaacatcctggctaacatggtgaaaacctgcctctactaaaaatgcaaaaaattagccggacgttgcgacacgcgcctgtagtcccagctactcgggaggctgaggcaggagaactgcttgaacccaggaggcgaaggttgcagtgaactgagattgcmccatcgcactccagcctgggcgacagagcaagactccgtctcaaaacaaaacaaaaacaaaaccaaacaacaacaaacaaaaaatttaaaaatggacttgactaagatttagttttacctgtaatggttgaacttctactatgagaaaaatgccctaatgaggagcatttaatcaatcaacagtcaagtttatggcacaaacctaagtgctgaagactttccactaatacaagtgtttctttgacaagtgaaaaactgccaattatatttattttgaaaataaacttactaggtaggtct

SEQ ID NO: 47849 - DNA, 601 bp, Human
tatcccacatatttctaagaggaaacaaaaatagtatcactttgctctatttaagaaaatttaggccgggtgcagcaactcacgcctgtaatcccagctctttgggaggccgaggcgggcagatcatgaggtcaggagatcgagaacatcctggctaacatggtgaaaacctgcctctactaaaaatgcaaaaaattagccggacgttgcgacacgcgcctgtagtcccagctactcgggaggctgaggcaggagaactgcttgaacccaggaggcgaaggttgcagtgaactgagattgyaccatcgcactccagcctgggcgacagagcaagactccgtctcaaaacaaaacaaaaacaaaaccaaacaacaacaaacaaaaaatttaaaaatggacttgactaagatttagttttacctgtaatggttgaacttctactatgagaaaaatgccctaatgaggagcatttaatcaatcaacagtcaagtttatggcacaaacctaagtgctgaagactttccactaatacaagtgtttctttgacaagtgaaaaactgccaattatatttattttgaaaataaacttactaggtaggtc

SEQ ID NO: 47850 - DNA, 601 bp, Human
aattatcaagtatactttaatgccgagaatttcagaatattctgccattaagaaattcctatgtgccagaaccccaccacccccaaatagagaaagacttccatgtaagtattacaccagaaatgagatagcaatcttaaataacagaaattgctgggaagtatataactcaatctgagaactaaagggctaagtaatccatgtttctgtgctgtccaaaaatttttaaggactcttgaaaagctactaaatggtggaaatacattatttactgtttcaattagaaacaacaggagtctcygagcctactctgggtaaatggtggaaatacattatttactatttcagttagaaacaacaggagtctccgagcctactctggctcaggaggctgtccaatttttccttcttaaaaaataataggattctaagggttgtttccacaaactttcttgaaccaaaaaatgttcaggatgtgtggagaatcattaggtatgaaactacctgaaaccaatccattatctgataaagggaatacactgtcatcagagcaagccatactacaatataaacaatcatattaagataaaaacttacgagg

SEQ ID NO: 47851 - DNA, 601 bp, Human
gtgtaaaagtcacctaacttcactaggcactgttcactttttaaacaagagacaataaaaaatattgcccacaaacaatatcccagctctagggcaggtttcagaaagtcttcatgctttaatagcgacctgggaagaaaagaatgaacatgctttaatattaagtgaactaattatcaagtatactttaatgccgagaatttcagaatattctgccattaagaaattcctatgtgccagaaccccaccacccccaaatagagaaagacttccatgtaagtattacaccagaaatgagatrgcaatcttaaataacagaaattgctgggaagtatataactcaatctgagaactaaagggctaagtaatccatgtttctgtgctgtccaaaaatttttaaggactcttgaaaagctactaaatggtggaaatacattatttactgtttcaattagaaacaacaggagtctctgagcctactctgggtaaatggtggaaatacattatttactatttcagttagaaacaacaggagtctccgagcctactctggctcaggaggctgtccaatttttccttcttaaaaaataataggattcta

SEQ ID NO: 47852 - DNA, 601 bp, Human
caaaatatcagtgaccaacaaggtggcagatatcacaactggattgccttcaaatcccttgtttcttctctggtttccaagtttacgctggtatttctacataaacatgagtaaacctgactccccagatgaaatccatacttctaaatccatacgtactcctgaaatattaatttttcatttattatttatccttagtggtccagaatcaaggtacgacctactggtaaacagccattctgaacgtcaactagcattctcaaagtcaagcactcttcaagtattgtttttagttttttgwcaggaacactctgtttctttccgagtttcatctcaaatatcacctcctccatgaaactgtcctcagtacccccaagcagaaccagcagccttatcgcctttgtttgcccctctaatagaacacttacacactccattatggttatatttatttcccctcactgatttcagctccttgaaagcaaagaccagatcatattcagttttgtctgcagcctaatagatgctcaacaaatactggctgaataaattaactagcttaattaagctataagcagcggtgaatttttcaatgaaactg

SEQ ID NO: 47853 - DNA, 601 bp, Human
acaagatctaacagtgtcacttcatttgctggccagttacctaggagcataggaatatcgactccccacccatgccagtactctcagagttcaaaacagctgaacatgcgtggggattctttctctttcaagtttctgtgctcagccagctaggagaaacagaaagaaaaagaagaaaagaaaaagaaaaaaggaaaggaaaagaaaagaaagagatagtaggtagaggacaaatactcactaagaacttactgggggcactttactaggatgattaggaaatcaaaagggtctactggcygggcgcggtggctcacgcctgtaatcccagcactttgggaggccgaggcgggtggatcatgaggtcaggagatcgagaccatcctggctaacaaggtgaaaccccgtctctactaaaaaaaatacaaaaaattagccgggcgtggtggcgggcgcctgtagtcccagctactcgggaggctgaggcaggagaatggcgtgaacccgggaagcggagcttgcagtgcgccgagattgcgccactgcagtccgcagtccggcctgggcgacagagcgagactccgtctcaaaaaaaaaaaaa

SEQ ID NO: 47854 - DNA, 601 bp, Human
aaagtcatgtcctttgcagggacatggatgaagctggaagccatcatccttagcaaactaacacaggaacagaaaaccaagcaccgcatattctcacttataggtgggagttgaagaatgagaacacatggacacagggaggggaacaacacacaccaggccactcggggtagtggggcgaggggaaggagagcattaaggttaaatagctaatgcacgtggggcttaaaacctagatgatgggttgataggtgcagcaaaccaacatggcacacatacctatgtaacaagcctatacgttctgcacttgtatcccacaacttgaagtgaaataaaaattttttaaaatgttgaaaataagaacatcaaagctgagtcaagtatctcagactggggaagtttttcacatatttgaactgtaactcttagagaaccgaggatcaaacaatcactttaccatcaccagggtccatagtatagcattagtttaagatgaattttatacttttacaaaactttgcaacttttaatttccaaaagtattttgcacatgtctttttattttcacaacctggaaggctaccaaagcaaggaatatttt

SEQ ID NO: 47855 - DNA, 601 bp, Human
gcatgacagattaaggcatttggattgtattcagcaggcatggggaagccactgactacctttaagcaaggaagtgataggccccaaagcagtagtacagaaagatcaatctgacagccctgaataggaaaaaatgaagggcagagacagagacagagagagagagagagagagagagagagagagagagagagaaagacaaagggatcattcaaaggctaccgaggtaggtcaagcagaagaaggtaaacatcttaataatggaaaattttatacacacacacacacacacacacacaccggtgtgtgtatatatatatatataatttctaagtatatatattaaaggatatatatatataataaaaggtatatacatacacttacaaatgaatgaatacaagagaaaattctgaaagaagaatcaaaaggactttgattaaatactgatggagggacaagagatttacttctctaggtacaggcacaaagaaacaacatagaaattacattgaattcaaccttggtctcaattttgaaaacagaagcatcacttaacctttattagtaaacagcttactcctataataatcctaaggtt

SEQ ID NO: 47856 - DNA, 601 bp, Human
ataaacaaaaggcacagagacagtaaatcacaaattgatattaggaagaagttagtcatctgtttgtggggggcatggagaatgccaagaaaaatagtgtgaaataaatctgaaaaggtatgttgaagtcagacttaggaggaccttgcatgacagattaaggcatttggattgtattcagcaggcatggggaagccactgactacctttaagcaaggaagtgataggccccaaagcagtagtacagaaagatcaatctgacagccctgaataggaaaaaatgaagggcagagacagagasagagagagagagagagagagagagagagagagagagagagaaagacaaagggatcattcaaaggctaccgaggtaggtcaagcagaagaaggtaaacatcttaataatggaaaattttatacacacacacacacacacacacacacaggtgtgtgtatatatatatatataatttctaagtatatatattaaaggatatatatatataataaaaggtatatacatacacttacaaatgaatgaatacaagagaaaattctgaaagaagaatcaaaaggactttgattaaatactgatgga

SEQ ID NO: 47857 - DNA, 601 bp, Human
agtaaatatctttcctgtacttcaaacacacttaaggacagccggcaggactttaggggagtctcaccaagtcagaggtctctgatatgggaaagcctagggacaaattccagggaccacagttaagtgttaatcaagcacagggaaactctcataaccaccaatggattgcattaccttttctaggaagctgtcttcttcctgagagcggagcaggaaaagaaagtcattgacagacagaatatgattagaattaatttacagaattagaaacagatcagtattagaactcactatcttrccagatatacatgctttaaacagctttgaattcttcaaataaattatgattgttgaaaatgaaatacatttttcatacacaaagtttactatacattttaaatttttgtgcagtttgagaatatcactcaagaaatatgtgcagttctagacttcagtgccctttggcatctgccaactgacccagccaaatgcccctgatgtctcttcctgtctgctgcttggaggcaggtgcattgaggtatatacctcaatgaaagaatatggctgtgggcccaacagtggccatctggaaggagat

SEQ ID NO: 47858 - DNA, 601 bp, Human; identical to SEQ ID NO: 47852

SEQ ID NO: 47859 - DNA, 601 bp, Human; identical to SEQ ID NO: 47853

SEQ ID NO: 47860 - DNA, 601 bp, Human; identical to SEQ ID NO: 47854

SEQ ID NO: 47861 - DNA, 601 bp, Human; identical to SEQ ID NO: 47855

SEQ ID NO: 47862 - DNA, 601 bp, Human; identical to SEQ ID NO: 47856

SEQ ID NO: 47863 - DNA, 601 bp, Human; identical to SEQ ID NO: 47857

SEQ ID NO: 47864 - DNA, 601 bp, Human; identical to SEQ ID NO: 27338

SEQ ID NO: 47865 - DNA, 601 bp, Human; identical to SEQ ID NO: 27339

SEQ ID NO: 47866 - DNA, 601 bp, Human; identical to SEQ ID NO: 27340

SEQ ID NO: 47867 - DNA, 601 bp, Human; identical to SEQ ID NO: 27341

SEQ ID NO: 47868 - DNA, 601 bp, Human; identical to SEQ ID NO: 27342

SEQ ID NO: 47869 - DNA, 601 bp, Human; identical to SEQ ID NO: 27343

SEQ ID NO: 47870 - DNA, 601 bp, Human; identical to SEQ ID NO: 27344

SEQ ID NO: 47871 - DNA, 601 bp, Human; identical to SEQ ID NO: 27345

SEQ ID NO: 47872 - DNA, 601 bp, Human; identical to SEQ ID NO: 27346

SEQ ID NO: 47873 - DNA, 601 bp, Human; identical to SEQ ID NO: 27347

SEQ ID NO: 47874 - DNA, 601 bp, Human; identical to SEQ ID NO: 27348

SEQ ID NO: 47875 - DNA, 601 bp, Human; identical to SEQ ID NO: 27349

SEQ ID NO: 47876 - DNA, 601 bp, Human; identical to SEQ ID NO: 27350

SEQ ID NO: 47877 - DNA, 601 bp, Human; identical to SEQ ID NO: 27351

SEQ ID NO: 47878 - DNA, 601 bp, Human; identical to SEQ ID NO: 27352

SEQ ID NO: 47879 - DNA, 601 bp, Human; identical to SEQ ID NO: 27353

SEQ ID NO: 47880 - DNA, 601 bp, Human; identical to SEQ ID NO: 27354

SEQ ID NO: 47881 - DNA, 601 bp, Human; identical to SEQ ID NO: 27355

SEQ ID NO: 47882 - DNA, 601 bp, Human; identical to SEQ ID NO: 27356

SEQ ID NO: 47883 - DNA, 601 bp, Human; identical to SEQ ID NO: 27357

SEQ ID NO: 47884 - DNA, 601 bp, Human; identical to SEQ ID NO: 27358

SEQ ID NO: 47885 - DNA, 601 bp, Human
cctgctgttgctgcttgtcgacttccaactacattaggtagtaattatttcacttcatgccttaaattgctcctttgagactccggctatatagatggttcctaatttaggacggtgtcacttagaattcttcgacttttaagaaagccatgagcattcagtagaaactgtacaagtaaccacacaaccgtctgtgttcatgattttgcccaactgtagattaaggtaagtgttctgagcatgtttaaggtaggctagcgcagccataaaaaggaatgaaatcatgtcctttgcagcaacrtgggtgcagctggaggctattatccaaagcgaattaaagcagaaacagaaaatcaaatattgcatgttctcacttataaatgggagctaaacattgggcattcatgaacataaagatggcaacaatagacagtggagacaactagaagggagaggaaaggaggagcaagggttcaaaaactattgggtaacatgctcactacctgggtgacaggatcaatcgtatccaaacctcagcaccacgtaatataccgatgcaacaaacctgcacatgtacccccaaatctaaaataaacagctg

SEQ ID NO: 47886 - DNA, 601 bp, Human
acttacatatgaccttgggcatccatcaagccatttaatttgttgatacaaagtaaaatgcagaaatcagtacatttccccccaaaagaccattgcacccttatagctttttaaactggttctgtatgttcatattgtcctgtccataataaattaattaattaattagtgctgtctgagccctttccccaggtcctagaaataaagccatttggtagccctgatgtgatgctacaacttctataacacctattagtttcagtccttccaagtaaaatggtaaggccaagctgacaactgyaatacaccagatagccacaagtacttggcactacactgtggtaaataagaacacaactttgaaagcaaatgcctgaatataaatgtggactgacactttctaatggtcttgcacagtttactttggctccatgtgtctcagtttcctcatctttaagagggggtaccataatcatgcttacacaccggactgttgggaggattaaatgaaatatgtaaagcacttagaacaaaacttgacacatagtaagcactcaatgttatctgttataattagtattatcggagagtagaaatgatg

SEQ ID NO: 47887 - DNA, 601 bp, Human
gacaccaattttctcatttataaaataaagaatgaactagatgctaaaatttctttcaacactaaatgcgaagaattactaccctaaatccttctacatctaatacatgatttctgatttttcaatcctcctattttgtaaactaataaaaatgataatgcaagcatacaaccatcagcacagagcagtggttaagaaaacagactgactctggagccagccaggctgcctggctagaatcccaactctgctacttacatatgaccttgggcatccatcaagccatttaatttgttgatataaagtaaaatgcagaaatcagtacatttccccccaaaagaccattgcacccttatagctttttaaactggttctgtatgttcatattgtcctgtccataataaattaattaattaattagtgctgtctgagccctttccccaggtcctagaaataaagccatttggtagccctgatgtgatgctacaacttctataacacctattagtttcagtccttccaagtaaaatggtaaggccaagctgacaactgtaatacaccagatagccacaagtacttggcactacactgtggtaaataa

SEQ ID NO: 47888 - DNA, 601 bp, Human
tcaactgaaataagataatgagccttcttaaactaataaattctagatagcattaataaaaatatgatgtccacatcatgaaatgtaatcagttctgttctctacattagtcagactcccctctaatactgtgaaaattctgacactttttaaaaaggaacacttaaaaaatacagtagttagaaacatcaacagtagaaatgaaggaaaccagagtgtagttcagattctgctatttcagggatgcttaactttggggaagctatttaactctctagacaccaattttctcatttataatataaagaatgaactagatgctaaaatttctttcaacactaaatgcgaagaattactaccctaaatccttctacatctaatacatgatttctgatttttcaatcctcctattttgtaaactaataaaaatgataatgcaagcatacaaccatcagcacagagcagtggttaagaaaacagactgactctggagccagccaggctgcctggctagaatcccaactctgctacttacatatgaccttgggcatccatcaagccatttaatttgttgatacaaagtaaaatgcagaaatcagta

SEQ ID NO: 47889 - DNA, 601 bp, Human
atataaccagcctttatatagtttgaggaatgagtaggagagatcactctcttctgtttcttattcaaggacaaaatagatctctattagtataatctttaatcttaaagcaaattatgaaacagatggtttttgactgctttagaagcagtatttaccaataccagaagtcagtacaaattctgaccaaacaagtcatgccaaaataacttcattaaactaatttcctttttataatgggtaagcagaatactacaggcctctaaatatataactgacacaagtttgaaattgattaacrgtaactgtcacaggacgacatggatgttaggccttgcacttagactcagttacttaatggtcaaatgaaatagaacaatagaagctgaaatttaaaactaaagattttagtgactatagctcaactgaaataagataatgagccttcttaaactaataaattctagatagcattaataaaaatatgatgtccacatcatgaaatgtaatcagttctgttctctacattagtcagactcccctctaatactgtgaaaattctgacactttttaaaaaggaacacttaaaaaatacagtagt

SEQ ID NO: 47890 - DNA, 601 bp, Human
aaaagtatcattaattagatttttttaaattaccatatttcatcaaatctaaaatgccatcaattgtaagatatactcttgattgttagtccatataaaagaaatttttaaaagtaaataaaaattttaaaaataaaaattttttaaattgtaagatgtaccattattttatgtatccaagaaaaaaagtgtagccaattaaaccatgatacactatcattgatggttagacatttcccaatttcatcaatgttaaaataatgaaacatgtaaatattttatatataaccagcctttatayagtttgaggaatgagtaggagagatcactctcttctgtttcttattcaaggacaaaatagatctctattagtataatctttaatcttaaagcaaattatgaaacagatggtttttgactgctttagaagcagtatttaccaataccagaagtcagtacaaattctgaccaaacaagtcatgccaaaataacttcattaaactaatttcctttttataatgggtaagcagaatactacaggcctctaaatatataactgacacaagtttgaaattgattaacggtaactgtcacaggacga

SEQ ID NO: 47891 - DNA, 601 bp, Human
gttacaggagtatatatacatctgtatatgaaaacatcaaaatgtacacatctaactgcacactgtaaattatactgctataaagtagatataatatacatgttatatattaaaatacacaatcgttttttaaaaactagaaaaatacatgccacaacattaaccctaattatttctaggtctggttagaataccagtaatttttattctattctgagttattttctgtatatttcaaattttttacaatgaaaatgttacctttgtaatagggaaaagtatcattaattagatttttttwaattaccatatttcatcaaatctaaaatgccatcaattgtaagatatactcttgattgttagtccatataaaagaaatttttaaaagtaaataaaaattttaaaaataaaaattttttaaattgtaagatgtaccattattttatgtatccaagaaaaaaagtgtagccaattaaaccatgatacactatcattgatggttagacatttcccaatttcatcaatgttaaaataatgaaacatgtaaatattttatatataaccagcctttatatagtttgaggaatgagtaggagagatc

SEQ ID NO: 47892 - DNA, 601 bp, Human
cagtatatcgccagtaccaaatacacagaagaggttcagtatttgttatgtgaatgataccattaatgggtggcgggggggggcagtactttaaaaaaatgtttaatgacaagagaaatatgttttaataaatcaaaggaaaaatggccacaaaacatgtccagcctcattctaatttttacaaaagaaaagaaaaataaaaacaataatgggtgtatgtacatttaaaagactagaaagcaaaggagcatgagagaacttgttggaggtgatagaaataatctatataagattgtagtakggttacaggagtatatatacatctgtatatgaaaacatcaaaatgtacacatctaactgcacactgtaaattatactgctataaagtagatataatatacatgttatatattaaaatacacaatcgttttttaaaaactagaaaaatacatgccacaacattaaccctaattatttctaggtctggttagaataccagtaatttttattctattctgagttattttctgtatatttcaaattttttacaatgaaaatgttacctttgtaatagggaaaagtatcattaattagatttttt

SEQ ID NO: 47893 - DNA, 601 bp, Human
tattaactcaggcatgaaatcttacgtacaattcatcagtatatcgccagtaccaaatacacagaagaggttcagtatttgttatgtgaatgataccattaatgggtggcgggggggggcagtactttaaaaaaatgtttaatgacaagagaaatatgttttaataaatcaaaggaaaaatggccacaaaacatgtccagcctcattctaatttttacaaaagaaaagaaaaataaaaacaataatgggtgtatgtacatttaaaagactagaaagcaaaggagcatgagagaacttgttrgaggtgatagaaataatctatataagattgtagtatggttacaggagtatatatacatctgtatatgaaaacatcaaaatgtacacatctaactgcacactgtaaattatactgctataaagtagatataatatacatgttatatattaaaatacacaatcgttttttaaaaactagaaaaatacatgccacaacattaaccctaattatttctaggtctggttagaataccagtaatttttattctattctgagttattttctgtatatttcaaattttttacaatgaaaatgttacct

SEQ ID NO: 47894 - DNA, 601 bp, Human
tcatctaggagtcttaaccatgagccctcttcatctcctcccaaagactggactggagaccttcctgtatatgcactacccaagcacttttcacactgcaatgaaatttgccctatcattccctctgagctattaactcaggcatgaaatcttacgtacaattcatcagtatatcgccagtaccaaatacacagaagaggttcagtatttgttatgtgaatgataccattaatgggtggcgggggggggcagtactttaaaaaaatgtttaatgacaagagaaatatgttttaataaatcmaaggaaaaatggccacaaaacatgtccagcctcattctaatttttacaaaagaaaagaaaaataaaaacaataatgggtgtatgtacatttaaaagactagaaagcaaaggagcatgagagaacttgttggaggtgatagaaataatctatataagattgtagtatggttacaggagtatatatacatctgtatatgaaaacatcaaaatgtacacatctaactgcacactgtaaattatactgctataaagtagatataatatacatgttatatattaaaatacacaatcgttttttaa

SEQ ID NO: 47895 - DNA, 601 bp, Human
ccttatataatgttgggaatgctttttcccacttttctttgcctaattaattctaccttatcatctaggagtcttaaccatgagccctcttcatctcctcccaaagactggactggagaccttcctgtatatgcactacccaagcacttttcacactgcaatgaaatttgccctatcattccctctgagctattaactcaggcatgaaatcttacgtacaattcatcagtatatcgccagtaccaaatacacagaagaggttcagtatttgttatgtgaatgataccattaatgggtggcgggggggggcagtactttaaaaaaatgtttaatgacaagagaaatatgttttaataaatcaaaggaaaaatggccacaaaacatgtccagcctcattctaatttttacaaaagaaaagaaaaataaaaacaataatgggtgtatgtacatttaaaagactagaaagcaaaggagcatgagagaacttgttggaggtgatagaaataatctatataagattgtagtatggttacaggagtatatatacatctgtatatgaaaacatcaaaatgtacacatctaactgcacactgtaaattat

SEQ ID NO: 47896 - DNA, 601 bp, Human
ctagccatgttctctttttctctaggctttgaacaaactttcccttatataatgttgggaatgctttttcccacttttctttgcctaattaattctaccttatcatctaggagtcttaaccatgagccctcttcatctcctcccaaagactggactggagaccttcctgtatatgcactacccaagcacttttcacactgcaatgaaatttgccctatcattccctctgagctattaactcaggcatgaaatcttacgtacaattcatcagtatatcgccagtaccaaatacacagaagaggttcagtatttgttatgtgaatgataccattaatgggtggcgggggggggcagtactttaaaaaaatgtttaatgacaagagaaatatgttttaataaatcaaaggaaaaatggccacaaaacatgtccagcctcattctaatttttacaaaagaaaagaaaaataaaaacaataatgggtgtatgtacatttaaaagactagaaagcaaaggagcatgagagaacttgttggaggtgatagaaataatctatataagattgtagtatggttacaggagtatatatacatctgtatatga

SEQ ID NO: 47897 - DNA, 601 bp, Human
agctagccatgttctctttttctctaggctttgaacaaactttcccttatataatgttgggaatgctttttcccacttttctttgcctaattaattctaccttatcatctaggagtcttaaccatgagccctcttcatctcctcccaaagactggactggagaccttcctgtatatgcactacccaagcacttttcacactgcaatgaaatttgccctatcattccctctgagctattaactcaggcatgaaatcttacgtacaattcatcagtatatcgccagtaccaaatacacagaagaggttcagtatttgttatgtgaatgataccattaatgggtggcgggggggggcagtactttaaaaaaatgtttaatgacaagagaaatatgttttaataaatcaaaggaaaaatggccacaaaacatgtccagcctcattctaatttttacaaaagaaaagaaaaataaaaacaataatgggtgtatgtacatttaaaagactagaaagcaaaggagcatgagagaacttgttggaggtgatagaaataatctatataagattgtagtatggttacaggagtatatatacatctgtatat

SEQ ID NO: 47898 - DNA, 601 bp, Human
aggactggataggggaacagatggaaaacaaggacattacatacatacatcatgtttctgcaatggatagtagcaagcattccaattcaaagcaacaccacaaaacactatttaacataagccatcagcaaggatgaacatgactaccaacgttatctgtttcacccagaaattccaattctggcaatttaacctaaggaactatcagagataatactaagtaactacgtataagaataatcagctgggcaggacacagtggctcgcacgcatgtaatcccagcacttcaggaggccgagrcaggtggatcacctgaggtcgggagtttgagaccagccaggctaacatggtgaaaccccgtctctactaaaaatataagaatttgaggccaggtgcagtggctcacacctgtaatcccagcactttgggaggccaaggtgagtggatcacctgaggtcagttcaagaccagcctcatcaacatggagaaaccctgtgtctattaaaaatacaaaattagccaggcgtggtggcgcatgcctgtaatcccagctattcaggaggctgaggcaggagaatcacttgaacccgggaggcagag

SEQ ID NO: 47899 - DNA, 601 bp, Human
gcttctcctttgccttccggcataaatgtgaggcctccccagccatgtggaactgtgagtccaataaacctctttcctaataaattacccagtcttgagtatctctttattagcagtgtgagaacagactaatacaaatggtgtaaatttaagtatatgtcaattttgataatactataagcatgatatcttctttaaagcaatttaaataaaaatttcaaaatgcaaggaaatacaattcacatacaaatatcaaacatgttgcctttttcctattccactaatccataaaccacatgarggcagcaatctcatgcttgttttctccaccactaatgactataatgtgtctggcaacagtgacagatacattaccatcactaacaaatattttgaatgaatgaaatctggcaatttaaaaggtatttttataattctacttgtttttactatcctacttcatttgaaaacagtggaattttttaaaatataaatcaagagactagaaccaggtttcccaactttcactcaatcttatttccactaggactggataggggaacagatggaaaacaaggacattacatacatacatcatgtt

SEQ ID NO: 47900 - DNA, 601 bp, Human
cactttttacagataaaagtgagaaaaaatgtttggaatagtgatacaaatcattatgtattttttcctctttaaatgaccttaaagaagttttcacttatttatgtggtaactttaaaaagaacactgattagaatctccaccccttccctcaaagaggtacttacttatcattaccaaaagtttattttatagactcaagtacatgttattccattgattgattgaatgagacagggtcttgctgtgttgcccaggctggatggagtgcagtggcacaatcacagctcactgcagcttygacctcccaggctcaagtcatcctcccacctcagcctcccgagtagctgatactccaggtgcacaccaccacaccccactaaatttttattttttgtagagacagggtctcactatgttacccaggcaggtcttgacgtccttagctcaagtgatcctcccgcctctgcctcccaaggtgctgggattataggcatgagccactgtgcccagcctgttattccttttaaaaaaaaattatgtaatcttcatttccaaggtttttagaagatgttttcagagatactgaaaattcctacag

SEQ ID NO: 47901 - DNA, 601 bp, Human
ggagagaatggggagttaatgtttaatgggtacagagtttctgtttggggtaatgaaaaagttttggaaacagattgtggtgatggttgcacaacagtgtgaaagtcattaatgccacttaattgtacacttaaaaatggtaatgtggcaaattttatgttacatacgcttaaccacaataaaaaagaagagggaaaaaattaatagactttaatccctataacataaaaggatcagggaattgcagagtagtaggtagtgtgaattctccattttatatgccttctttatactttatatrcctttcatatatactaacgcctttgatcttagacctaagaccaaaacaatcctttttcttaacagtaaatgagacacattaagactgcttccagtattcactttttttttttttgggggggacggagtcttgctctgtcacccaggctggagtgcagtggcatgatctcagctcactataacctccacctcccaggttccagcaattctcctgcctcagtctccggagtagctgggattataggcgcgtgccaccatgcccggctagtttttgtatttttagtagagacggagtttcacc

SEQ ID NO: 47902 - DNA, 601 bp, Human
cccaaatatctcccattaggccaacctcaaacactggaggtcacacttcaacatgagattctgaagggacaaatatccaaactctatcaaacctaaataaagctgtattttaaaaaggaaagaaagaaagaaaccttattaagaaaacaaaagcctatgttttctccttacagtgtgccagaatttttacattggtaagtgctaaacaatctacttgggaaagaaatataggataaaacaaacacatacagaccaaaaaaagcagtcaaaaattagaaggttttttcagcaaaaaaagacmccattaaaaaccaggcaaagaccttaaatagacatttttccaaagatatacaaatggccaataagcacatgaaaagatgctcagcattgctagtcattaaggaaatacaaatcagaaccacagtgaaataccacttcacaactactgagatgccaataataaaaaaattttttaaatggaaaataacaagtgttcctgaggatgtagatactacaaccatcacacattcctgatgaagatgtaaaatggtacagctatgaaaaacagtttgacggttcctcagaaagctaaacacagaat

SEQ ID NO: 47903 - DNA, 601 bp, Human
aaaatttaaaaatctctaaaaaaatttaaaaatgatggcacatgcctgtggtcccagctacttaggagatggaggtgggaggatcacttgagcctagtaggtggaggctgcagtgagccatgatggtgccatcatcaagaccctatctcaaaaaaaaaaaaaaaaaaaagaaagaaagaaaaaagagagaaacgaaaacacatatccacacaaaaatttgtacacaaacgttcatgagtattactcataattgctaaaaagtggaaacaacccaaatgaccattaactaatgaatagatawataaattgtggtatattaaaacaacagattattcagtgtggtaggcagaataacggctcccaaagatttccacaccctaatccccagaatctgtgaatgtattgttatgtggtaaaaaggactttgcagatgtgattaaggaccaggaccttgaaacggagagatgatcctggattacccaggtgggcctaacctaatcaaatgagttctagctgcagaaaaccaaagagaaggaaacatgagaactcaaacgtgcttccctggctatgaagacggaagaaggggaccatgagccaagga

SEQ ID NO: 47904 - DNA, 601 bp, Human
tttggtcacttatcgcaataacgtctgttatagatttttccccaaatcaggatccaatcctagatcacacattacatctagtcagtatgttcctttagtttccttcaatctctaacttcattcatcgtttctggtcttgaaatttcaaaatttcaaaataaggccagttattttgctgaatatccctcaatctggatttgtctgatgtttccctatgattagtttcagattgtgaatttggggcaagaatacaacagttcatcatattaggaggcacataatatcggtttgttccattacyagaggtattaactttgatcactgattaaggtggtgtctgccaaagtatttttccctttgtaatttttttaagtatgttgtgaggagatacttgaatatattcaaatatcctatttcctcattgaacatttacccactagttttggcatccattgagactctctaacaccatcattacttctacttctatgctttagcattccactgtaaggaagagtttaatcttcatttatttatttattcatttatttacatatattagtatagattctgactcctgtattattcaatgggctataat

SEQ ID NO: 47905 - DNA, 601 bp, Human
caccatctctttctctgatcctcttccctctctctcttccacttctaaggacacttataattataatgggcccactcagatcatccagggtaacctccccatctcaaggtccttaacattaatcacgtcagcaaagtctcttttgccatgtaaagtaacacagattccagtgattaggacatgaacatgtttaaagggccattttttctgtctaccacagtagtaaatggttgaattttttttaaatagaaactcacaataataggcaaagttgtcatgttattataaatactcatctttktttttttttttttttttttttttttgagacggagttttgctcttgtggcccaggctggagtgcaatggcgcaatctcggctcactgcaacctccgcctcccaggttcaagcaattctcctgcctcagcctcccgagtagctgagattacaggcatgcaccaccacacccggctaattttgtatttttagtagagacggggtttctccatgttgaggctggtctcaaactcctgacctcaggtgatccgcctgcctcagcctcccaaagtgctgggattacaggcgtgagccaccacaccc

SEQ ID NO: 47906 - DNA, 601 bp, Human
tatgtgctattttctcttttttttgtatatgtatgggttttctattgctgctctctcaaattaccagaaatttggtggcattgaacaacacaaatttatcattttatagtttcgcaagttagaactcagacttaggtcttactgcattaaaatcaaagttatcaccagggctgagttcctttctggatgctccaggagagaatatatttccttgtcttttcaaaattctagaagccaaacaaattctttggcttagccctcttcctccatattcaaagtcaactatgttacatctctctgmccctgcttccctaatcaccatctctttctctgatcctcttccctctctctcttccacttctaaggacacttataattataatgggcccactcagatcatccagggtaacctccccatctcaaggtccttaacattaatcacgtcagcaaagtctcttttgccatgtaaagtaacacagattccagtgattaggacatgaacatgtttaaagggccattttttctgtctaccacagtagtaaatggttgaattttttttaaatagaaactcacaataataggcaaagttgtcatgttatta

SEQ ID NO: 47907 - DNA, 601 bp, Human
aagttcattatgtgctattttctcttttttttgtatatgtatgggttttctattgctgctctctcaaattaccagaaatttggtggcattgaacaacacaaatttatcattttatagtttcgcaagttagaactcagacttaggtcttactgcattaaaatcaaagttatcaccagggctgagttcctttctggatgctccaggagagaatatatttccttgtcttttcaaaattctagaagccaaacaaattctttggcttagccctcttcctccatattcaaagtcaactatgttacayctctctgaccctgcttccctaatcaccatctctttctctgatcctcttccctctctctcttccacttctaaggacacttataattataatgggcccactcagatcatccagggtaacctccccatctcaaggtccttaacattaatcacgtcagcaaagtctcttttgccatgtaaagtaacacagattccagtgattaggacatgaacatgtttaaagggccattttttctgtctaccacagtagtaaatggttgaattttttttaaatagaaactcacaataataggcaaagttgtca

SEQ ID NO: 47908 - DNA, 601 bp, Human
tttcaattgttgaagttaggtaatatggacaaggaagttcattatgtgctattttctcttttttttgtatatgtatgggttttctattgctgctctctcaaattaccagaaatttggtggcattgaacaacacaaatttatcattttatagtttcgcaagttagaactcagacttaggtcttactgcattaaaatcaaagttatcaccagggctgagttcctttctggatgctccaggagagaatatatttccttgtcttttcaaaattctagaagccaaacaaattctttggcttagccytcttcctccatattcaaagtcaactatgttacatctctctgaccctgcttccctaatcaccatctctttctctgatcctcttccctctctctcttccacttctaaggacacttataattataatgggcccactcagatcatccagggtaacctccccatctcaaggtccttaacattaatcacgtcagcaaagtctcttttgccatgtaaagtaacacagattccagtgattaggacatgaacatgtttaaagggccattttttctgtctaccacagtagtaaatggttgaatttttttt

SEQ ID NO: 47909 - DNA, 601 bp, Human
ttcaagaccagcctggccaacatggtgaaaccccgtctctactgaaaaaacaaaaattagccagacacggtggtgcacgcctgtaatcccagctgctcaggaggctgaggcaggagaatcgcttgaactcaggaggcagaggttgcagtgagccaagaatgcaccagtgtactccagcctgggcgacagaacaagaccctgtctcaaaaaaataaaaaattaggccgggcgcagtggctcacacctgtaatcccagcactttgggaggccaaggcaggcagatcacgaggtcaggagatcragaccaacctggctaacatggtgaaacccggtctctactaaaaatacaaaaaataagctgggcgtggtggcgggtgcctgtagtccctgctactctagaggctgaggcaggagaacggcgtgaacccaggaggcagagattgcagtgagccaagattgcgccactgcactgcagcctgggcaacagagcgagactccgtctcaaaaaaaaaaagatgaaacgagatcagtcatggccaggcatggtggctcacacctgtaatcccagcactttgggaggccaaggcaagcagagtccttg

SEQ ID NO: 47910 - DNA, 601 bp, Human
tggctgaatctgttcattcaaccaaaacatgaataaaatgtaatttggaaaaatacagtctaatgatggctttcacaagaccaaataaacatctatgaaccatcttaattatttttttagttacctaacaaatagtgttctcttacatatacaaaaagaaccataatcattattttaactcagttcaacaatagagggatggagcatttgttaaatgcttggttttcatgcaagtatgtatcataataattcaactctgatttgaagtactccagactctaatgaattaacaagtaactamtttcaagttcaactctccaattttagtcctattaacatgctttttagaaaaaaaatgtataaatcctatctttaaacacaatcttggttcttgaggaaaagatcacatttgaccaagtttataatcaacagtcttaagcatacatctactataaagcactttaatcacacagttattaatccaatcactaaagataaattatgacaacaaaaaacctgaactaccaacaatgtagtggtattacatcaacaattttctaatataacatattcattcttaaaacatcatttaaagaatact

SEQ ID NO: 47911 - DNA, 601 bp, Human
aagcttttttccccaatttaacctctttctgaacaagaaacaggagggtatcaggaggttggcacaggttctccagtccactgaatgtactaatcagagaaaggattacgggattaggagttgagtaagttaactccctctttattttatcttaactcttaactcccttctcaaatttagcagggaagagaatgagaaactatggtagaatacaaataaagcccaagattagtaacataaaaggtattatattccagagtctaaatgtcattttctgatgaagaaattagaaaagaactgrgcatacatggatcattttctacctcgggcttaaagtagaaaagaaaatctgggaaaacagaatagtcacctaacaaggatggaagcaaggaaggaggaagtggggaaaatagggaggaaagaagggagagcaagtcagtaagatagagcagagctaaactgccatgcccagagctgttcctagggatcttcctatactgaatcagctcaaaaagtctttctccaccttgttctgacaccagtcacagcttttgaaaagttatgaggagcacataaatggcaccaagataatggccagtta

SEQ ID NO: 47912 - DNA, 601 bp, Human
tggtagacctacatcttcattctcacacaaaggatattatctgtaaacacgcagtgttatgaagagactcaaagtgtcccgtgaattcaagaaagtgaaaatgtacttatcagggctctttcagttgaaagagaaaccaaactgaaactagcttaagcaaaaatgacattaacaatgaactaaatattatgaattactattaatcctgtttggtataataacaatgtgtggttatgcaggagaaaacatttatttcaagaaatacacacttaagtggctagaggtaaagtggcatgatatrtgcaacttattttcaaaaggttgaggggagtgcatctacatagagaaaaagagagaaagcacacaaatgaggcaaaatgttagtaactggtgagtttaggatgttaattgcgtcattctttcaactcgagagtttgtaggcatatttcaaaataaaaaggtgatggggaaaatgacatatgttatttaactgggacatacagatttgtagttcatttcaaggtggattagatcaagaatgaaaaagatgtgaaagggtgagtggatactaaacaggtctctcatctctatgcttttctat

SEQ ID NO: 47913 - DNA, 601 bp, Human
tctcatctgcaggcataaaatcttgtaatggcactcaattataaggcagctatccaaaagatctagcacgagcgtatacacttttattcatatcatttaaaagaaaacacaaaagtctaacttatctgagaatttataaacccttgagaatatgcccaaccatctccaaggacctaagacccacttaagaaacatttagctaacttctccaatggggaaagatttttatcactcccctgttatacctttaatcttccactcttcactacctttttcctctcagcctacaacatactacctkaaaacaaaaacacaacaaaactctctagccccctaccattcctcgagatactacttccttcactaccgaatttatttatttacttacaaactttatttacatacttactcgcattcacttcctccactggcctatttccattcatcacatatccattacagcatgacttttgttccaaaacacttgtgaaattattctctcaaatattaccagagcctgcaaactataatgttccaatagcctctttgtggctacttgacttccctgaagcactctgaagccaaagacagccaagagact

SEQ ID NO: 47914 - DNA, 601 bp, Human
cgcaatctcggctcactgcaacctctgcctcccgggttcaagcaattctctggcctcagcctcccaagtagctgggattacaggtgtgcaccaccacactcagctaattttgtatttttagtagagacagggcttcaccatgttggccaggctggtcttgaactcctgacctcaggtcatccacccgcctcagcctcccaaagtgctgggattacagacgtgagccaccatgcccggccaactttttactatactcttaacatcttctgagttttttaccatgtgcgtgcattaccttttaaaaaaaaaaaaaagtcacaagggattacatattgcatgattctcattacatcgcatatccagaataggtaaacccatagagacagaaagcaaattagtggttgccaggggctggaaagagaggagagaaagagagtgactatttaattgatctggggtttctttttagagaaaaatgctctggaactagatagaagtgacagttgtacaacattgtaaatatgctaaatgccacttaattgtatactttaaaatgattaaaatggtgaattgtatgttatgtatattttatcacaattaa

SEQ ID NO: 47915 - DNA, 601 bp, Human
ctggagtgcaacggcgcaatctcggctcactgcaacctctgcctcccgggttcaagcaattctctggcctcagcctcccaagtagctgggattacaggtgtgcaccaccacactcagctaattttgtatttttagtagagacagggcttcaccatgttggccaggctggtcttgaactcctgacctcaggtcatccacccgcctcagcctcccaaagtgctgggattacagacgtgagccaccatgcccggccaactttttactatactcttaacatcttctgagttttttaccatgtgcrtgcattaccttttaaaaaaaaaaaaaagtcacaagggattacatattgcatgattctcattacatcgcatatccagaataggtaaacccatagagacagaaagcaaattagtggttgccaggggctggaaagagaggagagaaagagagtgactatttaattgatctggggtttctttttagagaaaaatgctctggaactagatagaagtgacagttgtacaacattgtaaatatgctaaatgccacttaattgtatactttaaaatgattaaaatggtgaattgtatgttatgtatat

SEQ ID NO: 47916 - DNA, 601 bp, Human
agtttaaattgaaagcacaacaaaataacactgtttaacttagattgtcaaatatcaaaaatatgaatatatacttacatatagattgagcatcacaatacatgataaatgcactcctcacgcattgctgatgagagtataaacctgtactaacctctgtagaaggcaatttatcattatccatcaaaatgctaaaggcatataccttgtgatgagtatcctactccaaggtatttatgaacatagtctcctatatgtatatattatatagatatttattgtagctctatttgtaataacraaagatcccaaacaaactaaatatccattattaagacattggttaagtacatttggcacatccacacagtggaattagttttaaaaataagatagttctggccgggcacagcggctcacgtctgtaatcctagcattttgggaggctgaggtgggcggatcacttgaggtcaggagttcaaaaccagcctggccaatatggtgaacccctgtctctactaaaaatacaaaaaaattagccaggtgtgatggcaggtgccgtaatcccagctactcaggaggctgaggcagaagaatcact

SEQ ID NO: 47917 - DNA, 601 bp, Human
agtgctgggattacaggcctgagccaccacacccagcctactatccttaattttttctgtaatttttaaataatctttaacatcaaaaagtttaaattgaaagcacaacaaaataacactgtttaacttagattgtcaaatatcaaaaatatgaatatatacttacatatagattgagcatcacaatacatgataaatgcactcctcacgcattgctgatgagagtataaacctgtactaacctctgtagaaggcaatttatcattatccatcaaaatgctaaaggcatataccttgtgaygagtatcctactccaaggtatttatgaacatagtctcctatatgtatatattatatagatatttattgtagctctatttgtaataacgaaagatcccaaacaaactaaatatccattattaagacattggttaagtacatttggcacatccacacagtggaattagttttaaaaataagatagttctggccgggcacagcggctcacgtctgtaatcctagcattttgggaggctgaggtgggcggatcacttgaggtcaggagttcaaaaccagcctggccaatatggtgaacccctgt

SEQ ID NO: 47918 - DNA, 601 bp, Human
tttttagtagatatggggtttcactgtgttagccaggatggtctcgatctcctgacctcatgatccacccatctcggcctcccaaagtgctgggattacaggcctgagccaccacacccagcctactatccttaattttttctgtaatttttaaataatctttaacatcaaaaagtttaaattgaaagcacaacaaaataacactgtttaacttagattgtcaaatatcaaaaatatgaatatatacttacatatagattgagcatcacaatacatgataaatgcactcctcacgcattgstgatgagagtataaacctgtactaacctctgtagaaggcaatttatcattatccatcaaaatgctaaaggcatataccttgtgatgagtatcctactccaaggtatttatgaacatagtctcctatatgtatatattatatagatatttattgtagctctatttgtaataacgaaagatcccaaacaaactaaatatccattattaagacattggttaagtacatttggcacatccacacagtggaattagttttaaaaataagatagttctggccgggcacagcggctcacgtctgtaa

SEQ ID NO: 47919 - DNA, 601 bp, Human
accccatctctactaaaaatacaaaaattagctgagtgtggtggtggacgcttgtagtcccagctacgtgggaggctgaggaacaagaattgcttgaatccagaatgagactgtctcaaaaaaaaaaaaaatttactattaaatttggtccctttttgatagactggttaaacagaaattaataggtaaatatatttaagataacaataaccaaatttttcactatgaaagaaagggctgcaaactaaaatgaaccctggggtactatattagaattggaggtattggtatgagctgatgktttttaatatttatagataaatatagatgtaatcatatatagattttcgagttttgactgctagaagagctaaaagcaataacactgcagtatcaatgagtacacctagtggtcagttcctggtttttaaatacacttctccaccaaaaaagaactagggctcttgaatgatttctacagctggggcaggaaagatcttattgtgccggaagcacaaaaacgctcaaaaactgatggggattgtcaaaaggacacaggaaccctggtaaaaggattcccattggccaaatctgagacaat

SEQ ID NO: 47920 - DNA, 601 bp, Human
tgagaaaaagtataactaacttctattcaaataagcacttttaataaggatataaaatctcagccaggctcgtgcctgtaatcccacaatttgggaggccaaggtgggcaaatcacttggagccaggagttcgagacgaacctggccaacatggcaaaaccccatctctactaaaaatacaaaaattagctgagtgtggtggtggacgcttgtagtcccagctacgtgggaggctgaggaacaagaattgcttgaatccagaatgagactgtctcaaaaaaaaaaaaaatttactattaawtttggtccctttttgatagactggttaaacagaaattaataggtaaatatatttaagataacaataaccaaatttttcactatgaaagaaagggctgcaaactaaaatgaaccctggggtactatattagaattggaggtattggtatgagctgatggtttttaatatttatagataaatatagatgtaatcatatatagattttcgagttttgactgctagaagagctaaaagcaataacactgcagtatcaatgagtacacctagtggtcagttcctggtttttaaatacacttctcc

SEQ ID NO: 47921 - DNA, 601 bp, Human
tattcaatatctgattccttgcagttatgtctaggttgttatataaggaagtaagagccactagaaaagaaaacagattcaccaatcaactggtcacaaatttttaaaaatcagtttccattcaaatgtcccttaaacctcaaccataatatcaaagtctctttgagactgcatgacaatcaactacaaaatgaaacagcaaatcttgcaaaaggttgacatgataggtacttggaaagagactgacctgaatatcaaagaattttaggcccctaggaaaagttaagcaatccacaaataytatgcaaaaaccctttttatgatggggctaaaagagtcatacacaaacaaaagaagttttatcatgtcatagtttctgtgagaaaaagtataactaacttctattcaaataagcacttttaataaggatataaaatctcagccaggctcgtgcctgtaatcccacaatttgggaggccaaggtgggcaaatcacttggagccaggagttcgagacgaacctggccaacatggcaaaaccccatctctactaaaaatacaaaaattagctgagtgtggtggtggacgcttgtagtcccagc

SEQ ID NO: 47922 - DNA, 601 bp, Human
ttcataaaagagccctaaaggacaaaggatgatctcctcaaaactcaattgtctgtggagaattttctatggggaaaaagatatagtggctctgaatattcaatatctgattccttgcagttatgtctaggttgttatataaggaagtaagagccactagaaaagaaaacagattcaccaatcaactggtcacaaatttttaaaaatcagtttccattcaaatgtcccttaaacctcaaccataatatcaaagtctctttgagactgcatgacaatcaactacaaaatgaaacagcaaatyttgcaaaaggttgacatgataggtacttggaaagagactgacctgaatatcaaagaattttaggcccctaggaaaagttaagcaatccacaaatactatgcaaaaaccctttttatgatggggctaaaagagtcatacacaaacaaaagaagttttatcatgtcatagtttctgtgagaaaaagtataactaacttctattcaaataagcacttttaataaggatataaaatctcagccaggctcgtgcctgtaatcccacaatttgggaggccaaggtgggcaaatcacttggagccag

SEQ ID NO: 47923 - DNA, 601 bp, Human
ccaacatggtgaaaccctgtttccactaaaaaaatacaaaaattagtcaggtgtggtggtgggcacctgtaatcccagctactcaggagcctgagacaggagaatcacttgaacccaggaggtagatgttacagtgagccaagatcgcatcactgcactccagcctgggtgacagagtgagactctgtctccaaaaaaaaaaaaaaaaagaaggaaatggtctatactctggagagaatttgataacccaacctcctagaaatagccctggataacacctcagtagtttcaaacatccttyaggatgatttggaaggatgcatatgagagagtcaatattcaaatgaccaggaccttttttagtacctttaggaccttttttattcacttccatccaaggcaggaattcaaaagaacagtcccagtgtataggtttcctcaaaagcccttcttaatcctgacaactaggacaagaactagaaggcaaattagttaggggagaattatcttcaatggtgtatttttgaaaggagaaaggatacacctatcatgtttccccttcttcagcagactggactactgactgtgtggatcagaaaca

SEQ ID NO: 47924 - DNA, 601 bp, Human
caaggcatagggccctcattcctcagatgaagcaactggttagcctccagtggcagcagaaaattctacgaggcagatggtgccaagggactctgaaggggcacataagattatgtttgatataatcacaatgcaacatgagaggaagataagacttaaaaaaaaaaaaatctgtcacataaaaatagggcaaaaactagggtaaatccaatctctaagagttattctcagttacagcatttaaatatctcacacttcatcactgtgctttggtggtgatattctgtgatgttaagcagtyaagacaatcaaaacctaggatttaaggaccttgaaaaccctcacaaaaccaaaggagtcaaattataaaatttactccacccatgctacatgaatcacagacctactctatataatctaaatttacatatatcttcacaaaatagctcccagctgtctattaaggatctctgtttggccaagtcttgtccttggtgtaaaaatatgttgagctaaaggagcctctctgcctcagaagctggcctgccctttagatgaattttgtatactgcaaacattgctaagctactcttatttattt

SEQ ID NO: 47925 - DNA, 601 bp, Human
cattttgtgtcatctggccttcacagatgcttagggtgctacctacaaggatgttgtgtggcgttatacccaagattggaagtggcaggaggagccagaccctcccagagtatggttcataaacttagctagatggtggccaccaaggcatagggccctcattcctcagatgaagcaactggttagcctccagtggcagcagaaaattctacgaggcagatggtgccaagggactctgaaggggcacataagattatgtttgatataatcacaatgcaacatgagaggaagataagacttaaaaaaaaaaaaatctgtcacataaaaatagggcaaaaactagggtaaatccaatctctaagagttattctcagttacagcatttaaatatctcacacttcatcactgtgctttggtggtgatattctgtgatgttaagcagttaagacaatcaaaacctaggatttaaggaccttgaaaaccctcacaaaaccaaaggagtcaaattataaaatttactccacccatgctacatgaatcacagacctactctatataatctaaatttacatatatcttcacaaaatagctcccagctgtc

SEQ ID NO: 47926 - DNA, 601 bp, Human
gcatgaaccaccacacttaggcttaagtacattaatcttaatgaattgcatgaattattttgaggaaaacgtactcatatttgaaactttagaactcttttttaaaattaatgtagattgatggataaatatataataaaacacatatagcaaaattttaattgtagacttgagatggtaggtttatgggtgttcaacacaaaattctttcaacatttatgtaagattttttaaagtatcataataaaatgttcaaaaattatcattaaaaagaaaacatagcaagtagtgtattttaaastctttagccattaaaaatgtgcaaagtttgaacaaagttgaattactaaaacttagataaattagatataatagtaaagaataattgtggggtaggggtgattttttccacaaactctttttaaggcacaaaaagtacagtgattacagaaattttttctgtattttaggaggtagtccaaaagagtcaagataagaattatatgccttattaatctttgtcttggcccagttctctggcaaacagagcctgattaaaatgctgatgtttcacttgagaggtgcatacacagggcatcaa

SEQ ID NO: 47927 - DNA, 601 bp, Human
tcccttctgcttgctctttattcttcaatactgagttccagaaaccctcttttggaaagcacaggtaacagatgctcctgtgacttgtgtttttcccaggtgtatccttaaactttggcttaataaacctctgattgagtcacatttttggttaatatactgatttgatcattacacattgtatgcatatatgaaaatatcacatgcacccccaaaatatgtacaactattatgtatcaataaataaaaataaactgtaaaaataaaaaatatacaagtttaccaattttttgagtcttcmtttacttatgaaggctcctgtatcatataaaatttatattaaattttatgcttatgaaatacaatagaaaaatggttgtagaatacagataacttaatgaataaaacacaaatgtccaacatataaagaactcaacttcacaagtaaacagggagacacaaaagataacagtaggttttcctcattcaattggcaaaagttaaaaagtttagtaacatgtgttgaagaagttgggaaaataaattctctcatacactaatgatggcagtcattttggaaggcaatttggcagaccatatt

SEQ ID NO: 47928 - DNA, 601 bp, Human
ttcctcctctttccccccagagctataatttcacaaccctgtgtcatagcattacacgttaagtcagcattgtcccgcaatggcaaaaggacatatacctccctcacaaatttctcataagaaaatcccttcctagtcactaaacctttcaggatacatatcccctaaaaccagcacatgccaattgtaaccttgggtgtgcaacctaagtttaactctcaaaactgagttctgttaaatctcatgctgacaatgtcaattacaagcttaccttcttaggtacacaacagggacaagacaraaaatcactccttcgatcatgtcttttgcagggacatgaatggaggtggaagccattatcctcagccaactaatacagcaacagaagaccaaatatcgcatgttctcacttataagtgggagctgaatgatgagaacgcatggacacattgtggggaacaacacacactggggcctatagggatggtcaggagagcatcaggaagaataactaatgaatgttggcttaatatctaggtgatgggatgacctgtgcagcaaaccaccagagtacacatctacctatgtaacaaacctgcat

SEQ ID NO: 47929 - DNA, 601 bp, Human
aaatgaaatcctgacatttgcagcaacatggatggaactggaagtcattatattaagtgaaataacccaagcacggaaagacaaataccgtatgttctctctcacatgtgggagctaaaagggtgaatctcatggaagtagagacttgattagtggttgccagaggctgggaaggagaggtggggattaagagaggttggttaatgggtacaaaagtacagttaaaagctgggcacggtggctcacgcctgtaatcccagcactttgggaggccaaggtgggcggatcacaaggtcaggagtcaagaccatcctggctaacatggtgaaaccccgtctctactactaaaaatacaaaacattagccaggcgtggtggcaggcgcctgtagtcccagctactcgggaggctgaagcaggagaatggcgtgaacccgggaggcggagcttgcagtgagccgagatcgcgccaccgcactccagcctgggtgacagagcgagactctgtctcagaaaaaaaaaaaaaaaaaaaagtacagttaaatagaaagaataagatctagtgttcagtaatataatacggtgactatagtcaacaacaat

SEQ ID NO: 47930 - DNA, 601 bp, Human
agtcacaagtctgggcctccagaacatctaaccaaaaagcttcaagttggggttcccacaatcccctctgggttctattagtttgctagagtggtcacagaactccagaaacacgcttaccagtttattataaaggatattacaaaggatacaaatgaacagccagatgtaagagatgcatagggcaagttatggtggaagggacacaaagtttccatgcccaccccaggcacaacccccagaaacctccacttattcagctatctcgaagctctacaacacagggctttgggctttttawgaaagcttcattacataggcatgactgattaaatcactggccactggtaatcaatttaaccctcagcctctctcctctccccagagataggggtgaggctgaacgttccaactctctaatggtgccttggtctttcacgtaaccaactcacatcctgaaactacctaggggctgtcagccatcaatcaatcactagcacacaaacagacattactttggaggtcgtaaggattttaggagttgtataccagggaaacggggtcaaaggccaaacatatattccacaatatcacctattat

SEQ ID NO: 47931 - DNA, 601 bp, Human
aatgcagacagcacaaattagtgataacctatgtaaattgtaattgatgattaatctgaaatatttattactgtttgattatattacaataaaattatctttctagtttaaaaatagaatggacaagtttttaaattaaaagaagctatactactgatgcagaattaagtggaaaatactatgcaggactttctaaagcagactatgaaaaggtatcatggatatacttgttaagaatattacgaatatatgtgtaaatgctatgaatcactgccagtttatggaactggtaaaagacatygaataattttttgttctttgccaatgctcgttggtgtagtcatagagttttatgaagaatcactgtgctgtctgagagtgaaaaactcaaactgtttttcctctgctctcacaccacaacaatcaacatgaagacttgtgtgaccaaatgtgtgggagtttctccccacacaccaagcaagaagttaagttctgcagtggagaggagccgggtatcctctaattcaactttccaacactatcaggagatagtgttagatctcaaaggttaagagctcagtaccacaaaccccatggcccc

SEQ ID NO: 47932 - DNA, 601 bp, Human
agcattaaaatgaaagacgcagatcatagtgtgtttgaatatatcacgctgttaacgaaaagagtcaaactctgtataaaatatttttagagattgattctgagccaaatatgagtgaccatggccaaagacacagccctcaggtggccctaagaacatgtgccaaggtgggtggcgtatggcttacttttatatattttagggaggcatgagacatcaaccaaatatatttaagaaatacattggtttagttcagaaaagcgggacaactcaaggcgggggcggggtggcggcgggggcrgtgttccaggctataaacgttttctggtttacaattggttgagtttatctgaagacctgggatcaatagaaaggaaatgtatgttcaggtaaagataaaggattgtaggcaccaagttttattgtgcagaggaagctctcagatagcagacttcagagagaacaggttgtatattgtttattatcagacctaaaagagtgcctggctcttacttgattatctcctggatctagaaaggaaggaaggaaaacaaggggaaagtggattctctatagaatgtggatttttcccacaagggat

SEQ ID NO: 47933 - DNA, 601 bp, Human
agagccagattttttatttagctatattcacacagtttggactatgaaaggaaacagctagtctagccattttcaaggccaccagtttcggtgcttagaatatatttgttaaccccagtatgaaaatatatgatacataataatgtaagcaagacaaacctattttctcacaatatacatatttttccagataggggaataaattagaacatacttgaacatagttctatccaataaaactattactgaacaactgtgatagttattaagaggtaggaaaaataaattgtttttaattacygaccacgtatataaatgctcccaggcactgtgcaagacccaatgaaatcaaaaatgaatctagatacagcacctatccagggaactgtagttccacagaaatgctataaattctcaattatcttgtttttcattcttttaacaatggagaagcaaattacatttactgagctctcactgtgagccaatgtgttaaaagctttaagtgtattatctttcagaaaacagtgaaagattgctggatgttctacggaatgctagatgttgtctggtatacgctactgagtaatttgattccata

SEQ ID NO: 47934 - DNA, 601 bp, Human
taagactccacatacaaaatcacatttgctattataatagagccagattttttatttagctatattcacacagtttggactatgaaaggaaacagctagtctagccattttcaaggccaccagtttcggtgcttagaatatatttgttaaccccagtatgaaaatatatgatacataataatgtaagcaagacaaacctattttctcacaatatacatatttttccagataggggaataaattagaacatacttgaacatagttctatccaataaaactattactgaacaactgtgatagytattaagaggtaggaaaaataaattgtttttaattactgaccacgtatataaatgctcccaggcactgtgcaagacccaatgaaatcaaaaatgaatctagatacagcacctatccagggaactgtagttccacagaaatgctataaattctcaattatcttgtttttcattcttttaacaatggagaagcaaattacatttactgagctctcactgtgagccaatgtgttaaaagctttaagtgtattatctttcagaaaacagtgaaagattgctggatgttctacggaatgctagat

SEQ ID NO: 47935 - DNA, 601 bp, Human
ataatttaattttaaagcttaagaagtttatgaagtgatgtcacaaatttcaacccacttattcctccctaacctttacttttagaaactacaggagggaagggggaggggaagacagtaaaaagtagcttaaatgcaacagaaaaattcctcatagcctcacttttctctttttaaaaaatgcaaaacaaagacactattcattgctcccgttgtggggatgcttactatgcatatctctatcacgactaagccaaagcccaatagataggaggcgccataattttccataacaaaacaraataaagcttacctttgtatgtggttcctgtctcttaccaggcaaaaactggaaatctggggaatcatctccataactttcttggttggctcagaaatattgcttttaaaatctgattgggtctctttttgctgcaatagctcctgtttggcatattctttgagccttttataaagggtgcgtaggccctgtgctgttcgaggagggcggtctactccaattgcattatagttaactgctatgatatcccaacatctattcttttctactattactgaatgtttattagtgtgttcttcg

SEQ ID NO: 47936 - DNA, 601 bp, Human
gtcgttttcaaattataaaaacctatacctactaaccaaagggtacagttttatacctgcgatgcaaaaaacacttttctccatggttcaagggagagaaaattctgcataagtagcacagtataaaacaattttactgcgtagttttctggatatctagctattgggatttcatcatttgtcatcacagtgaacattttaaccagtggccccaagaattaatccactgtgtattcatgtcctggattcccactggtgatattttttttactgtgctatcaagtagaaataagcagtatckggtaagaagctaggctcaaaaatactttcctagtaaattaccaaaataacatatgcacttggctacaaagtggtttttttctgcttctctcctaatttcaaagggatttcatagtaatcaataatttgcttatataatgcctcttccaccaatagaaaagcacattgtgtaaagctttgtttgaaaggctcctcaaactaacaaggagtttacaatttgtttaaattaccctaaatggttcagaataagaatgtagctgccatttttatattttgccagaggttacaatctgaattagtg

SEQ ID NO: 47937 - DNA, 601 bp, Human
acataagaatttaaaaggcatgtttcttatattcttccctttaaaacctaacaaattggtattatttaagccataggtatagaaatgtacaaatcaactcatttttatcagagaaatgttcatatcccaaaagattttttgtgtgtgaatattgtaaatattcacacacacaaatagtcaaaatgtaaccagatacttgtatatttatatattatttttcttctactcactgttatttttaaaatatgcaactaactaaaattacagtttctacatgtcgttttcaaattataaaaacctrtacctactaaccaaagggtacagttttatacctgcgatgcaaaaaacacttttctccatggttcaagggagagaaaattctgcataagtagcacagtataaaacaattttactgcgtagttttctggatatctagctattgggatttcatcatttgtcatcacagtgaacattttaaccagtggccccaagaattaatccactgtgtattcatgtcctggattcccactggtgatattttttttactgtgctatcaagtagaaataagcagtatctggtaagaagctaggctcaaaaata

SEQ ID NO: 47938 - DNA, 601 bp, Human
atgtcaatgtagacacagtaacataagaatttaaaaggcatgtttcttatattcttccctttaaaacctaacaaattggtattatttaagccataggtatagaaatgtacaaatcaactcatttttatcagagaaatgttcatatcccaaaagattttttgtgtgtgaatattgtaaatattcacacacacaaatagtcaaaatgtaaccagatacttgtatatttatatattatttttcttctactcactgttatttttaaaatatgcaactaactaaaattacagtttctacatgtcgytttcaaattataaaaacctatacctactaaccaaagggtacagttttatacctgcgatgcaaaaaacacttttctccatggttcaagggagagaaaattctgcataagtagcacagtataaaacaattttactgcgtagttttctggatatctagctattgggatttcatcatttgtcatcacagtgaacattttaaccagtggccccaagaattaatccactgtgtattcatgtcctggattcccactggtgatattttttttactgtgctatcaagtagaaataagcagtatctggta

SEQ ID NO: 47939 - DNA, 601 bp, Human
gctagtttagaaaatcataagttgtaacaacatatccattacattcatatggataagagaaagataggaaagtggctatccactatctaaattactaatatattggatgaaataatctatatacttagtatatttatcaaatgtagtatatttctacagaatcaagtctacatttaaaaaacaaaatcactcttctctatgttctcccagcattacattttgtaattaaagctcatggaccccaaacaattgtctatgatatgcaagatgtctggtggcttaagtgtatagtcatccctcwgtatccaagggggattggtttcaggacaccccctaccccatcaagatccacagatactcaagtcccttatataaaatgtttgtattcacatacaatttacacacatccttccatatactttaaatcatctctagattacttacaatggctaatataatgtaaatactatgtaaatagttgttaggatacaggacaagtgagccccaaaactggggattagcccaactcctacctcagttataccgtctttttaaatttcgtattactttttattgttgtactgttatttatttttctgcc

SEQ ID NO: 47940 - DNA, 601 bp, Human
caagcccaggagttcaagaccagcctggacaatacggcaaaactctgtctctataaaaaatacaaatattagctgggcatggtggtgcacacctgtggttccagctactcaggaagttgaggcaggtaggttgcttgagcccaggaggttgaggctccagtgagctgtgactgtgccactgtactccagcctgggtgacagagcgagaccccatctcaaaaaaaaaaaaaaaaaaaattcataagggcatgttttgataaagggaaataatgtcatttaatattaatagtgggcattatcrtcttagtgaatgattcctaagcatagccactctggagttgaatgacttaattgtacaacccataaacctaagcctttaatattcttttttttttttttttttttttaaagaggtcttcaggttggtctccaactcctggactcaagcaatcctcctgcctcagcctcacaaagtgctaggattacaggcatgagccaccgcacccagcctaatattcttttgtttaacaattctaaatacacacattgttttcaatggcacaaatgaaaatttaaaatgtctcatataatcaaattcaat

SEQ ID NO: 47941 - DNA, 601 bp, Human
ctacaaaatacatggaacacaagtgttgactgtgctggaagaattaagaatccatttaatattttctttaataggaggtactaagttacggggctgttacaatattttaaataaacccaggtcatttaaaaactcctccctcttctctcacagcctggcccccaccaaaaaaaaaaaaaaaaaaaaagcaacatgaacaatttaacagagtaaaataaaagaggttgaaataagcccactcacacttactagaaattattaaacactttagtatacagtcatgtaccacacaacaaggttytgatcaaccacagaccacatatatgatggtggtcccgtaacatcttaataccatatttttactgtatattttctatttttagatatgtttagatacacaaataccactgtgttacaactgtctacagtattcagcacagcacatgcagtacaggtttacagtctaggaaccataggctataccacacagcctaggtgtgtagcaggctataccatcctaggtttgaggaagtacattccacaatgttcacacatcaacgaaatcacctagcaatgcatttctcagaacatattcctgtca

SEQ ID NO: 47942 - DNA, 601 bp, Human
gtatctcaataaagctgtttaaaacacacacacacaatgaaataacaccacatcttgattatactgactaaaattaaaaaaaaaaaaaaactgaccacagtaagtgctaataaagatatagagcaactgaaaatatcatatcctgctggaaggaatgtcaaacagtacaactagtttggaaaatggtttcgcagactctttaaaagttaaacatacacctaccataaccagccattacactgctaggtattcaccaaaataaaagaagaagaagaagaaagaaaaagaagacatatgtctsgaaaaaaaaaaacttgtacatctccaagccaggtaaatcaacctgccaaatgcctgaaaatttatcactactagaattcagataaattgtatcttcattactggcattcatggatttagaaagtgagtcttggctatcttcaaccagtaaattatactcagaaccaccaaagttgttttctgagaaaacaaatgattcatacccagcttgagtcagctctgtctggcatgacccaatgaactctgatcagttcctgaaaggattcagtctgctagagccctcagcaggaaccaagaagac

SEQ ID NO: 47943 - DNA, 601 bp, Human
acactttacatgactgaatcatagggtatgttaattgtatctcaataaagctgtttaaaacacacacacacaatgaaataacaccacatcttgattatactgactaaaattaaaaaaaaaaaaaaactgaccacagtaagtgctaataaagatatagagcaactgaaaatatcatatcctgctggaaggaatgtcaaacagtacaactagtttggaaaatggtttcgcagactctttaaaagttaaacatacacctaccataaccagccattacactgctaggtattcaccaaaataaaagaagaagaagaagaaagaaaaagaagacatatgtctggaaaaaaaaaaacttgtacatctccaagccaggtaaatcaacctgccaaatgcctgaaaatttatcactactagaattcagataaattgtatcttcattactggcattcatggatttagaaagtgagtcttggctatcttcaaccagtaaattatactcagaaccaccaaagttgttttctgagaaaacaaatgattcatacccagcttgagtcagctctgtctggcatgacccaatgaactctgatcagttcctgaaaggatt

SEQ ID NO: 47944 - DNA, 601 bp, Human
ccattaggatggctggaatcgcaaagtcagataataaacaagtgtgatgcgtatgtggagaaatcaaaaccctcataccctgctggtaggagtataaaatggtgcagcactttggaaaaaccagcatgacagttgctcaaacaattaaacaagagttaccaaatgacacagcaattacactcctaagtatatgcccaaaagaataataacatatgtccacaaaaaaacttgcatatgaatgtttatagctaggattattaataatagccgacaggtagaaacaacccaaatgtgcattcarctgacaaaggataaacaaaatgtggcatatgcatacaatggaatataattccatcatagaaaaagaacaaagtactaatacatgctaaaacacggatgaaccctgaaaacatttatgctaagtgaaagaagccagtcacaaaggccatatattttaggattccattcatataaaatgtctagaacagcaaaatcttacagagacagaaaatagattaatggttgcttaggctggagggtaaggatggggttaggaagcagggtggtggtagctaaaggtaaaaagtttctttctgaggta

SEQ ID NO: 47945 - DNA, 601 bp, Human
ttttgctttttgaaagatgccattaaaaaaacaaaagggaagccactggctggggtaaaatattcacagcatatgaataagacaaaggtcttgtatccagaataattattcttttttttttttcttttttttttttgagacagagttttgctctgtagcccaggctggaatgcagtggtgtgatctcggctgactgcaacctctgcctcctgggttcaagcgattctcctgcctcagcctcccacgtagctgagattacaggcgcccaccaccatgctcagctgatttttgtacttttagyagagacggggtttcaccaggttggccaggctggtcttgaatttgtgacctcaagtgatccacccacctaggcctcccaaagtgctaggattacaggcgtgagccactgcacccagcctaagaattcttatagtttaaaaataagacaacattgattttatatcctgagactttcctgaagttgcttatcagcttaaggagattttgggctgagacagtgaggttttctagatatacaatcatgccgtctgcaaacagggaaaatttgacttactcttttcctaattgaataccctttatt

SEQ ID NO: 47946 - DNA, 601 bp, Human
tacactaaaattaaaaagctttgttgaaaaaaaattaacaaagctcttataaataagcacagctcctatttcatgaattggaacattcaattttgttaagatagtaattttccccaaaacgatcaatatatttaacacaataccaatcaaaatcccaggacatttttagtaaaattggcaagttgatttaaaaattcatatggaaataaaagtaacgtagactaaccaaagcaatttttgaaaagaacaaagttggatgtttacaataatgctgcgataatcaagatagtttggtactgcscttcctctccaaaaaagacatatagacattccaatgcattggaagagaagcaagaaatagaactattcacacatatacggcgaaattattttcaacaaaggtagggaagcaaattcaatgaggaaaggaaagtcttttcaacaaacattgctaaaccaactggatacacatttggaaaagataaacatcaaccattaagtcaccccatatacaaaattcaactcaaaatgaatgatagacctaaatgtaaaacctaaaacaaaaaatctctaatagaaaacacaggataaaatatttgta

SEQ ID NO: 47947 - DNA, 601 bp, Human
gatatatgtatacactgtgggatggctaaatcaaactaattaatattatccattacctcacatactttttgtggtgaaaacattttttaaaatgctactttcttagcatttttcaagtatacattgttattaactatagtcaccatgttatacaatagatttcttgaacttattcctccttaactgaaatttcggatcctttgaccaacatctccccaatgccccacctctatccaactctaggtaaccatcattctactttctgtttctaagagtttgacttttttgaattccacacatragtgagatcacacaataattgtctttctgtgtccagcttatttcactgagcataatgtcctccgggtttacccatgttgtcacaagtgacaggattgccttctttttaaaggctgagtagtgttctactgtgtacctataccaagaagtttttaatccattcatccattgatggacacttaagttgacttcacatcttggctactgtgaaaaatactccaaggaacatgggaatgcagatatctcttcaacatgccaatttcattttttttttttggctatatacccagaagtgaaagtg

SEQ ID NO: 47948 - DNA, 601 bp, Human
ctgttccgaagtcaaataaactcaaatgaagtagaataacataataatcactgtaaacattttaaaactctaaaaattaagaaattatttcaatgtctatagcatggaaaaatatctaaaatcacattttgacaaaactgatttaattaagtaacatgacaaactgaggaaaggcaaagattacagagttctctgaaagtaaaacctgaaatttttgtttatttaataaacaaaaattatatatatgtaggtgcacaacattctgttttgatatatgtatacactgtgggatggctaaatyaaactaattaatattatccattacctcacatactttttgtggtgaaaacattttttaaaatgctactttcttagcatttttcaagtatacattgttattaactatagtcaccatgttatacaatagatttcttgaacttattcctccttaactgaaatttcggatcctttgaccaacatctccccaatgccccacctctatccaactctaggtaaccatcattctactttctgtttctaagagtttgacttttttgaattccacacatgagtgagatcacacaataattgtctttctgtg

SEQ ID NO: 47949 - DNA, 601 bp, Human
cattttataaactaagaaatccaaatatcaggtgttaatattaccagatgagtataattactacaaatgtcttactgttccgaagtcaaataaactcaaatgaagtagaataacataataatcactgtaaacattttaaaactctaaaaattaagaaattatttcaatgtctatagcatggaaaaatatctaaaatcacattttgacaaaactgatttaattaagtaacatgacaaactgaggaaaggcaaagattacagagttctctgaaagtaaaacctgaaatttttgtttatttaataaacaaaaattatatatatgtaggtgcacaacattctgttttgatatatgtatacactgtgggatggctaaatcaaactaattaatattatccattacctcacatactttttgtggtgaaaacattttttaaaatgctactttcttagcatttttcaagtatacattgttattaactatagtcaccatgttatacaatagatttcttgaacttattcctccttaactgaaatttcggatcctttgaccaacatctccccaatgccccacctctatccaactctaggtaaccatcattcta

SEQ ID NO: 47950 - DNA, 601 bp, Human
gcacaagaaaattagattatattaagaaatagtatgaaagaatatttgatcatactcatgttagcattttataaactaagaaatccaaatatcaggtgttaatattaccagatgagtataattactacaaatgtcttactgttccgaagtcaaataaactcaaatgaagtagaataacataataatcactgtaaacattttaaaactctaaaaattaagaaattatttcaatgtctatagcatggaaaaatatctaaaatcacattttgacaaaactgatttaattaagtaacatgacaarctgaggaaaggcaaagattacagagttctctgaaagtaaaacctgaaatttttgtttatttaataaacaaaaattatatatatgtaggtgcacaacattctgttttgatatatgtatacactgtgggatggctaaatcaaactaattaatattatccattacctcacatactttttgtggtgaaaacattttttaaaatgctactttcttagcatttttcaagtatacattgttattaactatagtcaccatgttatacaatagatttcttgaacttattcctccttaactgaaatttcg

SEQ ID NO: 47951 - DNA, 601 bp, Human
cccactgttttaagcctaattttcattttttgttacttgcaactgaaagatcattttattataaactacacatatgcaaaaccatgcacactataccttaggggtaaaagatattccaaagtaattgtgataatttttcctctctcactgactttagaatttcactaaagaggcaataccaatgcatgaacaaattctccaaaaatctagccccaatcgaccttaaccaacatagaatgtgtactatatatttttctttttacttccccaatcactatacacagttgttccatatttttayaataaataaaacattctattgtagataatttagtttgcttcaactcttaacactgtcacggcctttcatacactacattcctgaaacactgaactagtttgaattccttcctgcttttgtgcctttacatgtgctattctctcttgcacatggcccttacctataacctccaaaactattcatccttcaaatagtatcttaaacggtaactcctatcaagcttacccctagcctcctgtgcagattaaatggttcttttatgctcccactgcttcctgggcagattaaatggttctttta

SEQ ID NO: 47952 - DNA, 601 bp, Human
attttcattttgaaaaccctaaaatatacctatgttcagtccctctccctaccatacaggccaaataaatcagagcctcaaagaaaggtcagagtctgggcatcggcatttcttttctttttctttcttttttttttttaagagacagggtctctccagcccaggctggagtgcagtggcaggatcaaggctcactgcagcctcgatctcctgggttcaagcaatcttcctgcctcagtctcccaagtagttagagttacagatgcatgccactacacctggttaatttatttttttgtayagacaaggtcttgctaagttgcccaggctggtctcgaacttagcctcaagcaatccttccccatcagcctcccaaagtgctgagattacaggcgtgagccactacacccttaaaagcacctcaggtgattctactggcatggtcagggtaaaaacccactgttttaagcctaattttcattttttgttacttgcaactgaaagatcattttattataaactacacatatgcaaaaccatgcacactataccttaggggtaaaagatattccaaagtaattgtgataatttttcctctctc

SEQ ID NO: 47953 - DNA, 601 bp, Human
gccacattttagaaaatatgatgacccttttcaagtagttgaaaattactaaaattttctctactgaaactggcctaaaatttataatctgtgccaatctgtatttaatatatagtcttaaattatttatggtggaatactttttaattgtaatgctctgatataggaagaaattacttagctcaatgtcaaagacccatcactccatcccaaatcagtattggtcttcacttatccaaattaatgaagattatagttttatcttcacataaaatccaattactgttaatctcagttttamatggaaatggaagacaagaataaccttttaactttgaggtacctttaaagtagctctaattccaagatctctcatttcatttagatccatagatgatcttgatccaaaggtgactctttcaaacatctcagtcgctagaagcttttcttttactcttaaactttgtttcacatactggttttttttttttcctaggtattatgcaatgatggccaactgagcctgatgcattatcacaagctattagcaattttagcattccagctttcagttttcttagcacctctatctttacattaa

SEQ ID NO: 47954 - DNA, 601 bp, Human
tgatctcaaaggcctctttacttcaaaacttatgtttccataatacttgcaatggggaaaaataatcattactttatatacttgctgttgtgaggaaagaagtcacctctatgtctcaactttcacatctactacactatactttgattcggattacttgtccttcccctcaccaaatgagaagctctgtgatgacagttttatctttaggcccaacccataaaaggcaatcaagaaatacctgctgagtgaacagtcaaaagaacaatcagatacaatctaggtttctttttttttaacrtgatttttaaaattgcattcatcagtgtgaaaattaactgattgaatggaactttcactagtaaaatttggactttgcatgaaatcttaccattcaatatttttacacactaatgcttgtgatcaaggcatacagtcctcaaattagaagtataatcatagtccagattaatacatttactaatttctctccttactaaaaagtcagattttattcaaaattatacacatgtatgtgtaatgtatacacatacaatttagatatgtttccttcaacacatgtacagtatttttattactg

SEQ ID NO: 47955 - DNA, 601 bp, Human
atgatctcaaaggcctctttacttcaaaacttatgtttccataatacttgcaatggggaaaaataatcattactttatatacttgctgttgtgaggaaagaagtcacctctatgtctcaactttcacatctactacactatactttgattcggattacttgtccttcccctcaccaaatgagaagctctgtgatgacagttttatctttaggcccaacccataaaaggcaatcaagaaatacctgctgagtgaacagtcaaaagaacaatcagatacaatctaggtttctttttttttaayatgatttttaaaattgcattcatcagtgtgaaaattaactgattgaatggaactttcactagtaaaatttggactttgcatgaaatcttaccattcaatatttttacacactaatgcttgtgatcaaggcatacagtcctcaaattagaagtataatcatagtccagattaatacatttactaatttctctccttactaaaaagtcagattttattcaaaattatacacatgtatgtgtaatgtatacacatacaatttagatatgtttccttcaacacatgtacagtatttttattact

SEQ ID NO: 47956 - DNA, 601 bp, Human
aggcaaaacattaggaaggttagtgactacccccaagaggtcaaagaaccagttagttcagtggcaaaaccatgattcttactcagatctctgaataagcacagtattcttttcagttccccacagccctgtattgtgtaatagtaaaagtacaaagagaaaggagaataaagaggagggggattgttaaaagagctggtgggacagacaaaatatttggacaaaaagagaaaattcagctgcatcagcttccactgcctgtatttcaactaagtctttgggataagctaatatagaactmagaatttttaattgtggggttttgtcccaataatgccgttgattatttgtatttaggtaagtcggttcatcttcctgggcctcagttttctccaatgcaaagtgaagagacgaatctaaatgatctcaaaggcctctttacttcaaaacttatgtttccataatacttgcaatggggaaaaataatcattactttatatacttgctgttgtgaggaaagaagtcacctctatgtctcaactttcacatctactacactatactttgattcggattacttgtccttcccctcaccaaatga

SEQ ID NO: 47957 - DNA, 601 bp, Human
aatatcacccaaaaaggcaaaatcaaatataactagaaggcaggtctcaattgataaatctgaaattagataataaacccaccaaaattattttggggatatatttgcatgcctacatcatgtttataaaaattgaattagataaaaaaagaaaaaagaatgaggagatgagaagaggagataaaaagaaatagactccagtagactatgtaaatattcatcagtgtggaactatactgtcacaggaataagagtttagtcatgtttaccattaacaaatacccagagggtaagttttctstggatcttcctaggtttctgagtaactgaaatgaactttcatctttgaggtcaattcctgttaggtaggagactaggaagtaaaaatgggaaatgtagtccttggctttcctctatatcactgtagcaaagtaagagtgtgctccttgtggatttccagtcaagaaatggccccgttatttttctatcttttaaaaaggacaacaaggaaaaagagaagatagaggtgaaaaatcacatactgcccaagcaaaaaggactataggattataaatcacctaataaaaggcccatcttcaag

SEQ ID NO: 47958 - DNA, 601 bp, Human
ccacctcagcctcccaaagtgctgggattaaaggcatgagccactgcacccagcctcatgaacctctttaaagcagcatgaagtcatcatagaataacaatgtaattcttcaaaactatgctaacacaatttaaaagatttactaaaatatcacccaaaaaggcaaaatcaaatataactagaaggcaggtctcaattgataaatctgaaattagataataaacccaccaaaattattttggggatatatttgcatgcctacatcatgtttataaaaattgaattagataaaaaaagaaaraagaatgaggagatgagaagaggagataaaaagaaatagactccagtagactatgtaaatattcatcagtgtggaactatactgtcacaggaataagagtttagtcatgtttaccattaacaaatacccagagggtaagttttctgtggatcttcctaggtttctgagtaactgaaatgaactttcatctttgaggtcaattcctgttaggtaggagactaggaagtaaaaatgggaaatgtagtccttggctttcctctatatcactgtagcaaagtaagagtgtgctccttgtggatt

SEQ ID NO: 47959 - DNA, 601 bp, Human
gaaaatctttttccaaaattctcataaccaggtgcagtggctcatgcctgtaatcctagcactttgggaggctgaggtgggtggatctcttgaggtcaagagttcaagaccagcctggccaacatggtgaaaccccgtctctactaaaaatacaaaaattagccaggcatggtggagcacgcctgtaatcctagctactcaggaggctgagatgcaagaatcacttgaacttgggagatggagattgcagtgagccaagataacgccattgcactccagtctgggcaacatagtaagactycgtctccaaaaaaaaaaaaaaattcttataaccagaattaaaagcctctttcacttgctcttatgaccctttaccacactagcagtcggtaagcttttattataccacattaaggtcaattgcatttatctgtttactcaaatactttaaaagccacttaaaagtaaggaccgtggtcctgattcccatatgcccacctcctagcagtgtttggcacgtggcatctatcaagaaccacttttggaataaatgcacacagtaagcactattcacctttcctaccaattgaaattcatagtg

SEQ ID NO: 47960 - DNA, 601 bp, Human
gcatttaaaaacaaggcaaaacaaaaccaaaacaaataaacaaaaaagactggaagaaatgttagcaggggcctttgattctttttttctcctgtttttttgtgtcctctaaaatatctttaagatactactattctttaatcagaaaatgcaaaagggaagaagaaacttttttctattttcagatgtagagacagaagaaaatctttttccaaaattctcataaccaggtgcagtggctcatgcctgtaatcctagcactttgggaggctgaggtgggtggatctcttgaggtcaagarttcaagaccagcctggccaacatggtgaaaccccgtctctactaaaaatacaaaaattagccaggcatggtggagcacgcctgtaatcctagctactcaggaggctgagatgcaagaatcacttgaacttgggagatggagattgcagtgagccaagataacgccattgcactccagtctgggcaacatagtaagacttcgtctccaaaaaaaaaaaaaaattcttataaccagaattaaaagcctctttcacttgctcttatgaccctttaccacactagcagtcggtaagcttttatt

SEQ ID NO: 47961 - DNA, 601 bp, Human
tgcaaaagttatatgcagatttttgactacacagtgggtcagcacccctaactcctgagttgttcaagagtcaactgtagtttgtcagttaattgtatttcttcttagtagaaattaagaaccaatatgcaattttatatatgtgttccatttcaaggtatagagaaaaaaattaccaacataaattacggctactatttaggtggctgttttagatcaatactttggcaacaaaggaccaaatgtcagcccaatgagatacagtgaatagcaaagagaaaatccagattcatcctttcaygataaagagaagggagcaaacaggaagcctttatggagatgtaccttgagcaaaattgtaaagggtaaataattactacactaattaggcagctgaatatagttggagcttgaactgaaaaatatgaagctagcacggcaggtagaagacaaaagatgaggatacttaaccttgagagtttagactgtatcttatatatcagcatctcccaaacaccagtatttcatgactaccatcacgatttgttgtcatatctgtgatactatatgttatttatgatttttcttcaaatcattttaa

SEQ ID NO: 47962 - DNA, 601 bp, Human
tttaaagttaagaaagtccaagggaattaaggatattacaaaaatacataagtatacagttgaccactgaacaagaagggtttgaactgtgaaagtccacttatatatgggtttttttcaataaatgttataaatgagtgtgcctacctctcttgcctcccttctatctcctccacctcttccgccacctctgccactcctgagacaaccaaaccaacccttcctcttcctcctcttcctcagcctactcaacatgataaggatgaagagctttatgatgatccatttcctcttaatgaayagtaaatacattttctcttccttatggttttcttcatgctttcttttttctggctttcttgtaaaaatacagtatataatacatatatgaaattatgtgtaaattgagtgtttatgttatcagtaaggcttccagtcaacggtagtttattagttaagtttctgcaaaagttatatgcagatttttgactacacagtgggtcagcacccctaactcctgagttgttcaagagtcaactgtagtttgtcagttaattgtatttcttcttagtagaaattaagaaccaatatgcaattttat

SEQ ID NO: 47963 - DNA, 601 bp, Human
attaaatgttattagagatattattagtaagaccatgtatttttatgccactttatatttttaaagaccttagaagtgtatgttttatatttttaaagttaagaaagtccaagggaattaaggatattacaaaaatacataagtatacagttgaccactgaacaagaagggtttgaactgtgaaagtccacttatatatgggtttttttcaataaatgttataaatgagtgtgcctacctctcttgcctcccttctatctcctccacctcttccgccacctctgccactcctgagacaacmaaaccaacccttcctcttcctcctcttcctcagcctactcaacatgataaggatgaagagctttatgatgatccatttcctcttaatgaatagtaaatacattttctcttccttatggttttcttcatgctttcttttttctggctttcttgtaaaaatacagtatataatacatatatgaaattatgtgtaaattgagtgtttatgttatcagtaaggcttccagtcaacggtagtttattagttaagtttctgcaaaagttatatgcagatttttgactacacagtgggtcagcaccc

SEQ ID NO: 47964 - DNA, 601 bp, Human
tttaatcagcaagatctactgagctgtattttatgattctgtcagtaaatgaagtcctcaacaaaaatagctccctgcatcataaaaaaattaaacactaaacacttgatataatacacataatttagtaaaagttgttatcctacagacctactgttatataatttaaaattaaatgttattagagatattattagtaagaccatgtatttttatgccactttatatttttaaagaccttagaagtgtatgttttatatttttaaagttaagaaagtccaagggaattaaggatattacmaaaatacataagtatacagttgaccactgaacaagaagggtttgaactgtgaaagtccacttatatatgggtttttttcaataaatgttataaatgagtgtgcctacctctcttgcctcccttctatctcctccacctcttccgccacctctgccactcctgagacaaccaaaccaacccttcctcttcctcctcttcctcagcctactcaacatgataaggatgaagagctttatgatgatccatttcctcttaatgaatagtaaatacattttctcttccttatggttttcttcatgc

SEQ ID NO: 47965 - DNA, 601 bp, Human
ccataacaactcaaaaccaaaatgtaagctaaaactccatttttgtgcaaaagggttagggagttaacaagtaaaaactgaattactgatttgaaaaactagattttttttaaatgactaaggctaaacttttaagtttcttacctgatcaacagtaaatatcttgatcctttcacttcctagccatttttgaaattctttcttccaattattcaccaagcttccaggtgtgacaattagtgtcttctttattactggcttgcctccatagggtccctgacactgcagggtccagatgagygaaatacattgcaatgtcttccctaaacccatttcatcagcaagaatagctccacatctgccattcattctgttagaaataattttacttcctttaatcacaatagaaaaatattttatgctcttaaaatcatcaagaaccagaaactgatattttgtaatgacactgaagacttttagtacttcattagctgatttacaacacatcttttgcatctttgataattatatccattacatattgtcaactaaattaccaaaacataaatctgaaattagagagttgaatctaaatcatctg

SEQ ID NO: 47966 - DNA, 601 bp, Human
aagaactggaatgtgttaactctttctgtcttagtcaactgaggctgctataaacaaaataccatagattgggtggcttaaacaacagacatttatttctcacagttctggtggaaggtctaagatcagggtgctagcatggttgggttctggtgagagccctcttcctggcttgcagaagaatgctttttactgtatcctcacatggtaaagaaaggaagttctggtgtctcttgctctggttacggaggcactaatctcatcacgtggctctaccctcacgacctcatttaaacctaaytacctcccaagcccacctcctaatactgctatattgaaagttagggtttcaacatatgaatctgggggacacaaacattcagtccataacaactcaaaaccaaaatgtaagctaaaactccatttttgtgcaaaagggttagggagttaacaagtaaaaactgaattactgatttgaaaaactagattttttttaaatgactaaggctaaacttttaagtttcttacctgatcaacagtaaatatcttgatcctttcacttcctagccatttttgaaattctttcttccaattattcacc

SEQ ID NO: 47967 - DNA, 601 bp, Human
gaatccactcagcttctcaaacagccaaagatatgaaaatcattcagagtatggttcctatttccctgactcattttttcctttaaaaatggcattttataaatattcaacactagttttcctattctttggtttccacttcactattattgacaaacattcattgggcatccagaaaatcttgggggtataactatgaaatttgaccctagtccttttgtctttatcatcgtgattaaattcaaaaaataaaaaggtcatttagcatttcccaaaatcatttttttaaagcacagatcaytttaaaaatcgcttttgataatggttaatacaatcctcctatacaaattggaagtcaaatcatgaggaatttcttaaaggtggatagtcttccccaccccaacacagtaagaacagaagaggaggagttttctcctctctgttgttctggggcatatttccaccctatcagtataggaaggaggtacaagtttttggtcatactccttctctctcttcatttaacttcagagagctgtgacatgcataaacgacacatgaaggaaaaaatgacgatgacacagtaagaataatcatatcc

SEQ ID NO: 47968 - DNA, 601 bp, Human
agtaagaagaaacagtctttttctcttctaactcagtgttactaaattcagctaactcattttttttttcattacttttctggctccagtgatctcaagatcaaaggccagtaaagaaatctgaactgcagcactggaaatcaagtataacgaatccactcagcttctcaaacagccaaagatatgaaaatcattcagagtatggttcctatttccctgactcattttttcctttaaaaatggcattttataaatattcaacactagttttcctattctttggtttccacttcactattaytgacaaacattcattgggcatccagaaaatcttgggggtataactatgaaatttgaccctagtccttttgtctttatcatcgtgattaaattcaaaaaataaaaaggtcatttagcatttcccaaaatcatttttttaaagcacagatcactttaaaaatcgcttttgataatggttaatacaatcctcctatacaaattggaagtcaaatcatgaggaatttcttaaaggtggatagtcttccccaccccaacacagtaagaacagaagaggaggagttttctcctctctgttgttctg

SEQ ID NO: 47969 - DNA, 601 bp, Human
agactattttcaagagtatgggaaagaaacttctgagaaaatgaaaggactctttcttttccctacctccaccctatccctacaaaaaaaaaaaagctttttctttgttttttggtttgtttttttaaaaaagaaataaatctaccacccaacccaacactgtcaataacctacacctatatcctcctgtaacctccacagaaagctctgagagctttttatacacatttatatttttccttttaatcctataagcccacttctaggaatctatacacaaagagtatatgcttgtagataytcatcaccacattatttataacagtaaagaattaatctcagatttatcttttctatgatataatgaaagggcattgaagatcttataataatcattcagctcttaattgtgggctgaactgtatctccctaaaattcctatgttgaagctctaacccccaatgtgactgtttttggagataggacctttaagaaggcagttaaggttaaatgaggtcctaaggatggggccctaatccaatatgactggtgtccttctaagaagagagagagatactccacgaatacatttgcagagagg

SEQ ID NO: 47970 - DNA, 601 bp, Human
cctccccacccccaggttggaccagcaattgctaatttttttaaatttaacacatctagtcagttttaaatttttagacacatcattgaaagagttgggaaaaatacatttatgttggtatatattcagttaagcctctaaaagaatatgcatgatgatgacaaagattggggagtataggaaagacgagaaagaacggtagaaggatcactgtggttggctttcagacattcatcaaaccccaaatgattaagtcaatcatggtaattctgtcccctcctttgcaaatgactgacatackcaagggttcttgtctcatactgcgttcactggaagcagagcctaagacagtgatttgtttgcatgtgatttacagagggagagctctcaggagaaagggaataatggaatcagaaaatggtaggggaagaaactaagcaagaatggcctcagctataatttagcttgagctaaattacagggagctctagagcataaactgcaccataacgttggtcctgaaatcactctaaggcaagggagctgccatttgctgcttacccctaaatcagtcagtcgttgattgcaaactatagaggag

SEQ ID NO: 47971 - DNA, 601 bp, Human
tagctgggactacaggcatgtgccaccatgcccagctaatttttgtatttttagtagagacggggtttcaccatgttggccaggatggtctcgatctcttgacctagtgatccacccacctcagcctcccaaagtgctgggattacaggaatgagccaccacacccagccagctaagtttttaaataaatgtacttttttttataataaattcataaaaggagtattgccaggccacaagatatacacaattttaatgcttttgatatacattgccaaactttccccaagttgtgccaacrtacattccaaccaacaatttacattccaaataggagactcttgtctacacttgctactactagtaaatccaagttggggaggtggtatacacctgcagtcccagctactcgggaggctgaggcaaaaggatactccaggagttcaaggccagactgggcaacgcagagtgacaccatctctaaataaacaaacacacaccaatagaaaagtacaaaagtcactttggttattttgttctacttttttcaaaactagtaaagatgaacatttttatatgtttattgtcataattctttgtg

SEQ ID NO: 47972 - DNA, 601 bp, Human
cagcctcccaaagtgctgggattacaggcatgagccactgtgcccagccagtttctaattttttacccttacagctaagtttttatttcgttttatttttttgaaacagagtctcactctgtcgcccagggctggagtgcagtgatgtgatctcagctcactacaacctccacctcccaggctcaagcaatcctcccacctcagcctcccaagtagctgggaccacaggtacatgccaccacacctggctgatttttttttttttttttttttttggtagacataaggtcaccctataccytatagctaagtttttaattttttagttttgttttttttttttgagatggagtttcactctgtcaccaggctaaagtgcagtggcatgatctcagctcactgcaacctctgcctcccgggttcaagtgattctcctgagtagctgggactacaggcatgtgccaccatgcccagctaatttttgtatttttagtagagacggggtttcaccatgttggccaggatggtctcgatctcttgacctagtgatccacccacctcagcctcccaaagtgctgggattacaggaatgagccaccac

SEQ ID NO: 47973 - DNA, 601 bp, Human
tcggccaggctgatcttaaactcctgacatcaagtgatccacctgcctcagcctcccaaagtgctgggattacaggcatgagccactgtgcccagccagtttctaattttttacccttacagctaagtttttatttcgttttatttttttgaaacagagtctcactctgtcgcccagggctggagtgcagtgatgtgatctcagctcactacaacctccacctcccaggctcaagcaatcctcccacctcagcctcccaagtagctgggaccacaggtacatgccaccacacctggctgatttttttttttttttttttttttggtagacataaggtcaccctataccctatagctaagtttttaattttttagttttgttttttttttttgagatggagtttcactctgtcaccaggctaaagtgcagtggcatgatctcagctcactgcaacctctgcctcccgggttcaagtgattctcctgagtagctgggactacaggcatgtgccaccatgcccagctaatttttgtatttttagtagagacggggtttcaccatgttggccaggatggtctcgatctcttgacctagtgatcca

SEQ ID NO: 47974 - DNA, 601 bp, Human
aaaataatgatatatcctataattggtagaatcttagagtcaatgaaatatagtctgtatacaacacgtagaccataatttaaccattgtcctacctttaaaaatgtttgtttcccatttgtgtttcctttagtttgcttcttttttgttgttgttgtttttgagacagagtcctgctctatcacccaggctggagtgcagtggcacgatctcggctcactgcaacctccacctcccgggttcaagggaacctcctgcctcagcctcctgagtagctgggattacaggcacacaccactayatctggcgaatttttatatttttagtaaagatggggtttcaccatgtcggccaggctgatcttaaactcctgacatcaagtgatccacctgcctcagcctcccaaagtgctgggattacaggcatgagccactgtgcccagccagtttctaattttttacccttacagctaagtttttatttcgttttatttttttgaaacagagtctcactctgtcgcccagggctggagtgcagtgatgtgatctcagctcactacaacctccacctcccaggctcaagcaatcctcccacctcagcc

SEQ ID NO: 47975 - DNA, 601 bp, Human
atgatctatttatatgtttagcataaccatttaattaagtgaagtcacagtctcctaaataacaaaataatgatatatcctataattggtagaatcttagagtcaatgaaatatagtctgtatacaacacgtagaccataatttaaccattgtcctacctttaaaaatgtttgtttcccatttgtgtttcctttagtttgcttcttttttgttgttgttgtttttgagacagagtcctgctctatcacccaggctggagtgcagtggcacgatctcggctcactgcaacctccacctcccrggttcaagggaacctcctgcctcagcctcctgagtagctgggattacaggcacacaccactatatctggcgaatttttatatttttagtaaagatggggtttcaccatgtcggccaggctgatcttaaactcctgacatcaagtgatccacctgcctcagcctcccaaagtgctgggattacaggcatgagccactgtgcccagccagtttctaattttttacccttacagctaagtttttatttcgttttatttttttgaaacagagtctcactctgtcgcccagggctggagtgcagt

SEQ ID NO: 47976 - DNA, 601 bp, Human
tctctactaaaaatacaaaaattagctgggtgtggtggcaggcgcctgtaatcccagctactcgggaggctgaggcaggagaatcgcttgaacgtgggaggtggaggttgcagtgagccaagatcatgccattgcactccagcctgggggacaagaacaagacttcatctcaaaaaataaataaataaacaaataaataaacagcatcattaagtttctccagaataagattatatatatatagattatatatatagattttatatataatatatatacatatatacatatatatctgagcccctatttcctcaccaaaaaaatggggatggtaatactagtacttattccagagttttgtaaataataaataaaataacactaataaagcacttagtgattggtacaggttgaccatcctttatccaaaatacttgggaacagaagtggttcagatttcagattttttcagattttggaatatttgcatcttgggcatgggctgcaagtctaaacacgaaattcatttatatttcatatataccttatacacatagcctgaaggtaattttatacagtatttttaataactttgtgcatg

SEQ ID NO: 47977 - DNA, 601 bp, Human
tttttttaaagagacagggcctcattatgttgcccagactggtctcgaactcttggcctcaagcaattctcccgcctcagcctcgcaaagtgctgggattataggcgtgagccaccgccctggccaagacgggcgatcttaatgcacaagttcttaaccaagaacacgtattagaatcacttgaaaaggcttttttaaaaatgctcatgcctgggtcctactctcaaacaaactctgaattaatccatatgtgttgaggcctggactaatgtaattttaagagcttcccaggatattatawtatgtaccactaattaataattgaccaatagataatatctttatactgtgacagcctgatgcagcatctccatcatagagatttaccagtttgacttctcatctcaagctaatcgcgacactatctcttctgactccatgtacacttcaattatgagttatgatattgttactggttacgttccactcacatttcctaaagaaagacctaacatcttaattgaacttgggaaacaatttagtttcaatagaaacatagttacaaaccattgcttaaaggttatttatacatgtagaaggc

SEQ ID NO: 47978 - DNA, 601 bp, Human
atttgattaaaaatactaggaactctaaaatatttctatcactgggacatatgaggagaaagaagtagctgctggctgctttaggttagctctgcctacaacttggaaagatcatcaaaggaccacaggcccagggtctagtatacagtttttcatcttcagaaacttgaatatgcttaagctctagggaaattattcatattaaccaaattaagagactgaataagtcagaatgaaaatgtattgacctatgagacctgcctatttagaccaatcagtctatgcacgtgcattctgtccyatgaaagaacgtccccagggaaagtcaaaccactaacagaaggtgtctggtgaatattaaatcagagtacagggagatgggtgatcttttctttttttaaagagacagggcctcattatgttgcccagactggtctcgaactcttggcctcaagcaattctcccgcctcagcctcgcaaagtgctgggattataggcgtgagccaccgccctggccaagacgggcgatcttaatgcacaagttcttaaccaagaacacgtattagaatcacttgaaaaggcttttttaaaaatgctcatg

SEQ ID NO: 47979 - DNA, 601 bp, Human
aattttaatttggcttactgtcaaaatacagcaatatttaggtgtagtcatttgattaaaaatactaggaactctaaaatatttctatcactgggacatatgaggagaaagaagtagctgctggctgctttaggttagctctgcctacaacttggaaagatcatcaaaggaccacaggcccagggtctagtatacagtttttcatcttcagaaacttgaatatgcttaagctctagggaaattattcatattaaccaaattaagagactgaataagtcagaatgaaaatgtattgacctawgagacctgcctatttagaccaatcagtctatgcacgtgcattctgtcctatgaaagaacgtccccagggaaagtcaaaccactaacagaaggtgtctggtgaatattaaatcagagtacagggagatgggtgatcttttctttttttaaagagacagggcctcattatgttgcccagactggtctcgaactcttggcctcaagcaattctcccgcctcagcctcgcaaagtgctgggattataggcgtgagccaccgccctggccaagacgggcgatcttaatgcacaagttcttaacca

SEQ ID NO: 47980 - DNA, 601 bp, Human
tgcctcctctcctcttagcctactcaatgtgaagagctttgtgaggatctacttccacttactgaataataaatatattttctcttcttcattcttttcttaataacattttctttttatagcttactttagtgtaaaaatacagtatataatatacaaaatatgtgtgaactgacttaatgctactggtaaggcttctggtcaacagtaggctattcgtagttcagttttgggggagtcaaaagtcatacaagttataaagggattttcaacagcacacacaggggtcagcccccctaaycccagggttgtttaagatcgaatgacttttttttatacttcacaaatgttttcctgtgtgttgcaccccctctttagtaatactagaaacactttaagggcagtgaatcctatgtgaaatgtataaaaatgctgggcacagagtactaattttaatttggcttactgtcaaaatacagcaatatttaggtgtagtcatttgattaaaaatactaggaactctaaaatatttctatcactgggacatatgaggagaaagaagtagctgctggctgctttaggttagctctgcctacaactt

SEQ ID NO: 47981 - DNA, 601 bp, Human
gtaaatctttataggtcatgatttgatcatttttttaaaaagtaacatgccttctactgagttagttacagagcagttctaacgcagtctcatgcctgctaccttcaccctgcaagtgtagtattaatatttcccacatgtaactacaggaagtaggagcagacaaagaaaggagagagaaataaagggcaaatggtgatacaaaatccatcctctccaaaaccctaacattttgcatctttgatacatctttttctcttttcctctctccttccctccctgttagtattctctactgaaytgtgggcttcatacaacacctttacatccaaaaacaagcactatcgtttacttaatcttaccagtttcttctgtaagaaggaagaatttcaccaataaattaacagagaaatttattcttacttacaacaatactttttatttcaccaatagttgtagaataaatttattccaaggtgattatcagcacctctgaaattccccctccaaaactgcctagctgatatgtgaacatataactagagatcagagatattcatgactacatcactttttgggttaaattcctaggattggcagg

SEQ ID NO: 47982 - DNA, 601 bp, Human
gaaaaactatatgattccatttatatgaggtatctggaatagtcagagtcagagagtagaagggtagtccaggtgttaagggaggggaaaataaggagttggtgtttaatagatatagtatttcagttttgtttgcaagatgcaaagagttctgaacattggttgcaccaggatgtgaatgtacttaacactacagaattatacataaaaaaatggttaaaatggtaactctatgttatgtctatattaccacaatttttttttaaagaaaaggcgatctcttcagataatgtgaagcaamagaacaaagacccagcctgtgccacttatgaaagtgtagcttctccttcaatgcaacatggcagggtttaggtttcttaaggacccacaaggagtcaaatgaccatcacacctataatcccaacactttgggagactgaggtacgcagattgcttgaactcaggagttaagagaccagcctgggcaacatggtgaaacaccgtctctacaaaaatacaaaaattagcagggcttgatagcacattcctgtaatcccagctacatgggaagctgaagtgggaggatcacttgggcctggga

SEQ ID NO: 47983 - DNA, 601 bp, Human
ataactttcactacagtatactgttatgattgttctattattggttattgttgttaatctcttactgtgcctaatttataactttatcactggtatgaatatacatgaaaaaacaaaatccatatagggcttggtagtatctgtggtttcaggcatccattcctggtcttggaaggtattcccaaggataagatggggattcccaaggataagatagccaaaaagcacattaaaaggtgctcgatatcactaatcattagagaaatgcaaatcaaaactacaatgatatcccacctcccayccactaggatgactattatcaaaaaaatagaaagtaacaaagttggtaaggagatagagcaatttgaaccctgtgcactgttggtggaaatgaaaatggtgcagtcctctatgaaaaacagtatggcagtacttcaaaatattaaaaatagaattaccatatgatgcaacaattccacttctggatttatatccaaaagaatttaatgggtgcagcaaaccaacatggcacatgtatacatatgtaacaaacctgcacattgtgcacatgtaccctagaacttagaatataataaaaata

SEQ ID NO: 47984 - DNA, 601 bp, Human
tcaaaaaaaaaaaaaaaaaaaaaagccccaagatgacagctatgtagcaagattagagatcagttcaaattgtagcaggaagacagaggactcacagaggaaagacaaagaaaatacagaggcacctagagaccacagtggtaccccattatctgcagatctgctttccactgtttcagttacctgcggtcaacctcggttcaaaaatattacacacagtaaggtattttgagaaagaaagagagaatgcacattcacataactttcactacagtatactgttatgattgttctattattrgttattgttgttaatctcttactgtgcctaatttataactttatcactggtatgaatatacatgaaaaaacaaaatccatatagggcttggtagtatctgtggtttcaggcatccattcctggtcttggaaggtattcccaaggataagatggggattcccaaggataagatagccaaaaagcacattaaaaggtgctcgatatcactaatcattagagaaatgcaaatcaaaactacaatgatatcccacctcccatccactaggatgactattatcaaaaaaatagaaagtaacaaag

SEQ ID NO: 47985 - DNA, 601 bp, Human
atcttgctaaggtacctgagaaggaaggaatttagactggaactattacaacattggtacgtagaacccaggccctgctcccatgtgatcagttgacttttctttcccaaataaagtatttattatctggagaaaataaaccaaagaaacttagaccagggaactgactgtagaaggcaggagagccaatgtagtggcttatgcctgtagcccctgctactcaggaggctgaaacaggaagataacttgaatccaagagtttcagtccagcctggacaatagagcaaggccctgtcttttaaaaaaaaaatgtgttaatgaaagtctagatactgaataagatccctctacccttttcctgccaactactagaataccagcagccaggcaccccatatgccagcccaaggaagatactactaaaggattcatctatggaaagacttaaatgattccacagaaaagatccacagatagggagtccccaaatttaaaagctagcttgctgcctgattacccaatgatgattattagtcaacgagccctgcctatccatacagtgttcaattaatgttttactgcttcactcttaactgtggac

SEQ ID NO: 47986 - DNA, 601 bp, Human
tagaccataccccaagtctctataattaccaaagaatccatatcatgtagttctatttctgactacagagcattagccagagttcagtaacaaaaactaaaatacattttaaaacatacttttaaataactcatgagacaaagaagaaatcataatgaaaaaacaaaatatttagaactgaataatgaaagactgtatatcaaaattatgggcagcttagaggaaaatgtatagtcttaaatatccacttctttgaaaagaagactgaaaaatcattaagctaagtattaaacttaaataytggaaaaagaacattagagtaaatacaaggaaaaaggagaaaagaagagaaattattaaaacaggaaaaaatttaatagggaggataaagtgttaattaatatttttaattaccaaaatggctatgaagaaaatctgaaaacatttctatgaagtttaaattctacccactaaaaaataaaaatatatacatattttaactaccacaaatattatatattgttataattatatattgtgcatgattatatttattatatttagttattagttatatatttatatatgacatataactaat

SEQ ID NO: 47987 - DNA, 601 bp, Human
tagagtaaaagcaaagaataatgcaaaagaagttaagtaatgcacagtgaagcaagtattcaagggctggattatgcaaaacatgaatggcagaggccagccgttattcaccaaatccatttctctttcctccagggcacttagtcacctttcccagcctcccttacggttagatattgccactgagtctggcctatggaatgcagctatgtcacttccaggtctgaactataaacatccttcaaactgaacaattttctactttatctcttctctcactgctggctggcagatgcagggkatcccagcagaggactctaaggtccaaatggatggaagagctccaagtgaaagaaccctggatcacgaaattaccttatgaaaggctgtccactaaatgcccacaatgacctgttacacaaatgagaaacatatttctattgtgttagaccattgtgcttttttagtttcttgttacagcaattagactgccctgactaacttatcaatttagagattttagtatctatcctaagagcaataggaagctattggaggttttatttttttaaccttttaattatgggaaatttcaaataaa

SEQ ID NO: 47988 - DNA, 601 bp, Human
ggaaaaaagataaagcattccatgataagcacattaaaaagctatgaaaaggaagggacactggcatagtcgagcaattgatacgagcctatgcaattaaagcctatagagtaaaagcaaagaataatgcaaaagaagttaagtaatgcacagtgaagcaagtattcaagggctggattatgcaaaacatgaatggcagaggccagccgttattcaccaaatccatttctctttcctccagggcacttagtcacctttcccagcctcccttacggttagatattgccactgagtctggcctatggaatgcagctatgtcacttccaggtctgaactataaacatccttcaaactgaacaattttctactttatctcttctctcactgctggctggcagatgcaggggatcccagcagaggactctaaggtccaaatggatggaagagctccaagtgaaagaaccctggatcacgaaattaccttatgaaaggctgtccactaaatgcccacaatgacctgttacacaaatgagaaacatatttctattgtgttagaccattgtgcttttttagtttcttgttacagcaattagactgccct

SEQ ID NO: 47989 - DNA, 601 bp, Human
atgttctattaagatctgaaagatgagaaaagaactagatggggaaaaaagataaagcattccatgataagcacattaaaaagctatgaaaaggaagggacactggcatagtcgagcaattgatacgagcctatgcaattaaagcctatagagtaaaagcaaagaataatgcaaaagaagttaagtaatgcacagtgaagcaagtattcaagggctggattatgcaaaacatgaatggcagaggccagccgttattcaccaaatccatttctctttcctccagggcacttagtcacctttyccagcctcccttacggttagatattgccactgagtctggcctatggaatgcagctatgtcacttccaggtctgaactataaacatccttcaaactgaacaattttctactttatctcttctctcactgctggctggcagatgcaggggatcccagcagaggactctaaggtccaaatggatggaagagctccaagtgaaagaaccctggatcacgaaattaccttatgaaaggctgtccactaaatgcccacaatgacctgttacacaaatgagaaacatatttctattgtgttagacca

SEQ ID NO: 47990 - DNA, 601 bp, Human
tcaacttaagaacagattgccttggtgcctactgagaaatctttcccaggccccaggacaactgagtgatgtgccatcacctatctttcacagaaacttttattgcttgtgatagttctgaaaactgtagagacatatccagctatattcttgtggagggctatttaagtggcgttttgctcttagagtacagcttgctgagttggggaaacttataaggcctcagaaaggacataaataagcttacatctgagggtctgtatacctggctctgtgaacatgtgctactgtatttcttaaygaaagctactatcttaactgtcttgatgcaattagcctaattttaaaactaaggcacggagaggttaagtaacttgcaaatggtacacagatagtgggtcgcagagatgggattgcagctgaagtctgtctgattctaaagtctgtcggtaacttcttaagtctttaaatgcagtattccaatatccttgtacccccaatagtttttctacttgggccatattgctactttgggattctgggactaagtgtattttggaacttttttttgtccccatcatgcttgattttgcttttaaca

SEQ ID NO: 47991 - DNA, 601 bp, Human
tctggtatctggcacattttgagcaacctacaaatgtctactacccaactttcctcattacagtaactttctgttgtcgtagccttacatttttggttctgcttaatactctcttaattaactatatataggttccctaattcccaaacaattataaaataaatttaataggcacacttttgccataggccaagtgattattgtcacagaattttctcccaggtagctctgcaatcctagagtgggaggggagaaagcatacgatgagagcgatccaggactgaagataaaagacaacaaagtaagactgacactaatatgctaacatgatttaatgtacatttgagatttacaaacagcacagttaagaaaatgtcctcaaaagatcttcttactttcataaactacctgaacaagtcccttaatctctaggagcctcagtttcaacatctgtaaactgaaggtgctcgcaagataaaccttcaagctctaaaatatatatatctgttcccctgatggctcagaaggcttttcagaaaattataattacagcatcttctttgcaaacatccattaacaatgtagtgataagatagttaat

SEQ ID NO: 47992 - DNA, 601 bp, Human
gaaaaaaaaaaaaaaaagacaggcttttcaggctctcacttaagcatgtgttttattatgtgatcaccattctaagtttggttatctggtttccacatttgcaaataactgggatgtgtaaaagggtggcacactgatagagaaggggtaaaccgctgacataaagatgaggcagaaaatcctatcaagcataggcaaaactcagaaaatttcatctaacctagacaatgtgcatcaagcataacacttggcactgttttgtggggggttaaacactgtctcctattttttaactccagasagcatcgctgtctataaagaggtttaataacctctttatacaggtacacagcatatctacaatcactattgccatcctgtgaaagttagcaaggcagaataactgtttctacttttaagacaaagagagtgaaactctggcagactgtaaatggaagagcactgattcacaatcaggcattgacattctcgatgctctgtgtttttgatagatggcctcataaaatataatatattaattgctcataatataaacccaagtcacaaagctaaagataaaatacattcagcacagggccag

SEQ ID NO: 47993 - DNA, 601 bp, Human
aattggtatgcaagggatgtttcctccccctgaatacattatgaacttgcagcatgctaatatgccatgctatcataagcaccagatggggcagtaggcagtacatgtcccatcaaacctcaagaagatgtattaatgttcatgctctttaaaaaaaaaaaaaaatcctttgcctgtgtccctagacttccacatttcttagcattcagtcactttctctcaaagcacagtcctccagggctgctcctcttcaccagatggtgccaggaatcatttcaatctattttatcacaggaggcaraggccacaaagcgtgtcagactacacttactgaaggcctaccaagcacaaaagagaacaacagaagatatgggagacatcagaaataaatcttctcaaggcattaccaatgaaacattttttaattacattgaatgcttatttatgttgaacagagaaaaataaaagaaaatctttgtatatccaaacttccaagactaactgatattactgtgaaattgaagtctacctaaatattctactcatttgtttacaagtaactatcagaacaaaccaacaaaccagaattcaagtcgaaaag

SEQ ID NO: 47994 - DNA, 601 bp, Human
actctaggtgccatggagacacaaacataattaggtaccagcccaaccctcgaaaagtgttcaatctataggaggacaaccatacaaatgattccacaaggcaaaatgttttaagtgccgtacgtgaaataacaaagtagtacatggtttcaaataagaaaaaaaatttaaaaattatataccaacataatattaaaaactacttaatttcatcacaaaaaagagaggaagataaattaatggagagaatacatacacatacattctctcttgcacatgctctctctctctcacatacacmcactctctctctcacacacacacacacactctctctctctctctctctcactctctctctctctctctcaagttattcctcagagcggaaatgctcagttcagacgcggcttggaagatataaacatcattgaaattcaaaagcagttctgaaagagaggatgcctcaattggtatgcaagggatgtttcctccccctgaatacattatgaacttgcagcatgctaatatgccatgctatcataagcaccagatggggcagtaggcagtacatgtcccatcaaacctcaagaagatgtat

SEQ ID NO: 47995 - DNA, 601 bp, Human
atcatggtaatatttgaagtgttttattaagaagataacagtaccagaaacagatttccaactggacactgccaactgtttaaatgttccttgaaactatcccaaaagttttattatgatccctatgtcagtgatagatcaggtacctattaaaaactgagcactgtgctgggtctcctaacaaattatctcatttaattttcacaataatgccatggccttaaggtattaattttccctttcaacggatgagaaacatacgctaaataactggttaaataactgctcaaaatcaaacatmaagcaaatggccaggccagaatccaacagacattttactgatcttaaaactcatgctaattccaattaaacatggtgcgtcaatggatttaaaggctcatctcattctttccagggttagttagtgactactaagtgcaagacacacaacagctcaagttatccttttaaagggggcaatttagatcatgtcacttcctagcttaaccctctgatggcttccagacatgcttagaataaatccccaacttctagcaatggactggcccctgaacttggctcaagctaccctgacctttga

SEQ ID NO: 47996 - DNA, 601 bp, Human
gagacaagagaggagaaatctagcagtgtagtttgcaatattatagcgcctaagccaaacaaattaaaatgaggaggtatggtggctacgtcacatgcgactctgtatcatgcaggtctcttctggaggcctgtggcccagcacacctagcacagattagcaaaatgtacctatctcacctgatcagctggtttttctttccctctctttctagtggaacacaaatactacctaagtctctgtatttgcggcatcctgcagaagagaatgaaaatacatataaggtgtggacagacaatayctgtgatggcctacaaagtttcacaaaggctgtttctcagcaaggcaactatctttttcgaattaccctcaaacctcacaagcctatcactcttctaagatggtgttaagaattcaattggggcttacctaaagaaaatgatacatcttaggatgtaaagtcagatgccttattctgaactgtgatgcccacctcccaatcttctgtggcctttttctgtggctttccctctttttctgacattccagcaagaatacagcagccataaatgtgacttctctcacagaacatgcagatgtt

SEQ ID NO: 47997 - DNA, 601 bp, Human
aaaataaaggccacattggccaagtaactgaaattgaaaataattacaaattgggtattatacaagataatggtcattgtccttaagagacaagagaggagaaatctagcagtgtagtttgcaatattatagcgcctaagccaaacaaattaaaatgaggaggtatggtggctacgtcacatgcgactctgtatcatgcaggtctcttctggaggcctgtggcccagcacacctagcacagattagcaaaatgtacctatctcacctgatcagctggtttttctttccctctctttctagyggaacacaaatactacctaagtctctgtatttgcggcatcctgcagaagagaatgaaaatacatataaggtgtggacagacaatatctgtgatggcctacaaagtttcacaaaggctgtttctcagcaaggcaactatctttttcgaattaccctcaaacctcacaagcctatcactcttctaagatggtgttaagaattcaattggggcttacctaaagaaaatgatacatcttaggatgtaaagtcagatgccttattctgaactgtgatgcccacctcccaatcttctgtggccttt

SEQ ID NO: 47998 - DNA, 601 bp, Human
ggattttaattcctaaaaatattacaactggcggggtatggtggctcatacctgtaatctcaacactttgagaacccaaggcaggaggactgcttgagcccaggagttcaagaccagcctggacaacacagtgagaccccatctctctttttaaaaaatttttaaatatatagtacaacatctgttttaaagtttattgtgggaggaagaaagggaggggtggggaaaagtaagaagatagaaagacagacagaaccatatatttgacactcaacctggtctttggagggtgagatgatgktcattttacttaagtacattgtatctcgtatatcctttaatatcctaagaaagcaagttttgtgagggtgacaaagagctctttctattattggaatctgaaaaacatgtgagagaaatggtcaaaataaaggccacattggccaagtaactgaaattgaaaataattacaaattgggtattatacaagataatggtcattgtccttaagagacaagagaggagaaatctagcagtgtagtttgcaatattatagcgcctaagccaaacaaattaaaatgaggaggtatggtggctacgt

SEQ ID NO: 47999 - DNA, 601 bp, Human
aaaagtataacttgtgtatgctcaatatctgctgttatcaaaatgttgtcaaacgtttagctcaccaaatgaactaattcaaatgatccattttcaataaacaattaactttaaatgtaaacatttacaactgatagactgcttaaatgaacattcaatacacttgttttagacgtttaaggacttctagtttcctcaaaatataaatgaggtgtcagtaaataacatataggccctatttcctttcaattttatcaaggaaaaagtgtgtcagatcattattaaaccctgtgtatgcaaygtgatttgacaatgaccaaagcttgttacggattttaattcctaaaaatattacaactggcggggtatggtggctcatacctgtaatctcaacactttgagaacccaaggcaggaggactgcttgagcccaggagttcaagaccagcctggacaacacagtgagaccccatctctctttttaaaaaatttttaaatatatagtacaacatctgttttaaagtttattgtgggaggaagaaagggaggggtggggaaaagtaagaagatagaaagacagacagaaccatatatttgacact

SEQ ID NO: 48000 - DNA, 601 bp, Human
tgtaccaccatgtcccaccaatttctttatttttagtagagacagggtttcaccattttggccaggctggtctcaaacttctaggctcaagcaatccgcctgcctcagcctcccaaagtgctggaactacaggtgtgagccacagtgcctggccaagatttttaatattactgcagcctgactgttagtttaccttcagcaaatgcctgttttgggtatcttatatctaaaatgagtttaaaagcactaaaacatagcagtcaaaaccaagaaagacttaacatgcagccttgactagcaytacatagaacagtgtttaggttaaagaatgcagctgccatacaacaacaaataaaacagaaaacacaaattggattggatgacagtaaatatctggaggcatggaataataaatgacgggagtaaccatgaggcccagtgaggtcttcagaatgatatgatgtttaagcatctgattttatgacattatgcagggaagaataagaatatactcaaccaagcgctgggcagcgggtatgtgggatggatgttaaatggattggacagggaagtcctgacaatggccttcaagaaccctcca

SEQ ID NO: 48001 - DNA, 601 bp, Human
ctatccatcacataaatgtacaattttttccactttagtttatatctcaggactcaattcctcacccaaactaccatgatacattcccaactgtaggcaagatggatcctactattgtaagagtctccaattcaacctatcagtgagattattctttctgcaaaacgagttcttcctgctttcttatttccactgaggcaagaccactctgccaattacgcaggctcaaaattcaaacagtacccttgattccactctcaccttttctcccaaataatgacactcattcaatgaatttcartcatggacttcaactcaatgctttcaaaatcctctcatgttgatttggaacctgcgctacctcttgtaatttctccctaatcagtctccacttttctgcctctcaatccttcaatctccttctatatcccctactacacttaagttccttaagtgccaggactgtgtcttcctctctttaaaacccctgctacgcttagtagaaagtcgttcccagaatcagtactcaaatatttttatattgaattgaatcctgtttattgtgcagccactaaaactcaaaagttatactttgagagga

SEQ ID NO: 48002 - DNA, 601 bp, Human
accaggtgcaggggcctaagcctgtaatcctagcactttgggtggccaaggtgggaggattgcttgaagccaagagttcgagaccagcctgggcaatatagtgagacactggctctacaaaaaaaaaaaaaaagatatcgatatatatattatacatatattttattttccatatggaaaataaaagtatagaacacaaataggaaggatataaaagttaattaccaagtgggaatttatgcaccgccaaaataaaccataatataattgcaatggaatttcaaagcttcgataatgagaytaaggataacacccatttagtattttccattttctcaaaattgtctatccatcacataaatgtacaattttttccactttagtttatatctcaggactcaattcctcacccaaactaccatgatacattcccaactgtaggcaagatggatcctactattgtaagagtctccaattcaacctatcagtgagattattctttctgcaaaacgagttcttcctgctttcttatttccactgaggcaagaccactctgccaattacgcaggctcaaaattcaaacagtacccttgattccact

SEQ ID NO: 48003 - DNA, 601 bp, Human
ctgcctttcaccaaccacttattgaggaccaacatgtatggttttccattatttcatttaatcctcaagagaatcaggtgagaaaattcaggcacaaaaagcaagtaaaaggagggaagatgagaaaatcatacctagttttgtttgactgcaaagtccaacttcttaaccactatattaccctccacctggaaaccatgttgattcaagcaaggatactcaggagtcaattaattccactatgaggaagctatgcacaagtaacagaaagtaataaaatagaccaggtgcaggggcctamgcctgtaatcctagcactttgggtggccaaggtgggaggattgcttgaagccaagagttcgagaccagcctgggcaatatagtgagacactggctctacaaaaaaaaaaaaaaagatatcgatatatatattatacatatattttattttccatatggaaaataaaagtatagaacacaaataggaaggatataaaagttaattaccaagtgggaatttatgcaccgccaaaataaaccataatataattgcaatggaatttcaaagcttcgataatgagactaaggataacacccattt

SEQ ID NO: 48004 - DNA, 601 bp, Human
atgtgacttctgcaagttctcacagaaaggtaggtgtgaaaaagtcaattccagacttggaggtgcatctatggtaaaaaatgagtgaagaagaccaagagggtataagtctgttgtgtctcaatcagtctatccaagagatggcaaaaagagcacagagcaccatgaagaggtgggctgagcaaccactaaactcatgttccattgcgggactctattctacttcacatctccatgcctgcaatatgcagaagcatggataaacctaatgagttttggaataaatattattactgtcatyctcatcaccactactgcctttcaccaaccacttattgaggaccaacatgtatggttttccattatttcatttaatcctcaagagaatcaggtgagaaaattcaggcacaaaaagcaagtaaaaggagggaagatgagaaaatcatacctagttttgtttgactgcaaagtccaacttcttaaccactatattaccctccacctggaaaccatgttgattcaagcaaggatactcaggagtcaattaattccactatgaggaagctatgcacaagtaacagaaagtaataaaatagaccag

SEQ ID NO: 48005 - DNA, 601 bp, Human
tatactattcgactaacacctcccaccaataacccaccatcaaatacatgactaaaggccagcaggatttcacaaaggcctgggctttgtttggcttacttgctacttggcacatagtagatactcagtaaatatttgatggttgattggctggctgaatgaaaaactgtttaaaactttgggtatggctgggcactgtggctcacgcctgtaatcccaacaatttgggaggctgaggtgggcagatcacttgaggccaggagttcaagatcagcctggccaaagtggtgaaaccccatcyctactaaaaatgcaaaaaattagctgggcgtggtggcatgcgcctgtaaccccagctactcgggagactgaggcagaagaatcacttgaacccaggcagcagaggttgtagtaagccgagatcacgcaaatgcactccagcctgggtgacagagcaatactttgtcccaaataacaaaacaaaacaaaacaaaaacctttgggcttatttattttatttttttaagctaaaaaatgaaggggtgggtttttttttttttttaattgagatagtctctctctgttgtccaggctggaatgc

SEQ ID NO: 48006 - DNA, 601 bp, Human
atttaccaagtgccagttatcttgctaagtgctttacatgagttaactcatttaattttcactataagacaatgcaatagatcttattcatattaccattttcaggtgaaaaaactgagctttaaaaagaataaataatttgtccattgtcccacagcaaatgaacagcatgcaaagccaaggggcatgatttcacggcccatgctccgggtttaactactatactattcgactaacacctcccaccaataacccaccatcaaatacatgactaaaggccagcaggatttcacaaaggcckgggctttgtttggcttacttgctacttggcacatagtagatactcagtaaatatttgatggttgattggctggctgaatgaaaaactgtttaaaactttgggtatggctgggcactgtggctcacgcctgtaatcccaacaatttgggaggctgaggtgggcagatcacttgaggccaggagttcaagatcagcctggccaaagtggtgaaaccccatccctactaaaaatgcaaaaaattagctgggcgtggtggcatgcgcctgtaaccccagctactcgggagactgaggcagaaga

SEQ ID NO: 48007 - DNA, 601 bp, Human
tggcaaactgctgttaagtcaaagaacaccaggatttagggcatcaaataagttatcaagttttaaaaaaacaaaaaaggtgaaaaggaaaacagtgttgctgcaccagaaccttccctgaaccaactgggagttaggtctggctctactgtgctttcaaagccctccatttcttccccatcatacaactcacatcttattgtaaaaatctttgtacatgccttcctcgtcagggtgaaatacaattactgctagaaatatttataatgtaattttttttagcctgtgtaatggcatgtgyctacagtcacagctatttaagaggctggggcaggaggatcacttgtgcccaggtgttaaaagctgcagtgagatatgatcaaaaaaaataaaataatataaatttttttttcaaatacgaggtcttactctgttgcccaggctagtctcaaattcctgggttcaaacaatcctcccacttcagcctcccaaagtgctgggattacaagcattagccactgcacccaggctatttctaattatcttaatagcagttaatactcaccgagcatttaccaagtgccagttatcttgctaagtg

SEQ ID NO: 48008 - DNA, 601 bp, Human
caattcataccaggtcatggtcttccctgattttgaaatgtaccttgactacaacaagcttatgatctttcaagacacagaacaagtgccacctctcccatgaaggcttcccaaattacccctgccccatattcagagcaaagagttgatcattaccttctttgggctctattttacatacatttattagcaaacttagcatcacttattacaactattatatttgcaggtgtgtgtcccgtgtgtatactatatacacatacacacggacacacatgttccttaaaaggccgagtctacrtcctattgattattccatccccagcattctgcacaatgcttagcacacagctaattctgaataaatacactgtggcaaactgctgttaagtcaaagaacaccaggatttagggcatcaaataagttatcaagttttaaaaaaacaaaaaaggtgaaaaggaaaacagtgttgctgcaccagaaccttccctgaaccaactgggagttaggtctggctctactgtgctttcaaagccctccatttcttccccatcatacaactcacatcttattgtaaaaatctttgtacatgccttcctc

SEQ ID NO: 48009 - DNA, 601 bp, Human
ctacttaatatagcaaagtaaggtcatgggtcctacatctctgcaaactctgccctcgaaactcctctgtatctgcacctatgcctctaggctcagaagaggcacccttctgcctctaggggcttcactctcccagaaattactctctctcttatcttcaacttgtttggccctaaccactccttctcaaaacctaggcttgctggagtctctctcatccagaaaaattaacacccctcccctttattgtagactatactggcacatcctccattctcccactgcctggcttcttaagggyagacctcaggggctccatccactttgcaatccaccacaaaaaagttccaacaaaaggacaaagttacctgctactttccttccaggtggccaaatccaaaaggcaatttttgttgttgttttttttttttttttgagacagagtctcacttaggctgaagggcagtgatgaggtttcactatgttgcccaggctggtctcgaactcctgagctcaagtgatccaaccgccttggtctccccaagtgctgggatcataggcatgagccaccacgcctggcccaaaaggctatcttgacccc

SEQ ID NO: 48010 - DNA, 601 bp, Human
ctaggctcaatgtcctgagcttcagatttgtcccaaatgtctacttctgggactgaagttccaatagtcatttcaactaattcatataatggtgatgggctaatgatggcaacttcatatacatacctacaccctcatcgcctcatgaaataaaaattgatgattttcaactgggttgggagaatgggctactgaatcagaattacctgagaaattctgaaataaactttctcatcaatgtgtaaatttataaccccgtgtcctgtggatgaccaatgccttgagaagccacagatgctgwtgttgagaaggagggagggcagaaacatcatccaactaagtgaaagaaatgttcaggtgccttgttcttccctctgcccataaatacatagtaggtattcagtaacagctgcatttccagtcaatatttttttaaaaatacataaacaagtccttctcatcaggtgcggtgactcatgcctgtaatcccagcactttgggaggctgaggcaggcagatcacttgaggccaggagttcaagaccagcctggccaacatggcgaaaccctgtctctacagaaaaatgcaaaaatgagccagg

SEQ ID NO: 48011 - DNA, 601 bp, Human
tctaaatacataaaaaaaaattttaaaggcgattttctcttggcttaatatggtcaatataaagggagatcaactccatatattttatacggttgtttcaatttcatatttatcatttcttaatagagtttctacatcagtgaatactttgcataatacaacttttcatggaaacccatgaccttacttaataaagtaattcagagaagttaccctaaataattaattgctaataaatattccctaaggacagaaaatcaagattgccttagcaggaaatatctgcatatatatatatattttcaaaagcatctaagtaagtctactttcaccttccatatttccagacaatgtaaaagcaagcataccttttaataccaggaaaaccactggggaacctagaaccataaaattctggctagttacaatttgaatgacacatttttacaattcagacaccaccttaagttccagggaagtgtctcaagtgaacacatacataaatttaatgttagtaagttcttaatgtagcctcatttctatttatactgtaaatatgggtatatatgttattaaattaagatgacagtctaaattccca

SEQ ID NO: 48012 - DNA, 601 bp, Human
aaaaaaaaaaaataagagtgggataataggtatcccactggagactccaaaaagtgggagggtgggagggaggtgagagttgaaaaattaccttttaggtataatgatcacatttggtacactaaaagcctcggctttaccaccacacaatatatgcatgtaagaaatgcatctgcacttgtacactctaaatacataaaaaaaaattttaaaggcgattttctcttggcttaatatggtcaatataaagggagatcaactccatatattttatacggttgtttcaatttcatatttatcrtttcttaatagagtttctacatcagtgaatactttgcataatacaacttttcatggaaacccatgaccttacttaataaagtaattcagagaagttaccctaaataattaattgctaataaatattccctaaggacagaaaatcaagattgccttagcaggaaatatctgcatatatatatatatattcaaaagcatctaagtaagtctactttcaccttccatatttccagacaatgtaaaagcaagcataccttttaataccaggaaaaccactggggaacctagaaccataaaattc

SEQ ID NO: 48013 - DNA, 601 bp, Human
tgttgtgtatatttacttggaaagatctttaaaatatactactaccacatggggggaagttacaaagcagtatgttttacaagatcctgttttttaagaaaactattttaagacaattagatggatgtgtatgtgtttgtaaaaagactagaagggtacgtataataatgatctctattagaatactgagtagctatttcttaagttcgtgattcagaatggggcagaactttcaaatatatcgtcaggccaggcacagtggctcatgcctgtaatctcggcactttcggacggtgaggcrggctgatcacttgagcccaggagttcaagaccagcctggccaacatggcaaaaccctgtctcagcctcccaagtagctgggactacagatgtgaaccaccatgcccagctaaatacaaaaattaaaattttttggctgggtgcggtggctcacgcctataatccgagaactttgggaggctgaagcgggcggatcatgaggttaggagttcaagaccagcctggccaatatggtgaaaccccgtctccactaaaaatacaaaaattagccgggtgtggtggcatgctcctgtagtcccag

SEQ ID NO: 48014 - DNA, 601 bp, Human
ctattcaacaataggcatttggcaattcaaattctaatacatccacagtggaatacaatgttgtgtatatttacttggaaagatctttaaaatatactactaccacatggggggaagttacaaagcagtatgttttacaagatcctgttttttaagaaaactattttaagacaattagatggatgtgtatgtgtttgtaaaaagactagaagggtacgtataataatgatctctattagaatactgagtagctatttcttaagttcgtgattcagaatggggcagaactttcaaatatatygtcaggccaggcacagtggctcatgcctgtaatctcggcactttcggacggtgaggcgggctgatcacttgagcccaggagttcaagaccagcctggccaacatggcaaaaccctgtctcagcctcccaagtagctgggactacagatgtgaaccaccatgcccagctaaatacaaaaattaaaattttttggctgggtgcggtggctcacgcctataatccgagaactttgggaggctgaagcgggcggatcatgaggttaggagttcaagaccagcctggccaatatggtgaaacccc

SEQ ID NO: 48015 - DNA, 601 bp, Human
gtggcgggcgcctgtagtccaagctactcaggaggttgaggcaggagaatggcgtaaacccgtgaggtggagcttgcagttagccaagatcgtgccactgcactccagcctgggcaagagagcgagacccagtctcaaaaacaaacaaacggccgggcgcggtggctcacgcctgtaatcccagcactttgggaggccgagacgggcggatcacgaggtcaggagatcgagaccatcctggctgacacggtgaaaccctgtctctactaaaaatacaaaaattagccgggcatggtggcgygcgcctgtagtcccagctactcgggaggctgaggcaggagaatggcgtgaacccgggaggcggagcttgcagtgagtcgagatcgcgccactgcgctccagcctgggcgacagagcgaaactccgtctcaaaaaaaaaaaaaaaaaaagaaaaacaaacaaacaaaaaaagcatcttccaatacagtagccactagccacatgtgactatttaaattttaattaagattaaataaaatttaaaatttcgtttctcagtcacactagctgcatactcaaatttacatgtgcctgatggtta

SEQ ID NO: 48016 - DNA, 601 bp, Human
gcttaggcattgtgccaaatgttgggcatggtttatctcactttaaacctctctatgaaaaggtactataaatttgcccactttataaaaaaggaactgaggctcagagggattgaaaaatttgcccaaggttttaagtcaggtcttaatccatgccttctcaaagttcattatcctctaaaactactgtcattttattcatgatctggaaaactgggatatgaactgcactcagtaaacgttaaatctgtagctagcattacattaaaactgcatcttccggctgggcacagtggctcaygcctgtaatcccagtactttgggaggctgaggcaggcggatcacgaggtcaggagattgagaccatcctggctaacacagtgaaaccccgtctctacgaaaaatatgaaaaaattagcctggcctggtggcgggcgcctgtagtccaagctactcaggaggttgaggcaggagaatggcgtaaacccgtgaggtggagcttgcagttagccaagatcgtgccactgcactccagcctgggcaagagagcgagacccagtctcaaaaacaaacaaacggccgggcgcggtggctcacgcct

SEQ ID NO: 48017 - DNA, 601 bp, Human
acattttacaagccaaagaaatgccccaataaacaacaacaacaacaaaaccctattaggataaatcagctacaatcaggcttaggcattgtgccaaatgttgggcatggtttatctcactttaaacctctctatgaaaaggtactataaatttgcccactttataaaaaaggaactgaggctcagagggattgaaaaatttgcccaaggttttaagtcaggtcttaatccatgccttctcaaagttcattatcctctaaaactactgtcattttattcatgatctggaaaactgggataygaactgcactcagtaaacgttaaatctgtagctagcattacattaaaactgcatcttccggctgggcacagtggctcatgcctgtaatcccagtactttgggaggctgaggcaggcggatcacgaggtcaggagattgagaccatcctggctaacacagtgaaaccccgtctctacgaaaaatatgaaaaaattagcctggcctggtggcgggcgcctgtagtccaagctactcaggaggttgaggcaggagaatggcgtaaacccgtgaggtggagcttgcagttagccaagatcgtgc

SEQ ID NO: 48018 - DNA, 601 bp, Human
ccaaatgcccatggtcactctggctttcatactcactgcatccctttccttgaatactcttcaccccatcaccgcctaattaagtccatcattcctttaaaacttccttcaggtgtcacttcagccagaaaccttttgctgacaacctttctatccccagctggccgggtttgtcccaagttctcatattagactgtctagatccctcctgcagcactgatcacacagtatttagaccacaatttacttaagagcaatgatgacattttatttgtttttatagtcccagcacttagcagtrtctgacacacagctttaactcaagatgaaatcatctatgtatctcttttttcctctcatcatccaaaaagaattccaaaagaatttttatattctggaaaaattaatcactaaagataaatctagaaaaatactactggattattcaattcaccagttttctaacaactctcagtaaccacatatttcctgagactttttagtatatgatattagaaaaaaagtttgtaaggcaatttatacacatatgatctatggcctctaaaaactgttttacaatagtagtgtcagtgtagtcata

SEQ ID NO: 48019 - DNA, 601 bp, Human
cctacaatttgggtcttccaaaccttctacagattcctagtcaaacaatccctactttgcctaaaaccgagattgagctgattttcaccaaaaccaagaaatgctgataaaataaccctggcatgcaaggtggagtgcggtagctcacgcctgtaattccagcattttgtgaggttgaggtgggtggaccacttgagtactggagttcaagaccaccctggccaacatggtaaagccctgtctctacaaaaaatacaaaaattagccaggcatggtggcacatgcctgtagttcctgctaygcaggaggttgaggcaggaaaatctcttgagcctgggaggcagaggctgcagtgagccaagatcctgccactggggtaacagagtgaaaccccaactcaaaaaaaaaaaaaaaaaaaaaaaaaaagcaaccctggcatgtagcatcaagatatcctcctaaactccactgaaattcttctcaattgtctctttattcttaatccaagaaacatgtacactactttatctgacatctctgtagcatctgacacttccccacttcctccttgaaccatttgcatccccagaattccatgagt

SEQ ID NO: 48020 - DNA, 601 bp, Human
tattttttaaaattcctcctgaggaggattcttaataaatatgtagtaatataattgtggatagttacatttctaactattagaaatccattccctatattattatccgttcaaagatatcaaatttcatggtaaaagacaaacacacaccatcaacagtatacacagagagaggatagaatgtagataacaatgggaagatgctggagacctgaaatttagttcaactttgcaactaacttatatagaatgacgtctcacctcatgtcttatcacaggtgccgtgatctgaatgtttccyaaaattcatgtgttgaaacttaatcaccaatgtgataatattaagaactggggcctttgggaggcactcagcccataagggctctaccatcatggatgggatcggtctcttacaaatgggttggagagagctaaggaggccacttttgcccttccatctcttctgccatgtaaaaaggcactattctagcaacaagctgccatcttgagagcaaagaccaggcccttacccaacctgtcagtaccttgattttgcatttcccagcctccagaagtatgagaaataaatttatcttgttta

SEQ ID NO: 48021 - DNA, 601 bp, Human
tcataggaatgtggtgaaattgaatgagattgcacgttttaaaccctagcactgtgcctacttatattaggtaccagcaggtgtgagcttcattctcttgtgtcttcaactccatgatccattcctgacttttctctcaatcctaggctctatcaaataccagccaccttggtactccctggcttttctgcctttcttttacttgctgtttccctcatctagaatgacccgtcccacttgcacattcttcactgctcactgtagatcacacatcctctttcagcttccctcaactgccccragcaacagccatatcacattacctctgcctttcttttaacatttatcacagcccttctgtatgatggacacatgtatatattatacacccaaacattccaaccaatgcaaatggtaagcacttgatggcgatattttttaaaattcctcctgaggaggattcttaataaatatgtagtaatataattgtggatagttacatttctaactattagaaatccattccctatattattatccgttcaaagatatcaaatttcatggtaaaagacaaacacacaccatcaacagtatacacaga

SEQ ID NO: 48022 - DNA, 601 bp, Human
ttaccctcagtgtctacaagctggaccttaatgtgcacagccccctacctgactcaagtttatagagttaaggagcaatatctaaacttaaacatatttgaaggctatttttctttcctaaaatagaccaccctaaaaaaaataaactataaatttgacaataagtttcctcctcaattttaagtttgtatttaagataatctttgtattcctatcttcttcccaattttagaaagtttttggtatattcataattttgatttgaaaacatctgaatattgtcttggtccacacttgtaaagactcctatccagaacagcaacatcatcatccatagattatttttttaattcttgaaatgtcaacaataactacagagacaatgtataggaaacaccactacttctaataggaatatgaacattctagccagaatatatgtatatgtgcatatattcagggtttttacattagccaaatttctgcaatggttagcttcactctgatcaaatggagttccagcccagaggtcctacaaactgagacaaagtgggaccatatgtaactcattctgtgctgttcagtgcaatcaatccaggat

SEQ ID NO: 48023 - DNA, 601 bp, Human
atatttcgcatttcaatttttcctgccctgttttaaaaatcactgctacataggtgaaatgtgttatacaatgaagtgaaactattatttacttaaaaggtgtaaatttatgacctgccattttaaaagcatgaaaccaatactccaattaataatctcaaacagagttaagaatgtaaaagtcccaaacagagaactaaaaagaactagacactgctaatatttttttcatgagtatgtggcagatatgaagaaatttcctgattacccaataatggacattcatacttcagaactgctktaagtatacttttcccttgacattctgaactgtttttctcaatctaatctacttatcaaagcaacagaccttttgatctgttcaaagcaatttcttaacactttggttataataaacatttaaaagttgaaataattttggtatcattttaaggaagctgcaataaaagaataaaaataatcatcattcaaataagagcatttgcacgatgagctagtcaacagcagtatcagagtctctatttttggttctttagatctaattctttcacaaatgtgtaggcacgcacatgaacacaca

SEQ ID NO: 48024 - DNA, 601 bp, Human
gtaatgattttctcttacacctgccatccctgtgctgtccttagttttctggcctattagatgaaataggttatcgtcttccaggcatatttcgcatttcaatttttcctgccctgttttaaaaatcactgctacataggtgaaatgtgttatacaatgaagtgaaactattatttacttaaaaggtgtaaatttatgacctgccattttaaaagcatgaaaccaatactccaattaataatctcaaacagagttaagaatgtaaaagtcccaaacagagaactaaaaagaactagacacwgctaatatttttttcatgagtatgtggcagatatgaagaaatttcctgattacccaataatggacattcatacttcagaactgctgtaagtatacttttcccttgacattctgaactgtttttctcaatctaatctacttatcaaagcaacagaccttttgatctgttcaaagcaatttcttaacactttggttataataaacatttaaaagttgaaataattttggtatcattttaaggaagctgcaataaaagaataaaaataatcatcattcaaataagagcatttgcacgatgagc

SEQ ID NO: 48025 - DNA, 601 bp, Human
tattattttactccttaagcacctcagtttttcaagtggggtttatcttttttaaaagcaagtgaacagaagaaattcaacatcttctatcaataaaatacacttatctactgacgtttaaatcaggattttatcatccaaaccccacttaagaaggtatagcacagatggcaggacctcatttgtaactaggttatattatatcctattgttatttctggcttaggcagatgctaccttggtagtgttatatgcagcagcacaactgcactggaagctgaagccaatgttagcaagaggyagaaaatagatgaggaagtgggatgataatgaacccctcatgacagctcagaaataacaaaaacctgaagtctgttatgcaggtgagatactggtaggagccagctctttgtaatgattttctcttacacctgccatccctgtgctgtccttagttttctggcctattagatgaaataggttatcgtcttccaggcatatttcgcatttcaatttttcctgccctgttttaaaaatcactgctacataggtgaaatgtgttatacaatgaagtgaaactattatttacttaaaaggtgta

SEQ ID NO: 48026 - DNA, 601 bp, Human
cgtcttcacatccacaggtgagtctggcattgtggagtgcttctcagtacgatctggaggatgccaccaggaacatattattttactccttaagcacctcagtttttcaagtggggtttatcttttttaaaagcaagtgaacagaagaaattcaacatcttctatcaataaaatacacttatctactgacgtttaaatcaggattttatcatccaaaccccacttaagaaggtatagcacagatggcaggacctcatttgtaactaggttatattatatcctattgttatttctggcttargcagatgctaccttggtagtgttatatgcagcagcacaactgcactggaagctgaagccaatgttagcaagaggtagaaaatagatgaggaagtgggatgataatgaacccctcatgacagctcagaaataacaaaaacctgaagtctgttatgcaggtgagatactggtaggagccagctctttgtaatgattttctcttacacctgccatccctgtgctgtccttagttttctggcctattagatgaaataggttatcgtcttccaggcatatttcgcatttcaatttttcctgccct

SEQ ID NO: 48027 - DNA, 601 bp, Human
cttttaaatggcagtgcaacactgcataaacagcctgagatgcgtactttgctaatcccttatagtcccaaagatctacttttgccttttagttatttttcattcatatggatttcatggcacatggtgtgcaaaatagctgcaaccgataacatttattagtttcacaattccttgatgacaatttcaaccaggactttgagatttattaaaacagttactcactatccctaatgaaatacacaggaaagaatgggaagttgcaattctgtcagaattctctatcctttcctttggactstactgaaagcaatacactctattgagagaactcagaacttgagccaagcaggaatggagtaaagttttaataagagtctgacaggttcaagacaagaaagacacgaccgggtgcggtggctcacgcctgtaatcccagcactttgggaggccgaggtgggagcatcacgaggtcggaagttcaagaccagcctgaccaacatggtgaaaccccgtatctactaaaaatatgaaaattagctgggctcagtggcgcatgactgtaatcccagctactcaggaggctgaggcaggagaatcg

SEQ ID NO: 48028 - DNA, 601 bp, Human
ttaaaaatggttaaaatgatgaactgtatgtatattttaccacaataaaaaatttcaatgttattcatcttaaaaatgacactagataaaagaagaatgtgttgttacaaattcttgttcatctgggccaatgataaaaatccgctaaagcaatgaaattaaaatgagcatccaattagattgagtgactcaacataacaaaaccattttgtcatcattgaaaaccactaggcatgccaggaaagtgtacttactgaaatactgaaatacacgtgcacatacacacacacacacacacacctttatatatataacatgtttatggccaatataacaataaatttgtataaccatatctttattagtcaaacagtgagaaaaaaaactctggtggggtcaatatataatgcagaatttaaaagactgtcactatagcatgaatcagacttgcacacaatcttcagatgtagaaactattataacaaaatacttgcgagaacggtgtctacatgtctgagtctcccacccacactatcccttacaccaagaaaactgggttggtttccatttgcttaccactagtcccagaacgagggtgcga

SEQ ID NO: 48029 - DNA, 601 bp, Human
ttagtgtttaccaggagctggggataaaagagatgaggagttactgttttatgaatacagaaggtttcggattgaggtgatgaaaaagttctggagatggacagtggtggtggctatacagcaatgtgaatatacataatgccaccaaactgtacacttaaaaatggttaaaatgatgaactgtatgtatattttaccacaataaaaaatttcaatgttattcatcttaaaaatgacactagataaaagaagaatgtgttgttacaaattcttgttcatctgggccaatgataaaaatccrctaaagcaatgaaattaaaatgagcatccaattagattgagtgactcaacataacaaaaccattttgtcatcattgaaaaccactaggcatgccaggaaagtgtacttactgaaatactgaaatacacgtgcacatacacacacacacacacacacatttatatatataacatgtttatggccaatataacaataaatttgtataaccatatctttattagtcaaacagtgagaaaaaaaactctggtggggtcaatatataatgcagaatttaaaagactgtcactatagcatgaatca

SEQ ID NO: 48030 - DNA, 601 bp, Human
aatctgtcactaccagttgggtggccttgcatattttacttaacctctataacctcagtttgcccatgtgtcaaatgtgtataaaaatcactccctcaaaaaaaaaaaaaaatcactctctcaaatggtagtcctgagaattatgtaaaatggcttgtaagccaaatgtttaacagaagtctgctactcaatgaatatttactgcctattatatgcaagttataatgaattaatgtcctcccctattttcctctctaggcttttagattttaaaaaatatattttttaaaagtatttcacrcaaaagtatgccacttgggaaaaatctacttaaagctaccaagtttttctgcattttcaattatggaaccactgttaataaagaacatgtcaaatttataaggcaattttcaaaaaaaaaaaattttgctaagaacaacacattcaccatttacttgatacaattattactttggatttactttgtggttccttggtctaacttatttacatgttaaaaaagcttattatgcaaattcaagaatgaataaaaaggaaaagataagtgactgacaaaagtatctgaagtatgccaacacac

SEQ ID NO: 48031 - DNA, 601 bp, Human
gcggtgagccttgctggcaccgatgcgaatgcattgggtgacagagaacgggtatgggtgacagagaaagaccctgtctcaaaaaaattactaaaaaaaaatgtttaaaagaaaaaacaaaaaagacagtacttcctaacattttcttaactccacctaagcatcagcatgatttagtacctaggttcaaatctgtcactaccagttgggtggccttgcatattttacttaacctctataacctcagtttgcccatgtgtcaaatgtgtataaaaatcactccctcaaaaaaaaaaaaaaatcactctctcaaatggtagtcctgagaattatgtaaaatggcttgtaagccaaatgtttaacagaagtctgctactcaatgaatatttactgcctattatatgcaagttataatgaattaatgtcctcccctattttcctctctaggcttttagattttaaaaaatatattttttaaaagtatttcacacaaaagtatgccacttgggaaaaatctacttaaagctaccaagtttttctgcattttcaattatggaaccactgttaataaagaacatgtcaaatttataaggcaattttc

SEQ ID NO: 48032 - DNA, 601 bp, Human
actcccaacttcttcactggcacaaaaggatgacggtctgatcttcccgttaagttgttacaaagataaaattaggaggataaaaaaatcctgaacaactacaaagctcaaccaatcttctgttcactctaaagacaagcaaaatgtaaaataacatatctcatatgaccaaaaaaatgaacaaaacctttattcaaagagacttctaaactcttcttcaaactttacttcttttcaggtaattatttaaaacactccttgtaattttcagactacttaggaaatggtcataaatacaatygattcagatagttttcatccattaaattaaatcaaagagcccctaaatgtactaaaaaagcacacagttatgacctagcaacaatatggtttaaaatactttacagaccagtgaactgtgcaataccttcaaaaatgggatgacaaaaggtctcagtgggaagttagtagcttcttgcagtttggaatgaaattcttcaattgtcaaagtggagttctatggaagaaaatatgtagtataaatacattagcctgttggtaaatagtaaaaacacaaacaaattaattattaagactggta

SEQ ID NO: 48033 - DNA, 601 bp, Human
aaatcagaggcttccttgagtgctcattttgaaagtgaccttcaaaggggagtgcaaatgaaactttcacatttatcaatctgctaagcccactgttagtataaacttattgagaatccactatgcccaagcaatatgcttacccaagtaaaagggatcttagtaatctgcttttctaccaaaactaccagttattttagtatccatcagtgaattaactacccgctatgctgaataaaaatgttccttctttctcttgtgaactttgtgtttgtttgttttccagttgctttactgaagyggcagcagttggaggagacagaaagctcacagcagagacttaaaaaccatttcgaatcccacacctcaatcagtcctcagccaggcacaccttggacatgtcacttactcccaacttcttcactggcacaaaaggatgacggtctgatcttcccgttaagttgttacaaagataaaattaggaggataaaaaaatcctgaacaactacaaagctcaaccaatcttctgttcactctaaagacaagcaaaatgtaaaataacatatctcatatgaccaaaaaaatgaacaaaacctttatt

SEQ ID NO: 48034 - DNA, 601 bp, Human
tgaccctgaaaggagcctattttttctttcttcttcttcttttttttttttttcttttttagcacagaaaccagtggtatttgcacaggaaatggcattcatatgatgaaatctttacagaaaacaacgctttctgagaaaggcaaagattctagtctcaacaaacttgttcaaattgttcaacaaacaatttgcttttaaataagaatatagtattatagtataagccattttgggagaaaacactaacacattatacctttaaccttaaatgtacaacttagaaaagaacgaaaagaayataattgtaatctgggtttccacacaaacagatctaatttctggtttgtaggtactcacaaagcagaatatttcatttcaccttaataataacaacaggaaagactaatatccagaaagttcagaattggggctcatttcagacaaacctttctaggcttctggatacttacttgaaccttatgtgtctgatacagttttaaaaatagatgaaatttcacacaggatctgatcagttatatttctggtgtctcccaaacaaagttctaggaaccagacagaaaggtaaatcctccttggc

SEQ ID NO: 48035 - DNA, 601 bp, Human
acaagactttaatgcatattgttacagcagtgtttgaatgcacttattaaggcccgagttcccacaaccatatggtttttgtcattaatgtctcctttgaggaaaagcactaaaattagaaaaaaaagttatatctttgattccaatgatcccaactaaatgatatggtaaccatatggtgtgcagcagtgatagaagaatctggaagtgtccttgtaagctttttaaattttttttggctgccaacttgaccctgaaaggagcctattttttctttcttcttcttcttttttttttttttcttttttagcacagaaaccagtggtatttgcacaggaaatggcattcatatgatgaaatctttacagaaaacaacgctttctgagaaaggcaaagattctagtctcaacaaacttgttcaaattgttcaacaaacaatttgcttttaaataagaatatagtattatagtataagccattttgggagaaaacactaacacattatacctttaaccttaaatgtacaacttagaaaagaacgaaaagaatataattgtaatctgggtttccacacaaacagatctaatttctggtttgtagg

SEQ ID NO: 48036 - DNA, 601 bp, Human
actgtatatgcataagatttaaattgtccaaaacaatacactgcaaagctctctgctcttggttctttagggatcccaaagataagaaatcctagaacaagaaatggagtaacaaatgaggagacaaaaaacagtatcttcaggactctattagcagagcatgatattcagaacgatgaggaagcgggggggaagtgaagactgttgcttgactttactaatactgtctcccacattcttcttatcaaaaagaattatttgggtgccacatatctctctctctctctctctctcacacacwcacacacacacacacacacacacacacacacacgagactatgtgccattctgtattaaatagagtcagctgggacctcaggtaaaggctctatctgaacatatagagacctttctaaaacaatcatattccttctgttaagaatgccagcaatattgaaccaagcaggcaaacatagttatgccagctcagagagacaaattcctgaatgataatcaggagaattgactcacaggctggacatcttgtgtgcagatgtcttttggcaaagcattcgctggctcccatccagaaacagcct

SEQ ID NO: 48037 - DNA, 601 bp, Human
tgactgtatatgcataagatttaaattgtccaaaacaatacactgcaaagctctctgctcttggttctttagggatcccaaagataagaaatcctagaacaagaaatggagtaacaaatgaggagacaaaaaacagtatcttcaggactctattagcagagcatgatattcagaacgatgaggaagcgggggggaagtgaagactgttgcttgactttactaatactgtctcccacattcttcttatcaaaaagaattatttgggtgccacatatctctctctctctctctctctcacacwcacacacacacacacacacacacacacacacacacgagactatgtgccattctgtattaaatagagtcagctgggacctcaggtaaaggctctatctgaacatatagagacctttctaaaacaatcatattccttctgttaagaatgccagcaatattgaaccaagcaggcaaacatagttatgccagctcagagagacaaattcctgaatgataatcaggagaattgactcacaggctggacatcttgtgtgcagatgtcttttggcaaagcattcgctggctcccatccagaaacagc

SEQ ID NO: 48038 - DNA, 601 bp, Human
catgactgtatatgcataagatttaaattgtccaaaacaatacactgcaaagctctctgctcttggttctttagggatcccaaagataagaaatcctagaacaagaaatggagtaacaaatgaggagacaaaaaacagtatcttcaggactctattagcagagcatgatattcagaacgatgaggaagcgggggggaagtgaagactgttgcttgactttactaatactgtctcccacattcttcttatcaaaaagaattatttgggtgccacatatctctctctctctctctctctcacwcacacacacacacacacacacacacacacacacacacgagactatgtgccattctgtattaaatagagtcagctgggacctcaggtaaaggctctatctgaacatatagagacctttctaaaacaatcatattccttctgttaagaatgccagcaatattgaaccaagcaggcaaacatagttatgccagctcagagagacaaattcctgaatgataatcaggagaattgactcacaggctggacatcttgtgtgcagatgtcttttggcaaagcattcgctggctcccatccagaaaca

SEQ ID NO: 48039 - DNA, 601 bp, Human
cacatgactgtatatgcataagatttaaattgtccaaaacaatacactgcaaagctctctgctcttggttctttagggatcccaaagataagaaatcctagaacaagaaatggagtaacaaatgaggagacaaaaaacagtatcttcaggactctattagcagagcatgatattcagaacgatgaggaagcgggggggaagtgaagactgttgcttgactttactaatactgtctcccacattcttcttatcaaaaagaattatttgggtgccacatatctctctctctctctctctctcwcacacacacacacacacacacacacacacacacacacacgagactatgtgccattctgtattaaatagagtcagctgggacctcaggtaaaggctctatctgaacatatagagacctttctaaaacaatcatattccttctgttaagaatgccagcaatattgaaccaagcaggcaaacatagttatgccagctcagagagacaaattcctgaatgataatcaggagaattgactcacaggctggacatcttgtgtgcagatgtcttttggcaaagcattcgctggctcccatccagaaa

SEQ ID NO: 48040 - DNA, 601 bp, Human
gtccatcattgtctgaaacattatatgtagcacatgactgtatatgcataagatttaaattgtccaaaacaatacactgcaaagctctctgctcttggttctttagggatcccaaagataagaaatcctagaacaagaaatggagtaacaaatgaggagacaaaaaacagtatcttcaggactctattagcagagcatgatattcagaacgatgaggaagcgggggggaagtgaagactgttgcttgactttactaatactgtctcccacattcttcttatcaaaaagaattatttgggtkccacatatctctctctctctctctctctcacacacacacacacacacacacacacacacacacacacacgagactatgtgccattctgtattaaatagagtcagctgggacctcaggtaaaggctctatctgaacatatagagacctttctaaaacaatcatattccttctgttaagaatgccagcaatattgaaccaagcaggcaaacatagttatgccagctcagagagacaaattcctgaatgataatcaggagaattgactcacaggctggacatcttgtgtgcagatgtcttttg

SEQ ID NO: 48041 - DNA, 601 bp, Human
aatgacaagtatttacatctctgaccatagaaaaacacttcaggaggtcaaggcaggcaggtcacttaagcccaggagtttgagaccagcctgggcaacatggtgaaacctcatctctacaaaaaatacaaaatcggttggatgcagtggcccatgcctatagtccctgctattgggaggctaaagtgagaggactgtttgaacccaagaggtcgaggctccaatgagccatgaccgtgccactgcactccagcctgggtaacagagcgagactttgtttcaaaaaaaaaaaaaaaaaaaagaaagaaagaaaaagaaaaggacacaataaaaatatgatttataatcttatgggactaccattgtacatgcagtccatcattgtctgaaacattatatgtagcacatgactgtatatgcataagatttaaattgtccaaaacaatacactgcaaagctctctgctcttggttctttagggatcccaaagataagaaatcctagaacaagaaatggagtaacaaatgaggagacaaaaaacagtatcttcaggactctattagcagagcatgatattcagaacgatgaggaagcggggggg

SEQ ID NO: 48042 - DNA, 601 bp, Human
tctttgcaacttgaagatttcatttgtaggaaccaggtgccatgtacaccgattaacccatcaggtagaaaagcatttctgaatacaggagaggtcccagctgcctcaatttttgggcccaacagccttaaaaaatagccttctagagaatcatggacaggaactacggctggctacttgtacctcaaattcattttttttttccttcagtgctctttatttctttatgtagagccaagtttctggcctatatcattttcctttactctgaagaactccttttaacttttttttttttttktgagttccaggatacaggtgcagagtgtggaggtttgttacataagtagatgtgtgccatggtcgtttgttgcacctatcaacccattatctaggttttaagccccatatatgttagctatttgtcctaatgctttctctcccctcacccaccaaccgccctcaagtcagttttctaagagtattaatcaagaaaccatctcataatcacaccaaagcatatttctacacaagatataaaatactaggatatttgctaaagataaatgcatgccatacactgtaacaatggaaatgactt

SEQ ID NO: 48043 - DNA, 601 bp, Human
cagtcttattctaaggaatgaatacacacacacacacacacacacacacacacacacacacacatatttcttctaatgttagaagaaatcctgtatactggtcactcttcctcctcagctaggtcagcaccttgaataaagaacgggctggttgataggctgatcggtaattctggcaatttcaaatgtaataagagagaaagaggcaatttcacacatagtaaaggcattaaaatgaaaacctaagaaggcattttactctgaacttactttgacattataaatccagattgtcattgcyttctctttctcttatttttattattgtttggggaggggcagtaagggagaggaaaggagaagatactgggaagagtgaacagcactcatccccaatcacacttaattccaggaaagatcaatcacataaatctctttgcaacttgaagatttcatttgtaggaaccaggtgccatgtacaccgattaacccatcaggtagaaaagcatttctgaatacaggagaggtcccagctgcctcaatttttgggcccaacagccttaaaaaatagccttctagagaatcatggacaggaactacg

SEQ ID NO: 48044 - DNA, 601 bp, Human
tttgagatagtagggggtacaaaatgggaaacaaaacaaccatgttacccacacaaaagcaaagattatttggtttgatttcttaagcaagaaaaatcctaaaccagaaaagtagcataacaggtgagaacacaatactgaaggcaaattagatcgaaaagctgtgatatcaaagctctgagaaaagaaagacagcaatgataatcatcctaacacaattattttctttaaatcttaataattttaatccattctgcagtctcaaagaaagaaagcattatctaacagttcttttccctcytcctacacaaaagtgcttgtgtctttacgagtcaccacggtgagcagttttaaagagggctcttagcttctactctctatctgtaagagtgttcatttcgtttacatggctccaaaacaaacgatcacattcctttcttcagcatctcccaccacagaatggtaaaagaataaatgtttactataaatgacgtttacatattaacaaagaatagaaatcagaattttctacttactttccctaatattttaggaaagaaataacataattttataataaaaattatctttttctactttg

SEQ ID NO: 48045 - DNA, 601 bp, Human
caacatagcgagacactgtcttaaaaaaaaaaatacagataacatcccatgagcaaatccataaatttaaaatatgtgtgatttttttgttttggtatgaaatgtaaaaaggcagggtgtggtggctcatgcctataatctcaacactttgggaggccaaggtgggaggatcacatgagcccaggagtttgagaccagcttgggcaacattgcagaccatgcctaaggaaaaaaaacataaaaagaatggggcctggtgtatctataagatccctcccagctgacaaattacataactctraagttcaaccaattatttttagagaataatgtttaacccttgggggaggaggaaatacatattaatccaactacatggcctttgcattgaaagtttagaagcgttaaactgagagtaatgtaaagcataattacattaaaataatggcatataagaaggggattcatacttaacatccatcatttgagatagtagggggtacaaaatgggaaacaaaacaaccatgttacccacacaaaagcaaagattatttggtttgatttcttaagcaagaaaaatcctaaaccagaaaagtagcat

SEQ ID NO: 48046 - DNA, 601 bp, Human
gcaactggaagatttcaagtatgcaaatatgcttgtttctccactaagaagctttgcaacattaggcaatttatttgggccttagtttgtgcaagaataaaaagatgggggccagctgggtgtggtggtgcatacctgtagtcctagctactcaggagcctgaggcagcaggttcacatgggcccaggagtttaagaccagcctgggcaacatagcgagacactgtcttaaaaaaaaaaatacagataacatcccatgagcaaatccataaatttaaaatatgtgtgatttttttgttttrgtatgaaatgtaaaaaggcagggtgtggtggctcatgcctataatctcaacactttgggaggccaaggtgggaggatcacatgagcccaggagtttgagaccagcttgggcaacattgcagaccatgcctaaggaaaaaaaacataaaaagaatggggcctggtgtatctataagatccctcccagctgacaaattacataactctaaagttcaaccaattatttttagagaataatgtttaacccttgggggaggaggaaatacatattaatccaactacatggcctttgcattgaaag

SEQ ID NO: 48047 - DNA, 601 bp, Human
tcattaagccaggaacacaggctagctgtggctcttctgtcgttaaaaatatatataaaacctcagaatgttatactatggcatctacccacttgagcaactatagaaaataaatgagggaaagtaaggtgaaaaaagagaagcttaagtcttagttgagtttccttatttaaattctgcacattaaaacatattttatgcaactggaagatttcaagtatgcaaatatgcttgtttctccactaagaagctttgcaacattaggcaatttatttgggccttagtttgtgcaagaataaaragatgggggccagctgggtgtggtggtgcatacctgtagtcctagctactcaggagcctgaggcagcaggttcacatgggcccaggagtttaagaccagcctgggcaacatagcgagacactgtcttaaaaaaaaaaatacagataacatcccatgagcaaatccataaatttaaaatatgtgtgatttttttgttttggtatgaaatgtaaaaaggcagggtgtggtggctcatgcctataatctcaacactttgggaggccaaggtgggaggatcacatgagcccaggagtttgagac

SEQ ID NO: 48048 - DNA, 601 bp, Human
taggaaagacagcagaaaccatcagctggaatagagactaaggcgtgaggagtatgcagtaaagttagaccctaacaaagcagcaagaaatcaggctaacaagttaaagttgaagctggaatgtggagagaacaaaatgccccgtacaactgtgttatctttaacatataaatgtaattttgtggctcggtacagtggctcatgcctgtaatcccagcactttgggaggccgagatgggtggatcacctgaggtcaggagtttgagaccggcctggccaatatggtgaaaccccgtctctrgtaaaaatacaaaaaattagccgggcatggtggcaggcatctgatacctctctacttgggaggctgagacaggagaattgcttgaacccaggaggtggaggttgcagtgagcccagatcagtcactccagcctgggcaacaagggtgaaacttcatctcaaaaaaaataaataaataaaaataaataaatgtaattttgtgctatttcactgaaaggcctcccaattgatgtgattaatatttttaaaaatcactccttgcaactgtggaatacataatagatgcaacacaaactagaat

SEQ ID NO: 48049 - DNA, 601 bp, Human
cattattatattatttataattgggaagctttcattcaaatagtagatactgagttaggccatgaggtattaatagaattatggcatataagaattaggaaagacagcagaaaccatcagctggaatagagactaaggcgtgaggagtatgcagtaaagttagaccctaacaaagcagcaagaaatcaggctaacaagttaaagttgaagctggaatgtggagagaacaaaatgccccgtacaactgtgttatctttaacatataaatgtaattttgtggctcggtacagtggctcatgcytgtaatcccagcactttgggaggccgagatgggtggatcacctgaggtcaggagtttgagaccggcctggccaatatggtgaaaccccgtctctggtaaaaatacaaaaaattagccgggcatggtggcaggcatctgatacctctctacttgggaggctgagacaggagaattgcttgaacccaggaggtggaggttgcagtgagcccagatcagtcactccagcctgggcaacaagggtgaaacttcatctcaaaaaaaataaataaataaaaataaataaatgtaattttgtgctat

SEQ ID NO: 48050 - DNA, 601 bp, Human
tggcttcagtattctgctcagtgaaatgggactaacaaattaagagacaacctaatttatactttaccctatctcaggctctttttttttttccagctcctcaataacagaaactgtaaactattaggaaaagaaaataaatgtcctttaaaaactacatgaggctggacgcagtggctcatgcctgtaatctcagcactttgggagggtgaggtaggtggatcacttgaggtcaggagcttgagaccagcctggccgacatggtgaaaccccgtctctactaagaaaaaaaaaaaaaaaattagccaggcatggtggagcatgcctgtagtcccagctactctgaaggctgaagcagaagaatcacttgaacctgaggcacagaggttgcaacgaaccaagatcgcgccactgcactccagcctaggtgacagagcgagactccatctcaaggaaaaaataaaaataaataaaaacaaaaactctacatgaaatatttttaagatgatgattagctagtgtgtgctggtaatccctttagtaacatttatataaaacagtgtataacattcaaggaaacggggaagtatgaaaaaatcca

SEQ ID NO: 48051 - DNA, 601 bp, Human
aaatctgcagagcttaatgttgaagaacatgcccactacatactaagagggatgcactattctgaatagactggccaatattggaaatgatggcaaagcatggcccccaagggagtggtggccaggagtcctaatgctgctcccttcaaagtatgtgtctacactaaaacatactgactccttacatattgatcactgatatcagactaaaatatccaatgtagctcagacattacctaattgcattgctttaaaataatttttaaaagtaaactgaaacattctagatactgatttatcrtctaagaatatacccatgtgattctaatctgtatttgcatatcccacaaatttctaaaaaatacacttcaatattcaatgcatattatcagcataaatcagctggaaaatactgaagactattagtggctatgaacgtaatgctaacacagcacctaccttactggcattgtggtgtagtggaaagagcactggactgggaatcaagagacctgagatctagtcctggctcttccatgactagctgtgtgaccttggtcaagtcacttaacctctctggacctcagtttattcatctgta

SEQ ID NO: 48052 - DNA, 601 bp, Human
tgataggaaacaacatttgtaaaaacaaattaagaggcaatctaatttatactttaccctatctcaggcttttttccccccagctcctcaataacagaagctgtaaactattacagaaagaaaataaatgtcctttaaaaactctacatgaggccaggtgcagtgactcacacctgtaatcccagcactttgcgaggccgaggcgggaggatcacctgaggtcaggaattcgagactagcctggccaacactgtgaaacctcgcctctactaaatatacaaaaagtagccgggtgtagtgrtgcatgcctgtagtctcagttgctcgggaggctgaggcaggagaatcacttgaaccccagaggcggaagatgcagtgagccgagattgtgccactgcactacagcctgggcaacaaactcaaaactctttcttaaaacaacaacaacaacaacaaaaaaactgagggtaaatctgcagagcttaatgttgaagaacatgcccactacatactaagagggatgcactattctgaatagactggccaatattggaaatgatggcaaagcatggcccccaagggagtggtggccaggagtcct

SEQ ID NO: 48053 - DNA, 601 bp, Human
tatatatttctactgcatagagactagcccctaatatattcaataagatagaaacaaaccatattcaaatttgactaatcactgctcccaaacttactttttacttacaagaccagcactcttatctttagacaggtggtaacatctattttcccagggacgttttctcataagaattctaccagttcacagtggctgcagacatctacatgccttctttattttagatagtaaaacaacagcatagaggcacttcttctactttcccggcatctagtgatggcatccagtctttgtctgmtaacactagagcaattcaggtggaaactgaatcaacaacagagataatcaggggcaacaggattctacaatgaaccatcctttatggccctttagggtgggcgccccagtgacaattcatacacaccaggttgagaagaataaaggacttagagacagaaggtataggcatagaaagaactgagggtaaatcttcagagttttatgttaaagaacatgcccactacatactaagaaggatgcactattatggagcgggcaggggacccttaggactcagccgtgtgacctccagttactt

SEQ ID NO: 48054 - DNA, 601 bp, Human
gccagtggcttcagtagtggactgcacagatacataacatttccatcatcacagaaagttctataggaaagtaaggatcaaactgagcaaataccgtatgcaatgcaatgtctgggaccctgacattatcttgagtcaccaaggtaatcaatcagcagtcatacagagctagcctggcctagaaggaagatctaggtcaacccccttattttaaagttgaggaaacacatacccagagagctaatgtatcctgtctggggttatcaggtcacatggcaggacgggaacaccctgacgacayaccatcaggtgatgcacagaactctaaacttggctttcagaaggaatgcattctataaataagacctgataactagtcacgattccttgattctcaaataaaagtaggagtaaagcagtaatttctggctgtatatatttctactgcatagagactagcccctaatatattcaataagatagaaacaaaccatattcaaatttgactaatcactgctcccaaacttactttttacttacaagaccagcactcttatctttagacaggtggtaacatctattttcccagggacgttttctc

SEQ ID NO: 48055 - DNA, 601 bp, Human
tcagcctcccaaagtgctgggattataggtgtgagccactgcacccagacaaaatgctttacttctaatagttttatgcaaagaaggaatgaacacagggaaatagaacacatatttgcccaaattcacttcttcttcagtattctgatccttgacccaaaactgtcaatattaactttaatcactggcattttcaagtaaaaaaaagtaccaaatcattccttgggaaacatctgttaagccacagatagcatgccatatcacactttggaaatatggaatatcatggaggctcaaaaatatcaaaataaacgtagagactatctgaaacaaaagatacaacacaagaaaatcaagtgatttttaaaaatatttgtggcaggcagactgcatatgaagtctcatgttgaaagagaattcaagctaaaaatttattttgcatttgttaccaacacaacaattgagggtcttgtattaatctagatgccctcctccaaagaaatttagtgtactgtcttaaagaatacaagtgattaggagagagaaagtacagctgttaaaagtctattaataccaatcaagtttttttcataaaggagac

SEQ ID NO: 48056 - DNA, 601 bp, Human
tagggaagagcatataaatcatcacaattaaagattttgctgagtagtgaaacaaaccatttcaggacaatgaaggaagcaattttatccctgaaggtttcagtctagtattttctatgactagatttgaaattcagagccaatagatggaaaattcaatgggaatgagaagataagtgttatgaacacgagtcagaagggaaatttcacctgaaggcattatagccagtaaatccacctctccaaatactaatcccattactttataaattaaatgaccttttcacaatagaacagtagyccaccgatctggctttgagaattcctttccaagatctaaacatttctctcaagtgactttcatatcaatttagaaatcaaatcctatattctacttcagatattctcgctcatttttttttcaaggatagcaggaaaaacaatgccttcaaaggatcaccaagcttttattttatcacataacctcactccagttgttttccaaacattttttaatcccaaatgattactgatgtcttacatggtcaagatgtttccactcttctgcccattctctgtctgttagtctgtgatcaatcat

SEQ ID NO: 48057 - DNA, 601 bp, Human
atgattaatcaatttttgttcataataaggaaataaacacaagatttttttttccactctgctctaaatagtttggcttcgaccaatattggctcaaaccaaacgtaattctgttttcgttgcttgccttaatgtgacctgacaaatacaattttgtttttaaaatatgcttcagaataatgcttgttaggtaaattaactgccttagactctttcattatttaatacttatgataataggcattcggcattcagagatcagcagaaatctacaaacctaagtgcataggaaactacactrgctgggaacaaattgaaaacagtaatgtgatcaacagataatatacttcaagttttaaactttggataatcagccatggtactaatgaggccaaaattatgaacttaatctgcacgttttgcagcatggacagtaacttgagttagcagatgggtatggggccaacgcataagataatatgagagaacaagaatccacagaaatccaccttcgtaagtttactcaaaaagtattcacacgtaatgggtggcaatgtcaatgacaaaaccgtattattaatttaggtaaaagttcacaggc

SEQ ID NO: 48058 - DNA, 601 bp, Human
agatatagacatatccatatctttatctgcgcacatgcactccattaaacacttcccagtcacagaaaatagatttatcagccaataatctccaatcctttcattacacacatcaatccattcaactccaaagcctggaagagggacttagaaagcacttaatgtaaatgattgtggcccataattacaaaccacctgtcctcttatttacagccatagctcagtcccagaaaatagtacacaaggctgcaagaatcagctagtaaggatgcacagtgaaaaaaaactgtaaaagcactaytggatgctaaaacttgcacactgcagagttctacacagattttctctaaagttatgatagtgtcttaatggcaacttaggattctgtgacaataaagaacataatgtcttaatgttgtctataaacaaagaaattaaatgcttgtaccctttgactaatacaacctacaaaagcttaaggccaaacaaatatctcaggtttaacaaaaatataaatccattgaacatcactaaaaaatagtatagtttgtatacttttaaaaaggagtttttttaaaccaagtttattcttttggttatg

SEQ ID NO: 48059 - DNA, 601 bp, Human
gaaaggaaaaagagctactaaggagattctgacaagcacttcggaaaacatacaaagtgctaaccagcaactgcctttctatacatataaaagtaattctacttcaatggtcaaatctgtcaattctgatcacattatcttgctcttctgtggagcataccatgtaataaaacttaaatgtataaataagtcatactttgaaaatagagacagcagtgttaaaatttgctttctaattttgttaagagttggatacttggagttttccctggaaagtaaatgagtaacaacagtaaaaacrataaatatctattatttcaagaaaatctattttatgaaaagtccttcaagatgtcaacttgcattttatttaaagaatagaaataccattatgaattcagtgtatactcagtgttaaaaattgtttcagtcagaggttattcaaaaaagagattttaatatcttaggaaaatactttttttttttttttttttttttttggagacagagtcttgccctgtcgtctaggctcgagtgcaatggcgtgatctcggctcactgcaacctctgcctcccaggttcaggtgactctcctgcctca

SEQ ID NO: 48060 - DNA, 601 bp, Human
cctagaagctagcaactgctttaggatttccatcttttacaacaaacatacttaatgctccaggaagtaaccatctcctcttaattttaaaagatggacatatttaactaatagtcccatatttttaaacccaatatagttaagtacagtaggcatttgcattatgaagtcagctgaatgactgtgagattaatttcatgatgtgatttaaagaaatcaatacaagggtacaaaactccaaacatttacatgcaaatatacacagaataacttgtttgtggttttcatattttgagagtayagaagttgaaatatttcattggctgggagaaatctatttttccatagccttgtattatgaattagggtcccaaaggtacaacagatttactacatttaagacaggaatcttttctaatctctgtgcctattaaagaagccacctgcttagaagtactttgtagatgaaaaaatacttatgaatccactgtaacttcacaatcttgaatgccaaggaaaaactttactagtttcatttaccactattctttaaagttctttttgattttatgttttaaattttttaattttatattttgag

SEQ ID NO: 48061 - DNA, 601 bp, Human
ttagatttatcaagattatcttccttaccactataactatttccagaagaaataaagtgcaatcaagttcatatttagccatgtgacacagtacaacacagagatttacttatgacattaaaagacaacttttaaggagaaaagacttggatttaagcataatttattggataagaataagaacagatctgtaaagtttgaagaaagaaaaaaacgtgacttcaaagtagcaatttttttttcatttattgtgttaagaagagacctgtagttaataaaaacttatttttttcttttttcyttttttgagacggagtcatgctcattgcccaggctggagtgcagtggcacgatcacagctcactgcaacctgtgcctcccaggtcaagagaatctcctgcctcagcctcccgagtagctcggattacaggtgcatgccaccaagcccagctaacctgtatatttttagtagagatggggtttcaccatgttggccaggctggtctcaaacttctgacgtcaggtcacctgacctcccaaagtgctggaattacaggtgtgagccaccatgcccagcctataaacattttttttttattaa

SEQ ID NO: 48062 - DNA, 601 bp, Human
agcccaataacaagtcagtgggtcatgaggagctttaaatctactattacaaaatatagagcagcatcttgtaatggaaagcagatagtgtatatgaaaagcaaaaataaatgtttagtaactttgtcatttcacttaaagagtaatttagctctgatcgttgaatactaattagtacagaagaacaactttaaaagtcgattgtaaccaaaaaattatctgagtactttaacaagtcaactagatttgatgttggtttcgttttttttttttttggatgcaggagaaaaggctgaagtaygcaatttaatttctaagacactggaattttttcatcaaagaaaaaaatgcatgcaagctaagacctcctatgccaagtttcagcctgaaatcattatggccctgaaaaaaatggagttttataatggaaatattgccagcttctcaattatagtgaaactggcagatgttactaaaataaaaatgatttcatcttgtaatcaggcctggtttaagaatattaatcaggtgttttgtttagtggttttttttgttttgttttgtttttgctgttgttgttgttagcagtaaagtcctttct

SEQ ID NO: 48063 - DNA, 601 bp, Human
ttagcatatatccatagaaaactattcccaaactgtttttaagcagcagtttagggataccactgtgagaagaatacaaatttaatgtcatattttagattgaaaacctactgtagatgatagacactgtaataaataatctaaacacttcctagataaggtttaacccttcttggagagggcaagcacacaacaaaaacaagtagtgctctttctctactctcttaagtccccaaaacctaaattacacccagaattaggtttaaaaacccccaaaacagacagtaaagaaaaataatartggagtcaatagataacaatatgccatgtaggaaaaaataaacaactgattaagtggaaaatacatagtgcagttttgaatctgcgtccaattgcttaccacttatggtaggacttcctttgtacatagctattcaagttgactttccaacaaaggtgctatattcagaaaaatctattctcacttaatagcagtcaaacaaagacttgagcagataatagcacaaaaagaattcggattacacaagaccttactggtaatttttctctatgaactatcaagaatttaacttaaatatac

SEQ ID NO: 48064 - DNA, 601 bp, Human
ggagaatatggccttgaacaattttttggatttctaatctttaaaaatgtgtgttgttatgttattatattgtgttattgggggcaatgtgaaagatttgcatagggtctgtagattaaataatagtcttctatcagtgataaagtcttgatttggtaactgtactgaagttatgtagaatattcttgttcttggtaaactgacattcaaatcatttaaggtaaagagaaattatgtctgcaacttactctcaaatgattagaaatatatatatatttaagagaaagaagaggatgaaagrgaggaaaagagaaaatactaaagcaaatatgataaaataagggaatctaggtgaaagttatagaggaattttttgtactttttttttgcaactttcctgcatgtttgaaatcatttcaaaataaaatgatgcaaaaagctatatgatgtactttcaagcacagggtatacttgtaattacaattttctgtgaaagtggatgcatttgttatgctacatcaagttttgggtgttctgccccttttgtatttttcaaatactttattcacctatgttttgcaacaaagataatgtataataa

SEQ ID NO: 48065 - DNA, 601 bp, Human
ataatatatgtaacattacctctagcagcaatgttatgctatgaaatgaccatcatatgggttaccacaaataatgtggaagtacagactgtctctaagatctcttagaaatattcagttgatgcaaacattgttttagcattggactttaggaccaatagctaaggcagtgatttcaatcccaagcctgccagatggctttggagaccacagcttacacagtatctattaaatcccttcaattggaaagcaagcatacacatatgcacatgcacacatacacaacagacacacacagccragctatgagtctctaaataatgctgcgaagttataagaatttcactttgatcggtaacctaccaaacattcaaaaccttttttggcaaagattaggtgttcaataaaaagacaaatgtgatcagctcttggcaaatttcatgaataccttgactttccccacactgttctaaatttttttccaaatatttatctaaagtgatcaccttgaatgaagaatgagcactctaatgaatgaaaactatcttgtttatttggagcttcccaagatgcctcacctcgcttgaatcctcctgctgat

SEQ ID NO: 48066 - DNA, 601 bp, Human
ttaaatacttactctccctcacaaattatagatatgtattgtagtagaccattgatttatcagtccatgccattgtgagttcggcttggtgagagcagcccattgtagtcctttatctaaagttactctggggttaaggatcgtgatgctatattaattaacgtggagcattactattctgctgattttgcaggcaatattttaaaaatcatgttgttagatattgtgttttagttactttgcagatctttgagccatttaggctagctgtgtgtgtgtgtgtgtgtgtgtgtgtgtgtgtgtgtgtgtgtgtgtgtgtgtgagaattattatactggaacaataatatatgtaacattacctctagcagcaatgttatgctatgaaatgaccatcatatgggttaccacaaataatgtggaagtacagactgtctctaagatctcttagaaatattcagttgatgcaaacattgttttagcattggactttaggaccaatagctaaggcagtgatttcaatcccaagcctgccagatggctttggagaccacagcttacacagtatctattaaatcccttcaattggaaagcaagcatac

SEQ ID NO: 48067 - DNA, 601 bp, Human
aattaaatacttactctccctcacaaattatagatatgtattgtagtagaccattgatttatcagtccatgccattgtgagttcggcttggtgagagcagcccattgtagtcctttatctaaagttactctggggttaaggatcgtgatgctatattaattaacgtggagcattactattctgctgattttgcaggcaatattttaaaaatcatgttgttagatattgtgttttagttactttgcagatctttgagccatttaggctagctgtgtgtgtgtgtgtgtgtgtgtgtgtgtgtgtgtgtgtgtgtgtgtgtgtgtgagaattattatactggaacaataatatatgtaacattacctctagcagcaatgttatgctatgaaatgaccatcatatgggttaccacaaataatgtggaagtacagactgtctctaagatctcttagaaatattcagttgatgcaaacattgttttagcattggactttaggaccaatagctaaggcagtgatttcaatcccaagcctgccagatggctttggagaccacagcttacacagtatctattaaatcccttcaattggaaagcaagcat

SEQ ID NO: 48068 - DNA, 601 bp, Human
gtacaaattaaatacttactctccctcacaaattatagatatgtattgtagtagaccattgatttatcagtccatgccattgtgagttcggcttggtgagagcagcccattgtagtcctttatctaaagttactctggggttaaggatcgtgatgctatattaattaacgtggagcattactattctgctgattttgcaggcaatattttaaaaatcatgttgttagatattgtgttttagttactttgcagatctttgagccatttaggctagctgtgtgtgtgtgtgtgtgtgtgtgtgtgtgtgtgtgtgtgtgtgtgtgtgtgtgagaattattatactggaacaataatatatgtaacattacctctagcagcaatgttatgctatgaaatgaccatcatatgggttaccacaaataatgtggaagtacagactgtctctaagatctcttagaaatattcagttgatgcaaacattgttttagcattggactttaggaccaatagctaaggcagtgatttcaatcccaagcctgccagatggctttggagaccacagcttacacagtatctattaaatcccttcaattggaaagca

SEQ ID NO: 48069 - DNA, 601 bp, Human
actcttaacatacctaacagccctaaaatgttcatgtgaaagtgacagttttaatgatatgacatcaactgtgcctcacgatattgctcatttgaacagagaaggacaaattctcctcaaaagatgctaataatgtttttaaaataaaaaacataaagtccttatatcttagccacaagataccaataaaactgaatttatgtctagtttaattgaacaatggaaaagtcagcagttaaagggcagataaacttccctttgtccctcttttcctgagaaactttcaaatgttgaaaatcarttccttttgtccccttgttattcatctgctacacattaaatagaaactctgggcattgagagattcctgcagagtctttcatctacagaaaagcctggtacaaattaaatacttactctccctcacaaattatagatatgtattgtagtagaccattgatttatcagtccatgccattgtgagttcggcttggtgagagcagcccattgtagtcctttatctaaagttactctggggttaaggatcgtgatgctatattaattaacgtggagcattactattctgctgattttgcaggca

SEQ ID NO: 48070 - DNA, 601 bp, Human
catattttctaaataggttttaggaataaagacacaaagcttataaatactgaaggaatacagcatgttactgcctgagtacaaagacttaattgacaatttcttcctagacatctgtctttagaatttggtgacctaaaaagtactcttaacatacctaacagccctaaaatgttcatgtgaaagtgacagttttaatgatatgacatcaactgtgcctcacgatattgctcatttgaacagagaaggacaaattctcctcaaaagatgctaataatgtttttaaaataaaaaacataaagtccttatatcttagccacaagataccaataaaactgaatttatgtctagtttaattgaacaatggaaaagtcagcagttaaagggcagataaacttccctttgtccctcttttcctgagaaactttcaaatgttgaaaatcaattccttttgtccccttgttattcatctgctacacattaaatagaaactctgggcattgagagattcctgcagagtctttcatctacagaaaagcctggtacaaattaaatacttactctccctcacaaattatagatatgtattgtagtagaccat

SEQ ID NO: 48071 - DNA, 601 bp, Human
agcaggaataataactgcaggattattcagggttatgtcagtgctaagcacagtgcatgatgttcataggtcctgaataaatggcaggtactaccaccactccctccttttggtactgactggaagaaagagagagtagatacagtccttgctccagatccagcaccttacaacctttagaattagaaggctgatggtcccattcaaattaagtgctatcacccatgggcactgacagctacaggagaagaacattaacttacttctcctcatacttcattagtgactaataatttcttcygcaacttcatttgctgtcctcaaaatttctgaagatttaccattgctgattacttccccgttcttccttattaaatgcctcttgttgaaatttcccctactaaaattctctttcttatacaataacttcttctgctgtttgttcttttccctgtagttgacagtgagggagggagggatgctggcataaagaaaaggaatatcttttccttctcatgctgccccttgtgagatcttgtggtttcaatgatcagctgtaagcaaattactctcaaacctgtttctccttgttatcttcttc

SEQ ID NO: 48072 - DNA, 601 bp, Human
ctactctatgctacagctaaacttgatgaaatggctctagcatatttaaaaagaatttgctcaaaaaaaaaaaaaaaaaacaaaaagcatgcctagggagtcattgtgacagtgcaaaatacatttatgtacatccctcttacaaaaacaccaatatgttagcattccgtgaagcatgctggttttcaggaaaaaaaaaaatcctataagagagtgaaatagcagctccgaaagatagcttttcttcttttcttttcttgaggacaaccaaaaagagtctttttttcctttttttttttttaactactagagaaatatcactaatacatacagatataaaagcagcatagaaagatacaggtttctcaccaactaggaataaagagactaaatgtgggcatatggttaaactacaatgcatcttcacatttgtccaacacatttacaagaaaaacaccattgggaaacctcacaggacagaagtgttttaacaccaagagaactactagtttttaattaaaaatccaaacagggtggggttgaaaaattttggaaaggggctggagctgaagccaccatttttaaaattatttttttcaat

SEQ ID NO: 48073 - DNA, 601 bp, Human
tcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgccgcctcccaggtaagtttttgatagtaggggtgctgctttgtaggttttattttttaagtcaagggtgaaaagaataamccccaacccccacaaaaaggcgcatcagaaccctagatctgagatggaaaaggctcacagcgcactttgcaaactgcaaagagtcgggagatgtttgcaattggttgcgtgcgtggagcgcaaggagggaacgcggcagggagggtaggctttggggcgaggtgggggtggggtgggtaatgcgctgctcaatgcaacgtgtatgcggtagcggggctgagaactttgagccggccccgggactgccccctgctcgggtcccagacctgaagctagcgcagttaggcaggtgggggaaat

SEQ ID NO: 48074 - DNA, 601 bp, Human
gcaaactgcaaagagtcgggagatgtttgcaattggttgcgtgcgtggagcgcaaggagggaacgcggcagggagggtaggctttggggcgaggtgggggtggggtgggtaatgcgctgctcaatgcaacgtgtatgcggtagcggggctgagaactttgagccggccccgggactgccccctgctcgggtcccagacctgaagctagcgcagttaggcaggtgggggaaatcccggggaagcttccagcagtctcttttcctttcctcctccttcggagcgcccacttcggtgccgggtsgccctccacccatcgggaagaggggcctcgaaccctcagccgcgctgcctccgcctcctgcgcggagacgtaacgggggacccgtgcgtaacggctgacgcgctggaatcctccgtctgacgcggggcacgcacggcgcgcggcgcccccttcgtccgccccgcccctgacgtcccgggagcgttctattttggaacgccggggccacgttgctaagggagggggcagcccggcgtttcgattggccgccggggcgcacgccttggccaatcagctttcccttcctatttgtagggtgca

SEQ ID NO: 48075 - DNA, 601 bp, Human
tcccgggagcgttctattttggaacgccggggccacgttgctaagggagggggcagcccggcgtttcgattggccgccggggcgcacgccttggccaatcagctttcccttcctatttgtagggtgcattttccttcccccctctctgtccccggaacccgtggttccttggcggctgggtctcttttcggcgcctctagaggcagagggaggggatccctgtcgtgacaagagcgcctgtctgcgacccaatggatctgcgaggcccttgcggggatctagtccctgggctctcaggagmagggggtgtctgcttgtgtgctggcgtttcttggagagatacggtggctgtcaccctcttctccaggcacacacagacacattcccactccctctgctcctcatgcccggttcctccggtgtgtcccaagacaggactagaaccgcgaaccgaagggcaaccagccaggtggtctccaggagctccgccccctctgggttcccaggactctgattggtcggcgagccagcccttccctcaccacgccccccgagagagtagttaagccttcagagcagttccaggagtccatttacggga

SEQ ID NO: 48076 - DNA, 601 bp, Human
ctgggtctcttttcggcgcctctagaggcagagggaggggatccctgtcgtgacaagagcgcctgtctgcgacccaatggatctgcgaggcccttgcggggatctagtccctgggctctcaggagaagggggtgtctgcttgtgtgctggcgtttcttggagagatacggtggctgtcaccctcttctccaggcacacacagacacattcccactccctctgctcctcatgcccggttcctccggtgtgtcccaagacaggactagaaccgcgaaccgaagggcaaccagccaggtggtcyccaggagctccgccccctctgggttcccaggactctgattggtcggcgagccagcccttccctcaccacgccccccgagagagtagttaagccttcagagcagttccaggagtccatttacgggaggggggagatgagcgctgctgaggcttgggggctcaggtcccgcaccattccccctccgcgacaatctgagagagctccagtggttacttttatctacctgtccgttcaccctaaactgtcactcgtcagtctcactctgagaagagacagtaacttgaaacgttgttctaaact

SEQ ID NO: 48077 - DNA, 601 bp, Human
ctgggctctcaggagaagggggtgtctgcttgtgtgctggcgtttcttggagagatacggtggctgtcaccctcttctccaggcacacacagacacattcccactccctctgctcctcatgcccggttcctccggtgtgtcccaagacaggactagaaccgcgaaccgaagggcaaccagccaggtggtctccaggagctccgccccctctgggttcccaggactctgattggtcggcgagccagcccttccctcaccacgccccccgagagagtagttaagccttcagagcagttccagsagtccatttacgggaggggggagatgagcgctgctgaggcttgggggctcaggtcccgcaccattccccctccgcgacaatctgagagagctccagtggttacttttatctacctgtccgttcaccctaaactgtcactcgtcagtctcactctgagaagagacagtaacttgaaacgttgttctaaactcctaggcccgtcccccaaacacccttttgactgggacccccgcccctgcatgggacctcgcgcagaggggggtgtgtatgtgtgtgagtgtagaggaaggcttggcctaa

SEQ ID NO: 48078 - DNA, 601 bp, Human
aaggcctcagtgttacagaaaccccaagatccttgctacacgagcgaggaccggaggcttgttttttggctcttgggggttctgaaagaagtagaggttcgggatgggtggaggagtgctgtatccccaaatctcatggcctctatctccctgactcagctcaccccagaggaagaggagaagcgaagggtgcgccgggaacgaaataaactagcagcagctaaatgcaggaaccggcggagggagctgaccgaccgactccaggcggtgaggacaggccctggggtgggagaggggatgytgaggggagctctctccccattctctgccccctctccacctgtacccttatcctgggttgagaactagacgttccacacatggaactaggtactgctgtggccagactgggtagcccagggcacaaacacagacccccatggacttaagtcaactcctggtcccccccccatttcctgaccccacggactactctcctagccttcatttcatcccaaggggccacatggggcccttgaggagaggggcgcccccatcatttctcccatctggtcttcagcaagtaacaacccattttgcc

SEQ ID NO: 48079 - DNA, 601 bp, Human
cctgtacccttatcctgggttgagaactagacgttccacacatggaactaggtactgctgtggccagactgggtagcccagggcacaaacacagacccccatggacttaagtcaactcctggtcccccccccatttcctgaccccacggactactctcctagccttcatttcatcccaaggggccacatggggcccttgaggagaggggcgcccccatcatttctcccatctggtcttcagcaagtaacaacccattttgcctcagtttctccatctctgcaaaccctcatcaaatctccygggctctttctacccttaacactctggaaagcctgtgaaatgaaattattccacctcctgccctagccacccacagctctcctggtgctggtggcatcccccaaaacccactcccttcctacgtcctcccttggtctgagagttccctgctgtatgcctgcagggtgagctgttactccttgagggaacaagggaattgtcaactttccttctctactttttctcttccccgggaggtagagagggaggggtaatagaagggaacacattaaaaacacataacagtggctcatgcctgtg

SEQ ID NO: 48080 - DNA, 601 bp, Human
ctggtctcgtggttccgagactgagcggccctgggggcgggggcggcgggcagttgaatccctgcggcccccggagcccactacaccatcaaaggcgatgtaggagaaggtcagctcccggggggtgccccagtcctgcgacgtggtctcctcctcgtcctcctctgagaattcccgggctgtgtgcagctctcgaaaatcagagtcgtcgttccctcctgcagtgggtgaaggagagccttgtttccctcagcaggtccctgagctgcccagccctgagccccttcacatgctccccacmacttaccttctgtggaatcaggagttgaggaggctgtagacggagcttcttctgcgagagggaaagaatcgaagactcttagaagcttagactgtccgaatcacagaagtgtcccagtcctggaatcttagaatatttgaatcacgggatttttagaacattctgcacacagactctaaaacctagcatcactgcctgatgaagctcagagtctttgaagtccaaatccaggaatcttaatcttagagtcttcaaagtaggaatcttaggaggtttcaattcattcattcgttcaacaac

SEQ ID NO: 48081 - DNA, 601 bp, Human
gctggagtgcagtggcgcgatcttggctcactgcaacctctgccttccaggttcaagcgattctcctgcctcagcctcccgagtacagacggggtttcaccatgttggccaggctgatctcgaactcctcacctcaagtgatccgcccgcctcggcctcccaaagggctgggattacaggcatgagccaccgcgcccggccggggaaatttttttaaaaagcggagtttatcacgtctagccagatgtgatatcacgtctatctcttcccttttccactatgtactgttcctttgcgaggytggtccctttaattcaaaatcctctcaccttttgccttctgtgggccaatgcagcatcttcatacacgttgcttacctagaaggcgtggctccaccgtgaattctaattggtccgtgctatcgaggcactgtccccttactggctctcgctccagtggcccccactgcttttcttcctcttccagcaatggctcttcgggcccagagttcgaatctcgcgatcgggatggggacggagtaccggcctggggtgtcccagagcccggactgagctggggagtcaagacctcgggcgatgag

SEQ ID NO: 48082 - DNA, 601 bp, Human
actgcactccagaaagggcgacagagggagactctgtggcttaaaaagaaaaagaaactttagtaatctgctttcctttgagtcctgaaaaccaggaactcagtacctttctatttctttccagatcctctctatcctcccacactccctccaactgacccctccgaccggtccctcttagaggctcacccctcacttccgtctccttccaatgcatctcctctcatttacctccaaatagggcagcccctccctccccatagcagggccctcccaggcaggctcctagtggccggcgccrgtggatgggggaggggccaggtcgcctgaggcgggggctaagtttaggcacgctggggggagggggcctccccgcagctgttctggcccgtctggcccctgagtgacagcgctgcctggggccgaggctgggggagggggtcctccctgctcctgggccccaaagtgctggctcgaaggagaagggaccccatgctccctctgggtcctccctatactgcccctcggccccctagccccagcctgcagcgctgcggaagcagatcagtaataaaaatgctccggatgtgcaggagataag

SEQ ID NO: 48083 - DNA, 601 bp, Human
ccgggttcacgccattctcctgcctcagcctcccgagtagctgggactacaggcgcccgtcaccatgcccggctaattttttgtattttagtagagacggggtttcaccatgttagccaggatggtctcgatctcctgaccttgtgatctgcccacctcgacctcctaaacctggctaatttttaaatgttttgtagagatagggtctcgctatgttgcccaggttgaattcctggcttcaagtgatcctcccacctcggcctcccaaagtgttgggattacaggcatgagccaccgcgcycggtcatatatatttttttaatgtcataaattttgaaacactgcttactagtaagaccataacagttcttatttccacaagaagcaagagaaagatcttttcccagcatcctgccctgcagtgggttgcagttctttttaacttttgccaatctgtcaggtgtaaagtgatatccccttgatacccttagcaacacatgtttctaagtcctaaatgtattaatcacgccatactcctttccagggcctaactcaaatttctgacccctttctgagaccctaaaacacacctcctaaaccc

SEQ ID NO: 48084 - DNA, 601 bp, Human
attttattttatttttatttttttctctattgcccaggctggagtgcagtggcgcaatcacgactcactgcaacctccgcctccctggttcaagcgattctcctgcctcagccttctaagtagctgggattacaggcatgtgccaccattcccggctaatttttgtatttttagtagagacggggtttcaccatgttggtcaggctggtctcgaactcctgacctcgtggtccacccgccttggcctcccaaagtgctgggattacaggcatgtgctaccgcgcctggccttaattcattmttttaaagagctgcatagtattctgtgttgtggctgtgctcctgtgctctcattcattttatttaaccatgtacctattgctgggtcattcagtttgtttcctaaccccttcaccgcaagcagggctgcaagcaacatcctccaacagatattctcacctcctggagtgactatttctgagacagattcccagggtggaattgctgggtggactggttgtgtgtctgtgtgtgtgtgtgtgtgtgtgtgtgtgtgtgtgttttgtttttgtttttattttttttgagacggattctcgct

SEQ ID NO: 48085 - DNA, 601 bp, Human
aaaatgacttctcgacacacctgtttgagcataacctgatttcctttttttttttttttttttgagagacagggtctcactctgtcacccaggctggaggcagtggtgcaatcatagctcactgcagcctcgatctcctgggctcaagtgatcctcccacgtcagcctcctcagtagctgggactacaggtgtgcaccaccactcagctaatttttgtttttgtttctgtttttagaggtaggtggctctcactgtgttgcccaggctagtctcgaactcctggcctcaagttatcctccygcatcagccctccaaagtgctgggattatacgtgtgaggcacagcacacagcccgatttgcaattttttaaaaattattttattttatttttatttttttctctattgcccaggctggagtgcagtggcgcaatcacgactcactgcaacctccgcctccctggttcaagcgattctcctgcctcagccttctaagtagctgggattacaggcatgtgccaccattcccggctaatttttgtatttttagtagagacggggtttcaccatgttggtcaggctggtctcgaactcctgacc

SEQ ID NO: 48086 - DNA, 601 bp, Human
atcagggcttgtacctgacctggctggtctcctcacctccctttccctgtcctacagctgaaaatgacttctcgacacacctgtttgagcataacctgatttcctttttttttttttttttttgagagacagggtctcactctgtcacccaggctggaggcagtggtgcaatcatagctcactgcagcctcgatctcctgggctcaagtgatcctcccacgtcagcctcctcagtagctgggactacaggtgtgcaccaccactcagctaatttttgtttttgtttctgtttttagaggtrggtggctctcactgtgttgcccaggctagtctcgaactcctggcctcaagttatcctcctgcatcagccctccaaagtgctgggattatacgtgtgaggcacagcacacagcccgatttgcaattttttaaaaattattttattttatttttatttttttctctattgcccaggctggagtgcagtggcgcaatcacgactcactgcaacctccgcctccctggttcaagcgattctcctgcctcagccttctaagtagctgggattacaggcatgtgccaccattcccggctaattttt

SEQ ID NO: 48087 - DNA, 601 bp, Human
caagtgcgcggccacggacacgatgctaaagtgcaggaggcagaggagggagaccatcaggcctgtgaagaccactcctgacgtcctcgtgtccttccagtacagcaggtccgccactgtggaggggtggggggcatcagggcttgtacctgacctggctggtctcctcacctccctttccctgtcctacagctgaaaatgacttctcgacacacctgtttgagcataacctgatttcctttttttttttttttttttgagagacagggtctcactctgtcacccaggctggaggcagtgrtgcaatcatagctcactgcagcctcgatctcctgggctcaagtgatcctcccacgtcagcctcctcagtagctgggactacaggtgtgcaccaccactcagctaatttttgtttttgtttctgtttttagaggtaggtggctctcactgtgttgcccaggctagtctcgaactcctggcctcaagttatcctcctgcatcagccctccaaagtgctgggattatacgtgtgaggcacagcacacagcccgatttgcaattttttaaaaattattttattttatttttatttttttctcta

SEQ ID NO: 48088 - DNA, 601 bp, Human
ggtgtcaagtataaccaggccacccccaacttccatcagtggcgcgacgctcgccaggtctggggcctcaacttcggcagcaaggaggatgcggcccagtttgccgccggcatggccagtgccctagaggcgttggaaggtcagaaatggcggcgggcaaaggggaccagtgaatgcggctgtgtggcctggggctgccgctttaccctgctgggacttggtttactcgtcggtaaaatagagcgaattcattgttatcatggaaaattatcactagcattttgtgcattccagtgtgacygtgtgcacctatgtgtaaaatgcaccattggcccggcgccgtggctcatgcctgtaatctcagcactttgggaggccgaggcacacggattacctgaggtcaggagtttcaccgtgcccaacatggtgaaattgcgtctctattaaaattcaaaaattagctgggcgtggtggtgcgcgcctgtaatcccagctattcgggatgctgagggacgagaagtgtttgaacccaggagatagaggttgcagtgagccgagatcaggccactgcacttcagcctggcgacagagcaagattccg

SEQ ID NO: 48089 - DNA, 601 bp, Human
aggctggtcttgaactcttgacctcaagagatccacctgcttcagcctctcaaagtgttggcattacaggccactgcgcccagcacaatctcttgaatttctaaaactagagtttccttaggttttcggagttccagaattctatgcgctaggatctacatttctagaactcccctcagaaggggatgggttgggtgacggaagcacgtgtttttgcttttctctcctgcagaaggaaagccacgcaagttggggagaaaacccccaaggatgaatctgccaatgtaagtcagggactctwcttgccctacatctcttaggccgtaccatgagggtagggatagtgggatgtgtggggtttgaacctgaaagaggaaatgggcagaggtgtggcaggggctggctcatggcagttttatttcctaccagcaggaggagccagaggccagagtcccggcccagagtggtgagtagagtgcccagtccagccacaggaactacaaatcccagaatactctgttctcacatgttaagcacccttataggagagtcagggcgaatggtgctggggattgtagtctcctgagatggggctttgatc

SEQ ID NO: 48090 - DNA, 601 bp, Human
gtagagatggggtgtcaccatattcgccagactggtctcgaactcctgacctcaggtgatccacctgcctcagcctctccaaagtgctgggattacaggtgtgagccaccacacccagcctcattcagtacattttgaataaattaacaaacctggggtgaggaaacagagctacaccaatacagccacagccccagcaagtagagctggggcactctcaacccacacactgctgtcgaatgaatgaatgaatgaatgaatgaatggggagaacaaagtggctggaactcagacctccttscactggagtcatccctagaacagcgtttcccactgaaaacctcaaggcctcacttctccgtctccctcctcacctgccgagggctcacaatgatgctgttggattttgccccgggtttcagggcctggttgggcgtctctcctgccaggggctctgaccctgtggggcacgtggccccagccccttccagaggctgtgagatggcatattcggcgtaggtctgaggggccgcctgggccgaggtgtccacagtgggaaggctctgtgtagatcggaataagggcttggcctgtggggaga

SEQ ID NO: 48091 - DNA, 601 bp, Human
cttcccacacctcctgcctcctcgcacctcttcccacacctcctccctcctcccacctgtggcagggtcttttccagcttctctctcctcctaaccctggacagtccctgatcctctgatccaggctcctcccctccatgcccactggcaccaggcctttcctaaagggtccccgggtctgtctccagctcagccctctccctccagccccagtctgcgtgtcctgtggtcctgaacacttcctgccctcacgcccagcaactttttgtgtttttagtagagatggggtgtcaccatattsgccagactggtctcgaactcctgacctcaggtgatccacctgcctcagcctctccaaagtgctgggattacaggtgtgagccaccacacccagcctcattcagtacattttgaataaattaacaaacctggggtgaggaaacagagctacaccaatacagccacagccccagcaagtagagctggggcactctcaacccacacactgctgtcgaatgaatgaatgaatgaatgaatgaatggggagaacaaagtggctggaactcagacctccttccactggagtcatccctagaacagc

SEQ ID NO: 48092 - DNA, 601 bp, Human
cccccagcccctccttcctgagacccaggagttcgggctccagctcttgttgcactgggcacctccaggccaagaccccctgcctccaacacagggtcccaccaaggcccagaacctgcaggaccatgcccagaggcttctcatagaacagtccagaacactgggacatgaccctcccaggccagtggggtgcccttcctgaagtctggggtggcgccgcagagctcacctgaggaacagggcacaggtgctctggcccagcacatagtcgggaattacgtcgccaaattcccagggcacrttgcgcacgaacttcagtacgggattgcccctctggggagggacgaagggcagaagccatcaatagggatgacccttgataaccacagggccctcctccacctcttcttgcacctcctccctcctcccacctcttcccacacctcctgcctcctcgcacctcttcccacacctcctccctcctcccacctgtggcagggtcttttccagcttctctctcctcctaaccctggacagtccctgatcctctgatccaggctcctcccctccatgcccactggcaccaggcctttcctaaagg

SEQ ID NO: 48093 - DNA, 601 bp, Human
gagtccaggcccccagcccctcctccctgagaccccaggagtccaggcccccagcccctcctgcctcagacccaggagtctaggccccagcccctcctccctcagatccccaggagtccagccctcagcccctcctcccccggacccaggagtccggcccccagcccctccttcctgagacccaggagttcgggctccagctcttgttgcactgggcacctccaggccaagaccccctgcctccaacacagggtcccaccaaggcccagaacctgcaggaccatgcccagaggcttctcayagaacagtccagaacactgggacatgaccctcccaggccagtggggtgcccttcctgaagtctggggtggcgccgcagagctcacctgaggaacagggcacaggtgctctggcccagcacatagtcgggaattacgtcgccaaattcccagggcacattgcgcacgaacttcagtacgggattgcccctctggggagggacgaagggcagaagccatcaatagggatgacccttgataaccacagggccctcctccacctcttcttgcacctcctccctcctcccacctcttcccacacc

SEQ ID NO: 48094 - DNA, 601 bp, Human
aagggctcagagtacggcatgggggacagagggtcctgaggcccacagagggtaagtcacttgccccaggtcactcttccaagaagatgctccgcagggattggcagccagggccacatggctgtgcttacctagaagaccagacccctggcttcttcatgaagaggggaagagacttgggcttcaaggggagaacaggtgccaggggccctagagagtgtgggcacggggacactgcatggctcgcggtgggaagcagggcccactgccaaaccatctgctctggccttggagggctacrgtgagggcttcatgacccagggaactaggactggctctgcccagcagtctgcagctgtcacagcctgcagggagcacaggaactcagaggtttcacttcctctgtctggccctgtctgcagaggggcccctaggttggaggggaaagttgtttaactagggtagagatgggagaaatcctgcttctcatcaactccagtcaaggatgtctgggacatgagtgacccagtccctcctccgtcagatccaggagtctgggcccagcccctcctcccttagacccaggaatctggccccagcc

SEQ ID NO: 48095 - DNA, 601 bp, Human
cgccattgcactcccgcttgggcaacaagagtgaaactccatttcagaaaaaaaaaaaaaaaaaggccgggtgtggtggctcacgcctataatcccagcactttgggaggctgaggtgagcagatcaccaggtcaggagatcgagaccatcccgactaacatggtgaaaccccatctctactaaaaatacaaaaaattagccgggcgtggtagcgggcgcctgtagtcccagcttttcaggaggctgaggcatgagaatggcgtgaacccgggaggtggagtttgcaatgagccgagatcrcgccactgcactccagcctgggcgacagagccagactccgtctcaaaaaaaaaaaaaaaaaaaaaaacaattgtggttgctaaaaatcaaaattccagcccatcccccgccaaatacaacctggtagtaaccactgctgggcgcatcttgatatcttttctggctacaggccagctcttgggagcccaaccccacttctccctgggtaaccctgggccagtggtttgctctctgggcctgtttcctcactgtaaagtggggtggtcaggcatagtggctcatgcttgtaatcccagcact

SEQ ID NO: 48096 - DNA, 601 bp, Human
ccgcacctggcttagaagctttttaatttgatgtgatcccatttgtccattttgctttagtttcctatgcttatagggcattactcaagaaatctctgcccagttcaatgtcctggagagcttctcaatgttttcttgtagacgtttcatgcattgaggtcttagatttaagtctgtaatccattttaatttgatttttgtatatggcgagagatagctatctagtttcattcttcctcattggattgcttctgctttgagacaggatcgctctgtcacccaggctggagcgtagtaacaygcttatagctcactgcagcctcaacctcctgggctcaagcgatcctcccacctcagtctccccagtagctgagactacaggcacgtagcaagctcacaccaccatgcccagctagttttttttatttttagtaaaaatgaggtgtccacttgcccaggctggtctccaacttctggcctcaagcagtcctcccgccttggcctcccaaaatgttgggattacaggcggaagccactgtgtctggtctttggttcttttttcaccttaaaactttggggtctcaggttgtgtttatttggg

SEQ ID NO: 48097 - DNA, 601 bp, Human
cagtgctgggattataggtgtgagccactgcgcctggctaagttattattatttttttgagacagtctcctggtgtcacccaggctggagtgcagtggtgtgatcttggctcactgcaacctccgcctcctgggttccaacgattctcctgcctcagcctcccgagtagctgggcctaaaggtgcccaccactatacccggctaatttttgtatttttagtagagacaggggtttcaccatattggccaggctggtctcgaactcctgacctcgtgatccacctgccttgacctcccaaastgctaggataacaggtgtgagccaccgcaccctgccaagttattttaaaatgtaccattattattgactatagtcacctggttgtgttatcaaatagtatgtcttattcattctttctttgtgtgtgtgtgtgtgtgtgtgtgtgtgtgtggtacccattaaccttccccatctccctgccagcccctaactaccctccccagcctccaggaactatccatccactcttatctccatgagttcaattgttttgatttttagatacacaaataaataagaacatgcaatgtttgtctttct

SEQ ID NO: 48098 - DNA, 601 bp, Human
ttttttttgagatggagtctcgctctgtcgcccaggttggagtgcagtggcgcaatctcggctcactgcaagctccgcctcccgggttcacgccattctcctgcctcagcctcctgagtagctgggactacaggcccctgcccagctaattttttgtatttttttttagtagagatggggtttcaccacgttagccaggatggtctcgatctcctgacctcctgatgcgcctgcctcagcctcccagtgctgggattataggtgtgagccactgcgcctggctaagttattattatttttytgagacagtctcctggtgtcacccaggctggagtgcagtggtgtgatcttggctcactgcaacctccgcctcctgggttccaacgattctcctgcctcagcctcccgagtagctgggcctaaaggtgcccaccactatacccggctaatttttgtatttttagtagagacaggggtttcaccatattggccaggctggtctcgaactcctgacctcgtgatccacctgccttgacctcccaaagtgctaggataacaggtgtgagccaccgcaccctgccaagttattttaaaatgtacc

SEQ ID NO: 48099 - DNA, 601 bp, Human
ttttttttttttgagatggagtctcgctctgtcgcccaggttggagtgcagtggcgcaatctcggctcactgcaagctccgcctcccgggttcacgccattctcctgcctcagcctcctgagtagctgggactacaggcccctgcccagctaattttttgtatttttttttagtagagatggggtttcaccacgttagccaggatggtctcgatctcctgacctcctgatgcgcctgcctcagcctcccagtgctgggattataggtgtgagccactgcgcctggctaagttattattatwtttttgagacagtctcctggtgtcacccaggctggagtgcagtggtgtgatcttggctcactgcaacctccgcctcctgggttccaacgattctcctgcctcagcctcccgagtagctgggcctaaaggtgcccaccactatacccggctaatttttgtatttttagtagagacaggggtttcaccatattggccaggctggtctcgaactcctgacctcgtgatccacctgccttgacctcccaaagtgctaggataacaggtgtgagccaccgcaccctgccaagttattttaaaatg

SEQ ID NO: 48100 - DNA, 601 bp, Human
ggaaccagtcattaaaggagctgtttcctgggtaaatctagagtggggttttggttctttattttcccctataccctcaagcatctatccattgagttacaaacaatccagttacaatctttttaagttattattattattattattttttttttttttgagatggagtctcgctctgtcgcccaggttggagtgcagtggcgcaatctcggctcactgcaagctccgcctcccgggttcacgccattctcctgcctcagcctcctgagtagctgggactacaggcccctgcccagctaaytttttgtatttttttttagtagagatggggtttcaccacgttagccaggatggtctcgatctcctgacctcctgatgcgcctgcctcagcctcccagtgctgggattataggtgtgagccactgcgcctggctaagttattattatttttttgagacagtctcctggtgtcacccaggctggagtgcagtggtgtgatcttggctcactgcaacctccgcctcctgggttccaacgattctcctgcctcagcctcccgagtagctgggcctaaaggtgcccaccactatacccggctaat

SEQ ID NO: 48101 - DNA, 601 bp, Human
gcaggagcctggcctgggaggacgatttattattacactgggggtttccttggcagctggggtcatcagggtactttcaagaagggctcgtgcaggacatcaaacagcctccgggcctggatgggagggagaaaaaaatgaggaaccagtcattaaaggagctgtttcctgggtaaatctagagtggggttttggttctttattttcccctataccctcaagcatctatccattgagttacaaacaatccagttacaatctttttaagttattattattattattattttttttttttttgagatggagtctcgctctgtcgcccaggttggagtgcagtggcgcaatctcggctcactgcaagctccgcctcccgggttcacgccattctcctgcctcagcctcctgagtagctgggactacaggcccctgcccagctaattttttgtatttttttttagtagagatggggtttcaccacgttagccaggatggtctcgatctcctgacctcctgatgcgcctgcctcagcctcccagtgctgggattataggtgtgagccactgcgcctggctaagttattattatttttttgagacag

SEQ ID NO: 48102 - DNA, 601 bp, Human
gcaccagcgcagccagcaggagcctggcctgggaggacgatttattattacactgggggtttccttggcagctggggtcatcagggtactttcaagaagggctcgtgcaggacatcaaacagcctccgggcctggatgggagggagaaaaaaatgaggaaccagtcattaaaggagctgtttcctgggtaaatctagagtggggttttggttctttattttcccctataccctcaagcatctatccattgagttacaaacaatccagttacaatctttttaagttattattattattattwttttttttttttttgagatggagtctcgctctgtcgcccaggttggagtgcagtggcgcaatctcggctcactgcaagctccgcctcccgggttcacgccattctcctgcctcagcctcctgagtagctgggactacaggcccctgcccagctaattttttgtatttttttttagtagagatggggtttcaccacgttagccaggatggtctcgatctcctgacctcctgatgcgcctgcctcagcctcccagtgctgggattataggtgtgagccactgcgcctggctaagttattatt

SEQ ID NO: 48103 - DNA, 601 bp, Human
ctgaaggtgcccacctgggccaccagaaggtgacacccccagaatccctccccagagactgcaccagcgcagccagcaggagcctggcctgggaggacgatttattattacactgggggtttccttggcagctggggtcatcagggtactttcaagaagggctcgtgcaggacatcaaacagcctccgggcctggatgggagggagaaaaaaatgaggaaccagtcattaaaggagctgtttcctgggtaaatctagagtggggttttggttctttattttcccctataccctcaagcatytatccattgagttacaaacaatccagttacaatctttttaagttattattattattattattttttttttttttgagatggagtctcgctctgtcgcccaggttggagtgcagtggcgcaatctcggctcactgcaagctccgcctcccgggttcacgccattctcctgcctcagcctcctgagtagctgggactacaggcccctgcccagctaattttttgtatttttttttagtagagatggggtttcaccacgttagccaggatggtctcgatctcctgacctcctgatgcgcctgc

SEQ ID NO: 48104 - DNA, 601 bp, Human
aagaaagctgaaggtgcccacctgggccaccagaaggtgacacccccagaatccctccccagagactgcaccagcgcagccagcaggagcctggcctgggaggacgatttattattacactgggggtttccttggcagctggggtcatcagggtactttcaagaagggctcgtgcaggacatcaaacagcctccgggcctggatgggagggagaaaaaaatgaggaaccagtcattaaaggagctgtttcctgggtaaatctagagtggggttttggttctttattttcccctataccctsaagcatctatccattgagttacaaacaatccagttacaatctttttaagttattattattattattattttttttttttttgagatggagtctcgctctgtcgcccaggttggagtgcagtggcgcaatctcggctcactgcaagctccgcctcccgggttcacgccattctcctgcctcagcctcctgagtagctgggactacaggcccctgcccagctaattttttgtatttttttttagtagagatggggtttcaccacgttagccaggatggtctcgatctcctgacctcctgatg

SEQ ID NO: 48105 - DNA, 601 bp, Human
ctaccatcaaggcttctgtataaaaggcaaatgaggaggcagcgcccccttctgctcccacccccttctgctcccacccccttcatgtcagcagcagccaatcgcttttctctgtcgtgcagtcggctcctgggattggccagggacgggacaggcgcggaaccactgcgcgcacaggcggagcgcggagacttgtccgtcacgtgcggccgcccggcctctcggccttgccgcgcgcctggcggggttgggggggcggggaccaagatctgctgcgcctgcgttgtgggcgttctcgggragctgctgccgtagctgccgccgccgctaccaccgcgttcgggtgtagaatttggaatccctgcgccgcgttaacaatgaagcagagttcgaacgtgccggctttcctcagcaagctgtggacgcttgtggaggaaacccacactaacgagttcatcacctggagccaggtacggtcaggccacggcggcctctgaaccccctgaataaccgcctcctcactcgctctcctgcggggtggtctctcgcggccttgcggctcgacgctgtctgcgaggcccgcggtgcggggccttggcgt

SEQ ID NO: 48106 - DNA, 601 bp, Human
ccatcaaggcttctgtataaaaggcaaatgaggaggcagcgcccccttctgctcccacccccttctgctcccacccccttcatgtcagcagcagccaatcgcttttctctgtcgtgcagtcggctcctgggattggccagggacgggacaggcgcggaaccactgcgcgcacaggcggagcgcggagacttgtccgtcacgtgcggccgcccggcctctcggccttgccgcgcgcctggcggggttgggggggcggggaccaagatctgctgcgcctgcgttgtgggcgttctcggggagctgctgccgtagctgccgccgccgctaccaccgcgttcgggtgtagaatttggaatccctgcgccgcgttaacaatgaagcagagttcgaacgtgccggctttcctcagcaagctgtggacgcttgtggaggaaacccacactaacgagttcatcacctggagccaggtacggtcaggccacggcggcctctgaaccccctgaataaccgcctcctcactcgctctcctgcggggtggtctctcgcggccttgcggctcgacgctgtctgcgaggcccgcggtgcggggccttggcgttca

SEQ ID NO: 48107 - DNA, 601 bp, Human
catcaaggcttctgtataaaaggcaaatgaggaggcagcgcccccttctgctcccacccccttctgctcccacccccttcatgtcagcagcagccaatcgcttttctctgtcgtgcagtcggctcctgggattggccagggacgggacaggcgcggaaccactgcgcgcacaggcggagcgcggagacttgtccgtcacgtgcggccgcccggcctctcggccttgccgcgcgcctggcggggttgggggggcggggaccaagatctgctgcgcctgcgttgtgggcgttctcggggagcggctgccgtagctgccgccgccgctaccaccgcgttcgggtgtagaatttggaatccctgcgccgcgttaacaatgaagcagagttcgaacgtgccggctttcctcagcaagctgtggacgcttgtggaggaaacccacactaacgagttcatcacctggagccaggtacggtcaggccacggcggcctctgaaccccctgaataaccgcctcctcactcgctctcctgcggggtggtctctcgcggccttgcggctcgacgctgtctgcgaggcccgcggtgcggggccttggcgttcag

SEQ ID NO: 48108 - DNA, 601 bp, Human
atcaaggcttctgtataaaaggcaaatgaggaggcagcgcccccttctgctcccacccccttctgctcccacccccttcatgtcagcagcagccaatcgcttttctctgtcgtgcagtcggctcctgggattggccagggacgggacaggcgcggaaccactgcgcgcacaggcggagcgcggagacttgtccgtcacgtgcggccgcccggcctctcggccttgccgcgcgcctggcggggttgggggggcggggaccaagatctgctgcgcctgcgttgtgggcgttctcggggagctactgccgtagctgccgccgccgctaccaccgcgttcgggtgtagaatttggaatccctgcgccgcgttaacaatgaagcagagttcgaacgtgccggctttcctcagcaagctgtggacgcttgtggaggaaacccacactaacgagttcatcacctggagccaggtacggtcaggccacggcggcctctgaaccccctgaataaccgcctcctcactcgctctcctgcggggtggtctctcgcggccttgcggctcgacgctgtctgcgaggcccgcggtgcggggccttggcgttcagc

SEQ ID NO: 48109 - DNA, 601 bp, Human
aaggcttctgtataaaaggcaaatgaggaggcagcgcccccttctgctcccacccccttctgctcccacccccttcatgtcagcagcagccaatcgcttttctctgtcgtgcagtcggctcctgggattggccagggacgggacaggcgcggaaccactgcgcgcacaggcggagcgcggagacttgtccgtcacgtgcggccgcccggcctctcggccttgccgcgcgcctggcggggttgggggggcggggaccaagatctgctgcgcctgcgttgtgggcgttctcggggagctgctgccgtagctgccgccgccgctaccaccgcgttcgggtgtagaatttggaatccctgcgccgcgttaacaatgaagcagagttcgaacgtgccggctttcctcagcaagctgtggacgcttgtggaggaaacccacactaacgagttcatcacctggagccaggtacggtcaggccacggcggcctctgaaccccctgaataaccgcctcctcactcgctctcctgcggggtggtctctcgcggccttgcggctcgacgctgtctgcgaggcccgcggtgcggggccttggcgttcagcctc

SEQ ID NO: 48110 - DNA, 601 bp, Human
gcgggggcccggccggcagcgccgctctcctcaggccgcggtgggggaggggcggcccgcgcggggcgtagcggcccaggcagccccttaacggtccggtccgcgttcggaaccggcccggcgtcgcgaggggaatcggcgagccgagggcgcgggagcctctttactgcacactcatcctccgtcctcccgcccggctcaggggttacaaatcgcggaggggacagggagcccagggccaggatcatcaacgtggggctttataggaggcgatctttacctcagcgaccgatcacccccrgttcccccaacattgctttgcatctggcatctttatgtggagagcagtcagggcaataggcatacgttcaaacgcaggttactgcttatcagttggttttaaaaatatatagaaattaacaaattattcttttgagattctgtgctatttgtataatgggattattaggattgttttaataaagtactaataggtggtaacttagtagttactaaatttcgctgaacagttaccagcagaggggcatatcgatgtgttgattattggtttgatctcaactctgcttctaaacaagcatga

SEQ ID NO: 48111 - DNA, 601 bp, Human
gcggggcgtagcggcccaggcagccccttaacggtccggtccgcgttcggaaccggcccggcgtcgcgaggggaatcggcgagccgagggcgcgggagcctctttactgcacactcatcctccgtcctcccgcccggctcaggggttacaaatcgcggaggggacagggagcccagggccaggatcatcaacgtggggctttataggaggcgatctttacctcagcgaccgatcacccccagttcccccaacattgctttgcatctggcatctttatgtggagagcagtcagggcaatagrcatacgttcaaacgcaggttactgcttatcagttggttttaaaaatatatagaaattaacaaattattcttttgagattctgtgctatttgtataatgggattattaggattgttttaataaagtactaataggtggtaacttagtagttactaaatttcgctgaacagttaccagcagaggggcatatcgatgtgttgattattggtttgatctcaactctgcttctaaacaagcatgaccttagtccagccctttatcttgtctggcctaagttaaatctttcataagatggatgggt

SEQ ID NO: 48112 - DNA, 601 bp, Human
actgagattctctccccacgaaagctgactttatcatacctttttgtcttttatgggccagaaataggggctatatatattggcagttgcttttaatcagagtatcatgtcagtggtaggcctattaaattctgattagcaacagtgttttaataacattcttattttctgagtactgtcaaatgtggagagtttcgtactgatccgtaaatgcatcattctatgagttctaagccaaataaacaagccacttaaccattttttaatcccattattaactttaagcttatgtgttaaccarttttctaatatgccagtgggacaatcaaaatgtaagctcagtgagatcactgtgccagagacacactaggtgtttaataattgtttgatgaataaatgagatccctcgaaaatgtaatggagtggtaggaatgatgaagataaaattatatttgaaatgactcttagagatcatctaggttagccttatcattgtatagatgaggatttgaggcttggacaggtgagattatttatccataattatacagctcgccaagattggagataagaccctaacataagcttgtccaacccgagg

SEQ ID NO: 48113 - DNA, 601 bp, Human
accattgcattatattagtatttcaaagtgaaaataagaaagactacaagtgtgggaggatgggggtaaaatccaacttagatggacctgcagaaaagttgaaagattgattttcaagtatttttatttgtatatataagagaaagaatgagctaaagactctaaaagagtagctggtgcatattaaaaattatagattagcaagccacaaatttctgttccgaaaaatgttttaaagtaatgtggctgaagtattagattattaggaatattttgagtgttctaacaagagtgccaaaagtaatttggagagtaacgactgtttctactctttggactcttgccaacatttgtgggtaaggtttaaggagaaggtgcctatctttcccacctcactcagtagtagttttctcatccttgtaaaatacttagggagattctgtgttgtattgcttgaacctcacaggtttaaaagacaggaaggtgaatttttgcactcaaagaagttatttactaattttagaatagagactgagggaatacaataagcagagatagagtgatgtgaatgaataaggagtgtatgtgagagagagtgagc

SEQ ID NO: 48114 - DNA, 601 bp, Human
aggaatattttgagtgttctaacaagagtgccaaaattaatttggagagtaacgactgtttctactctttggactcttgccaacatttgtgggtaaggtttaaggagaaggtgcctatctttcccacctcactcagtagtagttttctcatccttgtaaaatacttagggagattctgtgttgtattgcttgaacctcacaggtttaaaagacaggaaggtgaatttttgcactcaaagaagttatttactaattttagaatagagactgagggaatacaataagcagagatagagtgatrtgaatgaataaggagtgtatgtgagagagagtgagcacaggtatagcaagagattattgtcatctccctattttatataatcaaatagttgaaattctaaaaattcagtttatttggccaaagattaatttagtcagtcacaggtatttgttatgaatctgttatgacctaatattgtgctaggtatcaggaattcattcagtagtgaaccaaagtgcctacctttatggagcttacattgagtggtggatatcaataaatagtaagcaaatacaagctgggtatggtggtgcatgtcgt

SEQ ID NO: 48115 - DNA, 601 bp, Human
tgtcggttaagatgcaatcataagtcagaagccacaggtattttcaagagggtaagtttaatagagttactgactatatcagggaaattaaagaaaattaaaagaatacaagaatagttttaagaagcagccactactgatagggctgagatagagtgcccaagtaagaaccttttttgccaaggctaagattcttaccttattggaaggaatatggccatgactcagtagcagagcagtcactggtgttgctctggtggaacttactggaaatgcatccttcaaaacttggtgggaaatwtgccctctaggtcacgggttggcaaactgtagtccttttgccagctgttttataaaaaaaagtttaaatagaacacagctatgcccaatctatttacatattgtctgtatctgctttctcactacaaaggtagagttatgatgttataatctgcaagcctaatttactatttgtccctttaagaaaaagtttataaatccctgttctggagtactctaaaaaactgtttatggggagatatcttgttagagatactctgctttgaaacctcccaagggagaggaagcaccagtgaaagct

SEQ ID NO: 48116 - DNA, 601 bp, Human
gatacatgagtcaggaacaagagctcctttttcttgtaatatctctcttttatcccctgctgacagaacttaacatcatggcacctagaaaaagaaagatatttatttaaggaaccaagctctatgcttgtagagcagacaatgaagaatgaatttggagcaataaattgataactggcccataaacagactaggatttgtgaatattttaggtaaggtgatgaggaaagcctctccaaggagacgatgtttgaggagagatctaaatgattagaaaagatgggccaaaggggaatgacawaaggtaaggccttgaatgtggctgttcaaggaagcaggaaggcccatgtgattagaatatctttagggaattaggagagtgagagtagggaggtaggcaggagcagatggtatagggccctagatctatagtaagaagattggaaatgaggggaccagttagaagactatcacagttttcctgtatggtattgaaaatattgatggctgagactaaggtagcagcagtcaaggtattgagatgtagctttgaaatctttgaaggcaaagctgcaggatttgctgataaattgataaattg

SEQ ID NO: 48117 - DNA, 601 bp, Human
aaacagactaggatttgtgaatattttaggtaaggtgatgaggaaagcctctccaaggagacgatgtttgaggagagatctaaatgattagaaaagatgggccaaaggggaatgacaaaaggtaaggccttgaatgtggctgttcaaggaagcaggaaggcccatgtgattagaatatctttagggaattaggagagtgagagtagggaggtaggcaggagcagatggtatagggccctagatctatagtaagaagattggaaatgaggggaccagttagaagactatcacagttttcctrtatggtattgaaaatattgatggctgagactaaggtagcagcagtcaaggtattgagatgtagctttgaaatctttgaaggcaaagctgcaggatttgctgataaattgataaattggctatggttggaggaacgacaattaaaaatgattcataaatttggtttgaactacaggataaatccatttgctgaggaaagatgttagagattctttttggcatattaactttgagattaaaaatggatctctagtagtatttgaaacaacttgaaaattgtttaatttttcttaaatttgac

SEQ ID NO: 48118 - DNA, 601 bp, Human
gtaaagcattgtctcaatgaggttttgatttatattttcttgattattaatgagttctaaaaccttttcacgttcgttggccatttgtgtttcctgttctgtgaaatgtttgttttgccatttttctgttttttttttattatttgtgagaattcctatatattctacatattcgagtttatgttttggccatatcttccagtttgtggctttttacattttagttgtctagcacctttactgagtagttcttccttttccaatgatctatattgccacttctatcttacgtcacaagtaygtgtagatattgtcttaatcagttgggctgccgtagcaagatatcatagaccaggtggcttcaacaacaggcgtttattttttacagttctggaggtggagaagtccaagatgaaggcagtggccatttcagttcctgtgttagagctttctctgctttgcagacagctgccttctctctgtgtcttcccaatggcagagagagagagagagagagagtgtgttctggtctctcttatcttataaggacactaacctaacctggggggtcctatcttcattacctcctctgaacctaatt

SEQ ID NO: 48119 - DNA, 601 bp, Human
tcgttggccatttgtgtttcctgttctgtgaaatgtttgttttgccatttttctgttttttttttattatttgtgagaattcctatatattctacatattcgagtttatgttttggccatatcttccagtttgtggctttttacattttagttgtctagcacctttactgagtagttcttccttttccaatgatctatattgccacttctatcttacgtcacaagtacgtgtagatattgtcttaatcagttgggctgccgtagcaagatatcatagaccaggtggcttcaacaacaggcrtttattttttacagttctggaggtggagaagtccaagatgaaggcagtggccatttcagttcctgtgttagagctttctctgctttgcagacagctgccttctctctgtgtcttcccaatggcagagagagagagagagagagagtgtgttctggtctctcttatcttataaggacactaacctaacctggggggtcctatcttcattacctcctctgaacctaattacctcccaaaggccctaactccaaataccatcatatcaggggcaagggtttcaacatagaattttgggggaca

SEQ ID NO: 48120 - DNA, 601 bp, Human
tttttctgttttttttttattatttgtgagaattcctatatattctacatattcgagtttatgttttggccatatcttccagtttgtggctttttacattttagttgtctagcacctttactgagtagttcttccttttccaatgatctatattgccacttctatcttacgtcacaagtacgtgtagatattgtcttaatcagttgggctgccgtagcaagatatcatagaccaggtggcttcaacaacaggcgtttattttttacagttctggaggtggagaagtccaagatgaaggcastggccatttcagttcctgtgttagagctttctctgctttgcagacagctgccttctctctgtgtcttcccaatggcagagagagagagagagagagagtgtgttctggtctctcttatcttataaggacactaacctaacctggggggtcctatcttcattacctcctctgaacctaattacctcccaaaggccctaactccaaataccatcatatcaggggcaagggtttcaacatagaattttgggggacacaaacattcagtggttttgtttctggagtctttatgccattccattg

SEQ ID NO: 48121 - DNA, 601 bp, Human
ggtagaatggaagacacaagaaaagattgacttccggggaaacaggaaatgggtttagaacatactgagttaaagaacatagtgtaaaaaatgttaacattttaaattgaagtgtgtaatttgagatgatcagggacagagctgtagatgtgtttattataaaataaagtcaataataagataccctactgtggatgaattctaaggaaagaatatgaatggtgccacgattaaggataaaaacctggaaaatacagctacctcttatttgataggtggaagaaaattgaaaggaaatatragagataagagactcaacagtgtttagcatcaaagcccagagagtcgaacatttaaggaggagattgttagttgtaccaaatgaaatgccacagagaggtgtaggaagatcaggactgaaaagagggcattgaatttgatatttgacattttagaaatctggtttcagtcgagtgagggaaccaaaagcagttttcagtgagagtaagtggatggtcctgaattggagaaggggggtttaaaatacctgcttgttaaattttgcagttaaggaaaagacagatgggtagaatgaaaaaga

SEQ ID NO: 48122 - DNA, 601 bp, Human
aggaaatatgagagataagagactcaacagtgtttagcatcaaagcccagagagtcgaacatttaaggaggagattgttagttgtaccaaatgaaatgccacagagaggtgtaggaagatcaggactgaaaagagggcattgaatttgatatttgacattttagaaatctggtttcagtcgagtgagggaaccaaaagcagttttcagtgagagtaagtggatggtcctgaattggagaaggggggtttaaaatacctgcttgttaaattttgcagttaaggaaaagacagatgggtagawtgaaaaagaaggtataagagggaaagttcttttaagataggaaaagacgtatgcattttaagcattttaattttgataattacctagttgccaatactggttattgtcaagggttgtaaatttaatctaataagggaaaatcattatttgttttgctctacattcttcatttatgagtctgggtctcttctaaatttcacaatgtgtttttcatcaaaattgtgtttctgttaggaagaaagtagaggagagtagagatagagtaggaagctagcagtctccatggataaatttatattt

SEQ ID NO: 48123 - DNA, 601 bp, Human
attattattgggatattttattccattttagtttctaatttttttaattgtggtaaaatatacataacataaaattaaccattttaagtgcattaagttagattcacattgttaggcaaccattaccaccatccatctccagaacaatttttatctttccacactgaaactttatacccatttcacaataacttctaactccttcctccccgcagcccctgacaaccaccattctactttttgtctctgaaattggctattatggaaacttcatataaggggaattgtacagtatttgttsttttgtgactggcttatttcacagcataatgttttcaaagttcttttcatgttgtagcttgtgagaatttccttttttaggtgaaataatatttcattgcatgtatataccatactttatccatatatatttcaccatgtgttggtggatactgaagttacttctaccttttgcctgttgtgaaaaatgctactgtgaacatggggtacaaatatctgttcaagtcgttgcttttatggttttttttgttttgtttttttgttgttgtttttgggttttttttttttttttgagtatata

SEQ ID NO: 48124 - DNA, 601 bp, Human
tagggtattgacctggagtgtgcttggccaagatttttatttcagctgttgaaagtacagaaatgcacaactgttccttgttgggatgaattaggataataaagttttacttgtttccctgtatttttttcctaagttagcttaaaaaaaaaaaaaagtttaagttcctgctagaatatgagctccctggaagactttttctatagtttgtaattgtacatccagtacctacaataagtctcttctaataatataaatatgcccacatagtaggcattcagaaatacattcagtaatatattttttaatgcataatatcttttggtaaaataagatattttactaaatctgtaaaaggggtggaccatgaaagaaaatggcctagcatgaaccttttactgcataaatttaattaaatgtggaatgtggtaataaagaggcttgggggaaattgcaaggagcttggcataaggggagaataaaagactctaagatattcctgcttgcggaaactttttaacattaaaaaaaaatttttttttaagtagattattccttgcgttctctcccattgagctctgaagtttattctttccctagc

SEQ ID NO: 48125 - DNA, 601 bp, Human
ataagtctcttctaataatataaatatgcccacatagtaggcattcagaaatacattcagtaatatattttttaatgcataatatcttttggtaaaataagatattttactaaatctgtaaaaggggtggaccatgaaagaaaatggcctagcatgaaccttttactgcataaatttaattaaatgtggaatgtggtaataaagaggcttgggggaaattgcaaggagcttggcataaggggagaataaaagactctaagatattcctgcttgcggaaactttttaacattaaaaaaaaatttttttttaagtagattattccttgcgttctctcccattgagctctgaagtttattctttccctagcatttcatcccgggcttttggaaccagatctcacttcctgaacaggctacgaaaacctcttctaatagggaagctttgaattacaatcatgggtgtttactgtttctttgattttctaaatttactttttcaaaggtttcatcttcaaaaccagaagaaaataaaattcgtcaggaagatttaacaaaaattataagtagtgctcagaaggttcagataaaacaggaaactatt

SEQ ID NO: 48126 - DNA, 601 bp, Human
cataatatcttttggtaaaataagatattttactaaatctgtaaaaggggtggaccatgaaagaaaatggcctagcatgaaccttttactgcataaatttaattaaatgtggaatgtggtaataaagaggcttgggggaaattgcaaggagcttggcataaggggagaataaaagactctaagatattcctgcttgcggaaactttttaacattaaaaaaaaatttttttttaagtagattattccttgcgttctctcccattgagctctgaagtttattctttccctagcatttcatccygggcttttggaaccagatctcacttcctgaacaggctacgaaaacctcttctaatagggaagctttgaattacaatcatgggtgtttactgtttctttgattttctaaatttactttttcaaaggtttcatcttcaaaaccagaagaaaataaaattcgtcaggaagatttaacaaaaattataagtagtgctcagaaggttcagataaaacaggaaactattgagtccaggctttctgaattaaaaaggtaaagtgttatttccaaatataattttaatctgggaattgggtatgtgtc

SEQ ID NO: 48127 - DNA, 601 bp, Human
ttcatcttcaaaaccagaagaaaataaaattcgtcaggaagatttaacaaaaattataagtagtgctcagaaggttcagataaaacaggaaactattgagtccaggctttctgaattaaaaaggtaaagtgttatttccaaatataattttaatctgggaattgggtatgtgtctatgtgtgttgagtttggaggttgtctgatgttttattgtaagtactcagatcactttgttgaagccaagatcaaaggtcatttttctgcaagtattggttccctttactttgatttgtggccactractttactctaatattgttttaattatgatagtcagaagaagatataaacctaagcgtatcaaaacagtttgatgtataagtcttagcaataaacagtaggtctttaagatgatgtaggaaatatgattctatttaggttagctcatatggtgctcatagacaatgagggcatacgacataaaaaccctgtatgttacccatcctttgtttaatggctgtctcttaagatttctttgtgtggactcttaggaaaaagtaggacacaaaaaaatcggaaaacgatgcaggagagttgccat

SEQ ID NO: 48128 - DNA, 601 bp, Human
tgtaagtactcagatcactttgttgaagccaagatcaaaggtcatttttctgcaagtattggttccctttactttgatttgtggccactgactttactctaatattgttttaattatgatagtcagaagaagatataaacctaagcgtatcaaaacagtttgatgtataagtcttagcaataaacagtaggtctttaagatgatgtaggaaatatgattctatttaggttagctcatatggtgctcatagacaatgagggcatacgacataaaaaccctgtatgttacccatcctttgttkaatggctgtctcttaagatttctttgtgtggactcttaggaaaaagtaggacacaaaaaaatcggaaaacgatgcaggagagttgccatgcttgatacttatttcgtatagacttggaaaagtgttattcagagcttttatctacagaaagatgcttcgttttattttactacatttcttggttaccattattgtaacttgccatactaataacttgtgtatagagtagatagtgtattactcttcttagtaagtagctggaatttttctgtatcctaataggtgccaagggcttaagag

SEQ ID NO: 48129 - DNA, 601 bp, Human
cttttatctacagaaagatgcttcgttttattttactacatttcttggttaccattattgtaacttgccatactaataacttgtgtatagagtagatagtgtattactcttcttagtaagtagctggaatttttctgtatcctaataggtgccaagggcttaagagtggttactttacatattctctcttccatatcagatgtgagacgttactttagttaatcataactcaaatatcttcattaaaagaggaacctataactttgatttcttttttaaataagctttaggctttctcttyttgtgtatttaacaacttgtttactgtatgtatcttgtgtatactagctgctctttgacccagttccttgggaccacagtttcagcctttaaagaaagtgatccccaaatcattttttgtaccttagagggaactttcttctccttatctttttgtttgtttgtttttgttttgagacagtctcactctgttacccagtctggagtgcagtgacttgatcttacctcactgcaatctccgcctgccggttcaagcgattcttgtgcctcagcctccctagtagctgggattacaggcatg

SEQ ID NO: 48130 - DNA, 601 bp, Human
ctaataacttgtgtatagagtagatagtgtattactcttcttagtaagtagctggaatttttctgtatcctaataggtgccaagggcttaagagtggttactttacatattctctcttccatatcagatgtgagacgttactttagttaatcataactcaaatatcttcattaaaagaggaacctataactttgatttcttttttaaataagctttaggctttctcttcttgtgtatttaacaacttgtttactgtatgtatcttgtgtatactagctgctctttgacccagttccttggkaccacagtttcagcctttaaagaaagtgatccccaaatcattttttgtaccttagagggaactttcttctccttatctttttgtttgtttgtttttgttttgagacagtctcactctgttacccagtctggagtgcagtgacttgatcttacctcactgcaatctccgcctgccggttcaagcgattcttgtgcctcagcctccctagtagctgggattacaggcatgtgccagctaatttttgtatttttagtagagatggggtttcactgtgttggccaggctgttctcaaactcctg

SEQ ID NO: 48131 - DNA, 601 bp, Human
aacatagtgagaatgagtccctttggaaggaggtgtcagaattacgagcaaagcatgcacaacagcaacaagttattcgaaaggtaagaagctcttttccccaggaccataatttgcatttgtttaatgagtactgtttgtgacccaaaaaggtctttattgagtgtctgtgattgatcttagtttcttacatattggatgcacagatagaagtaaaaaatgaaatgaaattaagccaagtgttacacatttttaataaaaaatttctcactagctaaagatggttattccatactcgcakataatgtctcagtagcttttagtaaatgatcttttgcctaatataacaattttgaaatactttatttttatgagcataatgaatacactaccaatttcttttaaaattagaaaacatagccttactggttttttttgttggtttttattataaaaggcatagttaaggtctcagaagataaatgacaaatattttcaaatcagttgaccaaattatgagttcagaaaatgatttctcaatgtatgctgttattagtctgtggagaaaagcagttaacatagtgttgtaaaatgaatttta

SEQ ID NO: 48132 - DNA, 601 bp, Human
atctgagctgaaaatttaatagaggagttggaatccctccgtttcattgtgtccttgtgatttaatctttgcatatcagctttcatttgctaataagagatgaaacatagtaattaaggcagctattttttgctcatgagtaaactagactctgagtttaagcaacaggttttttgagggggagcttctgattgctcctgcttagaaggcccttgaactaaaaatagggttgtgactgacaggatcagggtctaatggagaaggctttaaagcagagatgagtagcagttgcagcctgtarcctagtcaacatagatttactgtgtttttttttttttttaaagtgtgcaagtgaaggttgaatgtagtagaattcagttctaagtgtttagtccaagtacatgtatttttaaaactttcataggcaactctaatgtgcagcctggttaagaatagttgacttaaaacaatagatgtaccttaacctgtactttatggaaacagtctgttaatacttttcagaaacagtgttttggtaatatattagcttacaacactctataatgtgtagattttttttttcctgaaagcaagaatagtt

SEQ ID NO: 48133 - DNA, 601 bp, Human
ctagctgttaacattttctcttgaataagcaatttagtggctaccctccttttcatagactctaatactatgaacctcttcagttaaaatgtctatatttttttccattgaaaaattgatattgattataaggcagaccatttagtagccttttttgtaaggaaatgctcactgttagaacctgtacaatagatatttttaattgataatactctatttaatcatgtaacttcacaaagcttataagcacactttctgcacagagtctaaatagtgctccaatcaattttggcttttattyatagcttctcagtgatatactactttttatagtttaccatatgatcctcaccttttatagcacctttaggaagttggcaatgtaatttcaagacatactctaagccagtagttcttatactcacatcagtatccagtctacactaaagggttttctaaacatactggatcccatgatccgaatttcagattcagcagttctgtagtaggattgagaatttaacatatccaaagttcctaagctagtgttcctggtattatgggccacactttaagaaacactactataagatatgaaagc

SEQ ID NO: 48134 - DNA, 601 bp, Human
cagcagttctgtagtaggattgagaatttaacatatccaaagttcctaagctagtgttcctggtattatgggccacactttaagaaacactactataagatatgaaagcttgtttgtgtgtcttcacaattttctctctaaatttaattaaatattaaagattagcttcccttgtcagtaggaagttttgacagataggtctcaacattaatctttatagaatcagacaataaacttttatctttttcttttttttctttggttgcaagcagagtttgtttgtttagaaatggagcatcaygatgttgcccaggctggtctccgactcctgggctgaagcaatcctcctacctaggcttcccaaagtgttgggattacaggcatgagccaccacgcctggcccatcacctttttctaactcgaaaatttcatgattattctgaaggaactgacggtttattttgcctctgttacctggtataagaaaaatgttgcctatcaaacaccagttttctcttttgcaccgtagtgtaatcttcaaagtacttgaagtaaaaaagttgggatctatagccaggcaagtttggtacttatcaccaaa

SEQ ID NO: 48135 - DNA, 601 bp, Human
gttcctaagctagtgttcctggtattatgggccacactttaagaaacactactataagatatgaaagcttgtttgtgtgtcttcacaattttctctctaaatttaattaaatattaaagattagcttcccttgtcagtaggaagttttgacagataggtctcaacattaatctttatagaatcagacaataaacttttatctttttcttttttttctttggttgcaagcagagtttgtttgtttagaaatggagcatcacgatgttgcccaggctggtctccgactcctgggctgaagcartcctcctacctaggcttcccaaagtgttgggattacaggcatgagccaccacgcctggcccatcacctttttctaactcgaaaatttcatgattattctgaaggaactgacggtttattttgcctctgttacctggtataagaaaaatgttgcctatcaaacaccagttttctcttttgcaccgtagtgtaatcttcaaagtacttgaagtaaaaaagttgggatctatagccaggcaagtttggtacttatcaccaaaacaaataaactgcctggaagctggtatgtttctttagacgg

SEQ ID NO: 48136 - DNA, 601 bp, Human
tggatttcaagtgttaatatgtgagaaattatgagacttagaggacaaattattatatgaatttgttttataagacttggtaatagagacaaaagaattaacagtataatgaaataatttttgtttatatttttttcagattgtccagtttattgttacattggttcaaaataaccaacttgtgagtttaaaacgtaaaaggtaagtttttatgataaagtattatgtcctgtatataggcagtcacactttttagtgtttaaccatgagtagcctacacttgctgagtatgtgcttgttktccaaaaagaacaattctcctttgttaaattatactcttaaaatctctagagtagtattattttttagttttatcattctgctgatgtttgtgagagataagggtagcctaaatggtcactttatagacatacatacagttaatacaaaatattcacttttcattcacattattaaagtagcattagaaggcctgagtgaaggaaatttttaaaaagaggccatatgttaaaaaaaaaatgaaaatttgttttacttgacctctcttagtttaagccactcatagtctttttaaatctgt

SEQ ID NO: 48137 - DNA, 601 bp, Human
tctcctttgttaaattatactcttaaaatctctagagtagtattattttttagttttatcattctgctgatgtttgtgagagataagggtagcctaaatggtcactttatagacatacatacagttaatacaaaatattcacttttcattcacattattaaagtagcattagaaggcctgagtgaaggaaatttttaaaaagaggccatatgttaaaaaaaaaatgaaaatttgttttacttgacctctcttagtttaagccactcatagtctttttaaatctgtatctcagccatgggtygtgatacctgtaaatgtcagtagctactattgtcacagctaaaacattagaagaataatggacaaaaggaatagttggaaggaaaaaatgatctgtaacactaagatttgggaaaaacttgattatgatcagagctttatggccttaactacttccactaattagttcttatgatattatctatttttttctatataaatacagttcatagagttgtgtggttcggtaagcaatgaagtataactggagagaatagcttattataacaaaaagagtgtagaaaagtggagaactgaaagt

SEQ ID NO: 48138 - DNA, 601 bp, Human
tcgaactcccagactcaagccatctgcctgcctcagcctcccaaagttttgggattacaggcatgagccactgcacctggcttactcatttcaatattatataataattgaatattttgaaaatgtaattattataatttaatgtgattatatattcttacattggttattctattttcaacttttttttattaatgttcaccaactagaatgctttttactccagcaatttaaatttttaccttcattttgtcacaggctttctggataatttgtcagatttctatccagtggcaaattrgtccagtccaaagtccagatcttttttattatctttttgttactactttcaaacttcagaattcaaaatagttctttagatttattattaaagtaataagatttttgttcttggacaatcaaacttaacctcacatctgatttcttttccctctactgttagaaaataatcaagcatacctattttgtttttaggattgaaggctcatgtaagtggatgaagatttttatatttttaactgggtttatatattttaaagtacttcacatcctttgcctctttattatctagtattggaat

SEQ ID NO: 48139 - DNA, 601 bp, Human
tctttattatctagtattggaatttatagttttttgcattttaataatgactttagtttgctttacaggattgaacttagtttgattaatacagctgtagcctgaatatatctgtagcttaagtttaaaaaaaaatcattgctaaaaagccaagctaacatgtaactgagagaggtgaagtgcgtttttttctcttagtgaaggtatttaatgaataagaataaaacacatttcaaaacagagcatcttgagctgaaacaatatccctatcagcatggtggctgtctggtcgtgcttgaartttctagtgaagtcctaagacttttttactctttaggcataaaaaatactttaaaatttgaagatctttccatagaaacatttttaggggtgtcatcttcagggtcccttacagtaaaagaagtagtaaagtgtagaatgcagttaatatacctcatacctctgtgaattggtgctgctagtaccaattattatgtaagttccgtaagagcagagaacacacctgttttgcataccccgagattcagtaaatagtagttgcctagttattttgtagatgatatcttgtttggtagtcaat

SEQ ID NO: 48140 - DNA, 601 bp, Human
aaatagtagttgcctagttattttgtagatgatatcttgtttggtagtcaatgattttgatttttagatatatttttctctctgaatttttaggttccacacagtaggactgaaggtttaaagccaagggagaggatttcagatgacatcattatttatgatgttactgatgataatgcagatgaagaaaatatcccagttattccagaaactaatgaggatgttatatctgatccctccaagtaaggagtttgtgagataaaatgtatgaaaatattgattacttttcttattacagagyaaaattcaaaactactttgttctttgaaaaataataatctttctcacatttggattattaaacttgataattaagctaaattattcaaccagataaaacctcacctcctcttcctctcaaaggaggtatactgaaaactaattgatttttaatttttattttggagttaagcacttctcattcaatctttatggtcttctatactatgaagtaccaatattgtgattaagctgctcgctcaagaaatttaagcctttcagtatgtggtatggggagagagtttccatttagaatgaatgg

SEQ ID NO: 48141 - DNA, 601 bp, Human
aagaaaatatcccagttattccagaaactaatgaggatgttatatctgatccctccaagtaaggagtttgtgagataaaatgtatgaaaatattgattacttttcttattacagagcaaaattcaaaactactttgttctttgaaaaataataatctttctcacatttggattattaaacttgataattaagctaaattattcaaccagataaaacctcacctcctcttcctctcaaaggaggtatactgaaaactaattgatttttaatttttattttggagttaagcacttctcattcratctttatggtcttctatactatgaagtaccaatattgtgattaagctgctcgctcaagaaatttaagcctttcagtatgtggtatggggagagagtttccatttagaatgaatggatagtatgaacttattaaatttgaaaatgtaataggttccttcttttattgctgatttagctgtagccagtaccctgatattgtcatcgttgaagatgacaatgaagatgagtatgcacctgtcattcagagtggagagcagaatgaaccagccagagaatccctaagttcaggcagtgatggc

SEQ ID NO: 48142 - DNA, 601 bp, Human
ctttgatgatatacttcctttgagtgtacatacagtgtttgtgattatatatatttgtgtatccaaactacagaataatgtaatttctagtaaggtacttataacaaagaaaacttaatagtaataatcagtaatgagattaaacattttatatagtatagaggaaaaaggtaaatcagactgttctgcagggtgtgtttttctgtaaatactaaagttttctgtaaaggctatgaattttcagttaaccagattttcaagaattcctactctagaataagatctcttaagattaagaacyggtaaggatgcagcagctgctagaaatatcttgcctagccaagttgtaatggtgatttttaaacataaaaacaaggatatctaatatttgattaaaaaaatttttttttccttagggttgagctgttggattatcttgacagtattgactgcagtttagaggacttccaggccatgctatcaggaagacaatttagcatagacccagatctcctggttgatgtaggtactttgggtaatctttgctatactggtagtttgtgtgtttatgtatattatttaaaaaccagtacgtcatttt

SEQ ID NO: 48143 - DNA, 601 bp, Human
aatttttttttccttagggttgagctgttggattatcttgacagtattgactgcagtttagaggacttccaggccatgctatcaggaagacaatttagcatagacccagatctcctggttgatgtaggtactttgggtaatctttgctatactggtagtttgtgtgtttatgtatattatttaaaaaccagtacgtcattttgttttgtattctacaggttgtttttgcatttcttttttaaattaataattttgtttatcagaaagaatgaaaaaataggtttgggacattgaaggagtrtgattaccacctgccttggagtagcaattgaactaatttccctgtgagaacatatcagatcttttcagcagtactgttaagttcatgtcttgtctggacttgttgctcttttctgttttgctctagaatgaattgtcagtaaatagaaatttgtggaaattagtaatagaggtacttagctaggaaatagcatggagacaccttttgatactttggggattaacattttttactcaaatatgttttaatatatttgccttattttttacatttttatattttgagttacaaggttcccct

SEQ ID NO: 48144 - DNA, 601 bp, Human
tagcttttggttatgtggtgaactattacccacttttggcacttgtgggattaactaccagtatgaaattaacttcttttggtgctgggagatcacctgactaaacttggtatattgaaaccaataactaaaatatgatttcttcatgttttatgggcagcattttacattcttatttttcctattctcaacttttttattaaaaagttatagtacccatattttttgtgagttctatcattagcataaagtaaaaattcaggaattcttatttattgcagaaaagggaagttgaaacgtrtgaatatttgactttttttaagtaataaggattttttttttgacatataggaactgcacttgggcttagcaagtgttgacaagagattttgcggaacttgtttttaatgagtagtaaggacaatttgaagttattagagcaggtgttttatatcattgtattttatataacttaattgtcatgaataggtatacactccctttatcttttatttgtaccaaattgtttagtaagccttgttaaaggtaaatcaagtccagattccagattagtgaagccagaattttattttgattcttt

SEQ ID NO: 48145 - DNA, 601 bp, Human
ttttttgacatataggaactgcacttgggcttagcaagtgttgacaagagattttgcggaacttgtttttaatgagtagtaaggacaatttgaagttattagagcaggtgttttatatcattgtattttatataacttaattgtcatgaataggtatacactccctttatcttttatttgtaccaaattgtttagtaagccttgttaaaggtaaatcaagtccagattccagattagtgaagccagaattttattttgattctttttctttatagtccaaaaatgagcacatctcaaatawatataagtgattagggtgaggggtggaatttatacgattattgtcatgtgtaagcctgaccagactgtctatatcttcaaagttacattgtggataacttagagcttaaaaaatttgtgaatttgtgaaataggaagttgattatacattcagtattcagataatttatattggaggttggcatactttctccataaaggggcagctagtaaatacttttggtttttcaggccatatgttctctgtcataactatgcagttctgcaattgtaatgtgaaagcagatacagacaatatgta

SEQ ID NO: 48146 - DNA, 601 bp, Human
ggattttcgcattgatgtttatcagggatattggcctgaaattttctttttttgttgtgtctctgccaggttttggtatcaggatgacgctggcctcataaaatgagttagggaggagtccctctttttctgttgtttggaatagtttcagaaggaatggtaccgctcctctttgtacctctggtagaattcagctgtgaatccgtctggtcctggctttttttggttggtaggctattaattactgcctcaatttcagaacttgttattggtctattcagagatttgacttcttcctggwttagtcttgggagggtgtatgtgtccaggaatttattcatttcttctggattttctagtttattcgtgtagaggtgtttatagtattctctaatggtagtttgtatttctgtgggatcagtggtgatatcctctttatcattttttattgtgtctatttgaaatccatttgttatcaggttctcatgttttagaataacggtgacgtctttggaaaatacctattttaggaagcctaaaaataaagatggtattatttcattaatgtttatatatttattgtgaatgctaagtgatgaaa

SEQ ID NO: 48147 - DNA, 601 bp, Human
gcctcataaaatgagttagggaggagtccctctttttctgttgtttggaatagtttcagaaggaatggtaccgctcctctttgtacctctggtagaattcagctgtgaatccgtctggtcctggctttttttggttggtaggctattaattactgcctcaatttcagaacttgttattggtctattcagagatttgacttcttcctggtttagtcttgggagggtgtatgtgtccaggaatttattcatttcttctggattttctagtttattcgtgtagaggtgtttatagtattctctratggtagtttgtatttctgtgggatcagtggtgatatcctctttatcattttttattgtgtctatttgaaatccatttgttatcaggttctcatgttttagaataacggtgacgtctttggaaaatacctattttaggaagcctaaaaataaagatggtattatttcattaatgtttatatatttattgtgaatgctaagtgatgaaatatttttatgtacacttttggaaaggtttcgtagtttttattatatcttggagcccttattttctcttaaatcctaaaacttacacagcttc

SEQ ID NO: 48148 - DNA, 601 bp, Human
taaatattctgtttatgagtgaaatgtataatacattttttaaatcaaaactacttaaaatgaatttaattgcttagttaattatctctcaattaacattttgaaaccagtcatctttgattcattctgatcttttactcgtgacaaattctatctgttctgctgctgaaatcccccttcatttcatacttaatatagaacatcttaattcaggttctttgttttatcccctcagtgacagcaatagttccttaaccagtcttgttatctctactcagatctctctctgtagcccattttycctgatgtttccccatctcatatatttcagataatataccagtatttacatattgtatcaatttttcatttttttcagaaacataaaatatgaaacaagtacttatatatatattttttttcttttagtctgagaataaaggattagaaactaccaagaacaatgtagttcagccagtttcggaagagggaagaaaatctaaatccaaaccaggtaggtataaatatagtattcagtctctgtaggtttttttaatcctatgcagaaacaagtgcaagccgagggtagtcttaattgaat

SEQ ID NO: 48149 - DNA, 601 bp, Human
tgtataatacattttttaaatcaaaactacttaaaatgaatttaattgcttagttaattatctctcaattaacattttgaaaccagtcatctttgattcattctgatcttttactcgtgacaaattctatctgttctgctgctgaaatcccccttcatttcatacttaatatagaacatcttaattcaggttctttgttttatcccctcagtgacagcaatagttccttaaccagtcttgttatctctactcagatctctctctgtagcccattttccctgatgtttccccatctcatatrtttcagataatataccagtatttacatattgtatcaatttttcatttttttcagaaacataaaatatgaaacaagtacttatatatatattttttttcttttagtctgagaataaaggattagaaactaccaagaacaatgtagttcagccagtttcggaagagggaagaaaatctaaatccaaaccaggtaggtataaatatagtattcagtctctgtaggtttttttaatcctatgcagaaacaagtgcaagccgagggtagtcttaattgaatatgctggctttagttctgtgaata

SEQ ID NO: 48150 - DNA, 601 bp, Human
acatcattttcattacccgtttcccaaataaaatattaaggttgaggctctggtatttcatttcaaatagtactggtctgtttttccagccatgaaaacgtttacattctaagtaaaaatcctagcgatggttaagtcttaaatacaaatccccaaactcttgcactgccttcagctttcagcttgaatgtataaccagttcccataattactacaatattactattatcttagtctcattgccaaaaacccagctgcaggctaactatgcaagaatgagacactgttgaaatgactcggaaaaaaaaaaaaaagaaactttaccctcactgaatttagctacaaaattctgcaattaaatgaaaccaattcacacacacacacacacacacacacacacacacacacacacacacccttcttctaagaaagaacaggatgccgctacacaaggaacccagagagaaattcggcaaacagttgcgcctaagccaccgcggcagagtcgggggctgggggcggggaagaggagaaaacttgggaagcacaatgactccagtgaggacttcagtgagggctccagggctcccgccaagaagcc

SEQ ID NO: 48151 - DNA, 601 bp, Human
gagggattcacgacttcagtagagaaagtaaatgcagatatggtagaaatagcaagagaactagaattagaagtggaacctgatgatgtgactgaattgctgcaatctcatgataaaacttgaacggataaggagttccttcttagggatgagcaaagaaagtggtttcctgaaatggaatctacccctggtgaagatgctgtgaacattgttgaaatgacaacaaaggatctagaatattgcatacactgattgataaagcaatggcagtgtttaggagtattgagtccaattttgaaagaagttctactgtggataaaatgctttcaaatagcatcacatactctggagaaatctttaatgaaagaacgagccaactgatgtggcaaacctaattgttgtcttattttaagaaactgcctgacatctcagccttcagcaaccaccaccctgatttgtcagcagccatcaccactgagggaagaccatccaccagcaaaaagattatgacttgctgaaggctcagatgatcaacagtatttgactaggtcatgtacattagctgggcacagtgactcatgcctgtaatcccagcactttg

SEQ ID NO: 48152 - DNA, 601 bp, Human
cactccagcctggggcacaaagcgagactctgtctcaaaataaataaataaaataaaataaaataaaaaagataggccaaaagcgaggcctcctgtgccaaacagccaagttgtgaatgcaaaggaaaagttattgaaggaaattaaaagtgctacttcagtgaacacgcaaatgataagaaagtaaaacagccttagccgggtgcagtggctcacacctgtaatcccagctactcagtaggccgacacccgagaaccacttcaacccgtgaggcggagggtgcagtcagccaagatcgcrccactgggtgacagagtgagactgtgtctcttaaaacaaaacaaaacaaaacaaaagaaaggaaaagaaaacagccttattgttgatatggagaaagttttagtggtccagatagatcaagccagccataacattcccttgacccaaggcctaacaaggcctaattcagagaaagctcctcctcttcaattctgtaaattgatgtgaggaagctacagaaaagctggaagctagcagaggttggttcgtgaggtggaaggaaaaaagccatctccacagcataaaagtgcaagatgaagc

SEQ ID NO: 48153 - DNA, 601 bp, Human
cactgcactccagcctggcgacagagcaagactccgtctcaaaaaaaaaaaaaaaaagaaaagaaactctataatggcctcaaagtgttcaagtgaaaggaagagtcccgcctatctcactttaaatcgaaagctagaaatgattacgcttagtgagaaaaaacgtcaaaaaccaagatagggccgggcacagtggtgatgcctgtaatcctagcactttgggaaaaggcgggcggattgcctgagctcaggagtttgagaacagcctgcggaacacggcaaaaccccgtctctactaaamaaacaaacaaacaaaagtagctggccatggtggtgcatgcctgtagtcccagctactcaggaggcagaaggtttcagtgagccaacattgcatcactgcactccagcctggggcacaaagcgagactctgtctcaaaataaataaataaaataaaataaaataaaaaagataggccaaaagcgaggcctcctgtgccaaacagccaagttgtgaatgcaaaggaaaagttattgaaggaaattaaaagtgctacttcagtgaacacgcaaatgataagaaagtaaaacagccttagccgg

SEQ ID NO: 48154 - DNA, 601 bp, Human
tactccagaggctgacgcaggcgaatcgcttgaacctgggaggcagaggttgcagtgagccgagatcgcaccactgcactccagcctggcgacagagcaagactccgtctcaaaaaaaaaaaaaaaaagaaaagaaactctataatggcctcaaagtgttcaagtgaaaggaagagtcccgcctatctcactttaaatcgaaagctagaaatgattacgcttagtgagaaaaaacgtcaaaaaccaagatagggccgggcacagtggtgatgcctgtaatcctagcactttgggaaaaggygggcggattgcctgagctcaggagtttgagaacagcctgcggaacacggcaaaaccccgtctctactaaacaaacaaacaaacaaaagtagctggccatggtggtgcatgcctgtagtcccagctactcaggaggcagaaggtttcagtgagccaacattgcatcactgcactccagcctggggcacaaagcgagactctgtctcaaaataaataaataaaataaaataaaataaaaaagataggccaaaagcgaggcctcctgtgccaaacagccaagttgtgaatgcaaaggaaaagt

SEQ ID NO: 48155 - DNA, 601 bp, Human
gaatcgcctgaactgggaggcaaaggctgtggtgagctgagatctcgccattgcactccatcctgggcaacaagagtgaaactctgtctcaaaaaaaaaaaaaaaaaggacgggcacgtggctcactcctataatcccagcactttgggaggccgaggtgggtggatcacaagataaggagatcaagaccatcctggccaacatgatgatgaaaccctgtctcaactaaaaatacaaaaaattagccaggcatggtggcacgtgcctgtagtcccagctactccagaggctgacgcaggcraatcgcttgaacctgggaggcagaggttgcagtgagccgagatcgcaccactgcactccagcctggcgacagagcaagactccgtctcaaaaaaaaaaaaaaaaagaaaagaaactctataatggcctcaaagtgttcaagtgaaaggaagagtcccgcctatctcactttaaatcgaaagctagaaatgattacgcttagtgagaaaaaacgtcaaaaaccaagatagggccgggcacagtggtgatgcctgtaatcctagcactttgggaaaaggcgggcggattgcctgagctcagg

SEQ ID NO: 48156 - DNA, 601 bp, Human
gtgtgaatgagttaccccctcacactatagcaagactatggtggaattcactgagaggcaaactgcaaaatctcagggagagattctgtacccaaatgttgacttccattacctgagtgaatgtattttgaactgtcactttccaaatgttttatctgaacagcagcacagcagcaaaagactctgaacaaggtcaaggatgagcggcacagtgcataactcacacttcaacattaagaagacgtttgttcttttaaatggtttaggggcataatgttaaacctttgtaaagcatccaatyaatccagttgattagcaaaaggtacattagagcttctggatcagtaataaaaacttccatcattttgtgtcacctcaaacaattttccatgtcttcagaacttaggatgagtcccaatcaattcctacaagattgatttctagaaaaaaagttccaaaattatgaaagagcagagcaatatttttttcctggcccaagtctgatagtagtaattttaaatacagtagacaaaggtgaaaaagataactccaagttcctccctggtatcaagccctatgtgagtctgagctcagatgatcc

SEQ ID NO: 48157 - DNA, 601 bp, Human
tgaacaccaccctcagtgtttgattcaagaggccagaggtagggcctcagcacttgcatttctagcaagtttctagatgatagtgatgctacaattccgtcactactctgaaaaccactgaaagcccctggagcttactggaacgtgtgcgtgaacagtgtgaatgagttaccccctcacactatagcaagactatggtggaattcactgagaggcaaactgcaaaatctcagggagagattctgtacccaaatgttgacttccattacctgagtgaatgtattttgaactgtcactttcmaaatgttttatctgaacagcagcacagcagcaaaagactctgaacaaggtcaaggatgagcggcacagtgcataactcacacttcaacattaagaagacgtttgttcttttaaatggtttaggggcataatgttaaacctttgtaaagcatccaatcaatccagttgattagcaaaaggtacattagagcttctggatcagtaataaaaacttccatcattttgtgtcacctcaaacaattttccatgtcttcagaacttaggatgagtcccaatcaattcctacaagattgatttctag

SEQ ID NO: 48158 - DNA, 601 bp, Human
ctcattataatcagaaaaagagtatttaaaaccacaaggtggtacactatataaaccatcaaaaggggtgcagaggggagacaggttataagagcagagaagaggaaacagtgctgaagtaaccagagaaaatggtcaatgattggagcctaaccatttagtgacaagtaacagaagaatcacttatttactaacatttcctgaaaagctactacaggccaagcactcttaaaagtacatttaatggtcatcgcagaatataactgactataagttataactttaactctccttgaccaattttttttttttttattttgagacagggtctccctctgtcacccaggttggagtgtagtggtgtgatcatggctcactgtagacttgacctcccaggcacaagcagtcctcccacctcatcctcctgaatagctgggactataggcatgtaccaccacacctggctaattattattattatattctttgggagagacaagatctcaccatgttgaccaggctagtctcaaactcctgggctcaagtgatcctcccaccctggcctcccaaagtgctggggttacaggcgtgagtcaacatg

SEQ ID NO: 48159 - DNA, 601 bp, Human
aatcccagctactcaggaggttgaggcaggagaatcgcttgaacccaggaggcggaggttgcggtgagccgaggttgcaccagtgcactccagtctgggcaacaagagcaaaactctttgtctcaaaaaaaaaaaaaagagcaacctcattataatcagaaaaagagtatttaaaaccacaaggtggtacactatataaaccatcaaaaggggtgcagaggggagacaggttataagagcagagaagaggaaacagtgctgaagtaaccagagaaaatggtcaatgattggagcctaaccwtttagtgacaagtaacagaagaatcacttatttactaacatttcctgaaaagctactacaggccaagcactcttaaaagtacatttaatggtcatcgcagaatataactgactataagttataactttaactctccttgaccaattttttttttttttattttgagacagggtctccctctgtcacccaggttggagtgtagtggtgtgatcatggctcactgtagacttgacctcccaggcacaagcagtcctcccacctcatcctcctgaatagctgggactataggcatgtaccacc

SEQ ID NO: 48160 - DNA, 601 bp, Human
ggccgaggcgggcggatcacctaaggagaggaattcgggaccaacctgaccaacatacagaaacctcatctctactaaaaatacaaaattagccgggtgtgatggtgcatgcctgtaatcccagctactcaggaggttgaggcaggagaatcgcttgaacccaggaggcggaggttgcggtgagccgaggttgcaccagtgcactccagtctgggcaacaagagcaaaactctttgtctcaaaaaaaaaaaaaagagcaacctcattataatcagaaaaagagtatttaaaaccacaaggyggtacactatataaaccatcaaaaggggtgcagaggggagacaggttataagagcagagaagaggaaacagtgctgaagtaaccagagaaaatggtcaatgattggagcctaaccatttagtgacaagtaacagaagaatcacttatttactaacatttcctgaaaagctactacaggccaagcactcttaaaagtacatttaatggtcatcgcagaatataactgactataagttataactttaactctccttgaccaattttttttttttttattttgagacagggtctccctctgtc

SEQ ID NO: 48161 - DNA, 601 bp, Human
gcagagcaagactccatcccaaaaaaaaaaaaaaaaaaaaaagacacacacgtatacggacaagtgatttacaacaaaggtggcgctgcagagaagtagggaaaaagatactcttttcaataaatggtgttgggataactagatgtccacatattaaaatgaagttgatttaatcccttccttatactatacaccaaaatctattccaagtgaattatacagttaaagataaaatgcaaaattattaaacatttagaaaataacagaggaattacttcacagcctcagggtggggaagacaaaaaaaaggaggaactataaaggaaaagactgataaactggactacattaaacttaacttctgtttatccaaaaaacacttttgaggctgggcacagcggctcacacttgtaatcccaacactttgggaagcaaaggcgggaggactggttgagctcaggagtttgagactagcctgggcaacataggaagaccctgtctctaaaaaaaaaaaaaaaaaaaaaaaaaaatttaaaattagccagcagggtgatacacctgtattcccagctactcaggaggctgagggaggaggattgct

SEQ ID NO: 48162 - DNA, 601 bp, Human
ggtgggaatgcaaaatggtacaaatctagaagatagtttggcactttaagaatttcaacaggccaggtgacgtggctcactcctatgaccccagcactttggaatgccaagactggaggattgcttgagcacaggagtttgacaccagcctgcgaaacatgactagacctcgtctctacaaaaatgtttttttaattagccatgtgtgatggtgggtgcctgtagttccagctactccagcgactgaggtcagaggatcacttgagcctgggaggttgaggctgcagtgagcagtgatcayaccactgcactccagcctggacaacagagtgagaccctgtctcaaaaaaaaaaaaaaaaaagttaaacatacacctaccatatgattcagccattccagtcctagtccaaccattcccaagagatatgaaagtctacacccatacaaagccttgtacaaaaatattcagagatctataataatccagttctccacgaatagatgtagaccttcaatgtaatcccaaacaacatctggaagaattattttagaagttgacaagtaattctaaaacatatattgatctgcaaaaggtcaaga

SEQ ID NO: 48163 - DNA, 601 bp, Human
ccgtaaagcaacaaactcataaatgggacatcatcaaaacgtataatttatgctcttcaagccactgttaagaaaatgaaaaagccagccataacctgggagaaaaatatagtatgtatctgataaacaatttatatccagaacatatagagaactctcaaaacccaaaaaaatggaggaaaaaaacacctttttttaaaattttctaagacagagtctcattctgtctcccaggctggagtgcagtgacacaatctcggctgactgcaacctctgccgcccaggttcaagcaattctccygtctcagcctcctgagtagctggaattacaagcgtccgccaccatgcccagctaatttttgtatttttagtagagatgggttttcgtcatgttggccaggctggtctccaactcttgaccttaagtgatccacctgcctcggcctcccaaagtgctgggattataggcatgagccacggtgcccagctaacaactttaaaatgcataaaagatttaaacacagagatatgcggatggcaaataaccatataagaagatgctcaacactatcagtcatttgggaaacgcaaattaaaacca

SEQ ID NO: 48164 - DNA, 601 bp, Human
cctaaaagtaaaatctaaaacttctaggagaaaaaaatcagaaaaacctttgtggcctaggatttggcaactcttaaatatgacacatacacaaaaacacaacccgtaaagcaacaaactcataaatgggacatcatcaaaacgtataatttatgctcttcaagccactgttaagaaaatgaaaaagccagccataacctgggagaaaaatatagtatgtatctgataaacaatttatatccagaacatatagagaactctcaaaacccaaaaaaatggaggaaaaaaacacctttttttwaaattttctaagacagagtctcattctgtctcccaggctggagtgcagtgacacaatctcggctgactgcaacctctgccgcccaggttcaagcaattctcctgtctcagcctcctgagtagctggaattacaagcgtccgccaccatgcccagctaatttttgtatttttagtagagatgggttttcgtcatgttggccaggctggtctccaactcttgaccttaagtgatccacctgcctcggcctcccaaagtgctgggattataggcatgagccacggtgcccagctaacaacttt

SEQ ID NO: 48165 - DNA, 601 bp, Human
gtttttcttctccctagaaccttttcccccatccttcccctctccacttggctaattcctctccccacctggctaattcccattgttccctcaagagtgggtgctgtgacacccccgccagaaccccacagtgccctgcaactttgcacagcactatgactgcctaagggcagggatggcagggcaagtgcaatgggagacactgggtctaagacacagatcaacatataataaatgctttcacaaaatttctcagttaaaactgacatatttgtaagttaaaatatcaatacttaatagytatctactcagtgtgccacagattcacatttcaccacctaaatcagtctaagaatctacactgtaccttagggatagatttcacagtaagtctattaaaggaactcaatcatctgtctagctatatagattccaaaaaattcaaactttaaacagcaaggatacccatattagtggttttcaaatgcagatccacgtaccagtgcaagtccctgatgaggttttgatagtcaagccatatctatccactagaactttctgcaatgatgaaaatgttctataccagcgctgcccaatgtag

SEQ ID NO: 48166 - DNA, 601 bp, Human
ctgtaatcccaacactttgggaggctgaggcgggcagatcacaaggtcaggagttcgagaccagcctgaccaacatggtgaaaccccatctctactaaaaatacagaaattagccagacatggtggcgggtgcctgtaatcccagctactcaggagactgaggcaggagaatcgcttgaacccgggaggcggaggttgcagtgagccgagatagcaccactgtactccagcctgggcaactgagcaagactcaatctccaaaaaaaaagaaagaaagaaagacacaggacagtcagctgcrtcacccactcacagaagaaccttagaaaagcagcagagccatattcaattccttccctatcttttttaaagaaatgcatcatgaattatgtcacattttagcaggagttgtccaatgttagcgtacgttttcagaagcaagttacttcacaacttttaagtatgaaccagtacctttaaagagttaacaatacttattaaataataaccatggctgaaagtggtaatgaataaacagggaattcattacaacattgtttctgtatatgtttgaaaacttctacaaggttttcacattgaa

SEQ ID NO: 48167 - DNA, 601 bp, Human
ggcctgcaaagcctagaatgtttactgtctagcccttcacgaagaaagtctgctagcccctgacctagggcataactagggacttaaccaaggctgacttgggtgtccttcctccaggttctcagagctcagagcattcttgaagaaggtagagattatctctaccttatattttacacatattcttttgtatttcttcagtttaatcattttttgaaaaagattagcatatttctttcataaatattgctctattaaagctccacgcttcaccaactcaataaaaaaaaaaaaaaaaaacaatgactcagttaaaaacagacatgtactgctatcaggaacattaaaccaatacagcaaagcatagcaagctacagtttattttgattcaagtacagttttaagaaaagaaccttccaactaaaggctccaagtctgtggagagtccccaccgccttgcttagctcactggatcattaagatacacattggatcattaagatagatacacactgcatcattaagatagatacgggggctgggtgcggaggctcccgcctgtaatcccaacactttgggaggctgaggcgggcagatcaca

SEQ ID NO: 48168 - DNA, 601 bp, Human
tgagccaccgcacccagcctctaaagctttttaataaacttccactcctgctctggaaaaaaaaaaaaagaaaagaaaaagaaatggaaaaaaacaatatcattcaatgaccactgttttaaatgtcagggattcaacagggaacagagaaacattttgccctcagactttatgtcaccaccaagagagaaagaaactaaaaagtaagtaaaatacaaacagtaacagatggtgaaaagggcttgaaaagaaatgaaacactgagcggggccaaggaaggatgtcttcaggagaggtgacwtaaggcttcacttacagagtggcaccggtgtgaggggtgggagtgggatgggacagaacctgtggggcaggagggaagggtatgtgatcagggaacacacactggcctttcaagggcatgggaaaatcccactgttgaagctgggcaggaggtacctaggagtttgctttgttatcaccctctacacgagaacagcaaactatgacccacaggccaatgtggccccacttgtttttgtacaacctgtgagctaaaaatggttttacatcgtatatggttaaagaaactaaaacaatgttt

SEQ ID NO: 48169 - DNA, 601 bp, Human
aaagtggctcaacatcattactaataagggaagttcaaattaaagccacaataagatatgacacaacctccaaaatgacaaaactgaaaaagtcagacaaaataaactacagacaaggatgtggaacaacaggagtgatacggtttggctgtgtccccacccaaatctcatcttgaattgtagctcccacaattcctatgtgttgtggcagggaccggtgggaggtaactgaatcataaggcgggctctttcccgtgatgttctcgtgatactaagtttcatgagatctgatggttttatragggggagttcccttatacaagctctcttgactgctgccatccatgtacaatgtgactttgctcctccttgcctcctaccatgattgtggggcctccccagccatgtggaatgtaagtcaattaaatctctttcctttctaaattacccagtctcggatatgtctttatcagtagcgtgaaaacaaactaatacaaggagtcattatattagtggtgatataaattggtataactactttgggaagcaatttggcagtaactagtcaggttgaagactggccagccctataactcagcaa

SEQ ID NO: 48170 - DNA, 601 bp, Human
ggaggtcaagactgcagtgtgcagcatgggcgcggtagctcacgtctgtaatcccagcactttgggaggccaaagtgggcagatcacgaggtcaggagatcgagaccatcctggccaacacggtgaaaccccatctctactaaaaatacaaaaaatagctgggcatggtggtgcacacctgtagtcccagctactcaggaggctgaggcaggagaactgcttgcacccaggaggcggaggttgcagtgagacgagacagcaccactcccctccagcctgggcgacagagcaagactgtccaaaaaaaaaaaaaatactgcagtgagctgtgatcgtccaactggactccagcctaagtgacagaatgagactttgcctcaaaataataataataaatgctttatgaactaaataaaaatacttcacatcaaaacttagcccttggataaagagagattccttaaaaaaatcaaaacaataaaaagtactcatcataaaggaaaaaagaaataaagcttatgacattaaaattaagaactttagttccctacagtaaccaaaacagcatggtactggtaccaaaacagagatatagaccaat

SEQ ID NO: 48171 - DNA, 601 bp, Human
aatactttacaaagaggtcaccacatctagtccacagccagtttttacatggttcctggactaagaatgatttttacattattaaagcgttgaggagaggggggagggggaagaaaggaagaaaaaattagaggaaatgcgataggctgtatgtgtatatgcgacccccgaaggctgaagtttctactctccggcctttaagaggggaagtctgccgacccctgaggttgggcatcacaagggacttgccctccagattgcctgagcacgctaagagacaactgcacacatcatgctgcakgccagggaactataacagtctcactccccctcaagtctataccttcagggcttaataccgtaccaggcacaaaacagtattttttaaatggcgaacaaatgaattaactgaatgaaccagctcaagaactggtgaaatcacattaaatggaaaggacctgtgcctttagtagtaaaacactacttacgtctgttaaagatactattaacaacattagcaccttacatttgtataccactctacacagtaactgcacatataacctcaaaggctaagaccataaaaactacactttataaa

SEQ ID NO: 48172 - DNA, 601 bp, Human
tattctgtctttcggaaaggaggagaaactagggaaaaacattccaattgctggttgatacagttcaacttagaaaacagttgcatgtgtttgcattttacttggcagtttgagatgcattacatttaaagtaaaaatcctgtgattgggatgatgtttcccttgccaacacaaacctttagagtacaccagatgtgtacaatctaacaaaaagtgattcctccttttggttggactcctttctgataatgtgatgaaagctctagaattctctccccagggaaaaacagctcacatacayacacaattctgcttagaatttcaggggttcatggacctaagagacaatgttccctcatcaaagcaatcactaagatattccaggaaaaaaaaaattaagagcaaaaagatcttcatgaactcatcaccaaagaaaaaatctggaagccatcctggaattacgctggattccttctctctcagccttgccatttcacttacttagtcacgcctgtagatgaactcagaaacaggcttcacatcaatccctactctccatttcctcagttgtgcccttaagtccttcatttatatgtacaac

SEQ ID NO: 48173 - DNA, 601 bp, Human
gcagcagaaaagtttgctttccaataaaatggtcaaaaaggcaaactcataggatagatgtaaatcaaagacatcagctctttgccaaccacataatcaaccatgtactgtttaaaattaacccacatgttgacaacatgcacttaaactaagttatttctgctatctgatttctcaaggcaattccttaggatccaatactattttttccaaacagaaaacaaaacttgccacctaaactttgccatgacctaggcaaagtagattcaaagcttttttcctaccttggaattacaattasccccagcgtgaaattctgagagtgatatcttaaccagtctaggttttcacttttgacttctatgccactgctagattccatcatttcttatatctttgccccatcacactttgcctttaatagaagtcacaatttttctcaacaggaaagaagaaactttcttacagattgccccattttcactctcttaagttctctctgctccatatggagcagcttaccaagttcatcaaatctctgcagggactgctattatctgtagtctgtaatccctaaattacatgtaataatgctgacatc

SEQ ID NO: 48174 - DNA, 601 bp, Human
agcaaacaccaggcttgacctttggatggggctggagagtaagctcacctatgattctccatcaaatggtcatttgacttttctgggttatttacttactcatctctaaagtaaaagctttggatcctaaatttagatatacccctaaaattctagattacgtaaagcaaagagtaaaaggggcacacatacacacacacgtaaaaaaaaaaagcagcagaaaagtttgctttccaataaaatggtcaaaaaggcaaactcataggatagatgtaaatcaaagacatcagctctttgccarccacataatcaaccatgtactgtttaaaattaacccacatgttgacaacatgcacttaaactaagttatttctgctatctgatttctcaaggcaattccttaggatccaatactattttttccaaacagaaaacaaaacttgccacctaaactttgccatgacctaggcaaagtagattcaaagcttttttcctaccttggaattacaattagccccagcgtgaaattctgagagtgatatcttaaccagtctaggttttcacttttgacttctatgccactgctagattccatcatttc

SEQ ID NO: 48175 - DNA, 601 bp, Human
ttaattaataaataattgttaattttttttagatggagtctcattctgtcacccaggctggagtacagtggcatgatctcggctcactgcaacctccacctcccaggttcaagtgattcacctgcctcagcctcccgagtagctgcaactacaggcgcacgccaccacgcctggcaagtttctgtatttttagcagaaacggggtttcaccatgttggccaggctggtctttaactcctgacctcaagtgatctgcctccctccgcctcccaaagtgctgggattacaggcacgagccacygtgcccagcctcaattactgtttttatattttgaattcagtcgatgaaaatttgtggaaatttgttttctctcattatttaaatacctacataatattcttgttttgcctattcatctgcaaaacctaaaatattcactatctgcccctttacaaaaaagttcaccgatccttgttttagtcaactagattcccaggtcttccgcacactggtagagttaagacacgttttgtccagctttagctttctcagttgcttttccttttaaactaagtctgccattttacatttattgctgac

SEQ ID NO: 48176 - DNA, 601 bp, Human
ccttgcagattagcattaagagatgaacacttgtaattgatgttgataatagcaaacactaagttcaaactctaatttagccaaatgttatccacctcctcccctaaaaaaaaaatccattcctctcattagacctgtatttttttaattatgctcaattgtttttattattttaattaataaataattgttaattttttttagatggagtctcattctgtcacccaggctggagtacagtggcatgatctcggctcactgcaacctccacctcccaggttcaagtgattcacctgcctcrgcctcccgagtagctgcaactacaggcgcacgccaccacgcctggcaagtttctgtatttttagcagaaacggggtttcaccatgttggccaggctggtctttaactcctgacctcaagtgatctgcctccctccgcctcccaaagtgctgggattacaggcacgagccaccgtgcccagcctcaattactgtttttatattttgaattcagtcgatgaaaatttgtggaaatttgttttctctcattatttaaatacctacataatattcttgttttgcctattcatctgcaaaaccta

SEQ ID NO: 48177 - DNA, 601 bp, Human
tgcttccatctaaccaccaataggaagtgattaatctgcaatgcaataacatgctagaaggcaattatcaaggagaatctaatagaattctataaatgccttctaagcaatgaatatgctcctgaactgctatcagtatttcgatgtatcctgtcaggattaagacatttttcaaagataaaatatgtaaaatctccttgcagattagcattaagagatgaacacttgtaattgatgttgataatagcaaacactaagttcaaactctaatttagccaaatgttatccacctcctcccctaaaaaaaaaatccattcctctcattagacctgtatttttttaattatgctcaattgtttttattattttaattaataaataattgttaattttttttagatggagtctcattctgtcacccaggctggagtacagtggcatgatctcggctcactgcaacctccacctcccaggttcaagtgattcacctgcctcagcctcccgagtagctgcaactacaggcgcacgccaccacgcctggcaagtttctgtatttttagcagaaacggggtttcaccatgttggccaggctggtctttaa

SEQ ID NO: 48178 - DNA, 601 bp, Human
agttaacactgttaccaaacactgaatagctctgcaatcaattttttctacagacttgatgtttcttaatggattcaatttaagtttacaaaggaaaacagtacttatatgaggaatttatactgcagtaaagtcatttcaatgacagctaacatttgaatcacaagttgcattaagcttctttatatacttctcgtatgtgaaagttaaaacaaaaagcaagatttcaattctgtgcaaatttgcagtggatatattttctgggttcaaactacattccagtagcatttttcaaactccratgcaagtacaaagaaaatttacatatttcaaaatccatttaactgtgcaattgaggtgcttccatctaaccaccaataggaagtgattaatctgcaatgcaataacatgctagaaggcaattatcaaggagaatctaatagaattctataaatgccttctaagcaatgaatatgctcctgaactgctatcagtatttcgatgtatcctgtcaggattaagacatttttcaaagataaaatatgtaaaatctccttgcagattagcattaagagatgaacacttgtaattgatgttgata

SEQ ID NO: 48179 - DNA, 601 bp, Human
aacttcattagctcttgtagacttaaccattgtcagttccttgaatttgtcagaaatagaaactgagtatcttgacttggcctaccacacagcagttaaatggacagtggtaggttttattctaactttatgaccttagagtcaagactcaaatttttctaaaagagcctccttcagttaacactgttaccaaacactgaatagctctgcaatcaattttttctacagacttgatgtttcttaatggattcaatttaagtttacaaaggaaaacagtacttatatgaggaatttatactgyagtaaagtcatttcaatgacagctaacatttgaatcacaagttgcattaagcttctttatatacttctcgtatgtgaaagttaaaacaaaaagcaagatttcaattctgtgcaaatttgcagtggatatattttctgggttcaaactacattccagtagcatttttcaaactccaatgcaagtacaaagaaaatttacatatttcaaaatccatttaactgtgcaattgaggtgcttccatctaaccaccaataggaagtgattaatctgcaatgcaataacatgctagaaggcaattat

SEQ ID NO: 48180 - DNA, 601 bp, Human
tctctgctcaaaaccctaaatggctctccatcttatgtggataacttaaccatgttaagttgtctgactacaacagacaaagaaatatgtcaaaaaaaaaaaaccaaaaaacaaaaaacttgcttaagactataagcttttcaataagaacagttgctcaaagagttgaggatactgataacaacatcaatgtcagtcaaaaaaaggcaaatatttttgaatgattttccttggttgttgacgttgctcaactgtttattcaaggagtcaatgccaaccttgaagtaactaaaaaattagkctctaagaatagtctgtgtggaactacaaataatattttcaaagctgagaaaacactaatttagtacaatctgaagtggaatctactaagatgcatgataataactggtgatagtaaaaatatatggggagcagacaaatgatttgctgcacaaatttacaaaaattatgaaagtattatggttattcatcagcaagtactatgtagaaagtatttaaatctgtcaggtgttattggaccagtagcatccacagtgaacttcattagctcttgtagacttaaccattgtcagttccttga

SEQ ID NO: 48181 - DNA, 601 bp, Human
tgccaagaaactgtccactttgctccacatcctccaccatcaccacgacttgtgccatcatcaccattcactcaaatgaactcaacagccacctgacaggtcccctgcttctaaccttgctgctctggtgcctatcctcaacattgcagatgaagtcaaatctcaatctgattgcagatgaagtcaaatctcaatcagatgtcatcacttctctgctcaaaaccctaaatggctctccatcttatgtggataacttaaccatgttaagttgtctgactacaacagacaaagaaatatgtcaaaaaaaaaaaaccaaaaaacaaaaaacttgcttaagactataagcttttcaataagaacagttgctcaaagagttgaggatactgataacaacatcaatgtcagtcaaaaaaaggcaaatatttttgaatgattttccttggttgttgacgttgctcaactgtttattcaaggagtcaatgccaaccttgaagtaactaaaaaattaggctctaagaatagtctgtgtggaactacaaataatattttcaaagctgagaaaacactaatttagtacaatctgaagtggaatctactaaga

SEQ ID NO: 48182 - DNA, 601 bp, Human
tgcaatctcggctcactgcaacctccacctcccaggttcaagcaattctcctgcctcagcctcccgagtggctaggattacagaggcctgccaccacgcccagctaattttgtatttttagtagagacagggtttcaccatgttggccaggctggtctccaactcctgacctcgtgatctgcccgcctcggcctcccaaagtgctgggattacagacgtgagccaccgcgcctggcctaacccaacatttcttaatccatatcctaacaatttaactcatctatgaagctccccaatgttyaaaatacacaaccactttataccaattttcccttcttctaaactcagtctatcaatagttcctgcacttaacacaagctgcaacctatattctgaaagaacacaggccagaagtaactttctgaaaaaccaaaaatacattaagaatgtgaatatgttatgaaaatcaccagagcaaacaaaagcttctttatgcttcaaaataattttttagccaaaaatattctaatactagactggcactgctcaaaggtgggaatactgtgtctcattcactatctctgcactgatgcttagtaca

SEQ ID NO: 48183 - DNA, 601 bp, Human
agggagagaccaggaattcaaatactggtttatcagcactcaaaatcatgctgctattcttgcttcccaaattaaccacgtaatattgttaaaacaataaacatgatctgggctttccaaagcaagcatgacagaaagttcttaccacagctgagtaatgttcaatatgacatattgacaaattataagttatctggctggaattaaacaagtaggatgagcccctggaaaagaaaatgtctgtttgatgctaagtgctaaataaggctcaaacccagtatttctttctttctttctttcttttttttttttttttgagacggagtctctctctgtcatgcaggctggagtgcagcggtgcaatctcggctcactgcaacctccacctcccaggttcaagcaattctcctgcctcagcctcccgagtggctaggattacagaggcctgccaccacgcccagctaattttgtatttttagtagagacagggtttcaccatgttggccaggctggtctccaactcctgacctcgtgatctgcccgcctcggcctcccaaagtgctgggattacagacgtgagccaccgcgcctggcctaaccc

SEQ ID NO: 48184 - DNA, 601 bp, Human
gaactagctcagagtataaagtagctatttctcaaattataaaattaaaagtcttaaattctttttctccagatggataaagaaaaattaaagttggcttattatacaatgatatacatgtttatctccacattctcaactctgaagatattttaagatggatattccctaccctttgtgcatgaatgagtgtattttaagataggtataaatagatgcttgggctgctctgaacccttttcccttttaacctacaaactaaaattttccataccacactaaatctgtgcttcattatcaygtagaatatttcctttcaccaccttgctttcaatgttctcatttcaatgcacaatccaacttggccagccttctatcattcttttctcactacctccaaataacaatcctgatcataacaatagcagcttcatgtgtgtggagtgtctatattagctcattactcctcacagccctaactggttactataattgtttccactttacatacaaggaaacagacttaaagaagttactaagttttccagggtcacacagcaaagaagggagagaccaggaattcaaatactggtttatcagc

SEQ ID NO: 48185 - DNA, 601 bp, Human
tttgctttatgttttattctatgtagttaaaggagaatttaagcaagttacaagcctccattctatcaagactaggcttactgcccacttactgttttagcaacaggcaacttaatgcatgttgaatcctgttttagcaacaggcaacttaatgcatgttgaatcctaactcttcttattccatgatttaatccatctttactaagaacagaaatctatttgtaactatgaaactgataaaatataagtataaaaatctgaactagctcagagtataaagtagctatttctcaaattataraattaaaagtcttaaattctttttctccagatggataaagaaaaattaaagttggcttattatacaatgatatacatgtttatctccacattctcaactctgaagatattttaagatggatattccctaccctttgtgcatgaatgagtgtattttaagataggtataaatagatgcttgggctgctctgaacccttttcccttttaacctacaaactaaaattttccataccacactaaatctgtgcttcattatcacgtagaatatttcctttcaccaccttgctttcaatgttctca

SEQ ID NO: 48186 - DNA, 601 bp, Human
gagtgtcggcctgggcattaggaaacctgatttctattgtttagaaaaaaacactattacttttaaagaaaacaaaatccaaactctttattatgacccttacttgtcaagccaagtctaactctctagtctaaagtctctcagcactgtctcttatgaatcctacactctggcaaaactaaactattgtcagtttacagagcaacttgtactttctctcacatctctatgccatctgctgctccttctacctagatcttcttcccattgcttaacttgatgtacatgtggtaggggctgytctgtctcaccccaggttagatgcccctctcctgcactccacagcatttcttcactcaatataggttattcagtgacagacacaagccatgcactgcacaaggtattggacatgcacggtaccagagacatgaccctaccccaaaggaatcttgtggtgaagcttactagagaggccattaaaattttgccttttctgtcagtctcttcctcctccaagtaaacaacaatattctaggccaggcgtggtggctcacgcctgtaattccagcactttgggaggctagggcaggtggatcac

SEQ ID NO: 48187 - DNA, 601 bp, Human
agggtcttgctctatcttccaggctggagtgcagtgaggagagcctagctcactgtagtctcagacacctgagctcaagcaatcctcccacctgagcctccctcagccacaccatcacgcgccagctaatttctttttttttttctggagatagggtctcactctgtcatccaggctggattgtggcaatgcgatcaagctcactgcagtctcaacctcccaggctcatgcgattctcctacatcggtctcccaagtagttgggaccacaggtgggcaccacccccagccccaggtaattkttttttttttttttttttttttttggtagagaggggagtctcactatattacccaggctggtctcaaactcctggactcaagagatccacccgtcttggcctctctccgcctcccaaagtgctaggatcacaggcatgtgccactgagaccatttctcatttaactattacttttcagaaccaagtataatgctagcaacagtatatgcaaatgcaaagaaaggttttttcatttattcatgtacagagatctgctatacattcctggcatcattccaggaacaaaaattcaaagacact

SEQ ID NO: 48188 - DNA, 601 bp, Human
ctgctgacatttatctggggcatcaaagcataccttctaagcctttacctcttcctcctcaaaatatttctcatcatcccattccaaatagaatattccagggggaacagggaagaggagaacttgaggggggttagggggttaagagggagaaggagagaaagaacagaaccaaaccactagcttcctatctcattttccatcacttgctcattccttttctacggtagggtcatactgaacaacctcaacttcccttaatgtgccatgctacttcttacaaacaagcctttacttatgscagtccttctgcctggtaggttcttcccttcccccacccagcttactcctaatcatccttcaaagttcagttcaagtgcaaccaaaaatctgccttccatgaccctcctcccacctaagactgatgtggatgcaccaccctatgcatgaatgtttctaccacaggatttagcccactgaactataatcaataatttgcctgttttttaagagacagggtcttgctctatcttccaggctggagtgcagtgaggagagcctagctcactgtagtctcagacacctgagctcaagcaatcct

SEQ ID NO: 48189 - DNA, 601 bp, Human
gaggtgaggagatcgagaccatcctggctaacacagtgaaacctactaaaaatacaaaaaattagccgggcgtggtggctaatcccagctactcgggaggctgaggcagagaatggcgtgaatcggggaggcggagcttgcagtgagctgagatcacgccactgcaccccagcctgggtgacagagcgagactccctcaaaaaaaaaaaccacagaatgtccaccctcctttcccagcattagtgacactcctcactcatggcaatcctacaaacttcctggcccttgtaggtcccccccsccaacccaacctacctaggcttcctctgcttgccctttaagtgctctcctggggaccctattctttgtgttaagtacattccctttgcagtgcaaaagcagccatagacaatatataaacaatttgaatgcatcccaataaatacatatttacaaaagcagatttggcccatgtgctatagtttcctcagccctgtaacagaccactgataccaacacgcacgaaccttaaggccttgcctctccctctaatacagcctatatatgttcttcctcctataaatatataccctataacaat

SEQ ID NO: 48190 - DNA, 601 bp, Human
gccgggaggtggaggttgtagtgagctgagatcacaccactgcctgggcaacagagcaagactctgtctcaaaatttaaaaaaaaaaaaaaaggaaggaagaaaggaagggaggaagggaagaagggagggaggaagggagggaggaagggagggagggagggaaaaaaattatgtggttatttttactcatttcaacaaattcttgctgttttgtgtggcaatgaagacagcagtcccatagtaaagagctaaagaaaactgtgtacaagcatccagcaatgccaaaagctctatcagtmtactatgcctactacaaacacacatactctgtgaggggcctgaggggcctcctgtataggacacacagctcgagcatactctacagtcatcacacctgtaatcccagcactgtgggaggccgaggcgtgtagatcatgaggtgaggagatcgagaccatcctggctaacacagtgaaacctactaaaaatacaaaaaattagccgggcgtggtggctaatcccagctactcgggaggctgaggcagagaatggcgtgaatcggggaggcggagcttgcagtgagctgagatcacgccact

SEQ ID NO: 48191 - DNA, 601 bp, Human
ggacttttatatataatctatatacttatatctacgtttttgattttcaaaaagatatatgagtatcaccaagggataaagaaggcctaaatggatcttttacaatcttacctgtggcccacgtatagcggctcatgcctgtaattctagcactttgggaggccaaggttggaggacagcctgagcccaggagttcaagaccagcctgggcaacacagagagactcccccttgcctgccccccaccaccctccttttccaacaaaaaataaattagctgggcatggtggcacatgcctttrgtcctcgctacttgaaaggctgaggtgggaggatctgcttgagcctgtgaggtcaaggctgcaatgagcctggtcacaccactgcactccacactgggcaaacagtgagactctgtctcaaaaagaaaaaaaaaaaaatccaacaacaacaaaaaaaacctacctgtggttatccctgagagatacaattcaccagcaattattttttgtatacagtatttttttaaatgttctacaatgaacatatattgtattagaaggaaaaaaacacattgtaaatgcaattttaaactttttttt

SEQ ID NO: 48192 - DNA, 601 bp, Human
agtctcttgtccatcctgctaatgagttaactacctttttcttgacatgttacatattttttatgcaaactgttagaactatgatttaccaatatcttctcccactctgtaatttgcctttcactctcctactaattttttgtttttgagatagtgtctcactctgtcacccaggccagagtacagtggtgtgatcatgcctcactgcagcaccaacctactgggctcaagcaatcctcctgtctcagcctcctgagtagctgggactaacaggtctgtgccaccatacccagctaatttmttttttttaattttttgtagagacagggtcccactatgttacccaggctggtcttgaactcctagactcaagcaatcctcctgctgtggcctcccaaagtgctgggattacagaagccaccatgccaagcctaataatgtcttttgaggaatatgatgtcctaactttaatgtagcataactcatcgatttttcttttatggttgctttttgtgtccagagataataagatgttatccatcataatcctccaaaactatgctctccaacacagtacccactagtcacgtgctaaggagca

SEQ ID NO: 48193 - DNA, 601 bp, Human
ttgagaggctgaggcaggagaatcacttgaacccaggaggcagaggttgcagtgagccgagatgatgccattgcactccagcctgggcaacaagagcaaaactccatcacaaaaacaaacaaacaaacaaatgaaatgataaattaaaattttaaaaaaatacagaaaagctcatagaatatggatataaagaaaatattggctaggtgcagtgcctcgcttctatcatcttggcactttgggaggccgaggcagatggattgcttgagtctagaagtttgagaccagcctgggcaacatrgtgaaaccctatctctacagaaaaaattagctgggcatggtggcacacgcatgtagtctcagctacttgggaagctgaggtgggaggatcacttgagcccgggaaggggctcacattgtactgctgtacaatgtgcctctgttgtaagctaagtgttattacaaaatagtcataagtttaaaaacatttaaaagtttataaagttatagtaagctacggttattactgaagaaaaatattttttataaacttagtgtacagcctaagtgtacagtatttataaaatctacagtagcgtac

SEQ ID NO: 48194 - DNA, 601 bp, Human
ccaacatggagaaaccctgtctctactaaaaatataaaattagccgggcatggtgacacatgcctgtagtcccagctacttgagaggctgaggcaggagaatcacttgaacccaggaggcagaggttgcagtgagccgagatgatgccattgcactccagcctgggcaacaagagcaaaactccatcacaaaaacaaacaaacaaacaaatgaaatgataaattaaaattttaaaaaaatacagaaaagctcatagaatatggatataaagaaaatattggctaggtgcagtgcctcgctyctatcatcttggcactttgggaggccgaggcagatggattgcttgagtctagaagtttgagaccagcctgggcaacatagtgaaaccctatctctacagaaaaaattagctgggcatggtggcacacgcatgtagtctcagctacttgggaagctgaggtgggaggatcacttgagcccgggaaggggctcacattgtactgctgtacaatgtgcctctgttgtaagctaagtgttattacaaaatagtcataagtttaaaaacatttaaaagtttataaagttatagtaagctacggtt

SEQ ID NO: 48195 - DNA, 601 bp, Human
aaaggatgatggaggttaggtgaagactatctacgatgcagctaaagcctcaacaccatgccttcgtgggactccccaaccatgacagaagactgggggctctctggaaaaggagagcatccttagacagaagtcaccctgcccaactgtacaaaacagaggtcgatctagtcactgaacacacatttcagctcctccactacgccctatgcactttcctctcaaacttcagatagtcaggtctttaccctgcaggaacctgatacgtctaagaagaaagatctaaagataccaatgctgrggatttcccaacaaatgggccatccagaatatcctgatgcaaaagtcagagtcaaaaggctgaacccacttgctaaagcttccaaagaattttttattcaccacaaggaaattaataccagacatgtgagaaaattctgtaacacaaaagacagagaacaacacgggagggtggggaagcggggaaggaataaaaaagccacttgggggaaataatacattactcacgcgttttagtgaagctggggaaaacagacctactgtgctgccagtcgtataaaagtctagcacatacgattat

SEQ ID NO: 48196 - DNA, 601 bp, Human
aaacccgtattttagttgaaggaaatatacatgaaataactaagaaccattaaaacaccaacaggcataattaatctgacacaaagttagctaacaaattcagaggaagatggcaaacagaatatacacatctatttcacttccactaaaattatacaaaagacacagatatggtttggctgtgtccccactcaaatcttgaattgtagctcccataattcccatgtgttgtgggagggacctgctgggaggtaactgaatcatgggggcaggtctttcccgtgttcttctcatgatagcraataagtctcacaagatctgagggttttatataggggagttcccctgcacacactctctcttgcctgctgccgtgtgtaagatatgtcttgcttccccttcgctttctgccatgattgtaaggtctccccagccatgtgggactgtgaagtcaattgaacctctttcctttataaattacccagtcccaagtatgtctttattagcagtgtgagaacaaactaatacagacatattaaaaagataaatttaaaaaccaaacccacaggacagggagaaatgaaagaaaaagtaactgaat

SEQ ID NO: 48197 - DNA, 601 bp, Human
cacaataactctgaagaaatcaaatgacaatttaaaaaaatacttctaatttctctttcctctttccattgcagtcagagagaacctgaaagactatatatatatataaccaccattatttcactagtttttttcaaggctttattgtactgtccaccttacagttagcttcttcactgcttaccatacttactgtactggaccttgaatgaagaataacaaatttggaaaaggcctgtcttcaaacccgtattttagttgaaggaaatatacatgaaataactaagaaccattaaaacaycaacaggcataattaatctgacacaaagttagctaacaaattcagaggaagatggcaaacagaatatacacatctatttcacttccactaaaattatacaaaagacacagatatggtttggctgtgtccccactcaaatcttgaattgtagctcccataattcccatgtgttgtgggagggacctgctgggaggtaactgaatcatgggggcaggtctttcccgtgttcttctcatgatagcgaataagtctcacaagatctgagggttttatataggggagttcccctgcacacactct

SEQ ID NO: 48198 - DNA, 601 bp, Human
gagacctgccaaatgcagggactgaaagagctataacacaaacaggactaaaacacggcctcctgcttgccatgttgtgagcaacgagcagaggagaatccccgagccagggctatgacaccctctttggggctttgcagttcctggcatctccactcttctgggcgccacctcgttcccctcatccagatgcgggtttccacagcagaggctgcatgcagtacatctggtccagctgcagccttgcacagaactggcacctgtgccagtgcctggagctgcccaccccgctacagcagcyggctgtgcaaggtggctggaccacatgctcacacacccacacacccctcacagctctgcgcctggctcgcccttggcaggtgtgggatccaggcttgtagtgtgagccaagcacagcatgccaagccgagtaggcgaacaagcccagtgggcatgggcaatactcaggcagaaggtgccaccagccaccgtgatttctggctggtgaagcggcaccccaaagatcctgtgacactattagtagttaggttttggggagtcaaaagttatacacaaattttcaactgcaaaggggatgggc

SEQ ID NO: 48199 - DNA, 601 bp, Human
gcaatataagcaatctagagatgatttaaagtacagttgacccttgaacaacatggatttgaatggtacaggtccacgtatagggggattttttttcaataatagttacactgagtgtgcctgcctctcctgcctccccttccacttttgccacccgagacagcaagaccaacccctcttcttcctcctcctcctcctcagcctactcaacatgaagacaatgagaatgaagatgtttatgaagatccacttccatttaataagtatattttcttaatatttcttaatatttctatatttyttaatatttcttatgatcttcttaatattttttctctagtttactctgttgtaaaaatacagtatataatacatatacaaaacgtgttaatcaactgtttatattctcaataaggcttccagtctacagtactgatagcagtggaagccagtctggaggggctgctgccaagacacaggctgcagtggggctggcaggaggtgggaacaggtggaaatcccaaccccctactgagttggcggggcaggagccccacattcccaggtacagctgcagcctcctagcctcggctccggagct

SEQ ID NO: 48200 - DNA, 601 bp, Human
ggagggctgatgttaatagccaggggtgaaaacagggtttaactgactagttgtgcccaggctaactcagcatttaccctcggacaaaaaataataataataataattttttaaaaatcccaaggggctatttctctagaaaataaagcaaaggtttctggtataggtgttaacaaccttacagtaaaactctcctttattttgttatttaggggcccacagactaaaagcatgctgaagcaaagtacttcagttctgaattcctaccaggggctaaatctaactccgaaaagtagctagwcctgcttccctatacacttacagacaataaaggatcatcagacatacagggaataccaccttcatgaaaaagaaacaaataccggagaaaacaaagagaaaaactggccttgaaagaaagctaagctgggaaagctcaagaaaacttaaaattaaaaataataaactagttttagagttcaacccatgagcagtccccagaacacttgtagttgcagataaaatacaaatgtaaaaatcccaacataaaagaaataacaaaaacaaaatatgaggcagaacagggagacatgctggaact

SEQ ID NO: 48201 - DNA, 601 bp, Human
ctgtctcaaaaaaaaaagactaaagagtcatgactatatattacaagtgattccagacaggatcctgtatcaagggtaagaactgctataagggacatcacttgccaaaatatgaccatggtctacagccatgccatccaatctcaaaagctaagcagcgtggggcctggttagtagtattgggattgggaggctgcctgaaaatactgggtgctgtaggcttaaaataaaattgtttttttaatatgaacatggccgggcacagtggctcacgcctgtaatcccagcactttgggaggcygaggcaggcagatcacctgagatcaggagttcaagaccagcctggacaacatggtaaaaccctgtctctactaaaaatacaaaaattagccgggcatggtggtgagtacctgcgctacttgggaggctgaggcaggagaattgcttgaacccaggaggcagtggttgcagtgagctgagaccacaccattgcattccagcctgggtgacaagagcgaaactccatctcaaaaaaaatttttttaattaaaaaaaaataaattcaacatgtgtaatacaacaatcacacacataaattcaa

SEQ ID NO: 48202 - DNA, 601 bp, Human
aagaacagagtagagcacggggcctggcccacggaaggcactcaactgtgtcgaatgaaagaataaatccatttacttttcttgattcacattcactcatcactagctccagctacacttactgttcgtattgacatatcctaacatatccctgataggatgggcaagtaataaatacagacttttgcttgaagaacttgggattaacagttatgttcatgatgaaaaacacaacatcctgtacatcaggaaagaaacactactttgcatttgggaggccgaggcgggtggatcacctgargccaggagttcgagaccagcctggccaaaatagtgaaacaaaaaaattggccaggtgtggatggcgccacttgagagactcaggcaggcctgaacccgggaaacggagcttgcagtgagatgagatagtgccactgcactccagtctgggtgacaaagtgagactctgtctcaaaaaaaaaagactaaagagtcatgactatatattacaagtgattccagacaggatcctgtatcaagggtaagaactgctataagggacatcacttgccaaaatatgaccatggtctacagccatgcc

SEQ ID NO: 48203 - DNA, 601 bp, Human
acaactccaaatcaccaaggaatcatctgaaagatgagtggggaaaaatgaacagaagaacagagtagagcacggggcctggcccacggaaggcactcaactgtgtcgaatgaaagaataaatccatttacttttcttgattcacattcactcatcactagctccagctacacttactgttcgtattgacatatcctaacatatccctgataggatgggcaagtaataaatacagacttttgcttgaagaacttgggattaacagttatgttcatgatgaaaaacacaacatcctgtacawcaggaaagaaacactactttgcatttgggaggccgaggcgggtggatcacctgaggccaggagttcgagaccagcctggccaaaatagtgaaacaaaaaaattggccaggtgtggatggcgccacttgagagactcaggcaggcctgaacccgggaaacggagcttgcagtgagatgagatagtgccactgcactccagtctgggtgacaaagtgagactctgtctcaaaaaaaaaagactaaagagtcatgactatatattacaagtgattccagacaggatcctgtatcaagggtaag

SEQ ID NO: 48204 - DNA, 601 bp, Human
ctttgtctcccctcatgcaaagagagacgatgcaaatagaaggcgtccatcactaagtccactagtgtagggctgtcctgttccctgtgctttcattctatgtcctgaccaaataccagagtgctttgaccgctctgtgacccagccacgtgcaggttttccctagcaagcttgaactcagtatggagccttaaacattcccaggcattgataaaggtatctaagttgctgcacaaaacactgaaagaaactagccctagacctgagacaaattcctcaaactctcataaaaactccacaycttaatccccttgctgcagacatacctagagagaacaccgccccactcctttttgctgtctgtcacaaggattgtcgcaatcctctgtaagtttccccaataaatgctctagactgatcaccctggtgtttagtacttctttctttagaatcccaaccagccccatctcaggataatctggagcactcccttgtgggaactgccctgccactgctttgggggcaactccagcctcagctcagtggtacaaaacaaagagcttcagctgaggaaacaactccgcaccaccccttgggtaaa

SEQ ID NO: 48205 - DNA, 601 bp, Human
agacaacacaacctcctcttcacatctaacacaattcacagtacaaaatcgagagtatctttgtctcccctcatgcaaagagagacgatgcaaatagaaggcgtccatcactaagtccactagtgtagggctgtcctgttccctgtgctttcattctatgtcctgaccaaataccagagtgctttgaccgctctgtgacccagccacgtgcaggttttccctagcaagcttgaactcagtatggagccttaaacattcccaggcattgataaaggtatctaagttgctgcacaaaacactraaagaaactagccctagacctgagacaaattcctcaaactctcataaaaactccacaccttaatccccttgctgcagacatacctagagagaacaccgccccactcctttttgctgtctgtcacaaggattgtcgcaatcctctgtaagtttccccaataaatgctctagactgatcaccctggtgtttagtacttctttctttagaatcccaaccagccccatctcaggataatctggagcactcccttgtgggaactgccctgccactgctttgggggcaactccagcctcagctcag

SEQ ID NO: 48206 - DNA, 601 bp, Human
gataggaacaacttttcaacaacatataaatgtttattttatatctattagacaaactgtccataaacgatagaaccaaacagaaggaaaaaagctactttacacccatgaaatgtcccagggccccagagcatattatagcaggagctactgtggaaaagaaaaaatgattcatatcaacaactcaagaaggaatcaagaatcaggattacaattcactgaaggcaagcaccccaggtccagaggtaagcacctatgcctcagagtgacttatcctgacagattcttagagagcataaayaacacctaggctgcgatgtatccatggttctctggcctcaggacccatcaactgtagacaggtcctcccagaagaaagttattagtacctcgcctgaatataaacggggttatcctatactagagacaagggaagacggggaggggttcaaagctgagtccaatgccaaactggcttgcaaagacctctatctgagattcactctgttatttgaaaccaataaaatgaaagtttttttcctaatgcgctgttcatgtaatctcaatgctcagtatgtcctcatctttttttttttttttt

SEQ ID NO: 48207 - DNA, 601 bp, Human
aaaccacagaagttcagctgatcttttgcatttacttttacctttggtatgtatttaccaattctgagaagaagaagcaggtggagaatctaggctgtgcattcacagaaaactgctgccagaagacagaaaaatcaggcaaggttttggaacgctaaatcctagagcattagtattcttactgtataaaggtgtatttattgtcaaatattattctgcaatgaaaaggaatgaagtactgatacatgctacaacatggatgaaccttgaaaacattatgccaagtgttagaagccacaaragaccacatacagcctgattccttttatataaaatgtccagaataggcaaatctataagaaagtaggttagtggtttccttgggctgaagataaggaataaagagtgactcctggtgggtatggggttttcttttggggtgagggaaatttctaaaattgatggtggtgattgtactcattgtatagtatgagaattatacgtcaatttaaaaaaaaagacacaaagcctctaaaggcagtgagtagagattttcaagtcttacaagacaaagattaaagttccacacacgaggaagata

SEQ ID NO: 48208 - DNA, 601 bp, Human
gaacaggaggggctaaaaaacttcaaaaccacagaagttcagctgatcttttgcatttacttttacctttggtatgtatttaccaattctgagaagaagaagcaggtggagaatctaggctgtgcattcacagaaaactgctgccagaagacagaaaaatcaggcaaggttttggaacgctaaatcctagagcattagtattcttactgtataaaggtgtatttattgtcaaatattattctgcaatgaaaaggaatgaagtactgatacatgctacaacatggatgaaccttgaaaacaytatgccaagtgttagaagccacaagagaccacatacagcctgattccttttatataaaatgtccagaataggcaaatctataagaaagtaggttagtggtttccttgggctgaagataaggaataaagagtgactcctggtgggtatggggttttcttttggggtgagggaaatttctaaaattgatggtggtgattgtactcattgtatagtatgagaattatacgtcaatttaaaaaaaaagacacaaagcctctaaaggcagtgagtagagattttcaagtcttacaagacaaagat

SEQ ID NO: 48209 - DNA, 601 bp, Human
catatacaagaatgcacatatgcaaatacagtttcttttgcattacaccaatataatgtgttctacatactcttctataccttcttaaaacttactttaaaatatatcttcagcctaggcaacaagatgaaaccccaactctataaaaaaatataaaacaattagctgggcatggtggcgcctgcctgtagtcccagctgctcaggaggctgaggtgggaggattgcttgagacggaggaggctgaggctgcaatgagccatgattgtgccaatgcacatcagcctaggtgacagaacaagaccttgtggttttaaaaaaaatttttaaataaaaataaaagtatattgttcactatagattttcttgcataaatttttgattcttaaaaatactgtaggccaggcgtgatgactcatgcctgtaaacccagcactttgggaggccaaggcaggaggatcacttgagcccaggagttcgagaccagcctaggcaacatagtgagacccccatctctacaaaaaaattttaaaatagctggttgtggtggcacacacctatagtcccagcctgggaggctgaggtgggagggctgtttgagc

SEQ ID NO: 48210 - DNA, 601 bp, Human
attgttccagccctgtacaaggtggctttatgtgtgtgtgttttaaaatgtgtccccctaataaacttggaggtaattactaatatcatcattttcaagaaaaagaaaactgaggctcacatacacaagtaaggacttgtgatacaattagactgtaaaagtaaaatgtcaaagccgcatgcaactccaaagcccaaatcatcttttccatcaccctaaatttaaaggtccattcagtttatttcaagtatcctaaaacttaaactctgccacatggtattagatatgtgaccctggcacttttttttttttaactttctctccataacttagtttctcgtcggttaaataaagtttaaaatggtatgtatttttcagttatgataattaaacattacaagcataaagggctttgagagcgcccataacaaaggctccatgtcactgtaagtgcatcattactgtctgcctcttctgtgcataggcaataaattaagcagtagggatcccaaaataattggacagagtcccatcccataaggagttgacagaccatcagaagacaagcaaacaaatctgagtacccagaagtctaacttct

SEQ ID NO: 48211 - DNA, 601 bp, Human
tagccgggatggtctcgatctcctgacctcgtgatccgcccgcctcggcctcccaaagtgctgggattacaggcgtgagccaccgcgcccggccacaattttttaacttaaaaaatgttaaaaccatttttaaagagtaaatctcatttatattttacaacaaatctgcaaatataattatgtttacttttataaatgaagagaaaagctttgagagtttaagaacaagtctaaagcgaaagagacaggaaaaagagacaataaccaatcactgactaagggcttatattgttccagcccygtacaaggtggctttatgtgtgtgtgttttaaaatgtgtccccctaataaacttggaggtaattactaatatcatcattttcaagaaaaagaaaactgaggctcacatacacaagtaaggacttgtgatacaattagactgtaaaagtaaaatgtcaaagccgcatgcaactccaaagcccaaatcatcttttccatcaccctaaatttaaaggtccattcagtttatttcaagtatcctaaaacttaaactctgccacatggtattagatatgtgaccctggcacttttttttttttaa

SEQ ID NO: 48212 - DNA, 601 bp, Human
tacatagtagttggccttttttgtcaatttccctcccgtatgcttttggttttgtcatgctggcatgaatggttgttattccagcttaccaagaaatttcaggagtcactttgctaattctatctaaaaatttgtatcattaaaaaatgttaaaaccaacctaacacccattataatagctgctacttttttaaaaaatagaaaataaggtttggcaaggatatgaagaaatcgaaacccttgtgtattgttggtgggaatgtaaaatggtacaactgctatggaaaacaacatgggtggkcctaaaaatattaaaactaggaccaccataaagattcaataatcccacttctgggtataaaccaaggaactgaaatcaggttctgcaagagatattcaaacacccatattcatagcagcattattcacaatagccaaaaggtagaagtaacccaggtgttcatccacaaataaacaacatgtggtatataaattcaatgaaatattattcagccttgaaaaggaaagaaattctaacacatgctgaaccttgaggacattatgctaagtgaaataagccagtcacaaaagaataaataac

SEQ ID NO: 48213 - DNA, 601 bp, Human
ataatatatatatatatatatgtatatatataatatcagtagcagctagtgtggatctatccctcattatatctatattccaagcaacagacataaataagacagcttttcttctttccaaacggagctacatagtagttggccttttttgtcaatttccctcccgtatgcttttggttttgtcatgctggcatgaatggttgttattccagcttaccaagaaatttcaggagtcactttgctaattctatctaaaaatttgtatcattaaaaaatgttaaaaccaacctaacacccattgtaatagctgctacttttttaaaaaatagaaaataaggtttggcaaggatatgaagaaatcgaaacccttgtgtattgttggtgggaatgtaaaatggtacaactgctatggaaaacaacatgggtggtcctaaaaatattaaaactaggaccaccataaagattcaataatcccacttctgggtataaaccaaggaactgaaatcaggttctgcaagagatattcaaacacccatattcatagcagcattattcacaatagccaaaaggtagaagtaacccaggtgttcatccacaaata

SEQ ID NO: 48214 - DNA, 601 bp, Human
tctcaagtacctctaaaattaatggcataaaaactatttcattatctaaaaaggcaaagacaacaaaaccctgaccttattaatctaagtagtatttttacggactctaattaatgataatttcttatttctgttttgacatatatacagagatcaaagctaaattccagatttagaaactgctgagaggttaactgctgtaattgcttttttcttaaaggctcctgaaatctgtaagatgctgcattagtttttcagatgcagtggtagaagcatgacaacacaggacagaagaagaagytcaaagtgttcaatctatccatatatgttataaaacagagttttttttattgcttatactgaccataataatgcaaacatcaaaaggcaatccagtagttacttaacgctaacattgcccaaaacaaacatagaacttttattttatggaaaatgtatatacacacatgcaacttatttcatcaccatcaattttttttaccctataaatgcaatttatccacagtttgactgctcaccttatttaacaaatagcaacagtgtcaagctattgtgtctttccaagttaggttaactttcc

SEQ ID NO: 48215 - DNA, 601 bp, Human
tatcaagcaactatagctgtatataaaataactgcatttaacccataacacaatctcagtgaagcagctacttccctattttcacagaagatgaaaatgaagttcagagaggccaagcaacttgcccaaggtcaaagagctgcaaaatgaggcaagtactggctagtttggtgatacagagttttattattttcttcctgctaaatattaaagacaaactatgcttttaaattcctaatccagtgacatcttgaaaagaacagaaacagactacagttaatggcaacataagtgaaaaagmgtaagcagtcctctatattcccttatttatgaattctacatactaatataaaagccaaccacttatttaaaagttctgtgacctttacaccaacctcttttagtactggcatattttaaagcaattctggtaaatcctacttgaaaagtaaactcttatctttaccttccagatataaccagaatacatgtatttctcaccacatctcctggcctcaccccggcccaggctgcctggattacagccataggcctcctacctggtctctctgctccagctctcaccgccctacactctatt

SEQ ID NO: 48216 - DNA, 601 bp, Human
tcaatatccaaatatcatctcctaatgtgcaagatcttgagagtataggaagatgttaagatatgaaagagcataaattctccaggccagagaccaaggtgactaagtagagaccagattgaaacagcagctatggaaatgttaggaaccaactcatgccacagagaagagctgaagaggatacaggtgatactgctaataataacctataccttttatcaagcaactatagctgtatataaaataactgcatttaacccataacacaatctcagtgaagcagctacttccctattttcayagaagatgaaaatgaagttcagagaggccaagcaacttgcccaaggtcaaagagctgcaaaatgaggcaagtactggctagtttggtgatacagagttttattattttcttcctgctaaatattaaagacaaactatgcttttaaattcctaatccagtgacatcttgaaaagaacagaaacagactacagttaatggcaacataagtgaaaaagcgtaagcagtcctctatattcccttatttatgaattctacatactaatataaaagccaaccacttatttaaaagttctgtgacct

SEQ ID NO: 48217 - DNA, 601 bp, Human
tcctttcttcgtttcaaaacataagtgagtaataaactcatactaaagaagacagacagaaaacacccttacaatctgtactagcaactttttaaaatgcagagctacttagtttttccattcaaactgtgagacagtcaaggtcatctcaaaaatttagctgtctgaacacattccactttagcagtaagataattagtaactaggctcctggtgcctttgttctccgaatgtacataagacacactgagactctacagttctagctttcctaaatgtgggtaattttgttagtagtacatttgtataaaccaatcaaaaatcaagtattttacttaacagtgaaaatgaccgaggctttgtttatgaagtcactaacttctgaaaacaatagcttaacaaaggctgaggagaacaagaggcttatttgtgtccagtgatgccccaggacagttgtttcatttctaacatgctactcttgatgatggctttgtctctaggtttactttcaggctcctaatagtagccagagttcaagtgacctcttctatgctccactgaaaacatatcattcaccagcatgaactctgaccccagggaa

SEQ ID NO: 48218 - DNA, 601 bp, Human
tctttaacattagcttagggaatattgaggtatccaagaggcatgatttcctttcttcgtttcaaaacataagtgagtaataaactcatactaaagaagacagacagaaaacacccttacaatctgtactagcaactttttaaaatgcagagctacttagtttttccattcaaactgtgagacagtcaaggtcatctcaaaaatttagctgtctgaacacattccactttagcagtaagataattagtaactaggctcctggtgcctttgttctccgaatgtacataagacacactgagaytctacagttctagctttcctaaatgtgggtaattttgttagtagtacatttgtataaaccaatcaaaaatcaagtattttacttaacagtgaaaatgaccgaggctttgtttatgaagtcactaacttctgaaaacaatagcttaacaaaggctgaggagaacaagaggcttatttgtgtccagtgatgccccaggacagttgtttcatttctaacatgctactcttgatgatggctttgtctctaggtttactttcaggctcctaatagtagccagagttcaagtgacctcttctatgc

SEQ ID NO: 48219 - DNA, 601 bp, Human
aacctagaaaatcatgatgtagttgaacccatgttaaaacaaagtcctttttaatactttaaaatataatcttccttggatgggacctaaggtggattctttacaccaaattcaaccgcacagtgagcttggttcaaacaccccagaaggctttaagggtaccttaaaggtttcagttcaaggtatataaatatagtctgctctattatttttagcttgtcctggtattttatgtgtcttcttaaattgggacactgctgtgctttttgaggttaatgtgactgataaaatcaaatgtgtrgtttagaatgtctaactgcagatagagatttgtatattctttggatttgagcttttcactgtgtctttatctacaagttgtaacttttatacttgaatataaccaattcagccaattcctatacaccaacatctttgtccttatcacacagataaaaattaaccagcataacaacaaggtttcctgcctccctgtcctggtacaagagtaacatgaggggagagagaggaagtttactaagatagttacacactgggcaatcacaatggaagcagtgtgtgcagcaccaggaaggaacag

SEQ ID NO: 48220 - DNA, 601 bp, Human
ccatgcattctactcttaggtatttttctgtgcacactagtcattgattcattcaacaaatatttaacaaacacctagtatgtgccaagcatatggcagtgagcaaaagatgaagacacctgcttcctcatggagctcatttaagctgagaccgaaaaggttaagtaggagttggctagtcagagaatgcagagatgatggttctaggaaggtgcaacagaaggtataaacgcctgagaggaagagttcggggtgtttgaggcactgaaaagccaaaataattgtgctattaatgagcaamaggacaacggcccaaagctggagaaatcaagagatcagatcaggatttaacaaccaaatatctgacactctttagtccttcctagcctttcaaaaacatgaaataaataatgtaaaaactggtataatcaaataacttcccaaacagggctttctgcatttgatagtcttgcaacctaaaataccactgtgaacatttacatttaattcaatattctgaatcaaaactgtctttaaacctagaaaatcatgatgtagttgaacccatgttaaaacaaagtcctttttaatactttaaaat

SEQ ID NO: 48221 - DNA, 601 bp, Human
gtttaaagtaagagtctaccagccaggagtggtggctcacatctataattccagcactctgagaggccgaggcgagtggatcacatgaggttggaagtttgagaccagcctgaccaatatggaggtcttatctctactaaaaacacaaaattagccgggcatagtggtgcatgcctgtaatcccagctactcgggaggctgaggcaggagaatcgcttgaacccgggaggcagaggttgcggtgagccgagatcacgccattgcactccagcctgggcaacaagaacgaaactccaactcaaaaaaaaaaaaaaaaaaaaaagtctactacgtcttaggcactgggaatgcagcaatgagcaggacagataggattcccttgtctcatggggtgtacatttcactgagggacagcagctaaaccaaagaagtaaataaataaaccgtcaggtatgttagatagtggttaagagcaaacagaaaagacagaacagggatgggggtacagtgatggcaggaggatgagtccattttaaattgtttgatcgggctgggtgtggtggcacacacctgtaatcctagactttgtgaggccaaggtg

SEQ ID NO: 48222 - DNA, 601 bp, Human
agaagatgccatctaggactttgacagctagaggtgaagtcaatgcttagcttcaaagcttcagaggacaggctgtctctcattaggggctaatgcagctggtgattttaagttgaagccaacactcatttcccattctgaaaatcctaaggcccttaagaatgatgctaaatccactgtgcctgtgggaattcaagataagatttggggggggacacagccaaaccatatgacagcccctcagaaggggccaattctcctgatgtccaaatcgagccctttgctaagaccagtttccacrgaaaagaacacttcagtctcttgccaggattccagaagccaaggagagagaaaacatgccaaatttcacttaattctcaattttgagtataagaatgcattcaatataccatgttttaccagaatttttccataataaaatacatgaaactgggccgggcacagtggctcacgcctgtaatcccagcactctgggatgtcaggagtttgagaccagcctggccaacatggtgaaaccctgtctctactaaaaatacaaaaattatctgggtttggtggcatgtgcctgtaatcccagcta

SEQ ID NO: 48223 - DNA, 601 bp, Human
aggttgaaggaaaaaagccatctccacagcataaaagtacaagatgaagcagcaagtgctggtggagaagctgcaccaagttgtccaaaagatctagctaacatcactgattaatgtggctacactaaatgacacaatgaagaagaaagagtcttttattagaagatgccatctaggactttgacagctagaggtgaagtcaatgcttagcttcaaagcttcagaggacaggctgtctctcattaggggctaatgcagctggtgattttaagttgaagccaacactcatttcccattctgmaaatcctaaggcccttaagaatgatgctaaatccactgtgcctgtgggaattcaagataagatttggggggggacacagccaaaccatatgacagcccctcagaaggggccaattctcctgatgtccaaatcgagccctttgctaagaccagtttccacagaaaagaacacttcagtctcttgccaggattccagaagccaaggagagagaaaacatgccaaatttcacttaattctcaattttgagtataagaatgcattcaatataccatgttttaccagaatttttccataataaaa

SEQ ID NO: 48224 - DNA, 601 bp, Human
tttaaatcaaacgctagaaatgattaagcctagtgaagaaagcatgtcaaaagctgaaacaagccaaaagctaggcttcttgtgccaaaaagccaagttgtgaatccaaaggaaaagtcactgaaggaaatacaaatgctactccactgaacacacaaatgataagaaagcagaacagccttattgctgaaactgagaaggttttggtggtctggatagatcaaaccagtcacaacattcccttaagccaaagactaatccagagcaagctcatcttcagttctataaattgaggtaaggyagctacagaaggaaagcctgaagctagcagaggttggttcataaggttgaaggaaaaaagccatctccacagcataaaagtacaagatgaagcagcaagtgctggtggagaagctgcaccaagttgtccaaaagatctagctaacatcactgattaatgtggctacactaaatgacacaatgaagaagaaagagtcttttattagaagatgccatctaggactttgacagctagaggtgaagtcaatgcttagcttcaaagcttcagaggacaggctgtctctcattaggggctaatgca

SEQ ID NO: 48225 - DNA, 601 bp, Human
tcattaccttaagtgaaataagccaggcgctgaaacacgcatatctcatgttctcattcacagttaggagctaaaaaaagtgaatcccatggaagtatagagtagagtggtggttaccagaggctgggaagggaaagggtacagggcataaatagaagtaggttaaggggtacaaaaatatagttagaaggaataagttctagtatttgatagtacagcaagaaaatcacagttaataatttattgcatattttaaaatgagaattgtaatgttcccaacacaaaggaaagaaaagtgttkgagatgatatcctaattaccctgatttgatcatcacatattgtatacaggtatcacgtatacctcaaaaataagtacaatatttacataccaataacaagtaaatcaatgaaatgagttacctgacacaatgtcttaagaaactcacagttattaagattgaagcctatactaagaataccagtgaagacacaacaagcagatctcactgtttccactattttcagtactgtgaagacagatgctcaatctgatttaccaaatgaagaggacgcaatcggatattccaactggtcctagc

SEQ ID NO: 48226 - DNA, 601 bp, Human
tgtatttgggagacccatgtcatgtgcaaagacacacacaggctcaaaataaagggatggaggaatatttaccaagcacatggaaagcaaaaaaaaagcagaggttgcaatcctagtctctgataaaacagactttaaaccaacaaagatcaaaaaagacaaagaagggcattatataatggtaaagagatcaatgcaacaagaagagctaactatcttaaatatatatatgcacccaatacaggagcacccagattcataaagttcttagagacctacaaagagacttagacttccacayaataatagcgggagactttaacaccccactgtcaatattagacagatcaacaagacagaagataaacacggatattcaggacttgaactcagctctggaccaagcggacctaatagacatctacagaactctccaccccagatcaacagaatatacattcttctcagcacatcacacttattctaaagttgacaacataattgaaagtaaaatactcctcagcaaatgcaaaagaatggaaatcataacagtctctcagaccacagtgcaatcaaattggaactcaggattaagaaaact

SEQ ID NO: 48227 - DNA, 601 bp, Human
ctcttccttctctagttcttttaattgtcatgctagggtgtcgattttagatctttcctgctttctcttatggacatttagtgctataaatttccctctaaacactgctttagctgtgtcccagattaactttaaatgtaagtgtgctaaatatcccaattaaaagacacagactggcaaactggataaagagtcaagactcatcggagtgctgtatttgggagacccatgtcatgtgcaaagacacacacaggctcaaaataaagggatggaggaatatttaccaagcacatggaaagcaaaaaaaaagcagaggttgcaatcctagtctctgataaaacagactttaaaccaacaaagatcaaaaaagacaaagaagggcattatataatggtaaagagatcaatgcaacaagaagagctaactatcttaaatatatatatgcacccaatacaggagcacccagattcataaagttcttagagacctacaaagagacttagacttccacataataatagcgggagactttaacaccccactgtcaatattagacagatcaacaagacagaagataaacacggatattcaggacttgaac

SEQ ID NO: 48228 - DNA, 601 bp, Human
agataaaaagcctctgcagagcaaaagacacaattaacaaagtaaaaagacaacacaaagaatgggagaaagtatttgcacctacccatctgacaacggattaataaccagaatctataaagagcttagaaaactcaatagaaggagttggaggtacaatgagctaaaatcatgctcaatgaactccagcttgggcaagaaagcaagatcctgtctttttttttttttttttaaatacttttaagttctgggatatatgtgcagaacgtgcaggtttgttatgtaggtatacacatgccayggtggtttgctgcacccatcaacccgtcatctacattaggaatatttctcataacgctatccctcccctacccccaacaatcctgcgacaggccccggtgtgtgatgttcccctccctgtgtccatgtgttgtcattgttcaactcccacttatgagtgagaacatgcagtgtttggttttctgttcctgtgttagtttgccaagaatgatggtttccagcttcatccacgtccctgcaaaggacatcaactcatccttttttatggctacagagtattccatggtgtatatgtgccaca

SEQ ID NO: 48229 - DNA, 601 bp, Human
caggatgcaaaaaccaacatatgaaaagaagtagcatttatatacaccaacaacgaacaatgtataaaataaatcaagaaagcaatcacatttacaacagctacaaaaaatatcaaatacctaggagtcaatttaaccaaagaagtaaatgatcaacataaggaaaactataaaacattggtgaaagaaattgaagaggggctgggtgtggtggctcatgcctgtaatcccagcactttgggaggtcaaggcaggcgtatcactagaggccaggagttcatgaccagcctcaccaacatgrcgaaaccccatctctactaaaattacaaaaatttgccaggcatggtatcacatgcctgtaatcccagctactcgagaagctgagccatcagaacagcttgaacccgggaggtgggggatgcagtgagccgagatcgtgccactgcattccagcctgggtgacaaagtgagactgtctcaaaaagagaaaaaaaaaaggaagaaattgaagaggacacacatacacaagttgaaaaatatttcatgttaaaggattggaaaaattaatattgttaaaatgacaacaatacccaaagcaatt

SEQ ID NO: 48230 - DNA, 601 bp, Human
gcaggatgcaaaaaccaacatatgaaaagaagtagcatttatatacaccaacaacgaacaatgtataaaataaatcaagaaagcaatcacatttacaacagctacaaaaaatatcaaatacctaggagtcaatttaaccaaagaagtaaatgatcaacataaggaaaactataaaacattggtgaaagaaattgaagaggggctgggtgtggtggctcatgcctgtaatcccagcactttgggaggtcaaggcaggcgtatcactagaggccaggagttcatgaccagcctcaccaacatrgcgaaaccccatctctactaaaattacaaaaatttgccaggcatggtatcacatgcctgtaatcccagctactcgagaagctgagccatcagaacagcttgaacccgggaggtgggggatgcagtgagccgagatcgtgccactgcattccagcctgggtgacaaagtgagactgtctcaaaaagagaaaaaaaaaaggaagaaattgaagaggacacacatacacaagttgaaaaatatttcatgttaaaggattggaaaaattaatattgttaaaatgacaacaatacccaaagcaat

SEQ ID NO: 48231 - DNA, 601 bp, Human
ttgggaaagaacaaacaaaactatcattattcataaactatgtaagtaaaactataattatgcatagattatgaagaaaatctaaaagaatctacaaataaactgctggaataaataaataaatgtaacaagactgctggatagtaaaacaacaactatacttctgatcattttagctaactcttttgaagcccaaattagaagataaagacaactaaattcatagtatcaactgcttcctggaagaaaagattacacctcacaagtcatcagaagaaaagatatgctagcaatgaaaaarcactacttggaataaatacggagtatgtcgggggagaagctaaaccaaaaataccacacaatccaaatatacctatgtggcccaaaaatcaatggtgagattctccataaacaggccttcataaataggtcttcaaaaaataggccaaaacattttttaaaagataaacttttgttacaatgttaccagaatgaagcagttttccattatagaatgtgattttgctcctatcctttcagaacttaccaaaagaaaaaaaaaaggaatgttattttgttttacactttaatgttttatctg

SEQ ID NO: 48232 - DNA, 601 bp, Human
ccacattttcagaaagaagagccagctacctcgatacatgcagaaaacacatatgataaaatttaccaaccattcatgataaaaactcgcagcaaactagaaataggatgagatttcatatatctgacaaagagtatctacatgaaatgtaaatactagtgggaaaaaaacttcccctccccaaactggaaataagacatggatgcccaccattaccacttgcgtacagcattgttctggaagtcactgccaagtaccatagacgcccccccttccccccaaaaaaacgggggggggggggaaaacataaacattgggaaagaacaaacaaaactatcattattcataaactatgtaagtaaaactataattatgcatagattatgaagaaaatctaaaagaatctacaaataaactgctggaataaataaataaatgtaacaagactgctggatagtaaaacaacaactatacttctgatcattttagctaactcttttgaagcccaaattagaagataaagacaactaaattcatagtatcaactgcttcctggaagaaaagattacacctcacaagtcatcagaagaaaagatatgct

SEQ ID NO: 48233 - DNA, 601 bp, Human
cagagctatacttagagtaaaatctatacatttggcagggcacagtgaatcacgcctgtaatcccagcacttttggaggctgagatgggaggacagcttgaggccaggagttcaagacctgcctgggcttgtgagacccctacaaaataatttaaaaaaatcagctgggcatggtggtgtgtgcctgtagtcccagctccttgggaggctgaggcaggaggactgcttaagccccagagctcaaggctgcagcaagttatgactgcaccactgcactccagcctgagcaacagagcacaamcctgtctcctttaaaaaaaaaaaaaaaattacgtatttaaattcatgtattagaagcgaaggttgagtatctctaagaatacacatctgtgaaggggggatggttaatgcacagaaaaatagaatgcgtaagagctagtatttggtagcacaactaggcattatggtcaataaaaatgtacatttaaaaagaactaagagtataattagaatgtttgtaacaccaaaaaaagataaatgtttgaggtgatggataccccatttagcctgatgtgattattatgcactgtatgcctatatc

SEQ ID NO: 48234 - DNA, 601 bp, Human
ccacttctaggaatttatgccaaagatatactgttaccaactaaatgtctgtgtgctcccaaaattcataagttgataccatactccccccaatgtgatgctattacaaggtagggtcttttggagggaatctgaactagataaggtcataatggtgaggccctcatgaatgggattagtgcccttgtgaaagtccaagagcatgcttcctctctctgctctccagagatatgcctgaggatctaagtccacagtctgaaaactggaaaaaaagggccctcaccagaactccaccatgctrtcactctgatctaggacttccagcctctagaccagtgagaaataagtttctgttgtttataagccacccagtttatgtattttgttacaatcgtcccaagtgaagagatatacttaacaacaacatgaaaatacatatgcataaggttattcactgcagccttacaaagtattaggaaacacctaaatgcccattcatgggagactaatagagtaaactatggtacattcctataatggagtactatgaatctgctgggggaaaaacaaaaggaaagaagaagagccctataattgacta

SEQ ID NO: 48235 - DNA, 601 bp, Human
tgttgactaaatgaaaccgggttctgagtggaggagtgaagtgctctggctttcatctctccaggatcattctggctgctgggttgtcaacagactaaggagagcaagtagggaaacaagatgtcagttaggataccatgccataatgtatggaagagacattttaaggcagctactgaagaagagctcaaagaaaggggtagcagtggaggcaatatgaaatgggtaggttctggatatatttttgaagataatgtggacaggattagctaatgtattcgatatggcttgagagcaaaaraggaataaaagacgattgcaaatggatctgagtaactaaaagatgaggtaaccctttgactggagcactggatggttattttgtagcaagaagtgtaaagacagagaagtgaggtacaaatgctggggaaagggaagatatagaaatgtgtggacttttccaagtactgcaggttgaagaaagtggacgaggtatgaaatggttgtctaggagagaacaagatggggggatagagcatgacagctgggtagcactaaggttgcaaatctagaatgtaaccaatcacaggatggcgacagg

SEQ ID NO: 48236 - DNA, 601 bp, Human
agaaatattccatttcaccttggatgccatatagtcattcaacaaaagtacctatacctactgagcacttggctgtttgcctgctagacactgttaaagacgttggcaataataccatgaagtacaaagatccctgatgtcacagaacttaagaagttggggaagaaaacagctaataaatgagcaaacaaatcaagtacaagacgatgtcaataataatgatctgaagaaaataaaatagtgacagaaaaacagcaatggtgaggcataagggagcattcttagactggcatgccctggsaggcagagttagtaagggcagggtgagaacaagcaaggagccacatcccgtaggtccttgtaggccacaaaaggaatctggcttttagtctgggagaaatggggagctcttggggggatttaagcaaatcactgattcggtgattagtatgttagagaaacaggaagcagaaagaaaaagtgagtgactaggacagaggtgacagggcatgatgggacaggatgggggagatgggtgagactctcaaaggacgtgcatgttgactaaatgaaaccgggttctgagtggaggagtgaagtg

SEQ ID NO: 48237 - DNA, 601 bp, Human
tctagctttcttcctagatgatactttccatcctgtaaaggaagagtttaattttctaagacctccatagtcctttctagaatcaaaactatttgaatccgtaacaatcaatgttcaattgattgttattaataatcaattgtttttaaatgtttttaaacatacattcacctgctcctctgtcagagagaacagcttacacttctaacacacacaaagtgtccagtgatgacacctaacaataaacactgaagaccgttggactgctctgaaaagtcctccaggcacctacctatggccraactcagggaaaactccctgaagaattcccttcccctacagataccagttgtttatagcatagtttgttcttgcagaatcccaaatcactgtacattttcccattcctatcagaaggatgattttaaattgaacacaacgttacttcccattaccagtcttcccactaccagcttggtaacagtaattagtattaatccaacccaacacacctatattttaacaaactacatgaactgatttttttccatttactattacagattcagatttaccaaccattccctactgactcatgact

SEQ ID NO: 48238 - DNA, 601 bp, Human
atgtaggcatctttaggagccaacattctacctatgggaaatcactacctcaatcactatctctcaggattttgaattcaaaattttttcttcctcgtgctctgttagcttaggttctcctctttaacatggcttttatgctttttcttaaagctttcctttctagctttcttcctagatgatactttccatcctgtaaaggaagagtttaattttctaagacctccatagtcctttctagaatcaaaactatttgaatccgtaacaatcaatgttcaattgattgttattaataatcaaytgtttttaaatgtttttaaacatacattcacctgctcctctgtcagagagaacagcttacacttctaacacacacaaagtgtccagtgatgacacctaacaataaacactgaagaccgttggactgctctgaaaagtcctccaggcacctacctatggccgaactcagggaaaactccctgaagaattcccttcccctacagataccagttgtttatagcatagtttgttcttgcagaatcccaaatcactgtacattttcccattcctatcagaaggatgattttaaattgaacacaac

SEQ ID NO: 48239 - DNA, 601 bp, Human
attcaggaacacacagttaaggctacgtttctggtgacactggaaatacatgaaaagttctttgaattcgggcctaatcagtttattattacttgctctttaaaaattattatgaagcaatcttaaatactcccaaatctaatgcctctaacatgtgttcccttgagttcagagaaggtcacctttgaatgaggtcatcagggaatgttccctagagatggtgaaatttctcctggagcaatggacaggttaagtgttagaactgactcttgccctgtacctacctaggtatgagggccakgagagaatatgttgttaagtgggcagcatgtatggaagactcatttgggaacatgacagaaccatttgctgtcctttacacgagggtatgcaaattacaaccaactgtgaccttctcaatcttttaggtgataagacaagtttttttttaaatgatgctgatattaaaatgaaaaatgtctatgaaagaaaataatcactgctttttaaaattagcaattaattgaagctataatacaacttgttaagacatacaaaaaagttcctgcactcatcaagtattgctttattacagcacaat

SEQ ID NO: 48240 - DNA, 601 bp, Human
tcttgtgcatgtttttaaaaagcaaaagaaatcaagtgtgcatcacaccaaagcaggtttgtatcttacttccactcctctggtgggtgagcaagctcatacttctccctcacactggagacgcccatatccacgtgaagccagtgaacctcctctgaccgcaggtgactgaggcggaatccatagcaggccacatgctttactttgtgactgtccactatcttctgaatgatgccctaaaacataccccccacaagaatgactgttataaactgaaaaaaaaaaaaaaaaaaaaaaaaamccaaaacaaaacaaaaacaaaacaaaaaaaaaactatatgctaaaaagtaatgcaatgttcatttcttttagtcaattatcagaaatctttggtatgagaatatcaagttaaataaattacttaggaatctttgtttctgaaatagtattttcaagaacaaggagaagttttagaaaagaaaacataaagagattctctcctttctttattaacaaggcatgtaaacttaaaaacacatttctgcaattccactgtcatcaccccccaacctgtcaaagcacaccagctatctttcagtt

SEQ ID NO: 48241 - DNA, 601 bp, Human
tgtgtcacaaactatgtaactacaagtttatcaattttgttttcatgtgtaaaataagaacgatagtctctaactcctagggtttggggacagttaaatgaaatgtatatttaagttatctggtgtaagcagcatacagatggcagagtccctggctcagccacttatgacgacaaggcatcaatgtcatcatcatcatcatcattagtattattatgagcagtagtatcccgatcaccctttcatctagtagggtcaatctgtgagaaattctatataaccccacctaaatttttcttcmttttgaggattcaagacccagtcagtaaagcagtgcctattcaattttacttgaaacaaagtaaataaattggcttaaaagaacaacaacaatctactaagagatttagattcaatgaccattttattgagcactaaggatttcattataacaaagtctgcatctgacatgtccatataaaccaagataatagacttgtgttaaataaaagtaccttgacacaggaggatcacctgagtaggggagttcaagaccagcccaagcaacacagcaagatgaccatctcaaaaaacaaaacaa

SEQ ID NO: 48242 - DNA, 601 bp, Human
caagtagctggggctacagacacctgccaccatggctggctaacttttgtatttttagtagggctggggttttgccatgttgcccagtctggtctcgaactcctgagtcagttcaacaaatccgcctgccttggcctcccgaagtgctgagattacaggcgtgtgagccaccacatctggcctgggcactatttctcttaatcaatttaataatcagaggagaaaggtataattattcgcattctgcagactaaaaaaaaatgctcagcaaaaagttatcagttccagtcaacgattcaarcaggtccaaggaggcttttggtattaatgggactcccattttatttatttatttttttggttgggggaagctcccatattaaagataaggaaaaaggttcaacatgaaacaatgggcagcctggctccacatccattctcttaacatccagcattctgatgctgctggtgatcatcaactaacattttctgtccatttagtgtatgacaggaattgtgacgagcattttacacagatgatttctttttagagaagcataaggaacatgggctctagataaagatcacctatgcctgaatt

SEQ ID NO: 48243 - DNA, 601 bp, Human
ctagaattcagtggaagtatgttatgtatatatgtatccatcttaaatgtttgcatcaaatattaaagactttaaaggttagagaatgcgtatcatcaaattctgaggccattataaagtgactaatttatctcacacttcagtgaaggttctcacacacaatacttacgtaacgtttcagctgcattctcagataaatatacgctggctatagaaagctgatgaggacaattactgatttatctgtgccccccctcccgcccacccccgacatgtgtgtttaaatagcagaaacctctgkattccaaactgattttgcaactttggaattaaaccctttcccaagttgggtgctgcctgtgcaggacaatatatggatcacttataacagttctggaattgcgaagcatgtagcagggcagattctgcattgagactttaccaggagaagtcaaatatataattacttaccaaaccagcaataaaaactcatagtatattcaaaactttcttgccagatcaggctaaaatttaaaaatatgcatttttttcccacataaacgaaaattatacaggttttatacatggcctgttttaaaca

SEQ ID NO: 48244 - DNA, 601 bp, Human
actaaaaccgctgaacaaattatttttttaaaatcttcttgaatgcttacgtgagctgggaaacaaaacaaaacagaaaatactcaagctaatgacaggaatagagaagtctatgggagaacttaaggtcagcttttaccttaagggtagaactgaagaataaaaacatgttgtaaagcatgacaactggcaaacaaaagcaagcatgggaatgataaatacaaaattcaggataatggtacactgagtggagtgaaagggcagtgtgtacagtgaggtgggccacaggaacatgggacarggaagtatcaggatgttcttttcatctgagcagtagggtcatgggtattcattttatcatcaattatcacaccttataaaagaataaatatatatcagatattatagaatctacagaattaaaaattatcaatgtcatcaaattctgagccccataaaaatcactgatttagcctagaattcagtggaagtatgttatgtatatatgtatccatcttaaatgtttgcatcaaatattaaagactttaaaggttagagaatgcgtatcatcaaattctgaggccattataaagtgactaat

SEQ ID NO: 48245 - DNA, 601 bp, Human
cttcaattatcaaaaatatacaagagtgaaaaagggagaagaaatgtacacaattaaatcttcaaaccacagaaaataaaccttctaataagagagttagactacattacattttagcttctgtctggaaaagggcagctgataattcctatactgagaatgccaggcttaaactaagttttacctcttagacctgcaatttcaaaatgtatcttaacgacagctttaaggccaagaaaatatagagaaggaagtcaatttctaatgacacaattatctgaaaacttgtaaaactacaaargaaaactggaataaaaataaaaggaaggtgaccaataagaaataagtatgccctggcacctcacatgttcctatagttaagtttagattctataccatagagttaagttacagttttagactcagtattttcttcaacttcctattgcaactccttttgtcaaggaaaccactgattatttaatgtcatttaaaagttaatgggtggacatactcattctaagtcttaaaacatctgtaggagtaaacaatgacaaactcgtatcaggctcaggcatctgaagagctgaacatttcaaca

SEQ ID NO: 48246 - DNA, 601 bp, Human
aggggccaggcatggtggctcacacctgtaatcccagtactttgggaggccaaggcaggtggatcacttgagctcaggagttcaagaccaggctggtcaacatggcaaaaacatctctctactataaatacaaaaattaggcagacatggtggtgtgcacctgtagtcccagctacacgggaggctgaagaaggagaatcgcttgaacccgggaggcagaggttgcagtgagccgagatcatgccactgctttccagcgtgggtgacagagagagactttatctcaaaaaaaaaaaaaaaaggtagtaaatgaatctaactgcatagcaatcttttaaaagaacatttgatgttgagtgtgtgtgtgcccgtgtgtgtacttgggtgggagcacatgcacacatacatgtgtgtgcacacacacaatctgatttctcaaacttcaaaaatttgctttatttcttggatttttttcatgacatcttctaataaatctcatctaaaagttttgaatatcagggcattaggattaaaagtcaattctcaatattaaattcccgaagataataaactgagcacctaaaacccatgccctactgtg

SEQ ID NO: 48247 - DNA, 601 bp, Human
actctttgaagaatgtactagataggtaatgacctggtccctgtatacatacccctctctccctcataagaatggtattctatctacccccaaccaactcagtttcctaacctttgcctgatggtccatgtttctgtgcctttgcaaatgctgatttatcctcttgactggcttcctggctcccatgcaacaaaccccacatatctacactttgtgaatcactcattctttaagacttaggttaaataacatctccatgtgaaaacacctcacacatcaagtaccattctcctgtaaacasccagctgatacttccactttagtttctagcacattatgttataattttgcttacttgtctgagagtcttccttttagtggaatgcttcctgggggttaaaattttgttttatttccgaatctctggcacttagctacaaaggactcagtgttcagttatcttttgctgaattaattatgaaaaagatgaagtatagggtttctagcctcccacgacataaactccacgttgggttaatttaatacaatctaatataacagtctgatgcacacattaatttcattattggaaaaatttcta

SEQ ID NO: 48248 - DNA, 601 bp, Human
tccaagcagctctggtgccttccactgaagaatggtactagaaaccaagatctaagcacagggtaccataagagactttttttaatgctactggtatttgtcatttcataacagtgaaataaaccaacatttatctttcctttttcattttaaaaaacatgaacgttcccacagaactaaaaatcaacatgctccgagtaacttgtcttctttctcctcaagcacactccttttctgtgactggtatccatagtggcccacgacagaaaaccaagagactccttgggttcctccctgtccytaattcaaatgtaatcagcctccagtcagactctacctctgctagcccgtgtctccatggccactgcttccttctgtctcacagcctcatcattctcacatggacaagaaaggtacaacagcttcctggctccttgctaccattttcaatcttctttaatgaaattctaatctcacaaatatggaattctaaattgcgaatctcatcatataattgtcctgcttgaaatgatgagtcagcgatgctcaaaggccaagtccagactctttgaagaatgtactagataggtaatgacctggt

SEQ ID NO: 48249 - DNA, 601 bp, Human
ccactggctcattcatcctttgacacagccccatcgttttgctttttgagcacttccttctttctggcactacaagctgctctagggctcacccgtgtattattcctcctctccctcaaactgcatttttccaagcagctctggtgccttccactgaagaatggtactagaaaccaagatctaagcacagggtaccataagagactttttttaatgctactggtatttgtcatttcataacagtgaaataaaccaacatttatctttcctttttcattttaaaaaacatgaacgttcccayagaactaaaaatcaacatgctccgagtaacttgtcttctttctcctcaagcacactccttttctgtgactggtatccatagtggcccacgacagaaaaccaagagactccttgggttcctccctgtccttaattcaaatgtaatcagcctccagtcagactctacctctgctagcccgtgtctccatggccactgcttccttctgtctcacagcctcatcattctcacatggacaagaaaggtacaacagcttcctggctccttgctaccattttcaatcttctttaatgaaattctaat

SEQ ID NO: 48250 - DNA, 601 bp, Human
aactctttccactggctcattcatcctttgacacagccccatcgttttgctttttgagcacttccttctttctggcactacaagctgctctagggctcacccgtgtattattcctcctctccctcaaactgcatttttccaagcagctctggtgccttccactgaagaatggtactagaaaccaagatctaagcacagggtaccataagagactttttttaatgctactggtatttgtcatttcataacagtgaaataaaccaacatttatctttcctttttcattttaaaaaacatgaaygttcccacagaactaaaaatcaacatgctccgagtaacttgtcttctttctcctcaagcacactccttttctgtgactggtatccatagtggcccacgacagaaaaccaagagactccttgggttcctccctgtccttaattcaaatgtaatcagcctccagtcagactctacctctgctagcccgtgtctccatggccactgcttccttctgtctcacagcctcatcattctcacatggacaagaaaggtacaacagcttcctggctccttgctaccattttcaatcttctttaatgaa

SEQ ID NO: 48251 - DNA, 601 bp, Human
acagaccacgctatctgagcataatgtcattaagccaaaagttaatttaaaaagaaaatatttttaaaatccacacatttgaaaatgtaaaaacagaaatgaatacacaaaagtttcaaaacaaacatttaacaatcttaagttctggaatgcctttttaaaaatcggatcttaaaactcaaaaaccaaaatgaaaatacgattttactacattaaagaaagacaaacttctgtaatgatgagagccatatacacatagttgaaagaaaatgacgagctgggaaagaaaatacagaactarcattacaagatgtgttaacatgacaaagactgcttaaaattaataaagaaaaaatatattagaaaagcttatttaaaatatagttaatttacaaaaaaaacttaaaaatggccatatatgtgaagaggtttaatatcaccagtaatcaaactaatataaagcaagttatcatctgttgcctatcatataggcaaaaatgaacaaaaaatggcaccatgccttacattgttattaacctgaactgaatgtccactattatgtggctgtttaaatgtatgtagcattatatactcattgggt

SEQ ID NO: 48252 - DNA, 601 bp, Human
gtgaacccaggaggcggagcttgcagtgagccgagatcgcgccactgcactccagcctgggcacagagtgagactccgtctcaaaaaaaaaaacaaaaaaaaaacttataagtaaaagtaaaagggaaactaatgttggaaacagattgagctacaatgaagaatgtttaggcaacagggtgataaacatgccggtttctaggacgcccccagcacacacacactaacacaaagcacgacaggcagaagggaaactgtttttgggtttctggaccgacggtacctgcaaggtggggatgawgaacccggcgcttgggcactgaggttggacctgacggaggcggaagtggcatcatttcctggctcttgccagaagccgcagcagtgtaaacaaagccccctggaactcagcttgcccagtctagggccaccagcctctaatccaagccactttggtggcctgagtgagagtcagagtaacagcagattgagacaccccagtacctcaaggttattgtcaaatacagaacagaaaacagctatgcataaaaacttgaagaaataaacggcacaaacaccacagatgggcataccagaggtt

SEQ ID NO: 48253 - DNA, 601 bp, Human
cccatacacagatgacaagacactaatattaggttagaactgtgttgtccaatatacaaccgctagtgatatgtagctatttatacttacattagttgaattaaattaaaaattctgttcccaactgcaatgctcatcacatttcaagtgatgagcagtcccatgtggctagaggctaccaaactaggtggggcagtcacagaacagttccattgtcgcagaaagctgcaatgggtggggctgggccagagcaatgaatctaggacttcagccaccctcattctctagggcttggtgctgygggcccaaaggctcctcagtaagcacagggatgggtgaaatgcatgagcactgggaataggtgcagagttaccacagggacaaccactcaaggttcttgccttgctcagaaagactggggaaagaaggtatagaggcatgaggagagagctctaccatgacaatgcagaaggcagcagatctcacaggagacagctgtatgttaagaagcctttcgttgggactgcttgtatatacatagcagagggcttctaagtattacctttcctacttctctctcaggactaacaaaaacggtttc

SEQ ID NO: 48254 - DNA, 601 bp, Human
tccagtaaactcttaggaaaaaatcgctttaaaccaacatcttttctgaaatataaaaagaagcgtattaacaaataacaccaccaaatcaattaatatgacaaacttgcaagaacataaaagcactgtaaattatttatccttccatatattatttaggaaggaaacaagtataataatgctttaatttaccagtatattcacaggaaggatgggacaaatcattttctagatatgtactggaaacatgaatacaagttggtttaaatagaaatccttttggttttttctttttttaccyttattgttgaaaactcttctaaaatattccctctttgtaaattatagtgtattaaaaactgtcctttttcagatatttcttgaaggttataaacatcacttccaactgggtaatactgtatttgtagagaaaatagctagcctgattagtaaatgattcaggatatacccgagaagttacagaaataaatcccttaggtttatcctaaaagttgactatttttaaaaatagacttttttgattaagtgactcattcacttgtctcagtttcacattaggaaaaaacaaacagataaattt

SEQ ID NO: 48255 - DNA, 601 bp, Human
agctttttaaattatatattttacatgtaaggaaggaaactacattttactttcccaaaagcaatttaccactggggaaaaggtcttggcataattttgttattttattatgataaaggagactctaattaccttgacagaatccagtaaactcttaggaaaaaatcgctttaaaccaacatcttttctgaaatataaaaagaagcgtattaacaaataacaccaccaaatcaattaatatgacaaacttgcaagaacataaaagcactgtaaattatttatccttccatatattatttargaaggaaacaagtataataatgctttaatttaccagtatattcacaggaaggatgggacaaatcattttctagatatgtactggaaacatgaatacaagttggtttaaatagaaatccttttggttttttctttttttacctttattgttgaaaactcttctaaaatattccctctttgtaaattatagtgtattaaaaactgtcctttttcagatatttcttgaaggttataaacatcacttccaactgggtaatactgtatttgtagagaaaatagctagcctgattagtaaatgatt

SEQ ID NO: 48256 - DNA, 601 bp, Human
gagtatcaaacacaattaagaagtaaaaccatgttttatgggagaaagctatactaaaaacctatttgccattaatgtgactagaataaatgtcagctttttaaattatatattttacatgtaaggaaggaaactacattttactttcccaaaagcaatttaccactggggaaaaggtcttggcataattttgttattttattatgataaaggagactctaattaccttgacagaatccagtaaactcttaggaaaaaatcgctttaaaccaacatcttttctgaaatataaaaagaagcrtattaacaaataacaccaccaaatcaattaatatgacaaacttgcaagaacataaaagcactgtaaattatttatccttccatatattatttaggaaggaaacaagtataataatgctttaatttaccagtatattcacaggaaggatgggacaaatcattttctagatatgtactggaaacatgaatacaagttggtttaaatagaaatccttttggttttttctttttttacctttattgttgaaaactcttctaaaatattccctctttgtaaattatagtgtattaaaaactgtcc

SEQ ID NO: 48257 - DNA, 601 bp, Human
tttcttcattgtagaaataagaaaccaggcccaagaccctgaggctagaaaatggcagagctcatctgagccagactctgccttaaccctaaagtttgtatcccctgctgcgcttgaaaatcttgatgtgtgctctggattagctgggggaatcacacattcagagtcctcccacctcactccaaggtgctctccacgctggatatgggaaggataagaactgaggctctgccaaagctactaatgcggggaagcatccaaagggttgaaacaaaagacagaccttcaaaatgcactaacrtgcacgcacacacatacacacacacacacacacacacacacaatattaatgattccaccaccacgattattttacatattgctccttttcttctgcatgtcaaaatattttagcctgtgaagacctagatgacaggaataactgtgcacataacttttttagttttatgcttagcagagtatcaaacacaattaagaagtaaaaccatgttttatgggagaaagctatactaaaaacctatttgccattaatgtgactagaataaatgtcagctttttaaattatatattttacatgtaa

SEQ ID NO: 48258 - DNA, 601 bp, Human
aaaaattagccaggtgtggtggcaggcacctgtagtcccagctatttgggagactgaggcagaagaattgcttgaaccgggaggaggaggttgcagcgagtcgagatcacgccactgcactccagcatgggcgatggagcaagactctgtctcaacaaaaaaaaaaaaaaagagaaagtagaattaaaaattaagatactaaacagggtcccaagattgaagggagtattttgccatttccactttgcgtggtgagaaaagagtaggagagggaacattgaagcagaggttcagaaggacyagtcatggaggagacagggccagtcctctaccgaacctctttgggcacctgtctcactctggctacactcacaccatggcacctgtgacctgtacctgtggttccgttttgaatatggggatcctttaaaaatctagaatgtattggactcctaaatgacaacagtcactcttttcctaattgtttatacacatacagatttaaggagactttgcaataattctgaggcttcataaaccagtgcttcacaactgaaaacccctgaccaatactactaatgtgacataaccatcaacagaa

SEQ ID NO: 48259 - DNA, 601 bp, Human
tagcggaggaaggcagataaaatacaaacaagtaacaaactacataattaaaaattgaggccaggcacagtggctcacgcctgtaatcccagcactttgggaggccaaggtgggtggatcacttgagctcaggcgttcgagaccagcccaaccaacacagtgaaaccccatctctactaaaaataaaaaaattagccaggtgtggtggcaggcacctgtagtcccagctatttgggagactgaggcagaagaattgcttgaaccgggaggaggaggttgcagcgagtcgagatcacgccaytgcactccagcatgggcgatggagcaagactctgtctcaacaaaaaaaaaaaaaaagagaaagtagaattaaaaattaagatactaaacagggtcccaagattgaagggagtattttgccatttccactttgcgtggtgagaaaagagtaggagagggaacattgaagcagaggttcagaaggaccagtcatggaggagacagggccagtcctctaccgaacctctttgggcacctgtctcactctggctacactcacaccatggcacctgtgacctgtacctgtggttccgttttgaat

SEQ ID NO: 48260 - DNA, 601 bp, Human
actacttacacagctgaatgcatcacgggcagtcccacccagttcagattctgcttcaatattgtctcttgactagtagcactagacagcacttaagtgtatgggacagaaatctgaggccaggccctgtattttcttcttcctcctcccacattagaccagtagctaagtcctgttagactttacgcccgtaacattcttcaaatgtaacccaacaactctctaccctctgcctcctttaaattcaagccctccttgtttctcttggcctcttatttctcagcatctgatgactaagaawcttaaaaagaagttgtgtgctgttcttctacaacagggattgaagccatcaaccctttgctaaataaagtgagtcaatttggtttgatcctcattttctcatcccaaactcttagacatggaatgtgtgtggtggtaaagaactcaactgctctccccgataatttaatctgctggaaaatttccaagtaactggggcaaatgtgtttgaaagtaataactatgcaatgttaagagacaatctggactccaattttactgtatttgtctcattcagctgaatgtgggaaaacatgctgct

SEQ ID NO: 48261 - DNA, 601 bp, Human
actggaccctaacatatacatctaacttggttgcaactctatcactctgaacttactctttcctataccccttccctttgacccccatagtctccaggcacttctagttcactacttacacagctgaatgcatcacgggcagtcccacccagttcagattctgcttcaatattgtctcttgactagtagcactagacagcacttaagtgtatgggacagaaatctgaggccaggccctgtattttcttcttcctcctcccacattagaccagtagctaagtcctgttagactttacgcccrtaacattcttcaaatgtaacccaacaactctctaccctctgcctcctttaaattcaagccctccttgtttctcttggcctcttatttctcagcatctgatgactaagaatcttaaaaagaagttgtgtgctgttcttctacaacagggattgaagccatcaaccctttgctaaataaagtgagtcaatttggtttgatcctcattttctcatcccaaactcttagacatggaatgtgtgtggtggtaaagaactcaactgctctccccgataatttaatctgctggaaaatttccaagta

SEQ ID NO: 48262 - DNA, 601 bp, Human
atctaaaacctgccactaagagcactgagatttcagccgtggtggcttattggccctacccgactggaccctaacatatacatctaacttggttgcaactctatcactctgaacttactctttcctataccccttccctttgacccccatagtctccaggcacttctagttcactacttacacagctgaatgcatcacgggcagtcccacccagttcagattctgcttcaatattgtctcttgactagtagcactagacagcacttaagtgtatgggacagaaatctgaggccaggccctrtattttcttcttcctcctcccacattagaccagtagctaagtcctgttagactttacgcccgtaacattcttcaaatgtaacccaacaactctctaccctctgcctcctttaaattcaagccctccttgtttctcttggcctcttatttctcagcatctgatgactaagaatcttaaaaagaagttgtgtgctgttcttctacaacagggattgaagccatcaaccctttgctaaataaagtgagtcaatttggtttgatcctcattttctcatcccaaactcttagacatggaatgtgt

SEQ ID NO: 48263 - DNA, 601 bp, Human
gagctcaggagagggcagcactgttgctagaaatttcagagccaccagctgaagtatttaaatacatgggactagatggcacctgcaaataaaatgaagacaaaagagaaggccaaagctaagtaagctgaccaatagttggttttaaccagggctgaggttttgacaggtgagtatgacagagtggaataagagaattatagctgttttgaaaaggattaattacagcttcacagaacttaaactgaagagcaataaaatgggttcaaggttagcaaggcttgactataaaatgtatcayatggaaagtgaggtggtcagcctcagatgctctataaacaaaagtccgaaaagcatattcttggtttgactccaggctttctaaacattctctgcttatgatcacctatgtaggacagactctacaacagagcatgcagattggacatggagatttgagtactgcttgtagccacctacatgatgtttttctccttataaattaacaatatagtaccttgggactttgctgaatataaagcagtctctaagaagcaggcccgctacactctggacctagaacaaatccactaaggaaatt

SEQ ID NO: 48264 - DNA, 601 bp, Human
actttaaaaaaaccacaatgcttatccataaaataaaattccaggacattattctttagaaatgattagagatacatgcaaagattcaggaacaaaaagattcactgcagaactgtttacagtaatagagagcctggttacgtaaactatggtgtatctatcttctcaaccaacattctatgcagcctcaagaactgttttggagaactaatctactggcattaaaacccatattacattgttacatgaaaaaagatgacaaaacagtcagcatggagtacagatgcctttaaaaggcaaragcacacgtgtgggtcctggtgagcacacagcaatgtacccatgaaggagataaagcaacgatgcttttgcttttttcatgaagtaagatgataggtggtcttccagtcctttttcgcttatttgagttttctacttaaacacatggaaatctgcatagcagaggtaaatgctttccaagcagcaaacccccagtccttggtgtgtgaagcagtctgagaaggccatggataaagggaatgtgatgaggtctaatgaagaggggcaagagaatgtaggccatagttaacaagttggcttt

SEQ ID NO: 48265 - DNA, 601 bp, Human
aatatcaaaaaaaaagcactttcacaaaatttcacaaaaatttattctgttttcctctgtgaatatccagctgacacagcagcatttaatgagatttaatcagtgatggcagaagtcaggacagtggtcatccttaggatgtgggacaagggaggccggtctgtttaaagtcaacagccaacaagagatttggggaaaaaaatcataaaaaaggtaacaggaaaacacactgatttccttgatgtgtaaagggacttattaatttaaaaggacaattgtgttggtaaaataggcaaagtayatgatatgagcagttaattcacagaggtgagaagaaaaacagtcaagacatgaaaatatgtttaaagttactaggtccttgctttacatctaagtgagcaaaaaagttacaagaataactttgtatctattaaaatggaaaaattaaaagagctattaaaactgccatccaatgagtgcgaaaatagtactctcacacactgccagtgacaatatgaagtttcctagcttttctgaaaagcaatccaacagcttcttttaaaattacaactatttgaaacgaaccctgcagttccatcct

SEQ ID NO: 48266 - DNA, 601 bp, Human
ttggctcaatattatcataactattaatataatctactataatgataaaggagaaaaaggatcatatcaatagatgctaaaagggtctttgattaaatttaggagctactcataaaactctaagcaaaagataaaaatattaaagacatgttattaaaactcaacaataaaaacaatcccaaataatgacacacttttaattgataaattaaaatctaaaacaaaataggaatattgtctactgccctgttattaaacatgatctttgagcttcttgtgactgaaggaaaaaattgtatgyggggaaaggtaaaattattcttttgctgattacattattatacacttataaaatccaaaattctaataaaaaacctgttcaatcaataataaggttgcagactgtatgttaaacaataatcaagaatatcttctatgctcacaatataaattttaaattgtaagtggcaagaaaaaccccaaaaagtcattcaacataaggcccaaaactataaaatacttatgaattggtttaatatggaagacctatctgaaaaagattgagatcttattgaagggtataaaagaagtcctgaaacac

SEQ ID NO: 48267 - DNA, 601 bp, Human
gttgatgccattctcctgcctcagcctcctgagtagctgggactacaggcgcatgccaccacgcccagctgattttttgtatttttagtagggacagggtttcaccgtgttagccaggatggtctccatctcctgacctcgtgatccgcccaccttggcctcccaaagtgctgggattacaggtgtgagccaccgcgcccggccaaattgttcttttataaagacacatatacatgtacgtctaatgcagcactattcacaatagccaagacatggaatcaacctaaatgcccatcgatgktagactggataaagaaaatgtggtacatgcacaccatggaatattatgcagccaaaaaaaaaaaagaatgagatcatgttctttgcaggaacatggatggagctggaggccattatctttagcaaaataacacaggaatagaaaactaaatactgcatcttttagctcccacttataagggaagctaaaagatgagaacacaaggacacacagagggcaacaacagacactggggcctaccagagggtggagggtaaaagtggggaggggattgggaaaaataactaatcagtactagga

SEQ ID NO: 48268 - DNA, 601 bp, Human
cagatgcagaaaaggctttcaataaaattcaacatctcttcatgttaaaacacctcaatgaactaggcattgaaggaatgtacctcacaataatacataaaataataagacagtgtagcaattcctcaacacctacaaacagaagtaccatacaacccagcaatcccattactggctatatacccaaaggaatataaattgttcttttttttttttttttgagacggagtctcgatctgttgcccaggctggagtgcaatgacgaaatctcggctcactgcaagctccgcctcccgggttsatgccattctcctgcctcagcctcctgagtagctgggactacaggcgcatgccaccacgcccagctgattttttgtatttttagtagggacagggtttcaccgtgttagccaggatggtctccatctcctgacctcgtgatccgcccaccttggcctcccaaagtgctgggattacaggtgtgagccaccgcgcccggccaaattgttcttttataaagacacatatacatgtacgtctaatgcagcactattcacaatagccaagacatggaatcaacctaaatgcccatcgatggtag

SEQ ID NO: 48269 - DNA, 601 bp, Human
acagaactaaaaacaaaaaccacaggatcatcttgacagatgcagaaaaggctttcaataaaattcaacatctcttcatgttaaaacacctcaatgaactaggcattgaaggaatgtacctcacaataatacataaaataataagacagtgtagcaattcctcaacacctacaaacagaagtaccatacaacccagcaatcccattactggctatatacccaaaggaatataaattgttcttttttttttttttttgagacggagtctcgatctgttgcccaggctggagtgcaatgacgmaatctcggctcactgcaagctccgcctcccgggttgatgccattctcctgcctcagcctcctgagtagctgggactacaggcgcatgccaccacgcccagctgattttttgtatttttagtagggacagggtttcaccgtgttagccaggatggtctccatctcctgacctcgtgatccgcccaccttggcctcccaaagtgctgggattacaggtgtgagccaccgcgcccggccaaattgttcttttataaagacacatatacatgtacgtctaatgcagcactattcacaatagcca

SEQ ID NO: 48270 - DNA, 601 bp, Human
gcaaatcaataaatgtgattcatcacataaacagaactaaaaacaaaaaccacaggatcatcttgacagatgcagaaaaggctttcaataaaattcaacatctcttcatgttaaaacacctcaatgaactaggcattgaaggaatgtacctcacaataatacataaaataataagacagtgtagcaattcctcaacacctacaaacagaagtaccatacaacccagcaatcccattactggctatatacccaaaggaatataaattgttcttttttttttttttttgagacggagtctcgmtctgttgcccaggctggagtgcaatgacgaaatctcggctcactgcaagctccgcctcccgggttgatgccattctcctgcctcagcctcctgagtagctgggactacaggcgcatgccaccacgcccagctgattttttgtatttttagtagggacagggtttcaccgtgttagccaggatggtctccatctcctgacctcgtgatccgcccaccttggcctcccaaagtgctgggattacaggtgtgagccaccgcgcccggccaaattgttcttttataaagacacatatacatgta

SEQ ID NO: 48271 - DNA, 601 bp, Human
gagaaaaaagaatgaaaaggaatgaagaaagcctctgtgaaatacgggattatgtaaagagaccaaatctatgtctcactggtgtccctgaaagagctggggagagtgtaagcaacttggaaaacatgtatcaggatatgatctatgaaaagttccccaacctagctagagaagtcaacattcaaatttaggaaaggcagagtaagatactacacgagaagatcattcccaagacacatcatcatgaaattcttcaaggtggaaatgaaagaaaaaatgttaaaggaaactagaagggccwggtcacctgcaaaggaaggcccatcagataaacagcagacctctcagtagaaactctacaagccaaaagagattgggggccaacattcaacattctggaagaaattccaacctgaaattttataattccagccaaactaagcttcataaataaaggagatataggatccttttcagacaagcaaatgctgaagaaatttgttaccatgagacctgccttacaagagctcctgaaaggagcactaaatatggaaaggaaagaccgttaccaaccatcacaaaaacacagaccagtgacact

SEQ ID NO: 48272 - DNA, 601 bp, Human
atcattgagatgtaggagtacactgaaacccaatccaaggaagctaagaatcacaataaaacaatacaggagctgagagaaaaaatagccagaatagaaaagaacataatcaacctgatggcgctgaaaagcacactacaaagatttcataatgcaaccgtaagtattaatagcctaacagaccaagttgaggaaagaatttcagagcttgaaagctgtctttctgaaataggagtcagaaaagaatagagaaaaaagaatgaaaaggaatgaagaaagcctctgtgaaatacgggattaygtaaagagaccaaatctatgtctcactggtgtccctgaaagagctggggagagtgtaagcaacttggaaaacatgtatcaggatatgatctatgaaaagttccccaacctagctagagaagtcaacattcaaatttaggaaaggcagagtaagatactacacgagaagatcattcccaagacacatcatcatgaaattcttcaaggtggaaatgaaagaaaaaatgttaaaggaaactagaagggccaggtcacctgcaaaggaaggcccatcagataaacagcagacctctcagtagaa

SEQ ID NO: 48273 - DNA, 601 bp, Human
gtatctcaaagtctaggctgatacagtgtcaagatcagactcaactagtagcaacaacaggaacaacaatacaactaaaatctaggagcatcaagtgtgccaggcatagttccaagcctataaataagtcctttatcctcctaataccatagaagacagttactgttcttcgtgtttgaccagatgacagaactgaggctcagaaaagtaatttatagatggtgtcacagaggactcatgatttgaacttaagtcccataattcccaaactcagtctttccctgcttcacactatgtatgytattatcctgctgggaatattttcatttgattctttcagaaatccaaatcctcaaaagcattcctcattatatgcttgcaaaaactccacaccgcttttatagtgacgtttctaggatatttattcattctaatctttgattttttaacatcatgacttagactgtactttcttctttgaatgctctaagcttttgagatatataagaaaaagtagaaaggacactttatttatagtgagttataacggattcctttttttaaacccagaattttatttaaacccaaaattttaaaaata

SEQ ID NO: 48274 - DNA, 601 bp, Human
tccctagagagcaaaaaacgctagctaatagtgaaatcaacacaggaagatgtttacgttttaaacatggaaggctcatttaatgcctgacatccgaatgttatttttaaatgtgtatgtcaaggaccttttggtaaactgaagataaaagatgaaaaattattcactaaaaaggaaatgggcaatctattacatttaacatttttcctaaattactatctttatgtaaagaaattatctgaaaacatttaaataatatttgtaaggcatatactcctgtttaaagtataaagtgcgacastggaagaagaaaacgtcaaaaataaaaataaaaaataaagcacaaagtgaaaaatcaagacctatagctgcaaaggctttaactgagagtaactgtagagatttctgaaagcaacttcattactctattttatacaaagaaaacttaggaaaaatatatgaataggcttattggtgtgatcaccgtgggaaaacacttttcctttagaaaagccatgtcctggaatcacacagatttatgtttacttagcgaaggctcatggcttcagctgctgttttcagggcacagcaccatcagtta

SEQ ID NO: 48275 - DNA, 601 bp, Human
tcattactttctcttccattgcgctacatgatttatcacaacttatctttgaactatatttattgggcagtcagaggacacacattttaaatcaataaattacatcatttccttccctgttgtgctgccaaaacactggggttttcccttgtctgcgccacaattatgtatgctgttgctaagcaactttctcacgatagcttggatttcagctcttatctgatcaacagcaataatggtgtcctgctgctataaggtttgtggaaattccactcttgtaaagtttgcttcatttatttastttcctttatctgttaacacttgcaatgtactaccttcctcactcactttcatacctatgttcatgattcctctatgtgtgtgtgtgtctgtgttttaagaaatggggtggagtctcacgaagtcacccagactcgagtgtggttgctattcacaggcatgatcatagtacaccacagcctcaaacccccgggcttcagtgatcctcctgcctcagcctcagaaccacaggaacatgccacattgcccagctttgattttaatccaaaattatcccttaacttcccacaactaaaggtac

SEQ ID NO: 48276 - DNA, 601 bp, Human
ctgctttattttaattcactatctatggtttgactctttcaccaagaatgtaaactctataaagggagggacgtggctttgttttctagcagactccagtatctagaatagtgctcagcacgctgcaggcactcaagaactatctgttggccggattaatgtaaaacagaaatgtaaaactgaggtctcttcaatcccgcagggcttgttaggggttaaatgaagtatcgtatgacagaaaaacaagtaattgcagctggcatacagttgactgcagcctcaccccactatcctagacacygaacacgcttactgtggagaagcacatgcagaatttcacaaggatccaggagcagtagggcctctaccttggtgtgtcagcactacatcccacatagtacggtgtttccaggttggcaggtaagaaataaccctgggatttagtaagattaccgtttttctaggtatcggcttaacaaagatgtccctagaaatgtgaattaccagctctggggctaagtgcaatgtactggttcctggccagctaggcttatcagtttttaggttttatggttttgtggaagatagaaacatatcacac

SEQ ID NO: 48277 - DNA, 601 bp, Human
aaataactttcctgttgctctcaattcatctgctttattttaattcactatctatggtttgactctttcaccaagaatgtaaactctataaagggagggacgtggctttgttttctagcagactccagtatctagaatagtgctcagcacgctgcaggcactcaagaactatctgttggccggattaatgtaaaacagaaatgtaaaactgaggtctcttcaatcccgcagggcttgttaggggttaaatgaagtatcgtatgacagaaaaacaagtaattgcagctggcatacagttgaytgcagcctcaccccactatcctagacactgaacacgcttactgtggagaagcacatgcagaatttcacaaggatccaggagcagtagggcctctaccttggtgtgtcagcactacatcccacatagtacggtgtttccaggttggcaggtaagaaataaccctgggatttagtaagattaccgtttttctaggtatcggcttaacaaagatgtccctagaaatgtgaattaccagctctggggctaagtgcaatgtactggttcctggccagctaggcttatcagtttttaggttttatg

SEQ ID NO: 48278 - DNA, 601 bp, Human
agctgggctattttgattgttcacttccttattcatgcacaacacgatcagccagtctatccatatgaagtcagtgacaactgtacgcttctcagtggtttggagtctctcctaataccagactgactaccagaataatttccagtgagccaggtactaggaacagatcaataacattcaatacctactactttgtgcacataaaaattattagtagcattaatttgattaaattatgtcacaaagcatataatttacaaaaatgaatttatcttttaaaatttggttgtttttttttttggggggggggacagggtcctctctttgtcacccagaatggagtacagtggggtgatctcagctcactgcaacctccaaatcccagggtcaagagatcctcctacctcagccttctgagtagctgggactatgggcacacgcctccacgcctggctacagtttttgtagagacagggtttcaccatgttgcccaggctggtctcaaactcttgggctcaagtaatctgcctgccttggccttccaaagtgctaggactacaggcgtgaggcactgtgcctggcctaaatttagttttacttt

SEQ ID NO: 48279 - DNA, 601 bp, Human
aagaaaaaggcagttcctgtcttcccaggagaagcctgctcccgagggtaatgaagcagctggtgagggaacgctgtctctagaagcattccagctaaacaaagggagaagaaatgacaggattcacagggtgccattttgtggcctctgatgaaatctaagcattaatgtcaacagctgctaaaactattaggtgaaatgctcatgggaacgttctcatgtatggatcagagagtgatgggacctaaacccattgattagtcttaacatcacaaagaacaaccagatgtacatcacctamgaagtattcttgttgtggggagggggggaatcaagcccaaactggatcaaacttctttaggttctaacaagcagctgatgggaaataaacgggccagaaaagaataggttaaacaagacagcatcacagagatgtaatcagcctaatccagaatatgagaataggacaagggacacaatttcttcaacagagtaattgcaactagtaacaatcaaccaacaaggtctagctgacacatacaggagatactcaagcaaattcacaaagtacttcttgtctgattcttgtttagacgaaacc

SEQ ID NO: 48280 - DNA, 601 bp, Human
tcctgaccaggtaacaagtgatagagggtagactggtaacaaattagacttaattgggctgggcctggtggctcatgcctgtaatcccagcactttgggaggctgaggcacatggaccacttgaggccaggagtttgagaccagctaacatggagaaatactgtctctatcgaaaatacaaaaattagccaggcatctgtagttccagctactcaggaggctaaggcacaagaactgcttgaacccgggaagcggagattgcagtaagccgagatcgcaccactgcactccagcctgggtkacagagaggggctctgtctcaaaaaaagtagtagatctaactgggtgaggacaagtcatctattgtgagatcaaggcaggcagcacttatggctggcaaatgctggaggtttaaggaaaggttcaaagtggctgtgagatggaattgaaagcaagaccaaagcaatgtggttgtgctattcgctttacggttcagttgtgctacagcagacatgggacagaacgagctggctttaacttggccaagtgagttaaaaccaaacaaacgagtagggcagagatgatggggatgtaggccagg

SEQ ID NO: 48281 - DNA, 601 bp, Human
catgttggctaggttggtctcaaattcctgacctcaggtgatctgcgcacactggcctcccaaagtgttgtgattacaggcataagccaccgcgcccggccgatcccagtaacatttactgacaatttcatcttattgcttgacttaaaagctacctttacacacactaaatttctggactttgtatatgatggccctagaggaaagcataaactggtctctcagttaagaagatgggcctgccagcctgtgtaacatagcaagaccctgtctctacaaaaaaattcaaaaattagccagrtgtggagtcacgtacccgtgggcccagctattgaggaggctgagttgggaggactgctggagccaggaggtagagcctggaccacagaagcagagcctctgaactccagcctggcgacagagggagaccctgtctcgccaagatgggcctgacaactggatgcactgtgtgatgcaggatgaattctggactggaggctggggaagggaaagatcaggaagcaacagcgatacggaacattactggtatgaaataatttagactgcggataagagcatttcttcagtattaaatttcctg

SEQ ID NO: 48282 - DNA, 601 bp, Human
gtgaaagtgaagtcaaagccagggatgcagggatgtagccctttaagatgcagcagtcattaacaaatgacagacacaggtaacatcaacatttaactgcatactcacggggtatcataaagaaagatcagaagtatggacccaagaacaagggtcaggactgtttgcccatcaagatggtaacaatcttattgacattgtcaatatattagcaacagaaatgagaacagaaatgtacacttcagtaatatttttcaaacggtatgctttgatcctattaacattttttttttttttttttgagacaaagtctcgctcttctcccccaagctggagtgcaatggcacgatcttggctcactgcaacctctgcctccgggttcaagcgattctcctgcttcagcctcccgcgtagctgggattacaggcgcctgctaccaagcccagctaatttttgtattttttttttttttagtagagtcagggtttcaccatgttggctaggttggtctcaaattcctgacctcaggtgatctgcgcacactggcctcccaaagtgttgtgattacaggcataagccaccgcgcccggccgatcccagt

SEQ ID NO: 48283 - DNA, 601 bp, Human
agcaatttttaaaatattttgcataccattttgtacttggttctgttggatcaaaagcacattttgcctttcattaaatactaaactatatttattttcataaataattatctcatagcagtaacacaaatgtgaaaataaatattaccgtccccactaatttcatctgcagatccgggtggcatgcaaagaaagggaagtagggaacagagggagggagacataggaaggagaagagggaagagaggggaaaacactattaaaatgacaagtaaaccaaagtgtaagaaaaataaaaaamaattaccccccagggtttaattcaaaagataaagaaagactgtagtggtagtatgtttacttgaatttgagggcataatgctaagtttaaagctgtcaatgtattacatgaagttacacagctaaagtattacagagtgtaaactggattttttctgccacactaagcaaagttaatttgactgcctcttacaattaaattttaaaaatggtttctaccttcctcaaagggaacttgtgtcccctcagataaaaatgcaaacaaactagtcattaatctgtatgtttagttacaagaaga

SEQ ID NO: 48284 - DNA, 601 bp, Human
gagaattcatggagtaaaatcaacaatgttgcaggtaaatgatctgcaaaagtttataaccctctatatatgagtttcatatgtatggtaatatctggtgtatatttctaagaattcctttttttttgaagacaggttcttgctctgtcgcctagggtggagtacagtggtgcaatcttgactcactgcagccttcacctcctgggctcaagtgatcctcccaactcagcctcccaaatagctggaactacaggcacgcgccgccatgcctgctaatttcttgtaccttttgtagagatgrggttttgccatgttgcccacgctggtctcaaactcctggactcaagtgtaatcccagaatgctgagaatacaggcaggagccactgcacccagccttcccaagaattcttgacattgatttggctgtattttgcttttctttcctggtttttaggattgttaagatagtattacactgatatgataggtatttttacatattcaagggccctaaaaattggagtacagtctgaaacttcctgggccctccacatgttagtgtaacatagtttaaggaaaacagaaaaattaccccccaag

SEQ ID NO: 48285 - DNA, 601 bp, Human
aataaataggctaatatatatcaggctagcacacattgtggaaaatatcatgttgcatacatttcaattaattcatacaatcacaagagaaaacctgtaaatttctttcttttttttttttagctggatgaattgtacataaaatctctggggatgtatcaaagctgtctaggaattacttatatttgggttgcaggtgtgtgtactatgatgcaatgtgaatagagaattcatggagtaaaatcaacaatgttgcaggtaaatgatctgcaaaagtttataaccctctatatatgagtttcatatgtatggtaatatctggtgtatatttctaagaattcctttttttttgaagacaggttcttgctctgtcgcctagggtggagtacagtggtgcaatcttgactcactgcagccttcacctcctgggctcaagtgatcctcccaactcagcctcccaaatagctggaactacaggcacgcgccgccatgcctgctaatttcttgtaccttttgtagagatggggttttgccatgttgcccacgctggtctcaaactcctggactcaagtgtaatcccagaatgctgagaatacaggca

SEQ ID NO: 48286 - DNA, 601 bp, Human
ggctttaccatgcaccaaagcttatgctggcctagagccaattctggttttagccacctattcagagacctctcctcagactaatttgcccccatcccactgttcttaatcatgttccctgactcattttcctcattacctataacaacctgatataattttgtttcctgtgaactgtatgcccacctctctagaatggaacagccaccagagtggaaccttcacgtatcttgctcaacactgtgtcctcagcagctaaaacagtgtctagcacagagaaggtccctcaagaaacacatgytaaaccaaaagaatgaatgcactgcaacaatcagtaaaggaacgctatacccctaagaaactgaggcaaaggatttaatctgtgtgaggcagcacagaagtgaatggtagagctgcaatacacgtgacaaaatacacaagcccatttggggaaaactgcttgagctttggaaagtcacttcacctggcaatgcttcagctgtgccctcgtgggtaaaataacatcatctgccttgtagcactgttatgaggattacaggagacatgacagaaagttgagatgtgccctacacataacaga

SEQ ID NO: 48287 - DNA, 601 bp, Human
aagttggggaagcagattataacaccaataaatcaattctctttaagacagttattatctgtaaactattcctaagtcctatatgacaggcagataatctatattattcttatacgtttataagaatacttaaaagattaaaaaagttttaatagactccaaatcatacattcttttatttctgtattctccctcttaatctgttttcagcaaatactaagaacagtaaattggcatctgtaggcctatagctctgcttctgtgtaagatggcttatcaaaacaccctgtgaaagaaaatytggggacggaaggaagctgctaacacacttgcaacaaaaaagactaagcaggggaggaatctactctaacagctaaggcaacagaagccacacaaatggccatttgcaatcatttctcttttgattccatagtttaacacgctcaactttgtgatactctcctcagaaaatgaatgcaactaaagctgtctttccacacaacagccctagcaccctcactgcttcctttcatataaagcacgtgcctttaggagtaaagcacatgaattggccctgctgcagcaggattttgggagagcc

SEQ ID NO: 48288 - DNA, 601 bp, Human
gatcacgtcaagaagttccaatgtatctacctactctttttgggtaatacaccaacttaaaagtccaccactatattaatgggaaatttaaaaatacccatctgaagaaaacagtcactcatgtggtaacacctatactgaaaaaatcacttcagccttgtcttttttctctttctagaaaaacgaaaatcttcagctgctccatgtataaggattttaactgctgggccattcttgtgagtcagtaaagcagggacaggactttgtgatgcatcatttccaaggagctctattttgataytttgacctagcatccttgtttaacaccaatgaaacgaaaagctacaagttctttcttctgtgacgccttattactgcattcagatattaaaggtacagaattcaaagcaaatagagaatatatatggtttacagtcactgggatatcaatcattccacatctatggtaatgactgagatcaaatctacaagtggaagaattcacttcttattatgtaatcatcattaaaagtgattacagtaaaaaaaaaagttggggaagcagattataacaccaataaatcaattctctttaagacag

SEQ ID NO: 48289 - DNA, 601 bp, Human
tttttgagattaactgtgctaattcattccatttgctcagggttgagaaatgcaacaggaatttgtttcctaacttttaaactcagatattttaggcattaatgtcaaaagggcagatctacaaagaaaaaaaggagaataagcagcatattacaatgaggttttttgagatcacgtcaagaagttccaatgtatctacctactctttttgggtaatacaccaacttaaaagtccaccactatattaatgggaaatttaaaaatacccatctgaagaaaacagtcactcatgtggtaacamctatactgaaaaaatcacttcagccttgtcttttttctctttctagaaaaacgaaaatcttcagctgctccatgtataaggattttaactgctgggccattcttgtgagtcagtaaagcagggacaggactttgtgatgcatcatttccaaggagctctattttgatactttgacctagcatccttgtttaacaccaatgaaacgaaaagctacaagttctttcttctgtgacgccttattactgcattcagatattaaaggtacagaattcaaagcaaatagagaatatatatggttta

SEQ ID NO: 48290 - DNA, 601 bp, Human
ttatactcaagtcagtactgtctggaacattaaaaaaataagaaaatgaaattaagaaataaatttctttttgcaaatgaaatttcaagagtttatctaattcaagatctggagactatacactccaacatgagacctggggcttcaagattttccttaatcaacaagctgcacatcacagagagaagcagaatcttgacatttccaggctgtatgaaggtcctttaagagttctgtttctctccccacacctcccatccctgaggtgtacaaactgacgatggttatgagctatttgtawtggttagtcaatggcaacaaagaataaacaatttaaagggggaaaatgcaaatttttgaatatatgtgtgtgaaagtatgggtatacgtgtgtgtatgtatgtgtattatacatatatggatatatatattgtgtgtgtatatacacacacattcacatatatacttaaccaataatactaattttctacagacagaaaataccctaatcaataaaggttctattatgatagagtcagaaaacaagattacaaaaatcctgtaactaaaaattattacagatatttgagttttaggcttc

SEQ ID NO: 48291 - DNA, 601 bp, Human
taaaagacaggcccagccttgtaggagctaatgttgccattttttggtttctgaatacgccaagtataagctgacatttatgaagagctttataaaagacacccgtaaatattaatacctagaagaactaaggactcatgaagacaaacaaaagcaatttaaacttaaatagtcaaaattagtctagttgtttggtagtcttaaaagacttactggactcatataaatgccttgatgtacatctccaaattggccttctccaatacatcgtccaagttctattctttctctttgaatctcataatccctggctgtaaaacataattcacacatcaatacttaagtaaaatattccaaatgtagaaataacacttgacgtatttcttgatcatccataagtaaaatttcatctgtggcacatcaatctatgaaaatgctttaaacacagtggaattctcttaaacaatattttaacaggaattcatgtaattagttatggtattagaagaactactgaaacaatgagttctactaaaggtagatatttttcatgttgttcctaggagtttttaaatttccgatttattttatatctatttga

SEQ ID NO: 48292 - DNA, 601 bp, Human
taataaagcataataaatgaaacatttaaactctggattcagattattttttatttgaaatcctatcatgaaattaaaatatttttgactaacgacaaatttcttaaaaaatatagaaagataagcttcaatggaatgaacaaaagcacagtacaaattattgctaaataataataacaactggaagaaaaaagatctagttactatccaaacaaggctaatacacagtcagttatctccacttcaaaccttactgtggctctgcgaaggtatgaggataatgtaatgcggagaaagcagrgacaagaaggaatctcccctcttatttccttccccatgaagttttggatgcagaagcacagaacagtcatgttgggtatttatcacaatgtacttacttgttcatgctaccactgacaccattaatagaggtaaatgctgacatggcaaagaaaggcagacacaattaataccctaattctaaataattgatgagagaaatatttagccatattttttgagccggaagaattagcaaactctccaaaagcaaaagcagaaaagtaccgtgaacaagaaattatacataagcactccattt

SEQ ID NO: 48293 - DNA, 601 bp, Human
cttcttgtctagagtgcataaaggcaccattatctggtttattcatggactggtcactgttttcccccaggaaagatgtggaacttctttgggcttcaagtcgtcttgtctataaatgccacagtgtgacctcaaaaagtttacttgcactctacccttgggaaatccaatactttcttagtatcttctgaataatccttaaaaattcacctttaagatgggataaagaaaatgtagtacatatatgccacggaatactatgcaggcataaaagaatgaaatcatgtccttggcagcaccrtggaaacaactgaaagccatttatccaaagtgcattaatgcagaaacagaaagccaaacactgcatgttctcacttgtaagtgggatctaaaccctggatacatatggacatgaagatgggaacaacagacagcagggaataaaacagcagggagggaaggaggtgggtaatggttgaaaaagtacccattgggtactatgttcactatttgggtgataggttcaactgaagcccaaacctcaggactgtgcaatatatccatgtaacaaacctgcacatggaccctctgaatctaaaat

SEQ ID NO: 48294 - DNA, 601 bp, Human
cttgtaagccatgctaagtcagaagctaggggagagagatttgaccataattggagctttattaaaattttaaagatataatttacttaagactctagcaaggtacaaagaaatgcaaatcaattttaaaagtaattgcatttgaacgaaaaatagttcggccttagacatactgatataatgaccttaaaatgctattactgcaaggaggagaagcagcataatctgcccccacccccaggccctctctcccgccaactcctacctgagctgagctttaagttcagtaaacctgggccgyctgctggggtcataggcccagcatttcgtcataaggctgtagagggtaggaggacaatttggaggcattggtaatctttccccattttcaattcgaccgattacatcattgttcttcactccttgaaaaggcttcacaccatgcatcagtatctcccacatacacacacctgtcaagtgggaatgaaaacacaacagtgagctcagtatgaagaatgtaactcccaggttccaggaacattgttcttctaggcactcgagtaccagctgggaggtaatgggcaaattatctaccaaagca

SEQ ID NO: 48295 - DNA, 601 bp, Human
agactccgtctcaaaaaaaaaaaaaaaagtagaaaaagaaaagttaaagatgttccccaaggatattaagtggtggggccaggattcaaagtgagatctgtcattccaaagctcataattttgcacgattctgttactggttaccttaaaattaaatacaaataactatatatttttaaggatgtctaactataactggtaactcttctgtactctaagatcaccaggtcccttctggattttcaggaaaatctctgttgttactactacctacttctaaattagctaacacagtgtgtgygcttaccatgagcaatggacatggattatttatttatatgtttgtttgagacagagtttcactcttgttacccaggctggagtgcagtggcacgatctcggctcactgcaacctctgcctcctgggttcatgcgattctcctgccttagcctcctgagtagctgggattcacaggcatctgccaccacgcccggctatttttttgtatttttagtagaggcggggttttaccatgttggccaggctggtcttgaactcctgacctcaggtgatccacctgccttggcctcccaaaatgct

SEQ ID NO: 48296 - DNA, 601 bp, Human
aagaaacaactgtgacagcatgggagagcaaccataggcagccagattctggagggagctgtcatgagaaggaagagaacggcactgggtgggtccccacttttcagtggccattagtgagaaggcaggcgccagtgttactggcttgaataaccagagaaatgagtttggagcaattatagctagcaaaaaggtaatcggaaaaaagtgaagggagaaatcccagaatgaagacaggcagagaaggagtgcttcaaattctgagtatatattctgcacacatctctgctgatcctagaakcatgcacacacagtgcagactccaagcagcccagctaaggctaaaataatggaacagagatttgcactgctgctcacagcggaaagaggctctgctacctacccatcagccacaatgtctaggatataatctaacattccttgatatacaaaaaaaaaaaaaacccataaaaatgtgacccattctcaagaggaaaaaaaattaaaggaggctgattctaaagatgactcagatgttgaaatcagcaaggatttaaaagaagctattatattcaagggtataaaagaaaatttattcata

SEQ ID NO: 48297 - DNA, 601 bp, Human
tttttaaaaaagattggattttgatacttaaaggaatcatgtaaaactaaggatctgttttatgatcctgatcataaaatttgctttggatataaaatcagtctgggtttgcagttatttaagttaatctagaaaacacccagagagagaacagcaataaatttgaagggaaaaaagtcaagcgggaactggcttgttttggcaagttcatgggaataccagttttgaaacatgatttcttataattagtcaacgctgcttcaccacaaaggaatggaattggccttttaaaaacaaaacmaaaccaaacaaaaccctaccgtctttgcagaaaacaagtctgaggtttgagatgaagctagggatggcatacctggaagtagctgacctagtagctaaaggccatgatcacagcattactgcttatgcctctgctctttttctcttttctcttaagcagtgatgctggagattatggcctttagtctccaggtggactggaaatccagcttcatggatatattgaaatcatatttctctcattgcttctccaactgcagtaaataaagtcttttgtttggttattgtgctgtatcgatct

SEQ ID NO: 48298 - DNA, 601 bp, Human
atatctaaatgaaaattagacaacctaggtgacgagctctgaaatgcaagaagcttttaaaaaatagaaggaactattagaaattccccatcagataatatcctgtgtaactaatggctaccattcccacaaagagctctaagtctttttctttctttctttcttgtttttggggcggagtcttgctctgctgcataggctgaagtgcagtggcacgatctcagctcactgcaacctctacctcccaggttcaagcgattctcctgcctcagcctcccaagtagctgggaccacaggtgcrtgtgccaccatgcctggctaattttttgtatttttagtagagatggggttttaccatgttggccaggctgctctcaaactcctgacctcaagtgatccgcccgccttggccttccaaagtgctgggattataggcatgagccaccatgcctggcctcctacctttctttctttatttttttttttttaaaagagatggaatggtactaagttgctcaggctggtcctgaactcctgcgttccagagtaactgggactacaggcttacaccatatgcctgtgcaagtatttcaaatgagtt

SEQ ID NO: 48299 - DNA, 601 bp, Human
ttaaattctaccatagacaggttagatgaccatggacaactctgtccctccaagcctcatccacaaaatggggtacctccctaactacctatcttgaagggttgttgcgaatatctaaatgaaaattagacaacctaggtgacgagctctgaaatgcaagaagcttttaaaaaatagaaggaactattagaaattccccatcagataatatcctgtgtaactaatggctaccattcccacaaagagctctaagtctttttctttctttctttcttgtttttggggcggagtcttgctctgytgcataggctgaagtgcagtggcacgatctcagctcactgcaacctctacctcccaggttcaagcgattctcctgcctcagcctcccaagtagctgggaccacaggtgcatgtgccaccatgcctggctaattttttgtatttttagtagagatggggttttaccatgttggccaggctgctctcaaactcctgacctcaagtgatccgcccgccttggccttccaaagtgctgggattataggcatgagccaccatgcctggcctcctacctttctttctttatttttttttttttaaa

SEQ ID NO: 48300 - DNA, 601 bp, Human
acatgtctgaggacagattcttttcacacctaatgtgatcacgccagcacttacgtgatcaattagcaatctggccaataatctccctaaattgctcaatacaatcttcctatcgttcagcttaaccagtgctttatctgatcaggaaaataagcaaaaacacaacagtatttacaagtgcttctgaaaatactacttgctttaagctggaaaccccataagttggtaacactgctacttaccactgcttgactactcagaagctatctgaagtcccacataacgctgcagccgctgcagygactgctaggcagcttcttcatcttggctgtttgccatcacataaacccctcagaatgcagccaaagcgagactttgctagtttcccattccacgcagatgccccagggctcagcagacagtttgaaaccctcgtcctaactgtggcaaacagctcttcctacattcctacaactctagagttctaataatgacactcattcaaagtttctaggctcctggtagatagtgtgcagtaaacaaccacccaaaaattactcaggaaagagtgacatcagtgcaccagactttctaatctggg

SEQ ID NO: 48301 - DNA, 601 bp, Human
tttaatctgggggttgccaaatcttttctttaaaggtcaaagagtaaatattttaaattgtgtaggctatactgtctctgccacaactgctcatttatgcctgtgtagggtgaaagcagctgtggataatatacaaataaatgagtgtgttccaataaaactgtgtttcaataaaactaacaaaaacacagtgggctatagtttcctcatctgtttatttaacaaataaacctttgtgtagagtgcagcaacctgcttatagaaaagaatctcaaaatatatattttgaaaatatcttttaaaaaaaaaagtgtaaggatatttaaatatttaagccaatctagtctttgtactctgaaaccaaaaaagaagccaagaagcctcatcaccactgcccatgaacctaatttggaaaattagtcatattaaactcactaaaaatccaacagattgggatatagaaaaatgtgtagatgaagagttgatttaatcctgtgagttttagggaagtgttgcattctttggtgctcattaccaaatacttatgttactttgcacttctgtgtactaaataaagtgctgtacagtgaattatcttctt

SEQ ID NO: 48302 - DNA, 601 bp, Human
gtgctgggattacaggggtgagccaccatgcccggccgccattaaaacttttaatctgggggttgccaaatcttttctttaaaggtcaaagagtaaatattttaaattgtgtaggctatactgtctctgccacaactgctcatttatgcctgtgtagggtgaaagcagctgtggataatatacaaataaatgagtgtgttccaataaaactgtgtttcaataaaactaacaaaaacacagtgggctatagtttcctcatctgtttatttaacaaataaacctttgtgtagagtgcagcaayctgcttatagaaaagaatctcaaaatatatattttgaaaatatcttttaaaaaaaaaagtgtaaggatatttaaatatttaagccaatctagtctttgtactctgaaaccaaaaaagaagccaagaagcctcatcaccactgcccatgaacctaatttggaaaattagtcatattaaactcactaaaaatccaacagattgggatatagaaaaatgtgtagatgaagagttgatttaatcctgtgagttttagggaagtgttgcattctttggtgctcattaccaaatacttatgttact

SEQ ID NO: 48303 - DNA, 601 bp, Human
ctacactgatgtaaatctgctttaatgttaggcttaacagaaggcagcaggttctcatatctgtttctgcagtcttacgatgttctgttttgttgcaatatatgaggggaaaaaaagtaaactcatacagctgtacaactggaaaagggaggagtattttggtagattctgggcacaactgtggtattgttttttgatttgacaccaaaatgcaagtggtagcttcttaaaggtgagttgcaatgtggaatttacaatggtatcatctgttacattaaaatccatagaattaaggggggaraaaaggagaaaaaaatccactatttatcttgtactttcaatggaacttctactcatgtgtgatttttaacatcctgtgtaggtcatttggaagatactgatttactgagctatagagatcctcccaatgttaacacatttcagtaaacaacatatatttttaaaatatcacatgttaataccatcctgagcttactataacagtctaagaatttagaaagctgtcaagatcacggtaataagtttttcaaaattctaatttttgcttgaaaactcgaattttataccggtaacaaacagt

SEQ ID NO: 48304 - DNA, 601 bp, Human
aataaattgggcaatttaaataggggcatataggtggtaatggtggaactgcgtgactccaaaatctactgtgccatgatgctattctatgacaagcatacttctgactcaccaaataaaaaggaacatacaaaacaaatagatcagagaatggcaaaaccaatgtaaaatatctcacagtgatgcaaagacttaactgggtagcaaatgataacacaaggttccatttcaaaataaaaataaaaggtaaaaagttgaaaatatgttttatgatagacaaaatatttgcacaaaggacaayacaaaatcaaatgttgctaaccaacagccatggagagtgcaaatgtattggtaaaatagctctacttctgttctctacaaatcagaggttagcatggtggtcaagagggcaggctttgagccagactgtcagtgttcacagttagggtgcttcagctctctgtgtctccctattgtcaatgataaaaggagtacaataaccagcagctacctcctggagctgccgtgaagattaaatatgttaatatatgtcaagatctttgaaaatggctttcatatgagtccaaaagtgtcaactgct

SEQ ID NO: 48305 - DNA, 601 bp, Human
gttttctgaatcaaatgctcttggagtccaagaatggaaggaggcagagccagggaccagaacaataaacagagctgacagttgcacagtgatgtactcttgataaattcaggcaaaaaaaaaaaaaaaaaagttacaatttagtgtgtattctgtgtgtactgaactacctactttacatacaatttgataattttgatcaccacattgctatgaagcaatattataacccctattttacagtctcaaataaattgggcaatttaaataggggcatataggtggtaatggtggaactgcrtgactccaaaatctactgtgccatgatgctattctatgacaagcatacttctgactcaccaaataaaaaggaacatacaaaacaaatagatcagagaatggcaaaaccaatgtaaaatatctcacagtgatgcaaagacttaactgggtagcaaatgataacacaaggttccatttcaaaataaaaataaaaggtaaaaagttgaaaatatgttttatgatagacaaaatatttgcacaaaggacaacacaaaatcaaatgttgctaaccaacagccatggagagtgcaaatgtattggt

SEQ ID NO: 48306 - DNA, 601 bp, Human
tctactgtgtgtgctagggtggcaatttccaaagtgtgttctacaaagtggttgtgctgaattaaaagaggttaaaaaaaagagttcggctaccttggtacttgttttaaagatatgtgttaatatatacgcattaatgatggttgcaggggaaagggttttctgaatcaaatgctcttggagtccaagaatggaaggaggcagagccagggaccagaacaataaacagagctgacagttgcacagtgatgtactcttgataaattcaggcaaaaaaaaaaaaaaaaaagttacaatttastgtgtattctgtgtgtactgaactacctactttacatacaatttgataattttgatcaccacattgctatgaagcaatattataacccctattttacagtctcaaataaattgggcaatttaaataggggcatataggtggtaatggtggaactgcgtgactccaaaatctactgtgccatgatgctattctatgacaagcatacttctgactcaccaaataaaaaggaacatacaaaacaaatagatcagagaatggcaaaaccaatgtaaaatatctcacagtgatgcaaagacttaa

SEQ ID NO: 48307 - DNA, 601 bp, Human
atagtaaccatgtagaaggatcactttaggctaaaaatgaagtaacatcaggaaatgtctcatagttggtctcatttacaagagaggagaatttgggcttgggaaaggttaatcatacattagttcaatgaaaaaaatcaatgttttacttaattctctatttactcatttttacacaccgttctaagcccttagagacaagtccccactctcaggggcttccactgcactggtgacagacagccactaacaaacacgtactagagtttcaaatcttgacagtgccgcagaccaggcctgmtgggacacaaagagaactgtctctctgctaacagcttgtctcattaagcaggtgctgcatgttttctcaaaacaatgctggtattcaattcccactcagggccagttcactttccataccagccaggcacagactcgggctgttcccctggggcccatctgcttgtctgccagaggtcagggtctctcagcaatcatagaggtggggtttctttctttaggccacctacgtacttcccattgctctgacccttgtgctgggtcagggttttggcttcttcacttatggaaatggtagtaa

SEQ ID NO: 48308 - DNA, 601 bp, Human
agctaaaatctcaagaaaggacatttgttatggctgcattagagagctagtgcaaatatatactagaaaacaagaaattgtttctttggaatttcacatttactaaaataatgagggcaggccatccttggatgcaaaagcaacaggaagccacaaaaatgtctgtgccatactttgctctagaaatcccctttcctgcccaacaaccactatcccccaacaagaataacaacaacaacaaaaatacacaaaaaatcccccaaatgtttgtcctctaatgacctgggagctgatggtaggrtaagtcgtacctttaagttctaacaatgatgactaaggcagagagaagacattcagttggacatagagaaaaatttcaaggcagagggaaaataagatgggtttctttacatggttccttctctcaatcaagagaaagagaacagaatcagtattggtttccacacctcattaggctagtgttgtatggtgggtgttgtcagttaattttttagtgagataaagcacagccaaaaccgtatttccaaatatcaacacatccttcaacaaaggttttgtgcatttattaggtctctaggca

SEQ ID NO: 48309 - DNA, 601 bp, Human
tccctgggttcttttagttaaaaaaagttcattaaacctgaaagcatttgagtagatggggtatcctgatctttgaattaagtcattaaaatatgaccgggcgtggtggctcaagcctgcaaccccagcactttgggagggtgaggtgggtggatcacttgaagtcagaagttcgagaccagcctggccaacatggtgaaactctgtctctactaaaaaatacaaaaattaactgggcgtggtggctcgcacttgtaatccaagctgctctggaggctgaggcgggagaattgcttgaacstgggaggcggaggttgcagtaagccaagatcgtgccactgcactccagcctgggagacagagtaagactctgtctccaaaaaaaaaaaaaaaaaaaaaaaagtcattaaaatcaataaatcttaggatttagaaataaaaggtaccttaggccatgctttatttattaccttttttttttttttttgagacaagctcttgctctgttgcccaggctggagtgcagtggcatgatctcggctcactgcagtctcgacttcctaggctcaaatgatcctctcaccccagcatcccgagtagc

SEQ ID NO: 48310 - DNA, 601 bp, Human
tactgtacctaggtcaaataaatttttaaactataggagtagttcttggttttaccaagaaaatttagtaaaaattaacatggtccaaagaactgaatgctctgtcttcctgtttcttcgttggcctcatgtacatgctgacgatagtccacttagggctttgcctttcaaataaatggactaaagattttagtatttctccctgggttcttttagttaaaaaaagttcattaaacctgaaagcatttgagtagatggggtatcctgatctttgaattaagtcattaaaatatgaccgggygtggtggctcaagcctgcaaccccagcactttgggagggtgaggtgggtggatcacttgaagtcagaagttcgagaccagcctggccaacatggtgaaactctgtctctactaaaaaatacaaaaattaactgggcgtggtggctcgcacttgtaatccaagctgctctggaggctgaggcgggagaattgcttgaacctgggaggcggaggttgcagtaagccaagatcgtgccactgcactccagcctgggagacagagtaagactctgtctccaaaaaaaaaaaaaaaaaaaaaaaa

SEQ ID NO: 48311 - DNA, 601 bp, Human
ctaatttttgtttttttgagacggagtttcactctgtcacccaggctggagtacactgcgccatcttggctcactgcaacctccgcctcctgggttcaagtaattcttctgcctcagcctcctgaatagctgggattacaggcatgcatcaccacatctggctaatttttgtatttttagtacagatggggttttgccacattggccaggctggtctcgaacttctgacctcaagtgatcagcccgcctcagcctcccgaagtgctgggattataggcatgagccactgcacctgcctaawttttgtatttttttttttttttttttttttttagtagagacggggtttcaccatgtgggctaggctggtctcgaactcctggcctcaagtgatctgcccaccttggcctcccaaagtgctgggatggattacaggtgtgatccaccgtgccaggccaaaaataacaatttttttttcccatctgccttacaatctcaagatttgctttaattcagaaggaaagttttatcctatgctttcgaaattctaaattagttaaatttaacacaaagttagtgtcagtgaatgtttaatgataca

SEQ ID NO: 48312 - DNA, 601 bp, Human
tgattaacctaaaagtaggtgcagcggcctggcctggtggttgcaaggacacagaccaatagctctgggcctagctcatgccaaaggccaagacccagaaacaagcttgtaaatagcagataccatggaaaccaacagtaatttttacacatacacagcataaaaaggaccacaacgagatataattaccattgttagagtctcttcaccaaattaaggaccataaagcacgtgtgctcataaccagagacctagctgccaccatcaccacttgacagtgtcacgagagcttctacaaccracacacactaccttccaactgacagagggtcagggtggccctcacactacaccgcaccaggcgttattcccagtgcaccaagctttccatgcggctgtctaaaaatctgcatctccagcgcagaccacctcctctgggctctatgccctatatccagctgcctcctctgcattcccatttgcatatcccaaatgtccaaacctggcatcatcatgtttccctgacatggactcctcattctgaattttatttcatttggtagcacaatgttatttttggtgacaccaatgctatgattcc

SEQ ID NO: 48313 - DNA, 601 bp, Human
ctgaagtactcaaaaagtaagagatgtgactagcagtagcaaccataaaaaatgatgtgatgatgtgatctctgaaaacagatgtcaaaacagatgtcttctgacatctaaaatttgggtaatactactgacaaagcaagttaatttttcaaacaagaacagaacttatctaatagggtgcacagctgaccttactgaagtaaatggcagggccagagcagtaggcctgggtgggtctaggaatgaaccagtttatgaagatgaaaacagaagctaagcatctttttttcttttcttttcktttttttttttttttgagatggagtctcgctctgtcgcccaggctggagtgcagtggcgcgatctcggctcactgcaagctccgcctcccgggttcacgccattctcctgccttagcctcctgagtagctgggactacaggcacctgccactacgcccagctaattttttgtattttttagtagagacggggtttcaccatgttagccaggatggtctcgatctcctgacctcgtgatccgtctgcctcggcctcccaaaatgctgggattacaggtgtgagccaccgcacccggcctgg

SEQ ID NO: 48314 - DNA, 601 bp, Human
ggtcaaatgttaacaactggagactctaggtaaagggaacatgggaattctttgtaccattcttgtaactttaaaaaactctgaaactatcctttcctcttctgcccattcacttgagggaccagctgggagctggttctgcttaggggttctgttgaagggctctaaacagagagtggaggtgattaggtttgactctactgtagcagaaaggacaagtttttattttcattttttatttatttatttttttgagacggagtctccctctgtctcccaggctggagtgcagtggcatgayctcagctcactgcaagctctgcctcccgggttcatgccattctcctgcctcagccttctgagtagctgggactacaggcgtccgccaccacgcccggctaattttttgtattttcagtagagatggggtttcactgggttagccaggatggtctcgatcacctgacctcatgatctgcccgcctcggcctcccaaagtgctgggattacaggcgtgagccaccgcgccaggccaacagtttctatttttaagagacagggtcttgatctgccgcccaggtcagagtgcagcgactattca

SEQ ID NO: 48315 - DNA, 601 bp, Human
ggaaaaggtgaaacttgtgtgttgtccctgaatttagggcagattttggatcacttatggaaaaacattctaataatcagaggcatcctgaaacagaatagacagccctgacagcagtagcagacagtaagcaaagagggcaaaagtcacaacttacttatctgttcattcaacagaattacaaaacagctcatgtatatcagccccatatccctagtgcctggcacagttcctggttggtgcgcactcaacacatcagtgttgactgaattaacctccatgctactatataaaaaaacaygttccctttcacgtaaaaatattcatttaaaagcaatagttaaatatagatgaaaaatgacctaaatcctcaaatgtagcgttgggtgtggtggtgtgtgcctgcaatttcacctatctgggaggctgaggtgggaggaccctttgaggccaggatatcaagaccagcctgggcaacatagtgagaactcatctctacaaagaaaaaaattttaacaattagctgggaatggtggtgtgtgcctgagtcccagctactggagaggctgaggtggggcgatggtttgagcccaggagtttg

SEQ ID NO: 48316 - DNA, 601 bp, Human
tcaaaagatgacataaacatggccaacaagcatatgaaaaaatgcccaatatcactaatcattagagaaaagcaaatcaaaaccacaatgagatgccatctcacaccagtcagaatgtctattattaaaaagtcaaaaaattaacagatgcaaggttgtggagaaatagaacacttaagacactgctggtgggaatgtaaattacttcggtcactgtggaaagcaatttggcgatgtctcagaacttaaaacagaagtagcatttgacccagcaatccccttattgggtacacacccaaargaatataaatctttctaccataaagacacatgcatgcttatattcatcacagcactgttcacaataacaaggtcatggaatcaacctcaatacccatcaatgatagactggataaagaaaatgtggtatgtatacactatggaatactatgtagccacaaaaagaatgagatcatttcctctgcagcaacatgggtggagctagaggtcattatcattatcttaagtgaactaatgcaggaacagaaaaccaataccacatgttctcacttataaaggggagctaaacactcagtacaca

SEQ ID NO: 48317 - DNA, 601 bp, Human
agaaagtttatagtgctaaacatctacaacaaaaagttaaaaagatctcaaattaataacctgacatcacaccttgagtaactagaaaaacaagagcaaatcaaccccaaagctaacagaaaacaagagatacccaaaatcagagctgaactaaatggaactgagacatgaaaaaccatgcaaaagataaatgaaaccagaaattggttatttgaaagaatacataagaatgactgatcactagctagactaattaaaaaaagagagaagatcgaaaaaaatacaatcagcaacgacaaasgggacattaccaccaaccccacagaaaaatacatagaactatcatagaacattatgaacacctctatgcacatgaactagaaaatctagaagatatggatgaattcctggacacatacacattcccaagactgagccaggaagaaagcgaatccctgaacagaccaataatgagctctgaaattgaatcagtaatagatagcctatcaaccaccaaaagcccaggaccagatggcttcacagttgaattttaacagatgtacaaagatgagctggtagcactcttactaaaaccactcca

SEQ ID NO: 48318 - DNA, 601 bp, Human
aaaaatagaatcagtactaagaagattgttcaaaaccatatgattacgtggaaattaacctgctcctgaatgacttctgggtaaggcagaaatcaagaaattctttgaaactaataagtacaaagatacaacacactagaatctcttgaacacagctaaggcagtgttaagaagaaagtttatagtgctaaacatctacaacaaaaagttaaaaagatctcaaattaataacctgacatcacaccttgagtaactagaaaaacaagagcaaatcaaccccaaagctaacagaaaacaagaratacccaaaatcagagctgaactaaatggaactgagacatgaaaaaccatgcaaaagataaatgaaaccagaaattggttatttgaaagaatacataagaatgactgatcactagctagactaattaaaaaaagagagaagatcgaaaaaaatacaatcagcaacgacaaacgggacattaccaccaaccccacagaaaaatacatagaactatcatagaacattatgaacacctctatgcacatgaactagaaaatctagaagatatggatgaattcctggacacatacacattcccaa

SEQ ID NO: 48319 - DNA, 601 bp, Human
acaaaaaatttagcaaatgacagcgtgtgttaacaacggctaatatgtgtatatatttcttcacttgatcttagccaaaaggctgagaagtgatgtacatatttctttaggtcacaaagagtttggcttattactaaaaggccttattaaacaacagaatataaatgcttctcatctgcacatggtacatactctaaaataaaccacacaattggctataaaacaattctatagctaattaaaaaaaaaaaaaaaccgaaatcacaccaaccacactctaggaccacagcacaataaaaayagaatcagtactaagaagattgttcaaaaccatatgattacgtggaaattaacctgctcctgaatgacttctgggtaaggcagaaatcaagaaattctttgaaactaataagtacaaagatacaacacactagaatctcttgaacacagctaaggcagtgttaagaagaaagtttatagtgctaaacatctacaacaaaaagttaaaaagatctcaaattaataacctgacatcacaccttgagtaactagaaaaacaagagcaaatcaaccccaaagctaacagaaaacaagagatacc

SEQ ID NO: 48320 - DNA, 601 bp, Human
gaagaaaaaaatattgcttgaacaaattttctgtgattctggagacttttacaaccatgtagtaagagcataaaaatttagcaaatgggccaggtggatcacttgaagtcaggagtttgagaccagcctggccaacattgtgaaaccctgtctttactaaaaattcaaaaattagatggacgtggtggcacgtgcctgtagtcctagctactcaggaggctgaggcacaagaatcgcttgaaactgggaggcggaggttatcacgccactgtactccagctctgggtgacagagcaagacyctgtctcaaaacaaaaacgaaaacaacaacaacaaaaaatttagcaaatgacagcgtgtgttaacaacggctaatatgtgtatatatttcttcacttgatcttagccaaaaggctgagaagtgatgtacatatttctttaggtcacaaagagtttggcttattactaaaaggccttattaaacaacagaatataaatgcttctcatctgcacatggtacatactctaaaataaaccacacaattggctataaaacaattctatagctaattaaaaaaaaaaaaaaaccgaaatcacacca

SEQ ID NO: 48321 - DNA, 601 bp, Human
agaatctcttgagcccggtaagcagaagatgcagtgagccgagatcctgccactgcactccagcctaggtgacagcgcgagactccgtctcaaaaaaaaaaaaaagatctcaaattactcaaattaataacctaacatcacgccctgaggaactggaaaaacaagagccaaccaaccccaaactggctgcttccttatgttgaagaaactaatgtgtaacaagcagttggccgggcgcggtggctcacgcctggaatcccagcactttgggaggcggaggcgggcagggggggatcacgargtcaggagatcgagaccatcctggctaacacagtgaaacaccgtctctactaaaaatacaaaaaattagccgggcgtggtggcgggcgcctgtagtcgcagctactcgggaggctgaggcaggagaatggtgtgaacccgggaggtggagcttgccgtgagccgagatcgcgccactgcactccagcctgggccacagagcgagactccgtctcaaaaaaaagcagttggtcctaaaacgttaggaaggactgggaattggtgtgaaaataagtcctatttctagcaggctttaacctat

SEQ ID NO: 48322 - DNA, 601 bp, Human
ggctaatagatataacctaagacactttactttctattgaaaagagatccacttctttacaatacaagtgctataaaaaatagcacacaaaattaaaattgttcctccctcacacaatcaagttgttttcaacatgtcatttaacacctctgattttaaagacttgcaaaaagtctcagagcttgaaggtatgaagaatgataccatatcaacttatttttgtgtagtgctttctactttatatatcactatcatatcattcatttgttcaatgaacagttattgaacatccgctttgttytagcactgttctaggtataaaacaaagatcctgcctggggagcaaacagctaacaatgcagtggaaggagacaggtaataaacaatgaacatgtattagtatattctgtgttctgttaggagaagctgtgtcccacaaagaaagatggctgggatagaaggagaggaactacacgttttttggtattggttgattgattaagtgagtgactgagtctcactctgtcgcccaggctggagtgtagtggcacaatcttggctcactgcaacctctgcagcccaggttcaagtgattctcctg

SEQ ID NO: 48323 - DNA, 601 bp, Human
tgcaaccctaaggaggtatttctgatgcattataccaacaaattctttttcccaatactctagtaatgagctgaatgtggtaaacatcgtacttgctgtggtctgtagaggaaaaattaaccatgagggtattccaaagctacgacactatatacattcaaaacccgctttcatcaaattaaactaacttctttccgcccaattcttttcttctttacctggtttacccacaggctgatatatatgttggtttccaatctgtgggaaaagaaaagttcagtcaatgcactggtatatacamttgggcaatgacctctctcacccaccctgtctatccacccccttgaacttctaggctagattctagtgtatcaaaatgaacaaaacagggttctgcataaggtctcagttggggtgggggatcaggcaaataggcaaatgatgccaatagcatgtgtggaaagggctgtgagagaagcaagcatgggacactctggaaccacaaacacagtggtcataacccatttaaaatgttcttacacagctgaggagaatgtaaattagtacaacctctatggaaaatgaactagaaaaactcaaa

SEQ ID NO: 48324 - DNA, 601 bp, Human
aatccacttgccttggcctctcagtgttggaattacaggcgtgagccactgtgcctagctgcattgcagtattagaacaatactgttcttttaggatggattcaatgacctctaccaagcagacaatgaagaaacagaggtgtatatttcatgttatttaaaaatctacttaggtcgggtgcggtggctcatgcctgtaatcccagcactttgggaggccgaggcgggcggatcacaaggtcaggagatcaagaccatcctggctaacacggtgaaaccccgtctctactaaaaatacccaaaaaaaaaaaaaaaaaaaaaattagatgggcctggtggcgggtgcctgtagtcccagctacttgggatgatgaggcaggagaatggcgtgaacccgggaggcggagcttgcagtgagccaagatcgcaccactgcactccagcctgggcaacagagtgagactctgtctcaggggggcggggggcgggaatctttacttaatatattttaagtacacatattattttcaagatttcaatttgcttcataccctatcctaattgtatgtattcattatgttattccagctgtgaaagatgt

SEQ ID NO: 48325 - DNA, 601 bp, Human
agttcccatttctgaacccttgggtgcttttgcctaagtaatctggaacagattaattcttggttgttccaaaagtctgggtatgagatagaaaagcacaagaataattcatttactgcaaagatgtacatgtctcattcttttgcatatataaacactgcttttggcatctgtcagtcatgagaggtgacaaagcaggccgaagtgccctcccacttgggcttcctgctttccagtccaaagttacatgcagagagccgggtgtgatagagagagctggacagacacacaaagacacgaygtgcttaccctccatggctattgtcgaacggaaggtgaggaaaagttaaaggaatttatcagagaaagggaaaaaagaaaaacaatattaataaaggcataagacaaatcccccataaaaacacatgagcagaacaaaaaggagctagtttccaagcctgcccaccagctctcactcactgttgccagggtgtggctactgtgccacctgctcactgccccagcatactgcatagagaggtctgccatgcaccatgctcagttacaaaacaaatgcagggaacatgcaaagcccgaggaa

SEQ ID NO: 48326 - DNA, 601 bp, Human
ggatacactttaaaaaagtgaaccagaatggattaactgtgctttccatgaaacattacaactttcaagcagctttttccacattgatggtttataagaagctgttgcaaagattgctaataggtatactaaaaaacagttgtaggggccaggcgcagtggctcatgcctgtaatcccaggactttgggaggccgaggcaggcagatcacctgaggtcaggagtttgagaccagcttggccaacagggtgaaaccccgtctctactaaaaatacaaaaataagccaggtgtggtggtgcaygcctgtagtcccagctactcgggaagctgaggcagcagaattgcttgaacctgggaggcaggggttgcagtgaaccaagatcgtgccattgcactccagcctgggagcctgggtgacagaatgagactccatctcaaacaaaacaaaacaaaaaacccaacaacaacaattgtaggattctataactcaacaacaaaatacagtatgatttaaaaaacaggccaaaaaagaaaaaaaaaacttgacatttttccaaaaaagatacacaaacgctcaaaaagcaaacagatgttcaagacc

SEQ ID NO: 48327 - DNA, 601 bp, Human
agtgttgggattacagaggtgagccaccacactcagcccttaagaagcttcttaaagacattcattaatttaaaatgattttttttttcagatggagtctcactctgttgcaggctggagtgcaatggcacgatctcggctcactgcaacctccacctcccgggttcaagtcattctcctgtctcagcctcccaagtagctgggactataggcgcgtgccaccatgcctagctactttttgtatttttagtagagatggagtttcatcatgttggccaggatggtctcgatctcttgacckcgtgatctgtccgcctcagcctcccaaagtgctcagattacaggcgtgagccaccgcgcctggcctggaattttttaagacaataattttatttattaattttttggtagagatagggtctcactatgttgtcttgaaatccaggcctcaagccatcctcctgccttggcctcccaatgtgttgggattacgggcgtgagctaccatgcctggcctaaaagaaattttttatattactacttgaaatggaaaaccaggatcatttgcaagctcaactatttttaaggagaattcgaggaa

SEQ ID NO: 48328 - DNA, 601 bp, Human
aaaagtgctacagagacaaccgacgaccctggaacgtgccctgcagagtgggacagtgcattacatcatgttaaagttccagaatgtggtgattgtgtggtggttatgtaggacaatggccttgttatgagaaatataaatggaaatcttaaaggggaagagggcatgagatacacagccattctcaagctgctcgacagcaggaagtgatgtgtgtacacacatagacaatggagcaaggtgacaatgtgctgacatgttaaaaggctgtgaaactcaaaggaaagttgggagttctctstattaatcttttaactttcatataaatctgaaatgatttcaaaataaaaaggacaaacaaaaagtgtgtgctgggatgaagaactgcccatgcttccctagaaatgagaaaagcaggcagctggagtcagcagggagcaaggctgaagcctgcagatcctggactctgtagtggggacgcatcccacatgcgtttgtcaatcccaaccacagaatgtacaccctaggctcaaagacactaaaacaaatgcaggtgcttcctttcatttgttagtcatataattgaaacaaaattgccaaa

SEQ ID NO: 48329 - DNA, 601 bp, Human
ctgaagaaagcaacaccacgtgcaaagtgtaatcctggtctggctctcacaggcgacggaaaagtgctacagagacaaccgacgaccctggaacgtgccctgcagagtgggacagtgcattacatcatgttaaagttccagaatgtggtgattgtgtggtggttatgtaggacaatggccttgttatgagaaatataaatggaaatcttaaaggggaagagggcatgagatacacagccattctcaagctgctcgacagcaggaagtgatgtgtgtacacacatagacaatggagcaaggagacaatgtgctgacatgttaaaaggctgtgaaactcaaaggaaagttgggagttctctctattaatcttttaactttcatataaatctgaaatgatttcaaaataaaaaggacaaacaaaaagtgtgtgctgggatgaagaactgcccatgcttccctagaaatgagaaaagcaggcagctggagtcagcagggagcaaggctgaagcctgcagatcctggactctgtagtggggacgcatcccacatgcgtttgtcaatcccaaccacagaatgtacaccctaggctcaaagacactaa

SEQ ID NO: 48330 - DNA, 601 bp, Human
atattctagaaagatggctcttggcggcaatgtggaggctgaatggaagggcaggggaacagacaagaggcagataaaccatctaagaggccatcttcagaggagaggtgatggtggatgtgcaggtgaacggaccaacctgagacctgatgagagatggaaggtgtgtggttgtttgcatgtgtgtaggggattgggaacagacgtgcaagtgcatggtgttgtcactgactgtggaagcaaacaaggaaagcagaccgttcttgccaatggcagacagttggagatcagagctcagggmggggttctataaaatcaacacagatttgggaggcatcaaatacttgaatctatgagaatgagaagaactaccagagtgaaaaagtattttttaataaaacaagtgggtagcactttgggagatgaccacactcaagggtggcagggaacaaaagcctgagcagaggtcttggcaggagaggagtgagtgaggaagctctgggccagagcagggggtctcaagggggagttaggactgaggggaaagcaggggctctggcaattaggagaccttgaagggctgttacagcagagagagttc

SEQ ID NO: 48331 - DNA, 601 bp, Human
aactgtgaaagccacacctagttgatctttatttggcaggacttggcaagagggataagagatttttaagaaggagaatgacaaaatctagagagatattctagaaagatggctcttggcggcaatgtggaggctgaatggaagggcaggggaacagacaagaggcagataaaccatctaagaggccatcttcagaggagaggtgatggtggatgtgcaggtgaacggaccaacctgagacctgatgagagatggaaggtgtgtggttgtttgcatgtgtgtaggggattgggaacagacrtgcaagtgcatggtgttgtcactgactgtggaagcaaacaaggaaagcagaccgttcttgccaatggcagacagttggagatcagagctcagggaggggttctataaaatcaacacagatttgggaggcatcaaatacttgaatctatgagaatgagaagaactaccagagtgaaaaagtattttttaataaaacaagtgggtagcactttgggagatgaccacactcaagggtggcagggaacaaaagcctgagcagaggtcttggcaggagaggagtgagtgaggaagctctgggcca

SEQ ID NO: 48332 - DNA, 601 bp, Human
ccttaggccttccagccatggttgggagtgtgtgtgtttgggggggttagggtggggggaaggggaggtggtgtgcagggagggggttgggcatttgctgaaaatagtgcagtgacctctctctcccaccagcgccgcctactaaacctgacctgctgcctgccaccagcccgatcaattcaacacagatgtggccccttttcctccccatcagagctcggcatatgtgtgctgggtactctctcgagccccgtttccctctgtggctctacctgcttctcctttgttcctcagtctgtamcctttctatcctttctctcctttaccccactaggtttagcttcctcccacctttagctttctaaccatcacccactcctttctatcactgcctctgcatcaggattctcaaactctcaaacttattctccctttgccatgattatcccctgcatctttccactctaacttctatttctctccctatatctactaatatgccttcaactcttaacagtctcttctctattatctccctcaccatctccagtctctcccctggctcttctccctgctcttttctttctccctatgttctacc

SEQ ID NO: 48333 - DNA, 601 bp, Human
atccacaacacagtggccctccatggtggagggcagggggtacacctaggacacagacttgaccccatccggaagagagattctcacacctctagggaatttctttggctgtggggtagggggatgacccatccttgcctgcccctacctcccctgatcccctcccggctctttaatcagggacatgaccaaattcaaaaacctcccagaaagccttgacctcaagacacgtatttctgacctagaataatgctttctacaggcctccagggctcccagctcaattctctcccagaactgccccctcactatcctccagtgcacatcccacgcgcgcatcagctgtgactaaggttcctctggccagttaggccaggagaagggaagaggaaaagggagcaagagtgatgtgtccctccctagacaaacagtagcctctcaagccaggagcccagggcaggagcaaattgaagtgggcagagcccttcctcacccccaagcgctgggaggagggaaagggggagaggggctggacagggatgagagggttggggagggagagaggggagaagggagagcgaagggaagccccatggcgata

SEQ ID NO: 48334 - DNA, 601 bp, Human
tttccagatcccctccccatccctgaccctgtccacctccatcctgggtctcttgcattctaaaacatttcccaggtttcccaagtcccatacacagtctcctccctacctccttatggatcgccttctcgttgaaattaatcccacagcccacagtaacattaatgcagcaggagtcggggactcggttcttcgacatggaagggattttctcccaatctgtgtagttagcagccccacagcacttaaactgggggagggaagaaatatggagaagaaggttgttaagtgaaccttcacyttcaatatggagatgagaattctttttttttttttttttttttttttgagacagagacttgctctgttgcccagacaagtgcccagcggtggctcaatctcggctcactgcaacctccgcctcccgggttcaagcgattctcctgcctcaccctcctgagtaggtgggattacaggcactcaccaccacacctggctaatttttgtatttttagtagagacagggtttcaccacgttggccaggctagtcttgaacttctgacctcaggtgatctgcccacctcggccttcaaaagtgct

SEQ ID NO: 48335 - DNA, 601 bp, Human
gaaaataggttgagagagacagtgagatgctcagtatcacacagcaaacctcttggccctatacatcattccaaacacaagacccaggttgcatatagaaggttcagtgtccctggtttagaaggagaggtggtgtgaggcaagcaagaagatgcctctgctgcactccagcctgggcgacagagtgagactccatctcaaaaaaaaaaaaaaaaaaaaaaagatgcctctgctccatacagcaggtctgtacacaggatctggctcatgtggttttagttaagttagccacaaatacagsgtctgcccacatctttgctttgaacagatgagccatggttggccaattatctgccaaccagataatttctcaatatgctcacaccagatgcttccagctagggagggtattaggggaaagggcttgagggccacagtaaactggacaagtttttctgcccagcctaggctgccacctgtaggtcacttgggctccagctatgtggctgcctcttctgctgggtgccttactctgggcagtgctgtggttgctcagggaccggcagagcctgcccgccagcaatgcctttgtcttcatcac

SEQ ID NO: 48336 - DNA, 601 bp, Human
tttggtctggtgaataatgctggtgtggctggtatcatcggacccacaccatggctgacccgggacgatttccagcgggtgctgaatgtgaacacaatgggtcccatcggggtcacccttgccctgctgcctctgctgcagcaagcccggggccgggtgatcaacatcaccagcgtcctgggtcgcctggcagccaatggtgggggctactgtgtctccaaatttggcctggaggccttctctgacagcctgaggtgaggggtacagggctctgggttccaggactaacagcagcccactmaacaaacgtgggccagcagaggtggttaagatacagcacattggaatagttaagaagagacagtttagggctagacttcatgggttcaatgaagtctacccttatgtaagctttgtgaccataagtagattacttctctttacccatttttaacgtgtttgttttttgttttttgagatggagtcttgctctgtcgccaggctggagtgcagtggcgcgatcttggctcaccacaatttccacccccggggttcaagcgattctcctgcctcagcctcccgagtagctgggactacaggc

SEQ ID NO: 48337 - DNA, 601 bp, Human
agcctgcgtttgtcaccatcactcagcaaataacctgaatgtctcctgtctctcagccttaatttttcaggcagcatcatgggacacatacttttagttttgagacaaggccttgctctcacccagggtggagtgcagtggtgcagtcacggcccactgaacttcaaactcctaggctcaagcagctcaagcgatatccgcctcagcctcctgagtagctgagaccacaggcgcgtgccagcatgcctggctagtatttttttacagatggggtcttgctgtggtgaccagacttgtctcmaactcccggcctcaagcgatgcttccgcctgggcctcccaaagtgttgggattataggtgtgagccactgcatactggaacacatactttatacttgaatttttttttatccccttccctcctgctccttacctatacttggatttctacatctgtgccagggcagtgggatgtatccccactttccccatcagcttaccctccagcaaatacgagactatacccttcaatatccagcactcagggctcaaccatgtgttttgggagcaagggaatggggttcctctaggtcaggaatcg

SEQ ID NO: 48338 - DNA, 601 bp, Human
ggtcaggaatcggcaaactcagtactcaagccagatctggccagctgcctacaagctgataatggttttttttatttttaaatggttacattgtaaactgttatataagtacctgataatatcattaattttgtttcttggcctgccatgcttaaaatattaactctctggccctttaagaaaaaaacgtgctgacccctgctctagatcaaagaaaacaaacctcaaaaatactttcctccctctaccccacttgacccttgtcccggggcagtaggcatctccgtcaaaactcttgtcyctggtctgtggtaactttctcagctccccaacccatgtccctcaaagtcccctccctatagggcaagaacccagcaacttcgctctgccccgactctaggcgggatgtagctcattttgggatacgagtctccatcgtggagcctggcttcttccgaacccctgtgaccaacctggagagtctggagaaaaccctgcaggcctgctgggcacggctgcctcctgccacacaggcccactatgggggggccttcctcaccaagtgtgagtagccaggcccacacaggggcacatgaaggga

SEQ ID NO: 48339 - DNA, 601 bp, Human
tgcagcttcctgcaggggccaaggaaggatctggggacaaactgtccggaactctgggccagggaggcgagaaggagagagagaggaagagccgaggcagatggaggactttggccacaactgccatgtactcaagagtagaaccgagtgggtaatgggtcgctttgctttttgtcttggcagtgcctccggagccagcgtggtggccatagacaacaagatcgaacaggccatggtgagtggcatcactgcgtcattctcatcccctgacttagctgctgcttatgtaactctgggcagrattgagggaatgggtgaaaaagcccttagccaaaaccctgaggaagccgacagcctgcctcctatccgcactggaggtggagtctgattagagtggcaccttttagggcatttccagtcttcccttcctgggctccctcctttcttcctccctcctccatctcaggtctttgccgcaggctctgactctctcctgggcctgttgttgggcagggagctcagactcttgcatttgtgtgcatcgtgcagctggcaaggggctgagctcattggatgcaacagcactgcagtgcctctgcag

SEQ ID NO: 48340 - DNA, 601 bp, Human
tggcagtgcctccggagccagcgtggtggccatagacaacaagatcgaacaggccatggtgagtggcatcactgcgtcattctcatcccctgacttagctgctgcttatgtaactctgggcaggattgagggaatgggtgaaaaagcccttagccaaaaccctgaggaagccgacagcctgcctcctatccgcactggaggtggagtctgattagagtggcaccttttagggcatttccagtcttcccttcctgggctccctcctttcttcctccctcctccatctcaggtctttgccgcrggctctgactctctcctgggcctgttgttgggcagggagctcagactcttgcatttgtgtgcatcgtgcagctggcaaggggctgagctcattggatgcaacagcactgcagtgcctctgcagagcctggactggggtcaggagttgggtggaaacaggaagcgaagcaccccacccctgtccctctccttaccaggtagaggtcatactccaaggagcagccacaatggctgcagagggttagggcttcagcggttgggagccacttaattgtgccctggagcttaaggacaccttccc

SEQ ID NO: 48341 - DNA, 601 bp, Human
ggccgcggctgccttccagacgcagggcatgcgacctgttggagtgtgaaattctaggggccgggttcctccccagagcggttttatttccgactggactgtgctgcgggtctcagaggccctctggtccgttcagggtgaggacagctgagaggcctgggcccgtgagctcttgcagaggagttgacacgcagaggggctgctgtccaataaacgaaagtgtcggggaaaaactttgcagggcgatctgcattactccaaagtgaacacactgcatgtctcagggtggctggaggcggcgagaatccccttatgggagtatatgagcttttccatgtgttatctctttaaaacctctcagcggctccgagacaaaactcccagtgtcgcagaggtttcttcatcaataggagtagtgctggagaatcttgggcactgccctcattttgcctgcgaaggaaaaattaggaagggataaaaagtcacaaaaattaggaaggtgggggggataagcaaattccaagggcatctatctctgatgaagggttggtgtctcctgtggtgccctactgtggattagttatttgtgtcctcggtccag

SEQ ID NO: 48342 - DNA, 601 bp, Human
gctcagctggattactaaatttttttttgagatggggtcttgctctgtcacccaggctggagtgcagtggcgtgatctcagctcactgcaacctccacctccctggttcaaaaaaattctcctgccttagtctcctgagtagctaggactacaggcacgcgtcaccacacccagctaattttgtatttttagtagagatggggtttcaccatgttgatcaggctggtcttgaactcctgacctcaggtgatctgcccacctcagcctcccaaagtgctgggattacaggcatgagccaccrcgtccagcctggattactaaatctttacagatgtatcctgactttctctgccttttccctctgtatttgccccaaccagtgcaggcctgagtgttccttccagcatgtcggagggggagtcccagacagtacttagcagtggctcagacccaaaggtagaatcctcatcttcagctcctggcctgacatcagtgtcacctcctgtgacctccacaacctcagctgcttccccagaggaagaagaagaaagtgaagatgagtctgagattttggaagagtcgccctgtgggcgctggcaga

SEQ ID NO: 48343 - DNA, 601 bp, Human
acccgatcagaccagcaaacctgggatccagcagcacgttacgtaaaacaggatcgcccaaaacttgtcccaatcccagccctccccccgaagcccccgggctgccctgccaggcaaacttcgcccctcaaaaccctggcctccagattcacatgtaatccccgccagcaactgttgaaactcaaagggtgggaaggacggggccaaattccttcaaacttgggagaaatgccggaggagaaaagaatcatctcgctgcaccactttccccattgccttccaagacccaaacttttgggggttctttcttaaggcaaaagaaaaagactttttgaaaagcaaatgctccgcccccctttaccttgcataaaacttcgctcaagtcgaagatggtggcagacacgagggtggtggtcatcctgtgcgttcgcgcgagccaggggcgaggatctggtgtgtcgcgaaggtcccggtgcggggaaggcgcagcctctcctgtctggagtcccacacgccagttcccggcgcccctcgcctttctgactccgggctggggcgcgcaaagcccaatttataaagttcagatttggtgggccggggg

SEQ ID NO: 48344 - DNA, 601 bp, Human
taatgccgctggacagacctagggcgcagactgggaacccgatcagaccagcaaacctgggatccagcagcacgttacgtaaaacaggatcgcccaaaacttgtcccaatcccagccctccccccgaagcccccgggctgccctgccaggcaaacttcgcccctcaaaaccctggcctccagattcacatgtaatccccgccagcaactgttgaaactcaaagggtgggaaggacggggccaaattccttcaaacttgggagaaatgccggaggagaaaagaatcatctcgctgcaccacyttccccattgccttccaagacccaaacttttgggggttctttcttaaggcaaaagaaaaagactttttgaaaagcaaatgctccgcccccctttaccttgcataaaacttcgctcaagtcgaagatggtggcagacacgagggtggtggtcatcctgtgcgttcgcgcgagccaggggcgaggatctggtgtgtcgcgaaggtcccggtgcggggaaggcgcagcctctcctgtctggagtcccacacgccagttcccggcgcccctcgcctttctgactccgggctggggcgcgcaaag

SEQ ID NO: 48345 - DNA, 601 bp, Human
ctcgcatatccccagctccccccaaagagtggaggaaaacattgtcccgagactcacttccccgagggacctcccactcccaaccccacgggtgggtaatgccgctggacagacctagggcgcagactgggaacccgatcagaccagcaaacctgggatccagcagcacgttacgtaaaacaggatcgcccaaaacttgtcccaatcccagccctccccccgaagcccccgggctgccctgccaggcaaacttcgcccctcaaaaccctggcctccagattcacatgtaatccccgccagsaactgttgaaactcaaagggtgggaaggacggggccaaattccttcaaacttgggagaaatgccggaggagaaaagaatcatctcgctgcaccactttccccattgccttccaagacccaaacttttgggggttctttcttaaggcaaaagaaaaagactttttgaaaagcaaatgctccgcccccctttaccttgcataaaacttcgctcaagtcgaagatggtggcagacacgagggtggtggtcatcctgtgcgttcgcgcgagccaggggcgaggatctggtgtgtcgcgaaggtc

SEQ ID NO: 48346 - DNA, 601 bp, Human
tcctcggcgtccctgcaccccaaccctgcagccctggggcgttggcagctgcaccaacaggagcagcaagctgggaaaacagagcaacatgacccgacgtgttaagagaaggcaaaacacttcagcaattaaaaagtagcccagcagcttcaccctttcaaattgggagggggaggttggaaagaaatttaacaacatccatagacttttgctatgtacatttaaaccgcagtcctggaacattccgagtttaaaacttgctttttcaacactggctgacaagcaacatgttttaaggagscccccattaaatccttactcgcgggactctcgagttcaagccagcattttgtcgccacctccccccccaaccccgcccgcaatcgatgagccgcaatgcctcggcaacacaggtaagcgggtcaacctgaatgcctctttcaccccaaagtttgctgcacgatcggctatcgcgggaagaagcccaacggagctagggcggactcaagccccactgcaaacttgttctgcaacatctttttgaatcacaacttggcctttcttcctcgcatatccccagctccccccaaagagtggagga

SEQ ID NO: 48347 - DNA, 601 bp, Human
cagacctctctagattaccgcaccccgcccccgccaccgcccgcgacaaaaacaggtaaacctcagaaaggagtctatcataggctacgttaggtccccttccaatcagtctctgcttaattgataccccctccttcaagacctggcctaagactctcaacttcctccttcagaagtgttcccttcctttggcaacaggttttcagactgcctttgctttttcttgtggggaggagattgggggcctggtctgaggttgggggagacagggatgtgattcctgaaaataaaactctttgcyctaagttcccggaagagatattttctacaataatctctctcaccatttccactcagccctagcccaccccgcccccttcactgagaagatgcctttgcaattagtcttttggctgcaagagcaagcttggataagagctccagtgtttaatctttaacgcaaagctgcagatggaaaggaaaaggaaagcaccaacccccctacccacctcctagtcaatagcggattgggggtggtggggatgggggcagagccaccaatggcaggtttctgttccaataggaccctggtcacctgccc

SEQ ID NO: 48348 - DNA, 601 bp, Human
aggaataatgaagtcactgaaacagccttgagttgaggtgtccttcatatacctccacctacatatggatatggtgacatggattcaatattcgaaccttgtttattaaataattgcagtttcttctttactaaggcctctcttagtcattttaataactctccaagttcaccactgaagattaaagacaaactgctaagatttagtcttcttttaatgtgtggcaagttaactaatgggaggaagtttttattcccgcccataaatgagcatactgtctcttaaaatagcttgtacacaytgcctttttaaaagaatcattttacactgaagacgacaatctctggttatcactgtttttaaatcctggagacatctctgcagtccatctgaactcggccaagcattgctcaaattgctctaccgtctgtaggttctgccttaagagattcctgacaagaagcggtttcagcctcttctggaggagacctctataacaatcagctgaggctgctgaatgagggggaagggcacatttgtagcagcttctcttactcatgctttgtagacttcctttcctgtcacagctcttggtattttt

SEQ ID NO: 48349 - DNA, 601 bp, Human
cacctacatatggatatggtgacatggattcaatattcgaaccttgtttattaaataattgcagtttcttctttactaaggcctctcttagtcattttaataactctccaagttcaccactgaagattaaagacaaactgctaagatttagtcttcttttaatgtgtggcaagttaactaatgggaggaagtttttattcccgcccataaatgagcatactgtctcttaaaatagcttgtacacactgcctttttaaaagaatcattttacactgaagacgacaatctctggttatcactrtttttaaatcctggagacatctctgcagtccatctgaactcggccaagcattgctcaaattgctctaccgtctgtaggttctgccttaagagattcctgacaagaagcggtttcagcctcttctggaggagacctctataacaatcagctgaggctgctgaatgagggggaagggcacatttgtagcagcttctcttactcatgctttgtagacttcctttcctgtcacagctcttggtatttttccactccaacccaggggaagccattctcctgtaaatattactccctctttaaact

SEQ ID NO: 48350 - DNA, 601 bp, Human
attcctgacaagaagcggtttcagcctcttctggaggagacctctataacaatcagctgaggctgctgaatgagggggaagggcacatttgtagcagcttctcttactcatgctttgtagacttcctttcctgtcacagctcttggtatttttccactccaacccaggggaagccattctcctgtaaatattactccctctttaaactccaacctaaagtgatggtgaggcttcagtttatatggccttccctttgactttttttctcaaatatatttaattgtacaattatatccttacygtgtagctgactggtagctcagtatcaccagcagtctgaaatagaatctcatagcctattaaataaaactgtggctctcagcagatttctagcatgtggttttggctaatctcctggaatatattggagaaaagtaccaagagacatttcagttgctctgttcctaaacagtaccaaaataacttgagtgttttgaacactttcaaataaacagcatggatcaaatttcaaaggagagactcatggaaaggtaactttcacaatccctttgttccttgcctttgctctgatgtcacaggc

SEQ ID NO: 48351 - DNA, 601 bp, Human
aaatgtaatgctgaaaccatataactgttagagaacataggactggatttttgcgaccttgggttaggtattggtttcttagctatcccatcaaaatcataagtgacaaaaattaaacttgacttagctaaattaaatacatctatgtttcaaagagcactattaagaaagtgggggccaggcacggtggctcacgcctgtaatcccagcactttgggaggctgaggcaggcggatcacctgaggtcaggagttcgagaccagcctcaacatggagaaaccccatctctactaaaaatacmaaaaaaaattagccgggcatggtggtgcatgcctgtaatcccaactactcgggaggctgaggcaggagaattgcttgaacctgggaggcggaggttgtgatgagccgagattgtgccattgcagtccagcctgggcaacgagagcaaaactccatctcaaaaaaaaaaaaaaaaaaaagaaactggaaagacttcatcaatgtaatgaaaaaccaaaaaaaaaaaagagaaaaggtaaaaagactgcccatagaattggcaaaatatttgcaaatcatatacctgataagattctagtgt

SEQ ID NO: 48352 - DNA, 601 bp, Human
cagtgcccttgggggatgggccacctgtagcagaggaataggagctgaggcatgagctgataagtggcatcactttagggccctctccaatctcacctggaatgtcactaatagtgacctatttctttgggttcaagcttttcattttctgggcctcctttatattgcagattcttttattttatagataggtctcactatgttgcccaggctggagtgtgggggctattcacagacataatcatagtacactactgcctcaaacttctgggctcaagcaagcctcctgcctcagccttcwggatagctgggattacagatgtgcaccactgtgctcggctgcagattccttttaggaggtgaatacataatcagtaatttgctaatgccttagtaaaaacttagtgatgtgcctgcatagagggaaatctataatagacactattgggatttggcaaatttcaatgtagccgtatatttcccatttatgacagcaaagattttaacttaatacctcttatttaacttaatacctcttatcaaaagttttttgatacttaacatttaccatcttctagacactgtgctaggcatttgctat

SEQ ID NO: 48353 - DNA, 601 bp, Human
atcccagcactttgggaggctgaagcaggaggattgcttgagtccaggagtttgagaccagcctgggcaacttagcgagtcccaatctccacagtggggggaaaaaaattagccaggtgtggtggtgcatgcacatagtcctagctattcaggaggctgaggcaggagtattgcttgagcccaggaggttgaggctgcagtgagctatgatcataccactgcattccagtctggcagcatggacaacagaataaagcctcatctgtttaagaaacaaaacaaagaaacctgacatatgctrcaatatgggtgaactttgaggacattatgctaagtgaaataagccagtgacaaaaggacaaatacagcatgattccatttatatgaagtttttagagaagtccaatttataaaaacaaagtggaatatcagttactaggacttggtgggagaaggaaatggggagttaattattgcttaatgggtacagagtttgttttgcaagatgagttctggagatggatgatggtagtgatggtagtgtccaatcaacttctcagtcttctcggctcttactacaaaggaagaaactgtactaccc

SEQ ID NO: 48354 - DNA, 601 bp, Human
tcctaactttattatggccacccagaggggaaacagacttctcatatcttaacacaggaggtggttttgcaaattggagcaaggtgcccaccatttgtacccaggggagttaggctcttacccttctgtaggaactgagaggttgaggcactatctccctaaatgtttgcatctccaggagatggcttcctgggtccttgaagaagcattcctgggttgtgagacttgtgagaggcctatttagtcattatgaagattcacataaatttgaaaagcacacaaatattatgaaatagaaggraggaagggaggtctctttctttattttcaacagggagaattaagcctcttaatttttttttttttttttttttttttttttgaggcagagtctcgctctatcgctcaggctggagtgcagtggcgtgatctcggctcactgcaagctccgcctcccgggttcacaccattctcctgcctcagcctcctgagtagctgggactacaggcgcccgccaccacgcccggctaatttttcgtatttttagtagagacagtgtttcaccatgttagccaggatggtctcgatctcctgacctcgt

SEQ ID NO: 48355 - DNA, 601 bp, Human
aactgagaggttgaggcactatctccctaaatgtttgcatctccaggagatggcttcctgggtccttgaagaagcattcctgggttgtgagacttgtgagaggcctatttagtcattatgaagattcacataaatttgaaaagcacacaaatattatgaaatagaaggaaggaagggaggtctctttctttattttcaacagggagaattaagcctcttaatttttttttttttttttttttttttttttgaggcagagtctcgctctatcgctcaggctggagtgcagtggcgtgatctmggctcactgcaagctccgcctcccgggttcacaccattctcctgcctcagcctcctgagtagctgggactacaggcgcccgccaccacgcccggctaatttttcgtatttttagtagagacagtgtttcaccatgttagccaggatggtctcgatctcctgacctcgtgatccgcccgcctcggcctccgaaagtgctgggattacaggcgtgagccactgcgcccggccaagcctcttaatttttaattagtattgttcacattgcctgattaagttacactttttaggtttattttgt

SEQ ID NO: 48356 - DNA, 601 bp, Human
tttgatttgtcttcctggcttagaaaccacggttgttccccaccacatttaggacctgggccttgccccggctcctgccgcatctctttgcagtcctctaggtgcactctgggttcggaggaattgtgcattgttctatagggctgaaggcattctctcctcctcagtaagcatttcttcctcctctcttattcctggctaatgtcttccagactcagatattgctgcttctgagaagttctcctgacccttctcttcctgggtctctgttcccgccacaccctttgtacatctggttcayagcaattagcactgggctgggctgccactttctctgcctgacatcctaccagcctgtgacctccttgaagtctgcaccataccttatttctgcattcctaggatttagtggagtgctaggcacagagtatacttttgttgaaggaaaaaaggaagcaaagcatcttagctttctcctgtaacttcattcacatcacaacccttgatgagttttcccaaaccagtattttgtttctctgaaaatgatctgctacttagaagccacctggtctcccagatttttaaaacgtatgactcaaag

SEQ ID NO: 48357 - DNA, 601 bp, Human
gggctgggtgcgatggctcacacctgtaaccccagcactttgggaggccaaggtggatggatcacttaagcccaggagttcaagaccagcctgggtagcatggcaaaactctatctctaccaaaaaaaaaaaaaaaaaaaatttagctaggtgtggcttctgtagtcccagctacttgggaggctgaggtaggaagatggcttgagcctgggagatggaggctgcagtgagctgagatcacaccactgcactccatcttgggcaacagaaccagaccgtgtctccaaaaaaaaaaaaaaaagctagtaggtagtaatgatgatgagttattgctcccttttttgaaatacatttttaaaccaggacatcagtagataatgactgctttcttcaagtaaggctgacctctaattactttagacagatggtgcattgttattttaatatccaaaatagtacaattcagaggcagaacctaagagattacagtggttggcttaaataatttaacctttgaataaatttacttatccctctctattaatgaccaaaccttggaggaaggagatgttacaagggctggttggagctgtctcctctg

SEQ ID NO: 48358 - DNA, 601 bp, Human
aattcggccgggcacggcggctcacacctgtattcctagcactttgggaggccaaggtgggtggatcacctgaggtcaggagttccagaccagtctggccaacatggtgaaacctgtctctactgaaaatgcaaaaattagccgggcgtggtggcaggcacctgtaataccagctactcgggaagctgaggcaggagaattgcttgatccggtgggtggaggttgcagtgagccaagatcacgccacttcactccagcgtgggtgaaagagcaaaacttcatctaaaaaaaattttttttwaattttaaattaatttccaagaattccttttgcatggggctaaatctgccatgtaaaatatttgagtctgtaactttaaaagccattagtaccctctcagcaccaagtgaggatgcagagtctttgtttttctcctgatttcactgacttgttattcctgacaagtcacaaacatttctatcctattcatatttagaaacaatttggaaaaactgcacactaagaggcccctagcttttctccatgtctgttattctaccaatgggttgcctgtggctcagcagaccctcctgtgtgtca

SEQ ID NO: 48359 - DNA, 601 bp, Human
ggcataacagccagacacatattccttacacattacaatgtctgcatttttcatcattaccctaagcttcttgaaaaattagtgagaccgtttcttatgacctatgaaccagaagaacttgccacagcactctgataaagaaatagctttaaggctgggcatggtggctcacacctgtaatcctagcgctttgggaggctgaagtgggaggatcacttgaggtcaggagttcgagaccagcctgaccaacatggcgaaacctcgtctctactaaaactacaaaaattagctgggcatggtrgtgcatgcctgtaatcccagctacttggggaggctgaggcagcagagccccttgaaccagggaggtggaggttgcagtgagccgagatcatgccattgcactccagcctgagcgacagagcaagactctgtctcaaaaaaaaaaaaaaaaaaaaagaactttaatattactcagttcatcctgctgttacaaaaagttaacttcccatcagcctcctcactcctcttaaaaaaaaactgtagcagatgggttacaattcatgttttctacaacaacatactagaaccagggttcagataa

SEQ ID NO: 48360 - DNA, 601 bp, Human
aaaaaaaaaaaaaaaaaaaagaactttaatattactcagttcatcctgctgttacaaaaagttaacttcccatcagcctcctcactcctcttaaaaaaaaactgtagcagatgggttacaattcatgttttctacaacaacatactagaaccagggttcagataatcctagaactagggttctgttctaccagtcctttgggtattggtagtacccaatactattggcacagtgggcattagaggagaaagctcttaagaggtgacatcaggctggcatcatgtatttgttgattcagttmtgtaattaactagaatagtttaacataaatttgtaatcctagagcaactttcatattttgttcttaaaggttatggcagtagaataaaaaagtactcacggtggcatacattgctagctgtccaccaaaatccattcgcattctgttctggacataagctagacctgcatttgctggccagtgccaaaagtgagcaggagtaatgtgccactttcaggccagagtcttgaaaagaggaggtgtgctttctcaatgctttcttcctctcccgctgccttgaacctggggagacctagactt

SEQ ID NO: 48361 - DNA, 601 bp, Human
gcagtagaataaaaaagtactcacggtggcatacattgctagctgtccaccaaaatccattcgcattctgttctggacataagctagacctgcatttgctggccagtgccaaaagtgagcaggagtaatgtgccactttcaggccagagtcttgaaaagaggaggtgtgctttctcaatgctttcttcctctcccgctgccttgaacctggggagacctagacttagccacacagatggcaaagtcctaggcatgagagccacaagccaggtctctgaattactgcataaaggaaagcctmctgctgacctggaatatctaccctggatgctaaacaaacaagaaataaacttgtttgagccatattttgggctcaaacatattttgctatgacagttaatttactctaataaccttacttaaaataatattatgtattatgcctataactagcccaggcatggtggctcacatctgtaatcctagcactttagaaggccatgatgggagcattacttgagcccaggagttggagaccagcctggaaaacacagtgagaccctgtctctacaaataatccaaaaaaaaagaaaaaaaatga

SEQ ID NO: 48362 - DNA, 601 bp, Human
taatattatttaactccagtttggggccttttatatgactattccttagagtgcaattaccaaaatataaatttataaagattataaatcttttataattgtacacctaatattataaaacaccaggcataccctggtgtcttacatctagtaagaacctaatggttgatgtgatttaaggagagtgctgagataaacatggaggtgaaagtagaaacatccaggaattgtccattcaagatctgtacagtacactgggtgcagtggctcatgcctgtaatcccagcactttgggaggccraggcaggtggatcacttgcggtcaggagttcgagaccagcctagccaacatggcgaaaccctgtctctactaaaaatacaaaaacaaattcaccagacgtggtggcgcacacctgtaatcccagctacttgggaggctgaggtaggagaattgcttgaatccaggaagtggaggttgcagtgagccgagattgtgccactgcactccagcctgcatgatagcgcaagaccctgtctcaaaaaaaaaaaaaaaaaaaaaaaaagtctgtgcagtccaggattgtgttgtcaacagacagag

SEQ ID NO: 48363 - DNA, 601 bp, Human
gataaacatggaggtgaaagtagaaacatccaggaattgtccattcaagatctgtacagtacactgggtgcagtggctcatgcctgtaatcccagcactttgggaggccgaggcaggtggatcacttgcggtcaggagttcgagaccagcctagccaacatggcgaaaccctgtctctactaaaaatacaaaaacaaattcaccagacgtggtggcgcacacctgtaatcccagctacttgggaggctgaggtaggagaattgcttgaatccaggaagtggaggttgcagtgagccgagaytgtgccactgcactccagcctgcatgatagcgcaagaccctgtctcaaaaaaaaaaaaaaaaaaaaaaaaagtctgtgcagtccaggattgtgttgtcaacagacagaggaaagacttgatattgacttgaaggttaattaaagctttcattctcttaagtctaaagtatcctctccatattttgagatttggtgaagtccataatgactttactcaaacctttttgtctttttttaaaaaaataaaagatttttatagatgttttatttggttcacatttttatcttggttcacaatgt

SEQ ID NO: 48364 - DNA, 601 bp, Human
agaagtttgagaccagctggggcaacatagcaagaccccatttctacaaaaagaaagtttaaaaaaatgagactctctttgtgtatttttttgctaaattaatagtacttaatttcctttaaaattgttggttcttaattttctttaagattgttggttctttttgatattttatttctactctatcactccaggatatctgaggtctaatggttaaccatttttttattgttgggttaagtcaatcgatatctcttagtttcagtttccaacatctgcaaaactgttcataataggatcragataatcttcccacaatcatttgacattttaaattttactgtgacaaaatgattatgatgtgtactttgtcacgtattatcattgtggcccaggctagttaagagttggagatagcacagaaaattcatcttgtcatccctcatttgcttccaggctgccacctaaaagactttggagatttgagttttactccagtccccaaagatgatctctacaacaacctgatagtgaatccacgctcagtgggtcttgccaaccaggaactggctgaggtggttagcagagctgtgtcagatgg

SEQ ID NO: 48365 - DNA, 601 bp, Human
ggcccagctactcaggaggccaaggtgggaggattgcttgagcccaggagtttgaggccagtctgggcaacacagtgagatcaggtctcttaaaaataaataaataagaaagaaaatataacttatccaaggactagaaccaggaaatagagctgggattcaaatccagtgtgactcttctggtgattattttccctgaggtgctgagaaagcttttcagatcactgaacagaaatgaaatctttgttacatctggagaagcaggtagattcctccttgggagtaaaaaaaaaaaaaaaakactcaggttgaagaaaacggtcacacccaggttccctactgagatgactaggccattcaattaaatcaaccagagggcaagtctcctgcctcctttctcagtgtagtctctggaaatttattaagtctgtctgctgttctgagttctggtcaagtctcactgtttggggaccactgatcaatgtgattaccacagatcttgttttcttttcctgtggctatctatattgcagccatgttactgcttaccagctcaatgttaaagcttaggcaatctgaaattctagagaggaagagataa

SEQ ID NO: 48366 - DNA, 601 bp, Human
ggttttgctggagttggtctagttcagttaagattttggtgaagggtgggttgagtgtggattaccactccttcatttgttcatcactattatggaccaggcagtctgccagatgctaggggtataaagactagacatagtctctgttctttgtaagaaagcaaggagggggtagtaacaatagcgactgatatacccacagcctgaggacttcttggttagaggctcccaggccatactctcagacacactgatctagaagacaaataaaaccatgacctctgggtaatattttcctgarcagttcagaatatatgggagtccatgttaggcacagactagaatctgtatatccctcccctcagtgagggaccaagtcaaaccaggacactacaaagattattcattgggcggaagtcctgtgtcggctgttggcaacttgagatggcaaccaggttatgcttcaagaaccaatctgtaaacaagtcagtaatgtgcaatgggatagaaaagggctaatcagcagtattcctgctactaggtaagttaatgagaaaccaagacaaccttagagattttattcgtcttgagaaagcaatac

SEQ ID NO: 48367 - DNA, 601 bp, Human
tattttatcctcttcctttttaggagacaaagaccaatccatttgagttttgatattgatgcatttgaccctacactggctccagccacaggaactcctgttgtcgggggactaacctatcgagaaggcatgtatattgctgaggaaatacacaatacaggtatgtagcaaccaggtctgcagcctgttaactacataggtaaatatgctagagtctcttgcctgcaaaggatcttttctgctattccacatcattgcagagtttgtttttgcttaaacttttgtagctaaaaattatatsgccatgctaataaaaaggatatagtcctttagagtcatgcttggacatggctcttaccaaattacactaaggtaataatgagtaaaaaattgtatatttaaacaattaaatacaagaataaattgtcaaactgatgcagttctttgagttatctaaaggcagattaagataagaaggcaagataagataagagtgcaaggctgtaatttgcactctaagagattggttcattgggagttgtgaatttggagctaaagctgatctcttgaagaaatctgcaaactggacaatatcttgggt

SEQ ID NO: 48368 - DNA, 601 bp, Human
ataaattgtcaaactgatgcagttctttgagttatctaaaggcagattaagataagaaggcaagataagataagagtgcaaggctgtaatttgcactctaagagattggttcattgggagttgtgaatttggagctaaagctgatctcttgaagaaatctgcaaactggacaatatcttgggtcctttatgtagggtaggtcttgtactagagcctgaaaggatttctaataagggggatacagttagatgagaatggctgatggaaagagtactaagatgaattctacgttatcaagacyggctacttttccaaaattcatacttgtttgcaaacagtttccatttctgtcagaaagcttctggttttaaagctacttcaaatgacctttcattccaaaatttaaagaactaccaaatcatactgcttcagtaaccatctgatggaactagggtatagatagagaccccagattgaaaggttcagggctatagagaacccttgactagctgggatagaaactcacattgagaaatggtctccttagcgccacagcctgccagaaccttaggcagtacaaaaaggcaggcagtactggtct

SEQ ID NO: 48369 - DNA, 601 bp, Human
tgcagttctttgagttatctaaaggcagattaagataagaaggcaagataagataagagtgcaaggctgtaatttgcactctaagagattggttcattgggagttgtgaatttggagctaaagctgatctcttgaagaaatctgcaaactggacaatatcttgggtcctttatgtagggtaggtcttgtactagagcctgaaaggatttctaataagggggatacagttagatgagaatggctgatggaaagagtactaagatgaattctacgttatcaagactggctacttttccaaaaytcatacttgtttgcaaacagtttccatttctgtcagaaagcttctggttttaaagctacttcaaatgacctttcattccaaaatttaaagaactaccaaatcatactgcttcagtaaccatctgatggaactagggtatagatagagaccccagattgaaaggttcagggctatagagaacccttgactagctgggatagaaactcacattgagaaatggtctccttagcgccacagcctgccagaaccttaggcagtacaaaaaggcaggcagtactggtctaattctcagatctgcaa

SEQ ID NO: 48370 - DNA, 601 bp, Human
catccagaataaccaactaaaaagttaaattctatagagaagtgaggcatttagaggggtgagcatagtagcaggtctggataggttcttctggtttaagcttcccttccacttgctccaggccaaaggaacactaccgagaactttgacacaagttctcaaaccttaacagaaggtaactgaagtccagataaaataattaacatatggctgaattttctcttgatcaagtacaagacactgggtcagtctgctgggagacaaaaagatgttgttagatgtggaacctgcctccagagckcaggcctgcaggggtgagaatgaagtttgcagtaataactacatttcagggcatatggtgtggtgctctaacagatacagataacacattagagttcaaaagtgggaatgcagtttggctagtgcaagtggcagatttcctctgccttcatacttgattcatttccaggcaggcatctggaaggttcctagtcatactggaggtggcatacattttgccaacaagcaggatgaaaacctcccccacccaacaccaagccttttccttttccagaacgcctgacaattatgcctgttatgt

SEQ ID NO: 48371 - DNA, 601 bp, Human
aaggaacactaccgagaactttgacacaagttctcaaaccttaacagaaggtaactgaagtccagataaaataattaacatatggctgaattttctcttgatcaagtacaagacactgggtcagtctgctgggagacaaaaagatgttgttagatgtggaacctgcctccagagctcaggcctgcaggggtgagaatgaagtttgcagtaataactacatttcagggcatatggtgtggtgctctaacagatacagataacacattagagttcaaaagtgggaatgcagtttggctagtgmaagtggcagatttcctctgccttcatacttgattcatttccaggcaggcatctggaaggttcctagtcatactggaggtggcatacattttgccaacaagcaggatgaaaacctcccccacccaacaccaagccttttccttttccagaacgcctgacaattatgcctgttatgttagttgaacagggatggtttatttcattatcttaaaaggtttcttttaatctactatagcacaacagtgttttaacttaaattcatggccaagaggatgaggtgcaaggggcttcctaaaaatag

SEQ ID NO: 48372 - DNA, 601 bp, Human
cacagggtattaatatgctacagtactatgtaaatttaaagaagtcataaacagcatttattaccttggtatatcatactggtcttgttgctgttgttccttcacatttaagtggtttttcatctttcctccctcctcccacagcctggctatacagtgcatccttgaactgtcagcccacagcagcaatatgcttattctatccacatccctaacatcatgcattcacaaggtcaaagttctggtccacaaacccttccctatagaagttcaatggctgcgaaagaatttgtagtaaacyaggcctcccaggatggcgagctccagtaagatgataatggaaagcagcagcttgttggttgtcactctacaaagagaagcaaagtggggagtagtcagaagtttggataaccttccttctaaacattttggggttagacctgggaccacggctggatactctgaggctgtatgtttgatcacacagccacttagcaggaagtactcataaggttctttagctgtcacttagggataacactgtctacctcacagaaatgttaaactgagacaataaaaaccaaagcataaaaatggattc

SEQ ID NO: 48373 - DNA, 601 bp, Human
gtcaaagttctggtccacaaacccttccctatagaagttcaatggctgcgaaagaatttgtagtaaaccaggcctcccaggatggcgagctccagtaagatgataatggaaagcagcagcttgttggttgtcactctacaaagagaagcaaagtggggagtagtcagaagtttggataaccttccttctaaacattttggggttagacctgggaccacggctggatactctgaggctgtatgtttgatcacacagccacttagcaggaagtactcataaggttctttagctgtcacttagkgataacactgtctacctcacagaaatgttaaactgagacaataaaaaccaaagcataaaaatggattctgaaatgttgttcaaatagtagttacttcctttaaaaatagcttttctagaaagaagggttagctagaaaaagtaatcaaatagacatccagctcaggatgggtcctgccctaggataagtaactagaagcctgggtaatacctttcaatcccttgtaaacttcttccctctgccctatttttccctttgctctcctatcaacccaaatgggtatgttataaaggtagtata

SEQ ID NO: 48374 - DNA, 601 bp, Human
gccatctcctgcagaggtgtgcttgtgttttgtttctttgtaagaacattgactacttatgttaagatatggatttttggagtttgggtgctgtcttaagtgttttagtaaatcactttgcgtttatgtatgcctattttttgtgtgatggtttgatattttcatattttttcataacagaaaaatagaaaaaatttcaccagaaaattaattcataaccaaataacagtattatttttaattccttggataattgatcgtggggaaataatttacatcacaaaatgttttgtatcctackgggctttcagttaatacaaaatgctaggctgaaaattcaaacctttgaattctggctctgctacttatcaacaaggtgaccatagacggagtgcttttactcacacttctgatgctaaatgtgggtttttttactcgaaccagccagttcttcaactctccagatatcaaatgtccttctttttatttcaattaaattctgacactacctaccaggaattagtactagactctgcagatttaagggctgtgtccacaagattgccttcacgtcacatgccagtggcaagtaccagatccc

SEQ ID NO: 48375 - DNA, 601 bp, Human
atggttatatttgatggcattttaaggagctcatcctaattttatgaaatagttcccatgtcatatctttgtctaaacacgttggcatgcaatatggtatagtggaaaaagcttacactatagagtcagattcctaaatttaaatattagtgctactacttactaactatgaaacttaaggcaagttgacctgttcaaatctgttttctcatctgctaaattagctaatttttctcatctgctaaattagctgatgcctacctacatctcaaaattgttgattctaataataaaaatagttaataataacaactaacacttacatatagcaattactgtgtgcaaataactcttttaagcatatgttaactcatttattcttcaaaacaaccatatgaggccaggtgtggtggctcatgcctgtaatcccagccctttgggaggccgaggtgggtggatcacttgaggtcaggattttgagaccagcctggccaacatggtgaaacccatgtctactaaaatacaaaaaaattagccaggcatgttgttgcatggctgtggtcccagctactcaggaggccgaatcacgagaatcacttga

SEQ ID NO: 48376 - DNA, 601 bp, Human
ttgttgcatggctgtggtcccagctactcaggaggccgaatcacgagaatcacttgaacccaggaggcggaagttgcagtgagcaaagatggggccactgcattccaacctgggtgacagagtgagaccctgttttaaaaaataaataaataagatatgtataaggaaggtactatttattgttatctctgccttaaagatggagaaactgtgacacagattgattcattgacttgcccaagacttttcaagtagtaaatggcaataaatgcatgtaaaaggatctaacataatgcctgtmatctttgtagatgctcagtatttgttctttttcttcctcatttaattaacagtactacctgttatctctaattagatatggtagctccaaatacttttgctactaaccattgtgcttctgatagctattgttaactacaaacataattggtggatatgtcttaaaaataaggacttgtcttgaaacagccagatatgtgaaaaaataactttttagtaatagcccactttatatctgggttttataattatttttgtattgtccactgaaagcagaatttttttttttgtatcataggca

SEQ ID NO: 48377 - DNA, 601 bp, Human
tgatttgcattcttcactcactggtgctttgtccgtcagcaaatggcctggtactgccatatccatctgctattttagcattttagactgcccagcattatctatctgctcccctacaattcccctatactatggcctaacaagtgctatgccatctgcctgcctgatcttgccctgcccaatctatgcctgtaacactgtaagtaggtgagattgtttagcatttctgctatcatctacacttgccttgtgccactgagttagactgctgactgagttagactgctgactgagtttgctygactgttgcctcctctacctatttgctacctatggctgccccattaatttatttgagatattgaaatcatctcctttgtacttgcaacttgctgattggcctgtgttgcctcctttacagtttgctgcatttaaaaaatcactggcattgctcctctgttgtcttgtaaccctgatcatattttatttccaataaaagttttgcctacatatcgtccaaacatcttagaaataggaaaatgctttgctatctaacagcccagtccagtttgctcctaaactgactttttaaactaccacc

SEQ ID NO: 48378 - DNA, 601 bp, Human
gggcttttatagaggagagaggtaggcatttgaaaggcaaggtttaaatgaagatgactaagatgagggaaccaggtcatgtttagaggaaccagcaatgggaacaggaattcatttcaatccagagatccttcatcctgtatactcagccttctaccactcatagacatttttctaaaaagattgctaggctcgaaccccagagattctgattcagtaggtttggaattcggtttaggtaatgtgcacatacatgcctctgtgtgtgtgtgtgtgtgtgtgtgtgtgtgtgtgtgtgtggctgtgtgcgtgcgcacacgtgaacgtgtgtctgtgtgtgtgttttaatccactgatgaaacacaatatgagttaaattgaactctgtaccgtagtggcctagaccttataagaatttaaaaagttaaagagaattgacccttgtcttcaagcagtttaaaactgcagtagttaaaaaatgatggacttaggaaagcagtttaaaactgcagtagttaaaataatgatggacttaggaaagaagactttcaatctgttaggtgataagttctcatttgttaattcaacaattttagggggg

SEQ ID NO: 48379 - DNA, 601 bp, Human
atacacttagctactattagcagtcattttaaaaaataccaaatataaactcttacacaattattttgcttggcaaactcatttttctatataggaattccaaaggagacattattctagcatgcaattaatatgaattatatttgattatctagatattgaaaccattttataaacttctctgacatgtagagctcaacttcctcttaagcattcaagagaacctatttttttttagttgcccataatatgcaaaccatttcagaacccagagatttttggtgagtgaattaacatgtartttgtatttttacatggaaactatatgtataaatggttttcaaccagggtaaattttggttccccagggacatttgcaatgcctggtgacatttttggttgttacaattggagggtacctagtgatatcaggtgggtagagcccaggaatgctgctaaacatcctgtagtgcatgggacagtcccggcaataaagaattatctgacccaaaatgttaatgcagagattggaaaaaccctcatgacataatatcgagtacgcactaactgccaggttgtgctggaggctgcgggtacatgg

SEQ ID NO: 48380 - DNA, 601 bp, Human
aactttagaatttgtagaaaattcatatgctagtgttgcatcctgaaattattatttgtctccaaattaaagtgaaaagtgattcaatagagaaacaccttgattccccatatctgtcagttgataaagtagctattgcagaattctacaacagagagaaggaagagtgagatagtaaatagaagagtagcgtttatgagttcaattaaaactttaaagaacagataattcctgtcttatttcctcattatttaaattgtatctaaacacaggatgaagaaaacatctgaactcaatctataaagataacaaaaccttcataccaaagtggaataaaaataacaaggagactatagacctaatcatatgtgaaaatatatgtagaaatattgaaataatatgcaaaaacttgatacagcatcaagttttttctaaatgtacacctcttcctaagcgaaactgattttaagaattcaagaacggtaaattttagacatcctttaatttcatttttatcattattaggtaaatcacaaaagattatatggtcatcttgatgtatgccaaaaagacataaaattcagtgtatttttttccttct

SEQ ID NO: 48381 - DNA, 601 bp, Human
gccttgccaccacaggctaaagtcctttgcagcccaaaataaatttgaaaggcagtctgcgctccaagaactacaattcttgggcaagtcctagtgctgacctgggctcagatacagtgggacgtgggggcacatgacctactaagacaccagccaggacagctaaaggagtgcttgcaccatcccttccccatgcctcaggccacatagctcacagctccaaaagagaccccatgcttctgcttgaggagagggaacagtaaaggggactttgtcttgcatttggaaaccagctcagccwcagtaggataggacaccaggcagagtcatgaggccccctttccaggccttagctcccggacaacatttctaaacacaccctgggccagaagggaacctgttgccttgaagggaaggactcagtcctggcaagatgcatcaacttttgactaaagagaccttggatcctccaaggtccagcagtgatacccatatagtatgccatgtgccttaggtgagcctctgagacatgctggcttcaggtgagacccagcacattcctagctttgatagctatcgtgagagactctttctgcttgag

SEQ ID NO: 48382 - DNA, 601 bp, Human
ggccagaagaggtttcttacagagtattaactccctttgcaattatgtagttgtacacaactgacctttgggacaaagagcaaaagaaaagaaaaaagagagaaagagattcctcttaccttagttctttagacaatatcggctccttttttttgtttccattagccaaagagataggtaggtcttctctctgagctttgggtgctaacactgtcattatggtattgcagctccacaattaggcctagccccattaagagctgttattcaagttctgacttcagtcccaaatctgcctgcyattatttacattaaacgtcatcaggtaatcactgtgtactctataaacaatcggtaggagagagaagctatggttactttctccatcttggctgacaccaaagaacaagtgttcaaactttaataccagatccctgacttcatatttactagcatttactagcagtgttaccttggtactttacaaggtttagcacatcttgttccagtggttaactaaactgcccacaaaatagtagcatttaacctccctaaatttataatttattccctacttgtttttttttaaaagatcaaatac

SEQ ID NO: 48383 - DNA, 601 bp, Human
gtggcacatatacaccatggaataccatgcagccataagaaaggatgagttcatgtcctttgtagggacgtggatgaagctggaaaccaacattctcatcagactatcgcaaaaacaaaaaaccagacaccgcatgttctcactcataggtgggaattgaacagtgagaacacttggacacaggaaagggaacgtcacacaccggggcctgttgtgggatgcggggagcggggagggaaagcattaggagatatacctaatgtaaatgacgagttaatgggtgcagcaaaccaacatggcrcatgtatacatatgtaacaaacctgcacattgtgcacatgtaccctagagcttaaagtataattttaaaaaatatgtttattttaaataaaaaatggaaataatatttttgaagtaaaatgatttattgatgaaaaatacttgaaacagaagatactagaataatactttcaatgtgctgaaagaaaataacatttaatcaagaattttacactcagcaaagttaccattcaagaatgggggaggatgaaatgtcattttcctacaaacagaaatgggaacattttatcaccaaaagaac

SEQ ID NO: 48384 - DNA, 601 bp, Human
caccatggaataccatgcagccataagaaaggatgagttcatgtcctttgtagggacgtggatgaagctggaaaccaacattctcatcagactatcgcaaaaacaaaaaaccagacaccgcatgttctcactcataggtgggaattgaacagtgagaacacttggacacaggaaagggaacgtcacacaccggggcctgttgtgggatgcggggagcggggagggaaagcattaggagatatacctaatgtaaatgacgagttaatgggtgcagcaaaccaacatggcacatgtatacatatgtaacaaacctgcacattgtgcacatgtaccctagagcttaaagtataattttaaaaaatatgtttattttaaataaaaaatggaaataatatttttgaagtaaaatgatttattgatgaaaaatacttgaaacagaagatactagaataatactttcaatgtgctgaaagaaaataacatttaatcaagaattttacactcagcaaagttaccattcaagaatgggggaggatgaaatgtcattttcctacaaacagaaatgggaacattttatcaccaaaagaacctcacgtaaaga

SEQ ID NO: 48385 - DNA, 601 bp, Human
gaaagaatcacctgagcctaggaggtcaaggctgcagtgagccatggttgtgccactgcactcgcctggggtacagagtgagaccctctcttaaaaaaaatttagtcctattttctaggaagatattaaatattgattatagttttttaaagttaagtatgcatattaaacttattagggtaatcactaaaaggatggacggagtatacaacttccagaaatagagggaagaaattaatgaggaaaatacttaaagtaagataagaaagggagaaaaaaacaaacaaacaaaacaaaacaraaaaaaacaaagacaagtagaaggcatatgtattggttaaaaaaagttataatacgaattcccagaacatcttccacttaaaattttcccatagaacactgcttagtttctcatattcaaacttgataaacatgtataccttcatgtttatctgaaaaacagcttcagctgatacatatgaaaattttatatttatatctgaaaaattcagtaaattttcaaaaaaattttattaaacttttaagatggtaatataattgtagattggcatgcagtataaggaatgatccagagaagtcc

SEQ ID NO: 48386 - DNA, 601 bp, Human
attcatcttaatgtatctttttattttttgagatttttttcttttttttttaatctatctaacactaggtcttatttcttctatcaaacttcatatgtgcccatcaatcaacttctcatctttccctcctccccactacccttcctggcccctggtaacaaccaatctactacctatcctcatgagattcacttttttagcccccacattatgagggagaacttgcgacattcttccttctgtgcttgccttgtttcatttaacataatgacttttagttccatccatgttcctgcaaatkataggatttcattttttaatcagtgaataatgttccattgtatatagatactgcattttctttatccatttgtatgttcactggtacttaggttgaatccatattttagccattatgaatagtgctgcagtaaatgtgagagtgcagatgtcttttcaatatgttgatttcccttcttttggatatatatccagcagtgcaattgctggatcgtatggtaattctatttctagttttatgaggaaattccatactgctctccatagtggctctactaatttacatttccaccaacagcgt

SEQ ID NO: 48387 - DNA, 601 bp, Human
aaaagcatgctaaaatgaaaatatatttagataaacatatgtggaaaagttttttttaagtgaatgatttatataagcaccacatggatgaaccttgaaaacatgttaagtaaaagaagcaagtcacaaaaggtgacatattatatgtttccctttatatgaaatgtctagaataggcaagtctgtatggacagaaaatagcttagtgaatgcctagggctgggagttgcaagaaaatgtggaatgactgctaatgggtatgggatttttttgtggagggtgatgaaaatgttctaaaatkgattaccaggatgattgtacaactctgagaatatactttaaaaactattgaattgtatcctttaaatgggtaagttgtatggtatatgaattttatattgatagagctgttttacaaaaaagtaagaatgttttaaaattcaggataatagttatttggagaagaagggacttgagatcaagtcaaggcacgcagtactctttgaaagtatcagtgatagtctattgcttcacctaggtagtaggcacatcagtgggatttttattgttattgtctgttttatacacgtcataccttgtt

SEQ ID NO: 48388 - DNA, 601 bp, Human
tttttttttttttttttttttttttttttttcagtgcagcaggtccccttctggcccaaggtgggtttagaaatgccgtccaagagctagggcctgggatgggaggctttaggaatcttcttggtgtttattttaccaggttgcaagacaaagtcctctttacttttccttctcctttcctcaagcagaagtctctccctatggccattatcactctaggctcagggcagctaccgcttggctgccactgatgtttattcaaggcccaagggctttttagtcaccactggtgagtcctgcraggcctgtatctctcccttcaggacagtgaatgcctttctggcccaaggcaagtctagacatgccctccaggagctaaggttaagattagtacatcaaaaattatttgagtgacccatttttcagttctcccaaggattgtacacaactaataccattctagatgcataggagataagttaattattagggtttaattctttggaggaactagttgagaatgattgtaaaactgttctaactggatgttctcatatagcatcagtgaagactttctcattgattaactatttattagctg

SEQ ID NO: 48389 - DNA, 601 bp, Human
aatctcatttcactgacagaaattaaatcttctggagaaatccaaaacaataatgatgctccctaagctgtattgtatgaaagaacatctactgattgccctgggaagaaaaagagttggtgacttcttcttggtaaatgatacggaaaaaacaatatttttatccatatcatttgtatatatattatatatatatgtgtgtgtgtgaatatatatatgtgtatatgtatatatatgtatatgtgtgtgtttttatatatatataaaacaaacatgctgtatgttatgtttatcaaacatrtacatatacatgtatacaccaccgcatggtggctggcacctataatcccagctacttgggaggctgaggcaggagaatcacttaacatatatgtgtatacgtgtgtttatgtatacgtatacatgtgtttatatgtatacatgtatacgtatacatgtgtttatgtgcacgtatacatgtgtttatgtatacatatatattaaaactatatatatacagttttattgtttccttttatccatgaggattttgagatattaaaataattatattaattgaataccaatcattctctaagca

SEQ ID NO: 48390 - DNA, 601 bp, Human
acaaccctttaacactaggcaagaatttacatttttatgccttttttataatcttttactaaaaacacatcttattagtcttacatgcctcacatgtaaatttatttccagtagtttgagttatatgttataatggtaactccttgaaattttttactttaatgtaaaacctgataagttgttttcattatgtgctaggtgctgccaaggcttaactccttccagcttaattaaagatgcggttagtactacatgtccctagccttaccatttatggagcaggcaagtcaaatagttcttwaaacccaaaaagcagtttataaacttaaaacatttagcaaacctagcacctgacctgcatagtttagtccacctgtttatattttaatgacatctgctttttaccaatattctttaagggttgtttttatttctcaaagattaaagtcacatgaactgaaaggcaccacaacttttatcatccctttaaaaatttttttgatccaagcacttatcttcctttaagccagttaattagagctctttttataggcatcacacacacaacacatatataactaaacagacaggcaaaagaaaa

SEQ ID NO: 48391 - DNA, 601 bp, Human
attacagttttccttaatgaggaaaattctgttatttaataattcacagtcaaaattacattgcatatctaaagaaagtttgagattatctgggacaaattgtttcctccatgctatgagttgcataagatagtagaaatagattacttctctaaaagtaggaatgttatttcttttgtgatttggcatttttccttctcatttgttctgatttaactcactacaaattctacttgctcaaggtagatcctcactactccatggcaagcctttggttcatctctcttactgacaaccttayatacattgccaaattgcaattttcagacctttgctcttgactcaatttcccctattttctcctcttcttattatattaaaggccatcagagctaaattatttgttctttctatttaaaacaattttcctgaattaatactttgctctattccttctatctcaaagaactgcttgtaattctcagttagtggctgcttctacttccttattattagatatcatctatgtacgagacactgtattcattccttgtttctccctagttgttgagtatgttggccacttattttctgaaacagt

SEQ ID NO: 48392 - DNA, 601 bp, Human
tatttaattattatgaaataatcatctggtagtcatttcatttcggtaagctcaacagcaatgttcctactttcattcctgattttagtaatttgaatctttttctctttttgtcagcctacttaaagatttgttcgttttgttattacttttatttttttattatactttaagttctagggtacatgtgcacaacatgcaggtttgttacatatgtatacatgtgccatgttggtgtgctgcacccattaactcgtcatttacattaggtatatatatctcctaatgctatccctccccsctcctcccaccccacgacaggccatggtatgtgatgttccccttcctgtgtccaagtgttctcattgttcagttcccacctatgagtgagaacatgcggtgtttggatttttgtccctgcaatagtttgctgagaatgatggtttccatcttcatccatgtccctacaaaggacatgaactcatcctttttttatggctgcatagtattccatggtgtatatgtgccacattttcttaatccagtctatcattgatggacatttgggttggttccaagtctttgctattgtgaatagtgc

SEQ ID NO: 48393 - DNA, 601 bp, Human
tctctttttgtcagcctacttaaagatttgttcgttttgttattacttttatttttttattatactttaagttctagggtacatgtgcacaacatgcaggtttgttacatatgtatacatgtgccatgttggtgtgctgcacccattaactcgtcatttacattaggtatatatatctcctaatgctatccctcccccctcctcccaccccacgacaggccatggtatgtgatgttccccttcctgtgtccaagtgttctcattgttcagttcccacctatgagtgagaacatgcggtgtytggatttttgtccctgcaatagtttgctgagaatgatggtttccatcttcatccatgtccctacaaaggacatgaactcatcctttttttatggctgcatagtattccatggtgtatatgtgccacattttcttaatccagtctatcattgatggacatttgggttggttccaagtctttgctattgtgaatagtgccacagtaattttgttgatacttttaaaggaccaactttgattttgttgattctttcaatgtttttgtgttctctatttcatttatctccactataattcttat

SEQ ID NO: 48394 - DNA, 601 bp, Human
tatacatgtgccatgttggtgtgctgcacccattaactcgtcatttacattaggtatatatatctcctaatgctatccctcccccctcctcccaccccacgacaggccatggtatgtgatgttccccttcctgtgtccaagtgttctcattgttcagttcccacctatgagtgagaacatgcggtgtttggatttttgtccctgcaatagtttgctgagaatgatggtttccatcttcatccatgtccctacaaaggacatgaactcatcctttttttatggctgcatagtattccatggwgtatatgtgccacattttcttaatccagtctatcattgatggacatttgggttggttccaagtctttgctattgtgaatagtgccacagtaattttgttgatacttttaaaggaccaactttgattttgttgattctttcaatgtttttgtgttctctatttcatttatctccactataattcttattattttcttttgtttgctttgggtttagtttatactttattttatagtttcttagggtggaagattagtgtattgatatgaaatctttcttctttttaaaagtagatgtttac

SEQ ID NO: 48395 - DNA, 601 bp, Human
atggagtttacaatttagtcatatattacaggttgagtatccctaatccaaatgcttgggaccagaagtgtttcagatttcagattttttcagattttggaatatttgcagatacttaaaccagttgaacatccctaatcagaaatccaaaatactccagtgaacatttcctttgtgctaaaaaagtctcagatttcagattttcagatagggatgctcaacatgtaaaataaacaggtagataataactttaataattataatttcatattaatttaataattataatttaaatacaatrcatgctaagaagaaatgaaaatgttatggtagtagaaaataatagcaggggaacttcatttagatagggtgagtagagaagacctaacatttcaccaggggcgtgaagaatgaatgaaaaccaaatgtgagcttttgtgctatgtggaggttttaggaattatattgatcaataatgaccactttaaaggcaggtgtcaccaatcaagaactcttacactaaaacttcattagtatgtgaatagtctaattcagtgatgtcaacagccaatttcaaatatctgttcttttttatttaaaa

SEQ ID NO: 48396 - DNA, 601 bp, Human
tgcataatattactagaatccaaattcttggaaaaaaaagtaaatagaaatgtcaaagtcattttactacaggccagatcctggtaattaatcactgaggatagtttccccagtaattaatccctgaggaaagattcccagaatgttgcaaaagaggtaatacagtgcaacattttcagaatatttctaaggaatactttgttaaatatattctagttgagagactgaatagaagattgaagtattttggatcccatggataatatcttttaacatcttggtaaaatacttgtcaaaagayttcttcatgattaatgatgacattttttgttttgctcctaaattttgattatcaatatatataagtaaactagtaatctcaatttactccacaatcctcacaattatttacattcaattctcagactttgtttataatgccgtgatagtacaatataaacatttacagtttaacctctcttagctactgatagtgttttgcctttagaaaagtatgaataaaaatagctaatgatgtgaagctcttattattaagaatagtaaagtcattcatcttatctgaatgctaatcttttgtgat

SEQ ID NO: 48397 - DNA, 601 bp, Human
ttaaatatgaagtatatcagtctaaggatcctattaactgtccaatatagcaaaaaaaaaaaaaaatttaaaggcaagtagtatcctccctacttgcgggctgatcacttgagaccaagggaaaaacctcctgtctactaaaaatacaaaaaattagccaggcatggtggcatatgcctataatcccagctacttgggaggctgaggcacaagaatgatttgaacccaggaagtggaggttgcagtgagccaggatcgctctgctgcactccagcctgggcaacagagtgagaccctgtccaaaaaaaaaaaaaaaaagaaaagaaaagaaaaacatagaataagataatccaaagtaatactttctttacagaatataaatcaaggtaaatttacaaagaatttgattagttgacgagcagtggggccaaagagagcctaaatattaagatattcaggaaaaaagtagataaatgttcatgaaataaagatagttaaaagaaaagaaaggaaaggaatgaaaatactcatatgccacaattttgtattttcatctgaatactcagtttatgtattatgatattaaatttctattcagcta

SEQ ID NO: 48398 - DNA, 601 bp, Human
atctcttctttcccttacatttacatcatcatcttcatttaccttcactattgtagaaattaagtctccaatccctaatgtagcacattggtttaccaattgcatatcactatcttctgtgtcattcattagatgaaaaaaataagccttgctcaaaaatgaacctatccatgagttgtataggaacaagatttataacctcagctggctgatactatttagcaaaaacatttctccacgtagttatggtccctttgtaaaaaaaaaaatatatatatatatatacacatatatatatattcacacaattattttacttgtgataagctttgtttttgatatctcattatcaattaaccttcataacagccttgtttggggtaaatattaatgtcatcctcattttaaagatgaggaaattgagacgcagagaggttaactatcttgccgatcataaagctagcaagtgagtggcagaaaattgtcttttcttaaataccatgctttctcctgttaagaagttgttaaaagtcattagctctgtgactagcatgtagtagtcttgtattttcacttcatccatttactttgttcaggttga

SEQ ID NO: 48399 - DNA, 601 bp, Human
aattgaaatattgtccattttttaaaaaatcataatgtatgaattcaggctatgttgttctaaaatatgactagaggaaatgtctttggctttgaaaactaaaggtctttactaatcgggtgaaaaaagtctgtaggaaaatcaccattcttgagtcctgtgttcacagaatagtcatgagtgagttattttaaatttcaccaaattattgttaagtcacaaaaaaagaatttggtaaaggcagattttcctagaatagacttgagtttttggaaccttattacataactttaaaatgccrtaatacctctttagaccacatttttctctatcagagatggtgtcaggttggtagtaaggcttatttaattaattttccaagttcagacatcttggaaaggagagataaaggcaaggcatgacattactctttataaacatgacttactggaggagaatgcaaattttcatcctttaaatcatttaatcggctttattgagttacctaatatatttgggtgatagaggagaccctgaaagaaagaggacctcaggaagcattataggtcagaatgagtagcatatgcacagcaaaagtagt

SEQ ID NO: 48400 - DNA, 601 bp, Human
caatacagccacactgaaatgagtaaagcattagggtttttttaatgatcaaataggtgataagacatgacatttaagaataaaaactaagaatattaaatctaattaaaaactcagtatttcaaacttcatgcttaatgaaaacgaatgtgactttcttccagaagtgtcacaaaatgcataataattacaaatactcaataattcaagtttttatattattgactgtatctattccttggcctctattttttagaattaatcaatattttctgaaaacttcctgttcacatactcaccyaaattaatcttacttgatcttacttttgagaactgtcaaaatcacacacacgcaaaacaaaaaaaaatcagcatttcttattacaggcctagaatatcatccaaacaaaaggataatagtaggaacaacaatatagtaatagctaacaatatatactgttaactctgagctactctctaagcaagcactttacatgtatctctaagcaagcactttacatgtattcttattttctttacaaatatcttatgagatagatgttattattatcttcacttatacgtgaagttatgacttata

SEQ ID NO: 48401 - DNA, 601 bp, Human
atttaagaataaaaactaagaatattaaatctaattaaaaactcagtatttcaaacttcatgcttaatgaaaacgaatgtgactttcttccagaagtgtcacaaaatgcataataattacaaatactcaataattcaagtttttatattattgactgtatctattccttggcctctattttttagaattaatcaatattttctgaaaacttcctgttcacatactcacctaaattaatcttacttgatcttacttttgagaactgtcaaaatcacacacacgcaaaacaaaaaaaaatcarcatttcttattacaggcctagaatatcatccaaacaaaaggataatagtaggaacaacaatatagtaatagctaacaatatatactgttaactctgagctactctctaagcaagcactttacatgtatctctaagcaagcactttacatgtattcttattttctttacaaatatcttatgagatagatgttattattatcttcacttatacgtgaagttatgacttatacagtgttatacagctaataatggtagagccaaaattcaaatctagacagtttttttccagaatactactcc

SEQ ID NO: 48402 - DNA, 601 bp, Human
aaagctttatataggaaatacattaagaacatttaacattgatgcttaaattcatatttccttgagtcatggtgataaccagttctaaagaatagaaagtgtgttctacatattatagtattttctttaagaacaaataaggaactcaccaagttacctataaagaagcataaacaagctttgattttcagtggtaattataattaacttcaccagctatataacctgacacacttccgacttctttaagaatgggtcaatactgaaaaggaagtgtttttcacattaacctagaacttakgaaagctcggtggaatttaacaatgaaaatttatataacagtgggaaaacatttaagaatggtcacctggaaaagatttataaaattgttttgcttataaatattgtctatttgccggcattctcttatgttgtacatagatttaaaaaaaacagcagcccaggcgctgtggctcaagcctgtaatcacagcactttgggaggccaaggcaggcagatcatgaggtcaggagtttgagaccagcctgagtaacacagtgatacctcatctctactaaaaatacaaaaattagccaggtgt

SEQ ID NO: 48403 - DNA, 601 bp, Human
taattccatactttattttccattgtttagatttacaccctcaaacctctctctcttttcttttcctcattcttgtgtcttcttccctgtattattttctttaagcagtcattgatttatttcccatttggtccagaattgtacttaaataagacttctgagtaaaagaatataagaatattatcttcagactagctttttccttctagtatgtttaaaactagttgaacaatctgggccaaaagagaataactaacatttggaattatttttcctttttttttttttttttttttttttkggtgtgtgtgtgtgtgtgtgtgtgtgtgtgtgtgtgtgtatttttcttgtatgtatgtttgtgacttttttattgccgtttttttaaacattaacaattgtttttttcagggaaggacaaccataacccaccctaagttgcaacattcctttcataagttgtttcattatgatagtagattgtgttgaactatagaaattaatttgttgtgtatatatccatttgtggcaagctgctgtggaatgggaagcagaggtctggagcttaaatacagtttcttttgaaattaacaacatgtta

SEQ ID NO: 48404 - DNA, 601 bp, Human
aattccatactttattttccattgtttagatttacaccctcaaacctctctctcttttcttttcctcattcttgtgtcttcttccctgtattattttctttaagcagtcattgatttatttcccatttggtccagaattgtacttaaataagacttctgagtaaaagaatataagaatattatcttcagactagctttttccttctagtatgtttaaaactagttgaacaatctgggccaaaagagaataactaacatttggaattatttttcctttttttttttttttttttttttttttgtgtgtgtgtgtgtgtgtgtgtgtgtgtgtgtgtgtgtatttttcttgtatgtatgtttgtgacttttttattgccgtttttttaaacattaacaattgtttttttcagggaaggacaaccataacccaccctaagttgcaacattcctttcataagttgtttcattatgatagtagattgtgttgaactatagaaattaatttgttgtgtatatatccatttgtggcaagctgctgtggaatgggaagcagaggtctggagcttaaatacagtttcttttgaaattaacaacatgttaa

SEQ ID NO: 48405 - DNA, 601 bp, Human
aaccaattattactagatggttgccaagtggtgattttctaattccaatatttcttcatgtaacagctgaccttctgttataaggaagaatttattctcaggccagcatattttcaaaatgagaaaggcatcatagctctactttgggccttattggtatttgcccaaaatacaaacactttctttttttttattttttttattatactttaagttctggggtacatgtgtagaaggtgcactttttttacataggtatacacgtgccatggtggtttgctgcacccattaacccatcacytacattaggtatttctcctaatgttatccctcccctaaccccccaccccccaacaggccctggtgtgtgatgttccccttcctgtgtccatgtgttctcattgttcaactcccacttaggagtgagaacatgtactgtttggttttctgatattgtgatagtttgctgagaatgatggtctccatcttcatccatgtctctgcaaaggacatgaactcatccatttttatggctgtatagtattccatggtgtatatgtgccacattttcttaatccagtgtatcattgatggacatctg

SEQ ID NO: 48406 - DNA, 601 bp, Human
agtttttgcccattcaatatgatattggctgtgggcttgtcataaatagctcttgttattttgagatgtgttccatcaatacctagtttattgagagtttttagcaggaaggagtgttgaattttgtcaaaggccttttctgcatctattaagataatcgtgttttttgtcattggtttggtttatgtgatggattacatttattgatttgcgtatgttgaaccagccttgcatccaggtatgaagccgacttgatcatggtggataagatttttgatgtgctgctggattcggcttgccwgtattatattgagaatttttgcatcgatgttcatcagggatattggcttgaaattttcctttgttgtgtctctgccaggttttggtatcaggatgatgctggcctcataaaatgagttggggggattccctctttttctattgtttagaatagtttcagaaggaatggtaccagctactttttgtgcctctggtagaattcagctattaatccatctggtcctggactttttttggttggtaggctattaattactgcctcaatttcagaacttgttaatggtttattcagggattcaac

SEQ ID NO: 48407 - DNA, 601 bp, Human
acaaaacagacattaaaccaaaaaaaaaaaaagatcaaaaaagacaagggcattacataacggtaaagggctcaattcaacaagaagtgctaactatcctaaatatacaggaggacctagattcataaaacaagttcttagagacctacaaagagacttagactcccacacaataatagtgggaggctttaatactgcactgtcaatattagatcactgagacaaaaaattaacaaagatattcaggacccaaactcaactctggatcaagtggacctgacagatatctacagaactctccacccaaaaacaacagaatatatattcttctttgtgccatatggcacttactcctaaaaagattgcataattggaagtaaaacactcctaacaaatgccaaacaactgaaatcagaagaaacagtctctcagaccacagtgcaataaaattagaactcaaggttaagaaactcactcaaaaccacacaactacatggaaattaagcaacctgcccctgaatgactcctggataaataacgaaatcaaggcagaaatcaagaagttctttgaaaccaatgagaataaagagacatcatgcca

SEQ ID NO: 48408 - DNA, 601 bp, Human
aattgaaaccggaccctttccttataccttatacaaaagttaagtcaagatggattaaatatttaaatgtaaaacccaaaactgtaaaaatcctagaagaaaatctaggcaataccattcaggacatagatacggacaaagatttcgtgacaaaaacgtcaaaagcaattgcaacaaaagcaaaaattgacaaatgagatctaattaaagagcttctgcacagcaaaagaaactgtcatcagagtgaagagacaaactacagaatgggagaaaattattgcaatctatccctcagacaaargtctaatatccagaatctacaagaaaaaaataaccccatttaaaagtgggcaaaggatatgtacagacacttctcaagagaagatatacatgcagccaacaaacatggaaaaaagctcaacatcactgatcattagagaaatgcaaatcaaaaacacaatgagataccatctcaggccagtcagaatggcaattattaaaaagtcaagaaacaacagatgctggcaaggctgtggagaaatgggaactcttttacactgttggtagttcaaccattgtggaagacagtgtggtgattcct

SEQ ID NO: 48409 - DNA, 601 bp, Human
aagacattttcagaaaatatgaatgtaaacttaagttataaaaaaattaataatactttacctgttataaaaataaataaaccatccctggttttttcttttttataatttcagaggagtttcccttaacatcagtccttagaaaaatctcaccatgtattccaggtcacatttaaagagacattctaatttaaaaaaaaaaaaaaaagagttggaaattgccatttcatttttcctccagagaaaaatgctgtcatatgtattctcttttcccttcatgtgcttgtttcccattcatttrttcatcaaatcagttgtcacttgtacttgagcagactcttcatagatggataactttttgtcaagtgtttccacctatgatgatgaaaaataataatgaggttcacattaaacctttgaattggatcaaactcaattttttgtgcaaatgggtattgtaattagaccccctaggcactttgattaggtgtttagaaaccatcatacatagaaacttaatttactttgttcaacaaatatttaataaacatcaagtaaatgtcagatactatgttaagtcctgtatttgcaaagatgaata

SEQ ID NO: 48410 - DNA, 601 bp, Human
agagttggaaattgccatttcatttttcctccagagaaaaatgctgtcatatgtattctcttttcccttcatgtgcttgtttcccattcatttgttcatcaaatcagttgtcacttgtacttgagcagactcttcatagatggataactttttgtcaagtgtttccacctatgatgatgaaaaataataatgaggttcacattaaacctttgaattggatcaaactcaattttttgtgcaaatgggtattgtaattagaccccctaggcactttgattaggtgtttagaaaccatcatacrtagaaacttaatttactttgttcaacaaatatttaataaacatcaagtaaatgtcagatactatgttaagtcctgtatttgcaaagatgaataaaaataaaactcctgccccatggatttcataggctagtgcagaagagatgggtaaattaatgtggtacttgtctcctttaattggctcctttacaggcttgccttcctttgtcaattccttgaaaagctttctttacagttttttttctttggctcttttcacatcttgtccattgacttcagatggcctcatgcaggctagtagtt

SEQ ID NO: 48411 - DNA, 601 bp, Human
ttcaggaatatatctctgtctcattagaaaatttaattaagcagcagtttttattttattttttatttttgctcttctctgattgagctgtacaaaattgaagcaaagaattgagatacctattcaaatatttcaagtgaaagcatatatttttattatccaaatcactgccttaagtttctaccttcagtctagtaaggtcttcacttagaatgattctacttgcaaagggatgttggtctgtgctggcatttgctgtctattttttaatttttccatgaatgtggcctcttaaactcactcataattcccttcaggtattcatatctctttagactcatcattccatgaacttcattacactgctaaaatatgcacatctcattatatccttctacttctgcatcttattatatcattacctttatactccctgcattcttcaaaatgtatatcttaatccctcaatatatttttgtgacatatatgtgtgtatatatatgtttgtgtgtgtgtgtatatatatatacattttaaatatttttatatatatatatatacacacatatatatataaaatcacaacttgtaactaatcatg

SEQ ID NO: 48412 - DNA, 601 bp, Human
tgctggcatttgctgtctattttttaatttttccatgaatgtggcctcttaaactcattcataattcccttcaggtattcatatctctttagactcatcattccatgaacttcattacactgctaaaatatgcacatctcattatatccttctacttctgcatcttattatatcattacctttatactccctgcattcttcaaaatgtatatcttaatccctcaatatatttttgtgacatatatgtgtgtatatatatgtttgtgtgtgtgtgtatatatatatacattttaaatatttwtatatatatatatatacacacatatatatataaaatcacaacttgtaactaatcatggtatcttcatattcaaaaattatattaccggccgggcgcggtggctcacgcctgtaatcccagcacttcaggaggccgaggtgggcgggtcacaaggtcaggagttcgaggccagcctggccaatatggtgaaaccgcgtctctactaaaaatacaaaaattagctgggtgtggtggtgcacacctgtaatcccagctactggggaggctgaggcagaagaattgtttgaacccgggaggtgg

SEQ ID NO: 48413 - DNA, 601 bp, Human
cggccgggcgcggtggctcacgcctgtaatcccagcacttcaggaggccgaggtgggcgggtcacaaggtcaggagttcgaggccagcctggccaatatggtgaaaccgcgtctctactaaaaatacaaaaattagctgggtgtggtggtgcacacctgtaatcccagctactggggaggctgaggcagaagaattgtttgaacccgggaggtggaggttgtagtgagctgagatcgtgccattgtactctagcctagtgacagagtgagacttcatctcaaaaaaaaaaaaaaaaaaaawatatatatatatatccaatcagcattctgtatatgtgctttcaggtgctttttcccccagtactgtgggtcccacttgtgtgcttttaccaccgtacttattaagccttcttgtttaggggggttatttttatagctatgtaattgaataaaattacctattcacacagaaatcaggcctataccatcagagaaatgcaaatcaaaactacaatgagacaccatctcacaccagttagaatgccagtcattaaaaagtcaggaaacaacaggtgctggagaggatgtgaagaaataggaa

SEQ ID NO: 48414 - DNA, 601 bp, Human
ggctcacgcctgtaatcccagcacttcaggaggccgaggtgggcgggtcacaaggtcaggagttcgaggccagcctggccaatatggtgaaaccgcgtctctactaaaaatacaaaaattagctgggtgtggtggtgcacacctgtaatcccagctactggggaggctgaggcagaagaattgtttgaacccgggaggtggaggttgtagtgagctgagatcgtgccattgtactctagcctagtgacagagtgagacttcatctcaaaaaaaaaaaaaaaaaaaaaatatatatatataaccaatcagcattctgtatatgtgctttcaggtgctttttcccccagtactgtgggtcccacttgtgtgcttttaccaccgtacttattaagccttcttgtttaggggggttatttttatagctatgtaattgaataaaattacctattcacacagaaatcaggcctataccatcagagaaatgcaaatcaaaactacaatgagacaccatctcacaccagttagaatgccagtcattaaaaagtcaggaaacaacaggtgctggagaggatgtgaagaaataggaacacttttacactgt

SEQ ID NO: 48415 - DNA, 601 bp, Human
taggatttttaaagttaatttacacagcttttattgactatacttgtggttaaaataaggtacagtctttagatatgattcttaatatttccattatttataggtacctcattatgttttcacattttctatatacatgtcttatttgctgtagtttatcttgcaatttttaaattctgtatctattttgaagttccttagtctatagaattacatgaggattcagaatgtatgcagtggaaaaaaatgttttaagttaaaatggaaaaaaatagaaattttctcagaagtaatggcataraaataccttattccagtaaagaaggatctccaatatttttagaaattacaactcatccctgtctattcctaatgttttattggtggaattatgaaaattagtgaaaattaaaagagaaaaccttaggtgacagtaaaggatttgccagtaccagcagggttatttttttaagtttgagtgattcactttctcattagagcacctagtgctgcaagaattacctttttgactgttttctcaagtaaagactttgcaactcctaggagaccattagctcatcccaagcagcagagggtaagt

SEQ ID NO: 48416 - DNA, 601 bp, Human
aagtattcagtgtttttagtatactcagacgtgtagccatcaccacaattttagaacattttcattaattcaaaaagaatgcctgtcccttttagcaatcatcctcctatcccctcatcttcacatctagccctaaataaaccactagtctacttcctgtttctataaatttgcctatttgggacatttcatataagtaggatcatataatacatggtcttttgtaactggctttttccacttagcttaatattttcaagattcatccatgttacagcatgtatcagtaattcattcctttgttgtggtggtaaaaacacaacacaaaatttatcatcttaaccatttttaagttcagcagtgttaagtatattcatatttttgtgagacagatcttcagaattgtttcaattcgcaaattcaaaactctctatccattaaataactcttacacctccctctagcgtctgataactatcattctacttttttctattaatttgactactttaattgtttattcattcacctattaatgaacatttgagttgcttccacctcttgactattgtgaatatagtttctatgaccatattcaaga

SEQ ID NO: 48417 - DNA, 601 bp, Human
tggatattaactcttactagatatatgatttgcaattattttctctcatttcataggttgcctttttactctgttgattgcattctttgatgcacaaaatatttctgttagatgtagtcccatttgtctattttgctttagttgcctatgtttttggtgtcatatcccaaaaaaaaatcattgccacattgaatgtcatgaactacttcctgttttcttctagttttatagttttaggtcttacatttaggtctttaatgcaggttgagttaattttctttgttgttgtttttttcactgkcttcttcttattattaatttccataggttattagggaacaggtggtgtttgtttacatgagtaagttctttagtggtgatttgtgagattctggtgcacccatcacccaagctgtatacactgtacccaatttgtattcttttatccctcacctgcctccgaccctttcccccaagtccccaaagtccgctgtatcattcttatgcctttgcatcttcatggcttagctcccacttataagtgagaacatacaatgtttggtttttcattcctgaattacttcacttggaataatggtct

SEQ ID NO: 48418 - DNA, 601 bp, Human
ttcttattctttcaacagtaatcatatttcagggcttttgttgtatccatttgaatcctctttcgctacaactggttctgcaattcatttgacagcctattttgccctctactataggatactttcagtgaaaaagagggccttatgatatgggagtaatactcatgtgaatagataaataatttggaataatttagtttagttaattccaaaaagaaaatatttctgaaaataatgccttctttcccaatactaacaattaataggcattttccctggaagataatggtaaagaatacatgatgccttcttactcatgtatcctatgcccacctccctgcgttccataggaaaaggtagccagtttaaaattccaaacaatttacctaatgtaatacttgagtgtaattgcagcaagtatgaatcctcttattccagctttgtcaccttctcttgttacctttccctaccaacccctcctataatcttaactttagtatgcatataaatactattaccctgtgcccttcttgcagtctcagacagtgtagttctataagcagagcagacaaattactattccttctgccttatttctcta

SEQ ID NO: 48419 - DNA, 601 bp, Human
gaaagactatttctccctcatttccaaaggatagctttgctgcatatagtattcatagttagaaatttttttatttcagcactttgaagatgttatctcctttcttcctgtcctgtaaggtttctgcagagaaatctactgttagtctaatgtggatttcattatatatgacttgatttggagacctttggaattcctggacctggatatccatacctttccccagacttgggaagttttcagctattattttattaaataagtttcttatgccttttcctttctttttttctgaaactcyaataatatgaatatttgttcttgtatggtgtcccataagtcttacaagctttcttcactctttttcattcttctgtttctctctgtctctctctcttgctgggtatttcaaacaacctatcttccagttcaaagattctttcttctgctttatcaagactgctattgaagctctctattgtaattttttatttcattttttgaattattcagctgtaggatttctgtttggttcttttttatgatttctctatctttgttgaatttatcattcttatgaattgttttgctgattttgttg

SEQ ID NO: 48420 - DNA, 601 bp, Human
accttgagtctctagggccggcaatttgtgggaaggcaaatatatgggaaactaatgatagattaaaggctagttaataaagtttgatatataaattcctctggcgccatctgcaggctgataagtgtccaaagatttatccctcgggccaggcgcggtggctcacgcctgtaattcaagcactttgggaagcctaggcgggtggatcacaaggtcaggaaattgagaccatcttggctaacacacggtgaaacccctactctactaaaaatacaaaaaaattagccgggtgtggtggcgrgggcctgtaatcccagctactcgggaggctgaggcaggagaatggcgtgaacccgggaggcggagcttgcagtgagccgagatcgcatcactgcactcactacagccagggcgacagagcgagactccgtctcaaaaaaaaaaaaagattcatccctccaggggtcgcggggggagttacctttcttaatttatgtcctacttttaggcaaacaggagaaaagcagagagcgtttcttatatttttcttctcaagtgccttcggctaaaaaatatttgttatgctggcatattttggggt

SEQ ID NO: 48421 - DNA, 601 bp, Human
actatcctatccagatacagcttttccaaagaccaaaatcaacttctgagaagagaagtgataaatccaagagtttgaaaacacaaagataaggcaagcaggcttgaaacttcatggaacaaacaccagattcttagggttatttccctcctaccaatggctctggccctacctctaagtgcgttaatgagctctaagaaatagtataaggaaaaagggagcttttaaattgtttttaccctaatttgttctggactataattctgcccattctccctcttactgttatacttttttttttaaagaggttacttaatatactgtatatactgccattatcttgaagtactctaaaggccaaaacatcattgaaaggccaacatgttggtatgctgatatttttctgggatccacactgttaatttgtggtggacatttcctaataatggtgatattgcatttaactccaaaatatactttgaaaacagtataaagaacaacaaaactataaacaggttaaggcaattcagtgaatgtacaaatctctagtgtatacccttttcttgaatagtaataccttatatcaaactgagaacaattt

SEQ ID NO: 48422 - DNA, 601 bp, Human
agtgccttacaacttccaatttgtgaaccaaacacatcctaatttttcattgcttacccaatgttcttaaagtaggagttttctaatcatcaacgataatttagatctgaatttaattggttcttgtcatttttataaactatctgctctccttatggcatgaacctccttttctgctcaaaatgcaaagttttcatttttgagtcaacataatagatttattttcttctttttttttcttttactcctagcaagctgggatagatttattttctgatcatttttcagcagaggtttctcattttctattggttaacaaagaacattctttctaccttaacaaacgtgtttaatgacgagaggttctttccgatctcagtgatagactttttatgtagctgttagagttgccctcctttatctttaagcgttgctattgcagttgacatttctgtttcttctatgaataacctctaggtattactgtagctttagacattgttttcctaccccaaactcataaaaagtaatgtcttccagaaagcctgtcctaattatctccaactaattctaatcattctatcccatttaccctttttgt

SEQ ID NO: 48423 - DNA, 601 bp, Human
agcatattctttgaaacatgataaatttcagtaaggatttggaacaaaatccctttcagctgatttctgcaaattagaaaatttcatgtagagaattgatgtctctgaggtttcacaaaataggaaaaaaacatgtttcccagataacatgaaaataatgagtaaggctggcacggcggctcacacctgtaatcccaacactttgggaggccaaggcgagcagatcacctgaggtcaggagttcaaggccagcctggccaacatggtgaaaccctgtctctactaaaaatacaaaaattarcctggcatgttggcaggcacctgtaatcccagctccttgggagactgaggcaggagaatcgcatgaacccaggaggcagaggttgcagtgagccgagattgtgccattgtactccagtctgggcaacaagagcaagactccatctaaaaaaaaaaaaaaaaagtacgataaagcactgaaaagtacttatttatagtaatcagctaggctccagaacctttatccccctacagagatgaataccatgatggtgtgcatctcactgctgctttgtttacagtagctttacaataattctat

SEQ ID NO: 48424 - DNA, 601 bp, Human
aacatatgctgtctcgttgagagatcatttgttttcaagttaacaaaaacctgctgaagctagtgcaagcaaagaagacatttatggaaggatacaaggttatctcatagaacccaagagcaagaatacagctgggcctcaagggggatgaaaggcaggtagccagggttactccctttttagttgttctcattagatgtccatagggaagaaagggaaaggaagagtcaggcggtataaataggtaagaatttttcagacaacaagagtatggctagatatatactcctcaaaaagtatmttttctgtactgcatcaattgaagggaaataccaattacaggtcgcattgcccagtagatttgtatggatttaaagtaataactaaacaatccctttcaactattcccaatcatcctgtcccttcataagtcttgattcttggcattttgtttattctcacttgatcagtctcaagttaggacttttcaactgttctgacacccaaagataagacccctgttttcatctcttctccccagaccttcaacctgtaccatcaaagagcctgttgcacttgccttttcaagtgacagtcagga

SEQ ID NO: 48425 - DNA, 601 bp, Human
atgctttaggaataaagacaatctgcagataaactagccttcacacggactgaaattcagcatcaaactatctcaatccctgattagatcaagataatctgagttttccttaactgccagaagacctcaaattctttttggaggaatatatcattgtccaaagccttttcaattttttcatacctgatatttgggcttcaatctgaaaagttgccagacatgctagagatagagcaaaatgactaaaaattaagataggaaacaattgataaagtagacctaaaaatgatgctgatacttrtattgtctcacatggactttaataaccattatatgtttaagaaaaagggatgacaaagtgggaaatttcactagaaaactggtatctattcataagaatcaaattgaaattttggaaaagggatagaaaatatagaaatgagcataaaagacaaatgggatgtggtgaaaggtcaaacatatatgtagatgaagtctaagaaggagaggggagacagagtgagcaaaacgatatttaaaatattggcggatagttttccaaaatcaataaaagacatcaagccagaaattctaggagctc

SEQ ID NO: 48426 - DNA, 601 bp, Human
aaataaaaaatatttcatgaatcctaagggaggtatagaagaaggaaaaaggaaatcaaagcagaagtgacaaatggtacagtgatagttttaaacccaaatatagcagtaatcatactacatgtaggccaggtgcggtggctcatgcctataatcccagcactttaggaggctgaggtggactgatcatgtggggccaggagttcgagaccagcctaaccaacgtaatgaaacctcgtctctatacaaaaattagctgggtgtggtggcatgtgcctgtagtcccagctactcaggaggmtgagacatgcaatcgtttgaacccaggagacagaggttgccaacgtgagccgagatcgcgccactgcactccagcctgggtgacaagtgagactctgtctcaaaaaaaaaaaaaaagaaaaattatactaaatgtaaatagactgaatccttcagttaaaaattgtcattctggatttttaaaaaaacagctaatcatatgctgcttataagagacacatcttaaatattataaagacatagaaaactgaaagtaaaagatttgaaaaagttacaatgaaatatagctggtgtagctata

SEQ ID NO: 48427 - DNA, 601 bp, Human
catgtgcctgtagtcccagctactcaggaggctgagacatgcaatcgtttgaacccaggagacagaggttgccaacgtgagccgagatcgcgccactgcactccagcctgggtgacaagtgagactctgtctcaaaaaaaaaaaaaaagaaaaattatactaaatgtaaatagactgaatccttcagttaaaaattgtcattctggatttttaaaaaaacagctaatcatatgctgcttataagagacacatcttaaatattataaagacatagaaaactgaaagtaaaagatttgaaaaagttacaatgaaatatagctggtgtagctatattgataacagagaaaattctttttcttttcttataatacatttttatgtagagcaaatagagaaaattaaggtaaaaaggattactagatattaggagggacattttattattttaaattagttaattcatcaggaatatgtaagtaacatttgcaaatttactatatctaataatataacctcaaaatgaaaaatacgtgaattaattaattaataatcaacatttcatctagtcccccagtctttggagttcagaggaggctgagaa

SEQ ID NO: 48428 - DNA, 601 bp, Human
atgtgcctgtagtcccagctactcaggaggctgagacatgcaatcgtttgaacccaggagacagaggttgccaacgtgagccgagatcgcgccactgcactccagcctgggtgacaagtgagactctgtctcaaaaaaaaaaaaaaagaaaaattatactaaatgtaaatagactgaatccttcagttaaaaattgtcattctggatttttaaaaaaacagctaatcatatgctgcttataagagacacatcttaaatattataaagacatagaaaactgaaagtaaaagatttgaaaaakttacaatgaaatatagctggtgtagctatattgataacagagaaaattctttttcttttcttataatacatttttatgtagagcaaatagagaaaattaaggtaaaaaggattactagatattaggagggacattttattattttaaattagttaattcatcaggaatatgtaagtaacatttgcaaatttactatatctaataatataacctcaaaatgaaaaatacgtgaattaattaattaataatcaacatttcatctagtcccccagtctttggagttcagaggaggctgagaag

SEQ ID NO: 48429 - DNA, 601 bp, Human
tgagtgaaccaacagagggcagcagaaactcacatgttcagattgtagaatgtgcaaagtggttccatttacaaggattttctttcttgtttttgttgttattggttttgtttgttttttgtgttttgtgttttttgtttgtttgtttgtttgtttttgagacaaggtctggctctgtcgcccaggctggagtgcagcagcgcgatctcagctcactgcaacctctgcctcctaggctcaagccgttctcccacctcagcctcccaggtagctgggactataggcgcttgctaccaccccyggctaatttttgtattttttgtagagacggggtttcaccatgttgcccgggctggtctcaacttctgagctcaagccatccacctgtctcagcgtcccaaagttttgggattacaggcatgagccaccatgcgcagctttacaaggattttcaatttcaaaagtgtatttctgctttcctgtaggccatgcgtttaaagccatccctaatctcgacaagttttaaatcaaagttttgtatatttacttgtttttttggacatttttaacattgctagagtgacacatgctcactattgta

SEQ ID NO: 48430 - DNA, 601 bp, Human
aatgttataaagtggtagtattacatggattttataatccttgatttacaatggcttttttatttgttggtttggggtttttttgcttttccagaaaaaaatattctatctacttgtattttgaagcaagggaaagtaattgattctttttaagagtctgctattctgtgggcaactcatttttccatcgaaactattagtatcacttgtcactttttgcaccttaaaaaatctattcttaagcacttttgcaggtagaagagaattggaggtatgattatagctaataataggctaaackgaccattgccttttgacttgatgatgcaataagcagtgtttagccatgccaagggaacctaaaaatctagtagcccattccccactccaggttatacattcatgcttacatagaactgtataaaagtattaaaacaactgaaattttagaaccagaagagatcttgagaatcatgtagtccaaacctttcatttcatagatgagtaaagttagactcaaaaaactttggaacttgccaagatcagacagcttggttagataataatgccacacaagaaatcaaatctgttatttacagcc

SEQ ID NO: 48431 - DNA, 601 bp, Human
ttcttcagaatagatgccacagtcattgcctttaccaatgcttgctgctttcaggaagtgggagtcagtgttaaatgctgctgttggtaaatcatactgttggactctgatgtggccattctgtgtgtcagtgcagaaaatgtcatccttgctaggcacagtggcactcgcctgtaatccctgctcctcaggaggctcaggcaggaggattgcatgaggccaagtgtttgagaccagcctgggcaacatagcaacaccctgcctctaaaaaaattaacaaaaagaaaatgtaaaaaaaaaatgaaaataaaatgtcatcctttcatatcaaagcattcagaagagcatcattttagaacaaacatttcccttatttccttggtcacttatggttggaggtgaaaatcttctcattttcagtacacaataagaaacacttccaaagcatctggtaaagaaaaaaaaaaagaaaaagaaaaagaaaggaacacaatcctagcaattcatcaaatagaattattgaccccgtgtttccatgcaaggaccttctatcatgtgtttccttaatatcccattaaagcactctaccacccttgttctc

SEQ ID NO: 48432 - DNA, 601 bp, Human
aaatgaaagactttttctatggaaaccagaaagattggaagaaagaatagttctaccaggtgcacagattcatgcaggcttacaagaaacacaaaaaagcaagcaaatataacaccgccaaaggaacataatgggtctctagtaacagacccaaatgaaaagaaaatcaatgacctgctggaaaataaatgcaaagtaattatctgaaggaaattcaatgagatataataaaaaatatatacagacaagtcaacagaatcaggaaaacaatttatgatataaatgagaaattcagcagagwtaggaatcataaaaaaaaacagaaatcctacagttgaagaattcaataaatgaaataaaaatgcaatagagagcttcaataacagactttgtcaggccgaagactttctgaacttgaagataggtcatttgaaattacccactctgaaggggaaaaaaagaaataacaatgaaaaagaatgaagaaggcctgtaagacttacgagccatcattaagtcaacaaatttttttattatactttaacttctggggtacatgtgcacaacgtgcaggtttgttacataggtatacatgtgccat

SEQ ID NO: 48433 - DNA, 601 bp, Human
ttggaagaaagaatagttctaccaggtgcacagattcatgcaggcttacaagaaacacaaaaaagcaagcaaatataacaccgccaaaggaacataatgggtctctagtaacagacccaaatgaaaagaaaatcaatgacctgctggaaaataaatgcaaagtaattatctgaaggaaattcaatgagatataataaaaaatatatacagacaagtcaacagaatcaggaaaacaatttatgatataaatgagaaattcagcagagttaggaatcataaaaaaaaacagaaatcctacagktgaagaattcaataaatgaaataaaaatgcaatagagagcttcaataacagactttgtcaggccgaagactttctgaacttgaagataggtcatttgaaattacccactctgaaggggaaaaaaagaaataacaatgaaaaagaatgaagaaggcctgtaagacttacgagccatcattaagtcaacaaatttttttattatactttaacttctggggtacatgtgcacaacgtgcaggtttgttacataggtatacatgtgccatgttggtttcctgcacccatcaactcgtcatttac

SEQ ID NO: 48434 - DNA, 601 bp, Human
gattatgtgattttgaggaagtttcttaagctctgagcttaaaaggcttatttacttaaaaaagagaacaatatacttacttcttaatttttttgtgatgtctcagtaatgactggtaaagattccaaggatccctatatgagtctgctgcctttattagcgttatcttgccaagggttatacataaagaaaggcacattgttgggtggggtttggagttttggggcatgcatcatcatattttttggctctccctttccatcaaaaatacttggagacagagtttagttatttattcctrctggggcctttgctttggttatgctaacccccatcccttatccgactcttccccaggtggtgcctcggtgcacaacgccatgcagctgaagccgggcaagcccaatggctggaggattcccttcaacagccatgagggcggctgtggggctgccatgcgggccatgtgcatcggtctcaggttcccacaccatagccaactggacacactgatccaagtgagcatcgagagtggtcggatgacccaccaccacccaacaggctacctgggggcccttgcgtctgctctttttacagccta

SEQ ID NO: 48435 - DNA, 601 bp, Human
gggcctttgctttggttatgctaacccccatcccttatccgactcttccccaggtggtgcctcggtgcacaacgccatgcagctgaagccgggcaagcccaatggctggaggattcccttcaacagccatgagggcggctgtggggctgccatgcgggccatgtgcatcggtctcaggttcccacaccatagccaactggacacactgatccaagtgagcatcgagagtggtcggatgacccaccaccacccaacaggctacctgggggcccttgcgtctgctctttttacagcctatgcwgtgaatagcagaccacccttgcagtggggaaaaggactgatggagctgctaccagaagctaaaaagtacattgtccaatcaggctactttgtagaggaaaatcttcaacactggtgagtctgtaagcgcacgccctgctcaaacacggttgaatctgtgcgtgtacatccacctgcacatatatgtcttgtattcagagatcacagcaaccctcatggttttcacccccagccccctttctacccatctgctaaggatttcaagttcccttccagtaatgattctacaaagtagccaagt

SEQ ID NO: 48436 - DNA, 601 bp, Human
tcttacacttgcgcaacgttacagggaacacttgggaaaaggccgttacattgcccagatgttaacacaaaacccgaggacacttcacaaagaagaaaatacatttcagagaatcatgatctcactttaaaagagagaaaggaaaattaattttgccccaaaagaagaatcccgattcctctgcccccgcccccaggagacagacttgggagggaaaagtccccaactactctcagtctcctctgaagtgaaggacggaactgaggcgcctttttgaactcgctgctgctccagtcgccgyctcgtccccgtcggcccagcccgtcccctctcctcctccccgctctccctccatgttagccgcggcggggctcccgcttacggcccgaactacttttcctgctttaaagatttaagtttcgtaagcagcattactgccccagctccaccccagcacaccccaaggaccgaaactcccagcgccaccccgggagagcatccccaggacgcgcgcccacccgcccagcgcgcagacccaagaggccccggggaccgagttcggactcctcggcccctcgcctacctcggcgcggacccaggc

SEQ ID NO: 48437 - DNA, 601 bp, Human
aaatgtttagtttctgacctcactttcctggagactggagcccggggaatttagaattgtttattttctgtccataaacctttgagttaatggagcggcttctgagcaaagagtttgttggtttgtttgtagtgtctcaggaaggtcgttagagttgaaaaaattggtacaaaaaaaacaagcgctgaaatgctttaactggaaactcgagcccccaaagagcagagcaatggatcttctcttacacttgcgcaacgttacagggaacacttgggaaaaggccgttacattgcccagatgwtaacacaaaacccgaggacacttcacaaagaagaaaatacatttcagagaatcatgatctcactttaaaagagagaaaggaaaattaattttgccccaaaagaagaatcccgattcctctgcccccgcccccaggagacagacttgggagggaaaagtccccaactactctcagtctcctctgaagtgaaggacggaactgaggcgcctttttgaactcgctgctgctccagtcgccgtctcgtccccgtcggcccagcccgtcccctctcctcctccccgctctccctccatgttagcc

SEQ ID NO: 48438 - DNA, 601 bp, Human
taatatgaaggaaaaaattcaaacagggagcataaaccacccaccagggagctatttcttttgtaatgtgcattccatttcttctccctcatgctttttaattccttccatatttcctgccataattatcaaatgtttagtttctgacctcactttcctggagactggagcccggggaatttagaattgtttattttctgtccataaacctttgagttaatggagcggcttctgagcaaagagtttgttggtttgtttgtagtgtctcaggaaggtcgttagagttgaaaaaattggtacaaaaaaaacaagcgctgaaatgctttaactggaaactcgagcccccaaagagcagagcaatggatcttctcttacacttgcgcaacgttacagggaacacttgggaaaaggccgttacattgcccagatgttaacacaaaacccgaggacacttcacaaagaagaaaatacatttcagagaatcatgatctcactttaaaagagagaaaggaaaattaattttgccccaaaagaagaatcccgattcctctgcccccgcccccaggagacagacttgggagggaaaagtccccaactactc

SEQ ID NO: 48439 - DNA, 601 bp, Human
attattagtgcaggcactccctctgctgctgccctctctgcctagtccattcacatgttaatctacacacatctagagacatatgctacacccagtaccttctttcaagcagactacagagtgcatgggtgtgtgtgctcaggtggatgtggcagaatctggagggaggctggctgaaggtatatgctgcagacagagtagtaagagagtgagcaggtaagaaagagaagaagcaatcagaaagcaaccctgaggtgccaaggaagtaggacaccatggaacacattcaaaacaatatgayactttgcttaatgagtttgtttctatttttttaaatacaaggtttcactctgttgctcaggctggagtgcagtggcaccatcacggctcactgcagcctcaacctcctgggttcaagtgattttcctgcttcagcctcctgagtagctgggaccagaggcgtgtgtgctaccatgcccaggtaattttcttattttttgtagagatatggtctcacgatgttgcccaggctggtctcaaattcctgggctcaagcagtcctcccgtcttggcctcccaaagtgctgggattacaggcatg

SEQ ID NO: 48440 - DNA, 601 bp, Human
gtgcttgcccttctgttctggctagtctgcacagcccctgctatgttttacaccccgatttccagcaatggtctttagaattgcaacaagtagcttatttgccaaaggataaacaagcaagagatcattttagagatctttttagctttgttaataatacaagttgtggcaccaagaagatgcagtcagagatatgggttagatgcaaggcttacttgagtctaccatcagaacaattctaaagaacatagaggagctcccaaatataacccctagtgtacaatgccgataatagggtacrgtgaggttaagaaacgtggcctcaggacaaagccctcataatcttctagtattgcatgtctagagctaagtgaagtacatctatttgtagaattgctattgttctctcttaggtaatacactcaaagttcatgggtcaagcatggatcccttactggaatgaggattctgaactacaaatcagttaactgtacatgtgacttatcataatgaatttctagacctggaatgctgggaatcatagtgacagcagagacatccaccaagggagagtgggggtatgcttgggtacttgccaggg

SEQ ID NO: 48441 - DNA, 601 bp, Human
ttcgaagactttcttttcgtctttggggcatttcctctcggatcattacatccacttcagcccatgaccagatcttcacctcatggttcctctccaacttgcttctatgagcctggggatggagtcctggtttctgtcacctaatccagagacttctaggggaactgtaacgtgtccaccttctaaagccacttgcaacggccagggcctcgtatgctgggtgcttgcccttctgttctggctagtctgcacagcccctgctatgttttacaccccgatttccagcaatggtctttagaaytgcaacaagtagcttatttgccaaaggataaacaagcaagagatcattttagagatctttttagctttgttaataatacaagttgtggcaccaagaagatgcagtcagagatatgggttagatgcaaggcttacttgagtctaccatcagaacaattctaaagaacatagaggagctcccaaatataacccctagtgtacaatgccgataatagggtacggtgaggttaagaaacgtggcctcaggacaaagccctcataatcttctagtattgcatgtctagagctaagtgaagtacat

SEQ ID NO: 48442 - DNA, 601 bp, Human
catgtgttgctctgccccactgacttcgaagactttcttttcgtctttggggcatttcctctcggatcattacatccacttcagcccatgaccagatcttcacctcatggttcctctccaacttgcttctatgagcctggggatggagtcctggtttctgtcacctaatccagagacttctaggggaactgtaacgtgtccaccttctaaagccacttgcaacggccagggcctcgtatgctgggtgcttgcccttctgttctggctagtctgcacagcccctgctatgttttacaccccratttccagcaatggtctttagaattgcaacaagtagcttatttgccaaaggataaacaagcaagagatcattttagagatctttttagctttgttaataatacaagttgtggcaccaagaagatgcagtcagagatatgggttagatgcaaggcttacttgagtctaccatcagaacaattctaaagaacatagaggagctcccaaatataacccctagtgtacaatgccgataatagggtacggtgaggttaagaaacgtggcctcaggacaaagccctcataatcttctagtattgca

SEQ ID NO: 48443 - DNA, 601 bp, Human
aatccatgacattttcaattctcatatgtgatcactggtaatttacagctcatcctttacttcctattcttgtggcagcatgtgttgctctgccccactgacttcgaagactttcttttcgtctttggggcatttcctctcggatcattacatccacttcagcccatgaccagatcttcacctcatggttcctctccaacttgcttctatgagcctggggatggagtcctggtttctgtcacctaatccagagacttctaggggaactgtaacgtgtccaccttctaaagccacttgcaayggccagggcctcgtatgctgggtgcttgcccttctgttctggctagtctgcacagcccctgctatgttttacaccccgatttccagcaatggtctttagaattgcaacaagtagcttatttgccaaaggataaacaagcaagagatcattttagagatctttttagctttgttaataatacaagttgtggcaccaagaagatgcagtcagagatatgggttagatgcaaggcttacttgagtctaccatcagaacaattctaaagaacatagaggagctcccaaatataacccctagtgt

SEQ ID NO: 48444 - DNA, 601 bp, Human
agaatccatgacattttcaattctcatatgtgatcactggtaatttacagctcatcctttacttcctattcttgtggcagcatgtgttgctctgccccactgacttcgaagactttcttttcgtctttggggcatttcctctcggatcattacatccacttcagcccatgaccagatcttcacctcatggttcctctccaacttgcttctatgagcctggggatggagtcctggtttctgtcacctaatccagagacttctaggggaactgtaacgtgtccaccttctaaagccacttgcracggccagggcctcgtatgctgggtgcttgcccttctgttctggctagtctgcacagcccctgctatgttttacaccccgatttccagcaatggtctttagaattgcaacaagtagcttatttgccaaaggataaacaagcaagagatcattttagagatctttttagctttgttaataatacaagttgtggcaccaagaagatgcagtcagagatatgggttagatgcaaggcttacttgagtctaccatcagaacaattctaaagaacatagaggagctcccaaatataacccctagt

SEQ ID NO: 48445 - DNA, 601 bp, Human
tgtctgttagaaacattctgccagatgtccagttatttgaagaggactaagacaaagaatccatgacattttcaattctcatatgtgatcactggtaatttacagctcatcctttacttcctattcttgtggcagcatgtgttgctctgccccactgacttcgaagactttcttttcgtctttggggcatttcctctcggatcattacatccacttcagcccatgaccagatcttcacctcatggttcctctccaacttgcttctatgagcctggggatggagtcctggtttctgtcaccyaatccagagacttctaggggaactgtaacgtgtccaccttctaaagccacttgcaacggccagggcctcgtatgctgggtgcttgcccttctgttctggctagtctgcacagcccctgctatgttttacaccccgatttccagcaatggtctttagaattgcaacaagtagcttatttgccaaaggataaacaagcaagagatcattttagagatctttttagctttgttaataatacaagttgtggcaccaagaagatgcagtcagagatatgggttagatgcaaggcttacttgagtc

SEQ ID NO: 48446 - DNA, 601 bp, Human
agtttactaaaatggattaatgtcaattaaggctgtatttcactgtgtttgctgcacatccttgtagctaacaaggaaagccatttattgttaacaagttaaaatgttaaaaataacatccaaatagtaagtctcatatagagaggattaatttatctttcattaattattgaaggtttgctgttgttaaaacatggattaaaaacttgctaaatgttacctgggctagacaccaagagaagagacagattaaaagatagccatctttgggcacagagtcatgaaatgtaccctagatcayccctatccctcattttcttcatggtaacttttcctgtatgtaacttcatggtaacatacaggttcatacctttctgtactaactccctcagtcttgtcgcatggtgcctacatgggccagatgtaaaagttcatgaagctatacatggaagatttgtgcattttgctaccataaaaggatcttacaaaggaaggccctacattaatgtaaattaaaaaaaaaacagcaataagtataaagctactagttactatgtagttataataatataaactgtagctgccacgatttaaagcacct

SEQ ID NO: 48447 - DNA, 601 bp, Human
caagaaagctccccaaagcagatctaaagtttactaaaatggattaatgtcaattaaggctgtatttcactgtgtttgctgcacatccttgtagctaacaaggaaagccatttattgttaacaagttaaaatgttaaaaataacatccaaatagtaagtctcatatagagaggattaatttatctttcattaattattgaaggtttgctgttgttaaaacatggattaaaaacttgctaaatgttacctgggctagacaccaagagaagagacagattaaaagatagccatctttgggcasagagtcatgaaatgtaccctagatcatccctatccctcattttcttcatggtaacttttcctgtatgtaacttcatggtaacatacaggttcatacctttctgtactaactccctcagtcttgtcgcatggtgcctacatgggccagatgtaaaagttcatgaagctatacatggaagatttgtgcattttgctaccataaaaggatcttacaaaggaaggccctacattaatgtaaattaaaaaaaaaacagcaataagtataaagctactagttactatgtagttataataatataaa

SEQ ID NO: 48448 - DNA, 601 bp, Human
tatgtatgccacgtctgtgccatctctgaaaggccatttaccaccccacctttttctccttaagcaatccctgaagtcctgccccttggatatttcatccagtgccttgacatcgtgacgattcttgtgatcccctccttttttcgagaggaattttcccttctcctaatatgtggtattttatttaaataaaaaagttaatgtgttattttctgataaaatatgaaaataaaatatgccaattaaaagcttagagaatatagaaaagactagagcaaagaataaaatgacccataaatcyactacctacagataatttctaacacatttgtttgttgtacttttctataaatttttacagtcgtgagaataaagctggggggtgtgtgctttttaaattaaattataatcatttgccggcgcttcaaaatgtttttgtaaatgcttttggtggcacatacagctgttccatgatttatttaacccttctcctacggttgactatgtagtcaatgttaagttttttgctgtcataaataacatgactgacatcttatgtagagtcctttcaaaagtaataatgaccagggcaaagtggtct

SEQ ID NO: 48449 - DNA, 601 bp, Human
aggcaggagaatcacttgaacccaggaggcagaggaggttgcagtgagccgagatcgcaccactgtgctccagcctgggtgacagagcggactccatctcaaaaaagaaaaaaaaaaaaaaaaaaaaaagcagacttggagacacccagaaatgagaacaagaaaagacaaagaaaaatgggaagagaaaaacagcagacccccagaacggtcacaaggtaagataaagtgaaggggaacatcacactctggggactgttgtggggtggggggaggggggagggatagcattgggagatayacctaaggctagatgacgagttagtgggtgcagtgcaccagcatggcacatgtatacatatgtaactaacctgcacactgtgcacatgtaccctaaaacttaaagtataataataataaattaaaaaaaaaagttccacacaaaaagctgccatctactggacatactgattaggtggacaggctgaaaagggccccagctgcccaagtggagtctttcaaattctgagaaggcaggggccatctatcccactgccatgtttcaggattttctgaagtagtgccaagaggtgaggaaggg

SEQ ID NO: 48450 - DNA, 601 bp, Human
cagagtcaaaaacataagcgacccttcatctcttgcaggtatttgtttttggtgttgactatacaccatgagtagaggagaccttttccaagatctaatcgagtagacaggtagagacacaggaatgattcccattctactggtaaggaaagtgacttcggggaggttaagtaacttgcacaaggcctcacagctggacaaggccagaattcaaactcagtccactgccccaaagccctcgctcttaactgaagatacaagttagagacattatgtgactttaaaaaggtgcccagaaaagggcacagcaggacttctaagttggactctttcattgttctacagcgttgctcttaataacaaaatgggtttgttacagagtctatgaaaaagacagagttaggcctggcatcgtggctcacgcctctaatcccagcactttgggaggctgaggcgggtggatcacttgagggtgggagttccagaccagcctggccaactaggtgaaaccccatctctactaaaaacacaaaaattagccgggtgtggtggcaggcgcttgtaatcccagctactcaggaggctgaggcaggagaatcac

SEQ ID NO: 48451 - DNA, 601 bp, Human
tgggcactgtggctcacgactgtaatgctagcactttgggaggctgaggagggaggatcgcctaagcccaggagttagagaccagcatgggcaacaaggtgaaaccctgtctccactaaaaacacaaaaattagctgggcctgatggcacatgcctgtagtcccagctactctggaggctgaggtggaaggattgcttaagccaggatgtagaggctgcagtgagctaagattgtgtcactgctctccagcccgggcaacagagcaagatcctgtgtcaaaaaacaaaacaaaacaactgstacaaaaaaaaacccccaaaactcctaagtcactgatcattaggctgcaaatgctccactgtaaaaactgcattccaatgtgactcagaagtaaatggacctaattccaaatggaggtcatgcctgccatgtctatgtggccagaatggccaagtctgaagtgtcattccaggcacatagccatataacaactgatgttacctggaaagttaaacggctgggtctctacaatgctgagtggatgttacctagcagaagtgtctttggttttcaaacttccacaagacacagtgactatca

SEQ ID NO: 48452 - DNA, 601 bp, Human
gggctgtagtaagagcctgatctgaccagagatcagggccaggggagcagggcaggcaattcattaatacttgttcaggagcccctggatcctgatcatgggccaggcaacatgatgagaaagtaataagaaggattccagaaaacaaaattagggtccacgcaatagtttcagacaactatttctgtaagccatttgcaatactgcatcattatttttaaaagaaaatgtgaacatttacagaagcgagaaaaagttttgtttgcttttgtttttcaagtaagttcaataaatcccaaaytgcacactctgaattaggggttgtcttcccttttccccccaaaatttcttgatcgactacaaggagacccaggattcttcatttcttccccagtgttgttgagcggttggcttctgaagtggaaaatcaagtgattcctttctgtagagtaaacagcatttgggattcctgggcatgaagactgttcaggtgccacatgccgtactgtttatattccactcactacatggcgagagaaagtaaaggacacaagatgcctcctgtttttattcactctgttttctcattcttgagccagcc

SEQ ID NO: 48453 - DNA, 601 bp, Human
aagtcacttgatttaaccattgggtcaaagccaaagaccagtgcccatgggctgtagtaagagcctgatctgaccagagatcagggccaggggagcagggcaggcaattcattaatacttgttcaggagcccctggatcctgatcatgggccaggcaacatgatgagaaagtaataagaaggattccagaaaacaaaattagggtccacgcaatagtttcagacaactatttctgtaagccatttgcaatactgcatcattatttttaaaagaaaatgtgaacatttacagaagcgagaawaagttttgtttgcttttgtttttcaagtaagttcaataaatcccaaattgcacactctgaattaggggttgtcttcccttttccccccaaaatttcttgatcgactacaaggagacccaggattcttcatttcttccccagtgttgttgagcggttggcttctgaagtggaaaatcaagtgattcctttctgtagagtaaacagcatttgggattcctgggcatgaagactgttcaggtgccacatgccgtactgtttatattccactcactacatggcgagagaaagtaaaggacacaa

SEQ ID NO: 48454 - DNA, 601 bp, Human
caaagcacaaacagacacattcctgaaagactgctgggactctagggagaagccaggtgaatttcctgcttctgatataggactcagcctgtccctgtagcaccataattatagcacatagtgcaaaaccagggatggtggtgccctgggagaagcgaagctgcgtgctccgagtatttgtgaatgactggcaagcatacatctgcctccatcccaaagcaagttttgtgagctcggctgggccaccaagaagccatgctgggccctcctggtagggaccctgacagtaaagggaactcaktatgtctgagtctttgctcagggtgagcatctgtatttctgtttcaatagtgtttagcctctctgatagaaattccactgtatcaatttcacactacagtttaggtgagccaggtatatgtgtgaaggggatcagaaatttctcggaccatctttgaggtcccgtccattttctttttctctgtcacaaatgttatgccacaaactacaaacttgggccctctcaatagctaaaaatacatgtaattagcccaacccttacagaagctaataggatatgttggctgtgggattagggagg

SEQ ID NO: 48455 - DNA, 601 bp, Human
ttatttttgtaaaaaaaaaaaagtatctaaaataggacacgtaataaacaaaaacaaccccaacatggtttcttattatctagcttatatatgttcctttgtagaaaatgaaaaaacacaaagactcttctccaattgtatctgtaagaggaagcggttaactttgtaactatcctttaaaacaacatggtccacaagtagcttggggagttttattaagaaataagtctgcagtgagtactgaaattattatacccaacatttagccaagacttgaatgtctggcctctactcaaaacayttcccagtcccattctcccttctagtttcatctcccaagaaaggagattgagaaacccaaaatggactcacacctgaagtgtgttcctactgggaactggggttttctttgatcactatcaagcccttggtgccacacagaaaattacccttctgtggaacaggaggcagacaccaattaatgcataaagtgaatgtctttctccttaaaataaatagctaaaccagaaaatctgcatctctgcatgtggctgtcagcaagaccaaggccacataggataagaaaggaaagaaaatagaa

SEQ ID NO: 48456 - DNA, 601 bp, Human
acttaaacaggaaatgaagagacttctatttgatcaaatgtgtatggggaatttggaggaaaaacgcaattacctaagctgtaaaatgaccaacatagtggggtagtcatcctcaagcgctggttgtttttacaggatttcatatccctatcacagtttatttttgtaaaaaaaaaaaagtatctaaaataggacacgtaataaacaaaaacaaccccaacatggtttcttattatctagcttatatatgttcctttgtagaaaatgaaaaaacacaaagactcttctccaattgtatctrtaagaggaagcggttaactttgtaactatcctttaaaacaacatggtccacaagtagcttggggagttttattaagaaataagtctgcagtgagtactgaaattattatacccaacatttagccaagacttgaatgtctggcctctactcaaaacacttcccagtcccattctcccttctagtttcatctcccaagaaaggagattgagaaacccaaaatggactcacacctgaagtgtgttcctactgggaactggggttttctttgatcactatcaagcccttggtgccacacagaaa

SEQ ID NO: 48457 - DNA, 601 bp, Human
acgacaatgccatttacactgggcaaaataattatagcattacctggaaaataacccaatcaaccaacggaaacacagccactggggaggaacccagcttgctctctaatccacacagcaattccatggagcaacttaaacaggaaatgaagagacttctatttgatcaaatgtgtatggggaatttggaggaaaaacgcaattacctaagctgtaaaatgaccaacatagtggggtagtcatcctcaagcgctggttgtttttacaggatttcatatccctatcacagtttatttttgtaaaaaaaaaaaagtatctaaaataggacacgtaataaacaaaaacaaccccaacatggtttcttattatctagcttatatatgttcctttgtagaaaatgaaaaaacacaaagactcttctccaattgtatctgtaagaggaagcggttaactttgtaactatcctttaaaacaacatggtccacaagtagcttggggagttttattaagaaataagtctgcagtgagtactgaaattattatacccaacatttagccaagacttgaatgtctggcctctactcaaaacacttcccagtcc

SEQ ID NO: 48458 - DNA, 601 bp, Human
tcaaacaacaaatcactggagaatgaggaagtctttacattccaggccactgtaacatgagtaatttcagtcactacacgacaatgccatttacactgggcaaaataattatagcattacctggaaaataacccaatcaaccaacggaaacacagccactggggaggaacccagcttgctctctaatccacacagcaattccatggagcaacttaaacaggaaatgaagagacttctatttgatcaaatgtgtatggggaatttggaggaaaaacgcaattacctaagctgtaaaatgacsaacatagtggggtagtcatcctcaagcgctggttgtttttacaggatttcatatccctatcacagtttatttttgtaaaaaaaaaaaagtatctaaaataggacacgtaataaacaaaaacaaccccaacatggtttcttattatctagcttatatatgttcctttgtagaaaatgaaaaaacacaaagactcttctccaattgtatctgtaagaggaagcggttaactttgtaactatcctttaaaacaacatggtccacaagtagcttggggagttttattaagaaataagtctgcag

SEQ ID NO: 48459 - DNA, 601 bp, Human
gaacactcttaggcttacaattcctaacttttgtctctttctcagagactgtcatgactttctgaatatggctactgtcacatctgagcccacagactggcagtctagagcctcagctatctatctgagccccaaatacatgcacacacttcagcctaggcagagaaaagactttttcctggagtcagagtcaaacaacaaatcactggagaatgaggaagtctttacattccaggccactgtaacatgagtaatttcagtcactacacgacaatgccatttacactgggcaaaataattrtagcattacctggaaaataacccaatcaaccaacggaaacacagccactggggaggaacccagcttgctctctaatccacacagcaattccatggagcaacttaaacaggaaatgaagagacttctatttgatcaaatgtgtatggggaatttggaggaaaaacgcaattacctaagctgtaaaatgaccaacatagtggggtagtcatcctcaagcgctggttgtttttacaggatttcatatccctatcacagtttatttttgtaaaaaaaaaaaagtatctaaaataggacacgtaa

SEQ ID NO: 48460 - DNA, 601 bp, Human
tggggacagttcattacatgctttgaacactcttaggcttacaattcctaacttttgtctctttctcagagactgtcatgactttctgaatatggctactgtcacatctgagcccacagactggcagtctagagcctcagctatctatctgagccccaaatacatgcacacacttcagcctaggcagagaaaagactttttcctggagtcagagtcaaacaacaaatcactggagaatgaggaagtctttacattccaggccactgtaacatgagtaatttcagtcactacacgacaatgycatttacactgggcaaaataattatagcattacctggaaaataacccaatcaaccaacggaaacacagccactggggaggaacccagcttgctctctaatccacacagcaattccatggagcaacttaaacaggaaatgaagagacttctatttgatcaaatgtgtatggggaatttggaggaaaaacgcaattacctaagctgtaaaatgaccaacatagtggggtagtcatcctcaagcgctggttgtttttacaggatttcatatccctatcacagtttatttttgtaaaaaaaaaa

SEQ ID NO: 48461 - DNA, 601 bp, Human
catggtgaaaccccatctctaccaaaaatacaaaaattagccgggcgtggttgcaggcacctgtaatcccagctacttgggaggctgaggcacgagaactgctttaatccaggaggcagaggttgcagtgagccgagatcctgccactacactccagtctgggcgacagagcgagactctgtctcaaaacaaaaacaaacaaacaaaaaacagtgatatatcttttctgatcatatacatctgcagtgttcactcacagtattttctcatgaagcacttaacagaaattcttcactcaatygcctcatctgcatttgcttaacccactaaaattaacagagtttcccacgtgcatcaccacctcccttcttccagtcttcctcatcactattttcctcctccttatttgttctacccacttctaggacaagaaccatttggggacagttcattacatgctttgaacactcttaggcttacaattcctaacttttgtctctttctcagagactgtcatgactttctgaatatggctactgtcacatctgagcccacagactggcagtctagagcctcagctatctatctgagccccaaatac

SEQ ID NO: 48462 - DNA, 601 bp, Human
atcatctcccttgccacacactatgtacaggtgccattttaatttacagctttaattatcatttgtgagttgtgcttacagagcatacatttacttacaaaaaacagccaggcacggtggctcatgcctataatcccagcacattgggaggttgagtcagggagctcacatgaggtcaggagttcaagaccagcctggccaacatggtgaaaccccatctctaccaaaaatacaaaaattagccgggcgtggttgcaggcacctgtaatcccagctacttgggaggctgaggcacgagaaytgctttaatccaggaggcagaggttgcagtgagccgagatcctgccactacactccagtctgggcgacagagcgagactctgtctcaaaacaaaaacaaacaaacaaaaaacagtgatatatcttttctgatcatatacatctgcagtgttcactcacagtattttctcatgaagcacttaacagaaattcttcactcaatcgcctcatctgcatttgcttaacccactaaaattaacagagtttcccacgtgcatcaccacctcccttcttccagtcttcctcatcactattttcctcc

SEQ ID NO: 48463 - DNA, 601 bp, Human
tgactagtgactatgggcaaagaattaccaacaacagaatttaatgctttatttcatattctttgggacattagcttcctctgggaatggtgccaagttatattaaaattgctgatcatggaaggaaacaataaaaatatttactattcagctagcctctgcttaacttccaacttcacctgggactgagagacttagaatccaggtgtctgattaagcaagcccagcactactatcatgtccaagattaagcaaactgttgacgggcaagtgctgtcaaccatcttcccagatgcacaayattcttgcaaaatacggcacagagatgactatcattaagatacaaagattgtaggcacctcttcgtattacatatgagacatttggccttattaatccatttagctagtggattaattcaaaaaatatttactaagcatctactatacactaagcacaactggttctaggtattagagatccattgcagaatgagagagacaaagccctattctaaaggagtacatgctctagagggaggaaggtgaataaacaaacaaaaataacaagttcatttcagcctgtgatcagtaagtttaga

SEQ ID NO: 48464 - DNA, 601 bp, Human
cctctgagatcttaatgtgaaaatccagtgacactgaatgccttttgctttgttttatccatactggaaacatcacagttgccattcaaatgaaaccagagagaaagagtaacagcaggaaggatccaaaaaagtaaaggtttcagcaaaaggtgaggtccaaagacaaaggtgactagtgactatgggcaaagaattaccaacaacagaatttaatgctttatttcatattctttgggacattagcttcctctgggaatggtgccaagttatattaaaattgctgatcatggaaggaaasaataaaaatatttactattcagctagcctctgcttaacttccaacttcacctgggactgagagacttagaatccaggtgtctgattaagcaagcccagcactactatcatgtccaagattaagcaaactgttgacgggcaagtgctgtcaaccatcttcccagatgcacaatattcttgcaaaatacggcacagagatgactatcattaagatacaaagattgtaggcacctcttcgtattacatatgagacatttggccttattaatccatttagctagtggattaattcaaaaaatat

SEQ ID NO: 48465 - DNA, 601 bp, Human
ctcaatgctgaccactgtgttagcggtggaacgttccccagaatgagacttcgcctctgagatcttaatgtgaaaatccagtgacactgaatgccttttgctttgttttatccatactggaaacatcacagttgccattcaaatgaaaccagagagaaagagtaacagcaggaaggatccaaaaaagtaaaggtttcagcaaaaggtgaggtccaaagacaaaggtgactagtgactatgggcaaagaattaccaacaacagaatttaatgctttatttcatattctttgggacattagcytcctctgggaatggtgccaagttatattaaaattgctgatcatggaaggaaacaataaaaatatttactattcagctagcctctgcttaacttccaacttcacctgggactgagagacttagaatccaggtgtctgattaagcaagcccagcactactatcatgtccaagattaagcaaactgttgacgggcaagtgctgtcaaccatcttcccagatgcacaatattcttgcaaaatacggcacagagatgactatcattaagatacaaagattgtaggcacctcttcgtattacatat

SEQ ID NO: 48466 - DNA, 601 bp, Human
ccaactccactgaaaaatgaagtagtatgctatggtaagtccgggaactctgacttaaggagttaaggccacaggtaagtggaggtggttggcccccagggacttcactcaatgctgaccactgtgttagcggtggaacgttccccagaatgagacttcgcctctgagatcttaatgtgaaaatccagtgacactgaatgccttttgctttgttttatccatactggaaacatcacagttgccattcaaatgaaaccagagagaaagagtaacagcaggaaggatccaaaaaagtaaaggyttcagcaaaaggtgaggtccaaagacaaaggtgactagtgactatgggcaaagaattaccaacaacagaatttaatgctttatttcatattctttgggacattagcttcctctgggaatggtgccaagttatattaaaattgctgatcatggaaggaaacaataaaaatatttactattcagctagcctctgcttaacttccaacttcacctgggactgagagacttagaatccaggtgtctgattaagcaagcccagcactactatcatgtccaagattaagcaaactgttgacgggca

SEQ ID NO: 48467 - DNA, 601 bp, Human
aaacacttccaagtatcatgtaacaatattgttctcacagctctggtatccttcattttaactgtgtaaacactggagaaatgccacatatttaactgtttggggtcaccctgaggaactcccaactccactgaaaaatgaagtagtatgctatggtaagtccgggaactctgacttaaggagttaaggccacaggtaagtggaggtggttggcccccagggacttcactcaatgctgaccactgtgttagcggtggaacgttccccagaatgagacttcgcctctgagatcttaatgtgmaaatccagtgacactgaatgccttttgctttgttttatccatactggaaacatcacagttgccattcaaatgaaaccagagagaaagagtaacagcaggaaggatccaaaaaagtaaaggtttcagcaaaaggtgaggtccaaagacaaaggtgactagtgactatgggcaaagaattaccaacaacagaatttaatgctttatttcatattctttgggacattagcttcctctgggaatggtgccaagttatattaaaattgctgatcatggaaggaaacaataaaaatatttactatt

SEQ ID NO: 48468 - DNA, 601 bp, Human
tagaaactctatacaaaaatgtactagcttagttgctatggatagattatcatttgtggtaaaaacacttccaagtatcatgtaacaatattgttctcacagctctggtatccttcattttaactgtgtaaacactggagaaatgccacatatttaactgtttggggtcaccctgaggaactcccaactccactgaaaaatgaagtagtatgctatggtaagtccgggaactctgacttaaggagttaaggccacaggtaagtggaggtggttggcccccagggacttcactcaatgctgwccactgtgttagcggtggaacgttccccagaatgagacttcgcctctgagatcttaatgtgaaaatccagtgacactgaatgccttttgctttgttttatccatactggaaacatcacagttgccattcaaatgaaaccagagagaaagagtaacagcaggaaggatccaaaaaagtaaaggtttcagcaaaaggtgaggtccaaagacaaaggtgactagtgactatgggcaaagaattaccaacaacagaatttaatgctttatttcatattctttgggacattagcttcctctggga

SEQ ID NO: 48469 - DNA, 601 bp, Human
aaaacatgcacattctattcttcttgagacattcctgccttgcattctttccttgaagcagttgggatgtcacagctggggggaaggagctgtaaaacctacttatgctggccaatcaggccttggctgacaggaggcccaccaatgagggactgccaggtattccgttccgctgcaacaaattcccccctattttttcagaaattaaaaccctccgagaccctcaagctgtacacaatgcacaaagacctccttttttgttcattctgtttttccccaaggactgcattagaaactctayacaaaaatgtactagcttagttgctatggatagattatcatttgtggtaaaaacacttccaagtatcatgtaacaatattgttctcacagctctggtatccttcattttaactgtgtaaacactggagaaatgccacatatttaactgtttggggtcaccctgaggaactcccaactccactgaaaaatgaagtagtatgctatggtaagtccgggaactctgacttaaggagttaaggccacaggtaagtggaggtggttggcccccagggacttcactcaatgctgaccactgtgtta

SEQ ID NO: 48470 - DNA, 601 bp, Human
caatgagatagatatatcttctcaaaacctttttaaaaaattttcttggcttgactgctacactctcttactgccagctttcaatattacacacacacaaacacagtttcagtgccttgagattaaagtcaatgaaaacatgcacattctattcttcttgagacattcctgccttgcattctttccttgaagcagttgggatgtcacagctggggggaaggagctgtaaaacctacttatgctggccaatcaggccttggctgacaggaggcccaccaatgagggactgccaggtattcckttccgctgcaacaaattcccccctattttttcagaaattaaaaccctccgagaccctcaagctgtacacaatgcacaaagacctccttttttgttcattctgtttttccccaaggactgcattagaaactctatacaaaaatgtactagcttagttgctatggatagattatcatttgtggtaaaaacacttccaagtatcatgtaacaatattgttctcacagctctggtatccttcattttaactgtgtaaacactggagaaatgccacatatttaactgtttggggtcaccctgagg

SEQ ID NO: 48471 - DNA, 601 bp, Human
gacctagtccttcaaaaataggcaggcgtcatgggcacttaggctgaattctggctgttttcaatgcctgtggacaagtcatttcacccttctggtctcctctataagaaaggtaaaatgtttggtacttcctctctgtaagactttttatggctcagctcagaaacaatgacaaaagggctaattaagctgtacatatttggagccttctcttagctaaatatgcttttttgggggcatacaaatccatggacaaatttggcaatgagatagatatatcttctcaaaacctttttaaaamattttcttggcttgactgctacactctcttactgccagctttcaatattacacacacacaaacacagtttcagtgccttgagattaaagtcaatgaaaacatgcacattctattcttcttgagacattcctgccttgcattctttccttgaagcagttgggatgtcacagctggggggaaggagctgtaaaacctacttatgctggccaatcaggccttggctgacaggaggcccaccaatgagggactgccaggtattccgttccgctgcaacaaattcccccctattttttcagaaat

SEQ ID NO: 48472 - DNA, 601 bp, Human
aggatactgagtaatgaggacctagtccttcaaaaataggcaggcgtcatgggcacttaggctgaattctggctgttttcaatgcctgtggacaagtcatttcacccttctggtctcctctataagaaaggtaaaatgtttggtacttcctctctgtaagactttttatggctcagctcagaaacaatgacaaaagggctaattaagctgtacatatttggagccttctcttagctaaatatgcttttttgggggcatacaaatccatggacaaatttggcaatgagatagatatatcttytcaaaacctttttaaaaaattttcttggcttgactgctacactctcttactgccagctttcaatattacacacacacaaacacagtttcagtgccttgagattaaagtcaatgaaaacatgcacattctattcttcttgagacattcctgccttgcattctttccttgaagcagttgggatgtcacagctggggggaaggagctgtaaaacctacttatgctggccaatcaggccttggctgacaggaggcccaccaatgagggactgccaggtattccgttccgctgcaacaaattccc

SEQ ID NO: 48473 - DNA, 601 bp, Human
tggtatgtcttttacacttacagtacatctaaattggactagccacgtttcaagtgctcaatagccactgcagctagtagctatcggcattgaacagcacagttctaaacagttatggctggatgcggtggctcacgcctgttatcccagcactttgggaggccaaggcgagacgattccttgaggccaggagtttgagaccagcctgggcaatatagcaagatcctgtctcttaaaaaaaaaagaaaaagagaaaaaaggaaataaaaatagttctgagttctgacctcactgcatcggtggaggagggtttgaggagaaagaggacgaccttctttaacttggaatacttttcaagtggtgtataactgaagtcaatagagattatctgaacatacaggcaaggcagcatgtcaggctgcatctgggaccaggatactgagtaatgaggacctagtccttcaaaaataggcaggcgtcatgggcacttaggctgaattctggctgttttcaatgcctgtggacaagtcatttcacccttctggtctcctctataagaaaggtaaaatgtttggtacttcctctctgtaagactttttat

SEQ ID NO: 48474 - DNA, 601 bp, Human
ttttagtagagacagggtttcaccatgttggccaggctgttcttgaactccggacctcaagtgatccaccacctcggtctcccaaagtgctgggattatagttgtgagccaccgcacccggcctctggaaggtaccttttaaaaactcaaaagaaataaggtgaaattaagtgtaatcacttattttaagaaaatatatccaaaatattaccatctcaacatgtaatcaataatatggagatattttagacttttttcatactaagtctttggaatctggtatgtcttttacacttacagyacatctaaattggactagccacgtttcaagtgctcaatagccactgcagctagtagctatcggcattgaacagcacagttctaaacagttatggctggatgcggtggctcacgcctgttatcccagcactttgggaggccaaggcgagacgattccttgaggccaggagtttgagaccagcctgggcaatatagcaagatcctgtctcttaaaaaaaaaagaaaaagagaaaaaaggaaataaaaatagttctgagttctgacctcactgcatcggaggaggagggtttgaggagaaaga

SEQ ID NO: 48475 - DNA, 601 bp, Human
aagatttctggggtggtcaggaggggctccttaaaacctgtaagcatcaattttaacaccattgttctctactaggcatgggtgtcaggaagttctggcaccctctacaggtcccctggattttaatagtccagtttagaggaatgttaatctttgtggaacaaactaagaactacataaaatcagttcctttgaaaagaaaagcaacaatccaaacacaaattaatctgcatttccttatcaatatctaacatggaaatagatgaaatctataagtaatatacaggacaatcaaaaacayaccaaacatcatgccaagtgccaggggctcaaggaggagtaaagcacactctgtgtctctaaggagcttgtagcttaggtgagaagctaggggaatgaatatatgcaattttaaataacagaacaacacaatctaataagagataactcaagacaatgtgtggctatggttaagtgacaactgtctagagcagtgctgtccaacagaaatagaatacccatctcatacagaatttaaaattttctagtaggtacatttttttttgagacgaagtctcaatctattgcccatgctggagtg

SEQ ID NO: 48476 - DNA, 601 bp, Human
aggctgaccttgcagtgggctggaatacactgaaacacgagttgccgggacagcaaagccttaggtgtgcccacgtggtttatctccccttggattgggcacattagtaagaactgtgatgcccaaccaagaggtgagaccatctgatacaatggtggaggctggggggatagtagggatgtcagggttgactgaaacaaaatggatctgggagacccagcatagcaaagtagcaccagtctccactttaaaaacaaggacaggccgggcacagtggctcacacctgtaatcccagccctytgggaggcctaggcaggtggatcacttgaggacagaagtttgagaccagcctggccaacatggtgaaacccccctctccattaaaaatacaaaaattagctgggtgtggtgacttgcacctgtaaatccagctactctggaggctgaggcacgagaatcgcttgaacctggaaggcagaggttgcaatgagcctagattgcaccactgtcctccagcctgggtaacggagtgagactctgtctcagacaaaaaacaaacagcaacaacaacaacaacaaaaaacagggacaaagtcctgg

SEQ ID NO: 48477 - DNA, 601 bp, Human
tagtataccttgtgccactccattaacctttgttgaaagcaaaaaaaggtggattgaaccacactgccctggggacttgggatagggacagagaggaacaacacctgtgccaactcctttcctggggctgctccctcccagaactggtcttctttgaggaaataccctaaagaccctgccctccaccaccaggccatatatattcagcctggaatttcactaattagagattgtcttaggcccacagaaagacattgaagagtgtgtttgtgcatgtgtgtgcatgcatatgtgtgttaaygaggtagaagagcaacggaggacgaaaatggctttcagtcatttcctttgtccacagtttaaatatttaacctaactgagacatgctgagagaatgagaatttggtgaagaggaagataaggtaatgtgggaatgtggggtatctcagagcaaagcaaaattgggtgagatttctgagtatagggtaggggcagccaaagagctgcctgataccttgggggcctatactagggggaagtagagatgaagagaagcaagtgagaaggcaggagaaactgtggaaatgggcttattatctga

SEQ ID NO: 48478 - DNA, 601 bp, Human
ccttgggtgccactgaatttaagtagtccctgggtggttcctgataccacagacctgctgggaatagaatccactgtggcagagagcttgcttgcttccctgagctggaacagtacccccatcacttctgtggctgctttccattaccccaatttgcacatgattccccctaaacctgcaagccaagccactattctcgacggtggtccacatgccctggcactgagttggatgcccgacactgtcacctactgccttctacctgggcactgttaacaaagtctttggcatatggcacagrgcgtttttcctctctcctgggtgacttcattgttcatgtagcctcgagatctgtgggctcctcacttcgagcaaccctccacttcttagggaccctggatactgaaagctttgggaagtgtctgtaagcagagcaggtagccacagcagatttaagctgtaagtggactaaaatttaaaaaaagggtctagggctcccaaggctctatgttttgaaatgagaactcattagcctttgaaaatgtcagcatgatgaggaattgtcagatgcttctttaaccttcagataggcagagaatgt

SEQ ID NO: 48479 - DNA, 601 bp, Human
gcccacaaggggtctctgtgcaaatcagaaaaggcacctttctctccaggagatgcagcacatggccagggtatggggcttggctagcagagtgtagtttggatttcagcccctgtcacctcctcatgcagtcaacagcctgcacaatggtatgagaactctgacagcaaagcagccgagagtagagtaggaacattcagagaattgggaggaaaaccaggaagcctagagagctcccagaaatggatgatgaatgccatgtaagagaaatcatttggcaaatgtcgggataaaacagccaaaaaaaaaaaaaagcttttaaacttctgctgaaacctgaactagtaacctggagtgtaagccaggcagaggcagtgatgtcctgtgtaagaagaattaatgcaggaggactgaaatgggccctggatatatctctgcctctaacatatggtgtgacatggggcaaggtgcttgacctctctgggcctcagtttcctcagctataaaatgcagaggttatagatgatgcctaagtcccttaagctgtaagaattctattaattagaaagctcaggaatttaccacttcagatgttcctgaa

SEQ ID NO: 48480 - DNA, 601 bp, Human
taaagatgcatatctgggcgtcacctgtgtaggggtgagaaattgaggcagaggaacaaatgagctcaggagaaaaaggtgggcatggaaggctgagggcggctagggcgtggaaggaaaagggggagcacagacagcaggaagaacagcccacaaggggtctctgtgcaaatcagaaaaggcacctttctctccaggagatgcagcacatggccagggtatggggcttggctagcagagtgtagtttggatttcagcccctgtcacctcctcatgcagtcaacagcctgcacaatggtaygagaactctgacagcaaagcagccgagagtagagtaggaacattcagagaattgggaggaaaaccaggaagcctagagagctcccagaaatggatgatgaatgccatgtaagagaaatcatttggcaaatgtcgggataaaacagccaaaaaaaaaaaaaagcttttaaacttctgctgaaacctgaactagtaacctggagtgtaagccaggcagaggcagtgatgtcctgtgtaagaagaattaatgcaggaggactgaaatgggccctggatatatctctgcctctaacatatggtg

SEQ ID NO: 48481 - DNA, 601 bp, Human
tttggcttctagggcctggagggttggttgtgtgtctctatcagaaatgaagcctgggaaaggtgtcccgtgagggtggggtgggcaatgatgagtcagttatggacgcgtctcaaggacagtgaaacatcccaccgacagctgccaatattggctaaagatgcatatctgggcgtcacctgtgtaggggtgagaaattgaggcagaggaacaaatgagctcaggagaaaaaggtgggcatggaaggctgagggcggctagggcgtggaaggaaaagggggagcacagacagcaggaagarcagcccacaaggggtctctgtgcaaatcagaaaaggcacctttctctccaggagatgcagcacatggccagggtatggggcttggctagcagagtgtagtttggatttcagcccctgtcacctcctcatgcagtcaacagcctgcacaatggtatgagaactctgacagcaaagcagccgagagtagagtaggaacattcagagaattgggaggaaaaccaggaagcctagagagctcccagaaatggatgatgaatgccatgtaagagaaatcatttggcaaatgtcgggataaaacag

SEQ ID NO: 48482 - DNA, 601 bp, Human
gcaacatcctgaatagagagaggaaggagagagtctggggggctgccagatctttggcttctagggcctggagggttggttgtgtgtctctatcagaaatgaagcctgggaaaggtgtcccgtgagggtggggtgggcaatgatgagtcagttatggacgcgtctcaaggacagtgaaacatcccaccgacagctgccaatattggctaaagatgcatatctgggcgtcacctgtgtaggggtgagaaattgaggcagaggaacaaatgagctcaggagaaaaaggtgggcatggaaggcygagggcggctagggcgtggaaggaaaagggggagcacagacagcaggaagaacagcccacaaggggtctctgtgcaaatcagaaaaggcacctttctctccaggagatgcagcacatggccagggtatggggcttggctagcagagtgtagtttggatttcagcccctgtcacctcctcatgcagtcaacagcctgcacaatggtatgagaactctgacagcaaagcagccgagagtagagtaggaacattcagagaattgggaggaaaaccaggaagcctagagagctcccagaaatgg

SEQ ID NO: 48483 - DNA, 601 bp, Human
agagaaatctctacagaataacgaggtctggcaacatcctgaatagagagaggaaggagagagtctggggggctgccagatctttggcttctagggcctggagggttggttgtgtgtctctatcagaaatgaagcctgggaaaggtgtcccgtgagggtggggtgggcaatgatgagtcagttatggacgcgtctcaaggacagtgaaacatcccaccgacagctgccaatattggctaaagatgcatatctgggcgtcacctgtgtaggggtgagaaattgaggcagaggaacaaatgasctcaggagaaaaaggtgggcatggaaggctgagggcggctagggcgtggaaggaaaagggggagcacagacagcaggaagaacagcccacaaggggtctctgtgcaaatcagaaaaggcacctttctctccaggagatgcagcacatggccagggtatggggcttggctagcagagtgtagtttggatttcagcccctgtcacctcctcatgcagtcaacagcctgcacaatggtatgagaactctgacagcaaagcagccgagagtagagtaggaacattcagagaattgggaggaaaa

SEQ ID NO: 48484 - DNA, 601 bp, Human
cacaggagtgtctaacctagttgagctgatgaaacaagaatacaggccaatgcagtcctaagtaatggggccgactccaggagatgggacttcatagaagagatgggacttgagccgagctcttaagaaaggtaggatgtggatggaaaatctataggtttttgagcaggagagtgttaagaaaaacatttgaacagtggcacatggcaagaaatgggtaaggcggaattgggggcaggcagaaggatatcagttggaacaggcctggggtgatgacagttgcatctacactagtggtggmatggttatagaaggaagggatccaagagaaatctctacagaataacgaggtctggcaacatcctgaatagagagaggaaggagagagtctggggggctgccagatctttggcttctagggcctggagggttggttgtgtgtctctatcagaaatgaagcctgggaaaggtgtcccgtgagggtggggtgggcaatgatgagtcagttatggacgcgtctcaaggacagtgaaacatcccaccgacagctgccaatattggctaaagatgcatatctgggcgtcacctgtgtaggggtgag

SEQ ID NO: 48485 - DNA, 601 bp, Human
ctaaaaaatgtttttgtaaggctgccactagtttcataatttcacccttcggtttcttaggaaagtccaagtggaagtttctaatacagaccatttatctgccctgaattagcttgttaggtttgaatatggttcttattttctcctctccaattgtctacctaagacttgtccactttgaaggccaatgtagagagtataaatcctccagtcttcttcagtaatggccaaggaaaatgatttaaacccatcaaaatgctatttgatgaatgcctgtaacagcaaaacaaaaaaagagaayggtctgtaatgagcatggcgcaagctccgtggcataaacccaaaagggaggcctgggtgcagtggctcaagcctgtcattccagcactttgggaggctgaggtgggaagattgcttgagcccaggagtttgaggctgcagtgagctaggatcatgccactgcactccagcctgggtgacagagtgagaccctgtctctaaaaataacaacaaaaaacccaaaaaggagcagaggatgtggctgcccccaccacaggagtgtctaacctagttgagctgatgaaacaagaatacaggccaa

SEQ ID NO: 48486 - DNA, 601 bp, Human
ctttgattaatttctatgtttagcctctatcacagcttatgggatataacatgttccttttactactcattgcgtattgtgtgcctggaaattactatattcaaatttcaaatgggacagtgatgtttacctccaccattttctttattattttacagattctgtcacattctctatgtgtcttttcagactgaagaatctaggttggctcaggccaccttcacacggaagcctctctccttcactgctgctcacatgtcatctctggaatgcctcatgctgcctatgcttagagctttcytgaggtggcccagacacagcatagcacactagatgcttggtttctatagaatgatcggttcctgtgttctgcaatggtcttgtctagtcatagcagaagtatagcagtatagtaagcacttacagagttagaaacatgttaggcctgttcatatagggctgaaaatcatctcacaaagatctgtgaggctcagggattcatccctgtttgcactgaggagactgtgacttcaagagctgggccatgactgaggtaagagtcagacccaggtggctccaactccggtacttgagagaggtg

SEQ ID NO: 48487 - DNA, 601 bp, Human
tggttttgtggggcctgaagcttaaatggtttagggagggctaaaaaaatatacaattataaatgcaaattgggtaaatggccttgcaagacccttgcaaataaaaggtctgaaatcaaagcttaattagcttcatggtaatccaactccccatttgccctattattttcttcataaacaaaatctttccaataatggcttttgggtccttagtctattagagagagtcctattcaatatctgatgcacatatggcttatctcaagtagactctaagagccttgcacacttcagcttcccmcagacccaccacagtgtactgcctgagaaaatgctcaacaaatggtttgtatattaaatgtcatttgggggtacaaagtttcggttatgcaagatgagtaatttttggagatctaatgtacagcatggcgatgatagttaataatactgtttgtatacttttaatttgctaagaggatagatcataaattaaattttctcaacatgcacacacacaaaatggtaactatgtagaggtagtgaatatgttaattagcttgattatggtgaacatttcaccatatatatgaatattaaaaca

SEQ ID NO: 48488 - DNA, 601 bp, Human
tgagaaaagcagagagaaagagcaaaaccgcttcaggaccttgaaaccttgctggagtatctcatgaccttgttcaagtctctctttttttctggaaagaaatgtgttggtacatcctgcatatgctatggacagaggaggagggactggtgatttctagcagtggttctgatgtgtgtggcagggggcactgcatgtgtgcagtccctgctataagtttcccttccttatatgtgctcacaatcagtccctcatctcaaggttaatgcactagggccaaaccctggttttgtggggcctsaagcttaaatggtttagggagggctaaaaaaatatacaattataaatgcaaattgggtaaatggccttgcaagacccttgcaaataaaaggtctgaaatcaaagcttaattagcttcatggtaatccaactccccatttgccctattattttcttcataaacaaaatctttccaataatggcttttgggtccttagtctattagagagagtcctattcaatatctgatgcacatatggcttatctcaagtagactctaagagccttgcacacttcagcttcccacagacccaccacagtg

SEQ ID NO: 48489 - DNA, 601 bp, Human
cctctttacaaatcaaagccaggaaatgtcttgaatccaaggtcttaaaaaatggaaatgatttttgcaatcaaaaaagatctttgcaagcaaatggagaagcaagttatttgcaaaaccaccagtagaggtgatcgtgcatctgagtctctgggccaaccagaattaagtctgaacataaaatacacgttgaatgtttaaaaaaaagtcttctgaagtaaaataatttctggaagaacagtgtgctttggcaggaaaggaagcttataagcaaagccataaaactgtcagtttaatatamcatcatttcactaacatgaagtgggccggctctgtcccctccattcttttcctccttccaactcttttaaaaaagaacagctctacttatgccaaggtggaattttggctctacttgccactattctgcgacagagtggctttgttgacgtgagaaaggctctctttgctttgccagaattagtcatggaaacttcacaggaacaccagggcccctcagatatacacagaataccatggagctggggacaaaggaattcacagaactggggagagcagggggaggtctgcagtggggcgt

SEQ ID NO: 48490 - DNA, 601 bp, Human
tttttagataggcaggcaggggatacctctgaggcccttctagatttaagatcctatggtgaaaataaaactgaggctcacagctacatgtgactggtccaagatctcacagttgtagaattgaggcctggccctaggtctccagactttaatcccagcctctttccactaaaccactctacctctttacaaatcaaagccaggaaatgtcttgaatccaaggtcttaaaaaatggaaatgatttttgcaatcaaaaaagatctttgcaagcaaatggagaagcaagttatttgcaaaacyaccagtagaggtgatcgtgcatctgagtctctgggccaaccagaattaagtctgaacataaaatacacgttgaatgtttaaaaaaaagtcttctgaagtaaaataatttctggaagaacagtgtgctttggcaggaaaggaagcttataagcaaagccataaaactgtcagtttaatataccatcatttcactaacatgaagtgggccggctctgtcccctccattcttttcctccttccaactcttttaaaaaagaacagctctacttatgccaaggtggaattttggctctacttgcc

SEQ ID NO: 48491 - DNA, 601 bp, Human
tttgtgttgggtcctttctgaaattctgattcaaagtgcaaggcagcctggatggagagaggctgcaagcaggaaaaccggccaggtttaagactgtaatctagtcggggatgacaagggcctaggacccaaggccaatgttaattttagcaccttcagctgagtgaggctctgcagatatctctgtcctcacaacctctgtgcaggtctctgtatttttagtcccatgtaacagatgcagaggcatcggagagtcaggaaagctctgtgacgcatggaggccacataactagtgagagcwgactcaggaatagaacaaaggccagtctgactccagagcctcaaggttccctcttggggtacaatcaaggcagtgagctttggggagtggggacagttccaagggctggcacagggtgaggtcacaaggtacaatgcagttcttgcaaatagaagtgtttgttctaccactgtaatgattttaggaatgaggtcccaaagcagtatgaggacttcatgtatgcgtagataaccacattggcacatggatgttttctaggagtatgaggtcacaggcaggtccaatatcacaaaagtatga

SEQ ID NO: 48492 - DNA, 601 bp, Human
ggggtggcgctcgatggctgacctgaggggctctccacagcgactatgagaagtgagaaccttggaaggtttgggattgggtaggtaacatgatggatatggtgctttggaatgttaatttgtgttgggtcctttctgaaattctgattcaaagtgcaaggcagcctggatggagagaggctgcaagcaggaaaaccggccaggtttaagactgtaatctagtcggggatgacaagggcctaggacccaaggccaatgttaattttagcaccttcagctgagtgaggctctgcagatatcwctgtcctcacaacctctgtgcaggtctctgtatttttagtcccatgtaacagatgcagaggcatcggagagtcaggaaagctctgtgacgcatggaggccacataactagtgagagctgactcaggaatagaacaaaggccagtctgactccagagcctcaaggttccctcttggggtacaatcaaggcagtgagctttggggagtggggacagttccaagggctggcacagggtgaggtcacaaggtacaatgcagttcttgcaaatagaagtgtttgttctaccactgtaatgatttt

SEQ ID NO: 48493 - DNA, 601 bp, Human
cgtggtgaggaagagggagatgaagcagggtggcaggtgatgatggggagaggggtggcgctcgatggctgacctgaggggctctccacagcgactatgagaagtgagaaccttggaaggtttgggattgggtaggtaacatgatggatatggtgctttggaatgttaatttgtgttgggtcctttctgaaattctgattcaaagtgcaaggcagcctggatggagagaggctgcaagcaggaaaaccggccaggtttaagactgtaatctagtcggggatgacaagggcctaggacccarggccaatgttaattttagcaccttcagctgagtgaggctctgcagatatctctgtcctcacaacctctgtgcaggtctctgtatttttagtcccatgtaacagatgcagaggcatcggagagtcaggaaagctctgtgacgcatggaggccacataactagtgagagctgactcaggaatagaacaaaggccagtctgactccagagcctcaaggttccctcttggggtacaatcaaggcagtgagctttggggagtggggacagttccaagggctggcacagggtgaggtcacaaggta

SEQ ID NO: 48494 - DNA, 601 bp, Human
gtttccaaagctagaaatgagaggagctaggattccaactcgtatcttcaaccactgataactaaactcccatttataaatatccggcatcctactatttttattatatgtgatttaagctcttcaataactccttaagttagacatcattactagccccatttcacaggtgagagagcagaggcttaaataactagaaagtggcagagctagaattctgcccaaagggaaagcagtttatatttgatttattttcatatccagatgacgtaaggaaattatgatgggggtgtgagttgcrtaattagcaagtgtcgggagaatgtgcgttaagagtgcgtcagagatttaggtttaaattacccacatcccacctctattccttacttgctggtcgtgggccaggtgctctctttaaacctcagcttcctcatgtgaaaactgggagtactgattcttagagggttgttgtgaggattaaacgggatgtactgcaggcagcacagtgcctgccacacaactgaaagtggctattactacagtgggcaatttattttcagacaactttcccactgagatgctgtcactaccaccttgggct

SEQ ID NO: 48495 - DNA, 601 bp, Human
tgcaaactccaggtcattattttctgtcccaagccagcttgctggtcatgcagggctcccattggtctagaagccgttctcagctcacatttcattggttcacatgctgttgataaaccaattcttttttgaatgttgctaaggcgaattcaagaaagctagcaggcggggaagaaagaggaagtaattcccagaagtccgcggggattggagagcttttgttttcctaaacagagagtggagataaaaatcaaggatattctccaggcagggccctcttgtggaaactgtgcctgacaaygtaaggcaacacgaaaaaggaagaggaaaaggtttttgctgacgagttgttcccatgagttatggacacacaaatgcataaaaaagcatgctcagacacatgcctgcactcaaagacacccgcacacagctccacaggcaaacacccacaaacctccactcactagtctctgtccttaactagtaattttcattctttaaggctcacatgtcctcatctataaagtaggggtaaatgccaaccctgccctgcggagattcagtgagatacatgtggaagtaccaactgtaaaacaagctg

SEQ ID NO: 48496 - DNA, 601 bp, Human
tatttttgctatggtcccatttagcccctacccatgtctgccactgtcttcaagattaagagggcgaagctgcctgaaagtagaactattctcaaatcatttgctagtcaggcattcccctgttcagacgtgtgcagcagaactgacaaggcagggaatggtctcagtgtatgccacctgagaatgtgggggtattgacaggcactgatctgttggtggctcatcccttccctcccattcactggtggcagaaagccagccccacctcattcaccactcaacccaggggtagtggtggttrcatgaaggagaatgtgatttccccagcttctcatcctgactggctgggcaggcaaaatcacgaaagacctccagactcaaggctactgggctagatgctgtgacaaaaccaacaaagactgcaggaggcacgatggggtcatggggctggctggggtaaggcagggatggaaccagacagtccaccctccaggccatgtctaccacattatgcagagaactcacacccacaagtcttgtaacagtacaattcttatagttggtgaatgttttatactcaagattaggggaaaaaagcaaa

SEQ ID NO: 48497 - DNA, 601 bp, Human
aagctccatgactctcagaggaaactcacaaagaaagagacatttggaaaacaacacaggaagtgcaagaacaggatcaccagggagctggaggggaggaagagggtgagaatttttcaaaggatactttctgaagatactaggtcttaactgattcttaaagggtgagaggagtaagtcaggcagaaatggaaacattgtacagaactatgactatctgaaggacccaaacctgactgaatggtgttctaggcattatcatctcaaagggcaaaagaaggatggctaaaccattggaaaygtggattcgctatttttgctatggtcccatttagcccctacccatgtctgccactgtcttcaagattaagagggcgaagctgcctgaaagtagaactattctcaaatcatttgctagtcaggcattcccctgttcagacgtgtgcagcagaactgacaaggcagggaatggtctcagtgtatgccacctgagaatgtgggggtattgacaggcactgatctgttggtggctcatcccttccctcccattcactggtggcagaaagccagccccacctcattcaccactcaacccaggggt

SEQ ID NO: 48498 - DNA, 601 bp, Human
ttaaaagaaaaaatatccatgctttaaaaatcaggaatctggaataagaattccacgtttttcagggggatgaagaatgcttttataaagagaatgaaatcattggcactgcctgctgatgggtggctccgcaaggtaccacattggccttggccactgtcctctggctcccgacatcaggacttacctcaatgcagagacaggtgggttcccctttctctgtgactgcacattcccggccggctccacaaaacacattggcacagatcttggatttgctccttagctcttcctaaaacayacaatcataaaggaaaccgtgtgactgagatgaacccattatggaatgagcccataatgagattatctttcaggcttgggctttgctctggagtcatggctcatggtcttaaacagctagatgttgggtcttaaacagctgttggagacgttgcctccaacagctagtgccctactcccagatactgcttcagcccaggttcaggtacttctgagtccctaatatgtttctcaaagagcaagagttcctttcttgcatgcttcctttcttctaaaaatgcttgttgagcaccaattttat

SEQ ID NO: 48499 - DNA, 601 bp, Human
ggaacatgtaccaaattgttaacgctggttacttcagactaagggattgaagggttatgggggaagattataattttatgcttgtgtaaatgtctgtactatttgacttatataaaacaattcttattttttaattaaaaaatcttataaagctaaatttttttaaaagaaaaaatatccatgctttaaaaatcaggaatctggaataagaattccacgtttttcagggggatgaagaatgcttttataaagagaatgaaatcattggcactgcctgctgatgggtggctccgcaaggtagcacattggccttggccactgtcctctggctcccgacatcaggacttacctcaatgcagagacaggtgggttcccctttctctgtgactgcacattcccggccggctccacaaaacacattggcacagatcttggatttgctccttagctcttcctaaaacatacaatcataaaggaaaccgtgtgactgagatgaacccattatggaatgagcccataatgagattatctttcaggcttgggctttgctctggagtcatggctcatggtcttaaacagctagatgttgggtcttaaacag

SEQ ID NO: 48500 - DNA, 601 bp, Human
tggtaaacaacccaaagaaccaactgaatgtccatctatgggaaaatgattgaataaatctagttcttttatattactaaacattatgccactacaatgagttaaatgagttaaaagtatatgtgctgatctagagggttgtccctgataaattaatgagtaaagaatacaaactgtatatatctatatccatatcatgatcccatttttgcataaaatagggggaaccattatgtctacagtagcatataaaccctatgcttatagtaacatagaaaagaaaaacatgtggaacatgtaycaaattgttaacgctggttacttcagactaagggattgaagggttatgggggaagattataattttatgcttgtgtaaatgtctgtactatttgacttatataaaacaattcttattttttaattaaaaaatcttataaagctaaatttttttaaaagaaaaaatatccatgctttaaaaatcaggaatctggaataagaattccacgtttttcagggggatgaagaatgcttttataaagagaatgaaatcattggcactgcctgctgatgggtggctccgcaaggtaccacattggcc

SEQ ID NO: 48501 - DNA, 601 bp, Human
aatctcaagtacccagggacacaaacactgcggaaggccgcagggtcctctgcctaggaaaaccagagacctttgttcacttgtttatctgctgaccttccctccactattgtcctatgaccctgccaaatccccctctgtgagaaacacccaagaattatcaataaaaaataaataaattaaaaaagaaagaaagaaaaaaaatctttagctctatttagagatctctgcaacgttcttttaatttctaaattattgcttttatacaatggaataaatacatattcatgtttgtttttcaaaaaaaaaaaaacattaaaaaaaaaaaaccctgcatctcatctactgtttttaaaaatttgcatatcctctgacctagcaagccctggtgtcaatcaatgctacagaaataaaggcaggggcatataagggtatttgcacaaggatgttattggttatagtggtaaacaacccaaagaaccaactgaatgtccatctatgggaaaatgattgaataaatctagttcttttatattactaaacattatgccactacaatgagttaaatgagttaaaagtatatgtgctgatctagagggtt

SEQ ID NO: 48502 - DNA, 601 bp, Human
gagaaatcggatggttgccatgtctgtgtagaaagaagtagacatgggagacttttcattttgttctgtactaagaaaacttcttctgccttgggatcctgttgatctgtgaccttacccccaaccctgtgctctctgaaacatatgctgtgtccactcagggttaaatggattaagggcggtgcaagatgtgctttgttaaacagacgcttgaaggcagcatgctcattaagagtcatcaccactccctaatctcaagtacccagggacacaaacactgcggaaggccgcagggtcctcwgcctaggaaaaccagagacctttgttcacttgtttatctgctgaccttccctccactattgtcctatgaccctgccaaatccccctctgtgagaaacacccaagaattatcaataaaaaataaataaattaaaaaagaaagaaagaaaaaaaatctttagctctatttagagatctctgcaacgttcttttaatttctaaattattgcttttatacaatggaataaatacatattcatgtttgtttttcaaaaaaaaaaaaacattaaaaaaaaaaaaccctgcatctcatctactgttt

SEQ ID NO: 48503 - DNA, 601 bp, Human
aaatggaacaaagttcatatggcaactaggttatgctttggctgctgaaggtgccaagatcacaggcaagttcagtttctttggacttctatggtttttaaaggggagaagcaggaagtaaatttagctcagatccaataaagaaaggaactgaaacaagaaagagcagatggtaaaaagaagcacagagcactggaagtggatggcagcccaacctttccagttttagttgaggataccaaaaacacaaatttcagtgaaccaatatttattatggagtgctcactatgtgctgggcaaygggcaaaaccaaatgtgggcactgtcttcacagcatctcctgagacctcaggtttggtctcagctcacccacatctagttgtacaatttttaggatcaggtttctagatcctaagtccaggcttatgccaccacactgtggccaggtacactgccagtgaggacctcccagagctaatggatccccagtaggatctggcttttaggtttctgagttagaaaacttcctttctggggcaacaaatcaggatccttaacctggggactaaattggttgtatttaatttgcagaaagacgtgt

SEQ ID NO: 48504 - DNA, 601 bp, Human
caaacacacacacatgtgcgcgcgcgcgcgcgcgcgcacacacacacacacacacacacacacacacacacactccaattcttctgcagcctaactgtaaggatctcttgctgtatatactattgggggaacactttgttttcctcctgatctcaagcctttgttgtgaagctaggagtagggttgcctgggtctttgtgaagtactacagagaatcattatggacagggaaatggaacaaagttcatatggcaactaggttatgctttggctgctgaaggtgccaagatcacaggcaagytcagtttctttggacttctatggtttttaaaggggagaagcaggaagtaaatttagctcagatccaataaagaaaggaactgaaacaagaaagagcagatggtaaaaagaagcacagagcactggaagtggatggcagcccaacctttccagttttagttgaggataccaaaaacacaaatttcagtgaaccaatatttattatggagtgctcactatgtgctgggcaacgggcaaaaccaaatgtgggcactgtcttcacagcatctcctgagacctcaggtttggtctcagctcaccc

SEQ ID NO: 48505 - DNA, 601 bp, Human
agagctgggaatgtggagaggctgataggcaggcaggcaaacacacacacatgtgcgcgcgcgcgcgcgcgcgcacacacacacacacacacacacacacacacacacactccaattcttctgcagcctaactgtaaggatctcttgctgtatatactattgggggaacactttgttttcctcctgatctcaagcctttgttgtgaagctaggagtagggttgcctgggtctttgtgaagtactacagagaatcattatggacagggaaatggaacaaagttcatatggcaactaggttaygctttggctgctgaaggtgccaagatcacaggcaagttcagtttctttggacttctatggtttttaaaggggagaagcaggaagtaaatttagctcagatccaataaagaaaggaactgaaacaagaaagagcagatggtaaaaagaagcacagagcactggaagtggatggcagcccaacctttccagttttagttgaggataccaaaaacacaaatttcagtgaaccaatatttattatggagtgctcactatgtgctgggcaacgggcaaaaccaaatgtgggcactgtcttcacag

SEQ ID NO: 48506 - DNA, 601 bp, Human
gtggtcgtggaggaaagaccatgtggtcagccaggccacactgctctgttccttggctccccgtggctaaagctgccttgcagtggtgagagcacaccttacctttgcagtgtccatcgtaatcaacctggattttggatccagtgaggcaggcatctcgatgcagttcacagtggttgaggtaggtcttgccattactgccacacacaggcctcttgtgaggtttgcattgctgaaacagacccaaaagagaatgtttgtgcagttatggatatcgacacacagacacacacacacacayacatgcacacacacacacagagccattttgtaaggggactctccaccaccagagatggtgcttctaccccatcagggcacaggcagtcacagttctggccaactgaccctgtctcagttgcctatggcccttcatgcctatcctggtccagggtcatctcttctattcagtgaagaaagagacaccctctatagtttcaatgtttgtgatccctccaaaattcatgttgatacttaatccacaatgcaaaagtattaagaggtgaggcctttaggaggtgattaggtcatgaggactcct

SEQ ID NO: 48507 - DNA, 601 bp, Human
ctgtgttgaggagtggccagttctgggacacaattctgatgcatagaagatcttatgagcttggcagggattgtggaacacaaaatttctatcatgaaaagaatgtcctccctgagatgcacacagtagaaaaaataggcactcacctgggctggcagatggacttacggatttcttctctgcaagacaaaaagagaaaacgtgtaatgcgaagtgaaggaaaaaagaaaatttttctgtatttctaggattacagctgctctacatgtaggggaatgtttgtaaccttttcatcattttrtcttgaatcctttcccttcctttccttcttctagggcccaggtatgaggatcttctgtctcctgctttgtctgacaatttagggccactgagttacccttctggcctcatacctcctcctgttgcattgaggggtcactgggattttgagaattcaaatggagaatcattctggacagggaatggagtggagacaatcacctgggaaacagcttcttgtttcttcaaggaagggcaaggctgagaggggctgggcagggctatggcttggcagggggctggtatctaattagcaacaagt

SEQ ID NO: 48508 - DNA, 601 bp, Human
atgagaatattacagtttttatgctactagatttctgattttctccagtttctccctttctcaccaactaggtccatccaaacttccccccacttacaactgtataccacctgcatcatcctttattatgaacaacagaatgtgaaggccagtgagggctacgtcgaagccctgctctggacagctgttgtccactggaaataacagggggtgctgagagttgagtggatggggaagcagaggagagaaagctttggcaaaagagaattcctggaagacaacacatgctgtgggtgaaaarggcactgggccaggggaatgaaaatctgggagttcttccccagtctgccaattactagctgtgtgatatagaaaactcacttagcctctttgagcctcaatttcctcatctatatggtaattacaataagatctacttcacaaaggctaccgtgagaatctaaggaaagtatgtgcaaaaaagctctgtaactataaatcatgataaaattttagtgatcactaatagaaaaccacagaagtcttactggcatttccagttatcccctttcaaaaagagttgtgccttctatttgctggt

SEQ ID NO: 48509 - DNA, 601 bp, Human
ttagcacatccagggtacacaactggaaaaagtctagcccaggattcaagcacccatctctaaaatatttgtaaagattgagaatattgaaacagagagattttgctgcttatgtgagaaataactagagcagaaaaataataaaggatactttcattaactttaggaagctgaaggggaaaaaatcaataaagcagctctcttgactcaaagatgagctgaaataatacatgaataaatgagaatattacagtttttatgctactagatttctgattttctccagtttctccctttctcrccaactaggtccatccaaacttccccccacttacaactgtataccacctgcatcatcctttattatgaacaacagaatgtgaaggccagtgagggctacgtcgaagccctgctctggacagctgttgtccactggaaataacagggggtgctgagagttgagtggatggggaagcagaggagagaaagctttggcaaaagagaattcctggaagacaacacatgctgtgggtgaaaagggcactgggccaggggaatgaaaatctgggagttcttccccagtctgccaattactagctgt

SEQ ID NO: 48510 - DNA, 601 bp, Human
tcagagctgccaagaaaagtccttcatgtgtctgaagttgctcctgagtcctggctgggttgggccctggaagcatgtgagggagtagatggctggggcatctacctagtgaagagggctttggtgcttgcatggaaatgtgggtatctgaatgtgtctgcatgtaggatgtgtctctgtgtggcatgtgagtctctgtatgtggtgtgtgtgtgcgtgtctggcatgttttgagtttaagtgtgtccttctctgtgcttctgagtgtgatattctgagtgtgatgtacctgtgtgtgtggctgttcttgtcaatcagctgtaagaatgcccttaattgcttcttctaactctcaagttctgtgaaagatctgcatggcatgataacccgagccatcactaaatattatagcttccttcatttctctttgtgaaaatagcatctctcctgctcccaagtggaacactctgtctcttcaactaattatgattgggaacagcaatatctaagttcaggaacaatctctggacccatgaaatgccagtccattgattcttctcatatgaagactctctccaagccattggcagtcaagttaatg

SEQ ID NO: 48511 - DNA, 601 bp, Human
attgcagggcaaagtcactgctcacacacagcaggccctgcaggtacctttaccattcgctcagcttttgaacagtcactttctttacattactttctgttcctgtccaagtctcctggctcagcactatgatgtgtttttctgtagaagaggaaccattcttcctctaagggctctgtaatgtgggagtgattgagagagaggacagagcaagaaaggctgtgctttttcatctgggtatgatctcaaaaacttggaatccagagatttagtatctgccatagaggagagaaatctctaygtaaaaatgacacaagtgaagtcttaaatgaccaaatatccatttgaagccaacccagtatttcttcatctgcgggttctatagtgtcagaaagagaaatccacagactagactggcattggccacattaggtggcctcagagctgccaagaaaagtccttcatgtgtctgaagttgctcctgagtcctggctgggttgggccctggaagcatgtgagggagtagatggctggggcatctacctagtgaagagggctttggtgcttgcatggaaatgtgggtatctgaatgtgtctgcat

SEQ ID NO: 48512 - DNA, 601 bp, Human
gactcttcagaggagatgggctgagacaggcacttgcttgtgcacagcagctggggctgtgtgggctgtggtgccagggtaaaggagataagaaggctggctcaagtgtcagccctggccatcaggagccacagggattgagatcacacccagatgaaattaggaatggattagattccaaattccaagagcatggaaggctctttctacctgggtctttctttcttcattctgttacgctttcacctaagaaacagtgactacatcactggttatggtgaaagtcagattttggccttaytcaaattctaattcaatttggtttttgaacaattttgatgtaagaaatgccagctgggctggggagcatttcattggttcataacagtctctttgagatatcagacctctcaccaacaggcagctgctgacctaggaggaggcagtctccctttgaagacagcagcatgtaagactctgataatcatcaaaaagtagaaaatgaaacctgttttctcctgttagacactgccagagtgtctgggaagaggggattttgtgtctgtcagtcatgatcaagctttcttagatgcctggttgt

SEQ ID NO: 48513 - DNA, 601 bp, Human
agttcaaatattgcatgtgctgggtaaatgacagcaaccctcaaagactccagtgtcatcagggcctgatgatggaatgagtgtagggaggggaaacgtccagcactagctacagacccagtgccacatggcccaagtgggcaccatgaacctggcaaccacagtccaggcagctctcaaaaggcagtgctgtgtacacacacttcagtaggactagaataaggcctgcagctgggggaaggtccagcccatgtgctttctcaactcatgagggtccagttgggcctccccaggccagagytgtatgtagaatccacaggaacacagaattctggtgcctgccccagaaatagcctggaatgcctggggggtctgcctgtgaggtcctaatcatggaccatgaaccaacctaatttattgagcctctcttcagccagtcagttacaaagacataatatctctctgtgcctctttccccagctctatacaggttgattatcccttatctgaaatgcttgggaccagaagtgtttcagatttcagattttggaaagtttaaatatgtataatgagatatcttggggatgggatccaaatgtaa

SEQ ID NO: 48514 - DNA, 601 bp, Human
acaggggtcatcatgcaaagttcccgctcctctgccctgtgggccccactgcagatgtgtgcacaggtcctcagatcatccagctcaggctgccctcatgacccagctggcatcccacaagcacaaagtgaggagtgcagtaagctcacacactgttctctatggcaagatgctaaactgagacctcagccatctgggaccattcaagacacccaggcactagctgcaggaggagggtgtcaaatcaagactgatcaaattccaagttgcatatggctgctctcctaacaaatttcaatarcattttcccccttcctcccaaatcctttccctaggctccctcatgctgctgccctgggaaaggatcagcttccccatgttactttcaagatggctccccagatggtgcaagggattctggaagaaacatctatccaaatttctagatagaaggggaagatgtagctaacaactctcctctcctgcttgccatgtgtcacaggtgttccactctaatgttgtataatgaaggtgtgcatgaaacaactattaggcctttgcttagtacgtacttatcattcttgtcctaattcctaggaac

SEQ ID NO: 48515 - DNA, 601 bp, Human
aaagtagacgggcatatatctgtaacagttagggcaattgacatgaaatagcactaattatctaaaaatcagaacaaagctattttagacctatagttaaataatacattactgtaattccttcagaaaattaatcagtaaaacatcacccacaacattcagaaataacttgctctgacgtgcccttggcaatttattttaaaattatattcttctagtccttgcaagttctgaccaaaaacaataactatttgattagatatcagtggtactcaatatattaattcatactttcatagamtagaacaggacagaattcccattttgctttttacgtgacattctctcactggtggctcttttgcaggtgggaaagggtttaagtcccctctctcagttagtcttcccttgtggatcattctctgacctctcggttcctctcacctaagcaacttgttgttctcctggtctggatacgttgtaatattgatggcagtttcattctgttccacaaacttcaggaattcactggagtccaggcgagaatcaccattatcaaagttctagaaagggcatgacaagatcgttcagggatgttttg

SEQ ID NO: 48516 - DNA, 601 bp, Human
caagcaagaatcaccattatcatccttctagaaagagattttcagaaaagcttttagaactcagctccatcagcttgcagtgagccgagatcccgccactgcactccagcctgggcgacagagcgagactccgtctcaaaaaaaaaaaaaaaaaaaaaaaacaaaaacaaaacaaaacaaaaacaaacaacaaaaaaaaacaaaaaacaaaacaaacaaaaaaaaactcagctccatcacttctttcttgggctgtatttgagccctggctcaatcacttactactcaaatggacttgagytagttattcaacttttctgagcctgtcttcccatccgtaaaaggaggacaagaagccctccttcactgggatatcatgaggctcaaacgttgaaattataaaacatataatttcagattatcaaaatatgaaggatttacagaacctatactttaaggtcatagactattattaaagaagaatccttctagaaactgtgcaatgcacttcttttgaaaaaaagacatgcttttcctatttttaattcttaccgatgtgctgaaaccacatcaaaagtttcttagcgattagtttttatta

SEQ ID NO: 48517 - DNA, 601 bp, Human
gtatatacacgtcaagtcaaccaaactaggaaaatcaaaacagaagagatatgacagatgacatgaaaggaatataggatttgaaagaatatgaagttcaagcaagaatcaccattatcatccttctagaaagagattttcagaaaagcttttagaactcagctccatcagcttgcagtgagccgagatcccgccactgcactccagcctgggcgacagagcgagactccgtctcaaaaaaaaaaaaaaaaaaaaaaaacaaaaacaaaacaaaacaaaaacaaacaacaaaaaaaaacamaaaacaaaacaaacaaaaaaaaactcagctccatcacttctttcttgggctgtatttgagccctggctcaatcacttactactcaaatggacttgagttagttattcaacttttctgagcctgtcttcccatccgtaaaaggaggacaagaagccctccttcactgggatatcatgaggctcaaacgttgaaattataaaacatataatttcagattatcaaaatatgaaggatttacagaacctatactttaaggtcatagactattattaaagaagaatccttctagaaactgtgcaa

SEQ ID NO: 48518 - DNA, 601 bp, Human
ccccatggtatatacacgtcaagtcaaccaaactaggaaaatcaaaacagaagagatatgacagatgacatgaaaggaatataggatttgaaagaatatgaagttcaagcaagaatcaccattatcatccttctagaaagagattttcagaaaagcttttagaactcagctccatcagcttgcagtgagccgagatcccgccactgcactccagcctgggcgacagagcgagactccgtctcaaaaaaaaaaaaaaaaaaaaaaaacaaaaacaaaacaaaacaaaaacaaacaacaaaamaaaacaaaaaacaaaacaaacaaaaaaaaactcagctccatcacttctttcttgggctgtatttgagccctggctcaatcacttactactcaaatggacttgagttagttattcaacttttctgagcctgtcttcccatccgtaaaaggaggacaagaagccctccttcactgggatatcatgaggctcaaacgttgaaattataaaacatataatttcagattatcaaaatatgaaggatttacagaacctatactttaaggtcatagactattattaaagaagaatccttctagaaac

SEQ ID NO: 48519 - DNA, 601 bp, Human
ctagcaattgcttttccccatggtatatacacgtcaagtcaaccaaactaggaaaatcaaaacagaagagatatgacagatgacatgaaaggaatataggatttgaaagaatatgaagttcaagcaagaatcaccattatcatccttctagaaagagattttcagaaaagcttttagaactcagctccatcagcttgcagtgagccgagatcccgccactgcactccagcctgggcgacagagcgagactccgtctcaaaaaaaaaaaaaaaaaaaaaaaacaaaaacaaaacaaaacaamaacaaacaacaaaaaaaaacaaaaaacaaaacaaacaaaaaaaaactcagctccatcacttctttcttgggctgtatttgagccctggctcaatcacttactactcaaatggacttgagttagttattcaacttttctgagcctgtcttcccatccgtaaaaggaggacaagaagccctccttcactgggatatcatgaggctcaaacgttgaaattataaaacatataatttcagattatcaaaatatgaaggatttacagaacctatactttaaggtcatagactattattaaagaag

SEQ ID NO: 48520 - DNA, 601 bp, Human
ccactagcaattgcttttccccatggtatatacacgtcaagtcaaccaaactaggaaaatcaaaacagaagagatatgacagatgacatgaaaggaatataggatttgaaagaatatgaagttcaagcaagaatcaccattatcatccttctagaaagagattttcagaaaagcttttagaactcagctccatcagcttgcagtgagccgagatcccgccactgcactccagcctgggcgacagagcgagactccgtctcaaaaaaaaaaaaaaaaaaaaaaaacaaaaacaaaacaaaamaaaaacaaacaacaaaaaaaaacaaaaaacaaaacaaacaaaaaaaaactcagctccatcacttctttcttgggctgtatttgagccctggctcaatcacttactactcaaatggacttgagttagttattcaacttttctgagcctgtcttcccatccgtaaaaggaggacaagaagccctccttcactgggatatcatgaggctcaaacgttgaaattataaaacatataatttcagattatcaaaatatgaaggatttacagaacctatactttaaggtcatagactattattaaag

SEQ ID NO: 48521 - DNA, 601 bp, Human
ctaaaacagcctctctctacactgacccaacacaactattatccatcctgaccaatgcaggcatctaacctttagtttgttatatgaatgtcagatcacccaggctgtccaaatgttcccccccttaagatgactaaagtttcgtgaatggttttgtctaatgttttcactgcctgcataccttccactagcaattgcttttccccatggtatatacacgtcaagtcaaccaaactaggaaaatcaaaacagaagagatatgacagatgacatgaaaggaatataggatttgaaagaataygaagttcaagcaagaatcaccattatcatccttctagaaagagattttcagaaaagcttttagaactcagctccatcagcttgcagtgagccgagatcccgccactgcactccagcctgggcgacagagcgagactccgtctcaaaaaaaaaaaaaaaaaaaaaaaacaaaaacaaaacaaaacaaaaacaaacaacaaaaaaaaacaaaaaacaaaacaaacaaaaaaaaactcagctccatcacttctttcttgggctgtatttgagccctggctcaatcacttactactcaaatgga

SEQ ID NO: 48522 - DNA, 601 bp, Human
ggctcctacaaaatgcctccattcactacagctctctatttcttaggttaggcatactcttctcaggagggttgaaagatgggttgaggcacttgagaaactcttggaagctgagtttccaatcagcattttcatcagacagttcaatgagagcatcaacacagagtcccctgaaacaaaacacaggagaaatgtgttagcaagacctcagcttcgctcagaagaaaggaagtaagcatcaggaccacatacacccagggcctccacaggaggccaagaagatgactgctaactaaaacascctctctctacactgacccaacacaactattatccatcctgaccaatgcaggcatctaacctttagtttgttatatgaatgtcagatcacccaggctgtccaaatgttcccccccttaagatgactaaagtttcgtgaatggttttgtctaatgttttcactgcctgcataccttccactagcaattgcttttccccatggtatatacacgtcaagtcaaccaaactaggaaaatcaaaacagaagagatatgacagatgacatgaaaggaatataggatttgaaagaatatgaagttca

SEQ ID NO: 48523 - DNA, 601 bp, Human
gagaagtcattttgtcttccaaccactagtcttttaccatttcctaaggtgttataaggatcaatgggttaatatgtaaagtgcttagaagagagcctggcacatggtttttgctgagtatttgctttcactgttactattccattattatttttgattattattaaataataattattgtttttattttaatgttttaattattaaataattactatttttaattattattccattattactactttcactgttactatttccataatgttactattccattatcatttacttttgcccrgggtcttggtcctctcttattccaagcctctggagtgattttcaaactgaatgcctatgggataaatgttctgccctcaaagctccccacttggggctccaaccttacaggtgtgggtctgcctgggttccttgctcccagccaccgccctcttctccatcatccccaccccaacttctctcatgctgatttcatgaagctctctccttgctgttttttctttctgcttgaagcacagctcaccgtcacaggtcatggctgtacagacccaatttccacaggcacagacacagcggttac

SEQ ID NO: 48524 - DNA, 601 bp, Human
atttgaaaagatagctgtctagttccaccttcagagattctgatttaattgatgtgaggtgagatctggacaccagtatttttttacaagtctttctagttggttctaatgtgcagccagggttgacaaccatttcatctagcaatgtttctgaaacttgcacagtgataaacaaaaacaaaaactacacaggttcccaagctgctcttttgcaaattctgatttactaggtttaggatgaaatctctaggcttatcaagtagaatgttgaccattaggaaacacttctaggacatatctyccaaacattgctatcaaccttcccttcacagcagtttcccttggctctgcctcctcctggcttcaaattttgatgccccttcttgcttgtcccattttgatttgtgatctaagatcagactgctaactctcaggtattaacctgaaaatgccccagaatgctggctccacaaactcctcttagatccacggcctacacatccatacgtgctcaggcccctggggcaccaccatctaacatgggttgctccatgttatacccacatagagttctggacttggtcatccagggaggatgagc

SEQ ID NO: 48525 - DNA, 601 bp, Human
gaaggttgtagaatatatctggagctcttcaaaatagactagaaaagtctcatgattcttgccattcactctaacagatttcttacaggagctctgggttcttggttttgtaattctctacagatgttggttttaacagtggaggcttcatcactcttgaccacagtagaaggtgttatccagtcccttagagtaatctaaaataacatgcttctactacatttatttgtcatttgagtcatattaatttaattaaactttctaaaaggagatgattccactacttatatatcagtatttrggagactgatcatgatactcttgaatttcacctggattctgaatgaaactagttgactcaatagatggcctgtggaagagatggcctaacattccatccagtacagtcaaggtgacttgaatcaaggagttagggtagagggcatgaaagtattttatgaaataaagctaaaactgaaacaattgtgttgtggccagtctgaacaaagactatttttaatgtgagggctatggtcagcatgaagatgaaaagaaggggtgcctgagagcaagaataagccacttaatcttaatgtcactc

SEQ ID NO: 48526 - DNA, 601 bp, Human
tgctgattaggtgatattaggctctagtttgccagttctgatgttttgagttttgtttttgtttttttttttaaactattaatacccaacaacttcctttggtctgtacattccttttagaaatctttgtgtttttctctattattctttcttgttttgctcggtattcatctctctgtcctctcctctactcccaccccattatgaagaagatgggcaataaaaatttggtgtgtgtagtaaggaaggagggaactttttctgctgtaataattatgccttgtctaaattggtagattgyagttttctttctaagcccagtcctgtacaaatacccagtttcttggttgctagaggagattgataatatttctgatcaagtgatggaagtatttaatggccttctacctccatttcttttcaatagttcttagattgacttatggtttacataagcaattaggggatattcagaaattggatttgaagcctgctagattttactgttttccctgacaaaaggtgcttaactcaagtgtatgggcagctctctgccacaggacaaagggtagtaactcctagatgagctcctgaggaccac

SEQ ID NO: 48527 - DNA, 601 bp, Human
aaagccaggtgtggtggcgcacacctgtagttccagctactccggaggctgaggcacaaggattacttgaacctcggaggcagaggttgcagtgagccaagatcacgccactgccagcctgggcaacagagcgaaactctgtctcaaaaaaataaaataagtaatatatgaatgaaaacttggtaaagacacaaatagtagagaggtatgtaaactaaaatggcaaactagtttttcctctctgtggcttttccgctcactgcactcccaccaattttctctgtcataacagagaaactaygaagtttttgcttatccttccagtcctgttaccttgtatccctaacaccatcctccagaagccctttagaaatctaacaatgtaaagtgattctttttttattttttaaattttatttttttattatacttttaagttctggggtacatgtgcacaacgtacaggtttgttacataggtatacatgtgccatgttggtttgctgcacccaacaacccgtcatttacgttaggtatttctcctactgctaatccctcccccagcctcccacccccgacaggccctggtgtgtgatgttccc

SEQ ID NO: 48528 - DNA, 601 bp, Human
ctgctttttttcctggactatcattttcaaggatgtttatataacgagcagccttgcaagacagagatagtatttctcttcagagcaaagagcaggtttgcttatggtccagtataaaaagtgtctccttccagagcatgtttacatagagtttatagtaagtaaggataatgccaccctccagtgcaaagaatgggcatgcttatgcccattataaaatatttgagttccttttaagctcaggctctctttcctgtaacacaacccattgcatgtgtaattgttacctggcccttctatygcaccccatggaaattggggcatggggaactggcttaaatactgacactggctactgctatttccttgagtagtgaagttctttgtctctgacctggggtcttgtgtcttctgccagtatccatgaaactggcagaataacttgttagcttacaagtagggtaaaatctcagacccttcacagttcttagtaataatgttaaagctgctgttttcatacctgcaaaatcagcccttctgtaagtaactcctgttaagtttggatgagattagaatttaggtgccttatgactatatactt

SEQ ID NO: 48529 - DNA, 601 bp, Human
tgtgtcttctgccagtatccatgaaactggcagaataacttgttagcttacaagtagggtaaaatctcagacccttcacagttcttagtaataatgttaaagctgctgttttcatacctgcaaaatcagcccttctgtaagtaactcctgttaagtttggatgagattagaatttaggtgccttatgactatatactttatttttccccctattctttttcatgaaaataaattactcgagttaaaggactgtcattctgagattgtccttctgtgaaataatgatattagtgttgttctctttctctcttttccccaaataaaagcactgctgttttatgaggatgagctacactgacaagcatgttgatttgtttacttaaagctgaagtttggagtacatattgtcttaaaatgagaaatggggtatttgggaggacatttttttaaaattcgggtataacatgactttttaatgataaattagataaataataaaacatgttggataatgataatgctaagggaaaagaaaatgaaagaggatacgattgtttgggtggacaagacagttgaaattttagataatgttggctacaga

SEQ ID NO: 48530 - DNA, 601 bp, Human
gtcttctgccagtatccatgaaactggcagaataacttgttagcttacaagtagggtaaaatctcagacccttcacagttcttagtaataatgttaaagctgctgttttcatacctgcaaaatcagcccttctgtaagtaactcctgttaagtttggatgagattagaatttaggtgccttatgactatatactttatttttccccctattctttttcatgaaaataaattactcgagttaaaggactgtcattctgagattgtccttctgtgaaataatgatattagtgttgttctctttctctcttttccccaaataaaagcactgctgttttatgaggatgagctacactgacaagcatgttgatttgtttacttaaagctgaagtttggagtacatattgtcttaaaatgagaaatggggtatttgggaggacatttttttaaaattcgggtataacatgactttttaatgataaattagataaataataaaacatgttggataatgataatgctaagggaaaagaaaatgaaagaggatacgattgtttgggtggacaagacagttgaaattttagataatgttggctacagaagg

SEQ ID NO: 48531 - DNA, 601 bp, Human
attttctaatccagtaccgtgtgtcagttaggatgcctttgcctgtgataacagaatatccagctctagttggaattagaatccagtctagcagtagattgaacaataagaaaatttgtcttgcatgactagaagtcttgaagtagtacagttcaaaactggttaatttcacagctcaattatatcttcagggatctagatttgttccatctttatactctgctgaactcagcctgttgattatcctcttgggaccatgaggggagctagtctaatatggccatgtatttctaggtatcaygtgcagatgacaatgtccaaatgcagaaaaagggaccgtcccttccttgtgtcctattttaaaactgaagaaaggtttcccagagggctccctaggatactctatttatcccctgatgtctcactggctgcaattgttttatatgcatatttctaaaccagcagctggcaaaggaaatgagatcacatgactggtacttagactagttaaggtttaccttctaggactggggaaggtcccagagttctttggagcaaattgccattggtattttaataaaaccaataagcaaagaaagaa

SEQ ID NO: 48532 - DNA, 601 bp, Human
agaagtcttgaagtagtacagttcaaaactggttaatttcacagctcaattatatcttcagggatctagatttgttccatctttatactctgctgaactcagcctgttgattatcctcttgggaccatgaggggagctagtctaatatggccatgtatttctaggtatcacgtgcagatgacaatgtccaaatgcagaaaaagggaccgtcccttccttgtgtcctattttaaaactgaagaaaggtttcccagagggctccctaggatactctatttatcccctgatgtctcactggctrcaattgttttatatgcatatttctaaaccagcagctggcaaaggaaatgagatcacatgactggtacttagactagttaaggtttaccttctaggactggggaaggtcccagagttctttggagcaaattgccattggtattttaataaaaccaataagcaaagaaagaaaggagccacagttgataggaaactaataacatctgtatcacagatagccttaacttttggtactggttatttatttctttttgtgtaagaaaaggaattcctcttttgaaaaaggaatttttctttttgt

SEQ ID NO: 48533 - DNA, 601 bp, Human; identical to SEQ ID NO: 23297

SEQ ID NO: 48534 - DNA, 601 bp, Human; identical to SEQ ID NO: 23298

SEQ ID NO: 48535 - DNA, 601 bp, Human; identical to SEQ ID NO: 23299

SEQ ID NO: 48536 - DNA, 601 bp, Human; identical to SEQ ID NO: 23300

SEQ ID NO: 48537 - DNA, 601 bp, Human
atgaaaggaaagcagcacaattataattgaaattgggggattctttcccctattgaaatccaaataattttcctttattgtgctttttttttttttctttaggaccacaagaaaaaaaagtagtggtgtaccttcagaagctggatacagcatatgatgaccttggcaattctggccatttcaccatcatttacaaccaaggctttgagattgtgttgaatgactacaagtggtttgccttttttaaggttagttttgttggaagttggatttacattttcaatgatttgatatctgaaamctcttctgattagtagaccctcagaattttaattttagattaagaagttgaccggaattgacaccactcttcccaagagtagtagtagttggtataattttgccactttatttaaaattatgattttagtaggtttacaaaataccagtgctacatttgaatatgtataaattatgtttaaaatttacattttggtaagtatgactaaattcttaatttattttcattattactaccactttatttctaaatgttgccatagtcatttggctttgttctaaatctgtaggaaagatacag

SEQ ID NO: 48538 - DNA, 601 bp, Human
cctattgaaatccaaataattttcctttattgtgctttttttttttttctttaggaccacaagaaaaaaaagtagtggtgtaccttcagaagctggatacagcatatgatgaccttggcaattctggccatttcaccatcatttacaaccaaggctttgagattgtgttgaatgactacaagtggtttgccttttttaaggttagttttgttggaagttggatttacattttcaatgatttgatatctgaaaactcttctgattagtagaccctcagaattttaattttagattaagaagwtgaccggaattgacaccactcttcccaagagtagtagtagttggtataattttgccactttatttaaaattatgattttagtaggtttacaaaataccagtgctacatttgaatatgtataaattatgtttaaaatttacattttggtaagtatgactaaattcttaatttattttcattattactaccactttatttctaaatgttgccatagtcatttggctttgttctaaatctgtaggaaagatacagagattacacattttgttttcttgcagttactatgctgtccttcctatc

SEQ ID NO: 48539 - DNA, 601 bp, Human
caagtggtttgccttttttaaggttagttttgttggaagttggatttacattttcaatgatttgatatctgaaaactcttctgattagtagaccctcagaattttaattttagattaagaagttgaccggaattgacaccactcttcccaagagtagtagtagttggtataattttgccactttatttaaaattatgattttagtaggtttacaaaataccagtgctacatttgaatatgtataaattatgtttaaaatttacattttggtaagtatgactaaattcttaatttattttcmttattactaccactttatttctaaatgttgccatagtcatttggctttgttctaaatctgtaggaaagatacagagattacacattttgttttcttgcagttactatgctgtccttcctatcactacctgttggctgaggtagtgataggcctaaatgattcattatcttaaatgtactaaatatgttgagtaattttttcttctaaactaacagaaagagagaacctaggagttactcccttaggctggttaaagtgaaaggtagccaagtcaacccagcttgtttccttctctcatta

SEQ ID NO: 48540 - DNA, 601 bp, Human
tgatatctgaaaactcttctgattagtagaccctcagaattttaattttagattaagaagttgaccggaattgacaccactcttcccaagagtagtagtagttggtataattttgccactttatttaaaattatgattttagtaggtttacaaaataccagtgctacatttgaatatgtataaattatgtttaaaatttacattttggtaagtatgactaaattcttaatttattttcattattactaccactttatttctaaatgttgccatagtcatttggctttgttctaaatctgtrggaaagatacagagattacacattttgttttcttgcagttactatgctgtccttcctatcactacctgttggctgaggtagtgataggcctaaatgattcattatcttaaatgtactaaatatgttgagtaattttttcttctaaactaacagaaagagagaacctaggagttactcccttaggctggttaaagtgaaaggtagccaagtcaacccagcttgtttccttctctcattaggaaagaactattgttcattctcataacacactttttccaattgcaaacatactcagggtta

SEQ ID NO: 48541 - DNA, 601 bp, Human
aaactcttctgattagtagaccctcagaattttaattttagattaagaagttgaccggaattgacaccactcttcccaagagtagtagtagttggtataattttgccactttatttaaaattatgattttagtaggtttacaaaataccagtgctacatttgaatatgtataaattatgtttaaaatttacattttggtaagtatgactaaattcttaatttattttcattattactaccactttatttctaaatgttgccatagtcatttggctttgttctaaatctgtaggaaagatasagagattacacattttgttttcttgcagttactatgctgtccttcctatcactacctgttggctgaggtagtgataggcctaaatgattcattatcttaaatgtactaaatatgttgagtaattttttcttctaaactaacagaaagagagaacctaggagttactcccttaggctggttaaagtgaaaggtagccaagtcaacccagcttgtttccttctctcattaggaaagaactattgttcattctcataacacactttttccaattgcaaacatactcagggttaaaatagttta

SEQ ID NO: 48542 - DNA, 601 bp, Human
ttgccactttatttaaaattatgattttagtaggtttacaaaataccagtgctacatttgaatatgtataaattatgtttaaaatttacattttggtaagtatgactaaattcttaatttattttcattattactaccactttatttctaaatgttgccatagtcatttggctttgttctaaatctgtaggaaagatacagagattacacattttgttttcttgcagttactatgctgtccttcctatcactacctgttggctgaggtagtgataggcctaaatgattcattatcttaaakgtactaaatatgttgagtaattttttcttctaaactaacagaaagagagaacctaggagttactcccttaggctggttaaagtgaaaggtagccaagtcaacccagcttgtttccttctctcattaggaaagaactattgttcattctcataacacactttttccaattgcaaacatactcagggttaaaatagtttagcacaaattgcagcccatttcatttgttcttcacaagctggaacttttcttgtaagctaaatattaaatggttcaagtaaattggatacataagcctgaaac

SEQ ID NO: 48543 - DNA, 601 bp, Human
tggctgaggtagtgataggcctaaatgattcattatcttaaatgtactaaatatgttgagtaattttttcttctaaactaacagaaagagagaacctaggagttactcccttaggctggttaaagtgaaaggtagccaagtcaacccagcttgtttccttctctcattaggaaagaactattgttcattctcataacacactttttccaattgcaaacatactcagggttaaaatagtttagcacaaattgcagcccatttcatttgttcttcacaagctggaacttttcttgtaagctaratattaaatggttcaagtaaattggatacataagcctgaaactaggcgtttctcattatacatagagtataaattaagacagactttttcatggtgaaaggtttacagcctttaaaacatctgggaagaagtgggaaagtagggaataactctgttaaatatgataaaagacaaagcaccaacaaaggcctagttctaaacttgttataatttctcatgggagttgtggtttgtcacaaggttatggcggtccaagcaagtttacaatattttttagaataataactcccagaaatattt

SEQ ID NO: 48544 - DNA, 601 bp, Human
aattgcaaacatactcagggttaaaatagtttagcacaaattgcagcccatttcatttgttcttcacaagctggaacttttcttgtaagctaaatattaaatggttcaagtaaattggatacataagcctgaaactaggcgtttctcattatacatagagtataaattaagacagactttttcatggtgaaaggtttacagcctttaaaacatctgggaagaagtgggaaagtagggaataactctgttaaatatgataaaagacaaagcaccaacaaaggcctagttctaaacttgttayaatttctcatgggagttgtggtttgtcacaaggttatggcggtccaagcaagtttacaatattttttagaataataactcccagaaatatttttaaaataaggacctttctttaatatggaaaaaaaaaagatgaaatagagaggaagaggttgcctttcctcaactggatttgctggtgtgatatgcagctggtggaaaccagtttgtccatgctagctgttgatggccaccagtccactgaattagtggaaacccatgcttaaccagttgttaactatttttagtatcatttccagat

SEQ ID NO: 48545 - DNA, 601 bp, Human
attttagtaaatccaattgcaagagtgatgggaaacagagtttaaaaacttaagaaagatattaagatggagttgactttgaataataaagtcatccactgttgatgggtgacatttattaatacagaaagtttacagattttaccataagcatcagggtatttcctgcagctggggaaaccgtgcttgaaaggatgcgtaactcaaggaaaacacaagcccatgtaataagtattgcatgtgagaattgttcctatagaattagaaagcatcttttacattaaaatttatttttgtaaaragagaaaacatcaaaacttgagtagtatttgctattcaaagagtcttacataaacgaaaacatactcaacctactgccattacagaaatatttgacaaattcttgccatgcttacctgccatcgttgttgttatcctacaaatcaattggattttcacgcctctccactgactggaaccctacaacttgcttccttttatcctctttatatatgcttcagatatgcttgaagtagattgtttcttattgttcttgctgctcgagtttgttgagtagttggtacatgcagagtatttgtat

SEQ ID NO: 48546 - DNA, 601 bp, Human
aattggattttcacgcctctccactgactggaaccctacaacttgcttccttttatcctctttatatatgcttcagatatgcttgaagtagattgtttcttattgttcttgctgctcgagtttgttgagtagttggtacatgcagagtatttgtatgttatgacatatataggttttgtccatggttcctggctcataactcactcccaagacccttgttacagaaaccagaatctctctctctgatcttctcctaccctcctttcatctgcccactgcagaactctaatctgattatggkttctaagaccctcataccagagagtattctgccccataccatagcagaaggaacactgcacagagacaccaagaagaatctgaacagacaggccttgttaggtttagatcatgtccttataacctaattatattttaacatggttatccatgctttaatcatgtgtattcaatgaacgctccataaaagcccaagaagaacagatttgagggaattctgaagcgctaaacacgtagggtctgacaggaaggtgaagaagaactcatcatgctggaagggtggtccaccctaactccgcag

SEQ ID NO: 48547 - DNA, 601 bp, Human
atctctctctctgatcttctcctaccctcctttcatctgcccactgcagaactctaatctgattatggtttctaagaccctcataccagagagtattctgccccataccatagcagaaggaacactgcacagagacaccaagaagaatctgaacagacaggccttgttaggtttagatcatgtccttataacctaattatattttaacatggttatccatgctttaatcatgtgtattcaatgaacgctccataaaagcccaagaagaacagatttgagggaattctgaagcgctaaacaygtagggtctgacaggaaggtgaagaagaactcatcatgctggaagggtggtccaccctaactccgcagggacagaagctcctgtgtctgggacccttccagaacttgctctatgtatctcttcaagtgcctgtgtatttatatcctttcaaatatcctttgtaataaatcataaacatgtttccctgagtttttatgccactctgtcaaattaattgaacccaaagagggggttatgggaaccccaatttgaagccagtccatcagaagttctggaggcctggacttgagactggtgtct

SEQ ID NO: 48548 - DNA, 601 bp, Human
atggtttctaagaccctcataccagagagtattctgccccataccatagcagaaggaacactgcacagagacaccaagaagaatctgaacagacaggccttgttaggtttagatcatgtccttataacctaattatattttaacatggttatccatgctttaatcatgtgtattcaatgaacgctccataaaagcccaagaagaacagatttgagggaattctgaagcgctaaacacgtagggtctgacaggaaggtgaagaagaactcatcatgctggaagggtggtccaccctaactcygcagggacagaagctcctgtgtctgggacccttccagaacttgctctatgtatctcttcaagtgcctgtgtatttatatcctttcaaatatcctttgtaataaatcataaacatgtttccctgagtttttatgccactctgtcaaattaattgaacccaaagagggggttatgggaaccccaatttgaagccagtccatcagaagttctggaggcctggacttgagactggtgtctaaagtgggcaggcagtcttggggactaagccctcaacctacgggatctgaaactgtctcctggt

SEQ ID NO: 48549 - DNA, 601 bp, Human
agaataggaaaaagcacgttgagtagtttttccacaccacagcattcttttaggctcctgcttttaccttctgcttccctcagcatcctgcatctcaccaggagagacacagcttctttgccattctcggcattccacttcggaatcaatcagaatagctcctattgctagaaacttgctttattaagttctgtttattcagggcttatctgaaagagaaacattttttatgatttgagatttctaagccattttaaaacttggttttaacagcttgagaaattgggggtatagtagggayggagatacatatatttggatgtgacttcaagctagataaaagtttggaaggaataaaagtttgacatctaaagtttttgcatagtttgagttgagcaggaggtactaggtatgtttttaaaatatttttttcagccaggcacggtgactcatacctgtaatcccagcactttgggaggccgagacaggcgatcacctgaggtcaggcgttcgagaccagtctggccaacatgaagaaaccccgtctctactaaaaatacaaaaattagctgggtgcggtgacacatgcctgtaatcccag

SEQ ID NO: 48550 - DNA, 601 bp, Human
attcaaattcaaatttcctttaaaacactgggctggccaaaacaaaagacaatactatctacaggccagtttctaagattatcagattttagtagcatttaccatttcattgtacttggcacactttagcaaatttgcacttcttaaaagtacctgcaggcaatctcctatataaaaacacaatgcaggctagcttggctcctgcctttaattccagcactttgagaagttggagactagcgtggccaacgtggtgaaacctcatctccactaaaaatacaaaaattagccaggcatagcrgcgcacgcctgtagtcccagttacttgggaggccgaggcagtagaatcacttgaacgctggagacagagcatggagtgagctgagattgcaccactgcactccatcctgggtgacagcgtgagactctgtctccaaacaaaacaaaacacacacacacacaatgtaacaacacgaaacagaatactgtgaaaatgcttaattatgtctgactttacatgatggctggatatgtgattattttttcttctttatgctcttatgtactttgttcatttttaatgatgatcatgtataaagct

SEQ ID NO: 48551 - DNA, 601 bp, Human
ggacaagtattgaaagcaccataggtttatcttatattagcattttccaaactttataatgaaccagcagtgacccacacatctgccaggtaggaattgctcatcagttgtgtcgcgttatcttgttaagcttcagcaatgttccatacagccactaataacagatcaaagtgagcattagggttgaaattagtaagctgtttcttctcagttctttctggtagttgaataaatatagaatgtattaaatagttttctttatttcagaacttctcagagtctgtaatatattgtatggtgrtagcttaggaggaagatgcaataggaaacttttcccagataggttcactattttttttttccacgaaaaataagctgttctcaaaatacagtttacaaaattttatccttaactcttcactctttctcctagttagggagaccgctccaccagtagaaaagataaaccctggtaatttgttgtgtaaatgggataaatagcctagtacctagtcatgtggattcaggcagcactgagcctaaattaaagtttgcaaggtatacatgttaatgtatctaagttactatatttagcctgttt

SEQ ID NO: 48552 - DNA, 601 bp, Human
gcaataggaaacttttcccagataggttcactattttttttttccacgaaaaataagctgttctcaaaatacagtttacaaaattttatccttaactcttcactctttctcctagttagggagaccgctccaccagtagaaaagataaaccctggtaatttgttgtgtaaatgggataaatagcctagtacctagtcatgtggattcaggcagcactgagcctaaattaaagtttgcaaggtatacatgttaatgtatctaagttactatatttagcctgtttcttaagtatgtttcagartcatattcgtttttttcagtggcagttaccttcagatgcatgtgcttctaaagcatgttggttgcatgtgcagtacatgttgcttaagcatttagcttcagaatggcatctttcctgtgaatgtcttaacatttacaaaaaagtaccaggatctcaaatatcagtgctggtatttttttttttttttttacttaaagaaattgatatgattaaatattaagagacaatatgatccttgttggcttgtaaccctagtttttattgtcttgtagttattaaatagagcatctgttgagggac

SEQ ID NO: 48553 - DNA, 601 bp, Human
caataggaaacttttcccagataggttcactattttttttttccacgaaaaataagctgttctcaaaatacagtttacaaaattttatccttaactcttcactctttctcctagttagggagaccgctccaccagtagaaaagataaaccctggtaatttgttgtgtaaatgggataaatagcctagtacctagtcatgtggattcaggcagcactgagcctaaattaaagtttgcaaggtatacatgttaatgtatctaagttactatatttagcctgtttcttaagtatgtttcagagwcatattcgtttttttcagtggcagttaccttcagatgcatgtgcttctaaagcatgttggttgcatgtgcagtacatgttgcttaagcatttagcttcagaatggcatctttcctgtgaatgtcttaacatttacaaaaaagtaccaggatctcaaatatcagtgctggtatttttttttttttttttacttaaagaaattgatatgattaaatattaagagacaatatgatccttgttggcttgtaaccctagtttttattgtcttgtagttattaaatagagcatctgttgagggact

SEQ ID NO: 48554 - DNA, 601 bp, Human
tcaagctgactttcaggatgtaaatataaccaaagcaactgatatgtaaaaaatatattcaatggcattcctagattttcttctagggtgttttattgttttgggttttacatttaagtctttaatccatcttgagttaatttttgtataggtataagaaaggggtccagttttaattttctgcgtatggctagccagttctcccagcaccatttattaaatagggaatcctttccctattgtttgtttttgtacggtttgtcaaagattagatggttgtagatgtgtggtcttatttctsagatcttcattctcttccactggtctatgtgtctgtttttgtaccatgcttttttggttactgtagccttgtagtatagtatgaaagatagcatgatgcctccaggtttgttctttttgcttaggattgtcttggctatacgagcttttttttggttctatatgaattttaaaatagtttcttctaattgtgtgaagaatgttaatggtagtttaatgggaatagcattgaatctgtgaattgctttgggcagtatggccattttcatgatattgattcttcctatccatgagcatgtaa

SEQ ID NO: 48555 - DNA, 601 bp, Human
tcttccactggtctatgtgtctgtttttgtaccatgcttttttggttactgtagccttgtagtatagtatgaaagatagcatgatgcctccaggtttgttctttttgcttaggattgtcttggctatacgagcttttttttggttctatatgaattttaaaatagtttcttctaattgtgtgaagaatgttaatggtagtttaatgggaatagcattgaatctgtgaattgctttgggcagtatggccattttcatgatattgattcttcctatccatgagcatgtaacgtttttcccttygtttgtgtcctctctcatttccttgagtagtggtttgtagttctccttgaagagatccttcacttcttctgtattcctagatattttattctctctgtagctattgggaatgggagttcattcatgattttgctctctgcttgccttttgttggtgtatagggatcctggtgacttctgcacattgattttgtatcctgagactttaccgaagttgcttatcagcttaagaagcttttgggctgagatgatggggttttctagatataggatcatgttatcttcaaacaaagacaatttg

SEQ ID NO: 48556 - DNA, 601 bp, Human
tggcctcataaaatgagttagggaggagtccctccttttcaattgtttggaatagtttcagaagaaagggtatcagctcctctttgtacctctggtagaattcaactgtaaatccatctggtcctggactttttttcattagtaggctatttattactgcctcactttcataacttgttattgatctattcagggatccaacttcttcctgattcagtcttgggagtgtgtatgcatccaggaatttatccatttcttctagattttctagtttctttgcatagaggtgtttgtagtattygctgatggttgtttgtacttctgtgagatcagtggtggtatcctgtttatcattttttattgtgtctgtttgattcttctcttatttttgacaaagctgacaaaaagaagcaatagggaaaggactctctattcaattaatcctactgtatatctggctagccatatgcagaaaattgaaactgttcctgtttcttaatccatatacgaaaatcaacttacgatggattaaagacttaaatgtaaaacccaaaattataaaaccctggaatagaatataggcaatatcattctggacata

SEQ ID NO: 48557 - DNA, 601 bp, Human
tcataaaatgagttagggaggagtccctccttttcaattgtttggaatagtttcagaagaaagggtatcagctcctctttgtacctctggtagaattcaactgtaaatccatctggtcctggactttttttcattagtaggctatttattactgcctcactttcataacttgttattgatctattcagggatccaacttcttcctgattcagtcttgggagtgtgtatgcatccaggaatttatccatttcttctagattttctagtttctttgcatagaggtgtttgtagtattcgctgwtggttgtttgtacttctgtgagatcagtggtggtatcctgtttatcattttttattgtgtctgtttgattcttctcttatttttgacaaagctgacaaaaagaagcaatagggaaaggactctctattcaattaatcctactgtatatctggctagccatatgcagaaaattgaaactgttcctgtttcttaatccatatacgaaaatcaacttacgatggattaaagacttaaatgtaaaacccaaaattataaaaccctggaatagaatataggcaatatcattctggacataggaat

SEQ ID NO: 48558 - DNA, 601 bp, Human
gaaactactgtcagagtgaacaggcaaccaacagaatgggagaaaattttttcaatctatccatatgacaaaggtctaacatccagaatctacaaggaacttaacaaatttacaagaaaaaaggagccccattaaaaagttggcaaagaacatgaacagacacttcccagaagatattcatgtggccaataaacatgaagaaaagctcaacatcactgaccattagagacgtgcatatcaaaatcacaatgagataccatctcatgtcacaatggtgattattaaaaagtcaaacaacatrctagtgaggttgtagagaaataagaacgcttttacactgttggtgggaatgtcaactaattcaaccactgtggaagacagtgtggtgattcctcaaggatttagaaccagaaatatcattactgcatatagacccaaaggaatagaaatcattctattacaaagatacatgcacatgtatgtttattacagcactattcacaatagcaaagacatggaatcaacccaaatgctcatcagtgatagactggaaaaagagaatgtggaacataaacaccatggaatactatgcagcaataaa

SEQ ID NO: 48559 - DNA, 601 bp, Human
aaaaattactaatgagttcttttatctgagtaattttgcatcaacatgcttttattatggaagagaagattcagtgagtacaaaattgcagatacatgtgtcagaagatccctgaatataataaggcttagtattctgtgtcataattgcctgtttgtattcctctctggtctttaaacttcattagggcaaggatcaactccatcttactaaccatttgattccctatgtattacacgatatatgaccaataataagccttcaataaatacttgtaaaataaagaatgttatgtaatatrtcatgtggtattgttttattgatgtgttctttgaagtgttacctttgtgtccttagaggctatggtgggccctcaggccatatatgttggatgatttagtggaaaagagattagacttttatattttattctatttatttatttatgttttaatcttgtgtaagcctatagaggccaagatagggctcagagttaaaaacagtgatgttctaactttcaaaactactaaaaacaaaattagctatcaagggaaatcctgagtgttctgactgcaggggttccccaaagcctggaggaccg

SEQ ID NO: 48560 - DNA, 601 bp, Human
atgaacatctgatattagatctgatgggcacaccaatgttgtttcatatattaaataatagtggaagttttcaatttaattagtttatttatttatttatttatttttgagccggtgtttccctctttttgccaaggctggggtgcaatggcacatggttgcagctcactgcaatctccacctcccaggttcaaaggattcttctgcctcatcctcccaagtagctgggattacaggcgtgtgccactatgccaggctaatttttgtattattagtagagacaaggtttcaccatgttggygaggctgctctcaaaatcccgacttcaggtgatccacccgcctcagcctcctaaagtgttgggattacaggcatgagccactgcgcctggccaattgtatttttatgttagaaatatatatgggagttacaatactttgtttccaatgttccgctggaaaccactggttgaaaggataggtcccagtgtcagctgcccagttggcagttttggatagaatataagttctatgaaggcatggatgaagtatccttcatggtaatgatggtaatgttagtatagtcacttgtttaatgttgt

SEQ ID NO: 48561 - DNA, 601 bp, Human
ctgatattagatctgatgggcacaccaatgttgtttcatatattaaataatagtggaagttttcaatttaattagtttatttatttatttatttatttttgagccggtgtttccctctttttgccaaggctggggtgcaatggcacatggttgcagctcactgcaatctccacctcccaggttcaaaggattcttctgcctcatcctcccaagtagctgggattacaggcgtgtgccactatgccaggctaatttttgtattattagtagagacaaggtttcaccatgttggtgaggctgstctcaaaatcccgacttcaggtgatccacccgcctcagcctcctaaagtgttgggattacaggcatgagccactgcgcctggccaattgtatttttatgttagaaatatatatgggagttacaatactttgtttccaatgttccgctggaaaccactggttgaaaggataggtcccagtgtcagctgcccagttggcagttttggatagaatataagttctatgaaggcatggatgaagtatccttcatggtaatgatggtaatgttagtatagtcacttgtttaatgttgtataacttt

SEQ ID NO: 48562 - DNA, 601 bp, Human
tatttatttatttatttatttttgagccggtgtttccctctttttgccaaggctggggtgcaatggcacatggttgcagctcactgcaatctccacctcccaggttcaaaggattcttctgcctcatcctcccaagtagctgggattacaggcgtgtgccactatgccaggctaatttttgtattattagtagagacaaggtttcaccatgttggtgaggctgctctcaaaatcccgacttcaggtgatccacccgcctcagcctcctaaagtgttgggattacaggcatgagccactgcscctggccaattgtatttttatgttagaaatatatatgggagttacaatactttgtttccaatgttccgctggaaaccactggttgaaaggataggtcccagtgtcagctgcccagttggcagttttggatagaatataagttctatgaaggcatggatgaagtatccttcatggtaatgatggtaatgttagtatagtcacttgtttaatgttgtataactttttaactcttccaacttcaatttcatctatatctttcatagcagtccagtaaagtagtatcaattatagatatcattc

SEQ ID NO: 48563 - DNA, 601 bp, Human
tcctatagaactcaggtttatcatatacaatgttacacattattcctttgaataaattgtttacctaatactttttaaatttgggcattttctaggacattctattgtttttatttttaacttgtgttatactgcagtgaatgtcttcctgtgtgtagcattttgtttgtgtatgtgtgtcaatatctataaagtagctcttaagaactctggaaacattgtcagactgcttcctcaaacagcagaggtgggagggagcatcggcctaaccctacctggcctgccttaccagcatgcaacsaaggagaagagaataggatcaagagccagtgccagagagaagtacataatacaactttatggagtttaggttgcatcctataaagttaccatgttacactgtttcgatctaccaaagtagaagttttacatagtttagtatgaagttaattttattaaccttttcacacaacacaccctctcatattgctgcccaacaatgtcctgggtctttgtttccatggtcatcatattgagtagggttttagcagggacttgagtagttgggaactgaactcatgctagtgaagccattcttcac

SEQ ID NO: 48564 - DNA, 601 bp, Human
agaatatgctaataaattgagagattgacagaaaaaaaggattctgtttcactgtggctcacacctgtaatcccatcactttgggaggccgaggtgggtggatcacttgtctggagttcaagaccagcctggccaacatggcaaaaccccgtctctactaaacaatacaaaaattagccaggcgtggtggtaagcacctttaatcccagctactcgggaggttgaggcaagagaatcgcttgaacctgggaggtgcaagttgcagtgagccaagatcacaccactgcactccagcctgggyaacacagcaagactccatccctggaaaaaaaaagttcatcatttgttcttgtagtttcctagtgtggcccttgtctcagtggaaaattgtagtgtgatagactgaggagaattctgtttctgccacttcgcctgttgccttggtaggagctccttatctctgagctgagctccttttgtccttggtaaaatgtggttattatcatctgcatcctcatagtcttcttgtaaggactgtgaagtcacttttgaaaaatgccttgaatatgccagatggtctgttttctttcttttttgtttt

SEQ ID NO: 48565 - DNA, 601 bp, Human
gaatatgctaataaattgagagattgacagaaaaaaaggattctgtttcactgtggctcacacctgtaatcccatcactttgggaggccgaggtgggtggatcacttgtctggagttcaagaccagcctggccaacatggcaaaaccccgtctctactaaacaatacaaaaattagccaggcgtggtggtaagcacctttaatcccagctactcgggaggttgaggcaagagaatcgcttgaacctgggaggtgcaagttgcagtgagccaagatcacaccactgcactccagcctgggcracacagcaagactccatccctggaaaaaaaaagttcatcatttgttcttgtagtttcctagtgtggcccttgtctcagtggaaaattgtagtgtgatagactgaggagaattctgtttctgccacttcgcctgttgccttggtaggagctccttatctctgagctgagctccttttgtccttggtaaaatgtggttattatcatctgcatcctcatagtcttcttgtaaggactgtgaagtcacttttgaaaaatgccttgaatatgccagatggtctgttttctttcttttttgttttg

SEQ ID NO: 48566 - DNA, 601 bp, Human; identical to SEQ ID NO: 23301

SEQ ID NO: 48567 - DNA, 601 bp, Human; identical to SEQ ID NO: 23302

SEQ ID NO: 48568 - DNA, 601 bp, Human; identical to SEQ ID NO: 23303

SEQ ID NO: 48569 - DNA, 601 bp, Human; identical to SEQ ID NO: 23304

SEQ ID NO: 48570 - DNA, 601 bp, Human; identical to SEQ ID NO: 23305

SEQ ID NO: 48571 - DNA, 601 bp, Human; identical to SEQ ID NO: 23306

SEQ ID NO: 48572 - DNA, 601 bp, Human; identical to SEQ ID NO: 23307

SEQ ID NO: 48573 - DNA, 601 bp, Human; identical to SEQ ID NO: 23308

SEQ ID NO: 48574 - DNA, 601 bp, Human; identical to SEQ ID NO: 23309

SEQ ID NO: 48575 - DNA, 601 bp, Human; identical to SEQ ID NO: 23310

SEQ ID NO: 48576 - DNA, 601 bp, Human; identical to SEQ ID NO: 23311

SEQ ID NO: 48577 - DNA, 601 bp, Human; identical to SEQ ID NO: 23312

SEQ ID NO: 48578 - DNA, 601 bp, Human; identical to SEQ ID NO: 23313

SEQ ID NO: 48579 - DNA, 601 bp, Human; identical to SEQ ID NO: 23314

SEQ ID NO: 48580 - DNA, 601 bp, Human; identical to SEQ ID NO: 23315

SEQ ID NO: 48581 - DNA, 601 bp, Human; identical to SEQ ID NO: 23316

SEQ ID NO: 48582 - DNA, 601 bp, Human; identical to SEQ ID NO: 23317

SEQ ID NO: 48583 - DNA, 601 bp, Human; identical to SEQ ID NO: 23318

SEQ ID NO: 48584 - DNA, 601 bp, Human; identical to SEQ ID NO: 23319

SEQ ID NO: 48585 - DNA, 601 bp, Human; identical to SEQ ID NO: 23320

SEQ ID NO: 48586 - DNA, 601 bp, Human; identical to SEQ ID NO: 23321

SEQ ID NO: 48587 - DNA, 601 bp, Human
agctgctttggaccttatctgggaatttccttgggcttacagcctttaccctatccttgaaatggttctggtttcatagcaacttctaggtggtgtgggcgaagtttgggactggtttagggcggggacaagaccaagaacacaagtttccttgtactacgggagagagggaggggaggaaattggagaccccagcacccccttgctcactctcttgctcacagtccacgatggcccggtccctggtgtgccttggtgtcatcatcttgctgtctgccttctccggacctggtgtcaggggtggtcctatgcccaagctggctgaccggaagctgtgtgcggaccaggagtgcagccgtaagaatggggaggggagaattgggggcttgggcgttagcctgtgtggagggtgctgcattcccttctattccttccctagaccctatctccatggctgtggcccttcaggactacatggcccccgactgccgattcctgaccattcaccggggccaagtggtgtatgtcttctccaagctgaagggccgtgggcggctcttctggggaggcagcgtgagtcttgggagagtgaaagagggaa

SEQ ID NO: 48588 - DNA, 601 bp, Human
tgtgagccactgccccccagcctattttcactttatttaccaattttaggacctgatatggtcccatgttctgttctagacaccaagatacaacaacaaatgatcctttttattctaatggagggaaatgaacaaaaagcaaggcataaaaaatagcagcagccgggcacagtagctcacacctgtaatcccaagtaaggccaagttgggaggatagcttgagcccaggagttcgagaccagcctgggcaacatagcaagacccccatctctataaaaaaaaatttaaaattaactgggcwtcatggcatgtgtctgtggtcccggctactcgggaggctgaggtgggaggattgcttgatcccagaagttgaggctgcagtgagccgtgatcatgctactgcacctcaacctgggcgacacaatgagaccctgtttccaaaataataataataataaaagcaaatatgcgctgctgtgagaattaacagagacttacttgggtgttcagaaagggcctctgaacaggtggcatttaagctgagattcatatgacaaggatggagcagttatgtggagatcagggagaagggagaatgcaa

SEQ ID NO: 48589 - DNA, 601 bp, Human
caaactacttcctgtcttcaacactccattagttcatcttacactctgccctttaacgtggtcactgctgctcatcttacaaggtttgaggtcacaggacccttcctccaggaagccttgccttgtcccttcacgtggctgccgctgacttgccgtacgctgagaccatctcccatcaagccctgattcctctgagctgtcgtggggctctctctcctcccagtggcctttgaactccgtgagggcaaggactggggctttcttggtcaccggctttttcagtgatcagcccacaatgaamatgtaccataatggtggctaacgctctgtatcatgggctggtctgtgtgctttcatataaatcttgataacatttaattctcacaacaatcttgtaggaagaaggctattgttattcccattcgtcaactaagaaactggggccgggcgcggtggctcacccctgtaatcaatcccagcactttgggaggccgaggcgggcggatcacctgaggtcgggagttcgagaccagcctgaccgacatggagaaaccctttctctactgaaaatacaaaattagccgggcatggtggcgcatgc

SEQ ID NO: 48590 - DNA, 601 bp, Human
acattttcttgcttctttcctagcctggtatctattttacaagtggcttctgcttcagcttagcttttttttttgagatggagtttcgatttgtcacccaggctggagtgcagtggcgcaatctctgctcactgtaacttttgcctctctggttcaagctattctcatgcctcagcctccccagtagctgggattacaagcgccctccaccacgcctagctaattttttttcttttcctttttttttttttttttttttttggcatttttagtcaagacggggtttcaccgtcttggccargctggtcttgaactcctgacctcacgtgatctgcctcagcctcccaaagtgctggaattataggcatgagccaccatgcctggccagtttttatgaaggttggagtccagtggtgaggtcatggctcactgcaacctctgcctcccaggctagagtgatcctcccacttcagcctcccaagtagctatgaccacaaggcatgcaccactatgcctggctaatttttgtatcttttgtagagacagggtttcaccctattgcccagactggtcttgaactcttgagtgcaaaggatctgcc

SEQ ID NO: 48591 - DNA, 601 bp, Human
ctttggggaagccaaggcaggaggatcactggagcccaggagttcaagaccaacctggccaacataggagactgtgtctacaaaaaataaaaaattagccgtgcgtcgtgctgcgtgcctatggtcccagctccttgggaggctgtggtgggaagattgcttgagcctgggaggtcaggcctgtagtaagctaccatcatgccactgaactccaccctgagcagtagaaggagattctgtctttaaaaaaaaaaaaaggcacttgatggtatctagtcaaatgtttgcagccaggtgtggkggcacactcctgtaatcccagcactttcggaggccaaggtgggctaattgctgaagctcaggagttcaagaccagcctgggcaacatagcaagaccctgtctctgcacaaaatccagaaattagctgggcatggtggcatacacctgtggtcccagctactccataggctgaagtgggaggaccgcttgagtccgggaggttgaggctacggtgagccatgatcatgccactgcactccagcctgggtgacaaagtgagaccttgtcaccaaaaaaaaaaaaaaaaaattgtggtggagt

SEQ ID NO: 48592 - DNA, 601 bp, Human
gctactccataggctgaagtgggaggaccgcttgagtccgggaggttgaggctacggtgagccatgatcatgccactgcactccagcctgggtgacaaagtgagaccttgtcaccaaaaaaaaaaaaaaaaaattgtggtggagtctgtgctaggcttggcatactgcagtaaacaaatgggacaggcttatagctcctcaggcaagatagacaagttaacgtaccatgacaggaggtgggaaatagtcatgaaagaaaaggaagtagagtaagaatgacatgggaagaaatttagacgtsgtggtcagaggtggcaacatttcctctgagactgggtgactagaaggaggccaccatgtaaacctcaggggagggatgttccaggtaaagagagcagccagttcaaaggccctggggcaaaattggtgtgtcagacctgggggccagtgtggttgggaactcaggagggcggtggaatgtgggcagggatgaggtgggggaaatctgccagggccacgtcatgcaggcccatgtcagggtgctggtggcagtgaaaagaatcactcatttatcgagtgtttactacgtgccggatgctgt

SEQ ID NO: 48593 - DNA, 601 bp, Human
ggattacatgcatgagccaccatggctggcccccagttttatttttatatgccagtaacagaccagtagacttcacattgaaaagtagcactgaggggtaaatccaacaaaaggtttgcagaacgactacactgaaatcacagaatgtagctgggagaaatcagagactcagcaatggataggaagactcagtattgtcaagaggtcagttccatccaaattaattgaagattcaacgtgattgcaatcaaaatcccaccaggaatttcggtaaacactggacactgattggctctttctraatgtgtggaaagacaaggccaagccaggcgaggagaataaagcaccaggacctgcatgaccaggggaagctccagcaaccaggccaggcccaatggctcatgcctgtaatcccagcactttgggaggccaagataggaggattgctttaggtcaggagttcaagaccagcctctataaaatagcaagacctcatctctacaaaaaataaaatagaaaactgggcgtggtgactcattcctgtagtcccagctgctcaggaggctgagctgggaggatcgcttgagaactggaggtcaag

SEQ ID NO: 48594 - DNA, 601 bp, Human
gtgagaccttgtctcttttttgttttgttttgttttcttttgttttttttcgggagggagtctcagtcaatctgtctccccaggctggaatgcagtcgtgcaatctcggctcactgcaacctctgcctctcaagttcaagtgatcttctgcctcagcctcccaagtagctggatcacaggcacatgccaccacgtccatgtgcaaaaaaaaaaaaaaaacctgcagcaaccaaccaggatgatatacagttggcagaagggtaggaagacagaccaaggggacaggatgaagagtctaggyacagctacacttgtataattacttgatgtgtgatcgaggtaccactgcacttcactgaggaaaggactttttttcccctagttcatgatgcggggcagttgggtatctgcaaggggaaaaaattagccctacctcatactatatgcaaaatataacttgaagtgaattgcagatccaaatgtgacaactcacaaaatatagtttcttttctcttttcttttctttttctttttctttttttttttttttgagacagagcctcgctctgtagtccaggctggagtgcagtggtgtgatctc

SEQ ID NO: 48595 - DNA, 601 bp, Human
gggattacaggtgcccaccaccacgcctggctaatatttgtatttttggtaggggcggggtttcaccatgttgcccaggctggtctcaaactcctaacctcaggcgatccgcctgcctcggcctcccaaagtgttaggattataggcgtgagccatcgtgcccggcctaccacacatttctttctgcacctgccctgactgtccctttccatctcttcctctcctttgattttgtttaagagacagggtcttgctctgcctcccaggctggagtgctgtggcacaatcagagctcactgcrtgcagtcttgacctcctgtgctcaagtgatcctcctacctcagcctcacaaatagcatttaactctttctgatttaatgtcccactagaccctgggtttgttttgctctgtcgggccctctttgggtgccttttgcgcctctttctgggtgtttttccttacatctctcacccgctaggtttcctttcatggcctcttctctgcctcctggggctgctgtaaccacgcactctcctccctctctccacagggcatgccgccgatgactcaggcgccccgcattatgcaccacatgccggg

SEQ ID NO: 48596 - DNA, 601 bp, Human
aaccacgcactctcctccctctctccacagggcatgccgccgatgactcaggcgccccgcattatgcaccacatgccgggccagccgccctacatgccgccccctggtatgatccccccgccaggccttgcacctggccagatcccaccaggggccatgcccccgcagcagcttatgccaggacagatgccccctgcccagcctgtgagtatctagtcccacccaccaggtctcatataaatagtgagaatacaggactagaaagggaccagttggggggctgctgtaggttgggtggtcygggcaggccccctgaggaggtggtactgaatgaggaagtagcagtgggggtgggccctgggcagaggaattggcatgctggttggagggtacggaaggttagggtaggctggagtggtgccagcacctagattgattccatgagctattgagcgcctccttacgtgccaggccccgttctgcactgtagggctgcagcagggactgagatagaaacctctgctgtcctgtggcctatagtctgtaggggcaaagaggtgggaggcagacaggcaacagacaacaatatgtggtatgttgg

SEQ ID NO: 48597 - DNA, 601 bp, Human
tcaccgactcccctatacccccgcagctttctgagaatccaccgaatcacatcttgttcctcaccaacctgccagaggagaccaacgagctcatgctgtccatgcttttcaatcagtaagtggggcctgtggctgggtggtccctggagggtgatggccaggaggcatctccatggaaacaggcctcagaactctgccagcagagctctgagccaagtagggctttgcagaagggacagcgaccaaagatgtgaaaggaggaggctgtggctgggcccacggcctgtgggggacatggggrtgaggctggaaaggtctccatggccagggcttgccggcttttttcagccttgtttgagggctgagggagtccaggctctgggcctcattttcccagcccctaaaatgggggcatgcaaggcaaggtatgtgtaaaactgcattgagatgtccttgaacattggctaagactggcagaagtcagcgtgctcagaaacagcaagtgtgggagatggggatgcgtgaaactcttgtgcctggcgtcagggtggaggccggtgcagccgatgtgtagaggggctgttcaccattgttgagtgaa

SEQ ID NO: 48598 - DNA, 601 bp, Human
tgaagaaaacagctgtaaccaccgtttaacagggagggaaactgaggcacagaaaggccaagttaaagatactcggttaaagatacagcaagaataaagcggaacttgaactcatttctgtctgactccagaagaggcaaatcgatttgctgagatgtgtgaggaaaagatgaagaataatagcaaggaacatgtatcaagggcttgcagtgtaccagataccatgatccctgcattaataacttacctcttcaaacaccgctaagaaacgggtacgattatcattacttttttttttttttgagacggagtttcactcttgtcacccaagttggagtgtaatggcgcgatcttggctcactgcaacctctgcctcccgacttcaagcagttctcctgcctcagcctcccaagtagctgggattacgggcatgagctaccatgcctggctaattttgaatttttagtagacatggggtttcactatgttggtaaggctggtctccaactcttgacctcaggtgacccacccacctccttggcctctcaaagtgctgggattataggcgtgagccaccgcctggcctacccttttgtgtgtg

SEQ ID NO: 48599 - DNA, 601 bp, Human
aaggccaagttaaagatactcggttaaagatacagcaagaataaagcggaacttgaactcatttctgtctgactccagaagaggcaaatcgatttgctgagatgtgtgaggaaaagatgaagaataatagcaaggaacatgtatcaagggcttgcagtgtaccagataccatgatccctgcattaataacttacctcttcaaacaccgctaagaaacgggtacgattatcattacttttttttttttttgagacggagtttcactcttgtcacccaagttggagtgtaatggcgcgatctyggctcactgcaacctctgcctcccgacttcaagcagttctcctgcctcagcctcccaagtagctgggattacgggcatgagctaccatgcctggctaattttgaatttttagtagacatggggtttcactatgttggtaaggctggtctccaactcttgacctcaggtgacccacccacctccttggcctctcaaagtgctgggattataggcgtgagccaccgcctggcctacccttttgtgtgtgtgtgacagagtttcattctgtcattcaggctggagtgcagtgagtcaatctca

SEQ ID NO: 48600 - DNA, 601 bp, Human
caactcttgacctcaggtgacccacccacctccttggcctctcaaagtgctgggattataggcgtgagccaccgcctggcctacccttttgtgtgtgtgtgacagagtttcattctgtcattcaggctggagtgcagtgagtcaatctcagctcactgcaacctccatcccccaggttcaagcgattctcctgcctcagcctcccaagtaactgggactacagacacgtgccaccacgcctggctaatttttgtattttttttagtaaagaccgggttttgccatgttggccaggccggtctcgaattcctggcctcaagtgatccacctaccttgacctcccaaagtgctgagattataagcatgagccaccgtgccgggccatcattactattttgcagatgaacaaactaaggcccaaagagtggaagtatttcagccaaggtcacacaggtggtaggtagctgtgtgctcactttcacttttccatggaaggagggaagaacaaaaatggatttgggactgggcacagtggctcacatgtgtaaccccagcactttgggaagttgaagtgggcaaatagcttgagcccagatgtttg

SEQ ID NO: 48601 - DNA, 601 bp, Human
tgttgcccaggcttgtctcgaactcctgggctcaagcaatccgccctcctcagcctctcaaagtgttgggattataggcctgagccactgcgcctggcttatttttatttttatagagatgaaatcttgctatgttgcccaggctggtctccaacccctgggctcaagcgattctcctgcctctgcctcccaaagtgctgggattacaggcatgagccactgtgcctaggccttatcattgttattatgtccactttaaagacagagaaattgaggacaagagaggggacaggactcaaarccagtcactgttagaaatgagacttgatcctagacctaacctacctctccctatgtccaggcctcaccttccccgatggcgcaggtaccaggggaagtggacaacatggagggcctgcctgctcctaacaacaaccctgctgcccgctgggagagtccggatcggggctgggagcgggagcagccggctgcgtccaccgcagcggcctcgctctttgagtgctcccggatcaaggccttggcaggtacctggaggagggctggggtgggatgaggaggagggggaagggggaagggtgcc

SEQ ID NO: 48602 - DNA, 601 bp, Human
agggtgggaaaagagaccagcactgtccaatagaactttccatgatggtggaaatagtctatatccataatgtaccatataataatcactagtctctgtgacttttgaatgctagaaatgtggccagtgctatgtgacagcctttgagttttaaattttatttagttttaattaaatttatttatatatatattttttgagacagagtcttattctgttgccccggctggggtgtagtggtgagatcttgggtcactgcaatctccacctcaccggctcaagccatcctcctacctcagcyccctgactagctgggactacaggtgcccgccaccacacccggctaattctttttgtatttttagtagacaccgggtttcactgtgtttgccaggctggttttgaacttctgaccttaagtgatccacttgctttggcttcccaaagtgctgggattacaggcatgagccactgcacctggcctggtgttttttttttttttttttttgagacggagtttcgctcttgttgcccaggctggagtgcagtagcgcgatctcggctcaccgcaacctccacctcccaggttcaagcgattctc

SEQ ID NO: 48603 - DNA, 601 bp, Human
agaaatgtggccagtgctatgtgacagcctttgagttttaaattttatttagttttaattaaatttatttatatatatattttttgagacagagtcttattctgttgccccggctggggtgtagtggtgagatcttgggtcactgcaatctccacctcaccggctcaagccatcctcctacctcagctccctgactagctgggactacaggtgcccgccaccacacccggctaattctttttgtatttttagtagacaccgggtttcactgtgtttgccaggctggttttgaacttctgaycttaagtgatccacttgctttggcttcccaaagtgctgggattacaggcatgagccactgcacctggcctggtgttttttttttttttttttttgagacggagtttcgctcttgttgcccaggctggagtgcagtagcgcgatctcggctcaccgcaacctccacctcccaggttcaagcgattctcctgcctcagcctccctagtagctgggattacaggcatgtgccaccacgcccagctaattttgtatttttactagagacggggtttctccatgttggtcaggctggtctcgaac

SEQ ID NO: 48604 - DNA, 601 bp, Human
gtagctgggattacaggcatgtgccaccacgcccagctaattttgtatttttactagagacggggtttctccatgttggtcaggctggtctcgaactcccaacctcaggtgatccacatgtctcggcctcccaaagtgctgagattacaggcatgagccacggcacccggcctgttttaattaaatttaaatagccacatgtggcttgtgactgctgtataggtcagcacagccttagagccttagaaatgtacagtcccagaatggtgggactctgtaagcatattcccttagaatcccraaatgcagagccatcagatccttggaacttgaaatgtctaagagattcttagacctcttgaaatgaagacctctggcctggcgcggtggctcacgcctgtaatcccagcactttggggaggcaaaggtggacagatctcttgagtgcaggagttcgagaccatgttcgccaacatagtgaaaccctgtctctactaaaaataaaaataaaaaaaaaaattagccaggcgtggtggcatgcatctgtagttccagctatttgggaggctgaggtgggaggatggcctgagactgtgaggtg

SEQ ID NO: 48605 - DNA, 601 bp, Human
caattagaaatgtggatcttgagaaatctgacatagagtgaccaaaaccttcctgcttttaccaccgaaactctcagccttgggccaaccagtacagtgggtcaccctaccattttttttttttttttgagtcagggtctcactcttcacccaggctggagtgcagtggtgtgatcatggctcactgcagccttgaactcctggactcaagtgatcctcccacctcagcctcctgaatagctggaactacaggcatgcgccaccatgcctggctaattaaaaataatttttttttttggcsaagcatggtggcggatgcctgtaatcccagcactttgggaggctgaggcagatggatcacttgagatcaggagtttgagaccagcctgaccaatatggtgacactactaaaaatacaaaaattagatgggtgtggtggtgggcacctgtaatctcagctacccaggaggctgaggcaggagaatcacttgaacccgggagatgggggtttcagtgagctgagatcacaccatttcaatccatcctaagtgacaagagcttaactccgtctcaaaacaaaacaaaaaaatttttttgtaag

SEQ ID NO: 48606 - DNA, 601 bp, Human
tcctgcttttaccaccgaaactctcagccttgggccaaccagtacagtgggtcaccctaccattttttttttttttttgagtcagggtctcactcttcacccaggctggagtgcagtggtgtgatcatggctcactgcagccttgaactcctggactcaagtgatcctcccacctcagcctcctgaatagctggaactacaggcatgcgccaccatgcctggctaattaaaaataatttttttttttggcgaagcatggtggcggatgcctgtaatcccagcactttgggaggctgaggcrgatggatcacttgagatcaggagtttgagaccagcctgaccaatatggtgacactactaaaaatacaaaaattagatgggtgtggtggtgggcacctgtaatctcagctacccaggaggctgaggcaggagaatcacttgaacccgggagatgggggtttcagtgagctgagatcacaccatttcaatccatcctaagtgacaagagcttaactccgtctcaaaacaaaacaaaaaaatttttttgtaagatggggtcttgctatgttgcccaggctggtgtggaactcctgggctaaaa

SEQ ID NO: 48607 - DNA, 601 bp, Human
cccagcactttgggaggctgaggcagatggatcacttgagatcaggagtttgagaccagcctgaccaatatggtgacactactaaaaatacaaaaattagatgggtgtggtggtgggcacctgtaatctcagctacccaggaggctgaggcaggagaatcacttgaacccgggagatgggggtttcagtgagctgagatcacaccatttcaatccatcctaagtgacaagagcttaactccgtctcaaaacaaaacaaaaaaatttttttgtaagatggggtcttgctatgttgcccaggstggtgtggaactcctgggctaaaataaccctcccacctcggcctccgaaagtgctttgattacaggggtaagccagagtgcctagtagtcaccctactttgatgtatcagaacaatattagcaaagaccagagaactttatagttatagaaagaccttagacctttagaactgtagacccttgaaccttagtacttagtattcatagaggtctggaaccttagaagtgtttaatcatcagcattaaaactggcaaagaccctgaggagcctcagagatatggaacgtcataatcataagc

SEQ ID NO: 48608 - DNA, 601 bp, Human
tccgaaagtgctttgattacaggggtaagccagagtgcctagtagtcaccctactttgatgtatcagaacaatattagcaaagaccagagaactttatagttatagaaagaccttagacctttagaactgtagacccttgaaccttagtacttagtattcatagaggtctggaaccttagaagtgtttaatcatcagcattaaaactggcaaagaccctgaggagcctcagagatatggaacgtcataatcataagcctttaaaacatgacaccctagcacctttgacccttgggaccttracatcttagaaacacggagcgctagaatcataaaatatagatgatcataatcatgaattcttaaaacccaaaggtcagaatcagttccctccaaatcttagaactttagtaactcagcagtttataatcacaagatggatctctgatactaagatttttggaactttatttatttatttatttatttgaggtggagtctcactctgttgcccaggctggagtgcagtggcgcaatgtcagctcactgcaacctccacctcccaggttcatgagattctcccgcctcgggagtcccgagta

SEQ ID NO: 48609 - DNA, 601 bp, Human
aaccctgtctctattaaaaatacaaaaattagctgggtgtggtggcgcgtgcctctaatcccagctactcaggaggatgaggcaggagaatcgcctgaacctcagaggcggaggttgcagtgagcctagatcgtgccattgtactccagcctgggcgtcaatagcaaaactctgtctcaaaaaaaaaaaaaaaagagagagagagagagaaatctgtatatgccacaaagtatgaaccagattcaactggtggattgccagctttgtctgatctagaaacctagactgatgaaaacatacrctcatggaaacttacagtcatacttttagagccttagaaccttaaaaaggtaggaacatatcaacttagaattctagaatttactaatttagtgtaagtgagtttgtttttagttttgtttgtttgtttttgtttttgagaaggagtcttgctctgtcgcccaggctggagggcagtgacactatctcggctcactgcaagctccgcctcctgggttcatgccattctcctgcctcagcctcccgagtagctaggactacaggcgcctgccaccatgccccgctaattttttgtattttt

SEQ ID NO: 48610 - DNA, 601 bp, Human
tctgcccgccttggcctcccaaagtgctggaattacaggcatgagccaccgcgcccgtcctgtttttagtttttgtttgttttttgaggaggagggggtctctccatgttgcctagacaggtctcaaactcccggtgtcaactcatccttctgagtagctgggattacagatgtgtaccaccactcccagctgtagaatttattattattattattattattatcattatcattattattatttggactgctgccaggctggagtgtggtgataaaaatcatagctcactacaacctccarctcctgggcttgagcaatcctcccaccgtagcctcccaagtagctgagactacaggcatgcaccatcatgcccagctaattttcttattattttatttttttatagagacagggtctcgcaatattttccaggctgaacttgaactcctggactcaagtgatcctcccaccttggcctcccaaagtgttgggattacaggtgtgaaccactggaatttattttatctagaaaatattaattcagtgcctgctgtgtgcctggctcatgctggacaacatgaggggcatagtggtgactga

SEQ ID NO: 48611 - DNA, 601 bp, Human
gccaggcgtggtggctcacgcctgtaatcccagcactttgggaggcagaggcggatggatcacgaggtcaggagattgagaccatcctggctaacacagtgaaaccctgtctttactaaaaatacagaaaattagctgggcgtggtggtgggcacttgtagtcccagctgcacgtgaggctgaggcaggagaatggtgtgaacctgggaggcggagcttgcaatgagcggagatcaagccactgcactccagccggggttaacagagagagactccgtctcaaaaaaaaaaaaaaaaaaaattagctgggtgtggtggcatgagcctgtagtcctagctactcaaaagactgaggtgggaagattgcttgagcccgagttccaggctgcagtgacctaagaaggtgccactgccctccaacctgggcaacagaatgagataccatctctaaaaaacaaacaaacagaatgtgacatatgacagctccagaaaagcatcctcatgccacctccctatcactacagtccaagggtgtactctcttaacttctaacagctcagcttcattttgctggtgttttaactttctgtaaatggaataa

SEQ ID NO: 48612 - DNA, 601 bp, Human
gcagtgacctaagaaggtgccactgccctccaacctgggcaacagaatgagataccatctctaaaaaacaaacaaacagaatgtgacatatgacagctccagaaaagcatcctcatgccacctccctatcactacagtccaagggtgtactctcttaacttctaacagctcagcttcattttgctggtgttttaactttctgtaaatggaataatgcattgtgtgttgttttatgtccggcattattcactcaacattatgcttgtgggagattcatccatgtctccctgtgcttgtgggktggtccttctccttgctgtatagtgttgcgtggtgtgaatgtaccacagtgtgtttgtgcattcacctgttgataagcatttgggttgctgctagtttggggctactataaatggtggtgttgggccaggtgtggtggctcatgcctgtaatcccagcactttgggaggccaaggcaggcggattacttgagtccaggagttcaagaccagcctgggcaatacagtgagaccccatttctactaaaaatacaaaaaagtttgctgggtgtggtggtgcatgcctgtaatcccagctactc

SEQ ID NO: 48613 - DNA, 601 bp, Human
tgtttctggtggtttacacccacgcaggagtgaagctgtccaatcatagagtaagggtatatattttattttacatatatatgtatctgttgttgttaattgagacaaggtcccgctatgttgctcaggctggtctccaactcctaggctcaagcagtcctcctgccttggctgcccaaagtgtttggattacatgtgtgagccatgcgcccggccaagtgagtgcatatctaactttagtagagactgcccgtttgtatcgttttatattcccactagcagtgtaccagagattcagttrctgtgcaccccacccttgcgatggtcaggttttttgttttgttttgttttgtttgagacagagtcccactctgtcgcccaggctggagtgcagtggcgcgatctctgctcactgcaacccccgcctcctgagttcaagcaattctcctgtgtcagcctctcaagtagctgggattacaggcgcacaccaccacgctcagctaatttttgtatgtttagtagagacggggtttcgccatgttggccaggctggtctcgaactcctgacctcaggtgatctgcctgcctcagcctcccaaag

SEQ ID NO: 48614 - DNA, 601 bp, Human
caaaaaaaaaacaaaacaaaaaccaaaaaacaaaaaacaaaaaaaccactttattggcacccaccaccatgcccgctaatttttgtttttctggtagaggtggggtttcaccatgttggccaggctggtcccaaactcctgtcgtcaggtgatccacctgcctcagcctcccaaagtgctgggattacaggcgtgagccaccgtgcctggcctaaactttattatttatttattttggaggcagagtctcgctttgtagcccaagctggagtgcagtggcacgatctcggctcactgcaayctccacctccctggttcaagcgattgtcatccctcagcctcctgagtagctgagattacagatgtgcgccactaagtcctgctagttttttgtatttttagaagagacagtgttcgagaggctggtctcgaactcctgagctcaggcaatccacctaccttggcctcccaaagtgccagaattacaggtgtgagccaccatgcccagcctttttaaaactttagattatgaaataattacacattcataggaagtcgcaaagatagtagagatgataaaaagacatgtaactggctggtt

SEQ ID NO: 48615 - DNA, 601 bp, Human
cagctgctcaggaggctgaggcaggagaatcgcttgaacccaggaggcagaggctgcagtgagtcaagatcgcgcgactgcactccagcctgggcgacagagtgagactccgtttcaaaaacaacaacaaaagccaaaaaaaaaaaaaaagaaagaaaaaaaagaatagataggaaccaacgctgttggaaggaattgagccataaacaaggggaagagcactggggcagggcggagcttgattgggatgggcgtggttctagctagggacccgaaagggaagcagcgaggggtgtgacgaggagtttttgtttgtttgtttgaaacgaagtctcgctccctcacccaggctggagtgcagtggcgcgatctcggctcaacagcagcctccgcttcccgggttcaaaggattctcctgcctcatcctcccgagtacctaggattgcgggagcgcgctaccaagcccggctaatttttgtatttttagttagaggcagtgtttcgccatgttggtcaggctggtctcgaactcctcgcctcaagtgaaccacccgcctcggcctcccaaagtgctgggattacaggattgagccactacgcc

SEQ ID NO: 48616 - DNA, 601 bp, Human
gggttcaaaggattctcctgcctcatcctcccgagtacctaggattgcgggagcgcgctaccaagcccggctaatttttgtatttttagttagaggcagtgtttcgccatgttggtcaggctggtctcgaactcctcgcctcaagtgaaccacccgcctcggcctcccaaagtgctgggattacaggattgagccactacgccggggcggccatgggattagtggcaaaacattggtagagagggatccaatggcagggccagggctgagactatgggctaggagggcggggcttcatgaagggggcgtggttatcaggttcgaagtggggcgcccgtggaaggggcagagccagggacgtgaataaaccttgaagggatgtgattctttaaagggtctggctatgggaagagacagagcttctttagaaggattgagtcctgtgtcttggataaaacgagaggaggacagcctgatcctggacactcagggggcgtggccacgggaggcgggcttctttggaagctgcggggccgagggcgccatactcctgtctgtccagacccccgatcgcccaccgcccctgtcgccctagcccagg

SEQ ID NO: 48617 - DNA, 601 bp, Human
atgggacttaggaaagcgttccccaccatttacccattcattctttccttccaataatatcctaatatgctggaatcctattccaggtgttagggatgaaaataatgataaaaataattgtcacgatcaccaccatcacgataatcattttgtatcgaccctgttccaaacactgttctaagcacttgacatttaatacacacagcaaccccataaattaggtactatttagtaccccattttaccagtgaggaaatggaagcccagataggtggtgtcatctgcccaagatcacatatasctgggtgttggagctgaaattcgaatccaggcaatcttgatccagtatagagacaaatagacaaaggtgtgccttttaggagcttacattgtggtgaggaagacagataataaatacataaatatgtaaagaagacatgtatggaaaaaggaccagttctagttagagaagtttaaaaagctatgcagggccaggtgaagtggcctgtaaacccagcactttgcgaggctgagatgggaggaacactaaggccaggagtttgagaccagcctggccaacataatgagaccttaaataaat

SEQ ID NO: 48618 - DNA, 601 bp, Human
gtccctgagatagaaatgagcttggcctgttggaaatacaggaggaagagcagagtggctagagaatgggaggcaacgggagacatggaggagctgaggctcaggggatggaaggggctaggtgatctgtgatgagtagtttggattttattctgtctgagatggggagaggttgcaacattttatcaaggggaggtgcatacaagtttagaaagatagatccctttggctgggcatggcggctcatgcccataatcccagcactttgggaggctgaggcaagaggattacctgagtttargagttcgagcccagcttggccaacatggtgaaaccccgtctctactaaaaatacagaaattaactgggcttcatggtgcacgcctgtaatcccagcgactcaggaggctgaggcaggagaatgtgagccgagaccacaccactgcactccagcctgggtaatagatagagactctgtctcaaaaaaaaaaaaaaaaaaaaaaaaagtgaccgggcttggtggctcatgcctgtaatcccagcactctgagaggctgaggtgggtggatcacctgaggtcaggagttcgagacaagcctga

SEQ ID NO: 48619 - DNA, 601 bp, Human
tgatctgtgatgagtagtttggattttattctgtctgagatggggagaggttgcaacattttatcaaggggaggtgcatacaagtttagaaagatagatccctttggctgggcatggcggctcatgcccataatcccagcactttgggaggctgaggcaagaggattacctgagtttaggagttcgagcccagcttggccaacatggtgaaaccccgtctctactaaaaatacagaaattaactgggcttcatggtgcacgcctgtaatcccagcgactcaggaggctgaggcaggagaaygtgagccgagaccacaccactgcactccagcctgggtaatagatagagactctgtctcaaaaaaaaaaaaaaaaaaaaaaaaagtgaccgggcttggtggctcatgcctgtaatcccagcactctgagaggctgaggtgggtggatcacctgaggtcaggagttcgagacaagcctgacaaacatggagaaaccctatctctactaaaaataccaaattagctgggcctggtggcacatgcctgtaatcccagctactagggaggccaaggcaggagaatcgcttgaacctgggaggtgg

SEQ ID NO: 48620 - DNA, 601 bp, Human
gagaccaatgctggaaagaggtgaactgtccccagcctgctctcttctctctctcccccatcccatttcatcctacatttcaagagatctcacattcacctgtgtggaccctcagtgctatgtccaagctctggccaccctctcccgctgtgagcatctcccttctgcctcacagggcatacacaggaaagttcaaagtccttggtcgcttcagtgtggctgagctggtggcggggtggggtgcaggctctactgggaaggttccctttggcccccaactctctgccctgcagggagcagtaagacctgaaactcaattgtcctctgtagagcagctcctgggaggacggagggaggggcaggtgtgggatggaggtgggcttctctgactctcatccttctggctgtctgtcttgcaaaggagatcatggggacttttgccatctgtttctccatgtgtctatctctatatctgcttttccttgtacttatctcttctctcctccctccttccctcctttcctccttcccttttctcttcatgtcttctttctctctcctctcctttccctccccatctctgtctatatcttgctctctc

SEQ ID NO: 48621 - DNA, 601 bp, Human
cagttaccctgaggtaaacatccagaatttcaccaccagctggcgggatggcttggccttcaatgccctcattcaccggcacaggtaccacctggcctgggacagcccagtcctgcccttcagccccccatatccctgcagctgcacacctgtacatgtacttgtgtagatggcacacacagacataaagacccatcccttcacctctacacacacatacagttttctttcccttcacacacatgccctgcacatttacacacaggaacacacacccacacaggctcctgtccaggccacrtaccctgtgcacacatggacacacatgagccctcgcacagatgcatacacacacacagatacccacgcacgtgcacagcctgcccgcagggtaggaagctcgctcccctgtcactgtcatgctgctgtgtacccagcacctcctcctatcagaaaatgctttctcaggccaggcgcagtggctcacacttgtaatccctgcactttgggaggccaaggtgggaggatcacctgatgttaggagttcaagaccagcctggccaacatggcaaaaccccatctctactaaaaataaaaataa

SEQ ID NO: 48622 - DNA, 601 bp, Human
cccattctcaatttccacccatccccaacaccctccccaaccctgctttcaaccatctcccactaaaccaactcccactcccctaccccagccccaaacccagtggcatctccaacgccatccccacccctaacgccaaccccatcttcaagtgtctccatccccaccacatcttcggctccaactccattcctatccccaccctaatccatttccaacctcatttcgccctagcccatccccatgtctatctctcccacaactccatcctcatcctcagctgcttttccatttccagtcyatccctaatcccatccctgacttcagcctcagccccaaaccaggatcagccctgacacccgtctcccatcccaaattaaagctgctcccttcctctgagctctactgtgtgccagacacatgtctgggaaccttatcagagctgttcactttcatcttcacactgacctggttagagagaatttatcaaccctgttttattttattttatttatttatttatttatttatttatttatttatttatttatttttttagatggagtctcactctgtcgcccaggctggagtgcagtggcat

SEQ ID NO: 48623 - DNA, 601 bp, Human
tgtctatctctcccacaactccatcctcatcctcagctgcttttccatttccagtctatccctaatcccatccctgacttcagcctcagccccaaaccaggatcagccctgacacccgtctcccatcccaaattaaagctgctcccttcctctgagctctactgtgtgccagacacatgtctgggaaccttatcagagctgttcactttcatcttcacactgacctggttagagagaatttatcaaccctgttttattttattttatttatttatttatttatttatttatttatttatttatttatttttttagatggagtctcactctgtcgcccaggctggagtgcagtggcatgatctcggctcactgcaagctccacctcctgggttcacaccattctcctgcctcagcctcccaagtagcttggactacaggcgcccgccaccacgcccggctaattttttgtatttttagtagagacggggtttcaccgtgttagccaggatggtctcgatctcctgaccttatggtccacctccttggcctcccaaagtgctgggattacaggcatgagccaccatgcccggcctatttattt

SEQ ID NO: 48624 - DNA, 601 bp, Human
caggcgcccgccaccacgcccggctaattttttgtatttttagtagagacggggtttcaccgtgttagccaggatggtctcgatctcctgaccttatggtccacctccttggcctcccaaagtgctgggattacaggcatgagccaccatgcccggcctatttatttaatttttgagacggggtctggctctgttgcccaggctggagtgcagtgccatgatctcggctcacagcaacctccacctcacaggctcaagtgattctcccatctcagcctcccaagtagctgggactacaggygtgcaccatcacacctggctaatttttgtatttttagtagaggtggggtttcatcatgttgcccaggctggtctcaaactcctgacctcaggtgatctgcccactttagcctcctaaagtgctggaattataggtgtgagccaccgtgcctggacgttttatttatttattgttcttatgttcatttatttatttatttgagacagagcctcgctctgtcactcagactggagtgcagtgggggcgatcctagctcactgcaacctccgcctcccgggttcaagtgattctcctgcctca

SEQ ID NO: 48625 - DNA, 601 bp, Human
caggctggtctcaaactcctgacctcaggtgatctgcccactttagcctcctaaagtgctggaattataggtgtgagccaccgtgcctggacgttttatttatttattgttcttatgttcatttatttatttatttgagacagagcctcgctctgtcactcagactggagtgcagtgggggcgatcctagctcactgcaacctccgcctcccgggttcaagtgattctcctgcctcagcttcccaagtaactgggactacaggtgcacgccaccaagcctggctaatttttttttttttttgtatttttagcagagacagggtttcaccattgttggccaggctagtctcaaactcctgacttcaagtgatctgcttgcctcgtcctcccaaagagctgggattacaggcgtgagccatcacacctggcttacttatttatttttttatccaactgaatttaatatttaaaccctgtttaattattattattatgtttgaaatggggtctcactgtgttgcccaggctggagtgcagtggcacaatcttggctcactacagcttcaacctcctgtgctcaagcaatcctctcacctcagcc

SEQ ID NO: 48626 - DNA, 601 bp, Human
tttaacacaagtgatagaaactcagttcaaatggcttaaggtgaaaaggagtggattggctaatgtaaccaaaatgttcagggaagcctagtcaacatggcgaaaccccgtctctaccaaaaatacaaaaaattaggtaggcatggtggtgcacgcctgtagtcccagccactgcagaggctgaggtgggagaatcacctgagcctgggaagtcgaggctgcagtaagccaagattgtgccactaaactccagcctgggcaactggactgagaccctgtcagcaaaaaaataaaataaaawaaaaaaaagtctggggaagggtgggttttacctcaggcatggctggatccaggtatggctcaagggtgcttttaggactccatctgagaccaggcatggtgtctcatgcctgtaattccagagctttgggaggcaaagatgtgaggattgcttgaggccaggagttttgggcaacatagtgagaccccatctctatatcaaaaaagaaaaaaaaaagaaaaagactcaggccaggcacggtggctcatgcttgtaatcctaacactttggaaggccgaggcaggcggatcacttgaggtc

SEQ ID NO: 48627 - DNA, 601 bp, Human
ctggacatggtggcacgcgcctgtaatcccaactactctggaggctgaggcaggagaatcacatcaacctgggaggtggaggctgcagtgagctgagatcaagccattgcactccagcccaggcgacagtgagagactctgtctcaatcaaacaaacaaacaataccaaacaacaacagcaacaacaacaaaaatactcccccgaccttgttttgcattgtgatattttccgttccttctattctattccaccaaacaaatgctggctgtgacccattaaattaacttcactgttttctartcgccaactagccatccaggaggaaggtgaactatttaaggaaaaagagggagttcggggttaagcacagtggctcatgcctataatcccaacacttcgggaggccaagtggaaggattgcttgaggccagccgttcaagaccagcctggccaacatagtgagatcctgtctctattttaaaaagaaaaaggagtgcagataaccactgggattgatagataatgcaacagaggatgacagagggaacctagaaacatggtttaagaaaagagaagttggccggtggcagtggctcatgc

SEQ ID NO: 48628 - DNA, 601 bp, Human
atgttgaccaaaaatcataatccctgatactggtgatgacgtggtaaaattaaaacaacatttcagttggctgttcatttatttgtccagaaagaatgtattggatatctacaatctgccaggagtattcccaagcactttatatacctttctaaagtatcccaacattcttccgggcacagtggctcatactgtaatcccagcacttcaggaggctgagatgggtggatcacttgagctcatgaattcaagaccagcctgggcaacatggtgaaaccccgtctctctctctacgtgcgcrcacacacacacacacacacacacacacaaaatatatatatacacacacatatatatacacacatatatacgtatatatacacatatatacgtatatatacacatatatacgtatatatacacatatatacgtatatatacacacatatatgtatatatacacatatatatgtatatatatatacacactatatatatgtatatatatatacaaaatttagccaagcatggtggtgcacatttgtagtcccagctacatgggaggctgagttgggaggatgccttgagcccaggaggtaga

SEQ ID NO: 48629 - DNA, 601 bp, Human
tctaaagtatcccaacattcttccgggcacagtggctcatactgtaatcccagcacttcaggaggctgagatgggtggatcacttgagctcatgaattcaagaccagcctgggcaacatggtgaaaccccgtctctctctctacgtgcgcgcacacacacacacacacacacacacacaaaatatatatatacacacacatatatatacacacatatatacgtatatatacacatatatacgtatatatacacatatatacgtatatatacacatatatacgtatatatacacacatataygtatatatacacatatatatgtatatatatatacacactatatatatgtatatatatatacaaaatttagccaagcatggtggtgcacatttgtagtcccagctacatgggaggctgagttgggaggatgccttgagcccaggaggtagagattgcagtgagcagagattgtgccactgcactccagcctgggcaatagagccagaccttgtctcaaaaaaaaaaaaaaaaaaattcccaatatcccaatttccatagtaaagatcctagaattcagaactctctctctctctcttttga

SEQ ID NO: 48630 - DNA, 601 bp, Human
ctatatatatgtatatatatatacaaaatttagccaagcatggtggtgcacatttgtagtcccagctacatgggaggctgagttgggaggatgccttgagcccaggaggtagagattgcagtgagcagagattgtgccactgcactccagcctgggcaatagagccagaccttgtctcaaaaaaaaaaaaaaaaaaattcccaatatcccaatttccatagtaaagatcctagaattcagaactctctctctctctcttttgagacaggatcttgctctgttgcccaggttggaatacagkggcatgatcatggctcattgcagcctccaacacctaggctcaagcgatcctcccacctctgcctcctgaggaactgggactacaggtgcatatcaccatgcccagctaattaaaaaaaattttttttgtagagacagggtctcactgtgttggccatgctggtcttacaactcctgggctcggctgggcgtggtagctcacacctgtaatcccagcactttgggaggccaaggcaggtggatcacctgaggtcaggagttcgagaccagcctgaccaatatggtgaaaccccatctctac

SEQ ID NO: 48631 - DNA, 601 bp, Human
cataggtgtgcacccccacgcccagctaatttttgtattttaggagtctcaccatgttgcccaggctgctctccaactcctgagctcaagcgatccacctgcttccgtcttccaaagtgctgggattacaggtgtgaaccactgcacccggctgagaaatttgaaaacattatttaaaaataacaatacactgggagtggtgcgtgcctgttagacctgtgaggctgaggtgggaggaccgcttgagcctgcgaattggaggcttcagtgtgccataaacgagttcatgaatagccactgygttctagcctgggcaacatagtgagatctcacgtcttaaaaaaatttttttaaatctaaatatctaacgtgttaatataacttttttattaaaaataacttttcataacacaaaatgtactaagagtggcattgtttcgtacctttgcaaatctctttaaagtctggtttaagagatggcagctgggcttctcttaaatcagagtcggcttctgctctcagtctctcctgccgcctctggaaaactccactgaacactcgggaaagaatgagagtgaaaaagcaaatggcgtcttaacac

SEQ ID NO: 48632 - DNA, 601 bp, Human
gatttctgcttctctggggctctttcctatttctatttaattccatgttgtcttagatttgatttaagtggatttttttttttgagacggggtctcactgtgttgcccaggctggagtgcagtagcacgatctcggctcactgcaaccctcacctcccaggttcaagtgattctcctgcctcagcctcccgagtagctggggctacaggcatgagccaccacgctggctaatttttgtatttttagtagagacacggtttcaccatgttggccagactggtcttgaactcttgaccacccrccttggcctcccaaagtgctgtgattagcggcatgagccactgcacctggccttaagtggatatattgtgaaaaggtaacctgaggctgtcaacccaaaagatacagaaggatatacaatgaaaggtttctttcttaagtctgccctgagcatgggatagctggtcctgttgttaaaatgttaggctgggtgcagtgactcatgcctgtaatcccagcacttcggtaggctgagacgggaggattgcttgtgctgaagagttccagaccagcctgggcaacatagtgagaccccttctct

SEQ ID NO: 48633 - DNA, 601 bp, Human
ctctctccggcatgatccaggccagaaggggacccagtacccctccttctgtcttcccatctcctgacagaaagcatccctggtcacttcactgtgccacccccagccccaggaccgctaccccttttctgtttacggctcagacatcctttccctagatttatctggggcaaggcagcatgcttctaaaggaaacttttatgggaattctgttcttgaggatgcaaactcatcatttagtgcccccttttccatccaggcctggatccttcctttgttccactttttttttttttttttttgagacagggatcttactctgttgcccaggctggagtgcagtggtgcaatcatagctcactgcagcctggaactcctgggctcaaccaactctcctgcctcagcctcctgagtagctggactataggtgtgagccactgagcatggcctgttccacatttcttgagcacctgctgcatgccaggctcagcaaaacgaggaggaggagcccgggggactgttcattccatgattcattcattcattacttttcagtcattcattaattgctcctttcactctattgtttattcactcatcc

SEQ ID NO: 48634 - DNA, 601 bp, Human
ctcctgacagaaagcatccctggtcacttcactgtgccacccccagccccaggaccgctaccccttttctgtttacggctcagacatcctttccctagatttatctggggcaaggcagcatgcttctaaaggaaacttttatgggaattctgttcttgaggatgcaaactcatcatttagtgcccccttttccatccaggcctggatccttcctttgttccactttttttttttttttttttgagacagggatcttactctgttgcccaggctggagtgcagtggtgcaatcatagctcamtgcagcctggaactcctgggctcaaccaactctcctgcctcagcctcctgagtagctggactataggtgtgagccactgagcatggcctgttccacatttcttgagcacctgctgcatgccaggctcagcaaaacgaggaggaggagcccgggggactgttcattccatgattcattcattcattacttttcagtcattcattaattgctcctttcactctattgtttattcactcatcctccagtcaattaaacatgtactgagcccgtgctctgtacggagtgggggtgtgttcacag

SEQ ID NO: 48635 - DNA, 601 bp, Human
gggccgagggccgtgggggggccagcggccctgcgccctcctgcagccagcgatggctctgaaccaagccctcgcccctttaaaggtgttcagtaatcaagccccttcccttagggatgatctgcacacattagggacgatctcccctaatccgagatggtccaggcccccttccttattagtgacggttcaggagacctgctgtcttcccctccttcccttgcattccatagaaacgattctagactttggccacattagagatggcctagtaaacattttcctaaaccctaaacagagmtaggcctggccctgagcccctccatctgtgtgacccaggatcatcccctcctccatcatcaccccgtacctaagtttcttccaaccaaagctggttcaggaaccaggtctaacccctaaacccctcagcctcaattaaagacgattcgaccctcccccctatgttgaacacccatgggagattgttctctccgcacacggaataaacaagggcctccataccgtgcccccctcccccataactggggtaggccgggacttgagccactggaggaaccccctgttccccctcgcccccact

SEQ ID NO: 48636 - DNA, 601 bp, Human
ccctcaggacaggggacaggggagcaaaggattgggcattctggggacccttccatccatcctctatccaggaaagagcttgagctgcacccacccccaatataaaggcctcacttgcaaaggttttttcatcctttcctattccttccacccatacaccctagcagcccaggccctgaacctgggacttcctgaagggatggggggctgtggcaggttgaggggaccagctgagccctcctgccctgttctgcacagctggatggctggatccatgagaagatgctgatggcgcgggatrgcacgcgggaggacaaccacaagctgcataagagatggctccggcaccaggcattcatggccgagctggctcagaataaggagtggctggagaagatcgagcgggtgaggaagctgatggcccctctgcctgtgccaggtgcaggaggcctccagggagcccacgtctcacctgctgcacccgctgctgccatcctgctggtcttacacctctggactgactcaaatcagctccagatctgctcctagctatgtggctttgagtgattcatgtaacatctttgagcctcaatttgctcat

SEQ ID NO: 48637 - DNA, 601 bp, Human
gcggaagaagctgggcgagatccgccagtgctgggcggagctggagagcaccacccaggccaaggcacggcagctctttgaggccagcaaagcagaccagctggtgcagagctttgctgagctggacaagaagctccttcacatggagagccagctgcaagacgtggaccctggaggagacctggccactgtcaacagtcagctcaagaagctgcaggtatggtcttcctggcccagatgagggctccctatgccacatgggggccaggtcagggtccaaccccactcaaggtatgtcaartggaggggatttaatacagggatttatttcaaacttgtagaagatgagaaagggaatattgaagcaatccagctagtaataactgttggaagcagccaccactccctaaggtatggagtacaaagggaaaaggaaggatctagagccacaaagcagtaggtaaatgactagcatgctaaaggtttcacaggaccctgacactcatttcctggatggagaaaccaaggctcaggggtatgggaatggctttgcatggaataacaatgacattcattgagcatttctctaccagtctctggg

SEQ ID NO: 48638 - DNA, 601 bp, Human
ctgctttgtatctgctcccagcttggcagctccatgcttggtacacagcagttcacgtggaatgaccagaggtgaacgtagccattgcttctcacctcccagggagtaatggctcctgcctttgattttctttttttgttgctgttgttgatgttgttgtttgtttttttcttcaagatagttactcactctgtcgcccaagctggagtacagtggcttgatctcagtccattgcagcctcaaactcttgggctcaagtgattctcccacttcagccttccaagtagctgagaccacaagygcataccaccacgtctggataatctttttaaattttttatagagacagggtctcaccatattgcctagggtagtctcaaactcttgggctcaagcaaccctcccgcctcagccttccaaagtgcttggattacaggtgtgagccatggtatctggcccacgtgactcctgcttttacctgtcaggaacaatgcctgactgactgatgggaaactgaggttccaggaggtgagaggtgaacttacttgtccagagtagcaaatagcaaagcctggatttcagtccagtgcccttgactctt

SEQ ID NO: 48639 - DNA, 601 bp, Human
ctcaaactcttgggctcaagcaaccctcccgcctcagccttccaaagtgcttggattacaggtgtgagccatggtatctggcccacgtgactcctgcttttacctgtcaggaacaatgcctgactgactgatgggaaactgaggttccaggaggtgagaggtgaacttacttgtccagagtagcaaatagcaaagcctggatttcagtccagtgcccttgactcttcactcctcctttttgatatatttcctatgtagttatatagtgcttggcatagtgtatggcaaaaaaaaaaaaaaaggctagtaagaaatacataatgacactgattagtatgtattcattcatctctgtggcaaataattattaggtaccagctgggtgtggtggctcacgcctgtaaccccagcacttcgggaggccgaggcgggcggatcacgaggtcaacagttcgagaccagcctgaccaatgtggtcaaacctcatctctactaaaaacacacacaaaaaaattagctgggcatggtggtgcacgcctgtaatcctagctactcaggaggctgtaatcccagctactcaggaggctgaggcaggagaatc

SEQ ID NO: 48640 - DNA, 601 bp, Human
caaatgtctgggtctccaggaccccccttacactcttaaaccgcattgagatccttagaaagctttgtctgtgtgggttagacctattgacattcactgtattaaaaatgaaaatcgaggccaggcataatggctcatgcctgtatcccagcactttgggaggccgaggcaggaggattgcttgagcctaggagtttgagactagcctgggtaacggagcaacagcctgtctctattttattttatttagttatttgagccaggatctcgctctgttagcaggctggactgcagtggtgcratcacggctcactgcagcctcaacctctggggctcaagtgatgctcctccctcagtcccgcaagtagctgggactacggacccacaccaccatgcctgattgattttttttttaagaaacagaatctcactatgttggccagtctttatctctatttattgaactaaaaaaaaaaactaaaacggagtctggctctgccacctaggctggagtgcagtggcttgatctcagctcactgcagcctctgcctcctgggttcaagcagttctcctgcctcagtctctggagtagctgagatta

SEQ ID NO: 48641 - DNA, 601 bp, Human
ggtgcgatcacggctcactgcagcctcaacctctggggctcaagtgatgctcctccctcagtcccgcaagtagctgggactacggacccacaccaccatgcctgattgattttttttttaagaaacagaatctcactatgttggccagtctttatctctatttattgaactaaaaaaaaaaactaaaacggagtctggctctgccacctaggctggagtgcagtggcttgatctcagctcactgcagcctctgcctcctgggttcaagcagttctcctgcctcagtctctggagtagctgrgattacaggcctgtgccaccaagcctggctaatttttgtatttttagtagagatggggtttcagcatgttgcccaggctggtctcgaactcgtggcctcaggtgatcggcctgccttggcctcccaaagtgctgggattacaggcatgagccatggcatccagactgtagttctctttcatgtctagaatagaagagagctagcttctcccatccgtgtctgtattcaatccatttcactagcacaggtcatcaggtctctgaaaaacactgctgcatgctggagagagaatgagaatgg

SEQ ID NO: 48642 - DNA, 601 bp, Human
atctcagtgaagggcatggatgctggcgctgggctgcctgggtcaagccctggctctgtgccttatcacctggatagcccaaggaggttacttttctctccatgcttcagtttctttttctttttttaagagggagtctcactctgttgcccaggctggagtgcagtggcaggacctcggctcactgcaacctccgcctcctggcttcaagtgattctcctgcctcagcgtcctcctgagtagctgggattacaggcacctgccaccacgcctggctaatttttgtatttttagtagagayggggtttcaccatgttggccaggctggtctcaaactcctgacctcaagtgatccacccacctccgcctcccaaagtgctgggattacaggcatgagccaccgcgcctggctgtgcctcattttcttcttcagtaaaatgggcataatgatatttctgacctcataaggacattgtgaaggtgaaaagacataatgcattaagtggtttcagaactgctgacccaacaaatctaagattcagtatttattcacaggtctttaatttttttttttttagaccaagttttgttcttgtcaccc

SEQ ID NO: 48643 - DNA, 601 bp, Human
ctcctggcttcaagtgattctcctgcctcagcgtcctcctgagtagctgggattacaggcacctgccaccacgcctggctaatttttgtatttttagtagagacggggtttcaccatgttggccaggctggtctcaaactcctgacctcaagtgatccacccacctccgcctcccaaagtgctgggattacaggcatgagccaccgcgcctggctgtgcctcattttcttcttcagtaaaatgggcataatgatatttctgacctcataaggacattgtgaaggtgaaaagacataatgcwttaagtggtttcagaactgctgacccaacaaatctaagattcagtatttattcacaggtctttaatttttttttttttagaccaagttttgttcttgtcacccaggctggagcgcagtggcacaatctcggctcactgcaaccctctgcctcctgggttcaagtgattctcctgcctcagcctcccgagtagctgggactataggcacccgccaccatacccggctaatttttgtatttttagtagagatggggtttcgccatgttgtccaggctggtcccaaactcctgacctcaagtg

SEQ ID NO: 48644 - DNA, 601 bp, Human
ttcatttgtttttgttcatattccatttggggcatttacccctctccatgctgctttttaattttaatttatttttattttttgatagatggggtctcactatgttacccaggctggtcacaaactcctgggctcaaacagtcctcctgccttagcccctcaaagtgctgggattattcgcgtgagccactgcacctggccccaaaacacattttaaaaaagcaacatggatgattgggcacagtggctcatgcctgtaatcccagcactttgtgaggccaaggcaggaggatcgcttgarcccaggtgttccagaccagcctgggcaacatagcgagattcacatgcctgtgttcccagctactcagaaggctgaagtgggaggatcacttgagcccaggaggttgaagctgcagtgagctgtgatcgtgtcactgcactccaatctggtcgacagagtgagacccccatctcaaaaaaaaaaaaaaaaaaaaaaaaagaaaagtaatttggaggtggtaaatgaaatatttatatagtgttaaaagttagaaccatctttagctcacttgcttttgccaaattgcctgcccaggtcctt

SEQ ID NO: 48645 - DNA, 601 bp, Human
gaggaaggagttggggcctcctgctttagccagagtacagagttagctcttccctccctgtagggggttcagtctcaaccaagcccagcaaaccatgagatgggggtccccattgttcaagggaggggctgaagcccagaggagacaagggagtggccctggggtcacacagtgatgggtgccagaggcaggctccagcacgagactcctgggcccttttcccagcagagggagcccgaggcaggaagtgactgtgtgggccagggcacccagacggagcccagctgcccctcaggagctkctactggggaagggacctgccaaggccctgctgtcccctggggcatacacaggagaggggttggctgccatccagcctggcacgtttcctggctgtcccatccacccttagggcactggggccaggctgggctgagggaggtactggctcggggtctgaggggtgtagtggtatgcagtgtgtgagcgatctgtccccctcagcctctctcctgtcctcccgtcgccatctctgtgtctctctcttccctttgtgtccctctctgtcctactctctcactcccttctctctgtctcttta

SEQ ID NO: 48646 - DNA, 601 bp, Human
ggaggggctgaagcccagaggagacaagggagtggccctggggtcacacagtgatgggtgccagaggcaggctccagcacgagactcctgggcccttttcccagcagagggagcccgaggcaggaagtgactgtgtgggccagggcacccagacggagcccagctgcccctcaggagctgctactggggaagggacctgccaaggccctgctgtcccctggggcatacacaggagaggggttggctgccatccagcctggcacgtttcctggctgtcccatccacccttagggcactgggkccaggctgggctgagggaggtactggctcggggtctgaggggtgtagtggtatgcagtgtgtgagcgatctgtccccctcagcctctctcctgtcctcccgtcgccatctctgtgtctctctcttccctttgtgtccctctctgtcctactctctcactcccttctctctgtctctttatttattttgagacagaatcttactctgtcacccaggctggagtgcagtggcgcgatcttggctcactgcaatctccgcctcccaggttcaagcgattccccagcctcccaagtagctggga

SEQ ID NO: 48647 - DNA, 601 bp, Human
gatgggtgccagaggcaggctccagcacgagactcctgggcccttttcccagcagagggagcccgaggcaggaagtgactgtgtgggccagggcacccagacggagcccagctgcccctcaggagctgctactggggaagggacctgccaaggccctgctgtcccctggggcatacacaggagaggggttggctgccatccagcctggcacgtttcctggctgtcccatccacccttagggcactggggccaggctgggctgagggaggtactggctcggggtctgaggggtgtagtggtrtgcagtgtgtgagcgatctgtccccctcagcctctctcctgtcctcccgtcgccatctctgtgtctctctcttccctttgtgtccctctctgtcctactctctcactcccttctctctgtctctttatttattttgagacagaatcttactctgtcacccaggctggagtgcagtggcgcgatcttggctcactgcaatctccgcctcccaggttcaagcgattccccagcctcccaagtagctgggattacaggcacccgccaccatgcctggctaatttttgtatttttgtattttta

SEQ ID NO: 48648 - DNA, 601 bp, Human
gtagtggtatgcagtgtgtgagcgatctgtccccctcagcctctctcctgtcctcccgtcgccatctctgtgtctctctcttccctttgtgtccctctctgtcctactctctcactcccttctctctgtctctttatttattttgagacagaatcttactctgtcacccaggctggagtgcagtggcgcgatcttggctcactgcaatctccgcctcccaggttcaagcgattccccagcctcccaagtagctgggattacaggcacccgccaccatgcctggctaatttttgtatttttktatttttattttttctttttgagacggaatctcactctgtcacccaggctggagtgcaatggcacagtctcagctcgctgcaacctccgcctcccggattccagcgattctcctgcctcagcctcccaagtagttgtgattacaggcgtgagccaccacgcccggctaatttttgtatttttagtagagatggggtttcaccatgttggccaggttggtcttgaactcctgacctcaggtgatctgcctaccttggcctcccaaagttctgggattacaggcatgagccaccaccccagt

SEQ ID NO: 48649 - DNA, 601 bp, Human
tcggggcctgttgccaagctgtgcttcctggccaagaagccagatggtggagtctcaagtcctggctccccagccctcagggacctggccagctggtcggcctcagccacaggctcctgcttggagagatgggggactggtctcctgccagatgagaaaatgcactagaggctttgcagctgccaggctctgtccctggggaccccacactttttccaggcccacccccaccctaagcaaagctctttctctggccaaggaaacaccctcctcccccctgttctgcttctctgtcccatgkttttgtatccagctcagcatggcctaggagaggagtgcacattcagggactatacagtcccagtccttgccttattgggactcaaggcaagggaccccatcctttctttctttccttttttttttgtttttgtttttttgttttttgagacagagtctcactctgttgcccaggctggagtgcagtggcgcgatctcagctaattatgtcttcataattcacaaattatgtcttcaatttatgaaggtgctggctcggggtctgaggggtggagtgatcagtaactcaaattacgtcttc

SEQ ID NO: 48650 - DNA, 601 bp, Human
tgtccctggggaccccacactttttccaggcccacccccaccctaagcaaagctctttctctggccaaggaaacaccctcctcccccctgttctgcttctctgtcccatgtttttgtatccagctcagcatggcctaggagaggagtgcacattcagggactatacagtcccagtccttgccttattgggactcaaggcaagggaccccatcctttctttctttccttttttttttgtttttgtttttttgttttttgagacagagtctcactctgttgcccaggctggagtgcagtggcrcgatctcagctaattatgtcttcataattcacaaattatgtcttcaatttatgaaggtgctggctcggggtctgaggggtggagtgatcagtaactcaaattacgtcttcacaaatctccttgtcttcatttctgagcaccgctttcttctgtgttggcctcatggtcagggagtccctgatgttggcaggatgaccccaggatgcccggcctacctcctcccaacttaggaagcccatgggaaagagagcatctcttctgtgcacacacattttcctggcgaaaatggggagagtggcc

SEQ ID NO: 48651 - DNA, 601 bp, Human
gaataaataaattttcatggtgaagacatcaaaacctctagggaaatcccatgggaaaattatcgccttcatccctgttccccattcattaagttctcatcccgtcccccagtaagtaccatctgttatgaacttcttgtttactccagggaatttttatgcatgtgcaatccactataaatttatattcataggtaggttctaaattgcttcttcttcttcctctttttttttttttttttgtttgtttgttgttgagactgagtttcgctctttttgccaaagccggagcgcaatggcrcgatctcagctcactgcaacctccgcctcccgggttcaagcaattctcctgcctcagcctcccaagtagctgggataacaggcgcctgccacaatgcccggctaattttttgtatttttagtagagactgggtttcaccatgttggccagcatggtgtctatctcttaacctcgtgatccgcccgcctcagccttccaaagtgctgggattacaggcatgagccattgtgcccggctttttttttttttttttttttttttgagatggagttttgcttttgttgcccgggctggagtgca

SEQ ID NO: 48652 - DNA, 601 bp, Human
aatccactataaatttatattcataggtaggttctaaattgcttcttcttcttcctctttttttttttttttttgtttgtttgttgttgagactgagtttcgctctttttgccaaagccggagcgcaatggcacgatctcagctcactgcaacctccgcctcccgggttcaagcaattctcctgcctcagcctcccaagtagctgggataacaggcgcctgccacaatgcccggctaattttttgtatttttagtagagactgggtttcaccatgttggccagcatggtgtctatctcttracctcgtgatccgcccgcctcagccttccaaagtgctgggattacaggcatgagccattgtgcccggctttttttttttttttttttttttttgagatggagttttgcttttgttgcccgggctggagtgcagtggcatgatctcggctcactgcaacctctgcctcccgggttcaagtgattctcctgcctcaggctcccgagtagctgggattacaggtgtctgccatcacgcctggctaattttttgtgtttttagtagagatggggtttcaccatgttggccaggcaggtctcaaa

SEQ ID NO: 48653 - DNA, 601 bp, Human
gctgaggcaagaggatcccttgagcccaggagttcaaggctgcagagagttattatcttactactgcatgccaacctggatgacagagcaagaccctatcaaaaaacaaaacacacacacacaaatcaagagagttgtctgatggtggtaagcactgtgaagacgaagcaggatggagggaaattctttgattgttaaactagttccttgcactgatacatatcaatttttacagtttgtcatttgccttctaactctatgaaattttggttgatgcagaagtattttttaattattttttaattatactttaaattctagggtacatgtgcacaacgtgcaggtttgttacataggaattcatgtgccatgttggtgtgctgcacccattaactcgtcatttacattaggtatttctcttaatgatatccctcccccctccccccaccccatgacaggccccggtgtgtgatgttccctgccctgtgtccaagtgttctcattgttcagctcccacctatgagtgagaacgtgtggtgtttggttttctgtccttgcgatagtttgctcagaatgatggtttccagcttcacccatgtcc

SEQ ID NO: 48654 - DNA, 601 bp, Human
aggctgcagagagttattatcttactactgcatgccaacctggatgacagagcaagaccctatcaaaaaacaaaacacacacacacaaatcaagagagttgtctgatggtggtaagcactgtgaagacgaagcaggatggagggaaattctttgattgttaaactagttccttgcactgatacatatcaatttttacagtttgtcatttgccttctaactctatgaaattttggttgatgcagaagtattttttaattattttttaattatactttaaattctagggtacatgtgcacaaygtgcaggtttgttacataggaattcatgtgccatgttggtgtgctgcacccattaactcgtcatttacattaggtatttctcttaatgatatccctcccccctccccccaccccatgacaggccccggtgtgtgatgttccctgccctgtgtccaagtgttctcattgttcagctcccacctatgagtgagaacgtgtggtgtttggttttctgtccttgcgatagtttgctcagaatgatggtttccagcttcacccatgtccctacaaaggacatgaactcatccttctttatggctg

SEQ ID NO: 48655 - DNA, 601 bp, Human
aaataatccatctttcccttggggatttgaattggcacctatgaaacacatgaattttcctgtgtatttgggtctgcttttgcactttctgtctattcctaagacacagcagccatccaaattactatagctttgtatttatttttgataatttcttactatcaaatttttttatccggtaatcccagcactttgggaggccaagatgggcagatcacttgaggttatgagtttgagaccagcctgaccaacatggtgaaaccccatctctactaaaaatacaaaaaaaattagcaaggcrtggtgtcaggtgcctgtagtcccagctacttgggaggtcaaggcacaagaatcacttgaacctgggaggtggaggttgcagtgagctgaggttgcccactgcactccagcctggatgacacagcacccaggctgatttgttcatcctgaggtcaggagttcaagaccagcctggccaatatggtgaaaccccatctctacaaaaatacaaaaattagccgggcatgatggcaggtgcctgtaatcccagctactcaggaggctgaggcgggagaatcacttgaagccaggaggtgaaggt

SEQ ID NO: 48656 - DNA, 601 bp, Human
ccatcactcaatttcctgatttgctcattcatttgttcactcagttgatcattctagccccagccctgtgtttggatgatagtggggccacaggggtggccaaggcagaccccattgtgccccagagggttcagagtccaacggggaaaacagacttgtccccagacagtgacaattcagggtggttaggaatatgataggaaacaagacctgtatgtgcaaaggccaacggtgtgagcctggcttaagtgcagacagcaagaaagagtatgtcaacagaggagactgagacaggtgtggkggtgcctgttgtcccagctacatgggaggctgaggtaggaggattatttgagcctggggattcgatcccatctcaaagaaaaaaaaaaaacaaaaaatggaggaggctgaatattcaactgggctcttaggcaaggaagggcctgggatgccgtgcaggtttaaagtttagttgcgatgcaggggttcttggatgcattctccccttgacctgcttcctgtgtcctctccaggcatgggttcaggagcggctgccactggccatgcagacagagcgaggcaacggtttgcaggcggtcca

SEQ ID NO: 48657 - DNA, 601 bp, Human
gcttcctgtgtcctctccaggcatgggttcaggagcggctgccactggccatgcagacagagcgaggcaacggtttgcaggcggtccagcagcacatcaaaaagaaccaggtgagcagagccaggtgagggagcgagttaggacatttggatacatgtgatagaaacagctgaaggtggttaaagccaaaacaatgaatgtattggcttttggaattaacaagactgtggacagcagatacagatgtatccaggtgcttccatatattttcatgactcttggctctattttttttttttttgagatggagccttgctttgttgcccaggctggagtttagtggcacaatctttgctcactgcaacctccacttcctgagttcaagcgattctcctgcctcagccatccaagtagctgggattacatgtgtgcaccaccacacctggctaatttttgtatttttagtagagatggacggcggggggtggggtgtttcaccaggttggccaggctgggctcgaactcctggcctcaagtgatccactcgcctcagcctcccaaagtgctgagattacaggtgtgagccaccgcgcccggcctg

SEQ ID NO: 48658 - DNA, 601 bp, Human
tttgggaggccgaggcgagtggatcacgaggtcaggagatcgagaccatcctggctaacacggtgaaaccgcgtctctactaaaaacacaaaaaattagccgggcgaggtgtcgggcgcctgtaatcccagctactcgggaggctggggcaggagaatcgcttgaacctaggaggcggaggttgcagtgagccaagattgcaccattgcaatacagcctgagtgtcaagagcgagactccgtctcaaaaaaaaaaaaaaaaaagattaaaaaaaaaaaaagatttactgtgtgctaagtaytgtcttagggtttatgctgattatttaatttaatcccctctataaccctatgaggtagatattgtcattatcctcatttcaccaaacaatgtatgttggaagaatagggcactgaaggatggtggggaggtgggtctacagattattttggaagcttcctgatcattctgcagtaggtagagttatttaagagactggagttttgctgagattttgttttcctgtcttgatgaaaatactcttggctgtcaacagtgttggcgacagaactggcttatcgttgtcatggttgaggaaact

SEQ ID NO: 48659 - DNA, 601 bp, Human
acacggtgaaaccgcgtctctactaaaaacacaaaaaattagccgggcgaggtgtcgggcgcctgtaatcccagctactcgggaggctggggcaggagaatcgcttgaacctaggaggcggaggttgcagtgagccaagattgcaccattgcaatacagcctgagtgtcaagagcgagactccgtctcaaaaaaaaaaaaaaaaaagattaaaaaaaaaaaaagatttactgtgtgctaagtattgtcttagggtttatgctgattatttaatttaatcccctctataaccctatgaggtrgatattgtcattatcctcatttcaccaaacaatgtatgttggaagaatagggcactgaaggatggtggggaggtgggtctacagattattttggaagcttcctgatcattctgcagtaggtagagttatttaagagactggagttttgctgagattttgttttcctgtcttgatgaaaatactcttggctgtcaacagtgttggcgacagaactggcttatcgttgtcatggttgaggaaactgatcaagtgcacttagtacttaaaattgggggagctcagctgtgtgtgcagtgagag

SEQ ID NO: 48660 - DNA, 601 bp, Human
ttgcagtgagccaagattgcaccattgcaatacagcctgagtgtcaagagcgagactccgtctcaaaaaaaaaaaaaaaaaagattaaaaaaaaaaaaagatttactgtgtgctaagtattgtcttagggtttatgctgattatttaatttaatcccctctataaccctatgaggtagatattgtcattatcctcatttcaccaaacaatgtatgttggaagaatagggcactgaaggatggtggggaggtgggtctacagattattttggaagcttcctgatcattctgcagtaggtagwgttatttaagagactggagttttgctgagattttgttttcctgtcttgatgaaaatactcttggctgtcaacagtgttggcgacagaactggcttatcgttgtcatggttgaggaaactgatcaagtgcacttagtacttaaaattgggggagctcagctgtgtgtgcagtgagagtgctggatacacaggggctgttaagcaaaaaatagctgcaaatatgatgcatttggtgcatgcagactcagttccaagtgctccatagtttatcaccttataacaaccccgcaaggtagattat

SEQ ID NO: 48661 - DNA, 601 bp, Human
aaaagattaaaaaaaaaaaaagatttactgtgtgctaagtattgtcttagggtttatgctgattatttaatttaatcccctctataaccctatgaggtagatattgtcattatcctcatttcaccaaacaatgtatgttggaagaatagggcactgaaggatggtggggaggtgggtctacagattattttggaagcttcctgatcattctgcagtaggtagagttatttaagagactggagttttgctgagattttgttttcctgtcttgatgaaaatactcttggctgtcaacagtgtkggcgacagaactggcttatcgttgtcatggttgaggaaactgatcaagtgcacttagtacttaaaattgggggagctcagctgtgtgtgcagtgagagtgctggatacacaggggctgttaagcaaaaaatagctgcaaatatgatgcatttggtgcatgcagactcagttccaagtgctccatagtttatcaccttataacaaccccgcaaggtagattatctcagcctgatactagctgtgtgaccttagcaaattcctcaccctctctgtgcctcagtcttctcatctgtaaaatgg

SEQ ID NO: 48662 - DNA, 601 bp, Human
aaacaatgtatgttggaagaatagggcactgaaggatggtggggaggtgggtctacagattattttggaagcttcctgatcattctgcagtaggtagagttatttaagagactggagttttgctgagattttgttttcctgtcttgatgaaaatactcttggctgtcaacagtgttggcgacagaactggcttatcgttgtcatggttgaggaaactgatcaagtgcacttagtacttaaaattgggggagctcagctgtgtgtgcagtgagagtgctggatacacaggggctgttaagcmaaaaatagctgcaaatatgatgcatttggtgcatgcagactcagttccaagtgctccatagtttatcaccttataacaaccccgcaaggtagattatctcagcctgatactagctgtgtgaccttagcaaattcctcaccctctctgtgcctcagtcttctcatctgtaaaatggagatggtaatgttgtctggctccataggttgggagtgaggaggtgtgaggctatattatgtaaagctcttacttagcaaagcacctggcaggtagcagggtagcagacactcaagaatcgttggc

SEQ ID NO: 48663 - DNA, 601 bp, Human
agacctcctggtgcagtggggtgatgttgcctcgtgtaggcggatgctgagctccaggcctggaccagggatggaatctgtaaggaggtacagagagagacctctgtccaagtgggctcagagattggggctagaggtgggatgcattggctggggacccaacctgggagtccagagtcccaccgaggttcctggataggaggggcgtgagactgagatagaaaccgggtgaggctgccgaggtgggcggatcacttgaggtcaggagttggagaccagcttggccaacatggtgaaaccstgtctctactaaaaataaaaaattagctgggcatggtggcacgtgcctgtagtcctagctactggggaggctgaggcaggagaatggcttgaacctgggtggcagaggttgcagtgagccgagatcgcgccactgcactccagcctggtgacagagcaagactccgtctcaaaaaaaaaaaaaaaaaagaaaagaaaaaaaaagaaaggaaactgggtgaggctggatagaggtgagcttatccatttagggaagcagagctttccctgcatgctgaaatgcagggctttctgaacccaa

SEQ ID NO: 48664 - DNA, 601 bp, Human
agagacctctgtccaagtgggctcagagattggggctagaggtgggatgcattggctggggacccaacctgggagtccagagtcccaccgaggttcctggataggaggggcgtgagactgagatagaaaccgggtgaggctgccgaggtgggcggatcacttgaggtcaggagttggagaccagcttggccaacatggtgaaaccctgtctctactaaaaataaaaaattagctgggcatggtggcacgtgcctgtagtcctagctactggggaggctgaggcaggagaatggcttgaacmtgggtggcagaggttgcagtgagccgagatcgcgccactgcactccagcctggtgacagagcaagactccgtctcaaaaaaaaaaaaaaaaaagaaaagaaaaaaaaagaaaggaaactgggtgaggctggatagaggtgagcttatccatttagggaagcagagctttccctgcatgctgaaatgcagggctttctgaacccaagacttgcagaaaacagagtcctggccaggtgtagtggctcacacctgtaatctcaacactgggaggctgaggcaggaggatcgtttgagcccagg

SEQ ID NO: 48665 - DNA, 601 bp, Human
gaggtcaggagttggagaccagcttggccaacatggtgaaaccctgtctctactaaaaataaaaaattagctgggcatggtggcacgtgcctgtagtcctagctactggggaggctgaggcaggagaatggcttgaacctgggtggcagaggttgcagtgagccgagatcgcgccactgcactccagcctggtgacagagcaagactccgtctcaaaaaaaaaaaaaaaaaagaaaagaaaaaaaaagaaaggaaactgggtgaggctggatagaggtgagcttatccatttagggaagcrgagctttccctgcatgctgaaatgcagggctttctgaacccaagacttgcagaaaacagagtcctggccaggtgtagtggctcacacctgtaatctcaacactgggaggctgaggcaggaggatcgtttgagcccaggagtttgagaacagagggaacatagtgagacctcatctctacaaagaaatcaaaaagttagccaggtgtagagtcacgtgcctgtggtcccacttgggaggctgcaatgggaggattgcttgagcatgggaggtggaggctgcagtgagttgtgatcacacca

SEQ ID NO: 48666 - DNA, 601 bp, Human
tgcagaaaacagagtcctggccaggtgtagtggctcacacctgtaatctcaacactgggaggctgaggcaggaggatcgtttgagcccaggagtttgagaacagagggaacatagtgagacctcatctctacaaagaaatcaaaaagttagccaggtgtagagtcacgtgcctgtggtcccacttgggaggctgcaatgggaggattgcttgagcatgggaggtggaggctgcagtgagttgtgatcacaccactgcactccagcctgagcaacagagcaagaccctgtctccaaaaaaaaagaaaaaagaaaagaaaacagagctctacctggggacacagccgtgtctgaagattccaaggaaacacagccctgtcctggggagggggtttaggggggtcacgctctgccccagaagtctcaggggtccatccctgcccctccatgtcccccttcagcgagcagatcagccggcggcagtctcaggtggaccgcctgtacgtggcgctcaaggagctgggtgaggagcgccgggtggctctggaacagcagtactggctgtaccagctcagccgccaggtgagcgagcttgagcactgg

SEQ ID NO: 48667 - DNA, 601 bp, Human
cttgaggtcaggagtatgagaccagcctggccaacatagtgaaactccgtctctactaaaaacacaaaaaaatcagctgggtgtggtggcacatgcctgtagtcctagctgtttgggaggctgaggcaggagaattgcttgaactggggaggtgaaggttgctgtaagtggctattgaaccactgcacgccaacctgggcgacagagcaagactctgtatcaaaaagaaaaaaaaacattgtaggctggagggggctggtgtatgctgcccctttgctcactttgctgtacccccccccccacttcctgatggcaggtgctgcaggagaaattctcagagtttgccagcgagacaggtatggcagggcgggaacggctggcagctgtgaaccagatggtggatgagctgatcgagtgtggccatacagcagcggccaccatggccgagtggaaggacggactgaacgaggcctgggctgagctgctggagctcatgggcacacgggcccagctgctggccgcctctcgggagcttcataagttcttcagtgacgcccgagagcttcagggacagattgaggagaagcggaggcggctgccc

SEQ ID NO: 48668 - DNA, 601 bp, Human
ctggccgcctctcgggagcttcataagttcttcagtgacgcccgagagcttcagggacagattgaggagaagcggaggcggctgccccgcctgaccaccccgcctgagccgagacccagtgccagttccatgcagcggaccctgagagcctttgagcatgacctgcagctcctcgtgtcccaggtggggcgccggtggccatcagggcaggtgggagggcctggacagctgtgggcagcagagtgggcaaaaatcaggctgtggagcaggtcgaaattaggcagtggcacagacagaaagyggactacagaacaggaagaaattagataatggagcagatagaaaatggactgatggaatgatatatagaaatcaggtattggcagggaaaagtggtaccttagaaggtctcacagatattaaacagcttctggctgggcgtggtggctccctttgggaggccaacgcaggcggatcatctgaggtcaggagtttaagaccagcctggtcaacgtggtgaaaccccatctctactaaaaatacgaaaattagccaggtctggtggcgggcacctgtaatcccagctacttgggaggctgag

SEQ ID NO: 48669 - DNA, 601 bp, Human
ggctggagtgcagtggcgcgatctcagctcactgcaccctctgcctcccaggcttaagcgattctcctgcctcagccttccaaatagctgggattacatgcacgcgccaccacacctggctaatttttatatttttagtagagacgggatttcaccatgttggccaggctggcctcgaaatcctgacctcaggtgatctacccgtctcggcctcccaaagtgctgggattacaggcatgagctactatgcccagctggcaattattattattattattattattattattattattattatgaggcagagtctctctttgtcacccaggctggagtgtagtggtctaatctcggctcactgcaacctctgcttcccgggttcaagcaattctcccacttcagcctcgagtagctgggactacaggtgcaagccaccacacccagctaatttttgtatttttagtagagatggggtttcaccatgttggccaggctgatcttgaactcctgacctcaagtgatctgcccgccttggcctcccaaagtgctggggttataggcatgagccaccgcgcccagcccagttattttttataaatcc

SEQ ID NO: 48670 - DNA, 601 bp, Human
taaagttttgagggaagagttttctaggtggagggacccacaagtgcaagggcccagaagtgggctgtagttaggcatgtgtgaggaaaagctagagatcactgtggccagatggagggagggagtgagggagtgtagggtgagaggaagtgagtacagaggggcactggggccctggaaaccacacatggtgaggagcatgccttctctatgaggaacgtgggagccatgcgagagtttagagcagagtggagtgatgtgatgtgtacatttgagaaaaataggccgggcatggtggctyatacctgtcatcccagcactttgggaggccaaggcgggtggatcacttgaggacaggactttgagaccagcttggccaatgtggcgaaaccccgcctctactaaaaatacaaaaattagctgggtgttgtggcatgtgcctgtagtcccagctactggggaggctgaggcaggagaattgcttgaacctggaaggtggaggttgcagtgtgctgagatcgtaccactgcactccagcctgggcaacagagcgagactctgtgtcaaaaaaaaaaaaaaaaaaaaaaggctgggcacagtg

SEQ ID NO: 48671 - DNA, 601 bp, Human
gaggcggaggttgcggtgagccaagattgtgccattgcactccagcctgggcaacaagagcgaaattccatctcaaaaaaaaaaaaattaaatatacagggaagtaaaggtaacccacatgtgtatcgtgaacacttggcttgaacaaccatcaacatttggccaatctagccaaaagaggtggctcacgcctgtaatcccaacactgggaggccaaggcaagaggatcacttgaggccaggagtttgagactaccctacgcaacatagtgagaccccatctctacaaaaaagaaaaaaaytagtcaagcatggtggtgtgcatgcctgttgtcccagctacttgggagtctgagggaggaggatcacttgagtccaggagggtcaggctgcagtgagccatgattatgccatttcactccagcctgggtgacagagcgagattctgtcttaaaaaaaaattttttttttttaattagctgggcattgtggtgcatgcctgtagtcccagctaccctggaggctaagccaggatgatcacttaagcccaggtggtagattcaaaccatagcatgaagctatgattgccaactgatggaacc

SEQ ID NO: 48672 - DNA, 601 bp, Human
tcacttcaacaggtagtcaatattaaactactcctgaggccagaagttcgagaccagcctggccaacatgccaaaaatccatctctactgaaaatacagaacaaaaaattagccaggcttggtggcgggcacctgtaatcccagctactcgggaggctgaggcaggagaattgcttgaacccagaaggtggaggctgcagtgagccaagatcacgccattgcactccagcctgggcaagaagagcaaatctctgtctcaaaaacaaacaaacaaacaaacaaaggctgggtgcggtggctsacgcctgtaatccctgcactttgggaggcctaggcaggcggatcaactgaggtcaggagtttgagaccagcctgacaaacatgttgaaaccctgtttctactaaaaatacaaaaaaattagccaggcatggtggcaggtgcctgtaatcccagctactcaggaagctgaggcaggggaatcgcttgaacctacctagaagggggaggttgcagtgagcggagatcgcaccactgcacaacaacaacaaaaaactattaatgagacattttacattcttttttacattaactccacaaaat

SEQ ID NO: 48673 - DNA, 601 bp, Human
gccaggtgtgacggctcatgcctgtagtcccagcattttgggagaccaagatgggtggatcacttgaggccaggagtttgagaccagcctggccaacgtggtgaaaccccatctctactaaaaatgcaaaaattagctgggcgtggtggtgcacgcctgtaatcccagctactcgggaggctgaggcaggataatcacttgaacttgggaggcagaggttgcagtgagccaagatcgtgccactgcctgggtaacagaacaagactccatctcaaaacaacaacaacaataaaaaaaaaamaacaaaaaaaaaccgcttaaaggctgggtggggtggctcacacctgtactctctttggaagcctaggcgggaggatcacttgaacccaggagttcaagaccagccttggcaacatactgagaagccgtctctaccaaaaccaaaagcaaacaaagaaaaaacagccaggcgtgatggcacgtgcctgtagtcccagctactcagaggggtgactgagactcgaggatcacttgagcactggaggtcaaggctgcaatgagctatgatcttgctgcttgcactccagcctgggcgacagag

SEQ ID NO: 48674 - DNA, 601 bp, Human
actgaggcacaaaaagggcaagtcactcagcttaaacgaaccaggactttcagaatccagagttggccagtgtgtgttgtgcagatctgtccagtcagctgagtgtgtctccagaaagaggcctttggtcaggagacaatgacttcttgattctttttaaattgcacatttcatgaacatttgctgagtgcccactctgcctggcatgtgctgagtcgagcggtgactgaaccagtcccatccctgactttagagactcacagtccattgggaaaaacaggcttgtcatcaatgatgaccsagaattatctgggctggaatgggggcgattgggggactggagagtcaggggtgggtggagaaaggcaacgtttgcaagttgttctttgtgctgcttaaaattcaaaggggcatctgggcgcggtggctcacgcctgtaatctcagcactttgggaggttgaggcgggcagatcacttgaggtcagaagttcgagaccaacctggccaatatagcaaaaccctgtctctactaaaaatgcaaaaattagccggcatggtggcgcacgcctgtagtaccagctacttgggaggctgaggcag

SEQ ID NO: 48675 - DNA, 601 bp, Human
acttccagctaagaagtggaggctcctctgcccagccagacaggtccatgggagaaggaaccctggtttcactgggtctttctgtcccccatcccccaggaaggccaccctggctgacattgtggaacagctgcaggagaaagaggcaggcccagggctgcctgctggggtaagttgagcctcggatgggtggggatacgaggacccctttttcagagcaggaggcaggatctcagaaacagccagtgcctagccctggcaggacccattccctacctggaccctgcagagacagcatggmctctcagggtccccagaatctgaaaatgtcccccttagaaagacggggcacctacctaagagacccctactgcccctccacacacacacacacacacacacacacacacacacacagacacacacacacagacacacacacacagacacacagacacagatacacacacagacacacacacacagactcttcccacatctgtcctggactccgtatttcttcagcccagtggggtcccaaatttcttcatagcctcatacacacacacacagaaggaagccccaggttcctcctgcagac

SEQ ID NO: 48676 - DNA, 601 bp, Human
aggatctcagaaacagccagtgcctagccctggcaggacccattccctacctggaccctgcagagacagcatggactctcagggtccccagaatctgaaaatgtcccccttagaaagacggggcacctacctaagagacccctactgcccctccacacacacacacacacacacacacacacacacacacagacacacacacacagacacacacacacagacacacagacacagatacacacacagacacacacacacagactcttcccacatctgtcctggactccgtatttcttcagcycagtggggtcccaaatttcttcatagcctcatacacacacacacagaaggaagccccaggttcctcctgcagacagtggggacacgccctgcttgcacccccacctccagagatctggctgcctctttccaccaccgagagagattccaaaccaatgagtcctaacagactcactcccaagacccatggggccctaagaattgggcctccaaccctgaggtcctcccatactcgcctccgagacaaatggccctgtagacagatgggaccccagacccatgactcccccaaacagatgac

SEQ ID NO: 48677 - DNA, 601 bp, Human
agacagcatggactctcagggtccccagaatctgaaaatgtcccccttagaaagacggggcacctacctaagagacccctactgcccctccacacacacacacacacacacacacacacacacacacagacacacacacacagacacacacacacagacacacagacacagatacacacacagacacacacacacagactcttcccacatctgtcctggactccgtatttcttcagcccagtggggtcccaaatttcttcatagcctcatacacacacacacagaaggaagccccaggttyctcctgcagacagtggggacacgccctgcttgcacccccacctccagagatctggctgcctctttccaccaccgagagagattccaaaccaatgagtcctaacagactcactcccaagacccatggggccctaagaattgggcctccaaccctgaggtcctcccatactcgcctccgagacaaatggccctgtagacagatgggaccccagacccatgactcccccaaacagatgacccccacaccctctccatggacagcacccctcttccccctcccttcacacagccgtcgctgcct

SEQ ID NO: 48678 - DNA, 601 bp, Human
tgagggtaggggttgggaagggggagtcatctcttacaggtttccaaatgagggtctagccatgatgtgcctgctcttggggagtccagctcctgcttgtccaccctctttttgtccaactgagaggcagaatctggggacaagtggagccaaaaaggggtatcaccggccagtaatggagtgagtcccaagatatgaagtgggcaggacagattcagattttgctagtggaatctgtaggtggtctttcttcctcgtacctaatgccaaggtaggaataaacaagggcacctagtatgtyttgctttgggagggattcctccaggatcgaggctttggatgactggagagacaggaattctttattccagacagtagaccaatagactttccttgagaaagctccatgagtggggaggattgagtggagcaaaggcttatggaggagacagcttaagacttaccttcaggaaattcagtatgggaggggataaggaagggaaatctcagcctgggcaaaggcttgatactgagagacttaaatgctcccctcagggcagcaacagccttaaggaagagcattttaggtccaactagggcg

SEQ ID NO: 48679 - DNA, 601 bp, Human
tccttgagaaagctccatgagtggggaggattgagtggagcaaaggcttatggaggagacagcttaagacttaccttcaggaaattcagtatgggaggggataaggaagggaaatctcagcctgggcaaaggcttgatactgagagacttaaatgctcccctcagggcagcaacagccttaaggaagagcattttaggtccaactagggcgcaactagggcgcaaaggtccagaggtaggaaggctcagacatattcagaccttgaggatgttaatgaagagttattaggcagagtgctgyggctctgccttgagccccatcttgtcgctccaggtcgtgggtgagcctgtactgtgtgcttagtaagggggaactgggcttctacaaggactccaagggcccggcatccgggagcacacacggtggggaaccgctgctcagcctgcacaaggccaccagcgaggtggctagtgactacaagaaaaagaagcatgtcttcaagctccagtgagccccccaatgggcaggagggagggatccaaggctcagcttcaactcccagtgggaccctggcttccctgggggacacttggtgggcag

SEQ ID NO: 48680 - DNA, 601 bp, Human
tccaggtcgtgggtgagcctgtactgtgtgcttagtaagggggaactgggcttctacaaggactccaagggcccggcatccgggagcacacacggtggggaaccgctgctcagcctgcacaaggccaccagcgaggtggctagtgactacaagaaaaagaagcatgtcttcaagctccagtgagccccccaatgggcaggagggagggatccaaggctcagcttcaactcccagtgggaccctggcttccctgggggacacttggtgggcaggtgggctgggccccttccccagatctctsaagtcctgtgtcccttcctgcaggacccaggatggcagtgagtttttgctccaggcaaaagatgaggtgagatctggtcctttcctccctctgtgtggacctcagtaatgacctggctgtctggctcctgacccagagtgatggggctgtgagaagggacactcacaggccagagttatcagggctgtaatgggaaagcccacaggcactgagagcccaaaggaggttcctaacccagtggggagtgggaagggcttcagggagggctgcctgcagatcctgatgacaaagtccaacatc

SEQ ID NO: 48681 - DNA, 601 bp, Human
tttctcctccacctactgcaactgttcccataaactgggtgacagagtcagaaaactccccagctaaacacccgtaagacttcatacaacacaatactctatactgtgatgatcacagctgccaaggtaagaaacagatttcgctgactttggtaattcttactttctataattcttaattcctataatttctataatctgaacttttaaaatgagttaattttatgaatatcagttcaatcttaggcaataaaatgacatgacaaagtgcttaaatttataaatgcttatccatttagtracaggaaaaatgagacaactttgaaatgaaaaaggtcatattcatctttgatcctggttactggtttgtcatttaaatttatctttcacttttattttgcttttcaaatgtgaatttctgccaattaaaaaatcttccaattatgttaccatatttggtagtagtggttaatttctccatgcaaaaacaatgacttaattttgttatttattgctctgctgagaaacagtgcagaactgagctatttacatctgaactaatatgaatagtcatttgactacaacatgcacattatcagca

SEQ ID NO: 48682 - DNA, 601 bp, Human
actcctaacaagcacctttcatgttttcaatactcttgattctagggcctagaagacaatttgattttaaaattcatctataaatgaataccactcttgtgtcaaaacaaccaatttatatatattgtcattcttttaataaaagggtggagagcagcttcagtttccatggttgtttaggccatatacaagttcagaaaatcccaaaactatttatgattagactaacagaatgctctaaaaagatcagataacatgaaaataaaactaaactatttttgtatgctttccatcgaaaaaktactctattaaacagcttagctgttaagaaattaaaaaaaaaaaaaaaaaggaaactcatacagtggttgtcagtgcagagaagagaatgataaacatctgacaaccatgccataaattataatgtagtaaaggtcacagacaactccaaaaataggattctgctgttcccacaacaaaggttttcaattctcaatgtatgacaggaagccccatcttctatggataaaatctggcctaattatcatcatacaaatgttggtattcagtagaactaggattccacacatttcagatgata

SEQ ID NO: 48683 - DNA, 601 bp, Human
ttagctgttgtaggattataagatcatctttaaagtatgttaactatgctttaaacagtaaagagctcatctctttagggcatatctctgtatttcacaaatactaaaaacccatttatacaaagcctagttcaggttaatactgtgttaatcaggtaaccattaatttaggtgaatcctctaagcctcatttttctcacctgtgatagaaagagacttgaggaaaatattagagcttacatgtccaactaacaaattgttattagaactagttaatctgtcaatcacagcattatttttwaaattgtttaacttattattaaaaatgagggccaggcatggtcattcacacttgtaatcccaggaattacctgagctcaggagtttgagaccagcctgtgcagcacagtgaaaccctgtccctaccaaaaatacaaaaattagccaggcatggtggcgcacacctgtggtctcagctactcaggaggctgaggcagggagatcgctagagcctgggaagttgaggtgcagtgagccacgattgcacaactgcactccagcctgggtgacagagcaagaccctgtcagtcattcattcatc

SEQ ID NO: 48684 - DNA, 601 bp, Human
acaaatactaaaaacccatttatacaaagcctagttcaggttaatactgtgttaatcaggtaaccattaatttaggtgaatcctctaagcctcatttttctcacctgtgatagaaagagacttgaggaaaatattagagcttacatgtccaactaacaaattgttattagaactagttaatctgtcaatcacagcattatttttaaaattgtttaacttattattaaaaatgagggccaggcatggtcattcacacttgtaatcccaggaattacctgagctcaggagtttgagaccagcytgtgcagcacagtgaaaccctgtccctaccaaaaatacaaaaattagccaggcatggtggcgcacacctgtggtctcagctactcaggaggctgaggcagggagatcgctagagcctgggaagttgaggtgcagtgagccacgattgcacaactgcactccagcctgggtgacagagcaagaccctgtcagtcattcattcatccattcataaaaacaattaattaattaaaaatgagatggggtctcattatgttgcccaagctggtctcgaactcctgggctcaaacattcgtcccgc

SEQ ID NO: 48685 - DNA, 601 bp, Human
tgtccaactaacaaattgttattagaactagttaatctgtcaatcacagcattatttttaaaattgtttaacttattattaaaaatgagggccaggcatggtcattcacacttgtaatcccaggaattacctgagctcaggagtttgagaccagcctgtgcagcacagtgaaaccctgtccctaccaaaaatacaaaaattagccaggcatggtggcgcacacctgtggtctcagctactcaggaggctgaggcagggagatcgctagagcctgggaagttgaggtgcagtgagccacgaytgcacaactgcactccagcctgggtgacagagcaagaccctgtcagtcattcattcatccattcataaaaacaattaattaattaaaaatgagatggggtctcattatgttgcccaagctggtctcgaactcctgggctcaaacattcgtcccgcctaggccttccaaagtgttggaattatagatgtgagccaccatgccctgcccacagcattatttttaattaacaattttctaatagttttagtcataaaaatcccttatttaactttagtgatttattgaagcataccaattatg

SEQ ID NO: 48686 - DNA, 601 bp, Human
atttaagtatgtgtggggcttgcatattctccccacatctgtgggactctggtttcctcccatatcccaaaacagtgcacattaggttcactggcatgtttaagttgtcctgggttgagtgtgagtgtgtacatgagtgtatcctgtgatggagtggcctcctatccaaggtgggttcctccctccttgagctgctgggattggctccagccaccagcaccccaaaccagaataagagggttgaaaaatgaatgaatggatgaatacaaattattatcgaataaaaattggtaaagtctasggtgatcatacaaatgcatgacaataaacgctatggcacaaaagcactcagagatcccaccgtatttgaattgtttttgatctgcatggagctggatgtgctcctgacaattttcatttctcaaacatgattccatgtttttaatagaccaccacaaccactgttactcactgattcaccaaatactgggtaattatctttgttggcttttttttttttttcctgggacagagttttgctctgtcacccaggctggagtacagtggcatgatctgggctcaatgcaacccctgcctcctg

SEQ ID NO: 48687 - DNA, 601 bp, Human
tgtatattattgaaagaagccctcaattttgggatcaaagtcctggacccttgcccagccctgcccctgagtgtgtttctgtcaatggaggcctgtccctctgcatctcccggcctcagtttccccatgagtaaacagaagcggggtgggagacagtctggaggagatggtccctaaaggctcatcctagtttccccgctgtggagggaggcaggatagcacagaggttacgtccaggagctccggaaccaggcagcctagggttgggtaaattctagctccatcacttagaaaccgtgtraccttgggcaagcggtttcattttgctgagcctcagttttcctcatctgtaaaaagatgctcaaatcatgtctcccaggggttgtactgagatattaacccatatctcagagtagtaggtgccaagtaggcagatgtgactgttattagcagcagtggcatcagtgttaagttgtgctgagaagtgatcagattctaagcatctcagtccctgtagagaaaggtgggaaccccctaccctctggaggacggtggtggagggctagacagtctggctgggctcagggacctcctgggtccc

SEQ ID NO: 48688 - DNA, 601 bp, Human
cgatctcggctcactaaaacctccacctcctggattcaagcgattctcctgcctcaacctcctgagtagctcggactataggcgcccaccaccatgccccgataatttgtgtatttttagtagagatggggtctcaccatgttggccaagctgttcttgaactcctgacctcaaatgatccacccgcctcagcctatcaaagtgctgggattacaggcatgagctactgtgcccagccccttatggtcatttttatgtgcccacttggcagatgaggacactgaggctcagaaaaggggaygggttggcccagcatcccccagctatgaatgtatattattgaaagaagccctcaattttgggatcaaagtcctggacccttgcccagccctgcccctgagtgtgtttctgtcaatggaggcctgtccctctgcatctcccggcctcagtttccccatgagtaaacagaagcggggtgggagacagtctggaggagatggtccctaaaggctcatcctagtttccccgctgtggagggaggcaggatagcacagaggttacgtccaggagctccggaaccaggcagcctagggttgggtaa

SEQ ID NO: 48689 - DNA, 601 bp, Human
tctgctgcttatcagctgagtgacgttgggcaagtgacttaacctctctgtgcctcagtttttcatctgtaacatgggttaacatgatagaattgttgtaaggattaaggaattgatccatgtcaagcacttcccatgatagttcctggcatactgcagtatcgtaagtctagccattattataactgattattattattccatcatagcatgttgggagagtgatatgaaattgcacgtaagacattaaacaataatataggtagctattgttagtattatccttgtgttttttgttggtttttttttttttgagatggcgtttcgctctgttgcccaggctggagtgtggtggtgcgatctcggctcactaaaacctccacctcctggattcaagcgattctcctgcctcaacctcctgagtagctcggactataggcgcccaccaccatgccccgataatttgtgtatttttagtagagatggggtctcaccatgttggccaagctgttcttgaactcctgacctcaaatgatccacccgcctcagcctatcaaagtgctgggattacaggcatgagctactgtgcccagccccttat

SEQ ID NO: 48690 - DNA, 601 bp, Human
aatagggtccattctagtgtctccccacacaatggagccagccgcctaagttcacatcatggttctgctgcttatcagctgagtgacgttgggcaagtgacttaacctctctgtgcctcagtttttcatctgtaacatgggttaacatgatagaattgttgtaaggattaaggaattgatccatgtcaagcacttcccatgatagttcctggcatactgcagtatcgtaagtctagccattattataactgattattattattccatcatagcatgttgggagagtgatatgaaattgcaygtaagacattaaacaataatataggtagctattgttagtattatccttgtgttttttgttggtttttttttttttgagatggcgtttcgctctgttgcccaggctggagtgtggtggtgcgatctcggctcactaaaacctccacctcctggattcaagcgattctcctgcctcaacctcctgagtagctcggactataggcgcccaccaccatgccccgataatttgtgtatttttagtagagatggggtctcaccatgttggccaagctgttcttgaactcctgacctcaaatgatcc

SEQ ID NO: 48691 - DNA, 601 bp, Human
attagtcaggcttggtggtgcacacctgtagttccagctactggggaaactgagatgggagcatcacctgatcctgagaggtcaaggttgcagtgagccatgactgcaccactacactccaagcctgggtgacagagtgagaccctgtctcagaaaaaaaaaaaaaaaaaaaaaaaaaaaagagggatgttaggagcaagatctggctggtgtaagctacgttgagggtgtgagatatgtatgtatgtctgtatatgggtttttattttgggggggttgacagaggtgggaatatagtcargagtacaggggtcattattgttgcagcttaagagttacgatctgtatcaagggggccactgtttgttattgtcctgccagactggggtcatttatttctgcaaggagtccctgactagagtttccgtccaacctcttcacccaagtcttcctgcccttagtgccttgttttcctcccagcggcatctgccagccactcacagtgcccagaagcaagtgtgaactgccaccatctcctccacttctcccatctgctcccagaagcgggcaggagtggggcaagaatctcatctgtccagta

SEQ ID NO: 48692 - DNA, 601 bp, Human
cctgtggggatgctgctggcagagagggtgtggggtgggagcagtactgccgaggaggggtgggacttcaggcatgtgatgtgtttctgtgaatggcggtgttgcctatttggtgtgaaatgcaatacaactagagtgtgcttatgtagggatgagatgctgaaaggtgtgatgctgccttgagttgtgacggtctctaagtgaaagaaaggcagatgggccacggttttcttggagtgaatcaccattggatggtggatggtgaaaagggaaaatgacatacacttatataataataatratgatgatgatgatgatagcgactgtttactgagcacttaccatctaccagccttacgctatgtgcttcacatatgcaatctcatctaatgcacaaaacccagagaggtagatcttcctgcctccatgtttcagacaagcaggctgaggctcagagtagtgaaataactcgcctgaggattccacaccaagcacatgacggtggcaagatatgaatcctgaaagagctcattctaggaggggctcttaacctggtgatgttgacttcgtgataaagaatgtggccgggcgtgctggctca

SEQ ID NO: 48693 - DNA, 601 bp, Human
aaataaaaaaaaattaagaagaaatttaaaaatcgttgctaacaattggagcttgaagggctggttgtttttgttctccctaacatacattaatataaacatacaatgttcaaaaatgaaaaaaaagtttgtccatggaccaccttaaatcatcttgtgggtggcttgacggtccctgtatcagactagtgcaaatctgacgcctggagccccctcttctagtgagtctcctatgaacagtgattggctaagacctcccacctgtagagactcagcacttgaattcccaggagtccccgtygtgagcatcagtctgtgctggtccttcccagaattttatgcacatcttttctgtttggggaagtttcccaccatgtgagtcctacctccccagaaagaaaccaggtctctattgaccagccttcctcacagcaagggcagacacgtgacctcagctgaactcggagccctcagccattacgcacgcccaccctgtttgaacaaccaaggcactgcttgtgagaaagttctcccttgtagtgaggcagaatctacatgccagaactccgcacccacccattcccatcccactcttcactct

SEQ ID NO: 48694 - DNA, 601 bp, Human
tcaaataaaaaaaaattaagaagaaatttaaaaatcgttgctaacaattggagcttgaagggctggttgtttttgttctccctaacatacattaatataaacatacaatgttcaaaaatgaaaaaaaagtttgtccatggaccaccttaaatcatcttgtgggtggcttgacggtccctgtatcagactagtgcaaatctgacgcctggagccccctcttctagtgagtctcctatgaacagtgattggctaagacctcccacctgtagagactcagcacttgaattcccaggagtccccrttgtgagcatcagtctgtgctggtccttcccagaattttatgcacatcttttctgtttggggaagtttcccaccatgtgagtcctacctccccagaaagaaaccaggtctctattgaccagccttcctcacagcaagggcagacacgtgacctcagctgaactcggagccctcagccattacgcacgcccaccctgtttgaacaaccaaggcactgcttgtgagaaagttctcccttgtagtgaggcagaatctacatgccagaactccgcacccacccattcccatcccactcttcact

SEQ ID NO: 48695 - DNA, 601 bp, Human
catgcctgtaatcccagctacttgggaggctgaagcagaagaattgcttgaacccgggaggcggaggttgcagtgagctgagatggtgccactgcactccagcctgggcaacaagagcgaaactccgtctcaaataaaaaaaaattaagaagaaatttaaaaatcgttgctaacaattggagcttgaagggctggttgtttttgttctccctaacatacattaatataaacatacaatgttcaaaaatgaaaaaaaagtttgtccatggaccaccttaaatcatcttgtgggtggcttgayggtccctgtatcagactagtgcaaatctgacgcctggagccccctcttctagtgagtctcctatgaacagtgattggctaagacctcccacctgtagagactcagcacttgaattcccaggagtccccgttgtgagcatcagtctgtgctggtccttcccagaattttatgcacatcttttctgtttggggaagtttcccaccatgtgagtcctacctccccagaaagaaaccaggtctctattgaccagccttcctcacagcaagggcagacacgtgacctcagctgaactcggagccc

SEQ ID NO: 48696 - DNA, 601 bp, Human
gacgtggaggcacatgcctgtaatcccagctacttgggaggctgaagcagaagaattgcttgaacccgggaggcggaggttgcagtgagctgagatggtgccactgcactccagcctgggcaacaagagcgaaactccgtctcaaataaaaaaaaattaagaagaaatttaaaaatcgttgctaacaattggagcttgaagggctggttgtttttgttctccctaacatacattaatataaacatacaatgttcaaaaatgaaaaaaaagtttgtccatggaccaccttaaatcatcttgygggtggcttgacggtccctgtatcagactagtgcaaatctgacgcctggagccccctcttctagtgagtctcctatgaacagtgattggctaagacctcccacctgtagagactcagcacttgaattcccaggagtccccgttgtgagcatcagtctgtgctggtccttcccagaattttatgcacatcttttctgtttggggaagtttcccaccatgtgagtcctacctccccagaaagaaaccaggtctctattgaccagccttcctcacagcaagggcagacacgtgacctcagctg

SEQ ID NO: 48697 - DNA, 601 bp, Human
tttgagaaatgttagatatcatcattatcagcattgcctacaccatgaacacaagttcagtgcttatcacagcatcagacacagagcaagcaccctatacgtggggtttgggggttgggttgagaggtaggaggaggggtgatcctactttgttaatcacccatttccctagggggctgtcccaaacttttccctccttcttggaggaggaatgtcctctcactgatacaagccagaccttgtctccattctctgcactcagcctctctctaattcctgtctttctcatgccaccttctasaattttgccccttttatgtccttctgtactggaattgttctttcttctctttttctctccttcttccttcccttcctccaacaaatccttcctgagcacccatgaccttccagtccttggttcaggtgctggggatgcagcagggaacagacaaggtccctttcctttaaattccttttaaattttaaatgcatttatttacttatttatttattgtatttttagtagagacggggtttcaccatgttgcccaggctggtcttgaactcctgggctcaagggatctgctcaccttagcct

SEQ ID NO: 48698 - DNA, 601 bp, Human
gggttactgtgattaatgaaatgaggaaatgtaaggaaaggtacttcggatggtcccaggcacatagaagatttgagaaatgttagatatcatcattatcagcattgcctacaccatgaacacaagttcagtgcttatcacagcatcagacacagagcaagcaccctatacgtggggtttgggggttgggttgagaggtaggaggaggggtgatcctactttgttaatcacccatttccctagggggctgtcccaaacttttccctccttcttggaggaggaatgtcctctcactgatacragccagaccttgtctccattctctgcactcagcctctctctaattcctgtctttctcatgccaccttctagaattttgccccttttatgtccttctgtactggaattgttctttcttctctttttctctccttcttccttcccttcctccaacaaatccttcctgagcacccatgaccttccagtccttggttcaggtgctggggatgcagcagggaacagacaaggtccctttcctttaaattccttttaaattttaaatgcatttatttacttatttatttattgtatttttagtaga

SEQ ID NO: 48699 - DNA, 601 bp, Human
tctgcctggcctcttaagatgaaagttctgtgttcccttatgtgtgtaagatgggggtgtggtaagaggggctagatgtggctttgcaggcatggggaagggtccagaattaaggagtttcctgacaccaaggcaatcctcttaaacttgcttaatcagaccattaagcctattaggtaattaacccctctctggtgccttcctaccaatcatcctgacccctactgaattcattctcttccatggactcacggatatgtcctcttccccaccctcaccctaaacttgtcacagataaggrgtcctttatctccagaaggctcagaaagatggggagggaattctcactaatccctaggactccgtcctctctctgcttcttcaatttcactccccatcttctctcccagccagagcatcttccctgcttccctctgagggtggaaggtattcattttctctgaagaaaactggggtcaccctcttccccatcttctgccccctctctcttgtacttctttaaactgtccctgagaatttttgtatgaaacagcagaagcaactctagactaagagtgacgtttgtggtcgagcgcagtgg

SEQ ID NO: 48700 - DNA, 601 bp, Human
aaagaaagggaggagttaggccatcctgcttccaaattttaaggtcttaaaccatcccccaatggtttttcaacttttaagcaaaggaagcctattttctttttttctttttctttttctttttttttttttttttgagacaatctcgctcttgtcacccaggctgcagtgcaatggcgcaatctcggctcactgcaacctccgcctcccgggttcaagcgattcttctgcctcagcctgcggagtagctgggattacaggtgcccacaaccatgcccggctaatttgtgtgtgtgtgtgtgtgtgtgtgtgtgtgtgtgtgtgtgtgtgtgtgtgtatttttagtagagatggggtttcaccatgttagccaggctaacatgtgctgagattacaggggtgagccacagagcccagccaggaagcctattttcaatgtctcacgtaaaacctcaacatacagaacagataaaagagaaactgctctaacactctctgatctctctctctctctctctctctctctctctctctttctctttctctgttgcccaggctggaatacagtggtgccatcacagctcactgctgcctcgacctc

SEQ ID NO: 48701 - DNA, 601 bp, Human
gtaactgatcacagaggtccactgtggatcacatccatagagctcacccatgtcctagggacttgaacagtgtccccaaaacttgaacagcacatactaggtttgcaataagcactgggaaaagaaagggaggagttaggccatcctgcttccaaattttaaggtcttaaaccatcccccaatggtttttcaacttttaagcaaaggaagcctattttctttttttctttttctttttctttttttttttttttttgagacaatctcgctcttgtcacccaggctgcagtgcaatggcgcratctcggctcactgcaacctccgcctcccgggttcaagcgattcttctgcctcagcctgcggagtagctgggattacaggtgcccacaaccatgcccggctaatttgtgtgtgtgtgtgtgtgtgtgtgtgtgtgtgtgtgtgtgtgtgtgtgtgtatttttagtagagatggggtttcaccatgttagccaggctaacatgtgctgagattacaggggtgagccacagagcccagccaggaagcctattttcaatgtctcacgtaaaacctcaacatacagaacagataaaagagaaac

SEQ ID NO: 48702 - DNA, 601 bp, Human
accacatggctatgtgaaggacgagtgagtgcaaaggccctgaagtgggactgtgcctgtgctcttccagagggactaaggaggcccctgtgcctggggctgaatgagagaggggaagaatgggaggagatgaggacagagaggggtgctggtggtgaggggtgatggggctcgcaggccacagtgaggtccttaacttttaccccaagtgagatggagccatgggagggatgtggcctgacttaggttttaggaggattcctctgatgcccatgaggggagcagaccgtgagaagcaacrgtgggagaggtgggggcccagtgaggtggcgactgcaatggtccaggcaggaggtgacggcggtctgacaggtggaagcggtgagcggggaggcagaggaaggccggacgctggggatgctccgaacactcacttttgatcaggcgctgtgctgagtgctttgtgagcttgatctcgtccgttcctcacaacctcccggtgaggcgggtggaatgagctccatttttacacaagaggaaactgaggcacagaggggcacagagaagtgaaggtaccagcccacggtcatcaccagcccaa

SEQ ID NO: 48703 - DNA, 601 bp, Human
agcccggagggacgccctgacacctgcctccctccccaccctcgctcctccaactgaccagagggggcaggtgtgtgggaaaagacacatctgccagcgcatcatgcaaatgagctcatgaatatgcagcaggcccgttgtcttgccctgcccccacccccatctgctcggccaggcccctcgggctgggggcagctctgtccccttaggggaaggggaggccccctccccaccactgtcactgtccttagggcagaccttccccctcatctagggcccaggtgggagggagaaagggagraagggcggggggcctagggcagagacctgggccggggctcaccggggtagaagtctttggacttggagagcttgatggtggctccggtctccttctgcagctgcacgatggtctgcccgcccttgccaatgatggagcccgccgcgtagctggggatcagcaccttcaggaagtattcgccttcctctgcgggggcacacagggtggaggggagtcagcgggggaggggtcttcacctttggagggggtgagcagaggaaaccccaggggtcacagtagcagtatggagaataatacaaa

SEQ ID NO: 48704 - DNA, 601 bp, Human
gagggggtgacagaattccaaaggggggagcaagtgtgtggaacatggctggctggcccccaagcccggagggacgccctgacacctgcctccctccccaccctcgctcctccaactgaccagagggggcaggtgtgtgggaaaagacacatctgccagcgcatcatgcaaatgagctcatgaatatgcagcaggcccgttgtcttgccctgcccccacccccatctgctcggccaggcccctcgggctgggggcagctctgtccccttaggggaaggggaggccccctccccaccactgkcactgtccttagggcagaccttccccctcatctagggcccaggtgggagggagaaagggaggaagggcggggggcctagggcagagacctgggccggggctcaccggggtagaagtctttggacttggagagcttgatggtggctccggtctccttctgcagctgcacgatggtctgcccgcccttgccaatgatggagcccgccgcgtagctggggatcagcaccttcaggaagtattcgccttcctctgcgggggcacacagggtggaggggagtcagcgggggaggggtcttcacct

SEQ ID NO: 48705 - DNA, 601 bp, Human
ccacaagagtgtctaataatagctgacccttatacaacccaagcctcaggcaccattctaagcacttttttttttttccctgagacaagagtctcattctgtcgcccaggctggagtgcagcggtgcgatctcagatcacggcaacctctgcctcccagttcaagtgattctcatgcctaagcctcctgagtagctgggattacaggcgtgtgccaccacgcccgtctaagttttgcattttttgtagagatgggatttcaccatgctggccagtctggcctcaagtgatccacccgcctyggtctcccaaagtgctgggattacagatgtgagccatcgcacctgaccaaagcactttatacatacgtgttcacttaatatatgaagtaggcaatattattattgtccctgattccctgctaaggacgccgaggcacagagagggctcaagatgtgttcaagttctcttagatggtagtggatgttcagagatttgaacccaggtgtctggcttcagagtctgtgcattctgctaaatttggggtgcatggagtgatcagctctatgtgtgtatcttggagggaggcataaaatgatgac

SEQ ID NO: 48706 - DNA, 601 bp, Human
gagccaagggtgagtcagcctgcagtctgcctccgtctggtgtaaataggaaagggtgtgggttggggtgggaactggggggcggggtagggggaggtggatgccccaggaagagctggccgagggtttgcctctctgtgaagcttccttccaactcaggaagtctttgaccttccatccccttgtagtttttacaagggggcccacaggggcttttggggaggttggttaagccccacaagagtgtctaataatagctgacccttatacaacccaagcctcaggcaccattctaagcacttttttttttttccctgagacaagagtctcattctgtcgcccaggctggagtgcagcggtgcgatctcagatcacggcaacctctgcctcccagttcaagtgattctcatgcctaagcctcctgagtagctgggattacaggcgtgtgccaccacgcccgtctaagttttgcattttttgtagagatgggatttcaccatgctggccagtctggcctcaagtgatccacccgcctcggtctcccaaagtgctgggattacagatgtgagccatcgcacctgaccaaagcactttatacata

SEQ ID NO: 48707 - DNA, 601 bp, Human
gtgcggtggctcacgcttgaaaccccagcactttgggaggccgaggtgggcagatcatgaggtcaagagatcgagaccatcctgggcaacatggtgaaaccctgtttctactaaaaatacaagaattagctgggcgtggtggcacgcacctgtagtcccagctacacgggaggctgagacaggagaatcgcttgaacctgggaggcggaggttgcagtgagccgagatcatgctactgcactccagcctggcggcagagcgggactccgtctcaaaaaaaaaacaaaaaaaagaaaaaaamcaaaaagtgtcttgagtgtgcaccaggcaccgtgtggctgtgtacctgtgtgtctgggatacctggggtgtgtgtcagtgtccagcaagcacttcagtgcagcacgctggtgacacgaccctgactcctcaattgccatttcccagtctggcaggccagcctcgccatgtgtctgggcgtcactgtctgtgggtcacttgtgtagctgacatcccccacccgctttgggccatgttcctcactcttactacccccccttccccaccccagaacaatggcttggtctgagccaagggtgag

SEQ ID NO: 48708 - DNA, 601 bp, Human
ggtcttgagtgtggccgggtgcggtggctcacgcttgaaaccccagcactttgggaggccgaggtgggcagatcatgaggtcaagagatcgagaccatcctgggcaacatggtgaaaccctgtttctactaaaaatacaagaattagctgggcgtggtggcacgcacctgtagtcccagctacacgggaggctgagacaggagaatcgcttgaacctgggaggcggaggttgcagtgagccgagatcatgctactgcactccagcctggcggcagagcgggactccgtctcaaaaaaaaamcaaaaaaaagaaaaaaaacaaaaagtgtcttgagtgtgcaccaggcaccgtgtggctgtgtacctgtgtgtctgggatacctggggtgtgtgtcagtgtccagcaagcacttcagtgcagcacgctggtgacacgaccctgactcctcaattgccatttcccagtctggcaggccagcctcgccatgtgtctgggcgtcactgtctgtgggtcacttgtgtagctgacatcccccacccgctttgggccatgttcctcactcttactacccccccttccccaccccagaacaatggcttg

SEQ ID NO: 48709 - DNA, 601 bp, Human
tctgcccctgagaatgtaaaaggtcttgagtgtggccgggtgcggtggctcacgcttgaaaccccagcactttgggaggccgaggtgggcagatcatgaggtcaagagatcgagaccatcctgggcaacatggtgaaaccctgtttctactaaaaatacaagaattagctgggcgtggtggcacgcacctgtagtcccagctacacgggaggctgagacaggagaatcgcttgaacctgggaggcggaggttgcagtgagccgagatcatgctactgcactccagcctggcggcagagcgrgactccgtctcaaaaaaaaaacaaaaaaaagaaaaaaaacaaaaagtgtcttgagtgtgcaccaggcaccgtgtggctgtgtacctgtgtgtctgggatacctggggtgtgtgtcagtgtccagcaagcacttcagtgcagcacgctggtgacacgaccctgactcctcaattgccatttcccagtctggcaggccagcctcgccatgtgtctgggcgtcactgtctgtgggtcacttgtgtagctgacatcccccacccgctttgggccatgttcctcactcttactacccccccttcc

SEQ ID NO: 48710 - DNA, 601 bp, Human
acatatgtacaggagacaggaaagaccctatgaccagtgtgtgtgaacctgagaaggagagacagacaggtagactcaggtgtcagtttgtaggactttttggatgactggtgtgtttgtgtatgtgtgtgtctgaacatgtgaattacagcgagacaaagaaaacttgactggtcagtgtgagaatgtgcgtgcctgggtgagccgggatgtgtgtgatgcgtggagtgtgagtgtgtctctctctctttgaaggggattctgcccctgagaatgtaaaaggtcttgagtgtggccgggwgcggtggctcacgcttgaaaccccagcactttgggaggccgaggtgggcagatcatgaggtcaagagatcgagaccatcctgggcaacatggtgaaaccctgtttctactaaaaatacaagaattagctgggcgtggtggcacgcacctgtagtcccagctacacgggaggctgagacaggagaatcgcttgaacctgggaggcggaggttgcagtgagccgagatcatgctactgcactccagcctggcggcagagcgggactccgtctcaaaaaaaaaacaaaaaaaagaaaaaaaac

SEQ ID NO: 48711 - DNA, 601 bp, Human
atcctaatctgtgtttgtagaagataaagtgcagagactgccttatgaacagactatgtgacacagtgattccggtgaagatgttcgtgcgtgcccttgtgtgtgggacagactttggtgtcgctttgatgatgaaggttatgtagactctttgtgagacagagctgagtgtatgtgagagtttgagagaaagaaacaaaagaatctcacaaagtgggatagaggctacacaatgaatatataccactttgagactggatggcagtgtatgtgtctgcatttgtgtgtgtacgtgtgtttrtgaaagtgaaagagagacacacttctggatgtttctgagactatttggatgaccagtgtgaatatacacatatgtacaggagacaggaaagaccctatgaccagtgtgtgtgaacctgagaaggagagacagacaggtagactcaggtgtcagtttgtaggactttttggatgactggtgtgtttgtgtatgtgtgtgtctgaacatgtgaattacagcgagacaaagaaaacttgactggtcagtgtgagaatgtgcgtgcctgggtgagccgggatgtgtgtgatgcgtggagtgtga

SEQ ID NO: 48712 - DNA, 601 bp, Human
cccagctacttgggaggccaaggcaggagaatcacttgaacccgggagttgtaggttgcagtgagctgagaccaggccattgtactccatcctgggcaacaagagcaaaactccgtttcaaaaaaaaaaaaagaaaagaaaaaaaaattagccaggcgtggtcgtgttcacctgtagtcccagctattcagtgggctgaggtgggaggatcgcttgagcctgggatgtcgaggctccagtgagcctagatcataccactgcactccagcctgggtgacagagtgtgactctgcctcagacwaatatatattaaataataataataataaagcattttaaagtcagttgatctaaaaaatttatggcttcttttgaaaaatttggaagatgtggtagcactatgttcatgttcccaaagtgcaataattcggtggatttgagtggcagcttctccctttaaagatggcataccctctccagagagcaacaaccctcaaggcttttgttacctttttcaatactttagttatttaatttataatccctggtttggcccagctgctgcactgtaataaaagagaaactgaggtctacagaagga

SEQ ID NO: 48713 - DNA, 601 bp, Human
agtccctttacttctcagagcctctttttccacatctgtaaaatgggcatactattcccgatccatacgatttgtgcaaatattcagtgagacactggaagcctgctctctggagtcactcagtcagcagggttgctgtttctacaacacagcaaggtccaaatcgtaggttgtttttttttttttttttttgagacaaagtcttgctctgtcagccaggctggagtgcagtggtgcgatcttgcctcactgcaacctctgcctctcaggttcaagtgattctcctgcctcagccgctggrgtagctgggattacaggcgcctgccaccatgtctggctgatttttgtatttttagtagagatggggtttcaccatgttggccaggctggtcttgaactcctggcctcaagtaatccgcccacctcggcttcccaaggtgctgagattacaggcatgagccactacgtccagcctcctagtttattctttagtaactgtgtgaccttaggcaaatgccttcacctctctgtgccttacctttctcatctccagtattagcataaccacacctaccctatattattattggaaacattcttt

SEQ ID NO: 48714 - DNA, 601 bp, Human
aagctagacacaaaagaccatatattatatgattctgtttatataaaagatccagaataggcaagtccacagagaccaaaagtagattagtggctggaagacgttgagactgggatctgggggaatggtgagtgactgctcatgggcacaaggtttctttttggcatgatgaaaatgttctggaattagatggtaactgatgtacgactctgtgaacatacaacaaaactactaaactgtacacttctaaacagtaaagcttacagtatgtgaattatagctcaacagagctgttatttcaaaaaaaaaaaaaaaaaaacaccaggaaaaacaaacagcctgacaaatcaagaagatggaacagcatgttcacaaccacaaccaggagtggtatttagtctgtgatgcagtattttagagcagtgaaggaaggatagattggccaagaaaaggtttgaggacaaggggttaatcatgtgggaaaaataaagttaggttttaagaaaatttctacctcttccacctcctagctggtggcctgtgaaagtccctttacttctcagagcctctttttccacatctgtaaaatgggcatactatt

SEQ ID NO: 48715 - DNA, 601 bp, Human
tagcgatggggttttaacatgttagccaggctcgttttgaactcctgacctcgtgatccgcctgtctcagcctcccaaagtactgggattacaggcctgagccaccacacctggccagcatcctagtttttaaatgttggcaatctcttaaaaatgtctaagatttgtgtagtagaaacaatgcaatgtactagccaggctacccatttgcagtctgtgcatacaaatccctgaaaagctgccttggactctggagtcacctgcttgggtttaaatcctggctccctgtctgatgctgggyaagggacctaacctctttgagactcagttttctcatctgtaaaacaaggatattcagacctcctcataggactatgatgaagcttaattgagcttatgcatgtaatggtgagcttgaaatccaagcatgaccacaagtagctggaactgagagtgagtgcccttcaggtgactcacaactgctaccattggcagattacacctcagtccctatgtttctgcttggccctgtgggtgaagtcatcacctattcattcaaataagtgacatgtgctgagcacctactatgtgccaagcatag

SEQ ID NO: 48716 - DNA, 601 bp, Human
catcctggctaacatggtgaaaccccatttctatgaaaaatacaaaaattagccaggcgtggtggcacacgcctgtagttccagctacttgggaggctgagacaggagaattgcttgaacctgggaggcggaggttgcagcgagccgagatcatcgcaccactgcattccagcctggtgagtgagcaagactccgtctaaaaaaaaaaaaaaaaaaatcacaacaaaaattgtgtgtgcgcacgcgcatgtacacacatgcatgcacatgtgttcatgcatgcacaaatgttaacaactgrtgaatctaagtgcagtgtatggggactattccttaaacattttcaaaataaaaaggaaaaaaatctatgccctaacattcccttttcctcttctccgctttatttttcttcatagtatttttcactctctaacatcctctatattttacttatctccttgtttattttgtgtttctctgtaaaagaatttcaaatccacgaggttagagatttttgcctgtattattactgctgggttctcagcgcctagaaaagtgcctggaacacagtagatactcagcaaagggtgagcgaataaat

SEQ ID NO: 48717 - DNA, 601 bp, Human
agtaaagagtcatgaggtcagccaggcacggtggctcacgcctgtaatcccagcgctttgggaggccaaggcgggcggatcacgaggtcaggagatcgagaccatcctggctaacatggtgaaaccccatttctatgaaaaatacaaaaattagccaggcgtggtggcacacgcctgtagttccagctacttgggaggctgagacaggagaattgcttgaacctgggaggcggaggttgcagcgagccgagatcatcgcaccactgcattccagcctggtgagtgagcaagactccgtctaaaaaaaaaaaaaaaaaaatcacaacaaaaattgtgtgtgcgcacgcgcatgtacacacatgcatgcacatgtgttcatgcatgcacaaatgttaacaactggtgaatctaagtgcagtgtatggggactattccttaaacattttcaaaataaaaaggaaaaaaatctatgccctaacattcccttttcctcttctccgctttatttttcttcatagtatttttcactctctaacatcctctatattttacttatctccttgtttattttgtgtttctctgtaaaagaatttcaaatcca

SEQ ID NO: 48718 - DNA, 601 bp, Human
atgaatatgaatagtatttcagagagtcaagtgaacatgacaaaatatttgtaggagaaagggggtgttgctgtgacagagctccccatgctctattccctgttggtctccctgactttattattattattattattttttttttttttgagacacagtcttgctctgtcacccaggctatggtgcagtggcatcatctcagctcaatgcaacctccacctcctgggttcaagtgattctcaagtgagccgagatcatgccactgccctccagcctgaatgacagagtgagactccatctaaaaaaaaaaaaaaaaaaaggccaggcatggtggctcatgcctgtaatcccagcactttgggacgctgaggtgggcagatcgcttgagctcacaagttgtacagcctggacaacatggcaaaacctcatttctacaaaaagtacaaaaattaactgagtgtggtggtgcatgcctgtagtcccagctacttgggagtctgagaagggaggatggcttgagcccaagaggtggaggttgaagtgagccaaaatggcatcactacactccagtctgggtgatcgagccagaccttgtgaacaa

SEQ ID NO: 48719 - DNA, 601 bp, Human
tgtccaagcatctgcaagtctgatcaatcttaattcctgtggagacatttcaaaaccagtcatgtccttttgcacctccgagagcatttctacacataaattcctccctctcaaaaatccttcccatgtccccttaaaccctgggggtgtctgagaaatttgtgggggtggtggttttggttgttgcaaggactgggggaagatgtggactgtcagtggggaggaccataggtgtctgtaccccacaatggagagtcagtccctcacaagaaagagctgtcccaggccctatatgtctactttttttttttttttttgagacggagtctcactgtgtcacccaggctggtacacagtggtgcgatctcggctcactgcaatctccacctcctgggttcaagggattctgccacctcagcctccctagtagctgggattacaggcgcccaccaccatgcccagctaatttttttgtatttttagtagagacagggtttcaccatgttggccaggccagtctcgaactcctggcctcaagtgatccagccacctcagcctcccaaagtgctgggattacaggtgtgagccaccgcacccagac

SEQ ID NO: 48720 - DNA, 601 bp, Human
ctgcgtccagcatctaaaagcttaatggctaatccaatggggccctccaggatctcactccaagcttgcacaatggcccacccatgccttctagtgttacgtactctgacttccagccctggaaaagccttcattaagccttactttacagatgagcctcttgaggcccaagaggtgaaaggacttgtcctaaggttccccagttagtgacggagctgaaatctaggctcttgggttcctgatccattgtgctcccctagacatggtcttctcgttgaactctctgttgttatgggctgamactgtgtccccttcaaattcatatgttgaaggcgtaacttccagtactttagaatttgactatatttggagagagggtctttaaagagataattaaggtaaaatggggtcattagggcgggccctaatttactgactggtgtccttataagcagaggagattaggacacagatgcacacagagggaagactgtgtgaagacacagggagaagaaggtctaggagagaggcctcagaagaaaccaaccctgctgacaccttgatcttggacttctggcctccagaatcatgagatataaat

SEQ ID NO: 48721 - DNA, 601 bp, Human
tggcccggccccggcctcgcccgcgtaggatgccaggaggttggcggcggcggcggctgctgggttggccccggcggccacggcggccaggacgccggaagctgcggccgagttgaggcccaggcccagggagttggtgttgtagccgtaacttgccagcgtgttaagcgccgtgctgatggccagcaggtcggtgcctgagaaggcgggcagcgcggcgggaaaggcccccacgccagccagcccggcggggcccagcaggccggaggcggcggcggccgacgctgcggccgcggctggmagcacatccgcggggctggcgtacggagagccggtggggttggagttggccacggggcctgccacgttggcgtagctgatgttgaggcagctgctgctctgggggtcttcttgtaccttctgcacgatggcgctcacggccttgtgcacctgctcgggctcgccgctgaccgtcaccacgcgctcctgcaggttgatgccctccggcttctgggacagctgcacccatgctcctgactgttccatcacggctttcaccgtggcgcctcccttgccgatgatcaggcccgccgtgctgttg

SEQ ID NO: 48722 - DNA, 601 bp, Human
gcccacgtcgcaccagcccagtgtcttcatgtggtagtgctgcacattccgggcctgctgctggcacgaggcgggggtgttgcagctgctgcccgccgtgtgcgataccaccacatagcgtaagggcaggctcaggtgctgggcgcactctgatgccagggccttccactcgttccggggcactatggggctgcagcaggccgggtcttctgtctcctgagccgctccgagtcgaaggaggctggggagagcccaggcaagcagcatagagcggcgggacatagtggcagggcggcagggkccgggagaccgctaggagcgcccggtggaggggccgcctttatctgctgggggattccaggagtggcccggaaagtcttgcttcacaccctgctgggacttcctgctggcccagcagaccccagactcagcttccttctctggctgggccagggcgggatgcactgtggttggggtctgggtcacgcccacggcaatgacaggccccctcgctcagcagggagggacgcacaggcccctgggcgcttcgccccgccgtttctggaagacccggggccgggatcccggtcctgcttgtctc

SEQ ID NO: 48723 - DNA, 601 bp, Human
cgtcaggctggactgcagcccattctaaggaggaggtagctggtaggcgtggccccggacctgcttcagcctgcttcagccggcaccccttacagtctgttctccccacagcagccagagggagtctcttgtacctacactagccctggtccctgctctgcggggggaagcctcccatggctcccatctcggagtaaaagctacagtcctcactgtggtccacaaagccctgcctggtcctgccctttcctcatttcattccgctcgcccggctgtgttcagccaccctgtccttcccacrggacccgcccactcaaccccgttggctttgcccccagcaccccctgccacctgcaggcctctgtctgctcccccatcccagagccaaggcagccactctcagggaggctttcccttgccccacccttccaaggagcctgtgtgggtctggtcccagcctgaggtcaccctccctcacctctttccttttatccatcgcctctatcaccgtctgaattcacctgtggccttggcttgtttctccctgctggtctttcaaccccaggaggctagagtggcaccgttctccatgccacatctg

SEQ ID NO: 48724 - DNA, 601 bp, Human
gaacatgtgtcccctgggtggggtctattgaagtggtctctggggacctgcatgttcctccaataagctctgcaggagattctgatgcttacctgggtctgagagcctgcaggattgaaagttccctccctgtggaaaccgtcaggctggactgcagcccattctaaggaggaggtagctggtaggcgtggccccggacctgcttcagcctgcttcagccggcaccccttacagtctgttctccccacagcagccagagggagtctcttgtacctacactagccctggtccctgctctgcrgggggaagcctcccatggctcccatctcggagtaaaagctacagtcctcactgtggtccacaaagccctgcctggtcctgccctttcctcatttcattccgctcgcccggctgtgttcagccaccctgtccttcccacaggacccgcccactcaaccccgttggctttgcccccagcaccccctgccacctgcaggcctctgtctgctcccccatcccagagccaaggcagccactctcagggaggctttcccttgccccacccttccaaggagcctgtgtgggtctggtcccagcctga

SEQ ID NO: 48725 - DNA, 601 bp, Human
tggctgctgggactggctggttatggccctgccatattcccggagcctggcatgatggtgctggggtcgggggtggttggttctccctggtcatttgttgcatgaatgcatctcattgaaacctcagccaccatcgccaagcgggtacagtcagaagccccatttacaggtgaagaaacgaggctcagagagagaaggtgacgtgacatggaaaggggattcagaacgttagaaccagattcggaatcctaaaagctgagggccagacagcggctgcttctgtatgtggtgatgtggaccygaggctcgggccttcgtgacctcatgggaacacttaggatcagagcgcctgagtcttggaaacaaaatgttgaagttggagtctttgataaaatcttgaactggaagggctgggaatacctttggacacttctagacttctctgggtgggttttgtgtgtgtgtgtgtgtgagacacagccttaggaggtcctgagaacatgtgtcccctgggtggggtctattgaagtggtctctggggacctgcatgttcctccaataagctctgcaggagattctgatgcttacctgggtctgagag

SEQ ID NO: 48726 - DNA, 601 bp, Human
gctgcagtatgtgccaactcagcccccgcgctcacagtgtcattaatgacgcacagaatgtcggaacttccgaatcttgagtcccgaatctgctgcttaggaagccagctcccagaatctggccccagtgatgctggctgctgggactggctggttatggccctgctggtgatgctggctgctgggactggctggttatggccctgccatattcccggagcctggcatgatggtgctggggtcgggggtggttggttctccctggtcatttgttgcatgaatgcatctcattgaaacctcwgccaccatcgccaagcgggtacagtcagaagccccatttacaggtgaagaaacgaggctcagagagagaaggtgacgtgacatggaaaggggattcagaacgttagaaccagattcggaatcctaaaagctgagggccagacagcggctgcttctgtatgtggtgatgtggacccgaggctcgggccttcgtgacctcatgggaacacttaggatcagagcgcctgagtcttggaaacaaaatgttgaagttggagtctttgataaaatcttgaactggaagggctgggaatacctttgg

SEQ ID NO: 48727 - DNA, 601 bp, Human
agaagggacagcctgtgcaaaatccccgaagcgggaaagcgcatggcaagtttaaggaaccgaaaggccagggcggctgttagaggtgggggaaaaagcaaagaggccgagtcgaagcaagcgaggtctgcggggcggtggcgcccggggggccacgttggaactttgcctcgagggcactagggagccaaggaagggtcctgagcaagggaagaaacatgggtcgcgaaagccactgttcccctctccccacggcgatgccctccccgcccgagcccctgcttctttaggagcctcctcstttcgtctccgggcccaaacgccgcctcccgctcaccgcagctctggcctccgttcccctcgcgccccctcagcagtgcctcttcctacactccgccgccgccgccgccgccatcttccgttcgtcgccgggaacggtgcgcacgcgccacacacccagggccgccgggaaatggagtccagagcacagcccgaccccgcccatgcctcgtcccgtgcgagcggcattctgcccgcctccatactacggcgagcagacccttcatttccggctctgggtccggctaggccttctgggaaa

SEQ ID NO: 48728 - DNA, 601 bp, Human
attagctgggcgtctccggcgtgattggcgctgtgctgagaacacagtggcgacagagacaaacctagtccctaccttcatggaacacacggtcatagacatcataaaacagcacacagataagagtcggataacaaattagaccacacgtgacatgaaggaacacggaccgacaaaagcatttaacaggcggatttctggatggagggcagggaaggagggcttcgcagaggaagtgacgttggtgccgagacccgaaggatgaaatgggagttagccaagccgaatgggtaaaaggatrttgcaggcagaagggacagcctgtgcaaaatccccgaagcgggaaagcgcatggcaagtttaaggaaccgaaaggccagggcggctgttagaggtgggggaaaaagcaaagaggccgagtcgaagcaagcgaggtctgcggggcggtggcgcccggggggccacgttggaactttgcctcgagggcactagggagccaaggaagggtcctgagcaagggaagaaacatgggtcgcgaaagccactgttcccctctccccacggcgatgccctccccgcccgagcccctgcttctttagga

SEQ ID NO: 48729 - DNA, 601 bp, Human
aaatacaaaaattagccaggcgtggtggtgtgcctgtaatcccagctacctgggaggctgaggcaggcgaattgcttgaacctggaaggcagaggttgcagtgagccgagatcacgccactgcactccagcctgggtgacagagtgagactctgtctcaaaaaaaaaaaaaaggagcctacacaggccgagtttggtggctcaggcctgtaatccctgcactttggaaggctgaggtgggcagatcacttgaggtcaggagttcaagaccagcctggccaacacagagaaaccccgtctcyactaaaaatataaaaattacctgggtgtggtggggcacgtttgtaatcccagctactcgagaggctggggtgggagaatcacttgaaccagggaggtggaggttgcagtgaactgggatcgtgccagcctgggcgacagagtgagaccctgtctcaaaaaaaaaaaaaaagaaaaagcatatacaataaacaccaacctccacttcacttgttttcccttaatatatgttggaggccactatatcagtgtatagagattttcatcatttccttttatctacctcattcctttttagagtt

SEQ ID NO: 48730 - DNA, 601 bp, Human
aaattagccaggcatggtgccatgaacctttagtcccagctactctggaggctaaggtgggaggattgtttgagcctggttgtagtgaagtatgattgggccaccgtagtccaacctgggcaacagagcatgaacctgatgaacctgtttccaaaaaaaaaaaagaaaaaataatcagttaatatatattgaacacggccgggcacggtggctcaagcctataatgccagcactttgggaggccaaggcgggtggatcacccgaggttagcagtttgagaccagtctggccaacatggtgraacctcatctctactaaaaatacaaaaaaattagccaggcatggtggcaggcacatgtaatcctagctactcgggaggctgaggcaggagaatcgcttgaatttgggaggaggaggttgcagtgagccgaggtcacatcattgcactccagcgtgggcaacaagagtgaaactgcgtttcaaattaaaaaaaaaaagaaaaaaaacccacacacacacatagagagagaaagagaaagagagagagagaacacttaatatgtgctaagcacaattctaagatatacatattaactcattt

SEQ ID NO: 48731 - DNA, 601 bp, Human
tatagtggctcacaattgtaaacccagcattttggtaggtctaggtgggaggatggcttgaggccaggagttcaggactagcctaggcctaaaaactaaaaaagaaggccaggtgcaggggttcatgcctataatcccaacattttgggaggctgaagcaggaagagtacttgaggccaggagtttgaaaccagcctgggcaacacagcgacacaccatctctagacatatgcacaattagctgggcatcgatatcatgccactgctctccagcctgggagacacggtaagactccatctaaaaaaaaaaaaaaaaaaaaaaaaaattagccaggcatggtgccatgaacctttagtcccagctactctggaggctaaggtgggaggattgtttgagcctggttgtagtgaagtatgattgggccaccgtagtccaacctgggcaacagagcatgaacctgatgaacctgtttccaaaaaaaaaaaagaaaaaataatcagttaatatatattgaacacggccgggcacggtggctcaagcctataatgccagcactttgggaggccaaggcgggtggatcacccgaggttagcagtttga

SEQ ID NO: 48732 - DNA, 601 bp, Human
gcctcagcctccctagtagctgggattacaggcatgtgccaccacgcctggctaattttgtatttttagtagagacggggtttctccatgttggtcaggctgatctcgaactcccgacctcaggtgattcgcccgccttggcctcccaaagtgctgggattacaggcatgagccaccgcgcccggccgacgaccatatttcaaattttaacttcctctcgatccccatctgtgttgctttttctccatagcatttatcatcatcacacactacatatttataagttccacgaggacagtgatttatttatttgaaatcattttttggtagaagcagagtttcgccatgttgcccaggctggtcttgaactcctgcactcaagcaatccaccctccttggcctcccaaagtgcttgggatcacaagtctcagccatcgcccccggcctagaacagggattttgttccttcactttttatattcccagcacggaagagtgcttggcacctagcaggagctcaataaacatctgctgaatgagtgaacactactgccaaacggcctccccaatcactgggttcagtattcctgccctttcactc

SEQ ID NO: 48733 - DNA, 601 bp, Human
ttggcctcccaaattgctgggattacaggtgtgagccacagcgcccagccgaaaatgacacgttttttaaaaggaactacccaatagctattcacagtagtatcacatgataggggtctcctcaatgaatgacgagccacagcctcctccctagtttccctgctgcctgtcaccccctatcttgctcagggtcagggccaatgtccccatcaaggcctacaagattttatggcatctggcctgttcttcctctgactgcctctccccctgggctctttgctccacccactctggcctcctygctgtcctgtgaacatgcccaacatgccccttcctcaaagactttgtgcctctcttccgtctgcctggaatattcctcctcctagatatcagcacaactccttccctcttcatttccttcaggtctccactcacatgtctctgcagtaaggtcttccctgacgactatgtttcttttttttttgagacggagtttccctcttattgcccaggctggagtgcaatggcgtgatctcagctcacagcaacctctgcctcccaagttcaagcgattctcctgcctcagcctccctagtagctg

SEQ ID NO: 48734 - DNA, 601 bp, Human
agcagaggaaacagggtaaaaaaaattggtgaagccgggcgcggtggctcacgcctgtaatcccaacactttgggaggccgaaacgggtggatcgtctgaggttaggagtttgagaccagcctggccaacatggtgaaaccccatctctagtaaaaatacaacagttagctgagcctataatcccagctactcaggaggctgaggcagaagaatcgcttgaacccaggaggcggaggttgcagtgagccgagatcatgccactgcactccagtctgggacataaagacagactccatctcaaaaaaaaaaggtgaatctcagtatattatcctgaaaagaggtccctgacagcctgttgcatcagaggacaatacatgcagttcaagccatttttgtcaagtatgtgtttatgtatacgcagaatgacctgaggcaagacatttaacttctctggctctcagtttcctcttctaggaaacagggatagtaacagggcttacctcccaagactattttgaggattaaatgagttagtatatacagtaaacattggctaagtatactattatttttatgtacatgggaaaagatctgaaggct

SEQ ID NO: 48735 - DNA, 601 bp, Human
atatgttaaaaaaggaaaaaaatctgaaaggataaaccaaaaaccagcagaggaaacagggtaaaaaaaattggtgaagccgggcgcggtggctcacgcctgtaatcccaacactttgggaggccgaaacgggtggatcgtctgaggttaggagtttgagaccagcctggccaacatggtgaaaccccatctctagtaaaaatacaacagttagctgagcctataatcccagctactcaggaggctgaggcagaagaatcgcttgaacccaggaggcggaggttgcagtgagccgagatcrtgccactgcactccagtctgggacataaagacagactccatctcaaaaaaaaaaggtgaatctcagtatattatcctgaaaagaggtccctgacagcctgttgcatcagaggacaatacatgcagttcaagccatttttgtcaagtatgtgtttatgtatacgcagaatgacctgaggcaagacatttaacttctctggctctcagtttcctcttctaggaaacagggatagtaacagggcttacctcccaagactattttgaggattaaatgagttagtatatacagtaaacattggct

SEQ ID NO: 48736 - DNA, 601 bp, Human
cacctgcctcggcctcccaaagtgcagggattacaggcgtgaaccacagtgcctggcccagagtaaacttttaaaaacacagctctgaggaatatcaggcacagagtccggcacatagtaggcactcaatacatcacaaaaggcctgcttcaataattatgtttcagccactctctggaatatcatgaagctgtttttaaaagggaggaagggggctttcaggcatccatcacagtcacacaggcaaaattatggaatgattaacgtagcagtatatgtcaattacacaactattcataayagcaaaagactagaagcaactcaagtgttctcaaatagggagactggctgaaaaaaagttcatacataatcaaaggccatggggcttcaacacctgtgaaagtaagtgaaaaacatataaatataaataaaggaaaaagactatggaactgtaacaagaaaggaagaaaaaaacaaaaaaatgagaacaatctctagacactgatagagagtgcatacattaagtgaaaacaagcaaagctgaagacagtgttgactgtatgtttctgttttacaaaaaaaaaagaaaaatgaggccagg

SEQ ID NO: 48737 - DNA, 601 bp, Human
cagcaaactttctttttttttttttttttgagatgaagtcttgctctgtcacccaggttggagtgtggtggtgcgatctcagctcactgcaacctctgcctcccaggttcaagtgattctcctgcctcagcctcccaagtaactgggattacaggcacatgccaccatgcccagctaatttttgtattttcagtagagacagggtttcaccatgttggccaggctggtgtcaaactcctgacctcaggtgttccacctgcctcggcctcccaaagtgcagggattacaggcgtgaaccacrgtgcctggcccagagtaaacttttaaaaacacagctctgaggaatatcaggcacagagtccggcacatagtaggcactcaatacatcacaaaaggcctgcttcaataattatgtttcagccactctctggaatatcatgaagctgtttttaaaagggaggaagggggctttcaggcatccatcacagtcacacaggcaaaattatggaatgattaacgtagcagtatatgtcaattacacaactattcataatagcaaaagactagaagcaactcaagtgttctcaaatagggagactgg

SEQ ID NO: 48738 - DNA, 601 bp, Human
cccctgggctcccttctccatcccagccctgcccacactgggtcatcattgcctggtgacaggaatgtctgccccactggactggacactggcagagaagaaatgcaatgatgaagagtgtaggatttggagctggaatccaggattcaattactagttcagccagctcccagcagagtgaccctgggctaataatttaagccccggggtctgcttctttctgtataaaacagggatgaaactaccctgccttacagagctttcatgagaactagaagagcagaggcctgcactgagcacygtggccggcacacactgagtgtgtaaatgtggacactggtgttactgcaagtgtctttctcaggttcccagcctcctccctttcacctgctcagcccaggatgccccccgggccctcacctgtttgagcactgtgatctttgagtcattggtgatcagcgccgcctggttcagaagatccaccacctggaaggagggggagtggcaggggatagtgccagcccagtccagcccagtgcagccccctcggcactcccagggctctgccacctaaacagggattgccaaagccaggggctat

SEQ ID NO: 48739 - DNA, 601 bp, Human
gtcaacatggtgaaacgcgtctctactaaaaatacaaaaattagccaggcatggtggcaggtgcctgtaatctcagctactcaagaggctgaggcaggagttgcagtgagagccaggatcgtgccatggcactccagcctgggcaacagagcaagactctgcctcaaaaaaaaaaaaaaaagagatgctctgcctctctcatttggtacacttctctccttttatcctccatggcttggttcaaaagtcctccctgactccccatccctaggctgggtcaggagctccctctgggctcccrgagcccccctgggctcccttctccatcccagccctgcccacactgggtcatcattgcctggtgacaggaatgtctgccccactggactggacactggcagagaagaaatgcaatgatgaagagtgtaggatttggagctggaatccaggattcaattactagttcagccagctcccagcagagtgaccctgggctaataatttaagccccggggtctgcttctttctgtataaaacagggatgaaactaccctgccttacagagctttcatgagaactagaagagcagaggcctgcactg

SEQ ID NO: 48740 - DNA, 601 bp, Human
gaaccatgcccagcccaagtgccccatgtcgtcttctgcctttgcacacacttctgtgccctcagcttgacatgctctccctctcttggctgggcacggtggctcgtgcctgtaatcccagcagtttgcgggggccaaggagggtggaccacttgagctcacgagtttgagaccagcctggtcaacatggtgaaacgcgtctctactaaaaatacaaaaattagccaggcatggtggcaggtgcctgtaatctcagctactcaagaggctgaggcaggagttgcagtgagagccaggatcrtgccatggcactccagcctgggcaacagagcaagactctgcctcaaaaaaaaaaaaaaaagagatgctctgcctctctcatttggtacacttctctccttttatcctccatggcttggttcaaaagtcctccctgactccccatccctaggctgggtcaggagctccctctgggctcccagagcccccctgggctcccttctccatcccagccctgcccacactgggtcatcattgcctggtgacaggaatgtctgccccactggactggacactggcagagaagaaatgcaatgatgaa

SEQ ID NO: 48741 - DNA, 601 bp, Human
aacgagattgtgaacgtgctaaatgccactcacttgttcactttaaaatagctgatttttgctgggcgtcgtggctcatgcctgtaatccccgcactttgggaggccaaggtgggccaatcacttgaggtcaggagttcaagactggcctggccaacatggcagaaaccccatctctactaaaaatacaaaaattagccaggcatggtggcacgcacctgtaatcccagctattcaaggaggctgaggcacaagaatctcttgagcctgggaggtggaggttgtaatgagccaagattgcrccactgtactccagcctggacaacagagcaaaactcagtctcaaaaaaaaaaaaaaggccaggcacagtgactcacacctgtaatcccaacactttgggaggccaaggcgggcagatcacctgaggtcaggagtttgagaccagcctggccaacattgcaaaaccccttctctactaaaaatacaaaaataagccggatgtggtggcgcatgcctgtaatcccagctacttgggaggctgaggcaggagaatagcttgaacccggaagtcggaggttgcagtgagccgagattgcgccac

SEQ ID NO: 48742 - DNA, 601 bp, Human
gtcaagccccgtcctcacagagctgatattttgcgggaagaatcaaggttatttcaatgagtgaggaacactgtaaagaacagtgaaggtggggtgcctgagacatggggctgcatgggagcgggcaggaaggaatttctgaggaagagacctgagggaagggaggggagagccaggtggcaacctggggacgagggcccctagcaggaacagcaagcagacaggctgcgaaatccaactgtgacttctgaggagcaggggagacagagaggatcagaagtgagatgaagccgaagtgagrgtttgggtttccacctaagtaagctgatgagccagctggggtctgagagcaggggtgtgccaagactgatttacatttaacagcgtcactctggctgctgagtgcaagagtggaagcgggaaatgagtgcggtgattcctctttgggggatgaaatgccctggaacgagattgtgaacgtgctaaatgccactcacttgttcactttaaaatagctgatttttgctgggcgtcgtggctcatgcctgtaatccccgcactttgggaggccaaggtgggccaatcacttgaggtcaggagt

SEQ ID NO: 48743 - DNA, 601 bp, Human
tcccagccttgccacattctggctgtgtgaccttaagaaaattcacttcacctctctgagactgttttctcttcagttaaagggtcaaacaactgatccatagtattacgaataatgaagctgctcaagcatttaatacagtgccttacaaacaaatatttaatacacagtagctagtctacttcctcccagtcacaaagcatccagtaaagctttaataaacaaatgagcaagtgaccagcttgaacaagtcacttgaccattctgagcctgtttccctttctgtaaaaagaggataacyacagtatccatcgaggctgccataattacggagataacacgggaaaggacctgacacagcgcagggcacagtacgtgttccatgtggtgactgttatgttcaactcattcacgtgtgcaacaaatacgtagtcagcccctactaggtgacaacactgctccaggcaggtactggggacaaagtggccagcaagacagaaaaagtcaagccccgtcctcacagagctgatattttgcgggaagaatcaaggttatttcaatgagtgaggaacactgtaaagaacagtgaaggtggggtgcc

SEQ ID NO: 48744 - DNA, 601 bp, Human
ctgtctcaggggaccggaatggcacatccagaagctgggaacagtgcttggtgcctccagactgagccgcccctgaaccctctatctagactggtcctgtaacaccaactcctttgctctctcagggccctgctgttcacataagggacagtaggggcagacaactgtgtgaatttggacaagcgacttcacctcatttagaataatagtatctatccaattgtttatgcaattttttgggaaaattgcaacaatacttgtaaagtgcttagaagagtgcctgacatgcagaaagcattcmgtaaacaccaaaaagcattcggtaaacaccagccattgctactttaaagcactttgttttctgtaatcactagttttgcttgcctcagtctgagggctcaaaaagtagggaccctttcctagcttggcaataaccccagcagggtcattttcattgaagaaaaaaatgaagggcctccaacaaatgttcaatgaataaataggagctcagcacagaattttcacagcatacattacaatctgaaatattaattaaatcagtcaaaaaatatgaaacttagctgtcagctacatgaaggca

SEQ ID NO: 48745 - DNA, 601 bp, Human
tgcccataaagagtatgctcggatgctggttttgaaccccaacatattagtttgtcaacgagacatatcaggcaggatggccctgggtggggagggcgctctcacctgcagggccaccttgtagagctgggtcatggtgaggatagccttcttcaccacgttcacattctcgtccctcaagagcatgttgaggtttgcaatgagtttcagcagcaactcaatgtctcgcttgctgagggatggagaaaaaaggggcgaggtcaaggtgtggtcttagagcaagtaggaggagcctgaggtycaggagggaagggaaatcagggacctgtctcaggggaccggaatggcacatccagaagctgggaacagtgcttggtgcctccagactgagccgcccctgaaccctctatctagactggtcctgtaacaccaactcctttgctctctcagggccctgctgttcacataagggacagtaggggcagacaactgtgtgaatttggacaagcgacttcacctcatttagaataatagtatctatccaattgtttatgcaattttttgggaaaattgcaacaatacttgtaaagtgcttagaaga

SEQ ID NO: 48746 - DNA, 601 bp, Human
gaaggttaagtgcaacttcctgacctaggagacaacgttagctctccatgttatctgttcccacagaccagtggcacatcttgcccataaagagtatgctcggatgctggttttgaaccccaacatattagtttgtcaacgagacatatcaggcaggatggccctgggtggggagggcgctctcacctgcagggccaccttgtagagctgggtcatggtgaggatagccttcttcaccacgttcacattctcgtccctcaagagcatgttgaggtttgcaatgagtttcagcagcaactcratgtctcgcttgctgagggatggagaaaaaaggggcgaggtcaaggtgtggtcttagagcaagtaggaggagcctgaggtccaggagggaagggaaatcagggacctgtctcaggggaccggaatggcacatccagaagctgggaacagtgcttggtgcctccagactgagccgcccctgaaccctctatctagactggtcctgtaacaccaactcctttgctctctcagggccctgctgttcacataagggacagtaggggcagacaactgtgtgaatttggacaagcgacttcacctc

SEQ ID NO: 48747 - DNA, 601 bp, Human
taaaactttggtggatatctttccagacctttcctatacagaaacataacgaatgccatatatatgtttttaacttaaaaaattttaatgggtatatagtaggtgtaaataattatggggtacatgagattttgatacaggcatgcaatgcataattatcaccatcagggtaaatggggtctccatcacaagcatttatccgttttgttacacacaatccaattatactatttcaattattttaaaatgtatgattattttttagtatagttaccctgctgtgctatcaaatactggatctttttttttttccctgagatggggtctcactctgtcacccagagtggaaagcagtggcgtgatctcggctcactgcaacctccaccacccagactcaggtgatcctctcaactcagcctcctgagctgctgagaccacaggcacatgccaccatgcttggctatcaaatactagatcttatttgttctaactatttttttgtacccattaaccattcccacttcctccccaaccgcccattacccttttcagcctctggtaaccatcattctaccgtctgtctccatgagttcaattgttt

SEQ ID NO: 48748 - DNA, 601 bp, Human
aaatttagttataaggggctagacgcagtggctcatgcctgtaatcccagcactttgggaggccaaggcaggcagatcacttgaggtcaggagttcaagaccagcctggccaacatggtaaaaccccgtctctactaaaaatacaagaaattagcccaggtgtgaaggcctgtgcctgtaatcccagctacttgggaggctgaggcaggagaatcgcttgaacccaggaggcagaggttgcagtgagccgagatcgcgccactgcactccagcctgggtgacagagttggactccatattaaaaaaaaaaaaaatttagttataaagatgttcaaagcatgggcttgcaatagtgaaagactagaatacatgtgtatatacacacaactcaaagtcccttgtgacaccactcccctcaatacagtccccaaaattaatgcttaaaactttggtggatatctttccagacctttcctatacagaaacataacgaatgccatatatatgtttttaacttaaaaaattttaatgggtatatagtaggtgtaaataattatggggtacatgagattttgatacaggcatgcaatgcataattatc

SEQ ID NO: 48749 - DNA, 601 bp, Human
ggcctggatcacctcagacatgaacatgggtctctggcgggcgatattggcaagggagcccagcgctgtggtcaggttgatggaggagatggcagggtgcaccatgaacttaagcagctgctccaaggctgccttgccctcttcccatagcacgtctaagagacagagaggagaaccagtcagtgggatccgttttcccaggcctctggagacagcagcttttgggactaaaaggaaggacagatcctggtacctagatgtctatgaatggcgggaaaaacagaaaatgtggtggttgatyagttctatgagactattaatgagtataaaaatttagttataaggggctagacgcagtggctcatgcctgtaatcccagcactttgggaggccaaggcaggcagatcacttgaggtcaggagttcaagaccagcctggccaacatggtaaaaccccgtctctactaaaaatacaagaaattagcccaggtgtgaaggcctgtgcctgtaatcccagctacttgggaggctgaggcaggagaatcgcttgaacccaggaggcagaggttgcagtgagccgagatcgcgccactgcactccag

SEQ ID NO: 48750 - DNA, 601 bp, Human
ggaatggttgggaaggagacactctctttcccatggtgttgctaagtgaacggaatgggagccatgaactatggggggccatctttgctaccctaaggaaagggccagagagtgaaactaaaatggagaaacaaagagctgagagatggagaaatgcagatccacgacctgtacgcattcataccccaaccccagacttctcggttttcgtttcacaaaacagagaaaatggtatgagtctctgtgtacccatcaacatttcgctaatcttggaacatctatcctcccttttggtgggggragaggactggaatatttgaaagtatttcacagacatcatgtcatttcacccccacatacctcaatattaaagccagtcctgaatcaagtttctgtcacatgccaaaagattcctgtctaatgtagagaatctcaggcctgccagatggatgactagcgctcggggtccaccacggagctacatttctttaagaatgagcaggctgaggccgggtgcagtggctcacacctgtaatcccagcactttaggaggccgaggcaggcgaatcacaaggtcaagagatagagatcatcctggcca

SEQ ID NO: 48751 - DNA, 601 bp, Human
gggcgatctcggcctgaggtgtgcccaggtccaccagcagggtggtgatctgggcctggaactccaaggaagccgggtgcttcagcacactcaacaggtgcagcttcagattcttacgcacactgctcacctgcgatttggccagcgtcgggggcaggttggctgtgaggaaagtggcaggagctgtgtcttgtggaagatctcatggcatgctgccagtcttaattctcaaccccaaacttgggcagtggtcttgcaggcatctactagaaaagttccttcaccctcagatctaacgtgyggctttccgccttacaagctgatgcttcaaaccctgggggtctccatcagtatcagtcaatcttaaagagaaaaactcaccctctcttttagtaaatacatacaatttcgtcctcctccatctctggtctggaaattcacatatgcttcgcttggggagggttataatcaccacttttgcctccagaaacccccaactgaactgctgcaacagctcactgctagtctccctgacgccaggatgactttctaatggtcaccctgataagtgagcctcccctgttccacagtgaaaaaggat

SEQ ID NO: 48752 - DNA, 601 bp, Human
agaaaagccatagttgacactattgataaataatacaaccactagaaaattacttcagaaagaaaattatctgataactaaaacaaaggaatgaaagaagagctccacactctacataaagcacttctggaggaaaacataaagaagtgttcacacctggggagtggttacttcttgggagagggataagagggatactattttcattttattcctttctgtaaaatttaaataatgcataatttattaaacgtatattttgataattctattgtaatttatatatcatattaaatactgkaatttatttttataattattttataattttttaaaattagagacagggttttgccatgttgcctaggttggtcttgaaccccggcctcaagtgatctgcccgcctcagcttcccaaagtgctgggaatacaggtgtgagccactgtgcctggcccacataacataatctataatataatcttagtaaatacaaattcagcatagtttaaggtaaataatgaaacatttcagcatggtctgcctgccccaccccaccagcccctctcacccagcttcatcttcttgagtgtggagtccgag

SEQ ID NO: 48753 - DNA, 601 bp, Human
attccttttttttttttgagacggagtcttgctctgtcacccaggatggagtgcaatggtgcaatcttggctcactgcaaccactgcccccagttcaagcaattcttctgcctcagcctcccaagtagcagcaactacaggtgtgcaccaccacgcctggctaatttttgtatttttagtagagacagggtttcaccatgttagccaggctaatttcgaactcctgacctcaggtgatccgctcaacttggccttccaaaatgctgggattacaggcatgagccactgtgcctggcaattccccccccaccttttttttttttgagacagagtttcactcttgtcacccagactggagtgcaatggcatgatctcggcttactgcaacttctgcctcctgggttcaagtgattctcctgcctcagcctccagagtatctgggattacaggcatgcaccactacacccagctaatttttgtattattagtagagacggggtttttccatgttggccaggctggtgtcaaactcctaacctcaggtgattcacatgccttggcctcccaaagtgctgggattacaggcgtgagccactgcgcc

SEQ ID NO: 48754 - DNA, 601 bp, Human
agcgagactgtctcaaaaaaaaaaaaaaaaaaaaaaaaagacaaatttggtgggtaaaatataactttaaatatacaaaccctggccaggtgcagtggctcacgcctgtaatctcaacactttaggaggcgaaggcaggcagatcacttgaggtcaggagttcaagaccagcctgaccaacatggtgaagccccgtctctactaaaaagacaaaattagctgggcatggtggcacatgcctgtaatcccagctacttgggaggctgaggcaggagaattgcctgaatctgggaggcagagsttgtagtgagccaagatcccaccactgcactccagcctgggcaacaagagtgaaactccatctttaaaaaaaaaaaaacaaacaaatacaaaaattagcccggtgtggtggcattcgcctgtaattccagttactcaggaagcagaggtatgagaattgcttgaacccgggagacagaggctgcagtgagcccagattacaccactgcactccaatctgggcaacagagcaagactgtctcaaaaaaaaaaggatgaggtagagttctataaagaactccaagatgaaagtaaatgaaac

SEQ ID NO: 48755 - DNA, 601 bp, Human
gactgattccagggctggggcaaggacagtacaagaggagtctagaacatcttgtcatgctagtaagtaagtgaaatgctcaaaacaaattcctgatagtaagtgggaagaagaagagaaagttcttccttacagcagaatgtcaactgataaatgtagaaggaaaatctctttggagccagtatagaataatagactcaggcaacaatcatcactggatgttaaaaccactgggtgaggctgggcgcagtggctcacacctgtaatcccagcactttgggatcatgaggtcaggagatcragaccatactggctaacacggtgaaaccccgtctctactaaaaaaaatacaaaaaattagccgggcagatggcgggcacctgtagtcccagctactcgggaggctgaggcaggagaatggtgtgaacccaggaggcggagcttgcagtgagccaagattgcaccactgcactccagcctgggcaacagagcgagactctgtctcaaaacaaaacaaaacaaaacaaaaaaacacaaaaaaaccactgggtgaacgtttaaagagaaacatgtattttacatagtttcaaatatctccccc

SEQ ID NO: 48756 - DNA, 601 bp, Human
aggccctccatccttccggggtgcccgggtggtccctgcctctagtcagcctcagcaaacaggagcaaacagcggatgaagatccaggctgcagctctgcctctggtgccaaaccactttatgaccctgggcaactacctgactcgttctgaacctcagatctcctgatctgggaaatgggagtaagccacacccctgcagcttatcataagctctaagaagagattattattattactattttttgagacagtcttgctcgtcaccgaggctgcagtacaatggcatgatttcggctcaytgtaacctccgcctcccaggttcaagtgattctcctgcctcagcctcccaagtaactgggattataggcatgcgccaccaggcccagctaatttttttgtatttttagtagagatggggtttcaccatgttggccaggctggtctcaaatttctgacctcaggtgatccacctgtctcagcctcccaaagtgctaggattacaggcatgagccaccacgcccagcctggtgcagttttttagaaggcactttggtaatggctatcaagaatgtacactcggtacctaagggcacacctgg

SEQ ID NO: 48757 - DNA, 601 bp, Human
aaggaaaagaggttcactcccaggtttctggtttgggaactgggaggggcctggagaggagcgtggggagaaagtggaaaagtgtagttctgccacatgagtctgaggtgctcctgggacgtccaaaaggaggatgatcagaagcgggttgcatacccaggcctgaggctcactgatgtagtctggatatttgttccttcccgaatctcatgttgaattacaatccccgatgtgggaggtggggcctggtcgggggtgtttggatcatgggggcagatccctcatggcttggtgctgtctwcaggatagcgagttgtcacaagatctggtcatttaaaagtgtgtggcacctccctgctccccaacactccctttctcctgctcctgctctgccacacgagatgcctgctcccccttcacctttcactatgattggaagcttcctgaggtttccccagaagctaagcagatgccagcaccacgcttcctatacagcctgcagaactgtaagccaattaaaccccttttctttattaattaggagggtactctggaggaggtggatggtgtgaagtggaggcaggtgaaagaccgaggagat

SEQ ID NO: 48758 - DNA, 601 bp, Human
cctgcctcagcctcccaagtagcggggattacaggtgcctgccaccgcacctggctaatttttgtatgtttagtagagatggggtttcaccatcttgcccaggctggaaaaggataatttcaaacttcctatacatttgaagctttaaaaaaaatttatactgggcacggtggctcatgcctgtaatcatagcactttgggaggctgaggcgggcggatcacgaggtcaggagatcaagaccatcttggctaacacagcgaaacctcatctctactaaaaatacaaaaaacttagctgggygtggtggcaggcacctgtagtcccagctactcgggaggctgaggcaggagaatggcgtgaacccgggaggcggagcttacagtgagctgagactgcgccactacactccagcctgggcaacagagcaagactctgtctcaaaaaaaaaatgtattatttttcttagagacagggtcttactctattgtccaggctggagtgcagtggcgccatcagagttcactacagcctcaaattcctgggcttaagcaatcctcctgcttcagcctctccagtggctgggatcacaggtacatgcca

SEQ ID NO: 48759 - DNA, 601 bp, Human
acccagaagccacaagtgccaatccctggcccaggttagggccaggacacactcacctggtcccagtccggcagctgtcatctgtgtggccatgagccgagccaggtgcttgatctgggcttccgtgcctgctgactccacgggggtgtagatggcctggaaggaggctggcatggcctcgggtaggtacaccatgctgatgaggacctgtgggatgcccaggaagagagcctctccttaatcattaactcaagaagcattctttccatgcccatgccaatactggggaaatggcagtgcmtaagaccgacttgggcctgctctcctggggcccagcctcttctggaagtcacagagaaaacaaataattatatagtgtagtgcttgagagggtaacatgaagggcactgtgagccacagcaggagccaggcaaggcaagggctccctgcgcaagaagcacctaggctgagaactgaggggagggcaggagtcagcataatacaggacaaggttttgaggtgggaggggtgtgtattccccgtagagaaacaccatgggagaaggctaagaagcagcagagctggcaccctgtccagagaa

SEQ ID NO: 48760 - DNA, 601 bp, Human
tctatctgtggtacctgtcattatctacaccttagctcccacatgattttcaactgcaccacgagaagttgctcttccagtaaggagaacccagaagccacaagtgccaatccctggcccaggttagggccaggacacactcacctggtcccagtccggcagctgtcatctgtgtggccatgagccgagccaggtgcttgatctgggcttccgtgcctgctgactccacgggggtgtagatggcctggaaggaggctggcatggcctcgggtaggtacaccatgctgatgaggacctgtgrgatgcccaggaagagagcctctccttaatcattaactcaagaagcattctttccatgcccatgccaatactggggaaatggcagtgcctaagaccgacttgggcctgctctcctggggcccagcctcttctggaagtcacagagaaaacaaataattatatagtgtagtgcttgagagggtaacatgaagggcactgtgagccacagcaggagccaggcaaggcaagggctccctgcgcaagaagcacctaggctgagaactgaggggagggcaggagtcagcataatacaggacaaggt

SEQ ID NO: 48761 - DNA, 601 bp, Human
cctctcagcctcccaactagctgggactacaggcgcatgccaacatacctagctaatttttgtatttttttgtagagatgaggtctccatatgttgcccagcttagtcttgaactcctgggctcaagcgatcctcccgccttggacttccaaagtgctgggattacaggtatgagccactgtgcccagccctcagctgttttttttggagacggagtctcactccatcaccaaggctggagtgcagtggcttgatcctgactcgctgcagcctccacctcctgggtccaagccattttccyacctcagcttctggagtagctgggattatagacacccactgccacacccagctaatttttttgttttcagtagagacggggtttcaccacattggccaggctggtcttgaactgctgacctcaggtgatccacccgcctcagcctcccaaagtgctgggactacaggtgtgagccaccacacccagcctgtagcagtttttaatagcactgatcacaccctatgacccaacggttccactccttggtatatgctcaagacagatgacagcatgtgtacatgaagagagttggacacaaat

SEQ ID NO: 48762 - DNA, 601 bp, Human
cactgactcgggagtcagagagaacctattccagacttccttctgtctgcatctcagttacacacacacacacacacgcacacgcacacgcacacgagctgagaaccagaccttcagggtagggctcctgtcctgccctagcacccagaagaggactcaccggggctgagtgacagggataatgggctctggcctcctcttggcctgcggtgcctcttcctccaggggggacatggagctcagggaacccaccaccgagatggcttggccctgggctgacaggcgccgcttgatcaggacrctctctgtcttcaccaccttctcctccttgggctcctccttgcactgtttggtctgctctacacctgagggggaggcagcaaacagacacccagtgcgtcagacccacctgctccaacccgaggacctcctgtgtgcctggctctgttctgagccctgtacacacaaaaccttgtttaaatccacacaacactgtcctggagtgggtactctttttatccccacttttcaatacaactgaggctcaaactagaaatgccattcattgctggggggagcagcaaatgctacagccactttg

SEQ ID NO: 48763 - DNA, 601 bp, Human
gccagtagcatttactacacaacaggaaccacgcgaaatgcttgacaatcacaatcacttttcactcgagtatctagttacctaaccatcaccattaccacgaactaatttaattcttctttgatccttatgagaaagatactatcattatcctaattttagacataaaaaaggattttttttttttttttttacaggaaagagaacagcaaaggcttagtggttatggcactgactcgggagtcagagagaacctattccagacttccttctgtctgcatctcagttacacacacacacrcacacgcacacgcacacgcacacgagctgagaaccagaccttcagggtagggctcctgtcctgccctagcacccagaagaggactcaccggggctgagtgacagggataatgggctctggcctcctcttggcctgcggtgcctcttcctccaggggggacatggagctcagggaacccaccaccgagatggcttggccctgggctgacaggcgccgcttgatcaggacgctctctgtcttcaccaccttctcctccttgggctcctccttgcactgtttggtctgctctacacctgaggg

SEQ ID NO: 48764 - DNA, 601 bp, Human
atgatgatgacagccagtagcatttactacacaacaggaaccacgcgaaatgcttgacaatcacaatcacttttcactcgagtatctagttacctaaccatcaccattaccacgaactaatttaattcttctttgatccttatgagaaagatactatcattatcctaattttagacataaaaaaggattttttttttttttttttacaggaaagagaacagcaaaggcttagtggttatggcactgactcgggagtcagagagaacctattccagacttccttctgtctgcatctcagttccacacacacacacacacgcacacgcacacgcacacgagctgagaaccagaccttcagggtagggctcctgtcctgccctagcacccagaagaggactcaccggggctgagtgacagggataatgggctctggcctcctcttggcctgcggtgcctcttcctccaggggggacatggagctcagggaacccaccaccgagatggcttggccctgggctgacaggcgccgcttgatcaggacgctctctgtcttcaccaccttctcctccttgggctcctccttgcactgtttggtctgctc

SEQ ID NO: 48765 - DNA, 601 bp, Human
cacccagacgcaggaactctcagagcagacaaggagtgaagcgaggaaggccagccgaggacccttatgcctaggaaggtcccgtttgtgtgttggggggtgggggtaccagggtggggatcgatcatcacagaataaaaatgagtttctaggagcagcacccatgtacttaagtgcacagaaaaagatcctcaaagattcccctcatttgtgcctttgtcacctttgaagagagggatggggtgcaggtgatggccacggaagagtactggatctggattccccggaaatatttttcagytcagggagtatgttcctatactactggctaatcaacaattaacttcacagaatggggaaaaagtcacttttccccattctttgaaggtaacagtgccagcaagtggcagaatcaggacagagaaccaggtatatttctaaagctaaatagtaacagtaagaacgttaacaaccgtgaagaaccaagaccacaagagcagccctcacttgcagaggcctcccagcacctgccctgtgcacctgagtgcctgtgctcattgcacatttcctcctcgtcacccaggaggagctgctgctactg

SEQ ID NO: 48766 - DNA, 601 bp, Human
gaggccacggatagggaggaagctacagaaccaactcaggtagtgaatggggtgtagagaagtctatctccaggcccatgggtgagcactgttatttacagatgggaaaatggcagagagagggagtgacaaagccacgcagagcaagctcagagcaagtggcagagctgaggaacagctcagggagtgcgacctggagcccacatgcaaaactacaaccttgaacgtgcctccagagggggaggaggagaggagacttgggatgggtgcgaggaggactgactcggggggtgacgaagarggaggtggtcgcaatcagaaagggagggcagcaccaggagaggaagcctcttggggacaggagggtgcagggtcagccccctcacccatccttctggtctggtttctcctgcaggccagacaacaggcggatgaggcagtcctcatacttgtccagggagcccgaggcacctgcggccaggtaggcgttgtactcctggtagagccaggcgaaggccaggtccaggcgggcccgcacatcctccaggatgaaggacaggacctccgccttcaggcccgagttgaactgtgtcaccaggct

SEQ ID NO: 48767 - DNA, 601 bp, Human
cctccctccccagggcagccacacactgctctgctcagctgctgagcacgctgtgtcctcactgctggctgaggccacaccggctcccctgctgggctgggcaatgccctcaggccccggcacaggactgggctgcacgaggagcctgtgctggccaccacgggtggactaagagcgagagtgggactgcccttcccaggagggcaagcgcacgtgtgtgtgtgtacacactgcaggcagactcaggcacggtaaccctggtttctaggcagcttgatgccactgaaaatgaaaataaaacaaacagacagaaatagccaaaaaaccactgaaagaagggaatgggcccagagaaacttgcaagggagtgtggaagacgtgggctggttactcaggatagaggcggcctctgcaagctgcaggctgagggcagccaggaagtggaggaggggatcaccttgtccttctcatgggagctgaggtcgaggaggacatgcaggtactggaactggcgggacgggcgcttgaagatcaggtctcgaagtgtggacatgcccagataggtgcgactctgcagcaaaaggaaagggacccgagctca

SEQ ID NO: 48768 - DNA, 601 bp, Human
gtcccctccttgaaagaagccttccttgaaacacctcccctgcccaccccacaaccagatggtcggcccctccctccccagggcagccacacactgctctgctcagctgctgagcacgctgtgtcctcactgctggctgaggccacaccggctcccctgctgggctgggcaatgccctcaggccccggcacaggactgggctgcacgaggagcctgtgctggccaccacgggtggactaagagcgagagtgggactgcccttcccaggagggcaagcgcacgtgtgtgtgtgtacacactrcaggcagactcaggcacggtaaccctggtttctaggcagcttgatgccactgaaaatgaaaataaaacaaacagacagaaatagccaaaaaaccactgaaagaagggaatgggcccagagaaacttgcaagggagtgtggaagacgtgggctggttactcaggatagaggcggcctctgcaagctgcaggctgagggcagccaggaagtggaggaggggatcaccttgtccttctcatgggagctgaggtcgaggaggacatgcaggtactggaactggcgggacgggcgcttgaagatc

SEQ ID NO: 48769 - DNA, 601 bp, Human
acctgtgtccttgtcagctccaaacagcacagacggtgggttggggtgcaccaggagctgcaggtagttgagggcaaatttctccacatactcccgcagctgctccttctcatacatgcgtttgatgaacagcagggcctgggagcgcacctgaggaggaagatggagaagggcagggtcagggaagaggtaagaggaagaacagctattcctgcgagcatggcaacactcacgtgaaaacaagcccgaggctgagaaggggcagcccagctgttaccagggcccagggctggtccccagtgcaggaggcagatatcctggccagggccggacccgcagcaccacctcactgcctgcctctccagcccatctgcccatcactgcttcttgccttgctcactaagctccaagcagagggagagctcctcagttccttaaaagtgccactccctgccaagtctccctagaacgtctactgccagctaaaccctgtttcactcagatatcatctgccaggagccgtgagggaagggtctggtcctgggcactctgaccccagcagcagcacatggccatggccagggccagggccaggggtgtg

SEQ ID NO: 48770 - DNA, 601 bp, Human
gcaccacactgttccaaatggagaaactgaggccctaggacaggcacagacccgcaagaggtacgaccatctggggacccagcagctcagatccccagggcccggggaaggctaaggagagggaggaaagccatgaaaggtgggggtctccagggtcacctttgtctgtgaggctgtgcagacatctcgtgaccagtgtctctgctcccttgggacaattttccaccagcaggagcagctccggggagttcatgcccattcctcggatctagaggcagagacagggatgaccagacccagrgtgagagcttaggggaggctcaggtgttgcccggcagggtggctgcggggcatgctggcgcccagggtgagactgaggtgacagggtttggagggcgggggaaaggtggggaagggcaggagagtcagaggaaccttggcatctccctgcagctcctccagacatgggcctgctccagctcccagccctggctgggctgccctcctgcgggccactcctctgtggctcagacttgacctgacctcgaatgcccaccctgtgcttcgttcactggtgaagatgtttctggctccacccacc

SEQ ID NO: 48771 - DNA, 601 bp, Human
taagggtgaacaatcccttgctagtttttctaagttgaaagttttgcttcttttttttttttttttttgagatggagtctcactctgtcatccaggctggagtgcactggcgcgatctccgctcactgcaagctccgcctcccgggttcatgccattctcctgcctcagcctcccgagtagctgggactacaggcgcccgccaccacgcctggctaattttttgtatttttagtagagacggggtttcactgtgttagccaggatggtctcgatctcctgaccttgtgatccgcccgcctsgcctcaagttttgtttctttttgactgtgtcaaaacgaaatgcccctggcccacagcttgagggattcgggcaagatctgaggaggggccagactggagccgggcctgagaggggctggtgtgtggccagatcctaaaagggaagatgctgctggagcctccgcccctagctccacggtcttgcccctgctgtgaatgaaaccatcataaaaatatcccagagggtggcctgggagctccgggacacatggagatgtccagtacagctggtgtcccagggagcaggatgtgccctctctc

SEQ ID NO: 48772 - DNA, 601 bp, Human
ggggagtggaggggaggctggtggagtggctctttgctgctgctattttgatggtcccagagccatctatatgtgtgttttaaaccaccagggtctgcgtggaacagacatcctccattttttctctagcaccaaccactggggtaagggtgaacaatcccttgctagtttttctaagttgaaagttttgcttcttttttttttttttttttgagatggagtctcactctgtcatccaggctggagtgcactggcgcgatctccgctcactgcaagctccgcctcccgggttcatgccatyctcctgcctcagcctcccgagtagctgggactacaggcgcccgccaccacgcctggctaattttttgtatttttagtagagacggggtttcactgtgttagccaggatggtctcgatctcctgaccttgtgatccgcccgcctggcctcaagttttgtttctttttgactgtgtcaaaacgaaatgcccctggcccacagcttgagggattcgggcaagatctgaggaggggccagactggagccgggcctgagaggggctggtgtgtggccagatcctaaaagggaagatgctgctgga

SEQ ID NO: 48773 - DNA, 601 bp, Human
caggcttccaaaaagtggctggagccttctgctgtgtggggcctgggggagtggaggggaggctggtggagtggctctttgctgctgctattttgatggtcccagagccatctatatgtgtgttttaaaccaccagggtctgcgtggaacagacatcctccattttttctctagcaccaaccactggggtaagggtgaacaatcccttgctagtttttctaagttgaaagttttgcttcttttttttttttttttttgagatggagtctcactctgtcatccaggctggagtgcactggcrcgatctccgctcactgcaagctccgcctcccgggttcatgccattctcctgcctcagcctcccgagtagctgggactacaggcgcccgccaccacgcctggctaattttttgtatttttagtagagacggggtttcactgtgttagccaggatggtctcgatctcctgaccttgtgatccgcccgcctggcctcaagttttgtttctttttgactgtgtcaaaacgaaatgcccctggcccacagcttgagggattcgggcaagatctgaggaggggccagactggagccgggcctgaga

SEQ ID NO: 48774 - DNA, 601 bp, Human
actgaggtcctgccctggcgtcgcaggggccaggccactggagtgggggggaagcgcctcacctttgatgatggatttcatgtcgcacttcacggagtcaatgttgtgtaatgcgatcaggagctctccagggttcagcggggacaaggctgagtttccctcacctgcagcaggcgggaggaagggtgggggaagacagtgcggacgcataagtgaagagatgggtctgagttccccagatcgggggagctgcgagcaaagatgaggtgccctctgctttcagggctggaacaggggaagygactgacaacataaaaaggggacaccgaaggcagcagcagccctcaggcagcgtgaggttgccactgtgtgctcctccccatcctgggctcccaccctgggtagcgtgtggcacggctgggtctctctgcccctgggctgtgcacccccgagggcagggtaggaccacctcctcgtgtggtccccaacacagactccaacgcggcacagggggtcatgggcatttgtggcacagggcaagatggagccaggctacaggcttccaaaaagtggctggagccttctgctgtgtggggcctgg

SEQ ID NO: 48775 - DNA, 601 bp, Human
aaagctgtttcaagctagaacacgaaagtaagcagcacagagaggaagccccttcccgtctgagggtgagaagagaaatcaaaggacagcagtcttctgagtatagagggcgacagtgagggtgtccagctccgtgggacaggatggctcctggcccagaaaccttgctcaggagggatggaggggtgggcgctctcaggggaggtggtccttagacgctgaaccggcagagctgggattcccacccaggtccgtttcacttcagattctgtttcttctaccacaccacttagcttctgcktggccctgagtaagtcacctaacctctctggagcctccatttcctgtctacacaatggaagtgaacatacccaccaagtggcggaccagcaggctcaggcctgtaggcgttcagggagagcccagcgcagagtgctcagtgagtgggggccatcgtgaggcggccagttcgtcaccaaccctgccgccctgcaggcaagctctcctgcctcacctaccctggcccacaagtgccctggagccctgggtctgccctgctgctgcgcctctaccactcacggtgtgccctgcttccttctgt

SEQ ID NO: 48776 - DNA, 601 bp, Human
tgacatttccataagctgctctcttgaccttaaacgtttctcagagaacttgcagaggaaggttaggaagtaagtcactgaaaagctgtttcaagctagaacacgaaagtaagcagcacagagaggaagccccttcccgtctgagggtgagaagagaaatcaaaggacagcagtcttctgagtatagagggcgacagtgagggtgtccagctccgtgggacaggatggctcctggcccagaaaccttgctcaggagggatggaggggtgggcgctctcaggggaggtggtccttagacgckgaaccggcagagctgggattcccacccaggtccgtttcacttcagattctgtttcttctaccacaccacttagcttctgcgtggccctgagtaagtcacctaacctctctggagcctccatttcctgtctacacaatggaagtgaacatacccaccaagtggcggaccagcaggctcaggcctgtaggcgttcagggagagcccagcgcagagtgctcagtgagtgggggccatcgtgaggcggccagttcgtcaccaaccctgccgccctgcaggcaagctctcctgcctcacctaccc

SEQ ID NO: 48777 - DNA, 601 bp, Human
tgacttgcctcccagagaccctcaagaaacaaggtcaaattcccacctcggcctgcgagactcctgtgtgggcaggccccaggggcacctttcccaatggcgacagcctgacctcctcccttgaccaggccccctccttcgtcccctaggtccagaaccagccagcaagcacctccctcggtccctgcagtctcctgctgctgccgcctactcatccttccttggtctcagcctgagtgtcccctttttcgggaagtcttccctgatgtcccacacccaggctgggttacatggcccctcygggctgcccagtcccaggccacccctctcagttgttactggccagggacttcttgtctctccctggactgtaagccctggaaggacagggctagggctgtctttcctgtgtccccagcactacccaggatggatatgggtgagcagaggtgctgacttttcttaatgctggactaccaggagtgggtctagttatagacaagctccccagaggaacagggtggtctacgggggagtgaacagtgcacaacaaaaggactcgactttgtgatctggagcttagagtgcaaccaggaagact

SEQ ID NO: 48778 - DNA, 601 bp, Human
aggatgttcatgacgaagccccccaggcgggggtacatggtcagggactggatgacggtcctcatgagcagcatgggcagggggctctgctccatcagctgctgcatcaccacggccagcacctctgacgtgtacacgttccgctccgcaaagcacaggttggtggctgcgaggaggcggagagtgggcctgtcctctctgcccagctgccccctgggaggtgggagtcccggcctctgctgtctgcccatgtgaggggaagacttctaaagccctgacttctaaagcccctgcgggagasaggagactcccccgacccagcagaaggcacactgcaagccccgcccttggaaaacctgcaggcttggttcaagggagaagacatccaactccaggaagccccaaaatgggtggaacagggaacccgtggcccctcactttaaggacgaccttgggaaagatgtgttgccaagccctgggggagtggcagggccccccacccctgctagggagggaaggcagctattggtttctaccagcccctccagagagaacagcagtccacagaccagcttgtcagagggccaagggactgcccacc

SEQ ID NO: 48779 - DNA, 601 bp, Human
ccctccagaggcctttgtcttcccgatccaggcggctggaccacgagggcaacttgggaagggggtggaagaaaactcagccgccttttaccagagctccccctgggccaggcccaggctaagtgctgcgggagcacctctcatgacattctcacggcagcctccagggggcgaaattacccctgctaaacagcggaggtccgtgccggtgccgggacctgtcctgggtcacatgtacattctcaccgcagcctccagggggcgacattagtcctgcggggtttggtttttttgttctctytttttttttttttttttttttgagagatggtcttactctgccgcccaggctagagtgcagtgagtggcgcgtttcttcctcactgcagccccaaactcctgggctcaagcagtcctcctgtctcggcctcccaaagagttggcattacaggtgtgaaccatcacacctggccttatcgtggtatttctaaagcccaaatttctagcacctcttaaaaaactgggccatttttcagctctgggatgcatcctggccgggcacacagcggtggagggtgaggagcagccatgcctctcccgg

SEQ ID NO: 48780 - DNA, 601 bp, Human
acctccctccagaggcctttgtcttcccgatccaggcggctggaccacgagggcaacttgggaagggggtggaagaaaactcagccgccttttaccagagctccccctgggccaggcccaggctaagtgctgcgggagcacctctcatgacattctcacggcagcctccagggggcgaaattacccctgctaaacagcggaggtccgtgccggtgccgggacctgtcctgggtcacatgtacattctcaccgcagcctccagggggcgacattagtcctgcggggtttggtttttttgttctctctttttttttttttttttttttgagagatggtcttactctgccgcccaggctagagtgcagtgagtggcgcgtttcttcctcactgcagccccaaactcctgggctcaagcagtcctcctgtctcggcctcccaaagagttggcattacaggtgtgaaccatcacacctggccttatcgtggtatttctaaagcccaaatttctagcacctcttaaaaaactgggccatttttcagctctgggatgcatcctggccgggcacacagcggtggagggtgaggagcagccatgcctctc

SEQ ID NO: 48781 - DNA, 601 bp, Human
cgacctccctccagaggcctttgtcttcccgatccaggcggctggaccacgagggcaacttgggaagggggtggaagaaaactcagccgccttttaccagagctccccctgggccaggcccaggctaagtgctgcgggagcacctctcatgacattctcacggcagcctccagggggcgaaattacccctgctaaacagcggaggtccgtgccggtgccgggacctgtcctgggtcacatgtacattctcaccgcagcctccagggggcgacattagtcctgcggggtttggtttttttgttctctctttttttttttttttttttttgagagatggtcttactctgccgcccaggctagagtgcagtgagtggcgcgtttcttcctcactgcagccccaaactcctgggctcaagcagtcctcctgtctcggcctcccaaagagttggcattacaggtgtgaaccatcacacctggccttatcgtggtatttctaaagcccaaatttctagcacctcttaaaaaactgggccatttttcagctctgggatgcatcctggccgggcacacagcggtggagggtgaggagcagccatgcctc

SEQ ID NO: 48782 - DNA, 601 bp, Human
cgggggcgcggagcgagggaaacggactcggcggcgccggcatgaggagctgagcgtctcgggcgaggcgggctgacggcagcaccatgcaggcggcagtggctgtgtccgtgcccttcttgctgctctgtgtcctggggacctgccctccggcgcgctgcggccaggcaggtaagttagccgtcctctgtgcctttgggccataccatttcccgggaatctttggagccctcaggcgtattgaaaagggggcatccccatttcccgagtgcgcggggagattttttttttttttttttttaattcgggagggtggtgagaagtggagcaaaaatatatgtgtggaggcgcgcagatgcactggaagccttcggtcaaagcctgtttttctccttctgaagaggaatggggagaatgggaaaggggtgccctgcttctgggccccgctcctggttgctctcggatgagctggtccaaggctctcgggctggtgtctctgcgtccttcccagttgggttccgagagggagggggcggtggggattttcgtaggggagacgtaggactgcaggatggaggagtgagggtcagggtcattattt

SEQ ID NO: 48783 - DNA, 601 bp, Human
atcttgttttgtctataccctacgtatttctttttctatttcctttccctctctatattgtattgaagcaaatcatatcatttcattcataaaaattataggaatttaccactaaacagtaaggattcttttaaaaatgcaaccatgttactgtattttcaaaaattaggagtaatttcttactactatcaaatatcctgtttttcaaatttccagttctcgtaaatatgtatgtatatatgtatatgtatgtgtgtgaatgtttatatgtgtgtgtatatatattatatatatatatattgagagagagagtatatttagagtatatatttaagtaagtttgtctggaccaggacccagataatgtctgtagattgcaattagtttatttatttattttttgtgacagggtctcactctgtcacccagacaggagtgcagtagcacgattatggctcacagcagccttgacctcttgggccccagtgatccttccacctcagcttcctgagtagcttggattacaggcatgtgccaccttatctggctaattaaaaatttgtttttgtaaagatgggatttcaccatgttgcgcaggctg

SEQ ID NO: 48784 - DNA, 601 bp, Human
agtgcctgggatatgtgtacatagtaaggtacacatagtacatgttgatgtctctatcacttgggagccactgcactttaccatgctgcttaaactacaggtggaaatcattgacaactaggaccaaatctgacaaaattttaaagacctgtttatcttaggccaacttttcctacagttaggaaacagaggagttttcttgcactattggcatttctagtttccctaagagcaatcattggattgaaaaacataagttgattttttatggcccttgttatttctctaatacttaaatagwtctaatttatggcattttaattttagatacccatagatttttttttttttttttttttttttttgtgagatggagtcttgctctgtcacccaggctggagtgcaatggcgtgatctcagcttattgcaacctccacctcctgggttcaagcgatattcctgtctcagccacctgaataactgggattacaggcacccaccaccatgcccagctaatttttgtattcttagtagagacagggtttcaccattttggccaggctggtctagaactcctgacctcaagtgatcctcccacctc

SEQ ID NO: 48785 - DNA, 601 bp, Human
ccaggctggtctagaactcctgacctcaagtgatcctcccacctcggccacccaaagtgctgggattacaaacatgagccaccatgcctggccacccatagatatgtttatcaacttcctttctacttcataaataaaatcagggtgattttctgtgaactcaaaaagcttatatagatttgttgatttgtttctttaaaaggcatttatttatttattttatttatttttttcttttgagatggagtctcactctcttgcccaggctggatggagtgcagcggcacaatctcaactcatkgcaaggtccacctccctggttcaagcgattctcctgcctcagcctcccaagtagctgggactacaggcgcgtgccaccacacctggctaattttttgtatttttagtagagacagggtttcaccatgttagccaggatggtctcaatctcctgaccttgtgatccgcccaccttggcatcccaaagtgctgggattacaggcgtgaaccaccgcggctggcctaaaaggcatttatttatttgtgctcctactctgtaccaatttttatgcaagactgtgggcatttagagataaaagac

SEQ ID NO: 48786 - DNA, 601 bp, Human
gcacttacaacaatgctgggcatagagtaagcactatatgagtctttgttaaataacattaactccttcaggctgcttgagtactatttagatattttatgacatcacttgaatgcaaaatggtgccttaattacctgagtttaacatagtcccagaagtatgttagaaattactcaaatttatatttaactaagtggaatcaaatagtcctagagatagaagagaacttataggttatctaacctaattcaggaattacttttcacttgttaagagcaagccattggctgggcatggtgrcccacacctgtaatcccagcactttgggaggccgaggtaggtggatcatttgaggtcaggattcgagaccagcctgaccaatatggtgaaacccgcctctatgaagggtacaaaaattagcctggtgtggtggtgggcacctgtagtcctgagcctgaggcatgagaatcacttgaacctgggaggcggaggttgcagtgagcagagatggtgccactgcactccagcctgggcgacagagcaagtctttatctcaaaaaaaaaaaaaaaaaaaaaaaatcaagccattcaccaagatgg

SEQ ID NO: 48787 - DNA, 601 bp, Human
gagctcacattttgcaagtgattttaaaattttctagctgaggcagaactcctggttgagttgtgtgagaccacttattctgcttcacactgccccatgtctctagcttttacctctagttggtcaatttctattctgctttattttttttttttcaatttgccttttaagtaggtttgtttcggaggaattgccttcatttcctccactagtgaggttaggggatttgaacctaggcacttcaaggttaggatgaggttaggatgttgggggtcaggctggtacacacaatttgctggtrcacacaatttggtcattgctcaagcttttttctctgtgtggttttctttctttggattaaacagcatgatgctacaggaagagctaccacttgacagaacctggttctgcagatttctttgatttccctagtggatttttaatgcctttgggatatcctgttagtgttctgttgaggaactcagctgtggctcctcagcaggcataagtggcagttgaggctacacatagcttggtggtattaatctaaagtaggctggagagggagcgaggcgagcagttacctgaggaatgatctagg

SEQ ID NO: 48788 - DNA, 601 bp, Human
agctcacattttgcaagtgattttaaaattttctagctgaggcagaactcctggttgagttgtgtgagaccacttattctgcttcacactgccccatgtctctagcttttacctctagttggtcaatttctattctgctttattttttttttttcaatttgccttttaagtaggtttgtttcggaggaattgccttcatttcctccactagtgaggttaggggatttgaacctaggcacttcaaggttaggatgaggttaggatgttgggggtcaggctggtacacacaatttgctggtayacacaatttggtcattgctcaagcttttttctctgtgtggttttctttctttggattaaacagcatgatgctacaggaagagctaccacttgacagaacctggttctgcagatttctttgatttccctagtggatttttaatgcctttgggatatcctgttagtgttctgttgaggaactcagctgtggctcctcagcaggcataagtggcagttgaggctacacatagcttggtggtattaatctaaagtaggctggagagggagcgaggcgagcagttacctgaggaatgatctagga

SEQ ID NO: 48789 - DNA, 601 bp, Human
acattttgcaagtgattttaaaattttctagctgaggcagaactcctggttgagttgtgtgagaccacttattctgcttcacactgccccatgtctctagcttttacctctagttggtcaatttctattctgctttattttttttttttcaatttgccttttaagtaggtttgtttcggaggaattgccttcatttcctccactagtgaggttaggggatttgaacctaggcacttcaaggttaggatgaggttaggatgttgggggtcaggctggtacacacaatttgctggtacacacwatttggtcattgctcaagcttttttctctgtgtggttttctttctttggattaaacagcatgatgctacaggaagagctaccacttgacagaacctggttctgcagatttctttgatttccctagtggatttttaatgcctttgggatatcctgttagtgttctgttgaggaactcagctgtggctcctcagcaggcataagtggcagttgaggctacacatagcttggtggtattaatctaaagtaggctggagagggagcgaggcgagcagttacctgaggaatgatctaggatcatc

SEQ ID NO: 48790 - DNA, 601 bp, Human
aggatgttgggggtcaggctggtacacacaatttgctggtacacacaatttggtcattgctcaagcttttttctctgtgtggttttctttctttggattaaacagcatgatgctacaggaagagctaccacttgacagaacctggttctgcagatttctttgatttccctagtggatttttaatgcctttgggatatcctgttagtgttctgttgaggaactcagctgtggctcctcagcaggcataagtggcagttgaggctacacatagcttggtggtattaatctaaagtaggctggrgagggagcgaggcgagcagttacctgaggaatgatctaggatcatcagatatggtcaggaacaggctgtaggtaaaagggtggtggcaggtgaggctcagggaaatcagagagcaaatgatcaagagaagatactaggctggtcaggtcagtatccttctggctcaactagaaagagctacctgaaagagtctgaagcactttctgagtttctggctccacccttgatctgtgtcttaggtctttaaagggaaacttgtgttttttttttttttgtttttttttttttagtcagtcttgt

SEQ ID NO: 48791 - DNA, 601 bp, Human
cacttgacagaacctggttctgcagatttctttgatttccctagtggatttttaatgcctttgggatatcctgttagtgttctgttgaggaactcagctgtggctcctcagcaggcataagtggcagttgaggctacacatagcttggtggtattaatctaaagtaggctggagagggagcgaggcgagcagttacctgaggaatgatctaggatcatcagatatggtcaggaacaggctgtaggtaaaagggtggtggcaggtgaggctcagggaaatcagagagcaaatgatcaagagragatactaggctggtcaggtcagtatccttctggctcaactagaaagagctacctgaaagagtctgaagcactttctgagtttctggctccacccttgatctgtgtcttaggtctttaaagggaaacttgtgttttttttttttttgtttttttttttttagtcagtcttgttctcatccacacatgagctttaagtattcggttcctcctccttccttcttcttcttccttcctattctatatgtgtgtgtttttttctttttctttttattatttcttcctcctctttctttaccttc

SEQ ID NO: 48792 - DNA, 601 bp, Human
ttaagtgttctgattatgaaatgatgaactttgcagttattgtagggttatggaataaaaattattttaatttaattacacgcaataacatggaatgaaggcatggaccctcatcttcatttgtatttctttccatcgttgagcacagacagagccttgtacataacaggtgctcaacaagcaaatattgactgaatgaaattgttgatgccatgacttatagagggccctgtttcttcattaatgctcccatacccccaacattacatcaggttttccctggacaattgtttcttctctyttttcttcttctctttctttcatcatccctcaatataggctctgtcactttcctgcagcctctttccattttcctgtgtacatagctttgctcttttctcattcggtatgacccttggtttattttgtatttccccccactctatttctgccaagcgtctctttctctatgcaactaaagtaaaaacaagtctctgaaaggttatttacattcagtgttgggaaccatccctgtagcacattgctggacttattttgggatttagaaaatgtgttataattcaacacgctttccatttta

SEQ ID NO: 48793 - DNA, 601 bp, Human
tatttctgatggatttgaattcatatggcatattcagccaaggatttcccttactatttatttttagggtttgatttttttaaactatggttttgaactaaggacaacaaccttttttttttcctatagctaagccccagatattttgtctaaaaattaaaaataaatttctagtttttatcttacttttatggactaacaacctaatctaaaatattcatattatttaatatggattaattatgttaatataaatttatatgtaaatataaaatatagataataaaatatgtaagtttamacgtctattatataaattataacattgattaatatgttaatataaaatatttatattcttttataacttttttatttcttaggaggtggatgttacccatactccatgaaatcttcatgcctctaaaagatcttcatatactagtttaaatcagaaaaatataccagtagagaacaggcacattagtataattagcttcaagaatttatatctcagtgtaaaaggaggctgtgaaagtagctttgtaatgtttctttttttattattattatactttaagttttagggtacatgtgcaca

SEQ ID NO: 48794 - DNA, 601 bp, Human
cccactggctggcactccctagtgagatgaacccggtacctcagatggaaatgcagaaatcacccgtcttctgcatcactcacgctgggagctgtagaccggagctgttcctatttggccatcttggctcctcctctgaaagtagctttaagaccagatgaaaaagtgaggacttgtggtggagaggagaccctacattaaaagataaagatcaaatacagctgttgtgactttagctaacctaatgtaatcccaggaacaaaatagttcctatcttacttatatgtatttttataagagktttattgagatataattcacacagtatagaattaacccatttaaaaatggtatacgattgagtttttggtgtatttagagaactgtgcagcgatcaccactgtcaattttgaaaccttttcatcacttcaaaaagaaaccttatgcccattttccctaactgcctcccaccctcagcctgggcacccactgatctactttctgtctctacagatttacttactcttgagctttcatataaatggaatcgtacactatccagtcttttgtgactggcttttttcacttatcataatgtttt

SEQ ID NO: 48795 - DNA, 601 bp, Human
ctgtcaatttccctgtatattgccaaatcaaatagtgatacagcaatttacactccactagcactgtatgcgaatttatgtatagtctccttttcatcattatctggaaccataagactttaaagtttttttaaattttttttattttttattttttttttgagatggagtttcgctcttgtttcccaggctggagtgcaatggcgtgatctcggctcactgcaaactctgcctcccgggttcaagtgattctcctacctcagcctcctgagtagctgggattacaggcacgcaccatcaygcccagctaatttttgtatttttagtagagatggggtttcaccatgttggccaggatggtctcaatctcttgaccctgtgatctgccctcttcggcctcccaaagtgctgggattacaggggtgaaccaccgtgcccggccgactttaaagtttttaacaatattgtgggtatgagatggtatctagttattttactttccattttcctgatgactgatgaggtagagcacctttggtgatctgtatttcctcttttgactggcctattatgcgttccccatttttcaattgaaattttt

SEQ ID NO: 48796 - DNA, 601 bp, Human
ttgccagctctgcaattaaaatttttccattggttctatttcaggttaaggctcagtagctgttttgagtaactaacactaatgcagtttgtgtgtgtgttgcaatttcctgtgatttgatttgtgaactgacatccttttaactcactccaaaaacatttattgaggtcctactatgtggcactgttctgtgcctttgggatacatcagtgaataataaaaaaaattctttcttctgggcttatgttctagcacatagacaaaaatatagtaaatgatgcagtaatacattatatggtaygttcaaaggtgataagtactatggaaaataaaaaatatagcatggtaatggagactggtagtgcaggggagtgtagggggcatacgttgtaatttctagtagggtagtccgttaggcctcagagaaatgacattaggaaaagacttgaaggatgtgaggagtgagtcatacaggtatcttaggaagagcattatatatagagagaataaccagtataatgaccccaaggccagagtatatcggtcaaatatgaataacaagatgactgctccaaagaagattggtgatggaagatcttat

SEQ ID NO: 48797 - DNA, 601 bp, Human
aagttctcctagggtatcatttgataaattaaataaaaagtgacctccgtgttactttgaaagtattcatttgcctcagagcaacaagaagtttaaaaaaaactattataaaatatagaaagaatgactgtgcctggcgtttttcctttgtaaaaaagaatcaagatatcttgtaggaaacctttctttaacccagcatgtcaaatgtacagaatcctcattaaactgcactgatttgtctccagtagaggcaagaattacagagtccgatttattcagcattgtatccaaacacatcaayagcacagaacatgaagaaaacagtatctgagcccctgtatgctcagttttgttaaggctgagcagctaatcagagggaaggaatgaatggctctcctctagctactggctccagagctccaccatcctgtgatggctccttgtaattttattcatcttttatgtttctgatactgttggggtcaagttcaatgagcctttgatatgaaattgtttctattaagagctgagttcatgccagtgaagaaagagttttgagagtaagggttttatttcttttaaatattcagatgtgaggctg

SEQ ID NO: 48798 - DNA, 601 bp, Human
gagactgatttatcagaagatagctgaagcataaataggtaatgaggctgcctgacttcctgaatggagatgagaaaataggagctggtgccagtgtcagcatagtctgtctttttgtctttgcctctggtttgttggagcagggaccaccttggcagccagggaatcacaagagttccgggcttttagtgccttcagaactggaaatgtagcaaggtaaattcggggaatgcctctcaagagttcatcttatccaaggaaagccgtttttttttttttttttttttttttttttttttgkggcatgtgtagccttcatctaggaattcctgggtagtgagatctacatgatgtaatctctgtcctaggaaaatgcatcccaaaacaagggcaagaaattgtttacatcagttgtgatatggtttggctgtgtccccgcccacatctcatcttgaattgtagttcccgtaatcccaacatgtcatgggagggacctggtgggaggtaattgaatgatggggatggttacctccatgctattctcatgatagtgagtgagttctcacgagatctgatggttttataaggggcttttccctca

SEQ ID NO: 48799 - DNA, 601 bp, Human
gcactttgggaggccgaggcagtcagatcatgaggtcaggagttcgagaccagccttcccagatggtgaaacccgtctctactaaaaatacaaagaattagccaggtatggtggcgtgtgcctgtaatcccagctattcgggaggctgaggcaggagaattgcttgagccctagaggcagaggttgcagtgagctaagatcgcaccactgcactccagcctgagcgacagagtgagactctgtctcaaaaaaaaaaaaaaaaaaaaaaaaaagtatattgaggttctactttgtgacaaastgtgccaaggtgcttacagagatattggccctcaatttagctggaaagactatctgactgaatttctttttcttccttttgtctttctcttactcattccctccttttagaaaaaacttttaaaacttttattattttggttgaactcaacaccaaaatgtaggtagtaaattgtcataagaacatacattttacttttaagaaataatgcaggaatttagtaagtaaatattcagttttgaaagttaaacatattttgtcataaatagtgaaggcaaggggagagagctatttttattg

SEQ ID NO: 48800 - DNA, 601 bp, Human
gaagggggagatgctacacacttttaaacaaccagagctcctgagaactcactcactatcacaagaactgcaaggaggaaagtccacctccatgatgtagtcactgtgcaccaggcctctcctccaacactggggattacaattctacatgtgatttgggtggggatgcaaatcctaaccatatcaccaaagaagtctaatgtggaaccaggattgagaataaccagtttagaagttctttgatgtctttacttccatcttgatcttccataatagatcagtaacatatagcgtgccttgyaatttcctgattgtgctgagctgtttgctgtttttgtgcctttgttgttcctgtttcctggagtgctttcccttacattgtcaatctgaggagcaccaatgcattcctcggtatccctacagttgaaggactgctgttgtattttatacatatacctactgttagacttacactcattttgtaataatttgtttagtaccttcctcttgtgactgtgagtttcctgagtgcaagagccgtatccaactcatctttctttcccagagcctggtatgatcagcactctaaaagtgtcgaatg

SEQ ID NO: 48801 - DNA, 601 bp, Human
ctagttatatactaaggatcttgtattatgtgacctctaggaatctctcaatattattctgtaatacctgaagtacctgtttaatagtttttaaaatcacaattcattcttatgtagtaatttgaaagatggcatttctgcaaaattacgtttttccagtatctctgagaggtattactactttttcatcttcaacttaaagttaataaatattggaatttttccttgacagtaccttagcctgtgtcccccaccaaaggaaattcttggtattatactgattctctcttctcaaacatasctttttccttaaactaaaaaggcagggtctaagagtaactttctgagagccatcctggctcacttcagtggtgttgaataataagcctgataatatagcaactcagtgtagttcatttactttattccttctccaagataaccttaagaagcaaccatattggccgggtgcggtggctcatgcctgtaatcccagcactttgggaggccaaggcgggtggatcacgaggtcaggagatcgagaccatcctggctaacacagtgaaaccctgtctctactcagggatgccctctctcacca

SEQ ID NO: 48802 - DNA, 601 bp, Human
tattggaatttttccttgacagtaccttagcctgtgtcccccaccaaaggaaattcttggtattatactgattctctcttctcaaacatacctttttccttaaactaaaaaggcagggtctaagagtaactttctgagagccatcctggctcacttcagtggtgttgaataataagcctgataatatagcaactcagtgtagttcatttactttattccttctccaagataaccttaagaagcaaccatattggccgggtgcggtggctcatgcctgtaatcccagcactttgggaggccraggcgggtggatcacgaggtcaggagatcgagaccatcctggctaacacagtgaaaccctgtctctactcagggatgccctctctcaccactcctattcaacatagtgttggaagttctggccagggcaatcaggcaggagaaggaaataaagggtattcaattaggaaaagaggaagtcaaattgtccctgtttgcagacgacatgattgtatatctagaaaaccccattgtctcagcccaaaatctccttaagttgttaagcaacttcagcaaagtctcaggatacaaaatcaatgta

SEQ ID NO: 48803 - DNA, 601 bp, Human
aacatacctttttccttaaactaaaaaggcagggtctaagagtaactttctgagagccatcctggctcacttcagtggtgttgaataataagcctgataatatagcaactcagtgtagttcatttactttattccttctccaagataaccttaagaagcaaccatattggccgggtgcggtggctcatgcctgtaatcccagcactttgggaggccaaggcgggtggatcacgaggtcaggagatcgagaccatcctggctaacacagtgaaaccctgtctctactcagggatgccctctstcaccactcctattcaacatagtgttggaagttctggccagggcaatcaggcaggagaaggaaataaagggtattcaattaggaaaagaggaagtcaaattgtccctgtttgcagacgacatgattgtatatctagaaaaccccattgtctcagcccaaaatctccttaagttgttaagcaacttcagcaaagtctcaggatacaaaatcaatgtacaaaaatcacaagcattcttatacaccaataacagacaaacagagagccaaatcatgagtgaactcccattcacaattgcttca

SEQ ID NO: 48804 - DNA, 601 bp, Human
ggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcgtgctgctataaagacacatgcacacgtatgtttattgtggcactattcacaatagcaaagagttggaaccaacccaaatgtccaacaatgatagactggattaagaaaatgtggcacatatacaccatggaatmctatgcagccatgaaaaatgatgagctcatgtcctttgtagggacatggatgaagctggaaaccatcattctcagcaaactatcgtgaggacaaaaaaccaaacaccgcatgttctcactcataggtgggaattgaacaatgagaacacatgaacacaagaaggggaacatcacacaccggggactgttgtggggtaggggtagggggtgggatagcattaggagatatacctaatgctaaatgacgagttaatgggtgcagcacaccaacatggcacatgtatacatatgtaacaaagc

SEQ ID NO: 48805 - DNA, 601 bp, Human
tcgtgctgctataaagacacatgcacacgtatgtttattgtggcactattcacaatagcaaagagttggaaccaacccaaatgtccaacaatgatagactggattaagaaaatgtggcacatatacaccatggaatcctatgcagccatgaaaaatgatgagctcatgtcctttgtagggacatggatgaagctggaaaccatcattctcagcaaactatcgtgaggacaaaaaaccaaacaccgcatgttctcactcataggtgggaattgaacaatgagaacacatgaacacaagaagrggaacatcacacaccggggactgttgtggggtaggggtagggggtgggatagcattaggagatatacctaatgctaaatgacgagttaatgggtgcagcacaccaacatggcacatgtatacatatgtaacaaagctgcacgttgtgcacatgtaccctaaaacttaaagtataataataataaaattaaaaaaaaaaaaagagaaaccttgtctctactaaaaagaaaaaaatacaaaaaaattagccagccgtggtggcgggtgtctgtagtcccagctgctcgggaggctgaggcag

SEQ ID NO: 48806 - DNA, 601 bp, Human
aggaaagtgacattgaatactggtgcaatgaactcattggagctgcttttcaaaatgttcagagacagtgtcagtgatgctgtattagtttcctggtgcttctataacacattagcagaaacttcgttgcctgaaacaacaacaacttattgtcttacaactgtggaggtcagaagcctgaaataggtcttacaaggataagatgaagtattggcagtgctttgctccttttggaggccctaagggagattcattccttgccttttctagtttctagaggctgtctgcattccttggttcytgccctcttcctcttagcactctgatctctacttccaccatcataccttcttctctggttttaaccctgttgccttccacttataaggactcatgtaattagattgagcccatccagataatccaggataatctccccaagtcaaggtccttaacaatatctgcacagtccctttttccatgtgaggtaacatgttcgtaggttctggatattagggtgtaggcatatttaggggtcattattttccctaccgcagattccttctagttattaatgttgttacctggatattacctcctt

SEQ ID NO: 48807 - DNA, 601 bp, Human
ataagataccagatgtaaaatggagctgcaggaaaaagaattataattaatgcagacagtaaataccttgccaagaagaattttaacattacctcaatccaagctgtaatcatgataccaaggtgaataacacgtggcccttgtgtttttcaccacaaatttgcaacattaatatttctgattcaaaggaaattgaggtaagagctttaatagtcctacaataaggatggaggagggagaggttcattttaactgaaacatcatttctggtaagcagaggctcttcccaaaacacagttgytagcactctaggaaactcaaagagctttaggtagagggagtgatgttatccattgacatcacattaaaagcaactctgatggaaagagtgtctttctataagcagttaacttatagctgttcagttgttgttcatttatacatccaggggattgataacaaccttcgaatgaatcaggcaatcagaagatcaactaagtacctggtgctggtcaagtactgaggtcttgatgtgatattgacctgtagtgaggaggagatgaggaggctagacgaggttggaaaggcttcatggaagagg

SEQ ID NO: 48808 - DNA, 601 bp, Human
ctgtttaaatttacattaattcattcaaataaaattaaaaattctgttcttcagttgcattagccacattttaaatgctcaataaccctctctgccttcactccctcatctacttaatacctagtctccttctctgtttcattttaaaaataatacttatcaccatttaatatataggtgaattcttatgacattgccatttttataggtcaaaaaagtttgactaccattattgatgtatggccatctaatatttgatattttgattatttatttggtctatagtctttttcctaccccwgcaatgtaagctctttgagggcagagattttctttgcttcactgatgtatccttaatataggggttaaactccaggctgggagtcatattgactcagaaaccagaggataggattagccaggagacagaggtaagatgactaggagaggaagagtgaaacagcaaaaaagaagataaatgtttgagactagcttctgaaagctgcatgtagatactaggtgtgatttggaaagtcaggttcttaggtctctattttaataactcccttccatccctctttgaaatcattgcccctgttgg

SEQ ID NO: 48809 - DNA, 601 bp, Human
ggataggattagccaggagacagaggtaagatgactaggagaggaagagtgaaacagcaaaaaagaagataaatgtttgagactagcttctgaaagctgcatgtagatactaggtgtgatttggaaagtcaggttcttaggtctctattttaataactcccttccatccctctttgaaatcattgcccctgttggtaatctgtgttttctgcttcctgacatctgtaattccttgacttttaatactcaaacaaagaagggatgtttattcatgtccattctggccaaactgcctcacttrctttggagacatccgagtccaaagactttcttttcctgaaggagacacacatatggtcatacttatcaaagcgtgaagtttagaatactggggttgaagcataatttcttctgagatattggcagaaacctctattgggcatttttctttctatttcaatgcaaatttgcaactacaagacatataaaagattaaataagagcataaatggaggtagcctgggctgagaaacatgcactgtgctcttttttttttttttttttttttttgcctgggatcgatgttaaacataggtggcag

SEQ ID NO: 48810 - DNA, 601 bp, Human
aatacatattttttgattggaatggatggaaaagtatcattacataatgtttcttcttaatgttcagtaaataaaattatctataagtagattatatctataagtagagtttaacctttgagtagtaacttccacaggaggctgataaaaatatggaaaggttaaaaatgaaaagcacagccagtttcttttttgtcaaaattatcaagaaaagggtggggagcagtttttcttcatggggtcgtagttgtgaaatttcactctttaggacagatgtattaacaaaatgaaacatatggcstggtctggccacactagtcctaggctgcattggacctttccagaggtcagcaatgagtcttatattttattgtgaaacattcttcggaaagaagaaagctcaataaagacatgtaactctattatctgagcaattcagtccaatttttttttcttgtacatctcctgttcttgaagaagtggataattaaactgctccaaacaatgcaagatgttgaaaaatgtttcctttcagcagaattctttgatcctttacaacagaggacctgacaaaaaccacacatagtcccccaacaaagaa

SEQ ID NO: 48811 - DNA, 601 bp, Human
ggctgatgatgatgataaaaataaatgatgaggataacattataattaaatgatgatgttatgtgataataatgaataacaatagatatctcactgttattaataaatctgtaactgaatgccttgctgttcaactaaattcattatggtgaatatttgttcccatgtacatttaatacaaagttattgtgtataagacaaatctgtgtttggagtagtttggaatccttatgtttatttcatatatatatatatatacacacacacacacacacacacacacacacacacacacacacacgcatacacaagttttctaagcctctagtaatgctaaaagcttctctagaccctgaagacttagacttgagaagaaaggaaacaaagactttactcttagggaatttgcatctagccagagaaacaaacaatgaacatgttaaataaggtaatttcagagagtgacagtgccatttatagagagtgtctggtgtgaggatgaaaatagcacattcgagaattggttgtccgggacaggccatctctaaggaggtgacatttgaaagtaaggggcccccatgcagagggaacagcaagggtc

SEQ ID NO: 48812 - DNA, 601 bp, Human
ttcactagtgatgcccgctaacatctgccagagtggtttcttgaagaacccacaagcccaaacctatctataggccttgttgtggagggttggtgtcaccaatgggaaagctgactagtcctggaagctttttaagagagaaatctttgataaataatttttttgatgtctattgatgtattcaggttttctacttgtttttgaggccaactttgagaaattatagttttgcaaggaattgtccacaccatggggtgttttacctttatccatatttatctatgtgtgcttctcagaaaaytctaaaatttccccgttcctattcttaaatcctctttccgaatcctatttttatttttggttatcttatcaaatatataaacttctagggacttatttttgagacaggttcttgctctgttgcccagtctggagtgcaatggcgtgatctcggcttactacagcctcaaccccctgggctcaagcaatcctcccatctcagcctcctgagtagctgggactacaggtctgcaccaccacgcccagctaatttttgtgtttttagtggaaacagggtttcaccatgttgcacaggctggtt

SEQ ID NO: 48813 - DNA, 601 bp, Human
gaggcagagcttgcagtgagccgagatcgcaccactgcactccatcctgggcgacagagtgagactccatctcaaaaaaaaaaaaagaatttattttatatttcataaaagtcacccatttcaagtatacaattcagtgattttcagtacctttactgagtggtgcagcaatcaccaaaattcaatttttaaatgcttttcatttttcaacaagattgtttgttgccatttacatgtaaacctcattcctggtcccagcccaatgcaatcactaatctactttctgtctttataaatttgkgttttctggacatttcttataaagggaatcatacactatgtattcttgtatgtggcttcttgacatgtttttgaagttcatccatgctatatgtgtcagttcattccttttattactaaatattattgcattgtattgatatatcacattgtgactatccattcacccgatggtggacatttgggttttttctagtgtttggctattataaataatgttactatgaacaatctgtctgtgtagtctttgcgtgcctatatgttttcatttctcttggatagatacctagaagtggaatgg

SEQ ID NO: 48814 - DNA, 601 bp, Human
caatcaccaaaattcaatttttaaatgcttttcatttttcaacaagattgtttgttgccatttacatgtaaacctcattcctggtcccagcccaatgcaatcactaatctactttctgtctttataaatttgtgttttctggacatttcttataaagggaatcatacactatgtattcttgtatgtggcttcttgacatgtttttgaagttcatccatgctatatgtgtcagttcattccttttattactaaatattattgcattgtattgatatatcacattgtgactatccattcaccygatggtggacatttgggttttttctagtgtttggctattataaataatgttactatgaacaatctgtctgtgtagtctttgcgtgcctatatgttttcatttctcttggatagatacctagaagtggaatggttggatcatatggtagtttcatgctttgagaaatgctaagctattttccaaagtaggcttttgatttttttaaatggtgctataacagctgtttttctataaattctattttgcaggagggatgatgtcaagtataaatagttactaaggcttcaggttttcagtttc

SEQ ID NO: 48815 - DNA, 601 bp, Human
caaagtgctgggattacaggcgtgagccaccacgcctggccccaggtgtcaaatcattgaactttcttaaattatctagcagtgatagtggtacagcccaaccacagggaactttgccaggtttgacacattgggttcccagacatatttaatgtaatttgtttatgatatggctgttaaactattggatgaacaaaatctttgcaagataaaagattccatttgaataattggaaacttgttctctaatagttatatttgttttacagtaaggactatgttttagagtgaggtataaggygcgtgcttactcctggtgataccatctgcacagagctggcttaattactttgtctctgaaatatttatctcagtatgtctgtatatcaatctgttacttcacactctgaatatatgtatattttcctgtgtttcacctgttggcatatcttcttagctaatgagtgtgtggcagattgtactgtatacccttgtcctgtgagtgttaactataaccattctcagacagggactgtagctaccttattctcagttgactcctttattattttgtctataataaaattaaacagttttgacc

SEQ ID NO: 48816 - DNA, 601 bp, Human
tcttttttttttgagatagagtcttgctctgtagcccaggctggagggcagtggtgccatctcagctcactgcaacctctgcctcccaggttcaattgattctcatgcctcagtctcccgagtagctgggattacaggcgcctgccaccatatccaactaatttttttgtatttttagtagagacggagttttgccatgttgtcaggctggtctcaaaatcctgacctcaagtgatccatttgccttggcctcccaaagtgctgggattgcagacgtgagccaccacacccagcctttctmcctcttttaaaataattgaatgtagaatggacttgtggatttttatttatgtgatattcacactcaatttcaatcatttttctttgtgatattcaaatctttctaaagttggtttatagaagcccttttgatttctgtgtttttttgacatgaccctattaatctttaagtgcttctttgtattctgggacaggaagagagccttttgctttctgggacaatcagattgactttttattatatcttagaattgatttctagttttttatggtgactagtttatagactaatctttgtctt

SEQ ID NO: 48817 - DNA, 601 bp, Human
ccctactcaaagagttatttgagcccatgaattcatatttacatgacttctcagagagattccacatattcaagcaacaatcatttagagaaaaaacaaaatcagcttattaataaataataaaattgtttataatcaataataataatcatgaaagtgtctgaatttcctgatataaagaatacactaaaaaccctctttttacaaaaattatattgtggctttgtgttaattgaagtctctttcacattgtgaaaatagttactgtcattccttttttttttttttgagacggagtctygctctgtcgcccaggctggagtgcagtggtgtgatctcagctcactgcaagctccgcctcctggttcacgccattctcctgcctcagcctcgtgagtagctgggactacaggcgcccgccaccacgcccggctaattttttatattttttagtagacacggggtttcaccatgttagccaggatggtctcgatctcctgacctcgtgatccgcccgcctcggcctcccaaagtgctgggattacaggcgtgagccaccgcgcccggcctagttactgtcattctttagccaaactttgac

SEQ ID NO: 48818 - DNA, 601 bp, Human
gcaaaaatgatattgggaatctcagtgcctggatggagtggcataggattttctttcatgaacaccgttgattgctgctgggcagtgtctagaaggactttccttttgatatccctttccaaagctaacacaggccataaattagcctgcaaacccaaggacatcttaccttttgtgacaggttatcccagccatgcaaagttagtttccaccatgtcttcctcatttaactgttttcctagcctagtggtttcaatcctggctacacattataataacctggggaattttaaaaactackaatacctgggtcccttcctactcccatagaccaaatggtgcagtggttttccagagtggtccctgggaccagcggcatcatcgtgggaaacttgttagaaatgcacattcaaggttctcacccagacctactgaatcagaatcgctgatggatgtgacctaaaaaactgtgcttttagaagctctctgggttatttggttcaaatttgagaaccactgatctaatgtttttctgcatgacattcacctgctatagttttttctcactatcttgatgtagtccaaacctcaaccctgcacc

SEQ ID NO: 48819 - DNA, 601 bp, Human
tgcttctaagggcttgtattagtcagggacaggactaataggatagatgtatatatgaaagagagtttattaaggagtattgactcacacaatcataaggtgaagtcccatagtaggccatctgcaagctgaggagcaaggaagccagtgccagtcccaaaacctcaaaagtagggaagctgacagtgcagccgtcagtctatggctgaaggcctgagagcccctggcaaaccactggtgtatgtccaagggtccaaaagctgaagaacttggagtttgatgtttgaaggcaggaagcatycagcacaggaggaagatagaggccggaagacttagccagtctagtcctttcaggttccactgcttgcttttatcctaggcacacttgcagctgattagatggtgcccacccagattgagggtgggtctgcctctcccggtccactgactcaaatgttaatatcctttggcaacacccttacagacacacccaggaacaacactttgcatccttcaatccaatcaagttgacactcaatatcacagggctcatgggattacattagaccccttcagacaatgcaggagaatatcccgattt

SEQ ID NO: 48820 - DNA, 601 bp, Human
aggccggaagacttagccagtctagtcctttcaggttccactgcttgcttttatcctaggcacacttgcagctgattagatggtgcccacccagattgagggtgggtctgcctctcccggtccactgactcaaatgttaatatcctttggcaacacccttacagacacacccaggaacaacactttgcatccttcaatccaatcaagttgacactcaatatcacagggctcatgggattacattagaccccttcagacaatgcaggagaatatcccgatttatctatttatttttttgagrcagggtcttgctctgttgctcaaggtagagtgcagtggaacaatctcagctcactgcaacctccgcctcccaggtgcaggtgattctcctgcctcagcctcccgagtagctgcgactacaggtgcacgccacaatgcctggctaatttttgtgtttttagtagaggccgggtttcactatgttggccaggctggtctcgaactcttgaccttgtaatctgcccacgttggcctcccaaagtgctgggattacaggtgtgagccaccacgccctgccgagagtctccctattttaaagtca

SEQ ID NO: 48821 - DNA, 601 bp, Human
gctttctctattcatcgaagaatggtggcagatctgggatttcaactctaatcttctgtgtcaccctaaaaacacccagatagttgtttttaatacataattacagatttacaagtaccttttgaaatatttgcaacattttaaaacttagaggggaaacttacgatgcttattctgttatcagaattgatttggatttatgatatcagttatacgggattaaaattttccattatttcaggatcttttaaaaaattatttaaaccttaagattagattctcaattgaatattttatcctyggataaattctttattaaaaattatttgccagcttggtgcagtggcacatacttgtagttccagctatttgagaggctgaggtcgaaggagacttgagaccaggagctccaggctgtagtgttccataattgcacctgtgaattagacattgtgctccagcctgggcaatatagtgagagcacatctctaaaaaaaaaaaaaaaaattatttgccataaaattccatctctcaaaatgacagagtttaccaatatgacattcattattaaatgctggaaataatatattttccaatagtg

SEQ ID NO: 48822 - DNA, 601 bp, Human
gtaatttactagttacataaccatggccatgctgtgtcatctctctggaggtcagggtttttttttactttaaaatggcaaatgttcttgttctgcttgacctggcagagttgttgcaaaagcctaatgttataaactttgccaagtagtcaaatatgatgcatatcatttgggaatctttcagttgcaaataacaaaaatttaactcaaatttgcaaaagaaaaaggaatttattgacttgtgacggaaatccagcgtagttctggtttttggtctctaggactctgttgctctctatcyttagtttctagctcaatgtgtctggctaggataccttcaagcatcatttcagtagggaggactgcccgcctctgtcctagtgtatcactgagtctcactgtctggaaccagcttcgagtgaatcacaggcccattcctgtggcatcctaaccaggaaatatggcatggcccttggctgagactgggtgcacgcacactgggagctgggtgtggaatccatccctcccaaaccatgtgagctgaatgtgagggaggggtgatttcccctttaccagcatcagggaatacgatgccacaaga

SEQ ID NO: 48823 - DNA, 601 bp, Human
aaaatttaactcaaatttgcaaaagaaaaaggaatttattgacttgtgacggaaatccagcgtagttctggtttttggtctctaggactctgttgctctctatctttagtttctagctcaatgtgtctggctaggataccttcaagcatcatttcagtagggaggactgcccgcctctgtcctagtgtatcactgagtctcactgtctggaaccagcttcgagtgaatcacaggcccattcctgtggcatcctaaccaggaaatatggcatggcccttggctgagactgggtgcacgcacrctgggagctgggtgtggaatccatccctcccaaaccatgtgagctgaatgtgagggaggggtgatttcccctttaccagcatcagggaatacgatgccacaagaacagctgatcactaaacaagatactgttatttctttctctgtgacaaaaatgtttaatggcttaaaaggaaagaataaataatagttggtgggcattcataaagtaaagaaagaatcatatttcaaagggagattatatttaataagccagagaggaaaaagaccagaaatttaatgaggacagatcagtacaagg

SEQ ID NO: 48824 - DNA, 601 bp, Human
atgaactggcttgttactggttacttgcacctggtggaaaagtacactcaaggcctgactctgcagaacagttaggaggatctcaaaagaaagatatttaaaaagacctgaaaatctaaatggatctttaaccatgtaagcagaagcgtcagtagctggagccttcttggggatttgaagtcctgggaagctgacttcctttcttgggagtactgctgcattgcctgcactaagaggcttcttcaggcagtggagacctgtaaccattttcctgtaatttggtacctgttagtctatcagmtcagtgacaaatgcccacatgttaaaagctctgagaactcctaagatgaagaaacttgcttaatgcagcatttcataaacttccttggtcatttgcttttagcatcttttggaccatagttaggggaataaggctcaagatatgaccagggtcagattattacctttgagggccaaagtactgaagagagaatggtggctttgccaaatgtaactcaaaataatagaacactacattataaactaagttaaagaagtctcacaaggttctaattttctaaatgatgaaagcacttagcat

SEQ ID NO: 48825 - DNA, 601 bp, Human
tcattctcagtaaactatcgcaaggacaaaaaaccaaacaccacatgttctcactcatagatgggaattgaacaatgagaacacatggacacaggaaggggaacatcacactctggggactgttgtggggtgggggtagggggtatagcattaggagatatacctaatgctaaatgacgagttaatgggtgcagcacaccagcatggcacatgtatacatatgtaactaacctgcacattgtgcacatgtaccctaaaacttaaagtataataataataataataataaaaagaaaaaaaagaaaaaaaaagaaatatcactgtctatactgagaatatagagatccaaactttccagttagcatggttgtttcaaatttattttcaattattgatagttcagaaaaatttatttcagcttttcaccctgttattagtaatgcaaattttgtggattttagtcaaatttgggaaaacctctgtcatagtgcagtctaagattttatggcatttcaagttttgaggggacagtgaatgatcttaaatactctgaattaatgacccccatgacacagtttgttatcactgtcctcattcatta

SEQ ID NO: 48826 - DNA, 601 bp, Human
agaaatatcactgtctatactgagaatatagagatccaaactttccagttagcatggttgtttcaaatttattttcaattattgatagttcagaaaaatttatttcagcttttcaccctgttattagtaatgcaaattttgtggattttagtcaaatttgggaaaacctctgtcatagtgcagtctaagattttatggcatttcaagttttgaggggacagtgaatgatcttaaatactctgaattaatgacccccatgacacagtttgttatcactgtcctcattcattaggataccaasagttttgcattagcttcattgatgtcagtatttcacaagtcagtcagaaatttaaattttctggtatgctcgtatgattaacttctcttcataattagattgttaaacaacccaagagcttattcattaatttcaattggttacgtggccattttttgtcacttttgtttcatagttcattaattttttgtctgaattattttattttagttgtttaatgaattttttccaaaattacaaaagaagtagtctttgctgtatatagaaatcaggcatcataatttttcactaatttttttg

SEQ ID NO: 48827 - DNA, 601 bp, Human
gttgtttatgaatttgctttaagactttttttgcaggtgatggacacccgcttttaactagttatggctttggtagaaagaatttactggctcgggtaacaaaccactggaaggtaagcaggttggaagtagcctaaaggtcgcctggatttatatattcgaacagtgtcatatctgttaatctgtttctttcttttcccatctctctttttctatgttagttttattctctactcctgaaaaaggcctttttcttaaaaaatgattgcaggcagtgtggggttctatagtctgaaaggcytaaaggaacttcttttccagctcctagtgggaacacccttggaatgactctggccagcttgggtgatgtgcccacctcaacttttccgtgtctctccatgagtctagcaagtgatagaacattgtgattggcatgtggtgggttggaatagaagagcaggtcccccagaaaagcagggtgtcattttggtaagtcaaaaccataattgtccactgtagtagctgaggccaaggcttggtgtggaggtggcatggaagtcatcaactgatgaaacctactgtgtggggtgccactcctcgt

SEQ ID NO: 48828 - DNA, 601 bp, Human
gtggcagtttgccctgtgactctgttctctgataggttcaagaaaagtcattgatttttagtttgctcagctttttttccttgtgaaaatgagggtaatgacttctaagctccttacatgctggaacagaaactggaaaactttatattttcaatagattatattttttctgaactttcttattaattttcattttttgtcacagagtcttgctgtgtcacccaggctggagtgcagtgatacagtcatagctaactgcagcctcaaagtcctgggctcaagggatcttcccgcatcagcytcctgagtagctaggattacaggtacacagcaccatgcctggctaaattttttatttttattttatgtagtcagggtcttgctctgttgctcaagctggtctcaaactcttggcctcaagtgatccatgccttgcctcccaaagtgttgggattacaggcgtgagccaccatgcctggccatttcttgaaccttctgaatgttatatggaaatgagtgattttcactgatgttagtatgttcatactcataggaaaagtgtttcccacactcatgtttcaactttactagagtgtaaggt

SEQ ID NO: 48829 - DNA, 601 bp, Human
tattttttctgaactttcttattaattttcattttttgtcacagagtcttgctgtgtcacccaggctggagtgcagtgatacagtcatagctaactgcagcctcaaagtcctgggctcaagggatcttcccgcatcagcctcctgagtagctaggattacaggtacacagcaccatgcctggctaaattttttatttttattttatgtagtcagggtcttgctctgttgctcaagctggtctcaaactcttggcctcaagtgatccatgccttgcctcccaaagtgttgggattacaggcrtgagccaccatgcctggccatttcttgaaccttctgaatgttatatggaaatgagtgattttcactgatgttagtatgttcatactcataggaaaagtgtttcccacactcatgtttcaactttactagagtgtaaggttgatgatgagagcgatttgtctcgattctttacccaaatgacgtgaattataggtactcaaaaatattcatggaaaggataaatattagttgtatctgagtaccactatcttttttcttgaaattaattcccttttaaaatcttaaatacctactaccctc

SEQ ID NO: 48830 - DNA, 601 bp, Human
gtaggtgaggaagttttttcagcaggcacattgtcaagaagttatatacttttgactgggtgaagtggctcatacctgtaatcccagcactttgggaggctgaggcgagtagagcacctgaggtcaggaatttgacactaacctagccaacatggcaaaaacccgtctctactaaaaatacaaaaattagtcaggggtggtggcagacacctgtaatcccagctactcaggaggctgaagcaggaggtaaaaaagaaaaaaaagttatatactttctggcaacactgggccctctaagaayttgccacatcaaactgagaagttgctttgagagctttctggcagaaggagcttttgcagaggtcacgtttaccaagtcatcattccattgagatatgtggtattctagtgattcccaaatgctgatcctcagattggctgcagcagaatcacttggataactttcgaagaaatgattcctaagctaagtcccacccacagagattctgagtagatctggtggaggaagcctgggaatccacaggtttgtagaactctccaggtgattctgctacagagccatgacgccgtatgctctagt

SEQ ID NO: 48831 - DNA, 601 bp, Human
ctcatacctgtaatcccagcactttgggaggctgaggcgagtagagcacctgaggtcaggaatttgacactaacctagccaacatggcaaaaacccgtctctactaaaaatacaaaaattagtcaggggtggtggcagacacctgtaatcccagctactcaggaggctgaagcaggaggtaaaaaagaaaaaaaagttatatactttctggcaacactgggccctctaagaatttgccacatcaaactgagaagttgctttgagagctttctggcagaaggagcttttgcagaggtcacgyttaccaagtcatcattccattgagatatgtggtattctagtgattcccaaatgctgatcctcagattggctgcagcagaatcacttggataactttcgaagaaatgattcctaagctaagtcccacccacagagattctgagtagatctggtggaggaagcctgggaatccacaggtttgtagaactctccaggtgattctgctacagagccatgacgccgtatgctctagtctatgcagtgatcattgatacagggtagaactttaagagttcaacatacactgacatttcttctcatc

SEQ ID NO: 48832 - DNA, 601 bp, Human
aaaattaaaaataaaaaaatacaaatttacagctagataagaggaataagttctagtgctttatagcaccgtagggtgaatatatttaacgataatttattgtatattttgaaaaatccaaagaagaggattttgaatgttcccaacacaaagaaatggcaaatgtttaaggtgatggatatgttaattacctgatttgatcattacacattgtatacatatcagaatgtcactgcatcccataaatatgtataattattatgcgtcaactaaaaataaaaggacaaaagtactatgctgygtcagtaacttaaaatacttaaaataagttaccttaaatacttactctctctgaatagttttattatcaatttgctatatatgtaggtttattcattttagtttgttttcacctagggctggcactttttctttttgattaaatttaattcttgaaatatatgaggcatatgcatgtccaaaatgatataaaatatataaagtatgtactcagaagttttatttacttctattccttccacctagtttctacgtccatctcctgtataagtaaccatttttattaatttctagcttttcc

SEQ ID NO: 48833 - DNA, 601 bp, Human
cactttgggaggccaaggcaggtggatcacctgaggtcaggagtttgagaccagcttggccaacacggtaaaaccctgtgtctacttaaaaattacaaaaattagctgggggttgtggtgcgcacctgtaatcccagttactcaggaggctgaggcaggagaatcacctgaacctgggaggcggaggttgcagtgagccgaggttgtgccatttcacttcagcctgggcgacagagcgtgactctatctcaaaaaatatgtgtgtgtgtgtgtgtgtgtgtgtgtgtgtgtgtgtgtgtgtagatgtatttcttaaaaataaaaagattaaacctcaaatgataaaaaactacattagtgttctgtcatcttccataatatagatgaaaatggtcaagttcctgaacctttatgggagctcacaaaaatagtgaaagccatctcttaggtggatagcaatttttttctgggtaatagcaatgattaaacagaatgggctttgctgatatacctgtgacctactgcattctcatgaatattggtatcgtggtgttaatgcgcaggcattgagtattagtcatggcaagggacaaatatgtgt

SEQ ID NO: 48834 - DNA, 601 bp, Human
gattgtttcaattggattttaccaagagaacagtgtttagtttaagtaataggaaagaggatttgggttaatgaaaaaaggtgcataccattctgtttttctagagaaaattgtctggaaattttatgatctgttttggtgtatgaaatttaatttttttcatatcagtaagtagagttcgtgaattaaactactacactcatatttaagacttcctctgatttcatcataaaattattcttttacataggatgattttaaatgtttgccatagtttttattccggctttatatttatatwctctgtcttctggccaaatatttttctgagaaaaaaactataactttatattaaccatcactaggtaagttcaataaatgatattgtagcagcatttaaaagatttttcttttctctttcaaaaggcacacacaaactattgaaactattagtggagcaatataactcttgctgcactttgtaaaacattgctagactagattagatacatcgattcattacttttacttatttcacttttcttttgcttaggactctttgtttataagtatctgaaacctgacttaaccaaaataatga

SEQ ID NO: 48835 - DNA, 601 bp, Human
actaggtaagttcaataaatgatattgtagcagcatttaaaagatttttcttttctctttcaaaaggcacacacaaactattgaaactattagtggagcaatataactcttgctgcactttgtaaaacattgctagactagattagatacatcgattcattacttttacttatttcacttttcttttgcttaggactctttgtttataagtatctgaaacctgacttaaccaaaataatgaatttactgatttttgttttctggttgtttcgtggtcttctcttcattcttttcttccttygttttaatgaaagattgtttagatggattatattcagaacaatggaagtggaactggcctcaggtatgcctgaatctaggatctcagttatatcagatctctttatatttatttattgatattgtttttaatttctgggtacatagtaggtgtatatattcaaggattatatgaaatactttgatacaggcatacaatgtgtaataaccatatcagggtaaatgggatatctgtcacctcaagcatttatcctttgtgttacaaacaatccaattatagtcttttatttatttatttaga

SEQ ID NO: 48836 - DNA, 601 bp, Human
atgtatattcttggcacctttgttgaaaataagttcgttgtagatgtatggatttgtttcttggttctctatttttttacattggtctatttgtctgtttttatgccagtaccatgctgttttggttactatagctctgaagaatattttgaagacaggtaatatgatttcttcagttttgttctttttactcaacataattttggctattcagggtcttttgtggttccacataaattttaggattgtttttactatttctgtgaagaatgtcattggtatttagtaaggattgcattgwatctgtatattgctttgggtattatggtcattttaacaatatcttttcattttttgtgtgtgtgtcctcttcaatttctttgacaaatgttttatactttttattgtagagatctttagtttctttggttaattcctagctatttaattttataagtatctactataaattggattactttcttgattcctttttcagtaattgctgttagcatgtgtgttagcacagactggataatttataaagaaaagagggttcattggcacatggttccacaaactgtacagaagcatggcatca

SEQ ID NO: 48837 - DNA, 601 bp, Human
tatttcttaatatatctgggtgcaccaatgttgagtgtgtgtatatatatatatacacatatgtatatattttaattgttatgtattcttgctgaattgacccttttctcattatataatgaccttctttgtctcttttgtagtgtttgtcttgaaatctattttgtctgacataagtatagctactcctgctcacttgtagtttgtatttgcatggaatatctttttccatccttttattttcagtctatgtgtgtccttataggtgaagtatatgtcttatagacaatagaacgtggastcttgtttttttatccattaagccactcaatgccattttaatttttttaattttattttttgtggatacatagtcagtatatatatttgttgggtatatgagatgtttcattctctgtcttgattggagagttcagtccatttaaattcaatgttattattgataaataagggcttatttctgttattttaaaatttgttttctggttgttttatggtcttttcttcctttctgtcttctttttaatcactgtgattttctctggtggtaggctttgatttcttgctttttattttttgt

SEQ ID NO: 48838 - DNA, 601 bp, Human
ctgtgtctccacccaaatctcatgttgaattgtaattcctaattttggaggtggtacatggtgggaggttattggattgtgtggctggtttctaatggttagcatcatccacctagtgctgtcttgtgatagaggtctcatgagatctcgttgtttgaaagtgtgtagcacctccctctttgctctctctctctcatgccagccaagtgaaaatgtgcttgtttcccctttgccttccgccatgattgtaaatttcctcaggcctccccagaagcagaagcctgtgcagcctgcagaaccrtgaactgattaaacttcttctctcggccgggcacggtggctcatgcctgtaatcccagcactttgggaggccaaggtgggcggatcacaaggtcaggagattgagaccatcctggctaacacagtgaaaccccatctctactaaaaatacaaaaaattagccgggcgtggtggcgggcacctgtagtcccagctactcaggaggctgaggcaggagaatggcgtgaacctgggaggcggagcttgcagtgaaccaagatcgcgccactgcactccagcctgggcgacagagcaagactcc

SEQ ID NO: 48839 - DNA, 601 bp, Human
atacctgaaaatgtggaagcagctttaaaactgggtagtgggcagaggatggagcagtttgaaggttcagaagaagagaggaagatgagagaaagtttggaaattcctagagacttgttaaattgttgtgaccaaaatgctgatagtgatatggacaatgaagttcaggtttaagtggtctcagatggagttgaggaacttattggggactggagtaaaggtcactcttgctttgctttagcagagactggtggcactatgcccctgctctagggatcagttgaactttgaacttgaaagwgatgatttagggtatctggtggacaaaatttctaagtagcaaagcattcaagatgtggcttcttcttaccatgtatgctcagatgtgtgaacaaagagattatctgaacctggaacttatatttaaaagggaagcagagcatgcctggaaggtgtttcagagaccttcatggcagcccctcccatcacaggcctggaggcctggaagggaagaatgattttatgggccaggcccagggtcccactgccctgcacaacctcaggacactgctccctctgtcccagccactccagctccagc

SEQ ID NO: 48840 - DNA, 601 bp, Human
ccattgtgttttggaagtgactatcttgtttttgattttacaggctcataggtggaaaggacctgccttgtctcagatgtgactttggacttggacttttgagttaatgctggaatgagttaagactttgggagactgttaggaagtcattactgtgttttgaaatgtgaaaaggacatgagattcggtgggggaggcaggggcagaacgatatggcttggctctgtattttcacccaaatcttatgttgaattataattcccagtgttggaggtgcggtctggtgggaggtgattggatygtaatggtttaacaccatccctttagggctgtctcatgatacagttctcacaaaatctggttgtttgtaagtgtgtaacaccaccccctttgctccctgtctctctcttgctagccatatgaagatgtgcttatttctcttttgcttttcatcatggttgtgaattttctgaggccttcccagaagtagaagcctgtacaccctgcagaactgtgagccgatccaacctcttttctacataaattacccattctcaggtagttctttatagcagtgtgagaatggactaatacatttggt

SEQ ID NO: 48841 - DNA, 601 bp, Human
ttttgaaatgtgaaaaggacatgagattcggtgggggaggcaggggcagaacgatatggcttggctctgtattttcacccaaatcttatgttgaattataattcccagtgttggaggtgcggtctggtgggaggtgattggattgtaatggtttaacaccatccctttagggctgtctcatgatacagttctcacaaaatctggttgtttgtaagtgtgtaacaccaccccctttgctccctgtctctctcttgctagccatatgaagatgtgcttatttctcttttgcttttcatcatgrttgtgaattttctgaggccttcccagaagtagaagcctgtacaccctgcagaactgtgagccgatccaacctcttttctacataaattacccattctcaggtagttctttatagcagtgtgagaatggactaatacatttggttaagtcatgtttttctggtcttgctggtcttgatgcttatggatgttcattggtttctgggtgtggaagagttaggtatttactgtagtcttcatagtctgggcttctttgtacctgtctttgggaaggctttccaggtgtatgaagcttgggtgtt

SEQ ID NO: 48842 - DNA, 601 bp, Human
ttagaatgttttggcttatggttgtcagacatattcactgccttatgaactacaaaatccctggatttaaacttagactggagcatccaaatataagcacgctctaaaaaaaaagtcacataaacagaatgatacatctctgctattcttttttttttttttttcttttgagacggagtttcgctctgtcgcccaggctggagtgcagtggtgcgatctcgactcactgcaagctccgcctcccgggttcacgccattctcctgcctcagcctcccgtgtagctgggactacaggcgcgcrccaccatgcccggctaatttttgtatttttagtagagacggggtttcaccgtgttagccaggatggtctcgatctcctgacctcgtgatccgcccgtctcggcctcccaaagtgctgggattacaggcatctctgctattctacatagtaactgaataatagatatttcttcttcttcttcttttttttttttttagacagagtctcgctctgttgcccaggcgggagcacagtggtgccatcactgcttaatgtagcctcgaccttctgggctcaagcaatcctcccacctcagcctct

SEQ ID NO: 48843 - DNA, 601 bp, Human
cgagattgcaccactgcactccagcctgggcaacagggcaacagagcgagattctgtctcaaaaaaaaaaaaaaaatatatatatatatatatatacatttcatgtacggtggctataatctgaacctgattttgtttctatatctttccaaatattaaggattccaaggacagggacagataatataattatggttgaaatgtttttcattcatgtttgcatgtgtgtgtgtgtgtgtctgtgtgtctgtgtgtctgtgtttagtatgaccagtggtgattactgtttggcatttattaygtatctaaaaagagaaagaatgagccacttttctttttctcactatcttgtttctatctgtgttattctactgaatatactctcgccactttaccagtaacatactagtcttcaaacttaatgaccgtttttgtccttggattctctgtaggtacttgaaaaggctgattctctcatcctcaaaactcttaatagtaattcttccttccttttctccagcttctttttagcacatcttccctctctaaatgtagacatatccaagcctgagtcagtgtccttttcactctcccactcatc

SEQ ID NO: 48844 - DNA, 601 bp, Human
taatgactgctaactagcagatttcaagctcttgggaaatccctaacatctctgagtctcacttttctcacttgtaaaatggggagttagaatatttcttatctcaaattgaagtccatgtagggtaaataacttgtccagagtctaacatcttttctcatttggaatagaactttaccctgtacactgtttctttttttttcttttctgttttttgttttttgtttgtttgtttgtttttgagatggagtttcactcttttactcttgttgcccaggctggagtgcagtggcacaatctyggctcactgcaacctccgcttcccggattcaagcaattctcctgcctcagcctcccgagtagctgggattacaggcatgcaccaccacgcccggctaattttgcatttttagtagagacagggtttctccatgttggtcaggctggtcttgaactcccaacctcaggtatctgcccgccttggcctcccaaagtgctgggattacagacgtgagcaagtgcacccggcctaccgtgtacattatttcatgtgtcatttggataactatagtttggggtgaaagggatgatttttaccttg

SEQ ID NO: 48845 - DNA, 601 bp, Human
tcccggccggacgcggtggctcacgcctgtaatcccagcactttgggagaccgagtcgggcagatcatgaggtcaggagatcgagaccatcctggctaacaaggtgaaaccccgtctctactaaaaatgcaaaaaaaaaaaaaaaaaattagcctggcgtggtggcgggcacctgtagtcccagctaccagggaggcagaggcaggagaacccgggaggcgtaacttgcagtcagcggagatcacgccactgcactccatcctgggtgacagagcgaaactgcgtctgaaaaaaaaaaaarttcccagatgctgctatttgattagattatcatattttgcatacttttagaatctttagcaaacataacctaaaatcaaagtacacagtacacatatcacaaaatttgtgataatttttggctgtttttccaaacagattgaagctgcacgtgatagtttccttgtttatctctattgttccttccacacacccatgtgacatttattttctttgtggttgactgagaaaaaaagttaactttcccatgtccttccccggtcagctatcctgtttgccttaaattctattgctcttcact

SEQ ID NO: 48846 - DNA, 601 bp, Human
tgggcaacatagcaagacaccctctccgctaaaaaaaaaaaaatttagctgggcatcatagtatgcatgcctgtagtcccagctacttgggaggccgaggtgggagggtcacttgagcctgggagtttgaggctgcagcaagccatgattgcaccactgcactctagccaggggaacagagcaagtatctctctctcaaaataataataataaaaagacttaaagagaagaggaaatgctcagaggcattcttagagatttcaggataactcaaaaaagaaagaaagaaagaaggaaggargaaaggaaggaaggaaggaaagaaagaaagaaagaaagaaagaaagaaagaaagaaagaaagaaagaaaaaagaccaagtaaaaaagatatcttcacttagcaaaatatcttagagctaattccatactaatacatgtagaaatgtttcattctttttaagggctacatagtatataccatttgatggatttaccataatttactaaatattcctctgttaaggctcattaagtttgtttacagttttttattattacaaatggtgctgtgggctgggcatggtggtttatgcctgtaat

SEQ ID NO: 48847 - DNA, 601 bp, Human
tactcgggaggctgaggcaggagaatcacttgaaccagggaggtgaaggttgcagagagccaagatcatgctactgcacttcagcctgagcgacagagcgagactccatctcaaaaacaaaaacaagtggtgctgtgatgtcatgtacacatgtttttatatgtgtattatattacacatataggattatatctataggataaattccagaaatgaaattgctgagtcaaagggaatacataatttatattctcaccagaaacatatgaaagttcctttctcataccctgtttccatcacwtgcaacattgctctagctgtttttggcttccccgtagggccctgaggtgatgttctcccatacttctctcagtttttctgttgttattatattattagaaagctctgcctattatgtgcctgttccaccacagctccctccatcccaccagtctgttttccttcaagactcagatctatcatacattcatcttagaaacatccttgctccataatcaccattctgttcccttcccctagaactttccaggcctgattaggtgccctcctgtgtgtgtgtgtgtgtgtgtgtgtgtgtgtg

SEQ ID NO: 48848 - DNA, 601 bp, Human
tttatagcaaacagagatgtctgtttaaatattcttaataggataacagattattaaggaaacaaacagaattacagactttttagaagttatacttaccttcataggacataacaacatattttcatgtctgaattgtgggaaagggtctactgttggaaataatgttcacaaagactgttctgttacatagattagtacttgctttcctgatgatctaaaagaaaggatgttttcttttcatcttgatggccttcctttcaccagtagttggaagggcctgtagtgttaaagctaactrttgcacttccactaagtagaaaaaaagcaggcctgaaaagcataaagcttataatgtgaaatgaaaatgtcagaaaaagaattttaatcaatggaatatagaacatatactgtgttgcctctagtgcttgaattttcctaaggagcagttagaagcccagctaagtttcagtaaccagggatatgcttcttcctttcctggcagaagtaggaggttctctttctggagaaacaacccacgtttctggattgtgggcatagtcagctgagggcaagtgatatactgaaaacaggagggtgt

SEQ ID NO: 48849 - DNA, 601 bp, Human
tgtgttccctggtaccttggcttttttttttttttaaattatactttaagttttagggtacatgtgcacaatgtgcaggttagttacatatgtatacatgtgccatgctggtgtgctgcacccattaactcgtcattcagcattaggtatatctcctaatgctaaccctccctcctccccccaccccacaacagtccccgagtaccttggcttttaaagtggtattgagccacaatgatcagatatgccaacaggccattatatgttaatagaattttactagcatatttgtagactgttwatttgattaaactttcatgtcttggtaacttttctttatagcagaataaacgtagaagattctgatttggtaggcctgacggtgtctaggcatttttttaaaaaatctgattctgctgcaaagccggcttggaaaactttgctttattaggaacaggattctataaataagagctaacattcatgatagtggcaggctcagcttttacttgatcacatttattgtaagtgccctagtcctagcatacacatttaaagctccctgataattttcatcagattgtgacttcctcaatagaag

SEQ ID NO: 48850 - DNA, 601 bp, Human
gaggattctctagtatatcaaaaggatctggagggttggtgcatggctagagaaactaagaaaataaagatgatgaaatggaggtgttggggagggattcagagaatggagagaatgggaagaatgttttctttaaaaaacctttccaagctcataatttgttattcctcttaaatgaaataatgaaatttggatccttaaagcttccattttttccagttctcttcttctggagaggttttcatagtttaaagaccttatgaaatctttgattttcgattgtgaactatgatctgtgggyttcttttattttcactggttggattataatcatatttgaagtcttatgattcttttatattggtccaaagaaagttacatttaatatttggtgactgctctaaggaaaacatagtaatttggggcagcataacaatcactgaatgttagaacaagaaggcatagcttgttacagtatattataatctttacagtgtatattgttttgcacaattctgtaggtcaactgggcagatatgctttatgtagtgtcagctgggatgctattatatctggaagatgcaaacttgcctcaatcacg

SEQ ID NO: 48851 - DNA, 601 bp, Human
tttgacaactgtgatcctacaccagcctatgaccattcaagatgttctatttcttggagtcagactttgattagtagaaggagttttactgtgattgaggtttggtcaagcaagtacagtggaaagaggggtaaattagtttagagtgtgtgaagggaggtgatttatcaggacagatcatggaagataaactggattaagtagacaagaaggtgaggagagtgaaaaagtggtagataggctcaatggttttaagttccaaaacagtgagatagagttctagagaaagatgaatagatakgagatggtgaatagggtatgtgaatgattgaaatcaggatatgggatgcatttcatctatgttctggtttaataccataccagctttatgaagtgattttttttttttttttttttttagtgtctccattttaaacagaagcaaattatgttgatcaagattaagcagcttggccaagggtacacaattagtaaatggcagagcttggatggaaaattaaaatatttgtttttgtttttaactcccaaacctttgtataatactgtacgagctgtctctgattcatgacagttgcccact

SEQ ID NO: 48852 - DNA, 601 bp, Human
agtgagatagagttctagagaaagatgaatagatatgagatggtgaatagggtatgtgaatgattgaaatcaggatatgggatgcatttcatctatgttctggtttaataccataccagctttatgaagtgattttttttttttttttttttttagtgtctccattttaaacagaagcaaattatgttgatcaagattaagcagcttggccaagggtacacaattagtaaatggcagagcttggatggaaaattaaaatatttgtttttgtttttaactcccaaacctttgtataatactrtacgagctgtctctgattcatgacagttgcccactacacaaaggataatcattattatgactgaaaatgtttacattatatttgttttgcttttttaggcttgttatgacatgcaaatgaaaaaaggtctcagaaaacatttctaattttataaacatcttacttcctttagagaatgagtggcctttagaaattggttgaaaatgatttttacttttatatttcaaagttcacaaacaagcattcacacatcattattaagctattagtatggagtgaattctacctgacccatttaca

SEQ ID NO: 48853 - DNA, 601 bp, Human
aattttcaattggatgtacaacaggtactttcttcaccactctcctttccaacaatattgttcagttctctgtaaagaatcatgatggtcaaggaaggcctggcaggagaatcttgattgttcaaagacaaatgttcttgtcaaaggattggtttaggagtggccatataatgtaattctggcagaagatacttgagaagatgaatgctaagagctatttttgaaagggcttgttcacttttaaaaataaatacaaggctttttttctttttttaatcttggaataatgtattttctatamgatggtgagaattgcagccatcatatcagggtcatgagaggagccagttaagagagccccggctaccatgctgagggcagagcagaaagttgtaaacacccctcatctcattaatggcactgagccaccacgtgagccaaccctggaactgccctgatgtcagatgggaagattactttgatgcaatggtagcctccaagtatgcttaggtgagctatcctagaggtgagggaaccaaaagctcccacagactaaattccaatcctcaaatcacgtaattcactaaattaatttaaagtg

SEQ ID NO: 48854 - DNA, 601 bp, Human
tacctgggttaggggcaagtagggtagaggggccatgccagctaatcctgggatacatagtgttcatgttcatacatctgcatatgccttccccactgatggtgtggttacaaggaccagagttgaggtttgggcaagccccaaagatagcagtcgtcccaagctaataacacctgctcaagtgtctgagagatactgggacaagtatgcctagtcagtggctgtggcttgccagttagcctcacaaacagtcatgagttctgttatgtttattggacagataacaaatggagcaggaaagagtatcagcagttgttaatcagggtaattttgtaccccagtgtacatttagcaatgtctggagacatttttgattgtcatgactggtgtatgtaagagatgctactggcatctattaggtagaatctagggatgctaagtgtgctacagtgaacaagacagcctcccaagacaaagaattatctggcccaaagtatcaattgtgtcgaagctgaaaaaccccctcatgaatattaagtacatatgtatatttagtgtatcctggatatttagtgcctcttatatatttaatatatcatga

SEQ ID NO: 48855 - DNA, 601 bp, Human
cctgattgtttaatatactttttgttgtgttttctacagcttgcagctgagagcgtgctagctgattctaacataaagtcagtaagaacatctattctcaagataaatgaagcattgacttagactataattacaagttttctaaatagtaatataagtgtcagataatacaggattatggtgcctgcattaatgtaatgcttgtttgatcgttctgtttacatttcaagcaattgtaggcatggtgcttatcatgatgaacctctgtgctcaaaaatgcacatttttagatgattggaayagttttagtttgatgaccttcagttcacttaaggagtttttagttggctcaatgtctattaatagagcaacactagaaatttatagcttgatgcattttttaaaatttattaatgatagttttatttatattttagtgctttaaaagattaaaaatattttacggaagttgtgtcttgagacccctccattaaaagggaaagtttttcatatatatgaaattaaagagaagcatatttaagattatagaaacatgtaaatgttgtttaggattgatttcaaaaaagaataattttcaaat

SEQ ID NO: 48856 - DNA, 601 bp, Human
gttcacttaaggagtttttagttggctcaatgtctattaatagagcaacactagaaatttatagcttgatgcattttttaaaatttattaatgatagttttatttatattttagtgctttaaaagattaaaaatattttacggaagttgtgtcttgagacccctccattaaaagggaaagtttttcatatatatgaaattaaagagaagcatatttaagattatagaaacatgtaaatgttgtttaggattgatttcaaaaaagaataattttcaaatgttgatggtatatattccatttyatttcttttaactttctttgcctttttttattttgtgatgaaaactaacattttgtcagatgaaaatatcacatataacacattaaagaaatggtaaggcataatatacaattaaaactgtttgataaaaagttaaagtaaaaaattaaggacaatatgtctttaaaataatgatgtgcttacggtagtttcctggaattattggctggttcagcagaatcagctgtgctcagcaatggagtgacaggtggtgtaggcagttcaacctcatgtccttttagaaatactgggtgtgtgtgt

SEQ ID NO: 48857 - DNA, 601 bp, Human
tagaaacatgtaaatgttgtttaggattgatttcaaaaaagaataattttcaaatgttgatggtatatattccatttcatttcttttaactttctttgcctttttttattttgtgatgaaaactaacattttgtcagatgaaaatatcacatataacacattaaagaaatggtaaggcataatatacaattaaaactgtttgataaaaagttaaagtaaaaaattaaggacaatatgtctttaaaataatgatgtgcttacggtagtttcctggaattattggctggttcagcagaatcarctgtgctcagcaatggagtgacaggtggtgtaggcagttcaacctcatgtccttttagaaatactgggtgtgtgtgtgtctgtgtgtgtgtgtgagtgtgagagagagagagagacctataaagtgttgatttggggggcttaaagaattgttaaagcagatatgtgtaaactagatcctgattttcgtgttttacatttttgggatcctctttagtcatcatttatttttgttgttgcagtgatttgctgtcctctgaatacatagagagacacattgaacatggaggcaagactgtgg

SEQ ID NO: 48858 - DNA, 601 bp, Human
ttttattttgtgatgaaaactaacattttgtcagatgaaaatatcacatataacacattaaagaaatggtaaggcataatatacaattaaaactgtttgataaaaagttaaagtaaaaaattaaggacaatatgtctttaaaataatgatgtgcttacggtagtttcctggaattattggctggttcagcagaatcagctgtgctcagcaatggagtgacaggtggtgtaggcagttcaacctcatgtccttttagaaatactgggtgtgtgtgtgtctgtgtgtgtgtgtgagtgtgagagagagagagagacctataaagtgttgatttggggggcttaaagaattgttaaagcagatatgtgtaaactagatcctgattttcgtgttttacatttttgggatcctctttagtcatcatttatttttgttgttgcagtgatttgctgtcctctgaatacatagagagacacattgaacatggaggcaagactgtggaagttaaagtaagtgaaattttcctacttgtggggaaatttgttgagaatcttttaatactactgattattattttaattttcaatgatatttctaatgtaca

SEQ ID NO: 48859 - DNA, 601 bp, Human
ttctttgttgatggtttttctaacccctaagcctgtcataccagggaaatgataaatacaaactttgtccagactgaagggccagtggtggtttatttttccctttaagaaaactgctttgatctcacctgtcacctccatttgtttccactccatttgaaaatctaactcaaaattctcctctgggtttttccaggaaccacattgaaaatgctgaattctgcccatcaatccaaagtcagtagccaattatttctctgctggttccctcctgtctcgacttctgtgcttagctctttgrgatgtttctttttacatgaaatctgatagaagtctattttctttattaatgactcattaatacattataaatcaaagttgtaacgttttatattttttccttccctgcagtacctttttaaaaagcaactcttaaaacttttacttctttaccttccatgttagtttgctaaagctaccataacaaagtaccacagactgggtggcttaaacaatagaaatgtatgttctctcaattctgaaagctagaagtccaagatcaagatgttgacagggttggtttctgccgaggcctctctcc

SEQ ID NO: 48860 - DNA, 601 bp, Human
atagaagtctattttctttattaatgactcattaatacattataaatcaaagttgtaacgttttatattttttccttccctgcagtacctttttaaaaagcaactcttaaaacttttacttctttaccttccatgttagtttgctaaagctaccataacaaagtaccacagactgggtggcttaaacaatagaaatgtatgttctctcaattctgaaagctagaagtccaagatcaagatgttgacagggttggtttctgccgaggcctctctccttggtttgtgcatggttttcttcctstgtcttcacatggctttccctctgtgtatatctgcatcctaatctcttcttgtgagaacatcattcctattgaactaggacccaacctaataaccctgttttaactgcgttacctctttagagaccctgtctctacatacagttatattctgaggtattaggggttaggactttaacatatgcattttgggggaacacaatccacctgtaacaccttccttaagagccctgtaagtttttttgttttttcttaaagttggcttttctcttgggactgaagtaaatgaaaggaaatatgaa

SEQ ID NO: 48861 - DNA, 601 bp, Human
ggtgattgttccttaacataatgatttgtgttatctgcagggacatcatcagcctcattgaaatcagtttatcttgttcatgtagctgtgcataattctgatataaaagttatattaaaacttaaaaagaatttttttcaaaggttacaaaaataaagtctttatgcaagaaaagaaagatactttttattcctttaatgggacatattaatctttcacttacgtttattttcaatccatttaaaaattaaattcttaatttactcatctgttcagggagaacttttatatgattgacacrgacttctaaaagaattttaaagtaaagcctcaactaatcagaataccttgggaatacaactttaattctgattatggagaaccatcgttctggattcataagacaaaggacattggaattgatgagtagtggcagcagagtctcagccatgcagtttgctgctttatagcttgttttgtcttgaaacagaaagctgctaatatatggggctaattgaaatgaacagttatataggctttagttaatcagtattataatgctaacagtaataactatttattacagtaataacttttattg

SEQ ID NO: 48862 - DNA, 601 bp, Human
aataccttgggaatacaactttaattctgattatggagaaccatcgttctggattcataagacaaaggacattggaattgatgagtagtggcagcagagtctcagccatgcagtttgctgctttatagcttgttttgtcttgaaacagaaagctgctaatatatggggctaattgaaatgaacagttatataggctttagttaatcagtattataatgctaacagtaataactatttattacagtaataacttttattgtatgatgtgatagtcacataaatttgtatgtaccattcaatyctcaagacaacctgtaaatacaactattatcctaatttacagaaacgagacacagagaagatatacaacttgtgaaagtaacgtagtaaggagtaataaagctgcagtttgaatctagattctctaactccagagctgactcttacatgtataatattttatatactatacaatgtacaccatacattcggtgtacattctataatatgtaaaataagaggcataaaaattgaaatgtattttatttttatactcatggtatacatatctaattcatttttggtatctaacaatttctcc

SEQ ID NO: 48863 - DNA, 601 bp, Human
atggggctaattgaaatgaacagttatataggctttagttaatcagtattataatgctaacagtaataactatttattacagtaataacttttattgtatgatgtgatagtcacataaatttgtatgtaccattcaatcctcaagacaacctgtaaatacaactattatcctaatttacagaaacgagacacagagaagatatacaacttgtgaaagtaacgtagtaaggagtaataaagctgcagtttgaatctagattctctaactccagagctgactcttacatgtataatattttayatactatacaatgtacaccatacattcggtgtacattctataatatgtaaaataagaggcataaaaattgaaatgtattttatttttatactcatggtatacatatctaattcatttttggtatctaacaatttctcctttatggtctttaatccttaaactgaaatggtgatctacatcaagaccctttaggcatttctctcaaattcagttatgcatttaggtagtttttctgtaatatcagttgccttgggcaagaatggtaaaagacacactccaggccaaagcttgttttatttt

SEQ ID NO: 48864 - DNA, 601 bp, Human
gtattagctcaagttatttctaaactactgtatatgagcattcccaacttgtcttaggattagattcctaatccttaacgatgagtttgtacagagacatccgttacacaatattgacttttgactggtaattaactgtttacgactcatcatttgattgaattgagtgcactcaagaatcactgcatcaaaatcttaattgtattcatagttgcagtaaaaagatgaataagtaagcaaaggagtgcgggccaccattgaagtctggaaatgagtaaaggaattggagagagtgctgtgygttgaagggcagttgtcagaggagaaaggaatacataagggtgggagaggttattatgactctagggaaccttttactctggtggtagtatagttacattcaatgacataaaagttatatttatttaggaaaactgaaaatggccactatcatctgtggaaacaaagtaacaaggaatttgagttagtagcaaggaggaagcctgagtttttatccagaatagttttctgcttctgttcacatctgtcttccctccctggggtgggagccccatgatagatttctaacttagcacaatac

SEQ ID NO: 48865 - DNA, 601 bp, Human
gggccaccattgaagtctggaaatgagtaaaggaattggagagagtgctgtgcgttgaagggcagttgtcagaggagaaaggaatacataagggtgggagaggttattatgactctagggaaccttttactctggtggtagtatagttacattcaatgacataaaagttatatttatttaggaaaactgaaaatggccactatcatctgtggaaacaaagtaacaaggaatttgagttagtagcaaggaggaagcctgagtttttatccagaatagttttctgcttctgttcacatctgtyttccctccctggggtgggagccccatgatagatttctaacttagcacaataccatctcccagcaggcacctatgctgctagcagagtctctagattccttttgtgctcatttttctaagtcagatttccatttcttctttcttaaaaaagggataccttttaaaaatcctgccttaatcgtttagttttccccagtgaatgtgtcaatgacaggaaaaaaaaaaaaaacactagtagaggacagctgtaagaaatcacttagaaaattttaaatatagtgactgtcaggacaacagatgc

SEQ ID NO: 48866 - DNA, 601 bp, Human
acaggaaaccgtgtcccttggttcctgtgggtttgagctgttgcccatttttaagtactttcatttttaaatagtgaattgtgtcagaggaatactcattaattttctctgttactcgttcaagaactgtgatattctcacagaagtattttaaatactgaacaaaagtttatctggaaatattatagttttgatggttagtatatgtaagtcatagtgagctagcttcattgattaataattactgtatattgctgtcctgtagaaagattatgctttcatatactgtctattaactcargctccctaactcagtcttaggggcaaataactgccgccagtaatttactgttagtcatttggaagagttaaccttttctccttacaaatccaaactcattttgcttacttaaggctactgatggattattctttttagttaatgacactcatcttaatggaattaaaaaatataatgacttgttgtatttctgttttacatcattgtcaaagtcttgtatttttacaaataaatattatatattcctataagtgctcactttaacaccagggatttcctgtattatgcaatctgtatgtc

SEQ ID NO: 48867 - DNA, 601 bp, Human
gtttaactaacttgcccaagaattttaagaaaggaagtctggcaccagaatgtgtgctataatctactgtagtttatcctccctatggaaataaatgatcataatagcagaggaattagaatgcaaatattttaattacagcccttctacaatttaccatttgtaattcaccgtctcttttagtagttgttttaataggccagaattgaagatgtgttagttcaggtgagtcccaattattccaatataaaattttctttattccaaagaccaatgccttctaaagactcccccacccccygctttttttaaaaactatttcattttggagttcatttttagtccttctttgttcttcatagaagttggattgtgtattgttcagcacaggggagcaccatcgcttcaaatcattatagtttgaaatatgttactgtcttgcacatggcaaacacatggctcagtttatgcccatcttttgcctatgtgtaaatttatctgcatctggagtaaatgtgaagttttatgggcaagagtaactaagctgaaacataccattatcctgccaagagactagaagatatttgattgtatctctgcc

SEQ ID NO: 48868 - DNA, 601 bp, Human
cccccgctttttttaaaaactatttcattttggagttcatttttagtccttctttgttcttcatagaagttggattgtgtattgttcagcacaggggagcaccatcgcttcaaatcattatagtttgaaatatgttactgtcttgcacatggcaaacacatggctcagtttatgcccatcttttgcctatgtgtaaatttatctgcatctggagtaaatgtgaagttttatgggcaagagtaactaagctgaaacataccattatcctgccaagagactagaagatatttgattgtatctytgccaaagagcttcaaaatacccatcccccctacctcttttaccctccgttccacaacatacacagcccgcaagcaggaagagagtaaaagagccatacaaatctaacaaacaaactgataaagtgtttatttcctcctcacatgtaatatcagttattccagatatgtttcctaactttacatgtaacatcagttattccaggtatgtttcctaactttactttttatctgccactaggcatcatttagtatcttctggatgagcttattgatgtgtgcatttcccccctggcaggctt

SEQ ID NO: 48869 - DNA, 601 bp, Human
ggagttcatttttagtccttctttgttcttcatagaagttggattgtgtattgttcagcacaggggagcaccatcgcttcaaatcattatagtttgaaatatgttactgtcttgcacatggcaaacacatggctcagtttatgcccatcttttgcctatgtgtaaatttatctgcatctggagtaaatgtgaagttttatgggcaagagtaactaagctgaaacataccattatcctgccaagagactagaagatatttgattgtatctctgccaaagagcttcaaaatacccatcccccytacctcttttaccctccgttccacaacatacacagcccgcaagcaggaagagagtaaaagagccatacaaatctaacaaacaaactgataaagtgtttatttcctcctcacatgtaatatcagttattccagatatgtttcctaactttacatgtaacatcagttattccaggtatgtttcctaactttactttttatctgccactaggcatcatttagtatcttctggatgagcttattgatgtgtgcatttcccccctggcaggcttatgcagacatatgctcctctgccatcttgta

SEQ ID NO: 48870 - DNA, 601 bp, Human
tactgtcttgcacatggcaaacacatggctcagtttatgcccatcttttgcctatgtgtaaatttatctgcatctggagtaaatgtgaagttttatgggcaagagtaactaagctgaaacataccattatcctgccaagagactagaagatatttgattgtatctctgccaaagagcttcaaaatacccatcccccctacctcttttaccctccgttccacaacatacacagcccgcaagcaggaagagagtaaaagagccatacaaatctaacaaacaaactgataaagtgtttatttcytcctcacatgtaatatcagttattccagatatgtttcctaactttacatgtaacatcagttattccaggtatgtttcctaactttactttttatctgccactaggcatcatttagtatcttctggatgagcttattgatgtgtgcatttcccccctggcaggcttatgcagacatatgctcctctgccatcttgtaatcagtgtggtttcaggaaggtctcagatttcatgatttaattctctttgcattataggaaaaaaatttggggggattaagtaaattttgctttctcttgggac

SEQ ID NO: 48871 - DNA, 601 bp, Human
tgcacatggcaaacacatggctcagtttatgcccatcttttgcctatgtgtaaatttatctgcatctggagtaaatgtgaagttttatgggcaagagtaactaagctgaaacataccattatcctgccaagagactagaagatatttgattgtatctctgccaaagagcttcaaaatacccatcccccctacctcttttaccctccgttccacaacatacacagcccgcaagcaggaagagagtaaaagagccatacaaatctaacaaacaaactgataaagtgtttatttcctcctcacwtgtaatatcagttattccagatatgtttcctaactttacatgtaacatcagttattccaggtatgtttcctaactttactttttatctgccactaggcatcatttagtatcttctggatgagcttattgatgtgtgcatttcccccctggcaggcttatgcagacatatgctcctctgccatcttgtaatcagtgtggtttcaggaaggtctcagatttcatgatttaattctctttgcattataggaaaaaaatttggggggattaagtaaattttgctttctcttgggactgaagcaa

SEQ ID NO: 48872 - DNA, 601 bp, Human
agtaaattttgctttctcttgggactgaagcaaggttgctctaggtccatcatcatgtataatgcatcaactgccttaatggcattgttaagattgcaagtggtcttaactctgtatcctgaggaaaatatgttggcccattgccagtttatacaggtcaggtgtcttagtgctggaagaaaggaaaaatgaaaagtgacagctgctgtcagcatgagttctgttcctaagctctgtttgtaacctatttgagtagaaagtcctttattttctttctggtataagattttttttcccccarttaactatctaaagagttatttcatctgttaatgttcaagatgttatctataaacttaaaagacatattcagccataagtttttttaaaaatcaaagtagcactaactgatgatatttccatgtatggaactaattagctattttataatagaatttactattttaattctaattatagaactaaccttttcattatagaatgtcttttccaaatctactcttgcaatttttttgaaactagagtgaactattacagtaattataattgaacagaaagtagtagaaatactgtttttgat

SEQ ID NO: 48873 - DNA, 601 bp, Human
taatgttcaagatgttatctataaacttaaaagacatattcagccataagtttttttaaaaatcaaagtagcactaactgatgatatttccatgtatggaactaattagctattttataatagaatttactattttaattctaattatagaactaaccttttcattatagaatgtcttttccaaatctactcttgcaatttttttgaaactagagtgaactattacagtaattataattgaacagaaagtagtagaaatactgtttttgattttaaactggtttgaagcaaaaaaaaaaaatcacaaattattcccttggtgttgtcataagctacaattattttcctattcattaataaaaataccttagtttccagtgaataaggtgtggccactataaaatcagaaaaggtaataaagaccagagaatatatactattggtattgagtggtttgagtgtttacagcctttttgaaggaggataattgatcagtgctacatttgatgttttttgttttgttttgtttctttttttctttctttttgttgttgttgtttgtttgttttgagacagggtctcactctatctcccaggctgg

SEQ ID NO: 48874 - DNA, 601 bp, Human
tagaactaaccttttcattatagaatgtcttttccaaatctactcttgcaatttttttgaaactagagtgaactattacagtaattataattgaacagaaagtagtagaaatactgtttttgattttaaactggtttgaagcaaaaaaaaaaaatcacaaattattcccttggtgttgtcataagctacaattattttcctattcattaataaaaataccttagtttccagtgaataaggtgtggccactataaaatcagaaaaggtaataaagaccagagaatatatactattggtattkagtggtttgagtgtttacagcctttttgaaggaggataattgatcagtgctacatttgatgttttttgttttgttttgtttctttttttctttctttttgttgttgttgtttgtttgttttgagacagggtctcactctatctcccaggctggagtgcagtggcgcagtcttggctcgctgcagactcagagtcccaggctcaagtgattttgccacctgagtcctaaaagtagctgggactacaggtgcatgtcatcatgcccggctaatttttgtatttttagtggagatggggtttc

SEQ ID NO: 48875 - DNA, 601 bp, Human
tagaatgtcttttccaaatctactcttgcaatttttttgaaactagagtgaactattacagtaattataattgaacagaaagtagtagaaatactgtttttgattttaaactggtttgaagcaaaaaaaaaaaatcacaaattattcccttggtgttgtcataagctacaattattttcctattcattaataaaaataccttagtttccagtgaataaggtgtggccactataaaatcagaaaaggtaataaagaccagagaatatatactattggtattgagtggtttgagtgtttacarcctttttgaaggaggataattgatcagtgctacatttgatgttttttgttttgttttgtttctttttttctttctttttgttgttgttgtttgtttgttttgagacagggtctcactctatctcccaggctggagtgcagtggcgcagtcttggctcgctgcagactcagagtcccaggctcaagtgattttgccacctgagtcctaaaagtagctgggactacaggtgcatgtcatcatgcccggctaatttttgtatttttagtggagatggggtttcaccacgttacccaggctggt

SEQ ID NO: 48876 - DNA, 601 bp, Human
tcctctgttaaacaagacaaacatgtagctcagagctttgggtgtgggaaatactccataaatattagttctgatatcattattgaggtaaagtggcaatttgtacagaatttctggcaaagtctttggtggcttctacccattcttactgctagtttctgattccactcatgacaggaagcatgtcaggatcaccagcggcagttctttacttcctgctttataagacaattttctgtgcctctagactgtaaattccataagaagttcctccaagagaagcacccacgggaacttgtamtatattctcagcatttagcataatatttgttcatagaagacaataagtatctgctgaatgaaaaaaataagtgaaagaattaatccaggtattagaaaattgagtggtttctcctgttcacccaacagtatgtcagatgtgtaggggaaagtacagcctggacaggtctgggaacgcatattattccccctgctatcaaaatatgcagtgaatataaacaggaaaaataaaaactgatagccttataatcggcttgcctgatggtaagcgcatcctccacacagaggctcacattcatgc

SEQ ID NO: 48877 - DNA, 601 bp, Human
tgaaatgttttaaacatgttaaaaattgtataaaatacctcaacagacatccacgtgtagatttaacatagttcagtgttttgctatattagcttttaaatcttttcatggttttaaaatctactaattgtgtatcagcatgtctcctgttagtttttatttttattcttgccttgactcttttacttgatcaatcttgttagaattttttgtaaatactctctccccacccgccccccaccccccctttttttaaagacagggtctcactctgttgctcaggctggagtgcagtggtgcratcatagctcactgtaaactcgaactcctagcagtacttctccctcagtctcctgagtagctgggactataggcatgtgctgccacactaattttttaatttttacttttagtagagaccaggtctcactatgtttcccagactggtctcgaactcctgacctcaagcaatcctctcgcctcagcgtcccaaagtgctgggattacaggcatgagtcattgtgcctggctgaaaatacttttttttttttttcccccaaagaaccagctttactttctttaccaaaatatatttttcaat

SEQ ID NO: 48878 - DNA, 601 bp, Human
atactctctccccacccgccccccaccccccctttttttaaagacagggtctcactctgttgctcaggctggagtgcagtggtgcgatcatagctcactgtaaactcgaactcctagcagtacttctccctcagtctcctgagtagctgggactataggcatgtgctgccacactaattttttaatttttacttttagtagagaccaggtctcactatgtttcccagactggtctcgaactcctgacctcaagcaatcctctcgcctcagcgtcccaaagtgctgggattacaggcatgartcattgtgcctggctgaaaatacttttttttttttttcccccaaagaaccagctttactttctttaccaaaatatatttttcaataatttctgctcttacttttgtaatttccttttttctgctctgaaatttctgcttttcttttcataattcatttagttaaatatttaatttgttaattaccaatcttcttttctatatgcatctaagaatttaaaatttactcaagtaccattttagcagcatcctaaagctctgctacatagtttttttttgctgttgtccacacacacatatat

SEQ ID NO: 48879 - DNA, 601 bp, Human
agagacagggtttcaccatgttagccaggtctcaaacacctgacttcaagcgacccacccgcctcagtctcccaaagttctaggattacaggcatgagcctctgtgcctggctgcaacagaatcttttagcggccagaaattttctctttatccttccttcttcaaaaaaggaatggaggatagaattgaagtgaaactaaaggaggttatgtttatggtaaaagtggagaaaaaacgatttcctttttttccttaccttagaccctcatatagttgtgtttccttaaaaaaaaaaaaaaagaaaacaacaacaaacatctttttcagatatgacaaaagaaaattcctcctgtattttaggaatgcacaaatatgttttctctttgtgcaacaatcatctagtcagttatgttttttcctgttactagtcaaacatcaactacagaataaggttttaggtaattcacagtctttatgctaaaaagtccatatagagtaatgcatttaaattttattattcataaaaaggtacaatgatatagtggtttcctggaaagagttataatttcatgagtttgtaattatatagtaattatatat

SEQ ID NO: 48880 - DNA, 601 bp, Human
gctgtgtttgacttagtaaaatggaatattaagtttgccatattgtgtaaaaataatgatgagtattttaaaataaagagataggaaactagaatgctggttataggtaattaagatacaggttaattttattagatgagtgatgccatggtagacacctccagtttctaccactgaaccaagcttcttaaaaggaaaatccctggattgtgaataaaaatttacttggctatgtataaagagatgaattattttactggtttgaatagtgttccccaaaattcacgactcctagaacccrtgagtatgaccttatttagaaacagaatcttttcagttgtaatcaagttaagaggaagtcatgctagattagggtgcgccctaatccgatggttggtgtccttaccagagaaaggtatagacatagagacacagagacaaacacagaaagttatggcccctatattttatggtgttcaccatcttttaataagattaactccttcctcatcacttttattcctatccagtggttttctactgtctttcttttcctttcttgtggaaacttttgctacaataatattcttacacatctttt

SEQ ID NO: 48881 - DNA, 601 bp, Human
tggtatcttgagccttaattcccagagggtaacagaggaaagggccggctaacctgagcacacagtgcattgtgttacaacaaagaaattccgaatttaggaaacctgaatcctttatagtgggaagtaaacatgcctgccctttgctttgaagggagattgtctccatcttccaaagctgttccctatgcaaacatcattgaaaggatagtccagaagaatctcagacattaaggggttctagatacttattatagtgaaatattactgagtaatctttcagaattcatttccatatgtmacattaaatattacattttaatcatttaaattaagcctgatgatgtagggtagttgtatttttaaggcttttgaaaacctatagtgctaagttaaagtctaggaagtattcatttgtattcttggtcttatacttttatatttcatagatccatatactaacaaaatgaattttgaggatcaacatagggttgccatttcttctattttgccatatatgaaaacaaccctctcaaaacatctaaatactattactattgctaccaattttaaaaaaatgaacctaaccactaatgcaata

SEQ ID NO: 48882 - DNA, 601 bp, Human
caaaataagtctatttaaaaaaggaaaacagttgatattttaaataataaaggtaaggaagtaaacatagaacaaatgacagtttttcaaaaattaaatacatttagctttatgaaaaattaagtacactgtacttatttttatttttttgacaggaactgataaagattttgagatgcattagtatagattcatggattattggcatttgggaaccatgtgatagcctcacttaattttaatttactgtaaatgagaggaaataatcttttcacttttcttagcctttagaatcagatasttttagaatcaattatactctgtacctgaccagatatttagcctatgtcctttttgtgaatccagtctgattctgtacagtcacaggttatgagttttaatcgggataggttggtggatcatctttaacataaaatttagcttttttaagaatttccattatgcagctggccctaaggagacttactttgttatttgtttattttcttattttaatttgtattagagatgcggtctcactatgttgctcagacttgtcttgaactcctggcctcaagtgatctccctccttggccttcta

SEQ ID NO: 48883 - DNA, 601 bp, Human
gaggaaataatcttttcacttttcttagcctttagaatcagatacttttagaatcaattatactctgtacctgaccagatatttagcctatgtcctttttgtgaatccagtctgattctgtacagtcacaggttatgagttttaatcgggataggttggtggatcatctttaacataaaatttagcttttttaagaatttccattatgcagctggccctaaggagacttactttgttatttgtttattttcttattttaatttgtattagagatgcggtctcactatgttgctcagacttrtcttgaactcctggcctcaagtgatctccctccttggccttctaaagtggtgggattacaggtgtaagccaccatgcccagcctcccaaggagacttacaactgggaaggtggagtaaagattggaggagggcaggttcctgatgttgatgccagtcgagagggagttgagaccaggcaagaaatgtggttttggtaggaaagcacctggtggaacagactgcagccatgcagccaccaatgtgtcaggacagtgtatacacttggggggaatctaggatgcagtagggttcaaggacag

SEQ ID NO: 48884 - DNA, 601 bp, Human
ttgtattagagatgcggtctcactatgttgctcagacttgtcttgaactcctggcctcaagtgatctccctccttggccttctaaagtggtgggattacaggtgtaagccaccatgcccagcctcccaaggagacttacaactgggaaggtggagtaaagattggaggagggcaggttcctgatgttgatgccagtcgagagggagttgagaccaggcaagaaatgtggttttggtaggaaagcacctggtggaacagactgcagccatgcagccaccaatgtgtcaggacagtgtatacmcttggggggaatctaggatgcagtagggttcaaggacaggccgttagttcctgcaaggtggtatcagctagagcagaggttcccaactatggtagcatattggaatcatctgggcagatttttaaaatacccaggtcccaccctctagagattctggcgcagttggtatggggtgaggctgtgaattttttaaaagagcttcccatgtgttacaatatgctgccaggttggcaactactgtgctagggtggggtgagaaagggtcccacttgtggaagagggtgactggcatgagcttcc

SEQ ID NO: 48885 - DNA, 601 bp, Human
tgctcagacttgtcttgaactcctggcctcaagtgatctccctccttggccttctaaagtggtgggattacaggtgtaagccaccatgcccagcctcccaaggagacttacaactgggaaggtggagtaaagattggaggagggcaggttcctgatgttgatgccagtcgagagggagttgagaccaggcaagaaatgtggttttggtaggaaagcacctggtggaacagactgcagccatgcagccaccaatgtgtcaggacagtgtatacacttggggggaatctaggatgcagtaggsttcaaggacaggccgttagttcctgcaaggtggtatcagctagagcagaggttcccaactatggtagcatattggaatcatctgggcagatttttaaaatacccaggtcccaccctctagagattctggcgcagttggtatggggtgaggctgtgaattttttaaaagagcttcccatgtgttacaatatgctgccaggttggcaactactgtgctagggtggggtgagaaagggtcccacttgtggaagagggtgactggcatgagcttcccaaactgcatggcagaaggctggttcta

SEQ ID NO: 48886 - DNA, 601 bp, Human
aatgtggttttggtaggaaagcacctggtggaacagactgcagccatgcagccaccaatgtgtcaggacagtgtatacacttggggggaatctaggatgcagtagggttcaaggacaggccgttagttcctgcaaggtggtatcagctagagcagaggttcccaactatggtagcatattggaatcatctgggcagatttttaaaatacccaggtcccaccctctagagattctggcgcagttggtatggggtgaggctgtgaattttttaaaagagcttcccatgtgttacaatatgctrccaggttggcaactactgtgctagggtggggtgagaaagggtcccacttgtggaagagggtgactggcatgagcttcccaaactgcatggcagaaggctggttctaggaccagtgcccatggagggggagaaggctatgattcagtgaacagagcaggagaacaagagttgcaggggcgggtgtttggatctggaggtgcctacactggccctgacccttttagcatgaccaaaccattcctatctgcctgtgactttcatagatgtagcactgaaataccagtatcctgggaaacccct

SEQ ID NO: 48887 - DNA, 601 bp, Human
ccccaggtagacaaccataatctcagagattgtggttcctatgtagaagagggataagaatatttctttgtaggattgatatgaagatttagtgtgattgtgtatgtaaattgagtagaacagtaacagacacagtaattataatagcagcaaacacttgttgagtacttcctatgagccaagcattactctaaactctttatgtctattagctcatgtaatcctcataacagccctatgagataattatctccaattgacagatgagaaaatggaggcacgggcagtctctgtaatttgyttaagattacacagctggtaacggaaggcgccaatagctcacattgttaacatctacactacactggtgctccacatgaagtcagtgccccatgttctagtgtctaggacttgtttcagcccccaagactctgtggccttctgggttccattccctgtacaacccagatgtgaagtaccaccctatcttctccattaaatgcaaccgcaaccctcagttcatgatgatcagtggctcccctgggaatttggaggtggtttaaggtccaggattgcattgtgtaccattttacctgctctc

SEQ ID NO: 48888 - DNA, 601 bp, Human
tcagagattgtggttcctatgtagaagagggataagaatatttctttgtaggattgatatgaagatttagtgtgattgtgtatgtaaattgagtagaacagtaacagacacagtaattataatagcagcaaacacttgttgagtacttcctatgagccaagcattactctaaactctttatgtctattagctcatgtaatcctcataacagccctatgagataattatctccaattgacagatgagaaaatggaggcacgggcagtctctgtaatttgcttaagattacacagctggtaasggaaggcgccaatagctcacattgttaacatctacactacactggtgctccacatgaagtcagtgccccatgttctagtgtctaggacttgtttcagcccccaagactctgtggccttctgggttccattccctgtacaacccagatgtgaagtaccaccctatcttctccattaaatgcaaccgcaaccctcagttcatgatgatcagtggctcccctgggaatttggaggtggtttaaggtccaggattgcattgtgtaccattttacctgctctccaccccctccccaaagctgaga

SEQ ID NO: 48889 - DNA, 601 bp, Human
attccctgtacaacccagatgtgaagtaccaccctatcttctccattaaatgcaaccgcaaccctcagttcatgatgatcagtggctcccctgggaatttggaggtggtttaaggtccaggattgcattgtgtaccattttacctgctctccaccccctccccaaagctgagagttaccagcttctgtgggattatctcacaaggagcagtagtctcaggctaggctggtttccttggaatttcggtgaagaaaatgtcttcagtctgttacatctccatgtcatcctgttctctctcctycatttgtgaaacactgaacattttaagtagtgtcagtccttaagtcatactgtgaagtaggtaacatttgcgcctttaaaccacccatcctatcggtcctttctgtttcactctttcgtatctcagtgagtcaatttaattagaagctttcagctactgaagaaatagaagattggtgacaggatggaaagaggtcatttagagaagagcttctcgaactttaatgtgcatatgaatcatctagggacttgttaaaatacagattctctacagtaggttgggggtggggcctgagattct

SEQ ID NO: 48890 - DNA, 601 bp, Human
tgatgatcagtggctcccctgggaatttggaggtggtttaaggtccaggattgcattgtgtaccattttacctgctctccaccccctccccaaagctgagagttaccagcttctgtgggattatctcacaaggagcagtagtctcaggctaggctggtttccttggaatttcggtgaagaaaatgtcttcagtctgttacatctccatgtcatcctgttctctctcctccatttgtgaaacactgaacattttaagtagtgtcagtccttaagtcatactgtgaagtaggtaacatttgcscctttaaaccacccatcctatcggtcctttctgtttcactctttcgtatctcagtgagtcaatttaattagaagctttcagctactgaagaaatagaagattggtgacaggatggaaagaggtcatttagagaagagcttctcgaactttaatgtgcatatgaatcatctagggacttgttaaaatacagattctctacagtaggttgggggtggggcctgagattctgcatttttaacaacctcctagtgatgtcaatgctgcttgtctctgaactgcactctgagtagtaagtattta

SEQ ID NO: 48891 - DNA, 601 bp, Human
gatgatcagtggctcccctgggaatttggaggtggtttaaggtccaggattgcattgtgtaccattttacctgctctccaccccctccccaaagctgagagttaccagcttctgtgggattatctcacaaggagcagtagtctcaggctaggctggtttccttggaatttcggtgaagaaaatgtcttcagtctgttacatctccatgtcatcctgttctctctcctccatttgtgaaacactgaacattttaagtagtgtcagtccttaagtcatactgtgaagtaggtaacatttgcgyctttaaaccacccatcctatcggtcctttctgtttcactctttcgtatctcagtgagtcaatttaattagaagctttcagctactgaagaaatagaagattggtgacaggatggaaagaggtcatttagagaagagcttctcgaactttaatgtgcatatgaatcatctagggacttgttaaaatacagattctctacagtaggttgggggtggggcctgagattctgcatttttaacaacctcctagtgatgtcaatgctgcttgtctctgaactgcactctgagtagtaagtatttaa

SEQ ID NO: 48892 - DNA, 601 bp, Human
ggtttaaggtccaggattgcattgtgtaccattttacctgctctccaccccctccccaaagctgagagttaccagcttctgtgggattatctcacaaggagcagtagtctcaggctaggctggtttccttggaatttcggtgaagaaaatgtcttcagtctgttacatctccatgtcatcctgttctctctcctccatttgtgaaacactgaacattttaagtagtgtcagtccttaagtcatactgtgaagtaggtaacatttgcgcctttaaaccacccatcctatcggtcctttctgyttcactctttcgtatctcagtgagtcaatttaattagaagctttcagctactgaagaaatagaagattggtgacaggatggaaagaggtcatttagagaagagcttctcgaactttaatgtgcatatgaatcatctagggacttgttaaaatacagattctctacagtaggttgggggtggggcctgagattctgcatttttaacaacctcctagtgatgtcaatgctgcttgtctctgaactgcactctgagtagtaagtatttaaaggtgacatcctaagatggcagaagatttacct

SEQ ID NO: 48893 - DNA, 601 bp, Human
tctgtgggattatctcacaaggagcagtagtctcaggctaggctggtttccttggaatttcggtgaagaaaatgtcttcagtctgttacatctccatgtcatcctgttctctctcctccatttgtgaaacactgaacattttaagtagtgtcagtccttaagtcatactgtgaagtaggtaacatttgcgcctttaaaccacccatcctatcggtcctttctgtttcactctttcgtatctcagtgagtcaatttaattagaagctttcagctactgaagaaatagaagattggtgacagratggaaagaggtcatttagagaagagcttctcgaactttaatgtgcatatgaatcatctagggacttgttaaaatacagattctctacagtaggttgggggtggggcctgagattctgcatttttaacaacctcctagtgatgtcaatgctgcttgtctctgaactgcactctgagtagtaagtatttaaaggtgacatcctaagatggcagaagatttaccttcttacctttccaggcacattgaatccaaataaatgaatctctcttagtagaattttattaatgcaattggatgcta

SEQ ID NO: 48894 - DNA, 601 bp, Human
ataaacactgtaaaaacaagcatttcctccatcaatataatttagtgactctcaaatgatttatattcatttttacttagttttatgtaaaagagtattgctttgctgctgctcatgattgaatttctttttttttttttttttttttttttgagacagggtctctatcgcccaggctggagtacagtggtgccatctcagctcactgcgacctccacttccctggttcaagcgattctcctgcctcagcctcccgagtaactgggattacaggcatgcactaccacatccagctaattttgtatttttagaagagacagggtttcaccatattggctgggctggtttggaactcctgacctcaagggatccacccacctcagtctcccaaagtgctgggattagaggcatgagccactgcacctggcccatggttgaatttcttataactaggaaagcagatgattaaactttggtgcaagggtcacatatgtatttcctttcttttctttttttgtcattttttcttttgagacagaatttcactctttttgtccaggctggagtgcagtagcacaatcacagctcactgcagcctcaa

SEQ ID NO: 48895 - DNA, 601 bp, Human
attttgatttagagtcagctcactcagagtgtttatgaataattctgttagaaaagatttgataatgctaatctgaataatgaaatatcatgcagagttctagatgtggaggtgcattgtgagtagaaacctcctgtgaaatgaagcagctgattctccttgtgatgcaaagacttacattctttatttctgttttcagggaggagagcactgttactaccagggccatatccgaggaaaccctgactcatttgttgcattgtcaacatgccacggacttcagtaagtgttcaaaaagttrtttttactgtttgttttttcaataatttattttctttattatgaatgcactatagtagatatccctattttgtgtcaagaaatgactttaaattggtgatggatctgattttttttttctcttttgtattttataaaccaagcagatttttaaattagggttgcaaatggtcgggcgtggtggctcatgcctataatcccagcactttgggggggtctaggcaggcagatcacctgaggtcaggagttcgagaccagcccagccaacatggtgaaaccctgtctctactaaaaatacaaa

SEQ ID NO: 48896 - DNA, 601 bp, Human
atatatattgtcaagaaaaaagacaagcatactttaaggagatgctagactccatctcaaaaaaattaaataaaattagagctgcagaaaacagaggcttttgaatttcacaatgataccttaaaatgatatttgaagcatttttctagtttcatccaaattcagacaggagtgatttgggttaacttcggtgtctgtttctgtggatgtttagccccttgatattcttccctactccttctttatattagtttttatatttttgtcaaataatagcagtttcagtaaatggaaacgcctractccttacacaaagagaaaaggctgctagtgatctcaagagctcatatgtctttgcccctttttttcagcctgaatcccacctaattcatagcaaatctgtgggagggtctgtcgtttctcagagatctccgaggaacaaagttcatccttcctcaaggccttgcttcctttctcataaccttctctatcaaataatgtttgctgatgtttaacatgggaatacatccacttcctccatcctgtcgataatgataatgcacaggtggttgtttcttacttgttttgtaaccccttataa

SEQ ID NO: 48897 - DNA, 601 bp, Human
ttgcttcctttctcataaccttctctatcaaataatgtttgctgatgtttaacatgggaatacatccacttcctccatcctgtcgataatgataatgcacaggtggttgtttcttacttgttttgtaaccccttataaagctaccgtgtcattcctcagcattctcttttaactaaatcgtttcatttccttcttgtttgttttactttttggcacagaacaatccagcactttaattttgttaaattttcgttgagaaactttaaaataattcctttttgttaccatcttagagatgtgrcttttcatctaacaagcagttactgggtgtctcctgtgtgccagccctaggaatattaaggcgattgaaacacaagtcctgggagctcacagtctcatgaggaggccaaatctagcccatttcctgatgtggaacatgataggtatatttgctttttttttgagagagagagaggaaaaaaaaaaaaacaaaactgggaaaaatgcaagctaagcattgtcaccgaagaacaggtggcacctaagggctctggaaacatgccacctgaagacagtggagtgcaataggttggaatagcct

SEQ ID NO: 48898 - DNA, 601 bp, Human
acataggataaatataaccttgtatcatcttgttgtttagtaattattgcttctcatcttgactttactttctggaagaaatattttggggggatgttatgaaatattgaataatgtatgttgtcccaattacagtggtttagatatgagatatattatgtcatccatgactcatcctttataaattaccaagtgcgtactgtttttttttcatttttgatttattaaattcagttcaataatataaataagggaaaatcagattcgtatatctttcccataaagaacctgcaaggtcacwtttgtttggagtcaaaggactaataggcaatgttttgatcttggtgtgtttggtgttaatgcaaaaatcttgttactgtgggaaccttaaagcacggagttaagtttgagtttattgccctcttgtggaaatttgtaagaatggctttttcatttcaaaatcttattttgatacaaccttttgaaattttagctcaattggtctgtgacgacttggtcttagctataggtttttatcaagtatactgttatggactcaatataaaaattaggatttatataagtaaaacaaaaatatttc

SEQ ID NO: 48899 - DNA, 601 bp, Human
tttttcatttcaaaatcttattttgatacaaccttttgaaattttagctcaattggtctgtgacgacttggtcttagctataggtttttatcaagtatactgttatggactcaatataaaaattaggatttatataagtaaaacaaaaatatttcagttctcaaagcatataaaacacatgtattttttcattattaaggaattaataatggcatattatcatatagcaatctagagtcttctgagatacagatagtgtcagaatctgttgtcttcatattgcctacatgatgtttaagtmcaataaaaaaatgactttctcattggacattaacctagtataaggataaataacactcagtactattttaagaaaataatctgcttgctactttgttggtgttgccacgtgaattttggcaaactatgatggtttcatatgactttctggatggatatggctagttctcagcaagggtagagagatactccctgccatatttggtctacgtttttgaaaggctccccctctgactccttgggcacatattgtcagtaatgtcttacaaactgcatctgtttatgtttaaattccaaatag

SEQ ID NO: 48900 - DNA, 601 bp, Human
tacatgatgtttaagtccaataaaaaaatgactttctcattggacattaacctagtataaggataaataacactcagtactattttaagaaaataatctgcttgctactttgttggtgttgccacgtgaattttggcaaactatgatggtttcatatgactttctggatggatatggctagttctcagcaagggtagagagatactccctgccatatttggtctacgtttttgaaaggctccccctctgactccttgggcacatattgtcagtaatgtcttacaaactgcatctgtttatstttaaattccaaatagaatgtcatccaaattcagaaagtacatgtggctgaaaacagtgcagctgtgagaataatcattctgtgagtatatagaagttgaggacatgtggaagatgttatagcaggaatgaaagaatttggatagaggcagaacttggaggccattataattatagctcatggaatttcaccaatttcactaaatcttcaatgaaagacaaatactagtttatgtttaggagcttggctgtcacataatcatttctaccaaaaactaaaaaattactacagctcatagct

SEQ ID NO: 48901 - DNA, 601 bp, Human
gaatgataagacaagtttctttaacatcataaagggcctgatctcagtaaaaggatcatgttcttctaaaagcagcagctatcagaatctgtctgagtgggagctgaggccatttgtatattgaagtgctctccagaggatttctcagatggctggtagccacccccagcctacgaggtccaaaatggaattttttatttttaaagaaatatagggtcttgctctgtcacccaggctggagtacagtggcacaatcatcaatcactgcagccttgaactcttgggttcaggtgatcctccyacctcagcctcccaagtagctgggactacaggtgtgtgcatcaccaggcccagctaactttttaaaaattttttgtagagagagagtcttgccactcactacgttgcccaggctggtctcaaactcctggcctcatgtgatttccccccgccttggccttccaaagtgttgggattccagatgtgagccccatgcccagctcaaaactgaactcttaaaggatttgcatccttccctctgcttcctgcttccctaggcccatcccgaaaagttctttctgcatcccccctgcctgccctc

SEQ ID NO: 48902 - DNA, 601 bp, Human
ctcagatggctggtagccacccccagcctacgaggtccaaaatggaattttttatttttaaagaaatatagggtcttgctctgtcacccaggctggagtacagtggcacaatcatcaatcactgcagccttgaactcttgggttcaggtgatcctcccacctcagcctcccaagtagctgggactacaggtgtgtgcatcaccaggcccagctaactttttaaaaattttttgtagagagagagtcttgccactcactacgttgcccaggctggtctcaaactcctggcctcatgtgattyccccccgccttggccttccaaagtgttgggattccagatgtgagccccatgcccagctcaaaactgaactcttaaaggatttgcatccttccctctgcttcctgcttccctaggcccatcccgaaaagttctttctgcatcccccctgcctgccctcttttttttttttttttttttttttttgagacagggtctcactccattacctctttttttatcttgttaaatgacatgtccatttttccagttgctcaggtcaaaacttggagtcttcactaactcttctctgttttacgtact

SEQ ID NO: 48903 - DNA, 601 bp, Human
ttaaataatttggcaagttactttatctctttgggtttcagtttccttacttataaaataaggatagtcgttgtacttctcttgtagatttgtggaaaagattaaatgagtgtaaagtatttagcttgtggcaagttgttcaaatgtgttagctcttgttactagagcatcttccatgtttatggtaggtcgggcgttctcagtatagtccctgaaaacctgcatcaggatcacctggagcttatttaaaatgcaatttcctgggttccagtccataaatctgaggagagtcctgaaagakctgcgtttttactagctctccagatgactttttgcatatgaaaatcttggaattctatgttagaggaagaagtgatgggcaacagctagagcatggcaatcctgagcatggggtcaggtgaggatgaggtgactctacctataaggaatcagaaggaggggccttccctctcagtggtgtgtgtggtgtgtctggaggtgatggatgggactgggaaatgggcattgagaagcaaatgggccctctggctgctgctgattttaaaatgatcttgttctgggatgagagtcgatggccatg

SEQ ID NO: 48904 - DNA, 601 bp, Human
actgttgcttgtgtcatttcaggaggatttccattttcattcagtttacaaatccagactgtttgaattttccttggatgatcttccatctggtatgatgttcatatagtgactttttatctaaaagacaacttcagtaatttatttaatgccttagaactaatctatatttggaatatcattagcccacatctgcttttgacatttttagagggagagccaagtcacgtcaagagggagaataaaatgcaaactgtcctcacagatgagtttggaaagatgtggaggaaaactttaaaamattttaaaattaaaaataaggcactaaaggagaaacaagattagagcaagaattggtctgtgagacaaagtacatacaaattcactctttgtgaaatactggtcttgtaaacatagggatgaactcttaatcatttccctatttattgttttccttgtctcttttttgctctagcattttaagaaagaactattatgggttaacttttattatcattatgtgttatttgtgaaattagtcatttcttctcatctatacctaaatggatctaggttaattttaagagtgtttgtctcccaa

SEQ ID NO: 48905 - DNA, 601 bp, Human
gaaacggagtaatcctaaactaatgcttagataatcacttagaagtttacattgtctcttcatcagaaaataaatgtttcctaatgttcctttctctctaaatgaagtttgtaactccttgtcctcctgtaattttcctaaagagaaatgaacattctctccccttctctcctgctgccagagggatagaagatttaatagaatttactattttgaaaaatcttcaaatgggaatatagatgctcttacctctcacagactttttagactgttctttcagtgatcttataaaactttttamaatccctattctgataagaaaataagtcatgactagctgtgtgggaataaagctataatttaatgggtattactgggagcagtcaacattaattaatatttaaagtaataaataaagatttttccctaaagacttgactgtaggcttgctaggatataaccttatatatatatatatatctatctatatatatatatcttttttttttttgagaaaatcattcagggtttctttccagcagaaactttgatggtgacttggcagttttgctgttattaaaatgatttttagacacattct

SEQ ID NO: 48906 - DNA, 601 bp, Human
cctgctgccagagggatagaagatttaatagaatttactattttgaaaaatcttcaaatgggaatatagatgctcttacctctcacagactttttagactgttctttcagtgatcttataaaactttttaaaatccctattctgataagaaaataagtcatgactagctgtgtgggaataaagctataatttaatgggtattactgggagcagtcaacattaattaatatttaaagtaataaataaagatttttccctaaagacttgactgtaggcttgctaggatataaccttatatatmtatatatatctatctatatatatatatcttttttttttttgagaaaatcattcagggtttctttccagcagaaactttgatggtgacttggcagttttgctgttattaaaatgatttttagacacattctttaaaaactcaggtctgtttcaatcagtttctagttttcttttctcatcagaagttggcactgtcaattttgagagagtttgtctcccaacattacttatgatttactgtgataaatgagaagaaaacaagaaatggacaaataaatgtcaaaactgcaatttctgtgaa

SEQ ID NO: 48907 - DNA, 601 bp, Human
ctgccagagggatagaagatttaatagaatttactattttgaaaaatcttcaaatgggaatatagatgctcttacctctcacagactttttagactgttctttcagtgatcttataaaactttttaaaatccctattctgataagaaaataagtcatgactagctgtgtgggaataaagctataatttaatgggtattactgggagcagtcaacattaattaatatttaaagtaataaataaagatttttccctaaagacttgactgtaggcttgctaggatataaccttatatatatatmtatatctatctatatatatatatcttttttttttttgagaaaatcattcagggtttctttccagcagaaactttgatggtgacttggcagttttgctgttattaaaatgatttttagacacattctttaaaaactcaggtctgtttcaatcagtttctagttttcttttctcatcagaagttggcactgtcaattttgagagagtttgtctcccaacattacttatgatttactgtgataaatgagaagaaaacaagaaatggacaaataaatgtcaaaactgcaatttctgtgaaacag

SEQ ID NO: 48908 - DNA, 601 bp, Human
tgctctgtcattctttaattttagctattctagtgtatgtggtggtatctcactttggttgaaatttgcatttttcttgtgattaatgatgtgtagtatatacttactcgccactaatcagaatttctgtcttttttgttgttaagttgtaggagtacttacatattctagatagaaggcctttgccaaatatgccttatgaatatatttttcccagtctttggcttgctcatttacttaatggcatcttatgatgaacagatgttttaaatttcatgaagtttaacattagtttttatcrttattgctttctctatgctaagtaatttttgctagctcccaagttttgaagatattctctagtgttttcttctaaaaactctatagttttattttttatgtttagatctaggatcctcttcaaattactttttgtgcatggtgaaaagtaggggttaagttttattttattattttgtatgtggatacacaattattttaataccatttgttgaaaacagtttcctttcatcaatgaattgttttgatgtctttgttaaaaagtattaaaagtatgaatatgagtctatttcttgactct

SEQ ID NO: 48909 - DNA, 601 bp, Human
ttgggtgtaatttctcttagtccttctgtgtgtaaaactaaagagacaagttatctgccctatgtagtcccaggatccagtaatgggccagctatagacattcccttacaaaagagggaaaattcgagaaacaagaaagacactgacattgcagttctgaaattctgctgggcaaatgttgaccctttcttgactgggtttcaaggcctagaaataattctccatgactcttggctctgtgttctcaactcttaattctgctcatccttccttttccatgaaaggtagcacatatttgcakctgagtagttttatcagtctgctattctagtttgctaagagtttttatcaagaataggtgttgaattttgtcaaatgcttttctatgtctattacgggatcatataattttctcctttaatctgttaatgtgatgaattgtataaattgatgttttgaatatgaaactaatttgcattcttaaatgggccccaattggttatggtagattatatttgtgtgtattactgggtttgatttgcctatgttttgttaagcatttgtaaaatataggttcagaaagcatattggactgtagttt

SEQ ID NO: 48910 - DNA, 601 bp, Human
gcacatatttgcagctgagtagttttatcagtctgctattctagtttgctaagagtttttatcaagaataggtgttgaattttgtcaaatgcttttctatgtctattacgggatcatataattttctcctttaatctgttaatgtgatgaattgtataaattgatgttttgaatatgaaactaatttgcattcttaaatgggccccaattggttatggtagattatatttgtgtgtattactgggtttgatttgcctatgttttgttaagcatttgtaaaatataggttcagaaagcataytggactgtagttttcttttctggttttagtaccagggttttactggtcttataagatgtgttaggaaaagtttccaaactcttttttttttctaagttggtgtaaaagtggtattatttcttccttaaatctttggtagaattcatcagtgaagccatctggccttgtggttttcttggaaagtttaattaagaattaaagttatttaatagatacaggattattcagattttctatatatacacacgttcaaggaatttcatctaaattaacaaatttattggcataaagctcttcata

SEQ ID NO: 48911 - DNA, 601 bp, Human
cgaatcatagagctggtaaacagtttagacaaaattaagagttgtggccatcagaatcaagatatcaccactgtggtggtgtgggcaggagagatggttattaaaaacacaagatgaagggaatagatctctagtaagatcaagaagttgaaggaaccaggtatcttctttttattaccttgaaataaaatatatgtttacagacagatttttattgtgaataattattgctaaattttattgaatacttaccttgtacctggccctattataagaattttaactatattaacacatttarccctcaaaaaccttaagaggaaggtattatcacaggttaagtatcccttttccaaaatgcttgggaccggaagttttgcacattttgatttattttttggcagggggaggatttcagaatatttacattatacttagtgttttagcatccctaattcaaaaattagaaatctgaaatgctccagtgagcatttcttttgagtgtcctattggtgctcaaaaagtttttcattctggagcatttgggattttggattttcagatgagagatacttaacctataatatcctcattttactga

SEQ ID NO: 48912 - DNA, 601 bp, Human
aaataattaccatcaggatttaatgtgaaacagtatttttttgaattatggactgaaagaataggacaatattcttttgacatgtaccctgaagttcctcataaacatctcagcatctaatcatttgctaagtagacaaaaccttgatttctctttctgagaaagccatggacccatagaggtgaagtactataaaactgtgtggctaatatggcaactctttgacattaacaaaatgttgggatttgttgaaaaatttgctgtattaactagtctctcacaagtagcaaagcagctcctrttgccctaaaaacacccccctcccttaaaaaagaaaagaagactctcatcattggatgcactttagtgttattctttggtttccaacctcagaattgtatctattattccctatcaccttggtgttataatagttttttttttttaagtttttaagtttaggattgcagttagcaatgacaaaatccatgtgggagcatttttaaagttggttttaactgcaacactcaaaacaaacatatatgtattgatttaagtttgattgtatacccttatcgcaaaaatggaccttgggcaagtg

SEQ ID NO: 48913 - DNA, 601 bp, Human
taataataataacaacacaatcaggattgagtgctgcttccttgttcaagctaggtctaagttttatctttccacctatttgaatccagtgaatgtttctgttccctaggatttttataaaataagttataacaacatatattttgaacattttagatcgtcacaaattcagatatccatagacatcagtagacatataacgtaagtgaaattaaccagatataagacagtattaggtgggtaaggcctgtggtgaaatgaatggtgcatggcctgtctaaggggagcaactgcctctcaktgtttgccagttattaccaggtgagaatgctaattttaactgaagccagaaattggattttacatgatatttcctgatttttaaaacacgattgagaccaaccaaagatatatgtgatccacatctgccctgtatgccacctcgttgtgacctttatcttagaggtttcttcttgctgaataagtcttgcagaacttttaaatttgtttgcttttagcagtgttcacatccactttactgtctatacccctacttagatttgtatgtcttgcaattcatagacaactttcatatgtttta

SEQ ID NO: 48914 - DNA, 601 bp, Human
aaattaaccagatataagacagtattaggtgggtaaggcctgtggtgaaatgaatggtgcatggcctgtctaaggggagcaactgcctctcagtgtttgccagttattaccaggtgagaatgctaattttaactgaagccagaaattggattttacatgatatttcctgatttttaaaacacgattgagaccaaccaaagatatatgtgatccacatctgccctgtatgccacctcgttgtgacctttatcttagaggtttcttcttgctgaataagtcttgcagaacttttaaatttgtwtgcttttagcagtgttcacatccactttactgtctatacccctacttagatttgtatgtcttgcaattcatagacaactttcatatgttttatcattttgaataacaatcccaataaaaataaacttatgaaatggatggattgggtattttttacttcatctcccagatgaataaattgaggcctcaatcctttaagagacttgtctcaggcaacacagcagataaagaacttgatctcagctctgactctgacattgttttacagacaacacatttttacagaaaagatttttttttt

SEQ ID NO: 48915 - DNA, 601 bp, Human
acatgatatttcctgatttttaaaacacgattgagaccaaccaaagatatatgtgatccacatctgccctgtatgccacctcgttgtgacctttatcttagaggtttcttcttgctgaataagtcttgcagaacttttaaatttgtttgcttttagcagtgttcacatccactttactgtctatacccctacttagatttgtatgtcttgcaattcatagacaactttcatatgttttatcattttgaataacaatcccaataaaaataaacttatgaaatggatggattgggtattttttacttcatctcccagatgaataaattgaggcctcaatcctttaagagacttgtctcaggcaacacagcagataaagaacttgatctcagctctgactctgacattgttttacagacaacacatttttacagaaaagattttttttttttttacatttttagggatctttcaattgcaccatgttttctctgatgagatgattgttttctgatcactttgcaagaccttcacttgttttcttttgctttcagtttaaaaaacatcggctttccgttgtacataccaatacctatgcgaaatc

SEQ ID NO: 48916 - DNA, 601 bp, Human
tgagaccaaccaaagatatatgtgatccacatctgccctgtatgccacctcgttgtgacctttatcttagaggtttcttcttgctgaataagtcttgcagaacttttaaatttgtttgcttttagcagtgttcacatccactttactgtctatacccctacttagatttgtatgtcttgcaattcatagacaactttcatatgttttatcattttgaataacaatcccaataaaaataaacttatgaaatggatggattgggtattttttacttcatctcccagatgaataaattgaggcytcaatcctttaagagacttgtctcaggcaacacagcagataaagaacttgatctcagctctgactctgacattgttttacagacaacacatttttacagaaaagattttttttttttttacatttttagggatctttcaattgcaccatgttttctctgatgagatgattgttttctgatcactttgcaagaccttcacttgttttcttttgctttcagtttaaaaaacatcggctttccgttgtacataccaatacctatgcgaaatctgtggtgaacatggcagatttagtaagtatc

SEQ ID NO: 48917 - DNA, 601 bp, Human
ttttagcagtgttcacatccactttactgtctatacccctacttagatttgtatgtcttgcaattcatagacaactttcatatgttttatcattttgaataacaatcccaataaaaataaacttatgaaatggatggattgggtattttttacttcatctcccagatgaataaattgaggcctcaatcctttaagagacttgtctcaggcaacacagcagataaagaacttgatctcagctctgactctgacattgttttacagacaacacatttttacagaaaagattttttttttttttacatttttagggatctttcaattgcaccatgttttctctgatgagatgattgttttctgatcactttgcaagaccttcacttgttttcttttgctttcagtttaaaaaacatcggctttccgttgtacataccaatacctatgcgaaatctgtggtgaacatggcagatttagtaagtatcaaccccgttcattattgccctagaagattcttatttcctaattgctaatagaatggataatatgattcttatagttttactgctctatgttgcacttcagccaaggtgtctagtaagtt

SEQ ID NO: 48918 - DNA, 601 bp, Human
tctttaaagttactgtcttttaaatgttaatgttttctctgtttttggttctaagatgagagcttagtatttctggaatttatttttaattttttctcactcttatgttctttttttgatagcatgcatatttgacgtaatagcaaattatatatagtagaattttaaaaatctatcatctaaagtcagagctgttgaagaaagttataaaaggaagaaaagatgtattttggggtaactttatatataattccaaatttagagaaaagttgcaagaatactacaaggaaattgcatatgycctctattcagattcatcaattattcacattttccccatttgtttcataattttcttccattctccctcccttccttccattcatccatccttcagttttttttttgtttttttttgttttttttcctgaacctcttgaaagtaagttgaagacacttactggggatttattattaaatagtatatattctctaagagtaaaaagacattctcttatataaccacagtaaattattaaaaccagaaaatttaacacaaacataatacttttatgtaacccatggtctatattcaaatttc

SEQ ID NO: 48919 - DNA, 601 bp, Human
tatgttctttttttgatagcatgcatatttgacgtaatagcaaattatatatagtagaattttaaaaatctatcatctaaagtcagagctgttgaagaaagttataaaaggaagaaaagatgtattttggggtaactttatatataattccaaatttagagaaaagttgcaagaatactacaaggaaattgcatatgccctctattcagattcatcaattattcacattttccccatttgtttcataattttcttccattctccctcccttccttccattcatccatccttcagttttttktttgtttttttttgttttttttcctgaacctcttgaaagtaagttgaagacacttactggggatttattattaaatagtatatattctctaagagtaaaaagacattctcttatataaccacagtaaattattaaaaccagaaaatttaacacaaacataatacttttatgtaacccatggtctatattcaaatttcaccaattacctcaataatgtcttttaaagctaattttccccatccaaatccaatccaggatcacacattgcatttaatcatcatgtctctttagtctccttta

SEQ ID NO: 48920 - DNA, 601 bp, Human
ttgctcgttgctgaaaggaggaggcgtgaatgaagtaggtgtgaacatctgtacaatacaaagtggtatgatggctgaaaatgttttcctcatacttaagagataatttctcagtattcacatactccagatgttagattgctatattacaaatcagtatggtggcctggcacaatggcttatttctgtaattccagcactttgggaggctgaggtggacaaattgcttgagatgaggagtttgagacaagcctgggtaacatggcaaaatcctgtctttatcaaaaatacaaaaataggytgggtgtggtagcgtgtgcctgtagccccagctactggggaggctgaagtgggaggatggcttaagcctgggaggcagaggttgtattgggcccagattgcgccactgcactccagcctgggcaacagagtgagaccctgtctctaaataaataaataaataaataaataaataaataaataaaattaaaaatataaaaaactaatatggttactgtaagtgaccagaggacagactggggaaataatggcagataatatgggataattattatatattcatgttatgcttggaataatt

SEQ ID NO: 48921 - DNA, 601 bp, Human
gcacaatggcttatttctgtaattccagcactttgggaggctgaggtggacaaattgcttgagatgaggagtttgagacaagcctgggtaacatggcaaaatcctgtctttatcaaaaatacaaaaataggctgggtgtggtagcgtgtgcctgtagccccagctactggggaggctgaagtgggaggatggcttaagcctgggaggcagaggttgtattgggcccagattgcgccactgcactccagcctgggcaacagagtgagaccctgtctctaaataaataaataaataaataaataaataaataaataaaattaaaaatataaaaaactaatatggttactgtaagtgaccagaggacagactggggaaataatggcagataatatgggataattattatatattcatgttatgcttggaataatttccagattaagctacttacagattaaattgagagaatctttacctttaccttcattgaaaataaggccctatttatcactttgaatgattttccagggaattgaataattccctgaagcatcaggttgtcacctaacaacccaactggatattttttccttagtattta

SEQ ID NO: 48922 - DNA, 601 bp, Human
atttctgtaattccagcactttgggaggctgaggtggacaaattgcttgagatgaggagtttgagacaagcctgggtaacatggcaaaatcctgtctttatcaaaaatacaaaaataggctgggtgtggtagcgtgtgcctgtagccccagctactggggaggctgaagtgggaggatggcttaagcctgggaggcagaggttgtattgggcccagattgcgccactgcactccagcctgggcaacagagtgagaccctgtctctaaataaataaataaataaataaataaataaataaaaaaaattaaaaatataaaaaactaatatggttactgtaagtgaccagaggacagactggggaaataatggcagataatatgggataattattatatattcatgttatgcttggaataatttccagattaagctacttacagattaaattgagagaatctttacctttaccttcattgaaaataaggccctatttatcactttgaatgattttccagggaattgaataattccctgaagcatcaggttgtcacctaacaacccaactggatattttttccttagtatttaacagatttgggg

SEQ ID NO: 48923 - DNA, 601 bp, Human
gtaattccagcactttgggaggctgaggtggacaaattgcttgagatgaggagtttgagacaagcctgggtaacatggcaaaatcctgtctttatcaaaaatacaaaaataggctgggtgtggtagcgtgtgcctgtagccccagctactggggaggctgaagtgggaggatggcttaagcctgggaggcagaggttgtattgggcccagattgcgccactgcactccagcctgggcaacagagtgagaccctgtctctaaataaataaataaataaataaataaataaataaataaaattaaaaatataaaaaactaatatggttactgtaagtgaccagaggacagactggggaaataatggcagataatatgggataattattatatattcatgttatgcttggaataatttccagattaagctacttacagattaaattgagagaatctttacctttaccttcattgaaaataaggccctatttatcactttgaatgattttccagggaattgaataattccctgaagcatcaggttgtcacctaacaacccaactggatattttttccttagtatttaacagatttggggataaga

SEQ ID NO: 48924 - DNA, 601 bp, Human
agcactttgggaggctgaggtggacaaattgcttgagatgaggagtttgagacaagcctgggtaacatggcaaaatcctgtctttatcaaaaatacaaaaataggctgggtgtggtagcgtgtgcctgtagccccagctactggggaggctgaagtgggaggatggcttaagcctgggaggcagaggttgtattgggcccagattgcgccactgcactccagcctgggcaacagagtgagaccctgtctctaaataaataaataaataaataaataaataaataaataaaattaaaaatataaaaaactaatatggttactgtaagtgaccagaggacagactggggaaataatggcagataatatgggataattattatatattcatgttatgcttggaataatttccagattaagctacttacagattaaattgagagaatctttacctttaccttcattgaaaataaggccctatttatcactttgaatgattttccagggaattgaataattccctgaagcatcaggttgtcacctaacaacccaactggatattttttccttagtatttaacagatttggggataagaaaaataga

SEQ ID NO: 48925 - DNA, 601 bp, Human
ttgggaggctgaggtggacaaattgcttgagatgaggagtttgagacaagcctgggtaacatggcaaaatcctgtctttatcaaaaatacaaaaataggctgggtgtggtagcgtgtgcctgtagccccagctactggggaggctgaagtgggaggatggcttaagcctgggaggcagaggttgtattgggcccagattgcgccactgcactccagcctgggcaacagagtgagaccctgtctctaaataaataaataaataaataaataaataaataaataaaattaaaaatataaaaaactaatatggttactgtaagtgaccagaggacagactggggaaataatggcagataatatgggataattattatatattcatgttatgcttggaataatttccagattaagctacttacagattaaattgagagaatctttacctttaccttcattgaaaataaggccctatttatcactttgaatgattttccagggaattgaataattccctgaagcatcaggttgtcacctaacaacccaactggatattttttccttagtatttaacagatttggggataagaaaaatagagtaggt

SEQ ID NO: 48926 - DNA, 601 bp, Human
ttattatatattcatgttatgcttggaataatttccagattaagctacttacagattaaattgagagaatctttacctttaccttcattgaaaataaggccctatttatcactttgaatgattttccagggaattgaataattccctgaagcatcaggttgtcacctaacaacccaactggatattttttccttagtatttaacagatttggggataagaaaaatagagtaggttttccaaagggtttcttttactcctaaggcactaaacctactagagatgatcaaaaagaaaatactygcatttttaagaggctgcaaattgaaaaagatatcctcagttcttcttaagtttctattggccgaagatcatcactacctcctgttactcatttcatttgttttctgaagctacattctattccacttgaggggaatttcaggattacaactggatacaaagatgaacaagttctaaaaaaatttacagatttaattttattttgtattatccaaaagacggatttaattatataccaatattgaatttttcaagaatgtcactggtgaaatttggactcagatatacatttccaaaacc

SEQ ID NO: 48927 - DNA, 601 bp, Human
ggcaggctcttatagtaccagctactcgggaggctgaggcaggagaatcacttgaacccaggaggcggaggttgcggtgagccaagatcacaccattgcacttcagcctgggccacagagcgagactccatctcaaaaaaaaaaaaaaaaaaaaaaaaaagctattaccatgtatagagtacctattatatgccagatgattgagtgccagtattacttccatttagatactcatttaattctccaggtaattctacaggacacccatttttagccccattttacagatgaagtgactagmtcttacaagtataatgtctctaagattacacatatatcaaatggcaaactcaggttttgaaccctagtatttctgattctgaaacccttctgcctaaccaataatatattacactgccttctaccagaaaccttggtgtgtgcagagactttcaaaaatggtcaagaaattataatagttctcataaaggcctgtgaaactgagatcctgtaatagtgccataaagttcttcattcttccattggtatttgattgtctttcatttaagccattttaaataaatggtttaaatatggccat

SEQ ID NO: 48928 - DNA, 601 bp, Human
tactactttttaaaaggcattttaaggaataaagtggagataattattttaaaacagaaactactttaatgcaactgtgttcactttataacaaggcatgtgtattaattttctcttaggtgaatgtaaatgcgaggacacgtggtccgggtgcataatgggagacactgggtgagccacttgtatttgaaaataactcagtcttacattccctgctgtgctgttgtcttcttaggaatatgacactcaataacttagtgcatggaatctagcacttataaaatatttttgcaaaataacytcttatttataaaaacaattgatgtcaattaagttggtagacctcaaagatttttttttctttagccttacatctaggctataaacgtaagaaatgagggacaactttgtttttggtggcttacctgctaattccctttccttttatttccttcaattctaattaaatggtttataaacagtagtgtgctggtaagttaactcttgaaaacaaaaattagaaaacagcctggatttgtagctttctcacatttctgaggtgtaaatagtcccacaatggctgacttcaagccattactga

SEQ ID NO: 48929 - DNA, 601 bp, Human
ataaatttttgagggattacttattatactaacacatatttcagacctcacatcataatcctttgtacaaacttgattttcaacaaatatttcttgattgtgtttgaattttgaactcgcaggatatgtataacgaggaaaataaatgatagaggaaatatatatgcaaacatctgtttaaaatatttttccagccaggcatggtggctcatggctgtaatcccatcactttgagaggctgaggcaggcagatcacttgagcccaagagtttgagaccaacctgagcaacatggtgaaacyacatctctacaaaaaatacaaaaattaaccagtcgtggtggcacacacctgtagtcccagctacttgggaggctgaggtgggaggatcgcctgattccagggaggttgaggctgcggtgagccatgattgtgccactgaatgccagcatgggtgacagagtgagatcctgtctcaaataataataaagtaaaatatttctccaaaaatctttggactttttgtttagtaatgacaggaaatgataaaagttctatagttgcagtttcaacaattacgaaatttcatactagagattcttg

SEQ ID NO: 48930 - DNA, 601 bp, Human
catatttcagacctcacatcataatcctttgtacaaacttgattttcaacaaatatttcttgattgtgtttgaattttgaactcgcaggatatgtataacgaggaaaataaatgatagaggaaatatatatgcaaacatctgtttaaaatatttttccagccaggcatggtggctcatggctgtaatcccatcactttgagaggctgaggcaggcagatcacttgagcccaagagtttgagaccaacctgagcaacatggtgaaactacatctctacaaaaaatacaaaaattaaccagtygtggtggcacacacctgtagtcccagctacttgggaggctgaggtgggaggatcgcctgattccagggaggttgaggctgcggtgagccatgattgtgccactgaatgccagcatgggtgacagagtgagatcctgtctcaaataataataaagtaaaatatttctccaaaaatctttggactttttgtttagtaatgacaggaaatgataaaagttctatagttgcagtttcaacaattacgaaatttcatactagagattcttgtcttttaaatcctacatagtatatttgattatcc

SEQ ID NO: 48931 - DNA, 601 bp, Human
gaggaaatatatatgcaaacatctgtttaaaatatttttccagccaggcatggtggctcatggctgtaatcccatcactttgagaggctgaggcaggcagatcacttgagcccaagagtttgagaccaacctgagcaacatggtgaaactacatctctacaaaaaatacaaaaattaaccagtcgtggtggcacacacctgtagtcccagctacttgggaggctgaggtgggaggatcgcctgattccagggaggttgaggctgcggtgagccatgattgtgccactgaatgccagcatgrgtgacagagtgagatcctgtctcaaataataataaagtaaaatatttctccaaaaatctttggactttttgtttagtaatgacaggaaatgataaaagttctatagttgcagtttcaacaattacgaaatttcatactagagattcttgtcttttaaatcctacatagtatatttgattatcctgattattaaaatgtttaatagataatctgcatagcactaagcataatatacagtgaagtcaaatggctaccttcagatacgtacagctgtgtacattggaattcttcttaaagaga

SEQ ID NO: 48932 - DNA, 601 bp, Human
tatggggaggtggaggggggagagggtgtgtcattgcatgcagaggaggggtcccagtggtgcagatgcagtgaatcattatgccagcacataggtttcaagttatagtaatgaagctatggttcctcccgtggtggagactttagcatggtaatgaggaaagtttacttgggttcatttataaattgtcagtgtttgtcgggagctggttccagctgactaggtgaccacattccacacaaagtgtgggaaagagcaggctgcaaggcaggaggctgtaaaacaggctgattgctcaagytgattaaattcctgtagtatctggaaaccctccttgtctgcttagaggaagtggaggtgaaggaagtaaaggagttcagacaacttaaacccaagacagctttatttggagagtttggcatgaagccctttaaaaatgagtttagggtaaataatcattataaattccattaattaataacaaagtattaactactgtgtttagaagaagtagggatataaatggacagtttttgcaggctactgggaaactttataaaaactactcattcttaccttgttttttttccctttttatcaa

SEQ ID NO: 48933 - DNA, 601 bp, Human
ttatctaattcttagccatcattcaggattgtcccaggtttcaatactgtcatttgtagcaaaaggaatcacatttggtttttgtgtctctttagcttctttcagtctggaacagctcctctttctttgacttttaagacctgacatatttatattataggtcagttattttgtggaatgctctgcagtttggattctagctcagttttaatatttagggaagactcattataaaataaatttttcccaactctccttgatttaacttgaatgcacatgcaaataatgaaaaacccacagyaactattagtcaccaaatgaggaatttaaaaataatattgattggccgggcgtggtggctcacacctgtaatcccagcactttgggaggccgaggcgggcggatcacaaagtcaggagatcgagaccatcctggctaacacgatgaaaccccgtctctactaaaaatacaaaaaattagctgggcatggtggcgggcgcctgtagtcccagctactcgggaggctgaggcaggagaatggcgtgaacccgggaggtggagcttgcagtgagccaagatcgtgccactgcactccagcctg

SEQ ID NO: 48934 - DNA, 601 bp, Human
attgattggccgggcgtggtggctcacacctgtaatcccagcactttgggaggccgaggcgggcggatcacaaagtcaggagatcgagaccatcctggctaacacgatgaaaccccgtctctactaaaaatacaaaaaattagctgggcatggtggcgggcgcctgtagtcccagctactcgggaggctgaggcaggagaatggcgtgaacccgggaggtggagcttgcagtgagccaagatcgtgccactgcactccagcctgggcgacagagctagactccgtctcaaaaaaaaaaaaagaaataatattgactgaacaaaactcttatagattgaatataaatgtcatacataagtagactttattccctcattttaaagagtaatatacaattttaagtcttcagttttcagacattcacaaatgagaaagatgagttgaacccagctattgcttttcttctcttttatagctattatcttcctaaaaagttcacccagtgtaatattgaagagtatcatgacttcctgaatagtggaggtggtgcctgccttttcaacaaaccttctaaggtaataagtgtggttaataaggttta

SEQ ID NO: 48935 - DNA, 601 bp, Human
gaagaaaaattattgtgagtttgtacatttattttagaaaatatcctgttactttcaggaaagtgacaccgttttctgatgttttgaaaatgtttatattccttaggaatgtgtccttgaaggagcagagtgttgtaagaaatgcaccttgactcaagactctcaatgcagtgacggtctttgctgtaaaaagtgcaaggtaaataaacattaatgaccatttgacagaaaaaaaggacatacttgattaaatcattaaggctgggtaaatataatctaataacagaaatagtatctaacrtatattaaatgagtaagtgccaggtgctttataggatcttcacaaaatcttgtgtggtgtagttgcttattattattcccatctaaaagatgagaatactaaggcttgtagtggttaagtagtttgcccaaggtcttacaccaagtaagttggggaactagggcctgaaccctgttaatcttcagaggctgtcctttccatactttctgtggagcatgcacattaaatgaaaccaggtgttactaatgtttaaatgatgtttacctttcttggtaaagccaaggagactttcagtagatc

SEQ ID NO: 48936 - DNA, 601 bp, Human
aaggacatacttgattaaatcattaaggctgggtaaatataatctaataacagaaatagtatctaacatatattaaatgagtaagtgccaggtgctttataggatcttcacaaaatcttgtgtggtgtagttgcttattattattcccatctaaaagatgagaatactaaggcttgtagtggttaagtagtttgcccaaggtcttacaccaagtaagttggggaactagggcctgaaccctgttaatcttcagaggctgtcctttccatactttctgtggagcatgcacattaaatgaaaycaggtgttactaatgtttaaatgatgtttacctttcttggtaaagccaaggagactttcagtagatcttttcttgttgctcagcttggtgtatctcttgcattagctgctgaggaaacaagggagtactttgagacatgataataccatgcatatattattggtcctgcaagtttagaatgcatctttacacactttatgttttcatcctcccagcagcatcctcatacctatctccaaatatttaagcctttacatcaatactaacatttgaggcttacttcccctaaagaaatctaat

SEQ ID NO: 48937 - DNA, 601 bp, Human
ttgtgtggtgtagttgcttattattattcccatctaaaagatgagaatactaaggcttgtagtggttaagtagtttgcccaaggtcttacaccaagtaagttggggaactagggcctgaaccctgttaatcttcagaggctgtcctttccatactttctgtggagcatgcacattaaatgaaaccaggtgttactaatgtttaaatgatgtttacctttcttggtaaagccaaggagactttcagtagatcttttcttgttgctcagcttggtgtatctcttgcattagctgctgaggaarcaagggagtactttgagacatgataataccatgcatatattattggtcctgcaagtttagaatgcatctttacacactttatgttttcatcctcccagcagcatcctcatacctatctccaaatatttaagcctttacatcaatactaacatttgaggcttacttcccctaaagaaatctaattcttgttttctcatacaaaatctggtgtaatagtctacgttatttctatctgtctctcactttactctgtacatttcatggagcagagccaggcacttagacagtaattggtataca

SEQ ID NO: 48938 - DNA, 601 bp, Human
ggctttgtgatcataaagtttctgttgcagctcagctctgcctttgaaagcagcctttgaaaatacagaaacaaatgggcatagctgtgttccaataaaactttatttataaagataggcaatcagtgaagtttgacccatgggccacagtttgcagaccactgctgttaaagagtgcttgtttacttgtttattacttttcttctcccattataatacaagggtatttattggcaaggattttggttgatttatatactgctgtatcctagcacttagtgcaaatcctccctccctattytttcttttagaagtttcctggaacttcttgaacattatgcactcctctaaactaccccaaatttgctcatatttctaccctagatattctaaaatgttggcttgtcttagtcccaaggaagaagagaaacgtgaaattaaattttcttatttccttatttttaacccacattaagatgcaagttcctgatgagcagggttcttgtgttttgttctccattgagttcccagtagttagaacagtgcttggcacgttattaaatatttgatgaatggatgaatgaatacatattttgtttgg

SEQ ID NO: 48939 - DNA, 601 bp, Human
gaaatcttatcaaaataggaagatcaatttaaatgtttgtaatcaattctgaagataaaaggcctctctactattcatctattatttttcccaatcatagtttctttttcagttatctgacataagcagatattgcatcgctaatgggtatttgcttttccgttttagggaatttgctttggaggaagatgcaaaaccagagatagacaatgcaaatacatttgggggcaaagtaagtaaatagtgtggcttgatcattgttaaagcatgatgtcaggcggacttctcaaggacgtgtgtsctggaagtaaatttttgactactttatgactgggggattctcaaagctaccacaggtcttagcaggggcatgtttctggaaattagagtaaggcacccctttgagaagcagccccacacatcttggctagttggcagtgcctgtggacgagacagaaagtgcctttgctgccaggcagatggagcccatgccagggtgcacagcttggagaatagagcaaacctggatttcagctccatgtatactcttctcagctgagtgccctgaagctaaagcttcacaaccatatgggatggacgt

SEQ ID NO: 48940 - DNA, 601 bp, Human
aaactgtttcaggagacaatttgtagtaggaaaaaggctataaaaataatgataattcttaatagttataagtaggtgccacaatccttttaggaggggaagtgtatgctctctttaagcaattggaaacattgggatgggaaaacatttagtcaggcaggtttgtactccgaaaaaagatatcatttttgttttatccacttgagcaaaaatagtagctgacaacaagaagtaggaaacataactaccgacataactattgttttttttaaaaatataccaacaattatcctttgattartttgcattttgtcctaattcttagataactctatcaactgtccctggttttagaaaagataaaagcctgaaaaagatactgatgtaccttaaaatgttatttgacttccagagatttagcatgaattcaagcttgtcttaaagcaaagtaaaattgcttttgatagctgctaagaagtggggagcaaggtagaaattgtaccactgtttcttgaatctaattacaggatataactattataataaacttgtctttatgattaacaaaatatgctgaatgagaaattcatgtattatattt

SEQ ID NO: 48941 - DNA, 601 bp, Human
actttacataagctatgccatttaatcttcatggcagtcctcccattttatggaggaggaaactgagacacagttaatttgtccgaagtcatgtatatgggatgtaataataagcagaattagaatttggagagtatgatttcagaactctctcttcaccattttgctgaatgtcatagtcttgttaacaaattaaatggaaccttagcttggcactgcacctattcaacaattgtccccaacctacactttttgtcatttcatttatattcttccaaatctagcaaaccttaccattcckaatatgtccctacctccatgcctacatttatgctctataatcctccagaagcaccctttaactcataccatcatcagccaaaaatatacctattcttcaaagcccagcttgggaaacactttctatatataaatttctttatgatttactctagaaataaattatctctctcttctttgaacttccacagccctttgtacttatttgtccgtaattttgttttataagttgtttatgtgtgtgatttatcttcttatttagagtataattttcttgtgaataaagatcatatctaattgt

SEQ ID NO: 48942 - DNA, 601 bp, Human
tgaatcaggaagaaattgatttcctgaacagaccaataacaagctccaaaattgaaccagtaataaatagcctaccaaccaaaaaaaaggccaggaccagatagactcacagctgaattctaccagatgtacgaagaagagctggcaccattcctactgaaactattcaaaaaaattgaggaggagtgactcctccctatttcattctatgaggccagtatcatcctcatacaaaaacatggcagagactctacaaaaaaagaaaatttcagcccattatccttgatgaacattgattcaraaatcctcaacaaaatacttgcaaaccaaattgagtagcacatcaaaaatcatatccaccataatcaggtaggctttgttcccgggttccaagtttggttcaacatacgcaaattagtaaatgtgatttttcacataaacagaactaaagacaaaaaccacatgattatctcaatagatgcaaaaaagggttttgataaaatccaacatcctttcatgttaaaaactctcaataaactacgtattaaaggaacatacctcaaaataagagccatctatgacaaacccacagccaacatca

SEQ ID NO: 48943 - DNA, 601 bp, Human
gagttaacttgtaaaacacttaaaacaagactgggatatggcaagtgttcaataaatgtaagctatgctatttattatgattactgtatactgggcatcattgtctgttcttgtcactatatcgctgatacctgacatatgatatagcaactgatgcttgaagaagccaggcgacctgattaaggtcccttagtaagacaggagtgatatggtgaatcaaatccaggccttttgattttaagcctaaacctttttcgttctgcctatttgttaatctgtagctctgattgaggctgtgttrtagttacatttagatgtggatgtatgttatgttcctgaaaattagatcagacaagacagaaacccctgtagtaaaaacctgtctcaggaggaactttgctcatcttcaacctaacttaactctctcctgcttctctattcaaggttgttttgaattagatttaggtgtatattctgtttcctgagtggactaatgaagagagattattttcctataatataaaaaaaaatggtgtcaattttatatgaatcttttttctatactcaattcgtgggagttcttagttcccctgaccctgac

SEQ ID NO: 48944 - DNA, 601 bp, Human
atgatatagcaactgatgcttgaagaagccaggcgacctgattaaggtcccttagtaagacaggagtgatatggtgaatcaaatccaggccttttgattttaagcctaaacctttttcgttctgcctatttgttaatctgtagctctgattgaggctgtgttatagttacatttagatgtggatgtatgttatgttcctgaaaattagatcagacaagacagaaacccctgtagtaaaaacctgtctcaggaggaactttgctcatcttcaacctaacttaactctctcctgcttctctaytcaaggttgttttgaattagatttaggtgtatattctgtttcctgagtggactaatgaagagagattattttcctataatataaaaaaaaatggtgtcaattttatatgaatcttttttctatactcaattcgtgggagttcttagttcccctgaccctgacatagctagtatctacagcatgggttgaagtgctaaggttgtatagccttgtggaactttcttctcagcccactgcaaaacatcaggtctcccctcttcatcagacttttatttcattttgcttcctaaaaaatgaata

SEQ ID NO: 48945 - DNA, 601 bp, Human
ttgaagtgctaaggttgtatagccttgtggaactttcttctcagcccactgcaaaacatcaggtctcccctcttcatcagacttttatttcattttgcttcctaaaaaatgaataacatttttgcatgaagacccttactatggaaggaaggaaacctttgtattagataattgacagatgattatatttctgcttagctttttaaatcttccttataaaatttaagttagtgaaagtcaaaacaataatttctttgattttttttttagatgtagatcaatttctctgttaaaattcatygttccctttgggtcagttgttggtctctaggaaacatttgcttgaggtactggagggagaaataatgtaattagtattaagaagaacatactaataattttttggaattaccacattctaagcatataataataagaaattagtgtttatttttcatgcttctgtaccagagagttgacatttactctagcttgattttggatctcaggtttgcagtaatgagctgaagtgtgtgtgtaacagacactggataggttctgattgcaacacttacttccctcacaatgatgatgcaaagac

SEQ ID NO: 48946 - DNA, 601 bp, Human
gaagtctgtggacatgttttctcccttaagaagcttgtattcactttgagagagacaaaatataacacacacaaaaccgagagcagtaaggaccttgcgttagttgtcaaaatggagtgatatgcacaataacatttctagaatttctgagaaagaggtaaggatcaaaaggaacacagattttctacaagttcctccctaagtttcattactcttccctcttttagtttaatgacatcatggtttctggaaaatacaactgtgcaaaatgcacttggacaagaattaaaaaggacatttrccaaaaattatttttaaaacaactgatatggattgctgaattatggttgattttttctttcctttgaaaaatactcatttttgaaaacaaacagtgttgttagtgtgatgattacaaaactgaacaataaagtttctgaaaggattttataccactgatcttccttctttcttttttttcctctcaggtgttgctggcaccaatatcataataggcataattgctggcaccattttagtgctggccctcatattaggaataactgcgtggggttataagtaagtgaaatgtctcagtctt

SEQ ID NO: 48947 - DNA, 601 bp, Human
agctaaataaactctttcataattttgacctcacaagcaattgccatatatacttacaaaagtgttacctttggcgcagttggcttaagaccatgttaggtgataataataagttcatagcagatgcttaaaacctatgggcctctttggtgtgcaggttactgggtgtatttcacctcagcataacatttggagttatcaaatcatatatctgataggaaggcttctctttttgtcatttgatttctcctcacaccagaagcaaattagctctgtgttggaatcacaccatttctccaamttaatgcatgatttaagtagtaattgtcatcacaagcattattgtgttgaagtagctcagttgtttcatttggctgtgtgaaaatggaaagaaaaaattgttccttctggagtgtgtgattttctgccacctagtgatggaagtggatatttcatttttacaatcttggaaaaacctaccttttagaaacctaaacgctcatattacttattaaattatgtgtctatttgcctttattgattagaatgaaaatcactttttttctgcaggtgacttcttatttttatggcattcttttga

SEQ ID NO: 48948 - DNA, 601 bp, Human
cttaggagatccttaacagtcacgaattgactcactcctatttatcatacctgatgaaataaaatgttctggtattcatttatattcccctatttgaaattcttaggaataactatagtttggggtttatattccattaggaatgaattataattttatttctgtaaaaagttatttatataagtaacttgattcattaatttcattaagtcaatgtatgtttgaagacctgtgtttgaaataagatttactttagagcagtgattgatgttgagaaaacaattactctttaatgactgcwgcatatttatgtttttaaaagtggacaattgtttgacaatattgtcactgactctttgttgcttctcctgatgatgaggtgacatttttgtgtgtgcattcccattttaattctgtaattcagaatcctctagtgaagacttttcaatgaaagctagagcttttatgtttagagctccctcttgatgtccttccagaggtaactaactcttatgtttttccctctttctcttcttgtccatgaaaagaaactatcgagaacagaggtatgtaatacaaataatgtgaacataaaactgaa

SEQ ID NO: 48949 - DNA, 601 bp, Human
aggtaactgcacatttaaagaaagaatttgcatagttggaataataaaaatgcctatattcttgagaaagtcagacaccctgtatagcataaccgtaaaaatctatgtttaaccaacagcttaaaagagatacaaaatgttcatgttgttctataacaattgcctattttatctgaatctaaattagcacataatattggaatgcactcttcacttttcccacttaaaaagttactagtgctgttagctattgataaaaaatattaaaatattatcctggaaactgataacctagaccagstcttacacatgataatggtatttagttctatactcatggtatttatgcagattcctatttacttaaccttttccattgttgagttgcatgcttgtgacaggttatgaataaggtgtataaatgtggtaatttgtcatgctccatcacaactttcatttttttcacaaatcaaaaatttaaactttactcttttttaaataaattaaaattcccataaggctttaaccataggtatctgtagaatctgtataaatatatagtgcccatgggttaccatttgaaatcctggtcagtttgtgt

SEQ ID NO: 48950 - DNA, 601 bp, Human
cataatattggaatgcactcttcacttttcccacttaaaaagttactagtgctgttagctattgataaaaaatattaaaatattatcctggaaactgataacctagaccaggtcttacacatgataatggtatttagttctatactcatggtatttatgcagattcctatttacttaaccttttccattgttgagttgcatgcttgtgacaggttatgaataaggtgtataaatgtggtaatttgtcatgctccatcacaactttcatttttttcacaaatcaaaaatttaaactttactyttttttaaataaattaaaattcccataaggctttaaccataggtatctgtagaatctgtataaatatatagtgcccatgggttaccatttgaaatcctggtcagtttgtgtagacaacagaaaatattgacctttccctagagtgactaactcatcattaatggaaaaagtaaaactgggacaaaattacaatttaagaacaaccagatttcttcatgatgtgttttaaactcttgtgtccaaaagcgcttgcttagagcaggagccgccgtttagactttctgttgggtagaggttgat

SEQ ID NO: 48951 - DNA, 601 bp, Human
tgtcttataatgggcagaattgtggaacaaaggagccatagccttagacattaggtaattagaatgatggttatatttatcctttcatttaaaatattcaggaaggaaaacttccccaattttttcagttgatattattgtttatattatagcacaattgctttaggtcttagaagctatatgacttgtaatgagaattataagtggattttagtttttagggtaagtttgcaaatagcaatagaataagaaacagtaactgaacttagatacataaaacattcatatttagctgaaatcktattctcttcctttgtctgagatgaacacacaccattatgattgatgagaaatataaaaaataattagattatatctttttgatttatggtttcactttaagcagaatgccctccccttccccatttcttttctctctcacctgttttagccactttattttctacttgtgaacttctcatcttttttccaaacctttcttagtttgtttttatattattattattatttcggtgatattcctgcatctgtcaatgttacttggtacacattatacagtatttcttaaaacagtaaagta

SEQ ID NO: 48952 - DNA, 601 bp, Human
atgaaataagaaagcactcaagatttaggaagaaagccgtaaagataataaaggactggaaaaagaagtttgatttaaaattttaaaaggatcatttacttagtcatttatgacaacaaatgatgaaaagttattttatttaccatgggggcttgatattctctgttaaagcaagaagaattagctttgttatgatatgtaattaataattgtaaaaaagacaaatttctaaatgaaggatgttaaacattattattagtagtagtattgttattattatttttttgagatggagtttcgstctgtcacccaagctggagtgcagtggcgcgatctcggctcactgcaacctccgcctcccaggttcaagcgattctcctgcctcagcctcctgagtagctggcattacaagtgcgtgccaccacacctggctaatttttttgtatttttagtagagatggggtttcaccatgttggtcaggctggtctcgaattcctgacctcgtgatccgcccacctcagccttccagaaacattattcttaagagatctttaacgaaattcataacctatcactgacatttaccatgtgaagaaagtt

SEQ ID NO: 48953 - DNA, 601 bp, Human
ttccactgaacagttataaaattacctttttgatttaactttgaatctttccatttcttcgtatttctgttaaatgaataatgaagctctaaattgaacatcaaactctaatagtgatttatttggatgaaattctagaatagtttaaaagtcaatcagttcttttcagaccaaatccaggttgcattatgtgatgtttagaaattataaatagtttattcaccacaaagaaaaagaaagctatgcttaatctgggtagggactatctgtcctaacacaccttcgacatattttttttttwaaaaaagacaaaaatgcacttaacattttcaagtataatgaagttaccatgaaaacactcatattttcatatttttccccaaagcaaggctttattcatccaaatgataaaagacttttgtaattgcatttctggcctctacagttagaatgactttaacttgtctcatttattgataattttatgtgttgtgatagatttgattcatgtagatcattatccctacctctcttttttcctgaaataatatttgtatatgtctgtgttcatgtgtgtgtcttgttttctgactctgaaatg

SEQ ID NO: 48954 - DNA, 601 bp, Human; identical to SEQ ID NO: 48782

SEQ ID NO: 48955 - DNA, 601 bp, Human; identical to SEQ ID NO: 48783

SEQ ID NO: 48956 - DNA, 601 bp, Human; identical to SEQ ID NO: 48784

SEQ ID NO: 48957 - DNA, 601 bp, Human; identical to SEQ ID NO: 48785

SEQ ID NO: 48958 - DNA, 601 bp, Human; identical to SEQ ID NO: 48786

SEQ ID NO: 48959 - DNA, 601 bp, Human; identical to SEQ ID NO: 48787

SEQ ID NO: 48960 - DNA, 601 bp, Human; identical to SEQ ID NO: 48788

SEQ ID NO: 48961 - DNA, 601 bp, Human; identical to SEQ ID NO: 48789

SEQ ID NO: 48962 - DNA, 601 bp, Human; identical to SEQ ID NO: 48790

SEQ ID NO: 48963 - DNA, 601 bp, Human; identical to SEQ ID NO: 48791

SEQ ID NO: 48964 - DNA, 601 bp, Human; identical to SEQ ID NO: 48792

SEQ ID NO: 48965 - DNA, 601 bp, Human; identical to SEQ ID NO: 48793

SEQ ID NO: 48966 - DNA, 601 bp, Human; identical to SEQ ID NO: 48794

SEQ ID NO: 48967 - DNA, 601 bp, Human; identical to SEQ ID NO: 48795

SEQ ID NO: 48968 - DNA, 601 bp, Human; identical to SEQ ID NO: 48796

SEQ ID NO: 48969 - DNA, 601 bp, Human; identical to SEQ ID NO: 48797

SEQ ID NO: 48970 - DNA, 601 bp, Human; identical to SEQ ID NO: 48798

SEQ ID NO: 48971 - DNA, 601 bp, Human; identical to SEQ ID NO: 48799

SEQ ID NO: 48972 - DNA, 601 bp, Human; identical to SEQ ID NO: 48800

SEQ ID NO: 48973 - DNA, 601 bp, Human; identical to SEQ ID NO: 48801

SEQ ID NO: 48974 - DNA, 601 bp, Human; identical to SEQ ID NO: 48802

SEQ ID NO: 48975 - DNA, 601 bp, Human; identical to SEQ ID NO: 48803

SEQ ID NO: 48976 - DNA, 601 bp, Human; identical to SEQ ID NO: 48804

SEQ ID NO: 48977 - DNA, 601 bp, Human; identical to SEQ ID NO: 48805

SEQ ID NO: 48978 - DNA, 601 bp, Human; identical to SEQ ID NO: 48806

SEQ ID NO: 48979 - DNA, 601 bp, Human; identical to SEQ ID NO: 48807

SEQ ID NO: 48980 - DNA, 601 bp, Human; identical to SEQ ID NO: 48808

SEQ ID NO: 48981 - DNA, 601 bp, Human; identical to SEQ ID NO: 48809

SEQ ID NO: 48982 - DNA, 601 bp, Human; identical to SEQ ID NO: 48810

SEQ ID NO: 48983 - DNA, 601 bp, Human; identical to SEQ ID NO: 48811

SEQ ID NO: 48984 - DNA, 601 bp, Human; identical to SEQ ID NO: 48812

SEQ ID NO: 48985 - DNA, 601 bp, Human; identical to SEQ ID NO: 48813

SEQ ID NO: 48986 - DNA, 601 bp, Human; identical to SEQ ID NO: 48814

SEQ ID NO: 48987 - DNA, 601 bp, Human; identical to SEQ ID NO: 48815

SEQ ID NO: 48988 - DNA, 601 bp, Human; identical to SEQ ID NO: 48816

SEQ ID NO: 48989 - DNA, 601 bp, Human; identical to SEQ ID NO: 48817

SEQ ID NO: 48990 - DNA, 601 bp, Human; identical to SEQ ID NO: 48818

SEQ ID NO: 48991 - DNA, 601 bp, Human; identical to SEQ ID NO: 48819

SEQ ID NO: 48992 - DNA, 601 bp, Human; identical to SEQ ID NO: 48820

SEQ ID NO: 48993 - DNA, 601 bp, Human; identical to SEQ ID NO: 48821

SEQ ID NO: 48994 - DNA, 601 bp, Human; identical to SEQ ID NO: 48822

SEQ ID NO: 48995 - DNA, 601 bp, Human; identical to SEQ ID NO: 48823

SEQ ID NO: 48996 - DNA, 601 bp, Human; identical to SEQ ID NO: 48824

SEQ ID NO: 48997 - DNA, 601 bp, Human; identical to SEQ ID NO: 48825

SEQ ID NO: 48998 - DNA, 601 bp, Human; identical to SEQ ID NO: 48826

SEQ ID NO: 48999 - DNA, 601 bp, Human; identical to SEQ ID NO: 48827

SEQ ID NO: 49000 - DNA, 601 bp, Human; identical to SEQ ID NO: 48828

SEQ ID NO: 49001 - DNA, 601 bp, Human; identical to SEQ ID NO: 48829

SEQ ID NO: 49002 - DNA, 601 bp, Human; identical to SEQ ID NO: 48830

SEQ ID NO: 49003 - DNA, 601 bp, Human; identical to SEQ ID NO: 48831

SEQ ID NO: 49004 - DNA, 601 bp, Human; identical to SEQ ID NO: 48832

SEQ ID NO: 49005 - DNA, 601 bp, Human; identical to SEQ ID NO: 48833

SEQ ID NO: 49006 - DNA, 601 bp, Human; identical to SEQ ID NO: 48834

SEQ ID NO: 49007 - DNA, 601 bp, Human; identical to SEQ ID NO: 48835

SEQ ID NO: 49008 - DNA, 601 bp, Human; identical to SEQ ID NO: 48836

SEQ ID NO: 49009 - DNA, 601 bp, Human; identical to SEQ ID NO: 48837

SEQ ID NO: 49010 - DNA, 601 bp, Human; identical to SEQ ID NO: 48838

SEQ ID NO: 49011 - DNA, 601 bp, Human; identical to SEQ ID NO: 48839

SEQ ID NO: 49012 - DNA, 601 bp, Human; identical to SEQ ID NO: 48840

SEQ ID NO: 49013 - DNA, 601 bp, Human; identical to SEQ ID NO: 48841

SEQ ID NO: 49014 - DNA, 601 bp, Human; identical to SEQ ID NO: 48842

SEQ ID NO: 49015 - DNA, 601 bp, Human; identical to SEQ ID NO: 48843

SEQ ID NO: 49016 - DNA, 601 bp, Human; identical to SEQ ID NO: 48844

SEQ ID NO: 49017 - DNA, 601 bp, Human; identical to SEQ ID NO: 48845

SEQ ID NO: 49018 - DNA, 601 bp, Human; identical to SEQ ID NO: 48846

SEQ ID NO: 49019 - DNA, 601 bp, Human; identical to SEQ ID NO: 48847

SEQ ID NO: 49020 - DNA, 601 bp, Human; identical to SEQ ID NO: 48848

SEQ ID NO: 49021 - DNA, 601 bp, Human; identical to SEQ ID NO: 48849

SEQ ID NO: 49022 - DNA, 601 bp, Human; identical to SEQ ID NO: 48850

SEQ ID NO: 49023 - DNA, 601 bp, Human; identical to SEQ ID NO: 48851

SEQ ID NO: 49024 - DNA, 601 bp, Human; identical to SEQ ID NO: 48852

SEQ ID NO: 49025 - DNA, 601 bp, Human; identical to SEQ ID NO: 48853

SEQ ID NO: 49026 - DNA, 601 bp, Human; identical to SEQ ID NO: 48854

SEQ ID NO: 49027 - DNA, 601 bp, Human; identical to SEQ ID NO: 48855

SEQ ID NO: 49028 - DNA, 601 bp, Human; identical to SEQ ID NO: 48856

SEQ ID NO: 49029 - DNA, 601 bp, Human; identical to SEQ ID NO: 48857

SEQ ID NO: 49030 - DNA, 601 bp, Human; identical to SEQ ID NO: 48858

SEQ ID NO: 49031 - DNA, 601 bp, Human; identical to SEQ ID NO: 48859

SEQ ID NO: 49032 - DNA, 601 bp, Human; identical to SEQ ID NO: 48860

SEQ ID NO: 49033 - DNA, 601 bp, Human; identical to SEQ ID NO: 48861

SEQ ID NO: 49034 - DNA, 601 bp, Human; identical to SEQ ID NO: 48862

SEQ ID NO: 49035 - DNA, 601 bp, Human; identical to SEQ ID NO: 48863

SEQ ID NO: 49036 - DNA, 601 bp, Human; identical to SEQ ID NO: 48864

SEQ ID NO: 49037 - DNA, 601 bp, Human; identical to SEQ ID NO: 48865

SEQ ID NO: 49038 - DNA, 601 bp, Human; identical to SEQ ID NO: 48866

SEQ ID NO: 49039 - DNA, 601 bp, Human; identical to SEQ ID NO: 48867

SEQ ID NO: 49040 - DNA, 601 bp, Human; identical to SEQ ID NO: 48868

SEQ ID NO: 49041 - DNA, 601 bp, Human; identical to SEQ ID NO: 48869

SEQ ID NO: 49042 - DNA, 601 bp, Human; identical to SEQ ID NO: 48870

SEQ ID NO: 49043 - DNA, 601 bp, Human; identical to SEQ ID NO: 48871

SEQ ID NO: 49044 - DNA, 601 bp, Human; identical to SEQ ID NO: 48872

SEQ ID NO: 49045 - DNA, 601 bp, Human; identical to SEQ ID NO: 48873

SEQ ID NO: 49046 - DNA, 601 bp, Human; identical to SEQ ID NO: 48874

SEQ ID NO: 49047 - DNA, 601 bp, Human; identical to SEQ ID NO: 48875

SEQ ID NO: 49048 - DNA, 601 bp, Human; identical to SEQ ID NO: 48876

SEQ ID NO: 49049 - DNA, 601 bp, Human; identical to SEQ ID NO: 48877

SEQ ID NO: 49050 - DNA, 601 bp, Human; identical to SEQ ID NO: 48878

SEQ ID NO: 49051 - DNA, 601 bp, Human; identical to SEQ ID NO: 48879

SEQ ID NO: 49052 - DNA, 601 bp, Human; identical to SEQ ID NO: 48880

SEQ ID NO: 49053 - DNA, 601 bp, Human; identical to SEQ ID NO: 48881

SEQ ID NO: 49054 - DNA, 601 bp, Human; identical to SEQ ID NO: 48882

SEQ ID NO: 49055 - DNA, 601 bp, Human; identical to SEQ ID NO: 48883

SEQ ID NO: 49056 - DNA, 601 bp, Human; identical to SEQ ID NO: 48884

SEQ ID NO: 49057 - DNA, 601 bp, Human; identical to SEQ ID NO: 48885

SEQ ID NO: 49058 - DNA, 601 bp, Human; identical to SEQ ID NO: 48886

SEQ ID NO: 49059 - DNA, 601 bp, Human; identical to SEQ ID NO: 48887

SEQ ID NO: 49060 - DNA, 601 bp, Human; identical to SEQ ID NO: 48888

SEQ ID NO: 49061 - DNA, 601 bp, Human; identical to SEQ ID NO: 48889

SEQ ID NO: 49062 - DNA, 601 bp, Human; identical to SEQ ID NO: 48890

SEQ ID NO: 49063 - DNA, 601 bp, Human; identical to SEQ ID NO: 48891

SEQ ID NO: 49064 - DNA, 601 bp, Human; identical to SEQ ID NO: 48892

SEQ ID NO: 49065 - DNA, 601 bp, Human; identical to SEQ ID NO: 48893

SEQ ID NO: 49066 - DNA, 601 bp, Human; identical to SEQ ID NO: 48894

SEQ ID NO: 49067 - DNA, 601 bp, Human; identical to SEQ ID NO: 48895

SEQ ID NO: 49068 - DNA, 601 bp, Human; identical to SEQ ID NO: 48896

SEQ ID NO: 49069 - DNA, 601 bp, Human; identical to SEQ ID NO: 48897

SEQ ID NO: 49070 - DNA, 601 bp, Human; identical to SEQ ID NO: 48898

SEQ ID NO: 49071 - DNA, 601 bp, Human; identical to SEQ ID NO: 48899

SEQ ID NO: 49072 - DNA, 601 bp, Human; identical to SEQ ID NO: 48900

SEQ ID NO: 49073 - DNA, 601 bp, Human; identical to SEQ ID NO: 48901

SEQ ID NO: 49074 - DNA, 601 bp, Human; identical to SEQ ID NO: 48902

SEQ ID NO: 49075 - DNA, 601 bp, Human; identical to SEQ ID NO: 48903

SEQ ID NO: 49076 - DNA, 601 bp, Human; identical to SEQ ID NO: 48904

SEQ ID NO: 49077 - DNA, 601 bp, Human; identical to SEQ ID NO: 48905

SEQ ID NO: 49078 - DNA, 601 bp, Human; identical to SEQ ID NO: 48906

SEQ ID NO: 49079 - DNA, 601 bp, Human; identical to SEQ ID NO: 48907

SEQ ID NO: 49080 - DNA, 601 bp, Human; identical to SEQ ID NO: 48908

SEQ ID NO: 49081 - DNA, 601 bp, Human; identical to SEQ ID NO: 48909

SEQ ID NO: 49082 - DNA, 601 bp, Human; identical to SEQ ID NO: 48910

SEQ ID NO: 49083 - DNA, 601 bp, Human; identical to SEQ ID NO: 48911

SEQ ID NO: 49084 - DNA, 601 bp, Human; identical to SEQ ID NO: 48912

SEQ ID NO: 49085 - DNA, 601 bp, Human; identical to SEQ ID NO: 48913

SEQ ID NO: 49086 - DNA, 601 bp, Human; identical to SEQ ID NO: 48914

SEQ ID NO: 49087 - DNA, 601 bp, Human; identical to SEQ ID NO: 48915

SEQ ID NO: 49088 - DNA, 601 bp, Human; identical to SEQ ID NO: 48916

SEQ ID NO: 49089 - DNA, 601 bp, Human; identical to SEQ ID NO: 48917

SEQ ID NO: 49090 - DNA, 601 bp, Human; identical to SEQ ID NO: 48918

SEQ ID NO: 49091 - DNA, 601 bp, Human; identical to SEQ ID NO: 48919

SEQ ID NO: 49092 - DNA, 601 bp, Human; identical to SEQ ID NO: 48920

SEQ ID NO: 49093 - DNA, 601 bp, Human; identical to SEQ ID NO: 48921

SEQ ID NO: 49094 - DNA, 601 bp, Human; identical to SEQ ID NO: 48922

SEQ ID NO: 49095 - DNA, 601 bp, Human; identical to SEQ ID NO: 48923

SEQ ID NO: 49096 - DNA, 601 bp, Human; identical to SEQ ID NO: 48924

SEQ ID NO: 49097 - DNA, 601 bp, Human; identical to SEQ ID NO: 48925

SEQ ID NO: 49098 - DNA, 601 bp, Human; identical to SEQ ID NO: 48926

SEQ ID NO: 49099 - DNA, 601 bp, Human; identical to SEQ ID NO: 48927

SEQ ID NO: 49100 - DNA, 601 bp, Human; identical to SEQ ID NO: 48928

SEQ ID NO: 49101 - DNA, 601 bp, Human; identical to SEQ ID NO: 48929

SEQ ID NO: 49102 - DNA, 601 bp, Human; identical to SEQ ID NO: 48930

SEQ ID NO: 49103 - DNA, 601 bp, Human; identical to SEQ ID NO: 48931

SEQ ID NO: 49104 - DNA, 601 bp, Human; identical to SEQ ID NO: 48932

SEQ ID NO: 49105 - DNA, 601 bp, Human; identical to SEQ ID NO: 48933

SEQ ID NO: 49106 - DNA, 601 bp, Human; identical to SEQ ID NO: 48934

SEQ ID NO: 49107 - DNA, 601 bp, Human; identical to SEQ ID NO: 48935

SEQ ID NO: 49108 - DNA, 601 bp, Human; identical to SEQ ID NO: 48936

SEQ ID NO: 49109 - DNA, 601 bp, Human; identical to SEQ ID NO: 48937

SEQ ID NO: 49110 - DNA, 601 bp, Human; identical to SEQ ID NO: 48938

SEQ ID NO: 49111 - DNA, 601 bp, Human; identical to SEQ ID NO: 48939

SEQ ID NO: 49112 - DNA, 601 bp, Human; identical to SEQ ID NO: 48940

SEQ ID NO: 49113 - DNA, 601 bp, Human; identical to SEQ ID NO: 48941

SEQ ID NO: 49114 - DNA, 601 bp, Human; identical to SEQ ID NO: 48942

SEQ ID NO: 49115 - DNA, 601 bp, Human; identical to SEQ ID NO: 48943

SEQ ID NO: 49116 - DNA, 601 bp, Human; identical to SEQ ID NO: 48944

SEQ ID NO: 49117 - DNA, 601 bp, Human; identical to SEQ ID NO: 48945

SEQ ID NO: 49118 - DNA, 601 bp, Human; identical to SEQ ID NO: 48946

SEQ ID NO: 49119 - DNA, 601 bp, Human; identical to SEQ ID NO: 48947

SEQ ID NO: 49120 - DNA, 601 bp, Human; identical to SEQ ID NO: 48948

SEQ ID NO: 49121 - DNA, 601 bp, Human; identical to SEQ ID NO: 48949

SEQ ID NO: 49122 - DNA, 601 bp, Human; identical to SEQ ID NO: 48950

SEQ ID NO: 49123 - DNA, 601 bp, Human; identical to SEQ ID NO: 48951

SEQ ID NO: 49124 - DNA, 601 bp, Human; identical to SEQ ID NO: 48952

SEQ ID NO: 49125 - DNA, 601 bp, Human; identical to SEQ ID NO: 48953

SEQ ID NO: 49126 - DNA, 601 bp, Human; identical to SEQ ID NO: 48782

SEQ ID NO: 49127 - DNA, 601 bp, Human; identical to SEQ ID NO: 48783

SEQ ID NO: 49128 - DNA, 601 bp, Human; identical to SEQ ID NO: 48784

SEQ ID NO: 49129 - DNA, 601 bp, Human; identical to SEQ ID NO: 48785

SEQ ID NO: 49130 - DNA, 601 bp, Human; identical to SEQ ID NO: 48786

SEQ ID NO: 49131 - DNA, 601 bp, Human; identical to SEQ ID NO: 48787

SEQ ID NO: 49132 - DNA, 601 bp, Human; identical to SEQ ID NO: 48788

SEQ ID NO: 49133 - DNA, 601 bp, Human; identical to SEQ ID NO: 48789

SEQ ID NO: 49134 - DNA, 601 bp, Human; identical to SEQ ID NO: 48790

SEQ ID NO: 49135 - DNA, 601 bp, Human; identical to SEQ ID NO: 48791

SEQ ID NO: 49136 - DNA, 601 bp, Human; identical to SEQ ID NO: 48792

SEQ ID NO: 49137 - DNA, 601 bp, Human; identical to SEQ ID NO: 48793

SEQ ID NO: 49138 - DNA, 601 bp, Human; identical to SEQ ID NO: 48794

SEQ ID NO: 49139 - DNA, 601 bp, Human; identical to SEQ ID NO: 48795

SEQ ID NO: 49140 - DNA, 601 bp, Human; identical to SEQ ID NO: 48796

SEQ ID NO: 49141 - DNA, 601 bp, Human; identical to SEQ ID NO: 48797

SEQ ID NO: 49142 - DNA, 601 bp, Human; identical to SEQ ID NO: 48798

SEQ ID NO: 49143 - DNA, 601 bp, Human; identical to SEQ ID NO: 48799

SEQ ID NO: 49144 - DNA, 601 bp, Human; identical to SEQ ID NO: 48800

SEQ ID NO: 49145 - DNA, 601 bp, Human; identical to SEQ ID NO: 48801

SEQ ID NO: 49146 - DNA, 601 bp, Human; identical to SEQ ID NO: 48802

SEQ ID NO: 49147 - DNA, 601 bp, Human; identical to SEQ ID NO: 48803

SEQ ID NO: 49148 - DNA, 601 bp, Human; identical to SEQ ID NO: 48804

SEQ ID NO: 49149 - DNA, 601 bp, Human; identical to SEQ ID NO: 48805

SEQ ID NO: 49150 - DNA, 601 bp, Human; identical to SEQ ID NO: 48806

SEQ ID NO: 49151 - DNA, 601 bp, Human; identical to SEQ ID NO: 48807

SEQ ID NO: 49152 - DNA, 601 bp, Human; identical to SEQ ID NO: 48808

SEQ ID NO: 49153 - DNA, 601 bp, Human; identical to SEQ ID NO: 48809

SEQ ID NO: 49154 - DNA, 601 bp, Human; identical to SEQ ID NO: 48810

SEQ ID NO: 49155 - DNA, 601 bp, Human; identical to SEQ ID NO: 48811

SEQ ID NO: 49156 - DNA, 601 bp, Human; identical to SEQ ID NO: 48812

SEQ ID NO: 49157 - DNA, 601 bp, Human; identical to SEQ ID NO: 48813

SEQ ID NO: 49158 - DNA, 601 bp, Human; identical to SEQ ID NO: 48814

SEQ ID NO: 49159 - DNA, 601 bp, Human; identical to SEQ ID NO: 48815

SEQ ID NO: 49160 - DNA, 601 bp, Human; identical to SEQ ID NO: 48816

SEQ ID NO: 49161 - DNA, 601 bp, Human; identical to SEQ ID NO: 48817

SEQ ID NO: 49162 - DNA, 601 bp, Human; identical to SEQ ID NO: 48818

SEQ ID NO: 49163 - DNA, 601 bp, Human; identical to SEQ ID NO: 48819

SEQ ID NO: 49164 - DNA, 601 bp, Human; identical to SEQ ID NO: 48820

SEQ ID NO: 49165 - DNA, 601 bp, Human; identical to SEQ ID NO: 48821

SEQ ID NO: 49166 - DNA, 601 bp, Human; identical to SEQ ID NO: 48822

SEQ ID NO: 49167 - DNA, 601 bp, Human; identical to SEQ ID NO: 48823

SEQ ID NO: 49168 - DNA, 601 bp, Human; identical to SEQ ID NO: 48824

SEQ ID NO: 49169 - DNA, 601 bp, Human; identical to SEQ ID NO: 48825

SEQ ID NO: 49170 - DNA, 601 bp, Human; identical to SEQ ID NO: 48826

SEQ ID NO: 49171 - DNA, 601 bp, Human; identical to SEQ ID NO: 48827

SEQ ID NO: 49172 - DNA, 601 bp, Human; identical to SEQ ID NO: 48828

SEQ ID NO: 49173 - DNA, 601 bp, Human; identical to SEQ ID NO: 48829

SEQ ID NO: 49174 - DNA, 601 bp, Human; identical to SEQ ID NO: 48830

SEQ ID NO: 49175 - DNA, 601 bp, Human; identical to SEQ ID NO: 48831

SEQ ID NO: 49176 - DNA, 601 bp, Human; identical to SEQ ID NO: 48832

SEQ ID NO: 49177 - DNA, 601 bp, Human; identical to SEQ ID NO: 48833

SEQ ID NO: 49178 - DNA, 601 bp, Human; identical to SEQ ID NO: 48834

SEQ ID NO: 49179 - DNA, 601 bp, Human; identical to SEQ ID NO: 48835

SEQ ID NO: 49180 - DNA, 601 bp, Human; identical to SEQ ID NO: 48836

SEQ ID NO: 49181 - DNA, 601 bp, Human; identical to SEQ ID NO: 48837

SEQ ID NO: 49182 - DNA, 601 bp, Human; identical to SEQ ID NO: 48838

SEQ ID NO: 49183 - DNA, 601 bp, Human; identical to SEQ ID NO: 48839

SEQ ID NO: 49184 - DNA, 601 bp, Human; identical to SEQ ID NO: 48840

SEQ ID NO: 49185 - DNA, 601 bp, Human; identical to SEQ ID NO: 48841

SEQ ID NO: 49186 - DNA, 601 bp, Human; identical to SEQ ID NO: 48842

SEQ ID NO: 49187 - DNA, 601 bp, Human; identical to SEQ ID NO: 48843

SEQ ID NO: 49188 - DNA, 601 bp, Human; identical to SEQ ID NO: 48844

SEQ ID NO: 49189 - DNA, 601 bp, Human; identical to SEQ ID NO: 48845

SEQ ID NO: 49190 - DNA, 601 bp, Human; identical to SEQ ID NO: 48846

SEQ ID NO: 49191 - DNA, 601 bp, Human; identical to SEQ ID NO: 48847

SEQ ID NO: 49192 - DNA, 601 bp, Human; identical to SEQ ID NO: 48848

SEQ ID NO: 49193 - DNA, 601 bp, Human; identical to SEQ ID NO: 48849

SEQ ID NO: 49194 - DNA, 601 bp, Human; identical to SEQ ID NO: 48850

SEQ ID NO: 49195 - DNA, 601 bp, Human; identical to SEQ ID NO: 48851

SEQ ID NO: 49196 - DNA, 601 bp, Human; identical to SEQ ID NO: 48852

SEQ ID NO: 49197 - DNA, 601 bp, Human; identical to SEQ ID NO: 48853

SEQ ID NO: 49198 - DNA, 601 bp, Human; identical to SEQ ID NO: 48854

SEQ ID NO: 49199 - DNA, 601 bp, Human; identical to SEQ ID NO: 48855

SEQ ID NO: 49200 - DNA, 601 bp, Human; identical to SEQ ID NO: 48856

SEQ ID NO: 49201 - DNA, 601 bp, Human; identical to SEQ ID NO: 48857

SEQ ID NO: 49202 - DNA, 601 bp, Human; identical to SEQ ID NO: 48858

SEQ ID NO: 49203 - DNA, 601 bp, Human; identical to SEQ ID NO: 48859

SEQ ID NO: 49204 - DNA, 601 bp, Human; identical to SEQ ID NO: 48860

SEQ ID NO: 49205 - DNA, 601 bp, Human; identical to SEQ ID NO: 48861

SEQ ID NO: 49206 - DNA, 601 bp, Human; identical to SEQ ID NO: 48862

SEQ ID NO: 49207 - DNA, 601 bp, Human; identical to SEQ ID NO: 48863

SEQ ID NO: 49208 - DNA, 601 bp, Human; identical to SEQ ID NO: 48864

SEQ ID NO: 49209 - DNA, 601 bp, Human; identical to SEQ ID NO: 48865

SEQ ID NO: 49210 - DNA, 601 bp, Human; identical to SEQ ID NO: 48866

SEQ ID NO: 49211 - DNA, 601 bp, Human; identical to SEQ ID NO: 48867

SEQ ID NO: 49212 - DNA, 601 bp, Human; identical to SEQ ID NO: 48868

SEQ ID NO: 49213 - DNA, 601 bp, Human; identical to SEQ ID NO: 48869

SEQ ID NO: 49214 - DNA, 601 bp, Human; identical to SEQ ID NO: 48870

SEQ ID NO: 49215 - DNA, 601 bp, Human; identical to SEQ ID NO: 48871

SEQ ID NO: 49216 - DNA, 601 bp, Human; identical to SEQ ID NO: 48872

SEQ ID NO: 49217 - DNA, 601 bp, Human; identical to SEQ ID NO: 48873

SEQ ID NO: 49218 - DNA, 601 bp, Human; identical to SEQ ID NO: 48874

SEQ ID NO: 49219 - DNA, 601 bp, Human; identical to SEQ ID NO: 48875

SEQ ID NO: 49220 - DNA, 601 bp, Human; identical to SEQ ID NO: 48876

SEQ ID NO: 49221 - DNA, 601 bp, Human; identical to SEQ ID NO: 48877

SEQ ID NO: 49222 - DNA, 601 bp, Human; identical to SEQ ID NO: 48878

SEQ ID NO: 49223 - DNA, 601 bp, Human; identical to SEQ ID NO: 48879

SEQ ID NO: 49224 - DNA, 601 bp, Human; identical to SEQ ID NO: 48880

SEQ ID NO: 49225 - DNA, 601 bp, Human; identical to SEQ ID NO: 48881

SEQ ID NO: 49226 - DNA, 601 bp, Human; identical to SEQ ID NO: 48882

SEQ ID NO: 49227 - DNA, 601 bp, Human; identical to SEQ ID NO: 48883

SEQ ID NO: 49228 - DNA, 601 bp, Human; identical to SEQ ID NO: 48884

SEQ ID NO: 49229 - DNA, 601 bp, Human; identical to SEQ ID NO: 48885

SEQ ID NO: 49230 - DNA, 601 bp, Human; identical to SEQ ID NO: 48886

SEQ ID NO: 49231 - DNA, 601 bp, Human; identical to SEQ ID NO: 48887

SEQ ID NO: 49232 - DNA, 601 bp, Human; identical to SEQ ID NO: 48888

SEQ ID NO: 49233 - DNA, 601 bp, Human; identical to SEQ ID NO: 48889

SEQ ID NO: 49234 - DNA, 601 bp, Human; identical to SEQ ID NO: 48890

SEQ ID NO: 49235 - DNA, 601 bp, Human; identical to SEQ ID NO: 48891

SEQ ID NO: 49236 - DNA, 601 bp, Human; identical to SEQ ID NO: 48892

SEQ ID NO: 49237 - DNA, 601 bp, Human; identical to SEQ ID NO: 48893

SEQ ID NO: 49238 - DNA, 601 bp, Human; identical to SEQ ID NO: 48894

SEQ ID NO: 49239 - DNA, 601 bp, Human; identical to SEQ ID NO: 48895

SEQ ID NO: 49240 - DNA, 601 bp, Human; identical to SEQ ID NO: 48896

SEQ ID NO: 49241 - DNA, 601 bp, Human; identical to SEQ ID NO: 48897

SEQ ID NO: 49242 - DNA, 601 bp, Human; identical to SEQ ID NO: 48898

SEQ ID NO: 49243 - DNA, 601 bp, Human; identical to SEQ ID NO: 48899

SEQ ID NO: 49244 - DNA, 601 bp, Human; identical to SEQ ID NO: 48900

SEQ ID NO: 49245 - DNA, 601 bp, Human; identical to SEQ ID NO: 48901

SEQ ID NO: 49246 - DNA, 601 bp, Human; identical to SEQ ID NO: 48902

SEQ ID NO: 49247 - DNA, 601 bp, Human; identical to SEQ ID NO: 48903

SEQ ID NO: 49248 - DNA, 601 bp, Human; identical to SEQ ID NO: 48904

SEQ ID NO: 49249 - DNA, 601 bp, Human; identical to SEQ ID NO: 48905

SEQ ID NO: 49250 - DNA, 601 bp, Human; identical to SEQ ID NO: 48906

SEQ ID NO: 49251 - DNA, 601 bp, Human; identical to SEQ ID NO: 48907

SEQ ID NO: 49252 - DNA, 601 bp, Human; identical to SEQ ID NO: 48908

SEQ ID NO: 49253 - DNA, 601 bp, Human; identical to SEQ ID NO: 48909

SEQ ID NO: 49254 - DNA, 601 bp, Human; identical to SEQ ID NO: 48910

SEQ ID NO: 49255 - DNA, 601 bp, Human; identical to SEQ ID NO: 48911

SEQ ID NO: 49256 - DNA, 601 bp, Human; identical to SEQ ID NO: 48912

SEQ ID NO: 49257 - DNA, 601 bp, Human; identical to SEQ ID NO: 48913

SEQ ID NO: 49258 - DNA, 601 bp, Human; identical to SEQ ID NO: 48914

SEQ ID NO: 49259 - DNA, 601 bp, Human; identical to SEQ ID NO: 48915

SEQ ID NO: 49260 - DNA, 601 bp, Human; identical to SEQ ID NO: 48916

SEQ ID NO: 49261 - DNA, 601 bp, Human; identical to SEQ ID NO: 48917

SEQ ID NO: 49262 - DNA, 601 bp, Human; identical to SEQ ID NO: 48918

SEQ ID NO: 49263 - DNA, 601 bp, Human; identical to SEQ ID NO: 48919

SEQ ID NO: 49264 - DNA, 601 bp, Human; identical to SEQ ID NO: 48920

SEQ ID NO: 49265 - DNA, 601 bp, Human; identical to SEQ ID NO: 48921

SEQ ID NO: 49266 - DNA, 601 bp, Human; identical to SEQ ID NO: 48922

SEQ ID NO: 49267 - DNA, 601 bp, Human; identical to SEQ ID NO: 48923

SEQ ID NO: 49268 - DNA, 601 bp, Human; identical to SEQ ID NO: 48924

SEQ ID NO: 49269 - DNA, 601 bp, Human; identical to SEQ ID NO: 48925

SEQ ID NO: 49270 - DNA, 601 bp, Human; identical to SEQ ID NO: 48926

SEQ ID NO: 49271 - DNA, 601 bp, Human; identical to SEQ ID NO: 48927

SEQ ID NO: 49272 - DNA, 601 bp, Human; identical to SEQ ID NO: 48928

SEQ ID NO: 49273 - DNA, 601 bp, Human; identical to SEQ ID NO: 48929

SEQ ID NO: 49274 - DNA, 601 bp, Human; identical to SEQ ID NO: 48930

SEQ ID NO: 49275 - DNA, 601 bp, Human; identical to SEQ ID NO: 48931

SEQ ID NO: 49276 - DNA, 601 bp, Human; identical to SEQ ID NO: 48932

SEQ ID NO: 49277 - DNA, 601 bp, Human; identical to SEQ ID NO: 48933

SEQ ID NO: 49278 - DNA, 601 bp, Human; identical to SEQ ID NO: 48934

SEQ ID NO: 49279 - DNA, 601 bp, Human; identical to SEQ ID NO: 48935

SEQ ID NO: 49280 - DNA, 601 bp, Human; identical to SEQ ID NO: 48936

SEQ ID NO: 49281 - DNA, 601 bp, Human; identical to SEQ ID NO: 48937

SEQ ID NO: 49282 - DNA, 601 bp, Human; identical to SEQ ID NO: 48938

SEQ ID NO: 49283 - DNA, 601 bp, Human; identical to SEQ ID NO: 48939

SEQ ID NO: 49284 - DNA, 601 bp, Human; identical to SEQ ID NO: 48940

SEQ ID NO: 49285 - DNA, 601 bp, Human; identical to SEQ ID NO: 48941

SEQ ID NO: 49286 - DNA, 601 bp, Human; identical to SEQ ID NO: 48942

SEQ ID NO: 49287 - DNA, 601 bp, Human; identical to SEQ ID NO: 48943

SEQ ID NO: 49288 - DNA, 601 bp, Human; identical to SEQ ID NO: 48944

SEQ ID NO: 49289 - DNA, 601 bp, Human; identical to SEQ ID NO: 48945

SEQ ID NO: 49290 - DNA, 601 bp, Human; identical to SEQ ID NO: 48946

SEQ ID NO: 49291 - DNA, 601 bp, Human; identical to SEQ ID NO: 48947

SEQ ID NO: 49292 - DNA, 601 bp, Human; identical to SEQ ID NO: 48948

SEQ ID NO: 49293 - DNA, 601 bp, Human; identical to SEQ ID NO: 48949

SEQ ID NO: 49294 - DNA, 601 bp, Human; identical to SEQ ID NO: 48950

SEQ ID NO: 49295 - DNA, 601 bp, Human; identical to SEQ ID NO: 48951

SEQ ID NO: 49296 - DNA, 601 bp, Human; identical to SEQ ID NO: 48952

SEQ ID NO: 49297 - DNA, 601 bp, Human; identical to SEQ ID NO: 48953

SEQ ID NO: 49298 - DNA, 601 bp, Human
gttctttagaacttccttgtttactgtttagtgttctaacagcatttcctataacaagacttcaaaaactcctaagttaaaaaaaaaatcagtattatgttaaagctatgagcttaggacctaacgcacatttggtgtttaacaatattcatacagtgttttctagagcagttacttatttttttaaatgttgtgtataatttccactcacattgtatgattaaaattgtaatactacagatggcctttgagaaatcttgcctatgagataattaaattataatatttaatatgacattayaataggatcatctttatgagggagaagtattaaggacttcctcagatttttcagacttttctgattttggttacatgactcatgttaattaaatggatccaagtctgtaaagctgaccataattctcacataccttcttgtataggaactgtctctctatatatacacatgtatatatacatatatatatatatatttatacatacacacacacgtatatattttcttacaaggattcctgataggtagcatatcaagaattatgtttgcaaacttttaatactttccatatttaagtaa

SEQ ID NO: 49299 - DNA, 601 bp, Human
gtatgattaaaattgtaatactacagatggcctttgagaaatcttgcctatgagataattaaattataatatttaatatgacattataataggatcatctttatgagggagaagtattaaggacttcctcagatttttcagacttttctgattttggttacatgactcatgttaattaaatggatccaagtctgtaaagctgaccataattctcacataccttcttgtataggaactgtctctctatatatacacatgtatatatacatatatatatatatatttatacatacacacacacgtatatattttcttacaaggattcctgataggtagcatatcaagaattatgtttgcaaacttttaatactttccatatttaagtaatcccatttgcttctgatagtataataccatttgtgtgactacaagaggagcagaattaccacagacaaatatatcttttatttttttcatataagaggtgtttcaggtccattactcaaaattccctttagtacctcattattccaaaagatgatgaaaaattgggacatgaattaaaacatgcaccataaaggcatgctctgctaattaacaa

SEQ ID NO: 49300 - DNA, 601 bp, Human
cctcgcccagacagtcccatcccaaggcataagcccagggggctctgacagcccccagacagggagtctggatcacaggtcagtctccacctgccccttcattctgggctgccacttaatctccttacaagtcctttccttggctgagaacagggtcatttgatctttgagcgagccctcatgtttgccagaggtgctcctggtccagccagcaccagctaattttcctttgcctttccatcctggaaaacacaaagagctcccctatcccatctaacgccatttttttttgcatgtcgcrctatatgccaagtcaagccacataggtagatttactgcaatatgataaaatcccatcactccagccaccatgaccttgagatatcaggaagctcaccatgaagacattttcatgggcagatccccagaaagaacaaaaaattgggagttgttttcagtgaagaactctctggtgaagtgaccacagccttctgaaatgctccctcaaacagaggaaaaagtccatcaagtgcaagtcaagccatgttgttgtagcattcatggaatagctgtggcaccagtactttgagtttctaagatt

SEQ ID NO: 49301 - DNA, 601 bp, Human
ttagcttgaattcagtgtccataaaatggaaattagtatgaaaactatggcagaaccagagcaaaggatattatacgcatgcaaaccaaaatttaaaacaaggaaggaaaaaagacacctttatgctattgaatgcagtgtaggcagtagatcttgacctacctagtgctacccccgcccctcccactaacattcccaggctggatcagtcacagcagatgaggtacattctactgaaataaacacttttgctataaggtggcagtgtaaccagttcaatgtgggtttttaccaccttgcwccatggattaaggagcagtggatgtgtagtggtaacgtttgtgaatggaatagctactacagttatcacatctgtttttcattgatatcttatgagcagacattttttactcagctgttttcttttttcactttaaagacaaattagcaatagataggggcttgtctagtatgttcagcttagtcacaaattaccactacacatgcaaaatcaatcaagtacagcataatacagcagcagcttacatagaaatgctgattgtagggactaattagaccatttttgtatgttctcatcaga

SEQ ID NO: 49302 - DNA, 601 bp, Human; identical to SEQ ID NO: 48782

SEQ ID NO: 49303 - DNA, 601 bp, Human; identical to SEQ ID NO: 48783

SEQ ID NO: 49304 - DNA, 601 bp, Human; identical to SEQ ID NO: 48784

SEQ ID NO: 49305 - DNA, 601 bp, Human; identical to SEQ ID NO: 48785

SEQ ID NO: 49306 - DNA, 601 bp, Human; identical to SEQ ID NO: 48786

SEQ ID NO: 49307 - DNA, 601 bp, Human; identical to SEQ ID NO: 48787

SEQ ID NO: 49308 - DNA, 601 bp, Human; identical to SEQ ID NO: 48788

SEQ ID NO: 49309 - DNA, 601 bp, Human; identical to SEQ ID NO: 48789

SEQ ID NO: 49310 - DNA, 601 bp, Human; identical to SEQ ID NO: 48790

SEQ ID NO: 49311 - DNA, 601 bp, Human; identical to SEQ ID NO: 48791

SEQ ID NO: 49312 - DNA, 601 bp, Human; identical to SEQ ID NO: 48792

SEQ ID NO: 49313 - DNA, 601 bp, Human; identical to SEQ ID NO: 48793

SEQ ID NO: 49314 - DNA, 601 bp, Human; identical to SEQ ID NO: 48794

SEQ ID NO: 49315 - DNA, 601 bp, Human; identical to SEQ ID NO: 48795

SEQ ID NO: 49316 - DNA, 601 bp, Human; identical to SEQ ID NO: 48796

SEQ ID NO: 49317 - DNA, 601 bp, Human; identical to SEQ ID NO: 48797

SEQ ID NO: 49318 - DNA, 601 bp, Human; identical to SEQ ID NO: 48798

SEQ ID NO: 49319 - DNA, 601 bp, Human; identical to SEQ ID NO: 48799

SEQ ID NO: 49320 - DNA, 601 bp, Human; identical to SEQ ID NO: 48800

SEQ ID NO: 49321 - DNA, 601 bp, Human; identical to SEQ ID NO: 48801

SEQ ID NO: 49322 - DNA, 601 bp, Human; identical to SEQ ID NO: 48802

SEQ ID NO: 49323 - DNA, 601 bp, Human; identical to SEQ ID NO: 48803

SEQ ID NO: 49324 - DNA, 601 bp, Human; identical to SEQ ID NO: 48804

SEQ ID NO: 49325 - DNA, 601 bp, Human; identical to SEQ ID NO: 48805

SEQ ID NO: 49326 - DNA, 601 bp, Human; identical to SEQ ID NO: 48806

SEQ ID NO: 49327 - DNA, 601 bp, Human; identical to SEQ ID NO: 48807

SEQ ID NO: 49328 - DNA, 601 bp, Human; identical to SEQ ID NO: 48808

SEQ ID NO: 49329 - DNA, 601 bp, Human; identical to SEQ ID NO: 48809

SEQ ID NO: 49330 - DNA, 601 bp, Human; identical to SEQ ID NO: 48810

SEQ ID NO: 49331 - DNA, 601 bp, Human; identical to SEQ ID NO: 48811

SEQ ID NO: 49332 - DNA, 601 bp, Human; identical to SEQ ID NO: 48812

SEQ ID NO: 49333 - DNA, 601 bp, Human; identical to SEQ ID NO: 48813

SEQ ID NO: 49334 - DNA, 601 bp, Human; identical to SEQ ID NO: 48814

SEQ ID NO: 49335 - DNA, 601 bp, Human; identical to SEQ ID NO: 48815

SEQ ID NO: 49336 - DNA, 601 bp, Human; identical to SEQ ID NO: 48816

SEQ ID NO: 49337 - DNA, 601 bp, Human; identical to SEQ ID NO: 48817

SEQ ID NO: 49338 - DNA, 601 bp, Human; identical to SEQ ID NO: 48818

SEQ ID NO: 49339 - DNA, 601 bp, Human; identical to SEQ ID NO: 48819

SEQ ID NO: 49340 - DNA, 601 bp, Human; identical to SEQ ID NO: 48820

SEQ ID NO: 49341 - DNA, 601 bp, Human; identical to SEQ ID NO: 48821

SEQ ID NO: 49342 - DNA, 601 bp, Human; identical to SEQ ID NO: 48822

SEQ ID NO: 49343 - DNA, 601 bp, Human; identical to SEQ ID NO: 48823

SEQ ID NO: 49344 - DNA, 601 bp, Human; identical to SEQ ID NO: 48824

SEQ ID NO: 49345 - DNA, 601 bp, Human; identical to SEQ ID NO: 48825

SEQ ID NO: 49346 - DNA, 601 bp, Human; identical to SEQ ID NO: 48826

SEQ ID NO: 49347 - DNA, 601 bp, Human; identical to SEQ ID NO: 48827

SEQ ID NO: 49348 - DNA, 601 bp, Human; identical to SEQ ID NO: 48828

SEQ ID NO: 49349 - DNA, 601 bp, Human; identical to SEQ ID NO: 48829

SEQ ID NO: 49350 - DNA, 601 bp, Human; identical to SEQ ID NO: 48830

SEQ ID NO: 49351 - DNA, 601 bp, Human; identical to SEQ ID NO: 48831

SEQ ID NO: 49352 - DNA, 601 bp, Human; identical to SEQ ID NO: 48832

SEQ ID NO: 49353 - DNA, 601 bp, Human; identical to SEQ ID NO: 48833

SEQ ID NO: 49354 - DNA, 601 bp, Human; identical to SEQ ID NO: 48834

SEQ ID NO: 49355 - DNA, 601 bp, Human; identical to SEQ ID NO: 48835

SEQ ID NO: 49356 - DNA, 601 bp, Human; identical to SEQ ID NO: 48836

SEQ ID NO: 49357 - DNA, 601 bp, Human; identical to SEQ ID NO: 48837

SEQ ID NO: 49358 - DNA, 601 bp, Human; identical to SEQ ID NO: 48838

SEQ ID NO: 49359 - DNA, 601 bp, Human; identical to SEQ ID NO: 48839

SEQ ID NO: 49360 - DNA, 601 bp, Human; identical to SEQ ID NO: 48840

SEQ ID NO: 49361 - DNA, 601 bp, Human; identical to SEQ ID NO: 48841

SEQ ID NO: 49362 - DNA, 601 bp, Human; identical to SEQ ID NO: 48842

SEQ ID NO: 49363 - DNA, 601 bp, Human; identical to SEQ ID NO: 48843

SEQ ID NO: 49364 - DNA, 601 bp, Human; identical to SEQ ID NO: 48844

SEQ ID NO: 49365 - DNA, 601 bp, Human; identical to SEQ ID NO: 48845

SEQ ID NO: 49366 - DNA, 601 bp, Human; identical to SEQ ID NO: 48846

SEQ ID NO: 49367 - DNA, 601 bp, Human; identical to SEQ ID NO: 48847

SEQ ID NO: 49368 - DNA, 601 bp, Human; identical to SEQ ID NO: 48848

SEQ ID NO: 49369 - DNA, 601 bp, Human; identical to SEQ ID NO: 48849

SEQ ID NO: 49370 - DNA, 601 bp, Human; identical to SEQ ID NO: 48850

SEQ ID NO: 49371 - DNA, 601 bp, Human; identical to SEQ ID NO: 48851

SEQ ID NO: 49372 - DNA, 601 bp, Human; identical to SEQ ID NO: 48852

SEQ ID NO: 49373 - DNA, 601 bp, Human; identical to SEQ ID NO: 48853

SEQ ID NO: 49374 - DNA, 601 bp, Human; identical to SEQ ID NO: 48854

SEQ ID NO: 49375 - DNA, 601 bp, Human; identical to SEQ ID NO: 48855

SEQ ID NO: 49376 - DNA, 601 bp, Human; identical to SEQ ID NO: 48856

SEQ ID NO: 49377 - DNA, 601 bp, Human; identical to SEQ ID NO: 48857

SEQ ID NO: 49378 - DNA, 601 bp, Human; identical to SEQ ID NO: 48858

SEQ ID NO: 49379 - DNA, 601 bp, Human; identical to SEQ ID NO: 48859

SEQ ID NO: 49380 - DNA, 601 bp, Human; identical to SEQ ID NO: 48860

SEQ ID NO: 49381 - DNA, 601 bp, Human; identical to SEQ ID NO: 48861

SEQ ID NO: 49382 - DNA, 601 bp, Human; identical to SEQ ID NO: 48862

SEQ ID NO: 49383 - DNA, 601 bp, Human; identical to SEQ ID NO: 48863

SEQ ID NO: 49384 - DNA, 601 bp, Human; identical to SEQ ID NO: 48864

SEQ ID NO: 49385 - DNA, 601 bp, Human; identical to SEQ ID NO: 48865

SEQ ID NO: 49386 - DNA, 601 bp, Human; identical to SEQ ID NO: 48866

SEQ ID NO: 49387 - DNA, 601 bp, Human; identical to SEQ ID NO: 48867

SEQ ID NO: 49388 - DNA, 601 bp, Human; identical to SEQ ID NO: 48868

SEQ ID NO: 49389 - DNA, 601 bp, Human; identical to SEQ ID NO: 48869

SEQ ID NO: 49390 - DNA, 601 bp, Human; identical to SEQ ID NO: 48870

SEQ ID NO: 49391 - DNA, 601 bp, Human; identical to SEQ ID NO: 48871

SEQ ID NO: 49392 - DNA, 601 bp, Human; identical to SEQ ID NO: 48872

SEQ ID NO: 49393 - DNA, 601 bp, Human; identical to SEQ ID NO: 48873

SEQ ID NO: 49394 - DNA, 601 bp, Human; identical to SEQ ID NO: 48874

SEQ ID NO: 49395 - DNA, 601 bp, Human; identical to SEQ ID NO: 48875

SEQ ID NO: 49396 - DNA, 601 bp, Human; identical to SEQ ID NO: 48876

SEQ ID NO: 49397 - DNA, 601 bp, Human; identical to SEQ ID NO: 48877

SEQ ID NO: 49398 - DNA, 601 bp, Human; identical to SEQ ID NO: 48878

SEQ ID NO: 49399 - DNA, 601 bp, Human; identical to SEQ ID NO: 48879

SEQ ID NO: 49400 - DNA, 601 bp, Human; identical to SEQ ID NO: 48880

SEQ ID NO: 49401 - DNA, 601 bp, Human; identical to SEQ ID NO: 48881

SEQ ID NO: 49402 - DNA, 601 bp, Human; identical to SEQ ID NO: 48882

SEQ ID NO: 49403 - DNA, 601 bp, Human; identical to SEQ ID NO: 48883

SEQ ID NO: 49404 - DNA, 601 bp, Human; identical to SEQ ID NO: 48884

SEQ ID NO: 49405 - DNA, 601 bp, Human; identical to SEQ ID NO: 48885

SEQ ID NO: 49406 - DNA, 601 bp, Human; identical to SEQ ID NO: 48886

SEQ ID NO: 49407 - DNA, 601 bp, Human; identical to SEQ ID NO: 48887

SEQ ID NO: 49408 - DNA, 601 bp, Human; identical to SEQ ID NO: 48888

SEQ ID NO: 49409 - DNA, 601 bp, Human; identical to SEQ ID NO: 48889

SEQ ID NO: 49410 - DNA, 601 bp, Human; identical to SEQ ID NO: 48890

SEQ ID NO: 49411 - DNA, 601 bp, Human; identical to SEQ ID NO: 48891

SEQ ID NO: 49412 - DNA, 601 bp, Human; identical to SEQ ID NO: 48892

SEQ ID NO: 49413 - DNA, 601 bp, Human; identical to SEQ ID NO: 48893

SEQ ID NO: 49414 - DNA, 601 bp, Human; identical to SEQ ID NO: 48894

SEQ ID NO: 49415 - DNA, 601 bp, Human; identical to SEQ ID NO: 48895

SEQ ID NO: 49416 - DNA, 601 bp, Human; identical to SEQ ID NO: 48896

SEQ ID NO: 49417 - DNA, 601 bp, Human; identical to SEQ ID NO: 48897

SEQ ID NO: 49418 - DNA, 601 bp, Human; identical to SEQ ID NO: 48898

SEQ ID NO: 49419 - DNA, 601 bp, Human; identical to SEQ ID NO: 48899

SEQ ID NO: 49420 - DNA, 601 bp, Human; identical to SEQ ID NO: 48900

SEQ ID NO: 49421 - DNA, 601 bp, Human; identical to SEQ ID NO: 48901

SEQ ID NO: 49422 - DNA, 601 bp, Human; identical to SEQ ID NO: 48902

SEQ ID NO: 49423 - DNA, 601 bp, Human; identical to SEQ ID NO: 48903

SEQ ID NO: 49424 - DNA, 601 bp, Human; identical to SEQ ID NO: 48904

SEQ ID NO: 49425 - DNA, 601 bp, Human; identical to SEQ ID NO: 48905

SEQ ID NO: 49426 - DNA, 601 bp, Human; identical to SEQ ID NO: 48906

SEQ ID NO: 49427 - DNA, 601 bp, Human; identical to SEQ ID NO: 48907

SEQ ID NO: 49428 - DNA, 601 bp, Human; identical to SEQ ID NO: 48908

SEQ ID NO: 49429 - DNA, 601 bp, Human; identical to SEQ ID NO: 48909

SEQ ID NO: 49430 - DNA, 601 bp, Human; identical to SEQ ID NO: 48910

SEQ ID NO: 49431 - DNA, 601 bp, Human; identical to SEQ ID NO: 48911

SEQ ID NO: 49432 - DNA, 601 bp, Human; identical to SEQ ID NO: 48912

SEQ ID NO: 49433 - DNA, 601 bp, Human; identical to SEQ ID NO: 48913

SEQ ID NO: 49434 - DNA, 601 bp, Human; identical to SEQ ID NO: 48914

SEQ ID NO: 49435 - DNA, 601 bp, Human; identical to SEQ ID NO: 48915

SEQ ID NO: 49436 - DNA, 601 bp, Human; identical to SEQ ID NO: 48916

SEQ ID NO: 49437 - DNA, 601 bp, Human; identical to SEQ ID NO: 48917

SEQ ID NO: 49438 - DNA, 601 bp, Human; identical to SEQ ID NO: 48918

SEQ ID NO: 49439 - DNA, 601 bp, Human; identical to SEQ ID NO: 48919

SEQ ID NO: 49440 - DNA, 601 bp, Human; identical to SEQ ID NO: 48920

SEQ ID NO: 49441 - DNA, 601 bp, Human; identical to SEQ ID NO: 48921

SEQ ID NO: 49442 - DNA, 601 bp, Human; identical to SEQ ID NO: 48922

SEQ ID NO: 49443 - DNA, 601 bp, Human; identical to SEQ ID NO: 48923

SEQ ID NO: 49444 - DNA, 601 bp, Human; identical to SEQ ID NO: 48924

SEQ ID NO: 49445 - DNA, 601 bp, Human; identical to SEQ ID NO: 48925

SEQ ID NO: 49446 - DNA, 601 bp, Human; identical to SEQ ID NO: 48926

SEQ ID NO: 49447 - DNA, 601 bp, Human; identical to SEQ ID NO: 48927

SEQ ID NO: 49448 - DNA, 601 bp, Human; identical to SEQ ID NO: 48928

SEQ ID NO: 49449 - DNA, 601 bp, Human; identical to SEQ ID NO: 48929

SEQ ID NO: 49450 - DNA, 601 bp, Human; identical to SEQ ID NO: 48930

SEQ ID NO: 49451 - DNA, 601 bp, Human; identical to SEQ ID NO: 48931

SEQ ID NO: 49452 - DNA, 601 bp, Human; identical to SEQ ID NO: 48932

SEQ ID NO: 49453 - DNA, 601 bp, Human; identical to SEQ ID NO: 48933

SEQ ID NO: 49454 - DNA, 601 bp, Human; identical to SEQ ID NO: 48934

SEQ ID NO: 49455 - DNA, 601 bp, Human; identical to SEQ ID NO: 48935

SEQ ID NO: 49456 - DNA, 601 bp, Human; identical to SEQ ID NO: 48936

SEQ ID NO: 49457 - DNA, 601 bp, Human; identical to SEQ ID NO: 48937

SEQ ID NO: 49458 - DNA, 601 bp, Human; identical to SEQ ID NO: 48938

SEQ ID NO: 49459 - DNA, 601 bp, Human; identical to SEQ ID NO: 48939

SEQ ID NO: 49460 - DNA, 601 bp, Human; identical to SEQ ID NO: 48940

SEQ ID NO: 49461 - DNA, 601 bp, Human; identical to SEQ ID NO: 48941

SEQ ID NO: 49462 - DNA, 601 bp, Human; identical to SEQ ID NO: 48942

SEQ ID NO: 49463 - DNA, 601 bp, Human; identical to SEQ ID NO: 48943

SEQ ID NO: 49464 - DNA, 601 bp, Human; identical to SEQ ID NO: 48944

SEQ ID NO: 49465 - DNA, 601 bp, Human; identical to SEQ ID NO: 48945

SEQ ID NO: 49466 - DNA, 601 bp, Human; identical to SEQ ID NO: 48946

SEQ ID NO: 49467 - DNA, 601 bp, Human; identical to SEQ ID NO: 48947

SEQ ID NO: 49468 - DNA, 601 bp, Human; identical to SEQ ID NO: 48948

SEQ ID NO: 49469 - DNA, 601 bp, Human; identical to SEQ ID NO: 48949

SEQ ID NO: 49470 - DNA, 601 bp, Human; identical to SEQ ID NO: 48950

SEQ ID NO: 49471 - DNA, 601 bp, Human; identical to SEQ ID NO: 48951

SEQ ID NO: 49472 - DNA, 601 bp, Human; identical to SEQ ID NO: 48952

SEQ ID NO: 49473 - DNA, 601 bp, Human; identical to SEQ ID NO: 48953

SEQ ID NO: 49474 - DNA, 601 bp, Human; identical to SEQ ID NO: 49298

SEQ ID NO: 49475 - DNA, 601 bp, Human; identical to SEQ ID NO: 49299

SEQ ID NO: 49476 - DNA, 601 bp, Human; identical to SEQ ID NO: 49300

SEQ ID NO: 49477 - DNA, 601 bp, Human; identical to SEQ ID NO: 49301

SEQ ID NO: 49478 - DNA, 601 bp, Human
ctgagtttgtccgggaaacgcaggccctccgggagcccctccatactgtgaaacaggaaacacatacacgtcattctgccgaatcaagttttcttctttcaccactgagggcttttgtgcaaggccagacaactgcccgcctgcccgcccttcacaaggctcacctccccaccaccgggcacactctgccaacactccacccctctcttccattcacaccccgtaatttaaaaactggcgacttagaccataaagagttgctgtgaaagtgatgtctacatatgtaaagcaacttttaaaatccctattaacctgaaggttactgaggtgagtgcaaactaggtaagccaacgaatggcagggcttcaaattctccttttgttgttacagcatttatggtattttaagagcgttttatgaacgatggaaggctggagttggtaacattctgagacgggtgtagcctagggaagagtaaggtgtccggccgggctgtatctcgtgggtggcgagggaacattgcctgtctcggaaacagttcccaagacaacgcgcatcccagacgcccggcgaggctgccttcctacaggtcttttacttc

SEQ ID NO: 49479 - DNA, 601 bp, Human
caggccagggctgctgaaagctaagcaggtggagtcacttacatgctggaggcactggcaatctaagaatgctagtcttgaggtttgccatgccttgtggtttcaaagatacagatcattaacagtttaagtagatacttaaggggaaggtcttccagttttagactatattttccattcaatttcttaagctgtatttcttagagtactaccttaaaagtggtcttaggttttttatcccataatattctacagttttcacattaagattttgctatttctagcttttggtcaaaacaaractaggttgaattcataagaacaaacatctcctctggacgtgtctgggttataccaacagtatatttactgcacacagtgacctcatgaactagggaagtgtcctctctcaatgtaagatagcacctgtcaatgtaagatagcacctgtcatacaactcagaatgcagacaagtgaaaggtcttggggagctgaccttaattgcttctctgggtcaacaggccagaacacctaataaggacatggaggggctgacctagtaacagcatctgcatcaaagagaaactacactgttcacaag

SEQ ID NO: 49480 - DNA, 601 bp, Human
ggtttcactatgttgcccaggctagtcttgaactcccgggctcaagcaatcctcccacctcagtctcctaaagtgctgggattacaggtgtgagccactgtgccctgccagggatggagcatctttgcagtatttcattactctcagctcatggcagagtgttcaaaaggcaggggtagggtaagggctgaattatggagcagcaggtccagtaagtagaaaggccacttcccacttagcctgaatacattctatgaagtggaagaggaaagacctgagggatgtcatggcaaccacttatgttagcaggagcatgcccaaagctcagagaccaggagtgcaggataggccactcagggaccaggggtgcagggcagcaactcaaagccctaagtgccaccaggtcagggcagagtaggctcttggcaaataacagtaaatatcagttcctaatgtcagttaatgacccctgacctggcagattccatttcagcaccctaccttgtcctctgtgaaggaggccacccaaactgtctcactggttctaggtacacaaaacccaaatctgagaaatccactagattggcaggtaggatggaat

SEQ ID NO: 49481 - DNA, 601 bp, Human
ttatcacagacgaacaactaaattcagggaaaaaagagaagctgaattacaatcttactgactggaacacaacttctctcaccaactccacctctaggtatgactgcttccttttaaactggttaagaagggcccataggctctgagctggagtatcccacctgctcatccaattcggacctgtgctttttggtttggaagttgggtttaaaagactaatggccatataatatctgcattacaaaacactgacacctcataggcaggatggttctgtggttcagtacggccaccagagagyaggcaaatggattcaatcacataggccccatgattcaggaaatgctttctctttaatgcattgatctaaggccatcactaaatgtggctttctcaatgaaattttaaaaggactgctctctaacaatatacaacccattttgttagtcagattctaaaatctgccacacctcatctactgaaaggatgtagaataacaggccatgctgtgatctcactgcactttgataaaccctgctaataggcaggcctaccttgtttaccagctcaattgcgtaacaattaacaatttaaatgtact

SEQ ID NO: 49482 - DNA, 601 bp, Human
ttataactataaattataattaaaattattaattcaacattttgaaattatttaaattaaataatgttaattttaataatttccaaagaatctctgctgtaatttacctttactctttttcttctcttctgttcattctactagaatgcctcaaacatcttttcttctcacagaaacatacaatataatggacctagaaggaaagccctacctccagctgtttctctcaaccttatcacagacgaacaactaaattcagggaaaaaagagaagctgaattacaatcttactgactggaacrcaacttctctcaccaactccacctctaggtatgactgcttccttttaaactggttaagaagggcccataggctctgagctggagtatcccacctgctcatccaattcggacctgtgctttttggtttggaagttgggtttaaaagactaatggccatataatatctgcattacaaaacactgacacctcataggcaggatggttctgtggttcagtacggccaccagagagtaggcaaatggattcaatcacataggccccatgattcaggaaatgctttctctttaatgcattgatcta

SEQ ID NO: 49483 - DNA, 601 bp, Human
aaggcaaagaggacaagcaaaggagagctccagttggaatgttgattacattcatgcagcttcctcttgatttaaacactcatgacacattgaatgaactgaaagaaaaatcagcattatatgacagacctcaaagcacttatacggcacagcctatttctggcagcttacatttggttttctaatttgaacacgggtaaaacaacccctacaactttctaagatatgagtaaatgatagatggaaaagtttcctttttttagggaagcagtctaatataaaatccacagggtttctcacatcaaaacttcttagagaaagcagatataacttcaatggataaataatttaaataattatttgaataattatttaaattccaaataatatccaagactagaaatggccgtggtcaaagacacttaccacaaacacaaacaactggagtttatactgttgtattacgtggggatttccaaaccacacagtattaccccattactctaatggaacaccttaaacagtttattgccttaaaatctgctttattaaaacaaattgtagcatgcaagtgtatgtatgcacagaaacagaacagcta

SEQ ID NO: 49484 - DNA, 601 bp, Human
ttccaaagaatttattatcaaaactaaaacaaaacttcagttgtacataaagtaataaactttacaacagctgttaagagaaagtcgtgatgtaagtttatacatattaccgaaggcaaagaggacaagcaaaggagagctccagttggaatgttgattacattcatgcagcttcctcttgatttaaacactcatgacacattgaatgaactgaaagaaaaatcagcattatatgacagacctcaaagcacttatacggcacagcctatttctggcagcttacatttggttttctaatttgaacacgggtaaaacaacccctacaactttctaagatatgagtaaatgatagatggaaaagtttcctttttttagggaagcagtctaatataaaatccacagggtttctcacatcaaaacttcttagagaaagcagatataacttcaatggataaataatttaaataattatttgaataattatttaaattccaaataatatccaagactagaaatggccgtggtcaaagacacttaccacaaacacaaacaactggagtttatactgttgtattacgtggggatttccaaaccacacagt

SEQ ID NO: 49485 - DNA, 601 bp, Human
tcccaaaaatccaaagctgtggattttcaatggaatttgatttattaactttctcctaaaaaatgtcttatttattgaattctgatcttcccatactatcttttctataattaatgatatttaatcctcaggtcctggtttctgtcttcagcacatttactgtttctatcactaaaaaagattttgtcataacgatcttctacatgagttaatttatcttcacatcattactttaggtgcctttttaattcaccatttcacgtactttggtttctataatctcggtgaaaacatcttaatrtcccatttatctgcagagtatgcttctgacaaatttaaccactgagagcacagcacccagattctgatataaaggggaaatacctttaatagtgcaagaaaagtaggtgttacagaaccatctaaggaggacatgggatcagccacagttaggtccatgtctaaatagttttggctaaaataaggcaattggagaggaacagaaatgtaggccgataccttggcgtattagcttgaactgtaaaatgtttgatgttcgtcatgatcaccttgagtcatcagaaaatacgttttgagttta

SEQ ID NO: 49486 - DNA, 601 bp, Human
taggtgttacagaaccatctaaggaggacatgggatcagccacagttaggtccatgtctaaatagttttggctaaaataaggcaattggagaggaacagaaatgtaggccgataccttggcgtattagcttgaactgtaaaatgtttgatgttcgtcatgatcaccttgagtcatcagaaaatacgttttgagtttactctttaaatggcatagattcaacaatatctaatacattgaagaccctggtaaaattgattcaacaaatgtttgagtatgatgtgcactgcactctgtgttttrgtagattcaaaaatgaatccagccaggctcggaggctcacgcatgtaatcctagcactttgggaggctgagttaggcggatcacttgaggtcaggagtttgagaccagcctggccaacatggtgaaaccccatctctactaaaaatacaaaaatttagctgggcatggtggcgcacacttgtaatcccagctactggggaggctgaggcaggagaatctcttgaacctgggggttggaggttgcagtgagccaagattgtgccactgcactccacctgggcaacagagcgagactgtgtc

SEQ ID NO: 49487 - DNA, 601 bp, Human
tctcttgaacctgggggttggaggttgcagtgagccaagattgtgccactgcactccacctgggcaacagagcgagactgtgtctcaaaagaaaaataaaataaaaaatgaatccttatgtccatcccatcctcatgttctaacctagctagagatgacattggtacaagtaattgtgttaataatacaacatagaatgtcaagagaaaggagagattagttccagctgaggaattgtgggttttgttcacacacaactggaacacggctttgaagaatgatgaagatttgggcatgtggkaattcattcaaaaattattccaccactgtctccagtatatcagcactattttagatcctagagatacaaaaataagtaaaatataaccctctaggtattctttgtctagtggaaacctcagacaactgaataatttatgttagagtgttgtcaatgctttgacagaaatatgtagaaattgctattagaacacagagataggaatgattaactctgccgtttggaatcaacagagataaagtttgagctggatcttgaagtcttagttagcaaggcaaatagacatactaaatagaggaa

SEQ ID NO: 49488 - DNA, 601 bp, Human
agattcacattgtacattttgttattaaaaactcaactggaaattacagatattcttgaaattttcctttccacatttttaggcaaaaacctgaatctcagcatatattttattttacaaagtaaagaacttacttttcatgtagaaacatccccatcttgtggccttttaaaatattactggaaacttaaaacttgccttatagttttcattaaattaccaaggatgtgggtataaagtgggattgattttaggaattctatagaaaatcttgatgtcctagctattgtaactctatagsgtctgttacaaataactgccttagtgacattaaacttcaaataattgaatttttattaaaatttagctcatcttaaataatttcctagaacaaccataaaacttttttttttacaggattttattccttcaaatagtatattatcaaatgccttgtcatggggagtaaaaattcttcatattgatggtaaggattttataattgttttttgacagtatttgttttaagtgtccatgtctgtcctttggttcctgactttacatagtgaaattttgatagcagggatgtcttaatctgttt

SEQ ID NO: 49489 - DNA, 601 bp, Human
atagaacaatagttaccctccttaatgtggtggatattaatatttctgtggtattttcatttcttaaaaatattgatcacaactctgaattgactttatagcctactgataggtcacagtttgcagtttaaaaagcattctgggggctaagcatggaggcttatgcctctaatcccagcactttgggaggccaaggtgggcagatcacacgaggtcaggataccagcatgaccaacatggtgaaacccccatctctactaaaaatacaaaaatgcccggtgtggtggtgcatgcctgtaatcccagctacttggaaggctgatagaagagaatcacttgaagctggcaggcagaggtagcagtgagccgggatcacccccactgcagtccagcctgggtgacagagtgagactccatctcaaaataaataaataaatggatggatggatagatagcattctgggatgttatgtcagtgatcctgagaaatgttcaaggcctggcttaaggcaataacaaaggggaggggaagatttgaaagatacttaattggtttcagtgcctagtcagtgtcttgagtctagtatttactagattatta

SEQ ID NO: 49490 - DNA, 601 bp, Human
cccattcccttaaaccccagataactcctgatgcttttacattcaccatggttttgccttttccacagtgtcatatagttggaatcatacagtgtgtttccttttttgattggcttctttcacttggtaatgcttatttaaggttcctccatgtcttttcatggcttgacagctctttttaaaatctgagtaatatttcattttctatatgcagcacagtttatccatttacctactaaaggacatcttggttgcttccaagttctggcagttatgcataaagctaatgtaaatatccacrtgcagggtttttttgtggacatattgtcaactcatttgggtaaataaccaaagagtatgattgctgcttcacatagtaagactaggtttagttttgttataatatgccaaactgtcttccaaagtagttgtgccattttgtattcccaccagcaatgaatgagagttcctgttgctgataggttggattttcatctttattcaattaaaaatatttttaaatttctcttgtgacttactcattgtcctgtggggttacttttatcatttgtttccaaataggaatttttcagctatcttt

SEQ ID NO: 49491 - DNA, 601 bp, Human
tcaggccttgttctgtccactactgagagagagggatattgaaattaccaagtaaaattgtggatttgtctagttttccttttagttctagtacagttttgagtcattttgaagcctgttgttggatatgtacacatttaatattcttttttttttttttttttttgagacggagtctcgctctgtcgcccaggccggactgtggactgcagtggcgcaatctcggctcactgcaagctccgcttcccgggttcacgccattctcctgcctcagcctcccgagtagctgggactacaggcrcccgccaccgcgcccggctaattttttgtatttttagtagagacggggtttcaccttgttagccagaatggtctcgatctcctgacctcatgatccacccgcctcggcctcccaaagtgctgggattacaggcgtgagccaccgcgcccggccttcttatgtcttcctggtgaattgacccttctagcctctgtaatgctctctcttctgtccctgttaattcttattctgaagtctgctctctgatgtagaccattctggctttatttttattagtatttacatagtactttttgcagt

SEQ ID NO: 49492 - DNA, 601 bp, Human
attcttgacactgtagtttagaaggagttggctgacttttcctgtaaagagccagatagttgatattttaggttttgtgagccgtaagatctctgttgcaactaattagcttagcttttttgtacaatggatatgactgtattttgacgcaattttatttggaaaaatagactgacggctagattttgcccacaggctatatagtgtatcagctcctgttgtagaaccataaagtttaccatttactcagactaaaacattttattgaacttttaggtaatattaaggagttttaagaaamcttcctccacttgccccttaggtctttatatttcactaaatatctttgcctaaaccttatgatgggtatgtttactaaaggtactgacaggacttttaagtgtgaatacagtactgctcaatgtacaccaactgcacattgacaaaaattgtcctgattagattattcctataaacttaaagggatggtttcatatggatataccctagaggtggtgataactcattaagttagtctttattcttagactaatcttacttaagacataaagaagattagaaatgtgataacaagatacag

SEQ ID NO: 49493 - DNA, 601 bp, Human
acataaaagttagagagctaacacatgttttctgtaatgcaaactggagtacctggcaaatgctaggtgttcaataaatggtaactaattataccagtcccactgatcactctttacttctagcactttgtgtctacacattctttttaagttggttttctctatctgacagatttataaatttcataaaagctggtaccaagtcctagatatgctgtggtccctaaatactggtttagtgaattgtgaattgtacctaggatacgtaacactatctatgagattgaagttgtgagggctmtctctcttttctttaggtttcctattgtgattttatcatggaaaatcaattggctaaatcaactgaagaacgaacatttcagtaccaggattctcttccatcactgcctgttccttcacttgaagaatcattaaaaaaataccttgaatcaggtatgttaataatcttttagtatatattaatattattagtaacttagaaaactgtgatactgttgctggagaaggggtctcgatccagactctaagagagagttagagttcttggatctcttgcaggaaggaattcaaggtgagttgc

SEQ ID NO: 49494 - DNA, 601 bp, Human
agatatgctgtggtccctaaatactggtttagtgaattgtgaattgtacctaggatacgtaacactatctatgagattgaagttgtgagggctctctctcttttctttaggtttcctattgtgattttatcatggaaaatcaattggctaaatcaactgaagaacgaacatttcagtaccaggattctcttccatcactgcctgttccttcacttgaagaatcattaaaaaaataccttgaatcaggtatgttaataatcttttagtatatattaatattattagtaacttagaaaactgygatactgttgctggagaaggggtctcgatccagactctaagagagagttagagttcttggatctcttgcaggaaggaattcaaggtgagttgcagagtgcagtgagaagagacagtttattgaaagcttctccattatagagtaggacatcctcagaaagcaagcagactgtctttaagtttttcttacataggggtcttatcgatgtaaagactaagctgtgcctatgtgagggtgagcagacagcatgacaaaatttattattctgttgatttaaagaaaacaatccttgacatttta

SEQ ID NO: 49495 - DNA, 601 bp, Human
gatggagctgaatttaaaatggtgttactctggctctcctgagctcctgcttccccaacatttccccctctacttatgagagaacccttaaccttaaggggagataaagggtgaaggttgttcttttgtaactccttcctggaggcagtagatgttgatggttgggacagggtcttctcataatagtgtgcagtgagcctcttcagggagtaagggagctccttgcttgcatgatatcccaattgtttctagaaagttaatatactaggttagtaaatagaaaggtgaaacagctgctaarctattttatcttgcaaccctatacaataaacacaacagaaataaaagcacaataactaataacaatgaatattataataccaagcatactgaaaagaaatgctttccaagtgctggaaagctcatgaaactatgctgttatggggtcataagaccgggaatccatagccaaaatacaagtttctagagaactcatgtcctgggatatattatggcagtaatcaggaacataatattcagttttgttcaagacacaagttcctcccttggctgcagttaaagaatgtataaagccatatgg

SEQ ID NO: 49496 - DNA, 601 bp, Human
tcataatagtgtgcagtgagcctcttcagggagtaagggagctccttgcttgcatgatatcccaattgtttctagaaagttaatatactaggttagtaaatagaaaggtgaaacagctgctaaactattttatcttgcaaccctatacaataaacacaacagaaataaaagcacaataactaataacaatgaatattataataccaagcatactgaaaagaaatgctttccaagtgctggaaagctcatgaaactatgctgttatggggtcataagaccgggaatccatagccaaaatacragtttctagagaactcatgtcctgggatatattatggcagtaatcaggaacataatattcagttttgttcaagacacaagttcctcccttggctgcagttaaagaatgtataaagccatatggttttgcaagcccactggtcttatttgggaagtttctcctgtcagaagtgtgatagcctgatgagtgtcattgaaagccgcaccagtatgttttgctagagcttttatttgtaattcaatgtctatagctgctgcttgaagagagaatatggccataggataaaaccaccaagaagcc

SEQ ID NO: 49497 - DNA, 601 bp, Human
attggctaggtgtggtagctcacacctgtaatcccagcactttgggagactgaggcaggttgatcacgggatcaggagatcgagaccatcctggctaacacggtgaaaccccgtctctactaaaaatgcaaaaaaattagccaggcgtggtggcgggcccttgtagtcccagctactcaggagcctgagacaggagaatggcgtgaacccgggaggcagagcttgcagtgagccacgattgtgccattgcattccagcctggacaacagagcgagactccatctcaaaaaaaaaaaaaaaraaaaaaaagaaaaggaaaggaaagcatttatctcttataaaccattcattggaattggaatggcttaaattagcctatttgatatgccaaggtaagcctgaggttgatgaaagaggtaattcactgcgtacccaacagtttttctggtttagaagggaggccgtagtttgtgcccattctgtaaacaaattagctctaatattataatagatcaagtttaatattaaaactagtaatttcattttgagagtagtacttatccactggatggattctttttttgaagagaagccacaggat

SEQ ID NO: 49498 - DNA, 601 bp, Human
ggtgtggtagctcacacctgtaatcccagcactttgggagactgaggcaggttgatcacgggatcaggagatcgagaccatcctggctaacacggtgaaaccccgtctctactaaaaatgcaaaaaaattagccaggcgtggtggcgggcccttgtagtcccagctactcaggagcctgagacaggagaatggcgtgaacccgggaggcagagcttgcagtgagccacgattgtgccattgcattccagcctggacaacagagcgagactccatctcaaaaaaaaaaaaaaaaaaaaaaaagaaaaggaaaggaaagcatttatctcttataaaccattcattggaattggaatggcttaaattagcctatttgatatgccaaggtaagcctgaggttgatgaaagaggtaattcactgcgtacccaacagtttttctggtttagaagggaggccgtagtttgtgcccattctgtaaacaaattagctctaatattataatagatcaagtttaatattaaaactagtaatttcattttgagagtagtacttatccactggatggattctttttttgaagagaagccacaggattctttatt

SEQ ID NO: 49499 - DNA, 601 bp, Human
ctgaggttgatgaaagaggtaattcactgcgtacccaacagtttttctggtttagaagggaggccgtagtttgtgcccattctgtaaacaaattagctctaatattataatagatcaagtttaatattaaaactagtaatttcattttgagagtagtacttatccactggatggattctttttttgaagagaagccacaggattctttattggctcacaagagtgtgctggaacagtggtcaccacgttgaatgcctgtgggactttatgagaggcaggtttaattttggatgaatgtacscaagtgtgtattcccttactccactagaggtacttagaagcacttgatagggtcctctccactttggagaaagttgtctataggaggtccttctttccaagtctttaatatgactaagtcacctggttgaacagcagagttatgaatatttatggaggtggttctgacacatgaatattgaacaaacgtgcatgtaacatatgactgtttaccctgcaatagagacttaacccttgccttacgtgatcttagattctatttataatttggtattttattgccataaagagtctgttttgt

SEQ ID NO: 49500 - DNA, 601 bp, Human
aacgtgcatgtaacatatgactgtttaccctgcaatagagacttaacccttgccttacgtgatcttagattctatttataatttggtattttattgccataaagagtctgttttgtcaatcttatgatttctattttaatgctaagctagtcagttgtgactgaattccaagaagaggaaagatatggcaagtcatgtccaatctccctgcttcccctcatggcctgaattagttttcaggtgttttggatgccctttggccaagaagagggtccattttgttgggaaagggcttagaacktttaaaaacttatttattttagtttatagttccccttttttttgttaaggtatgccatcaatggccaagctcttattttgtccagtattgatgtcagggtggtgtgctacctgccctggatccatcatgtcccttggtgggaccactatggccaagggacttaaacaaaagacttatggccaattaaactttctaggccagatgggaatggaggtgggcaggcactccttaaccttaaaaccccttttaagcaacataagagccaaaagccaaatgggacggttataaaatttgcttatt

SEQ ID NO: 49501 - DNA, 601 bp, Human
ttgttgggaaagggcttagaacttttaaaaacttatttattttagtttatagttccccttttttttgttaaggtatgccatcaatggccaagctcttattttgtccagtattgatgtcagggtggtgtgctacctgccctggatccatcatgtcccttggtgggaccactatggccaagggacttaaacaaaagacttatggccaattaaactttctaggccagatgggaatggaggtgggcaggcactccttaaccttaaaaccccttttaagcaacataagagccaaaagccaaatggsacggttataaaatttgcttatttataaattctatacattaagctattttaatcttgacttgtagcaattagccatataaaatacaacattttgttcagctatagaggcagtttgcctgaccttgatttggagggtctgaattgattttattccccacaacaagcccttacaatctcatgtggtagtctctgggcctggaaggactaaatagtttcaaattatagaggaaaacaaaacataaggaattaatgttttaaacaaaaatgtcataagccctacctagttatgagaatgacatga

SEQ ID NO: 49502 - DNA, 601 bp, Human
tttgttcagctatagaggcagtttgcctgaccttgatttggagggtctgaattgattttattccccacaacaagcccttacaatctcatgtggtagtctctgggcctggaaggactaaatagtttcaaattatagaggaaaacaaaacataaggaattaatgttttaaacaaaaatgtcataagccctacctagttatgagaatgacatgaaaagaagcccatacgtagccaaatacttaaattatttaatatcaaggcatagaaaattatattcagatataggcaaaattattaaatgartcttaatgttttgaatacaggcctgtccctatgtctctgtctgtaggtctcatgaaaatagtttactttgattgtccaggtctaaagacaaggctttgattagcttcagcttgctatcagatactggcaggagtcagtgccttctttagatgagctatatgtactcaggagtcaaagccctgtaactgtaaggcacaaggattagttaatagcacttgataaggacccttttaaggaactagagggagtcctttaacggattttttttcttttatttttattttttttttgaaacatggt

SEQ ID NO: 49503 - DNA, 601 bp, Human
taggcaaaattattaaatgaatcttaatgttttgaatacaggcctgtccctatgtctctgtctgtaggtctcatgaaaatagtttactttgattgtccaggtctaaagacaaggctttgattagcttcagcttgctatcagatactggcaggagtcagtgccttctttagatgagctatatgtactcaggagtcaaagccctgtaactgtaaggcacaaggattagttaatagcacttgataaggacccttttaaggaactagagggagtcctttaacggattttttttcttttatttttmttttttttttgaaacatggtctcgttccgttgcccaggctggagtgcattggtgcaatctcagctcactgcaacctctgctccctgggtttaagcaattctcccaacttagcatcctgagtagctgggattacagtcatgcaccaccatgcccagctaactttttgtagttttagtagagatggggttttgtcaagttggccaggctagtctcaaactcctgacctcaagtgatccgcctgcctccagttcccaacatgctgggattacaggtgtgagccactacgcctggccctttaac

SEQ ID NO: 49504 - DNA, 601 bp, Human
gggtttaagcaattctcccaacttagcatcctgagtagctgggattacagtcatgcaccaccatgcccagctaactttttgtagttttagtagagatggggttttgtcaagttggccaggctagtctcaaactcctgacctcaagtgatccgcctgcctccagttcccaacatgctgggattacaggtgtgagccactacgcctggccctttaactgattcttttctagtatatataattatcagggtggaggtggtatgtgttaggccatttttgcattgatataaagaaatacctgagrctgggtaatttattttcaaaaaagaagtttaattggctcacagttctgcaggctatacaggaagcatagtgctggtatctgcttctggaaagtcctcaggaaccttacaatcatggcagaaggtgaagcaggagcaggcacttcacatggtgacaacaagagcaagaaagagagagtgacagtgaggaagaggtgccacacacttttaaacaaccagatctggtgtgaatcagagtgagggctcacttgtcaccaaggggacagcccaagccattcttgagggctctgctcccatgatcc

SEQ ID NO: 49505 - DNA, 601 bp, Human
gtagttttagtagagatggggttttgtcaagttggccaggctagtctcaaactcctgacctcaagtgatccgcctgcctccagttcccaacatgctgggattacaggtgtgagccactacgcctggccctttaactgattcttttctagtatatataattatcagggtggaggtggtatgtgttaggccatttttgcattgatataaagaaatacctgagactgggtaatttattttcaaaaaagaagtttaattggctcacagttctgcaggctatacaggaagcatagtgctggtatckgcttctggaaagtcctcaggaaccttacaatcatggcagaaggtgaagcaggagcaggcacttcacatggtgacaacaagagcaagaaagagagagtgacagtgaggaagaggtgccacacacttttaaacaaccagatctggtgtgaatcagagtgagggctcacttgtcaccaaggggacagcccaagccattcttgagggctctgctcccatgatccagccacctcccaccaggccccacctccaacactgggcgttacatttcaacatgagatttggaggggacatccaaactata

SEQ ID NO: 49506 - DNA, 601 bp, Human
gatcaaaacagaagcagaggtcattgtaaaataatagttactcatttagccaaagtgataatgaaaatgctttagaagcaatacagaaggttacatgatgtaaaaaccttaagccttttaaatcttagttttggcaaccaaaaaaacctaataaagacagcataggaattatacaatcttgtttcttaagacagttaccaaaaaggcaaagaaaaattctgcagtgtgactacttctgcttatgggaagcccatttagataacctggacatcaaacctgatgaaaaaagtgcttggatttractggacctaggaagagtatattcaaggttatgattatagcataggattacctcactcttaggaacagcattagttttttgattacattgacaatttagatgtattttaaaagccaaaagtacagaatcaagttatactagaggtaaacattgcttttctagaccttcaagataaaatattttagcattagctcataacaacagtaaaattagaactggagaaaaaaaaagttgatgagaaagctgaaggaaagaattatctcagacctcaaaaaagcaaaaagcagtgagacacagtaa

SEQ ID NO: 49507 - DNA, 601 bp, Human
tttaacatcggggaccaaaatttagaaagacttatttataaatgattttcttttcactgtaaccaatttaatcacatacaaaattcctttcatgaattccccttcacaaatcttatcatgacttacacaaaccgtctatgacatgcttggactttctgacttgttctaaacttctctctttcctaaataatcagtcattttactttaggacaaaaatttaccatacaagatactttttcatacaaaagtattcccttctgtataacctttcttaccaaaaatatgtattttttttttttttgagatagggcctcgctctcttgcccaggctagagtgcagtggcaaattcacggctcattgcagccttgacagcccaggctcaagtgatcctcccacctcagcctcccaagtagctgggattatagacatgtaccaccacaccaggctaatttttgtattttttgtagaaatggagctttgccatgttgcccaggctggtcttgaactcctgccctgaagcaatccacctgccttggcctcccaacgtgctggtgttacagacatgagccactgggcccggccaaaagtacatttttatat

SEQ ID NO: 49508 - DNA, 601 bp, Human
ctttttcatacaaaagtattcccttctgtataacctttcttaccaaaaatatgtattttttttttttttgagatagggcctcgctctcttgcccaggctagagtgcagtggcaaattcacggctcattgcagccttgacagcccaggctcaagtgatcctcccacctcagcctcccaagtagctgggattatagacatgtaccaccacaccaggctaatttttgtattttttgtagaaatggagctttgccatgttgcccaggctggtcttgaactcctgccctgaagcaatccacctgcyttggcctcccaacgtgctggtgttacagacatgagccactgggcccggccaaaagtacatttttatattcataactttcttcacatctctctctccctacttgttcctttttaccttctttcataggtaaattttaaataagctctaaattatataaaattattattatttttcaacttggagaatgttcacttccctcaattgagagatgctgaattaaataacccaaagaatgaaaatcatcaagaccagaaaaaaatgacaggtgtaaacttcagggcatgcaagcacagggcgaca

SEQ ID NO: 49509 - DNA, 601 bp, Human
cattttatagataaaatcattccacaattttattttattttatttttctgagatgagatctcactgttacccaggctggagtgcagtggtgtagtcacaggtcactgcagccttgacctccccagctcaggtgatcctccaacctcagcctcctgagtagctgagactgcaggcaggtgccaccatgccctgctaatttttgtatcttttgtagagatggggtttcaccatgttgcccaggctgccaacattttagaaacatgtttcccatattataaacatttcttaattggaaatgacycagatatccagtgagtcatgccaggaaagccatagaccaaaattttgggtaaagtagtcttcatgaaagtttgagggttttttatttttgtttttgtttgtttgttttgccttttcacattttgtttttcagtttcaaatgagtttctaacatgtacatttcttttacagttctggttgaactgtacaagaaaaacaaaatctctaagtaacctaaacatcaagttttatttcaatactagtagactaataataacagattcaaatcaggcagaaaagaagagaaaaatagagagcttta

SEQ ID NO: 49510 - DNA, 601 bp, Human
gtgcgcagtgcctcacgcctgtaatcctagcactttgggaggcggaggcaggtagatcacgaggtcaggagatcgagaccatcctggctaacacagtgaaaccccgtctctactaaaaatacaaaaaaaaaaaagagccgggagtggtggcgggcgcctgtattcccagctactcgggaggctgaggcaggagaatggtgtgaacccaggaggcggagcttgcagtgagctgagattacgccactgcactccagcctgggcgacagagcgagactccatctcaaaaaaaaaaaaaaaaaaaagaaaagaaattcaagtacaactttataacgtaaacagttgattaacagataattttatgttatatgtattattttctgaattatttaagttagagtaaagcaaatgttattaaaaaatgataaggaagagaaaaatatatttattatccattaagtggaagtagatcatcataaaaatcttcatcctgatggttttcatgttgagtaggtggaggaagaggagggactggtcttgctgtctcagaggtggtagaggaggtggaagtagggacaggagaggcaagcacactcattatcaa

SEQ ID NO: 49511 - DNA, 601 bp, Human
aatacattatttttgttatgtgatatatttgatgactatatgataaataaaatactggaagaatgcctacttttcttctattggatatatgcatctttactcctgtttaaccttagatttgagtcttgtgttttctgtttctgtttccagagagtgaagggcgttccccaaaccacattgtagtgctgtgtcgaggccgagcttttgtctttgatgtaatacatgaaggatgtttggtcaccccgccagagcttctcaggttttcagactactttcttgagtttcattaggtcttatggtrttgcttgaattaaaatatacatgtttagaattgcctttcaaggtgatagtaagctgaaaaataagaattttatgcatgcttttttaaaaaaaaatctatttgtattttttatttaaattatttttaaattttactagacatatataaatatgttcacttggagaaaaggaaaacattacatatattaccaattccattccctgccccagaattaatcactcttactagtttagtgtgttccattgttccatacctgttgcaatgaatttacatgtatacctagcttaaaaaatatatata

SEQ ID NO: 49512 - DNA, 601 bp, Human
tttactcctgtttaaccttagatttgagtcttgtgttttctgtttctgtttccagagagtgaagggcgttccccaaaccacattgtagtgctgtgtcgaggccgagcttttgtctttgatgtaatacatgaaggatgtttggtcaccccgccagagcttctcaggttttcagactactttcttgagtttcattaggtcttatggtattgcttgaattaaaatatacatgtttagaattgcctttcaaggtgatagtaagctgaaaaataagaattttatgcatgcttttttaaaaaaaaatctatttgtattttttatttaaattatttttaaattttactagacatatataaatatgttcacttggagaaaaggaaaacattacatatattaccaattccattccctgccccagaattaatcactcttactagtttagtgtgttccattgttccatacctgttgcaatgaatttacatgtatacctagcttaaaaaatatatataatatataatatgtattatatatgtatatacatatatatggtatacattttctatgtatatgttttaaagtatattacagaaaatttcaaaatgta

SEQ ID NO: 49513 - DNA, 601 bp, Human
gtggctcatgcctgtaattgcaacattttgggaggctgaggctggaggatcacttaaggccaagagttgaagaccagcctgggcaacatagggggaccctgtctctataaaaagttaaaaaattagctggacatgatagtgctacttgggagtgctcccagctacttggaaggctggggtgggaggatcacttgagcccaggaggtcgaggctgcagtgagctgtgattacgccactgcactccagcctgggtgacagagcaagacgctgtctcaaaaaaaaaaaaacaaaaaaaaaaaaacaaaaaaaagctatatctagtcaactgacaggtgaaaaatggttttcattgttgttcgaattggcatatccctcattacaagtgaggttgagcatttttatatggtttatatgccatttatttgtgttttctgtgagttacttttgcctatttttctgttggctattttactttatccttattgatttatagcaattatttatatagtctctacattaatcttttatacattatgtgtgttgcaaacattttcttccagttaacttgaaacaaattttggaaattgtccaatcttaattt

SEQ ID NO: 49514 - DNA, 601 bp, Human
tctactaactgtctgataggcattcaggaggtctatgaaccaagaaaattttttataaaggggtttggggctgggtatgatggctgatacctgtaatcccagcactttgggaggccaaggcaggtgaatcacttgagcccaggagatggagactggtctgggcaatggcatgaaaccccgtctctacaaaaaatacaaaaattagcctcacatggtgttgtgcgcctgtgatcccagctacttgggaggctgaggtctaggaggatcgcttgaacctgggaggttgagggtgcagtgaacrgtgtttgggccagtgcacttcagcctgggaaacagactgagactctgactccaaaaaaaaaaaaaaaaaagggttcagtagttgtattaatccatattcaggtttaggtgatagaaacctaaatcaaactagcgttagcgtaagaagatatttgttggcaaggagttagctaaatttgggtaaagctgacttcaatgttcaaatgctttcattagaaatctctccccattttttggtactgctttcttttgtttggcctcatatttaggtagactgcccaatgtgattgttgtaccaaca

SEQ ID NO: 49515 - DNA, 601 bp, Human
ctgggtatgatggctgatacctgtaatcccagcactttgggaggccaaggcaggtgaatcacttgagcccaggagatggagactggtctgggcaatggcatgaaaccccgtctctacaaaaaatacaaaaattagcctcacatggtgttgtgcgcctgtgatcccagctacttgggaggctgaggtctaggaggatcgcttgaacctgggaggttgagggtgcagtgaacggtgtttgggccagtgcacttcagcctgggaaacagactgagactctgactccaaaaaaaaaaaaaaaaaagggttcagtagttgtattaatccatattcaggtttaggtgatagaaacctaaatcaaactagcgttagcgtaagaagatatttgttggcaaggagttagctaaatttgggtaaagctgacttcaatgttcaaatgctttcattagaaatctctccccattttttggtactgctttcttttgtttggcctcatatttaggtagactgcccaatgtgattgttgtaccaacagtctcatatcttcatagctttcttcatagactcccaaaggaaatagccagcttctttgtttccaatggtt

SEQ ID NO: 49516 - DNA, 601 bp, Human
acgagatataccacttccagaagagctcattttcattgtggatgagaaagttttaaatgacatcaaccaagctaaagcccagtatctcagggaggtatatttttcacttttctcttaaataataatgattttttcttttaacaaccatatgtaaaaatttggctgtcatccaagcatgtctgcacaaaacattttaaaattatgcctttaacacctttaattctttatgtctggtgattactttaatgcaggtgataatttgcttctctttggtgtattctccttaggtgatttttcaccrttctcatttaattcttcttgttaggcatctgatctacagattgcggcttatgcctttacatcttttggcaaaaagctaaccaagaacaagatgcttcacccggatacgtttattcagcttgcacttcagctggcctattacagacttcatggacagtaaggaccattcagtttctattttcacagtcttgaagtccaagggtatatctttttttatagctatttcatcctaactcctcagtatttttgctcacttttttcccagctggtactgtgtcctatttgtacttccatcaataga

SEQ ID NO: 49517 - DNA, 601 bp, Human
ctactctgccattatggtaacatgactcctctcagttttgcttttttatctagtctgagaatatctgtctttaaatatgttatttagataattaaattcagtataattatcagtaaatttgtgtttaagtctaccatcttgctctttattttctagttatcccatctgtacttttttctttttcttttgaatttttagagctttaaaaaaattgcttcattttatttccaacatgagctatactttttttttttgtacagttgacccttcaacatcatggaggttaggggtccccaagccyccagtgcattagaaaatccaagtgtgtgaccagaagtcttaccaataacataaacaattaacacacattttgtatatgtattatatattgtattcttacaataaagtaaactagagaaaggaaatttttgttaagaaaaatcataaggaggctgggcatggtggctcacacctgtaaacccagcactttgggaggctgaggcaggcagatcacttgaggtcaggagttcgagactagcctggccaacatggtaaaaccccatctctatggaaaatacaaaaattagctgggtattgtggt

SEQ ID NO: 49518 - DNA, 601 bp, Human
taaacaaatttacaagaaaaaaacaaccccatcaaaaagtgggcaaaagatgtgaacagacacttctcaaaagaagacatttatgtggccaacaaacaaatgaaaaaaagctcatcatcactagtcattagagaaatgcaaatcaaaatcacaatgagataccatcttatgccagttagaatggcgatcattaaaaagtcaggaaacaacagatgctggagaggatgtggagaaataggaatgcttttacactgttggtgggagtgtaaattagttcaaccattgcagaagacagtgtggygattcctcaaggatctagaaccagaaataccatttgatccagcgatcccattgctagatatatacccaaaggattataaatctttctactataaagatacatgcacacatatgtatattgcagccctgttcacaatagcaaagacttggaaccaacctaagtgcccatcaatgatagactagataaagaaaatgtggcacatatacaccatggaatactatgcagccataaaagaggatgagttcatgtcctttgcagggacatggatgaagctggaaaccatcattctcaacaaactaa

SEQ ID NO: 49519 - DNA, 601 bp, Human
gggagttgaacaatgagaatacatggacacaggaagggaacatcacacaccgggggctgtcatggggtggggggctaggggagggatagcattaggagaaatgcctaatgtagatgatgggttgatgggtgcagcaaaccatcatggcacatgtatacctatgtaataaacctgcacattctgcacatgtatcccagaactttaaagtataataaaaaaaattctgcaaagccttcaaatagatgttttttaaatccagtttttgttgttgttcctagcattaagactggcttgccagaarctagctcatcatagctggcattggaaatttcacgcggtattttttttttatatagaagatatgttcaaatcaggttccaaataaattttacacattgcatttgattgatataccttataagtcttttttaaatatgggaatctttttcctacctttctcttattgtatttgatttgatgaagaaactgggtcatttatcctgtagagttttctgaattttcctgattgtattcccatggtgatatttaacatgttgctcagtctcctgtatgtcttgtaaactggtagttagagctagag

SEQ ID NO: 49520 - DNA, 601 bp, Human
ataactgatggaaagatataggagtatgtgttatagatcttcctagaaatctttcctctcccaaattaccccaatcctaattacaatgagcttaggatttttttctagttgggttttgcacagtgtgttattgaagtgtctctcgatttttaatacagcttcgtgagcggcagcaaaagatgttacaagcttttgcaaagcataataaaatgatgaaagattgttcagctggaaaaggtacttaagttaaaatttttctgacttaaaaatctctcatggtgaaaaatttttttctaacctsagatttggggtttcattgcaggatttgatcgtcaccttttaggtctcttactcatagcaaaagaggaaggtcttcctgttccagaactctttacggacccacttttttccaaaaggtaatatagtgtagtgttttacagcttcatcaattggcttcctctttttgtatattaaatggtttttagaaacaatataagcatctgtaggcctagtaaaatgttcttttattgtgccacacagcggaggaggtggaaattttgttctctcaacaagtctggttggctatttacgagtccaggga

SEQ ID NO: 49521 - DNA, 601 bp, Human
agagtagtggagaacaagataaaatgaaagtgatagcaaggcttgtaaggtccttatctacagtctggcagtctctttacaggggcctttcaaagcatagttggcttcataaaaattacgtgactacatttagcactatgtgaataagaagagggcaggcttggaggcacttcagatagaatgtgaaaaattggaatagtaatatgcatgacatatttcagtttctaatacaactgacccttgaacaacatgggtttgaactgcatgggcacacttacatgcagattttaaataaatgagwaaattttttggagattgagacaatttgaaaaaactcaaaactgtgtagtgtagaaatattcaaaaactaaagtattcatgaatgcataaaatatatacagatactagtctatttcatcatttactaccataaaatatacacaaatctactatacaaagttgaaatttatcaaaatatatgaacataagcccttacagactttatatggtgccatttgcagtcaagagaaatgtaaacaaatgtaaagatgcagttttcaatcataattgcattaaattaactgtggtacacactgtacta

SEQ ID NO: 49522 - DNA, 601 bp, Human
tgcataaactatatttatatatttatagatataaccttatgttgaagatcatctcaattatatatgtgtattctcacccattgcagccacaaacaattctttgcagagaattttccagcaatcgttggcacacaaaccctgctcttagcaagcacttgcacatgtatcttagccacatgaacatacataatcctggcaggaagcaaaaatatatttgctttataacttaaaatgaacaactggagacaaatttacctttttgtgggggaaagggatgagggcaattaggaggaagcaaagygaacgcaacaagggttaatccttaaccaagagcaatccacgtcccttttgaacaaatgagaacaaacaaggctactgaatcattaaataataacaacgatttgaaatgataataatactgatgatgacgatgagtttgcagccactagcctgcagcggaaacctttctgaggggtgcagaaagcgaggcgagatcgcccccaccacccattctcagaacctttctggacgtgcgagtgaactgcgaattgtggaaagcgggggtagctcaggacactgcgcagaaaccggtctccccggc

SEQ ID NO: 49523 - DNA, 601 bp, Human
tctttaatttattcctttatttttaagcattaaaatattcggctgctaaataactttgctattactactgacatttttctactatttatccactacaaaatctcagaagtaacataaatggtattataataacaatgtaataaaactgagaagtaaaaccatcagggaataattaaccagggcgtgtatctactttcagattatgaccactcatttcatcctgtctccttgaaaattgtacaagctctgttcatccactagggtaaagcatggcatcagcttattgaataaacacttgaawgttcctggtaaaagaaaagattttattaaacagttaatatttggaactaggtttacatcaatcatctgcttttttagagaacatgattgccctctagtgtggtgaaaagttaatgcagacaccgaggttttccaatggacagaaccagtctaggttctgaaaacatctgggtcactggctagttcagtattttcttttttaatgaaaaaattctagcattttttcatataaggtcacagatcttgtgacaacaggataatatgtgtttttcttcccacgaccaaaaaagaaactggtgtg

SEQ ID NO: 49524 - DNA, 601 bp, Human
gaaagacagacttagaagatgggaaaaataacagcagtcagtttttggtacacctcctcagtatcacatacctgcctgttttactcgctaagctgcatgttctctgcaggtggagactctgatattcagatgtgctctgaacagggggcacatttcaatcgatgaagaagtaaacaatgattttctttaatttattcctttatttttaagcattaaaatattcggctgctaaataactttgctattactactgacatttttctactatttatccactacaaaatctcagaagtaacataartggtattataataacaatgtaataaaactgagaagtaaaaccatcagggaataattaaccagggcgtgtatctactttcagattatgaccactcatttcatcctgtctccttgaaaattgtacaagctctgttcatccactagggtaaagcatggcatcagcttattgaataaacacttgaatgttcctggtaaaagaaaagattttattaaacagttaatatttggaactaggtttacatcaatcatctgcttttttagagaacatgattgccctctagtgtggtgaaaagttaatgca

SEQ ID NO: 49525 - DNA, 601 bp, Human
caaaggtaattcatatgcacatcaaagtttgaggaacacagtaatatgacactattaaatattttatagctggattagaattacataaaatgtaatcaaaaaataattctatcaatgcatatttaaaaaatccacttttgatgatacccaaaattagtttatacttatatatttcttcttacttcgttaaaattaacatcgattttctaataaacagaaaaccactacaaggagatgctcaataattgttgaaatctgataaaactagattgaaatcacattggattagatttaaaaaggyatctttaaatggaaaagaaagacagacttagaagatgggaaaaataacagcagtcagtttttggtacacctcctcagtatcacatacctgcctgttttactcgctaagctgcatgttctctgcaggtggagactctgatattcagatgtgctctgaacagggggcacatttcaatcgatgaagaagtaaacaatgattttctttaatttattcctttatttttaagcattaaaatattcggctgctaaataactttgctattactactgacatttttctactatttatccactacaaaat

SEQ ID NO: 49526 - DNA, 601 bp, Human
gatgtattgaatcagaatttgcattttaatgaaaatcaaaggtaattcatatgcacatcaaagtttgaggaacacagtaatatgacactattaaatattttatagctggattagaattacataaaatgtaatcaaaaaataattctatcaatgcatatttaaaaaatccacttttgatgatacccaaaattagtttatacttatatatttcttcttacttcgttaaaattaacatcgattttctaataaacagaaaaccactacaaggagatgctcaataattgttgaaatctgataaaaytagattgaaatcacattggattagatttaaaaaggtatctttaaatggaaaagaaagacagacttagaagatgggaaaaataacagcagtcagtttttggtacacctcctcagtatcacatacctgcctgttttactcgctaagctgcatgttctctgcaggtggagactctgatattcagatgtgctctgaacagggggcacatttcaatcgatgaagaagtaaacaatgattttctttaatttattcctttatttttaagcattaaaatattcggctgctaaataactttgctattac

SEQ ID NO: 49527 - DNA, 601 bp, Human
cgcacacacgcacacatgctcacacagagagccaaattcttattttctacctttctctcgaaggtcttctgccgagtcctgcaatatgaatataattttaaaaatccaattaagagagagtgatggggcagaacacataattcccagagtaataaaatccctaggtatatgagttcggaagtaaaatattttgtaaagattaccatagatttaaaaatgttaagacataataccagagcttaccaggagggatacctgtatattacaagttaatatccctaaaactgatgtgtttagtggwcagaatcagcatcatctgggagcttgttcggaagacagaatgtctgcctcaagccagatgtattgaatcagaatttgcattttaatgaaaatcaaaggtaattcatatgcacatcaaagtttgaggaacacagtaatatgacactattaaatattttatagctggattagaattacataaaatgtaatcaaaaaataattctatcaatgcatatttaaaaaatccacttttgatgatacccaaaattagtttatacttatatatttcttcttacttcgttaaaattaacatcgattttct

SEQ ID NO: 49528 - DNA, 601 bp, Human
tcctactctaagtacaattcctaaagaagctatatttccacatgaccagcaaaatgatggctgaaatgcattaattaacctttacactcatataaaagtgttttgtgagaacaaatgtacacgaatgttatctttaatcatgactaataaaaatggatattataaacacaagctttactactgcaaatgtctccttgacaaatgacagggcctgattcctttattaaaagataattaaaaatgtttcacaagggattcaaaaccttcctacagttctctcctgcctgcctgcctgctttgrtggtaatatgaagagaatcttgaaataacatctaatagttatattaaatgtgaatgtgtaaatttattttattcaacaaaatgttaaaactaaatatctctggcctatggaagtagttaaggaggcattttgaaatgtgctaaccatgatgggactgaggagattaagtcaatgttatttctggaactggtcatcagagtgtgttcccaccagaaatcgatgctgtgctgagcctgcagaacgccatgtgtctcatacgttacaacccacacggcctcatagctctctttctcccaaagc

SEQ ID NO: 49529 - DNA, 601 bp, Human
taaaaataaattattttaaatgtgctctatgagaactgtaattatctatttcttgccataaaataaattttgaaacccataactttccagagtattaaatattttactctggaggtcaacaacaagtgagaacaaacttaaaatatttttgttatggttttatagtataatatgtggctcctactctaagtacaattcctaaagaagctatatttccacatgaccagcaaaatgatggctgaaatgcattaattaacctttacactcatataaaagtgttttgtgagaacaaatgtacacraatgttatctttaatcatgactaataaaaatggatattataaacacaagctttactactgcaaatgtctccttgacaaatgacagggcctgattcctttattaaaagataattaaaaatgtttcacaagggattcaaaaccttcctacagttctctcctgcctgcctgcctgctttgatggtaatatgaagagaatcttgaaataacatctaatagttatattaaatgtgaatgtgtaaatttattttattcaacaaaatgttaaaactaaatatctctggcctatggaagtagttaagg

SEQ ID NO: 49530 - DNA, 601 bp, Human
attaatgttcttcccgagagtctggaaatgataacagtaccatcttgatgggattttctggtctcagttttgtaacagtcaatatattataagttggggttgtttcgtgtgagttaggttgctcctcactaggaagcccaaactgggaaactattattataataggtttactgtgagcagctttgttaatggaagttaaactttatggctgcatttcataaggaaaaaaaacttccaaagacagagtagaatgctaataaaaatttaatttacactttaacatgctctcttgtaaaagtayttgtgggactaggtttagataaatttcactcaattctctttatcctgatataaagacatacaactaaaagatggacagatttattatcctgatgatctattgttatattgggtacttgtactaatggttaatgtgcgaactccaacatccaaaatacaattattccagaagaataactgctaaatgggcactcttgcaggcgttgctttacaatctttgtaaaaaaaaaaaaatcattcagtcctaggcaatatttttgccctataaaaataaattattttaaatgtgctctatgagaac

SEQ ID NO: 49531 - DNA, 601 bp, Human
atgactttaaactgaagacaaatatgcctcgtgtatgactattctcactgtgcatgttttattacaggacagtggagggagtgctaaaccttattttgcatgaatgtgtatatatgtatgaaataggcacatacatgatatataacatatttatatattacatataaatattttgataggtaaataatatacacaactttattatatgtaatatatatattatatgttataatatatatataatatatattagacctgtgttccgagtctgcctctgaggcttgccactgaataaattatwtgagcttaaatttaccaatctttaaataagacaacttgtatagtatgcccatctcagagggattatatgaagattcaaaaggatgaagcaggtgaatgttttctaaaaatgacaaggtcccatatagatagatcatgcgatttaatttttcttttgaacattttttagtcttctatgcttgcctgctccttttaaaaaactatataagaaaaaaatcatcagaaatataataaaaagataatttttaaagtgacaagagtgcaggatcatgtaatatgtcattaaaagactagaacaact

SEQ ID NO: 49532 - DNA, 601 bp, Human
catttggacatgggctgctttgtctaagcagagtttgtaccatctcaggaaggtggactcagagggtagtgtcaaggtggtgccaagaaaggggtagacatggactagaagcaaagtaagtactgagttttatctctggcttatcagccctctcatattttcagtgtctacttgctggggacacccctgcttctagagattctctaagcttgatggttgccatcttgggccaccacttaccatccttcccttaaagcagattgagttggggaaaagttggatgtggattgactgtaacaamacgttgaatgagttaattgcttcttctgagccaaccttcatttaagaagaagaaggctcttctttaggaggaagaagggctggccaggtgggttctaatcacaagaactgcaaaacgtctgatgctgttgtcagagggactcaattaacattttatttcacttttcattacatagaaagtatttttcaaaaagcaaatgacgcagtttttgattgcgctccttgttccctctttactcattctaaatgcatgcacatgggtatttatatctaatgacaatttaaaaactcaacttcttgc

SEQ ID NO: 49533 - DNA, 601 bp, Human
ttctcagatagtgagtagtagtggagcatggttcaaaaccatgtccactggatacccacgcccacctctaatccacgctctctcttacctgtaacaggaacagttactgacctaaggacttttggggtaacttgtggtactgctttttaattttcataggattttacattcgtttgagttccaagacaagctgattatttttaattgcacagaactttacacttctgttttaacttttgaaggcagctttaaactgagccctaacacatttggacatgggctgctttgtctaagcagagtytgtaccatctcaggaaggtggactcagagggtagtgtcaaggtggtgccaagaaaggggtagacatggactagaagcaaagtaagtactgagttttatctctggcttatcagccctctcatattttcagtgtctacttgctggggacacccctgcttctagagattctctaagcttgatggttgccatcttgggccaccacttaccatccttcccttaaagcagattgagttggggaaaagttggatgtggattgactgtaacaaaacgttgaatgagttaattgcttcttctgagccaa

SEQ ID NO: 49534 - DNA, 601 bp, Human
ttataatatagaaatgattaataaatttaagaattctcagatagtgagtagtagtggagcatggttcaaaaccatgtccactggatacccacgcccacctctaatccacgctctctcttacctgtaacaggaacagttactgacctaaggacttttggggtaacttgtggtactgctttttaattttcataggattttacattcgtttgagttccaagacaagctgattatttttaattgcacagaactttacacttctgttttaacttttgaaggcagctttaaactgagccctaacacmtttggacatgggctgctttgtctaagcagagtttgtaccatctcaggaaggtggactcagagggtagtgtcaaggtggtgccaagaaaggggtagacatggactagaagcaaagtaagtactgagttttatctctggcttatcagccctctcatattttcagtgtctacttgctggggacacccctgcttctagagattctctaagcttgatggttgccatcttgggccaccacttaccatccttcccttaaagcagattgagttggggaaaagttggatgtggattgactgtaacaaaa

SEQ ID NO: 49535 - DNA, 601 bp, Human
taactgagaaaattataatatagaaatgattaataaatttaagaattctcagatagtgagtagtagtggagcatggttcaaaaccatgtccactggatacccacgcccacctctaatccacgctctctcttacctgtaacaggaacagttactgacctaaggacttttggggtaacttgtggtactgctttttaattttcataggattttacattcgtttgagttccaagacaagctgattatttttaattgcacagaactttacacttctgttttaacttttgaaggcagctttaaactragccctaacacatttggacatgggctgctttgtctaagcagagtttgtaccatctcaggaaggtggactcagagggtagtgtcaaggtggtgccaagaaaggggtagacatggactagaagcaaagtaagtactgagttttatctctggcttatcagccctctcatattttcagtgtctacttgctggggacacccctgcttctagagattctctaagcttgatggttgccatcttgggccaccacttaccatccttcccttaaagcagattgagttggggaaaagttggatgtggattg

SEQ ID NO: 49536 - DNA, 601 bp, Human
agaaattaacaaagtataagaattgagatgttcactttaaatttttattatttttatttagtattttcatcatttatctagggaatcagggaaggggattaatatttttgatgaccaaatgcttaacaatcaattgcttacttaacaaccatgtgatttaggtattgttttcccatttcataactgagaaaattataatatagaaatgattaataaatttaagaattctcagatagtgagtagtagtggagcatggttcaaaaccatgtccactggatacccacgcccacctctaatccaygctctctcttacctgtaacaggaacagttactgacctaaggacttttggggtaacttgtggtactgctttttaattttcataggattttacattcgtttgagttccaagacaagctgattatttttaattgcacagaactttacacttctgttttaacttttgaaggcagctttaaactgagccctaacacatttggacatgggctgctttgtctaagcagagtttgtaccatctcaggaaggtggactcagagggtagtgtcaaggtggtgccaagaaaggggtagacatggactagaa

SEQ ID NO: 49537 - DNA, 601 bp, Human
cctcattagagtttatttttttttttaaataagctgaactctcctgcttagtgcaatatattatgaccttgtgagagtttaaattgtaatggtgctttcatataaagctccttgtttgtcactattccatgtttatgagaaagtagaaacacattttattagctgtattttatggcttataaatgtgaaaaaatattgagcatttttatatgcagattatcatcaacagtatctaatatgaaaaagaactgtactatacttgtaaatataagcacatatttctcttaatatgtctgcagcyatgtcataaatataattcctaatttatgtaccacacatttacatgatttgatatttaggaggcaaaacaaaatgcttaaaatgttttggtattggtagttatcctcccttaaacctttgtactcagttgctggatgaatactaatttgatttcacaagatatctttgttgctctagtaattacattttactgataccttatagattttaaaaatagcaataacagattattgattggtacctgaaacactattgattgtaaaggcgttgctttcctgagtggctgagagaatagtgctaa

SEQ ID NO: 49538 - DNA, 601 bp, Human
gatcattagatttgaaactcgactcttccttggccagcatttgtgatcaggagcaagtcactcaactttccatggcttctttcctgtcaagtaggaataatgagacatgtctcaaagtgctgtaaaaaatcaaacaggaaaaagtgcgtgggacatgtgacttgtagctggctcaagcagagcaggtgaatgataaataacaagggatatgataacaaatattgctataagatggtatgtggctatcgtcaaattcattgttagatagtaaactagtgaaagttcacaagaaggaaagatmaaggaaagctggattcaaggttgacttggaaagcctgctattatttgttttgtggagagtatgatctttctgagcagcaaatttgagaaatccttcttgacttcttagctggctatcctcaccgtatgtattcatagttcacttctaaaatttatccaaagggatgaaatgtatacttttctggatagaataatttcatgactctttgctatttgtaggagtgacatcttctttttgcaatgagtttaagtggacaggtttttattcttttcagctatgcaagctggacacaaagtccag

SEQ ID NO: 49539 - DNA, 601 bp, Human
gggaaagtaagtgaaacaagtttctagcctaaaagaagtcatcaatatagttgggtataagagaaaagtctatagtgcaaaaaataaaaaacagttcaaaatgtggaaaaaagtctatagtgcaaaaaataaaaaaatagttcaaaatgaggaatctagagtgcagtggaaagatcattagatttgaaactcgactcttccttggccagcatttgtgatcaggagcaagtcactcaactttccatggcttctttcctgtcaagtaggaataatgagacatgtctcaaagtgctgtaaaaaatcaaacaggaaaaagtgcgtgggacatgtgacttgtagctggctcaagcagagcaggtgaatgataaataacaagggatatgataacaaatattgctataagatggtatgtggctatcgtcaaattcattgttagatagtaaactagtgaaagttcacaagaaggaaagataaaggaaagctggattcaaggttgacttggaaagcctgctattatttgttttgtggagagtatgatctttctgagcagcaaatttgagaaatccttcttgacttcttagctggctatcctcaccgtatg

SEQ ID NO: 49540 - DNA, 601 bp, Human
tcctttcctttctcacctgtaaaaatgaggatgataatcctcctataagatacttggcacaatcacagtacttgactcagtaagtacccaatacatgttggccaatattgcagcaatctgaagaaagggaaagtaagtgaaacaagtttctagcctaaaagaagtcatcaatatagttgggtataagagaaaagtctatagtgcaaaaaataaaaaacagttcaaaatgtggaaaaaagtctatagtgcaaaaaataaaaaaatagttcaaaatgaggaatctagagtgcagtggaaagakcattagatttgaaactcgactcttccttggccagcatttgtgatcaggagcaagtcactcaactttccatggcttctttcctgtcaagtaggaataatgagacatgtctcaaagtgctgtaaaaaatcaaacaggaaaaagtgcgtgggacatgtgacttgtagctggctcaagcagagcaggtgaatgataaataacaagggatatgataacaaatattgctataagatggtatgtggctatcgtcaaattcattgttagatagtaaactagtgaaagttcacaagaaggaaagataaa

SEQ ID NO: 49541 - DNA, 601 bp, Human
ccgagatgttggagccagattgaggtcaactcttctctccactaaattcctttatattatgctactgactggtatttcagtgcattttgaagtgcaagaatacttcttttccttggcccttaccacatagctttagctacagtgatagtttgaaaatggaactactggtggtaccactctaatttcttggcgtagaggcaaaatttaagaaagtcttctcatttctatccttcaaaaggcaaacttcacaatagcagataatcaaccttctctatgtaaggagaaagagaaggcaggtgartgtctcctttgtattcatttatatgttctctcccttattttagctccaatactagtgagtgaatgttagctaccccagggtaagggcaagaatatgatagaaactgaagatttgagctctaggtcaggaactattcaaccttagataatttattcaaccttctgaacatgagtttatttatccacaaaatggggatagggtgttgttgtaaggattgagttaggtaatgtattgagaaactgaagtgctgtgcaagacattgcttattaataagcattaatttctccaaattgatcttta

SEQ ID NO: 49542 - DNA, 601 bp, Human
cataaaatattacctatgatgtgacaaatgcttcataaagaaattaatgtcttgaatttcaaattgtttaactatcagggcaatttctactcttccacatgctacatgcaaggtctatttttggcttcaaatattctttttctactgttagaataagtgatgcataaactgtaagctttttggatgccatctggaactccctttgaattcttgatactcattcttaagacatgagaaggactacatgttgctatgactggctgagccagattggaataacctgtgcattttatctgtcacrgaaaataccatatgacttggtcataaacatacccaataaaaaaattaaggcaaaaatagaatcaagtgtttgatctgcatagataaatatgacttggaatttggcatgataaattgctgataaaccaaactcacaacttgggaatacattataaatgaaggcacacgttggctcccctttatgtcctattttctcttgtttattcagcctaaatattacttataaaaaaagggggattcatggttttaaacattgctcatatcttcaaaaattttacaaaatattaataggaagggccaa

SEQ ID NO: 49543 - DNA, 601 bp, Human
acgtgttgaaatgtctgttctcaaaaagacaggagactggttagccagaatgtggagaaaagcaatccttgtgcactgctggtggaatgtaaattcctagagccattatggaaagcagtatggaggctcctcaaaaaattaaaaacagaactactaggccaggcgtggtggctcacacctgtaatcgcagcactttgggagtctgaggtggacggatcacttgaagacaggagttcgagacatggtgaaaccccgtctctactaaacatacaaaaattagctgggcatggtggtgcgtgcytgtaatcccagctactcaggaggctgaggcaggaaaattgcttgaacccaggaggcagagattgcagtgagcctagatggcaccactgtactccagcctgggcgacatagcaaggctctgtctcaaaataaaaaaaataaaaaataaaaaaaaataaaactactagatgatccagcagtcccactactgggtatatatcccatcaaagtggaatcagtatgtcaaaaagatatctgcactcctatgttcactgcatcattattcacaagacccaagatatggaatcaatatgagtatcca

SEQ ID NO: 49544 - DNA, 601 bp, Human
caatgagatattatctcacacgtgttgaaatgtctgttctcaaaaagacaggagactggttagccagaatgtggagaaaagcaatccttgtgcactgctggtggaatgtaaattcctagagccattatggaaagcagtatggaggctcctcaaaaaattaaaaacagaactactaggccaggcgtggtggctcacacctgtaatcgcagcactttgggagtctgaggtggacggatcacttgaagacaggagttcgagacatggtgaaaccccgtctctactaaacatacaaaaattagcygggcatggtggtgcgtgcctgtaatcccagctactcaggaggctgaggcaggaaaattgcttgaacccaggaggcagagattgcagtgagcctagatggcaccactgtactccagcctgggcgacatagcaaggctctgtctcaaaataaaaaaaataaaaaataaaaaaaaataaaactactagatgatccagcagtcccactactgggtatatatcccatcaaagtggaatcagtatgtcaaaaagatatctgcactcctatgttcactgcatcattattcacaagacccaagatatg

SEQ ID NO: 49545 - DNA, 601 bp, Human
aactcaaatgtcacttcctcaaactttgcatgtagactcatctcctgacatagattttatcacatcatagcctgaacttcaattagtataattttctgcaaacaacctaaagcaatatacaagtaagtaagtaatcctcctaaagcctttgcattccagttttgtatcatccagtttatgtcacaaacagggtcaaaatataaaagacaacttactctaggataaattttccattttttctatttttttcccggatattttgaaatgaaagctcctctgagaagtgattattttctcctgwatacacagttctcaaaggaaggcatattaatgtccagcagttatatgaaaaaaggcacaagatcactaatcatcagggaaatgcaaatcaaaaccacaatgagatattatctcacacgtgttgaaatgtctgttctcaaaaagacaggagactggttagccagaatgtggagaaaagcaatccttgtgcactgctggtggaatgtaaattcctagagccattatggaaagcagtatggaggctcctcaaaaaattaaaaacagaactactaggccaggcgtggtggctcacacctgtaat

SEQ ID NO: 49546 - DNA, 601 bp, Human
tcactttatctataatagttattaacgtcgactgtgaaacaaatattttaacttggtgttactgccaagtaatatttatcgatgtttcaccaaaaagaattcttatctgggtagtgtacaaattgtacttaaggcagtctccctaaatgttgtcttaggaaatgaatgatatctaaataattaatgggagatgactatttcaggcaaaggccacaaaaactgcatgtaggagccaaaattttgcttccctccataatcctaaaaagaatatccagtgtccttcaacgaaattttgtaaaawgcgcagtgtgcaacattttctcaacagttttctaaagttgcatttttcaaaccccactcattagagttttattttagccattcattcacaacactgtgcattgttttgcacagtgtgaagcattagtttggcttatgtaaatggtgcagtgaacaaaaactgaacagttagttaagagtttcctcctgaatgacaagccccatgactttgctagtcatacttaagtaatatgtcttatggtcactttgtgtcaaagagaatagaataaatatattctattttatacttgtaaaatataaa

SEQ ID NO: 49547 - DNA, 601 bp, Human
gggaagacacagagtcagattaagcagcagcaatttgtaccacaaacctattagttatatcatgatttaattcctctatcaatctaaggaattaaaagttcagagcatatttcttgaagagtttgcataaaaacctctacttccgtaggctggtatgaagtttcaatggatttgaagagctccatattgctgttttagatctgagtatgtcttataaaattcactttatctataatagttattaacgtcgactgtgaaacaaatattttaacttggtgttactgccaagtaatatttatcratgtttcaccaaaaagaattcttatctgggtagtgtacaaattgtacttaaggcagtctccctaaatgttgtcttaggaaatgaatgatatctaaataattaatgggagatgactatttcaggcaaaggccacaaaaactgcatgtaggagccaaaattttgcttccctccataatcctaaaaagaatatccagtgtccttcaacgaaattttgtaaaatgcgcagtgtgcaacattttctcaacagttttctaaagttgcatttttcaaaccccactcattagagttttattttagcca

SEQ ID NO: 49548 - DNA, 601 bp, Human
tggctcaatgtagcacccaagtgatttcaattcctccctattactttttaattcttggctgaagagtagaaagtattttggatccatttttaattagcaaaactcacttcctatgcagaatgtttatcgcatttgtggggccaatgtccagagtcacaaatgttttggtcaccagtgataaggatgccagcttcattgttcactttgttgtaatgtgtggcttttctccagaaaataaacgttgacttctatctcacatgtgtttttgaatttagcctgactatgactttgtatgtaagaytgcataagggtggatagcctattatgctctcagtgaaagcagaaactttcagaaataaaaagtgcgagacttttatcacactgcaaaataaaaaaaaaattcagatgactttattttagttcatgggccagttgacttttctgtttgaattaaccagaagtttggagactgagaatacagatttaatgaactcaaagggagtcctagagctatcaccgtgggatggggttgattgtctttagataatggaatatctaattcatatagaacactgggaagacacagagtcagattaagcag

SEQ ID NO: 49549 - DNA, 601 bp, Human
actagatgacatgaatcagtccttgtgatcaaaattgtaataaaagcagtaaattgttgtaacctggtacctcaccttactctggattccagttaaagctcctgctgtgtttaatgagagttccgctacatcttgcaggctcttgtcctttttttctttcccctgatgaaagaaattcttacagtccttgatagagaccaaatgacactgtggtttagaggagtaatgaaagcgctttattctgtttatgtgtcaagatttttatcaccaagtctaattctgagtattgagggatttttttatccccctaagctcctaaatactagcaggtagtaaaacctaaaatgatagctagattggttgggacttaaatgagacaaagccagggtaaaaaatggagagtctattcatctggttaaggacagttctcatgtaagaatgactttgctcttcctttcctgcaatcttctaagctgggatgctcctgagcagcaatttgaggctgccatgacattctctgaattgcttctccagaatggctcaatgtagcacccaagtgatttcaattcctccctattactttttaattcttggctgaaga

SEQ ID NO: 49550 - DNA, 601 bp, Human
agcatgactctacccagtgacaaccattgcagagattctcattgatgagttgcttgcattctaaggagatccttaaaagccagctgcaaccacagtccaagcaaatcctaattccttccctgcagcaaaggcacactctcctgtgaagaagggtttcctcctaacgtggtacagttgcccaaactccccagatggcgttgctggaaaggtatgtcatcgggaaacaaacttaagacacaaatgaataaagcacagcagattatgtacccggctaagggaaatagtgcaaagagaaaaaaaagggaagagacttaatgaaagaagaactgataggaaacagtaactgaattcggagccactgaacactttgaaagatgggattaactcatgaaagacttcttagaaagattttttccggcttgtgtgggaacaatcattaatatgaattttaacacttatcattttgttgttatttaatttggaattgatagtgcagtatcataaaaatttcttctgtttattcatcctaggcaaaattgtatttgacactttagttttggctaatgctgtgtgtaaaagaagtagtgatatgtattagtct

SEQ ID NO: 49551 - DNA, 601 bp, Human
ccttttgccacatgaaaatgcagctagaagttggcagtctgcaaaagcaaagtaggccctaactagaatctgatcattctggcggcctgatctcagacttccagtttccaaagctgtgaaaaataaatttctgttgtttataagccacctagtctatggtactttgttttatcagctaaaactaagaaaatgactgataaaaatgttctttcttgttcgaggtggtctggggacaaaacccagttaacctctgtgggtggtgattcctttaatagcatttttatctttactgttatttgtwtcaaaggctatgaccccacatagcatgactctacccagtgacaaccattgcagagattctcattgatgagttgcttgcattctaaggagatccttaaaagccagctgcaaccacagtccaagcaaatcctaattccttccctgcagcaaaggcacactctcctgtgaagaagggtttcctcctaacgtggtacagttgcccaaactccccagatggcgttgctggaaaggtatgtcatcgggaaacaaacttaagacacaaatgaataaagcacagcagattatgtacccggctaaggga

SEQ ID NO: 49552 - DNA, 601 bp, Human
atcaatctatttaaaaactgccagaaggctttcttctagctctacaattttaggatgaggttcaatgtgttaacaggtgcaatgatcaaatatcatttgcctatgattcaacctaacacatcctgaggatctgctaaaagaatcccctcactatttagcttattttcttaaaataagcaatacatgttgtcctgtgccataaaagtcctggaacatccattctgagatattttgttgaacgcctttggaattttagaaggctaaaccaaatttctttgtatcatttgtttattcagttaawgaaattgtgtcacttataaaggcccaggcagatccagatttatatggagttaagtgagaatcataatttctgccagagcataaaacatttaatacatttaattccatgaactaattgaaaacagtaacagcaaggttttgtaggctggtaccttttttggaagagaaatgcattctggtatgcaaaacattttgcaaaattaagcacatattagaaacacatgaagcatattacatgccgactttattaagaagggtcaatccaaacataaaaataaaataaaagattttccatctcaca

SEQ ID NO: 49553 - DNA, 601 bp, Human
gctgatgtttggggtgtaaatcccatcacccaggtattgagcatagcacctgataggtagttttacaaacctctctccttcccccctctagtagtccacagtgtttattgttctcatatttatgtccatgtgtgctcagtgtttagctcccacttataagtgagaacatgctgtatttggttttctgttcctgtgttaattcacttaggattatgggtcccaactgcatccatgttgcagcaaaggacatgatttcattttttcttatggccatgttgtattgcatgctttatatttaccmcattttctttatccaatctgccatagatggacacctagtttgattccatgtcttagctattgtgaatagtgctgccatgaacatacaagcacatgtgtctttttaatagaatgatttattctcctttgggtatacaccaagtaatgggattgcaaggtcaaatggcagctctgttttaagttctttgtctctccctctttctacacacaccaaagccctcgatctgagctctgattacatctgataaggatctccttccctccgttgcaacccagcttgtgtgccaaccttgccatgcag

SEQ ID NO: 49554 - DNA, 601 bp, Human
gtattttttgtacagacagagtttcaccaggtttctcaggctggtcttgaattcccgggctcaagcaatccacccaccttggccacccaaagtgctgggattacaggtgtgagcctctatttccagcctctttctttctttcttttttttttaatttcaagttttattttagatacaaggggtatatgtgcagtctttttacatgggaatattaaatgatgctgatgtttggggtgtaaatcccatcacccaggtattgagcatagcacctgataggtagttttacaaacctctctccttsccccctctagtagtccacagtgtttattgttctcatatttatgtccatgtgtgctcagtgtttagctcccacttataagtgagaacatgctgtatttggttttctgttcctgtgttaattcacttaggattatgggtcccaactgcatccatgttgcagcaaaggacatgatttcattttttcttatggccatgttgtattgcatgctttatatttaccccattttctttatccaatctgccatagatggacacctagtttgattccatgtcttagctattgtgaatagtgctgccatga

SEQ ID NO: 49555 - DNA, 601 bp, Human
agtatagatgttgatgttgcgaggttccgggtaaaagcaagagcagatcagtgacagcatggacagctccttcattttttccttgtaggctgaaatgaaaagctgaagattagtatatttcattttttctgaatttctctttactgcttcctttaatttgaataataattattgcctcctgcagagtgaatattgccaggtagactcctttgcattctttcactaaatataaaggaatgcaagatgtcaacagaattctgaagtgcatgttccttagtgcagaggagatcaattgcatagyatagcaggttaaataacaagagaaagaaagggagttagaaaaacaaaggaaggtcgaaggaattaagatctagcaggataggagggagagagaggaaacagatggaattagtggaagcagacatgattaccagagagagaggctcattctagtaaatgtgcatgcaggtctattgtacataagtaagattccggagggctactctgatggttcagcctgaattgccacgtactcatttgggaatagtcagataactcatcaggatagttattaagcaaacacattatccagggtcctatg

SEQ ID NO: 49556 - DNA, 601 bp, Human
ttgagtcccaaactccatctctctggttttagcccactgatccttgtttgaagtctgaagctacccatgattaggccattctctgtggtgcaccaccatttttcaagtatttgaaaacagttatgttccatttcaagttgttcccccaggctaaacatcttcaagtgccccagaatgacactgtttctagatctttaccaccatattatttcctaacctctaagtgctctctaatttattaacgtctttttaaaattgtggcaaccaagccagcaggttatgttcccgttaatgttctttyagcagcctggttagtgcacatggaggttgtggtcaagtaaaatgccaggctggcaggccttgacctcagatccttagctgctaatagatagtctagataatactaactcaataactatattggaaatgatgtgggctttttccttcacaaatgtaaaaatgtttttcattttcctgatggcatccaagattatacttaaattttaaatacaattttataaaaattatggaaacctatggataaggattataagagaacacgggcaaataaaaacagcttatttgataaggtgatggggtt

SEQ ID NO: 49557 - DNA, 601 bp, Human
aaaatgcaatgatttttaaaagaacctcgctggtcagccctcaatttcagatgagcattctttgagtcccaaactccatctctctggttttagcccactgatccttgtttgaagtctgaagctacccatgattaggccattctctgtggtgcaccaccatttttcaagtatttgaaaacagttatgttccatttcaagttgttcccccaggctaaacatcttcaagtgccccagaatgacactgtttctagatctttaccaccatattatttcctaacctctaagtgctctctaatttatyaacgtctttttaaaattgtggcaaccaagccagcaggttatgttcccgttaatgttcttttagcagcctggttagtgcacatggaggttgtggtcaagtaaaatgccaggctggcaggccttgacctcagatccttagctgctaatagatagtctagataatactaactcaataactatattggaaatgatgtgggctttttccttcacaaatgtaaaaatgtttttcattttcctgatggcatccaagattatacttaaattttaaatacaattttataaaaattatggaaacctatgg

SEQ ID NO: 49558 - DNA, 601 bp, Human
ttctgtatgttcattgcttccagtcatcaatcatgcacagtgcccactccagggatgacaacatcactctgtgatgggggtccttgtcttcaagatgcttacagtctaatgggggcaataagacaacaccccattgtaatgtctttgctcctgtgttgttgctgtttagaatatcctcctctagtgtactcggctggagccaggagccagggatagagccactgtggtggaggagggagtggcaacatctactaatctaatttatacacatacacatggaatactgttcagccttaaaaaagttgggggaaatcctgtcatttttgacaacatgggtgaacctggaggacactatgctaagtgaaataagctaggcacagaaagacaaataccacatgatctcacttacatgtggactattcataaagttgaactcacggaagcagagtagaattgtggttaccaggggttaggggtggagactggggagatgttgatcaaagaatacataatttcagttaaacaggaagaacaaatgcaagagacttattattgagacggagtttccctcttttgccaggctggagtgcagtggcactat

SEQ ID NO: 49559 - DNA, 601 bp, Human
taggaatcacaggagctacgttagaaccagtgtaactccctgaacagttgggcatatttggcaaagtcaatgctgaaatgcaaagcatcctgctgatttctgttttgcccttctgtatgttcattgcttccagtcatcaatcatgcacagtgcccactccagggatgacaacatcactctgtgatgggggtccttgtcttcaagatgcttacagtctaatgggggcaataagacaacaccccattgtaatgtctttgctcctgtgttgttgctgtttagaatatcctcctctagtgtactyggctggagccaggagccagggatagagccactgtggtggaggagggagtggcaacatctactaatctaatttatacacatacacatggaatactgttcagccttaaaaaagttgggggaaatcctgtcatttttgacaacatgggtgaacctggaggacactatgctaagtgaaataagctaggcacagaaagacaaataccacatgatctcacttacatgtggactattcataaagttgaactcacggaagcagagtagaattgtggttaccaggggttaggggtggagactggggaga

SEQ ID NO: 49560 - DNA, 601 bp, Human
gcaattggaagtagcgttgttattccgggagataggaataaaatgctgtttatgagcatttgctctatgttgtttagaacatataagacctctctgtctttagtgtaactatggatatattttaacagaataaatatttaccatattgagaaatttgacaatatctgcagggagttgaataacggtaagcatacttagataaaaatagcctaaattgattttaaattaagctttattttccttttgaacaaatatgagctttgcatgaaaatcaagtagcacagatttatttgtttggaarttatcgtagctgtaggccctttttggttagacgagaaacataacggagttcttcagttctcacatataatgagatatcattatctagatatgcgtatatatgcatgcaccattatatatattatcaccattcctgtgcttaggaatcacaggagctacgttagaaccagtgtaactccctgaacagttgggcatatttggcaaagtcaatgctgaaatgcaaagcatcctgctgatttctgttttgcccttctgtatgttcattgcttccagtcatcaatcatgcacagtgcccactcca

SEQ ID NO: 49561 - DNA, 601 bp, Human
agaaggaaaacctatggaaaaagttacctttcttctttcctctgcagcctccagtttcttctggatctcctccagggacaggtctttcttctttggagaagctaaagttcgtggggcttctgagataggagatggtggcttcaagatcagctcaaaagcctggccagaggcacgtttgttgatttgcttcacttccatatctgaaaagtgaacatttgagaatgttaagcatacaaagcttgcagcatgggtttattttaataatttagattccagcaattggaagtagcgttgttattcygggagataggaataaaatgctgtttatgagcatttgctctatgttgtttagaacatataagacctctctgtctttagtgtaactatggatatattttaacagaataaatatttaccatattgagaaatttgacaatatctgcagggagttgaataacggtaagcatacttagataaaaatagcctaaattgattttaaattaagctttattttccttttgaacaaatatgagctttgcatgaaaatcaagtagcacagatttatttgtttggaaattatcgtagctgtaggccctttttg

SEQ ID NO: 49562 - DNA, 601 bp, Human
cacagatcctgagagggaggaagcagcacttcttcccctccccaccactggagttcgccagggctgtgttttctctacagtgcttctgcctgatggtctagggaagggaggcttttataataaggggattcaatatacgggaaggggcactagagcactgaagctctttggatttctgagagctctggtttggctagcctaaaattagcatctatcttacagtttttaccccaactagcctggctctgtgtctactgaaaacctatacatgttggcatggcacaggttcagctgtcattgytctctgtatgtgtgtgtgtgtgtgtgtgtgtgtgtgtgtgtgtgtgtgtgtgtgtgcgtgcatgtgtgcccgagtgtgtgagagggaggagcaggggagggagagagagaaggaaaacctatggaaaaagttacctttcttctttcctctgcagcctccagtttcttctggatctcctccagggacaggtctttcttctttggagaagctaaagttcgtggggcttctgagataggagatggtggcttcaagatcagctcaaaagcctggccagaggcacgtttgttgatttgcttcact

SEQ ID NO: 49563 - DNA, 601 bp, Human
ggcaagctcttggcccttaccctgggcaggaaagatcttggagggaagatctggtaatttgtaattccaaggaaaaccacgcctgacaaagggggtgacacagatcctgagagggaggaagcagcacttcttcccctccccaccactggagttcgccagggctgtgttttctctacagtgcttctgcctgatggtctagggaagggaggcttttataataaggggattcaatatacgggaaggggcactagagcactgaagctctttggatttctgagagctctggtttggctagcctaarattagcatctatcttacagtttttaccccaactagcctggctctgtgtctactgaaaacctatacatgttggcatggcacaggttcagctgtcattgctctctgtatgtgtgtgtgtgtgtgtgtgtgtgtgtgtgtgtgtgtgtgtgtgtgtgcgtgcatgtgtgcccgagtgtgtgagagggaggagcaggggagggagagagagaaggaaaacctatggaaaaagttacctttcttctttcctctgcagcctccagtttcttctggatctcctccagggacaggtctttcttctttg

SEQ ID NO: 49564 - DNA, 601 bp, Human
tacaatattaatatataattatggtatacatatacatatatacacatcacatatacaccagttaccattgttatatttatatctataattggtatatgtaatatatagagatagctatatatatctataatatagatatctctatataccaattaccattgtaattatatatataaaaattcatatatatatatatgacatgctcatcggacatttggagaacatcactcttaggtgaaaattgagatcagcatattacatatcataggaggattttttttcaactacaaagattagtgtwttcttgtttagaaaatttaatctaaggatttctaatgtttgagcctcattatttgataatacacatatttgtgtacatatatgcatgtatatatgcacatatactatacacagcacatctgtgtttgtcctgcattctctcttggagaattcaatctttaggaggaggattatcttcattctgtttttaattatccaacatagaagtgtccaaagttttggctgactttttagagaaaacatcataaaactgtgcagggaacatgttcttagtgattacctgattctaaaattatatcat

SEQ ID NO: 49565 - DNA, 601 bp, Human
tattttatatatatatatatatatacacacacacatacacacaccaatattaatatataatcatggtgtatatataccaatattaatatataattatggcatatatacaatattaatatataattatggtatacatatacatatatacacatcacatatacaccagttaccattgttatatttatatctataattggtatatgtaatatatagagatagctatatatatctataatatagatatctctatataccaattaccattgtaattatatatataaaaattcatatatatatataagacatgctcatcggacatttggagaacatcactcttaggtgaaaattgagatcagcatattacatatcataggaggattttttttcaactacaaagattagtgttttcttgtttagaaaatttaatctaaggatttctaatgtttgagcctcattatttgataatacacatatttgtgtacatatatgcatgtatatatgcacatatactatacacagcacatctgtgtttgtcctgcattctctcttggagaattcaatctttaggaggaggattatcttcattctgtttttaattatc

SEQ ID NO: 49566 - DNA, 601 bp, Human
taatactgtgatccctggatccagctgttcctgatgctgtagccactcctagactttttagtcacatatttgctttttgttttaactagttgagttgggttttggttataggcatgtccttactaacataattactgagatatatgcacttgctaaagactctttaaagataattaatagttctttaaattagtgctaattaagtcagtataacccaatagaataaaatcaattagtgattttttaaagttggcactttctgctaattagttgtattttcttttaattaaaactctaccaktaacaaaaaaaaaccataaaaaactaaaaataaaacccgaccactagggcataatctatatggttatttttgcattacaaaatgtttaacaaataactggaaaggtgatggaatacggcttttaaagcattctaaggaattttttttttctgggcatcataacactggatgattacatttgtaaatgtcttttaaccatgtggccagtttctagttcaattcaattgtttaaatgtataatcattgataatttcttgctgtcagggtgcaggagctttatcagtttcattaattagtaac

SEQ ID NO: 49567 - DNA, 601 bp, Human
tgtaagaaaataacggcaacagggcaacagaagggagatacaaattgaatagtgtatgaactaaataattattctaattgttatagtaacactaaacatttatagatagaaaatgtggacatctatagttttgtttatttaagatccattaccccttcctcttgtgagaacacctcgattttcttctggggaactacccctccacaattcttaccccagggatcttacctaaaatcctttgcaggtcagtggtgggcatgtgattcaggctagcatatcaaactactacatcctcttggcyataatgattggttctgggttgggcctgtgatccaggccaggccattgagactcaatttcgggacttttgttaaactattgggaaaaagaagctctgtttctgctggagttgctaagttgtgagaaaaataatttggaactgactattgaaattaaactttcttgataatgaaaccagttaaatgcaggaagagatgacaggcactgaaagaaagttttctgataatactgtgatccctggatccagctgttcctgatgctgtagccactcctagactttttagtcacatatttgcttttt

SEQ ID NO: 49568 - DNA, 601 bp, Human
tgatgagtatcccctgtgtctagaacagggcctgccaaatagtaagtgcttgataaatatctgttgactgagtgattttgcccagactaggatttccttagtgcaatttcagatgtcatttggaaacttagtgactataattgttttaggatgggagggtggaataaaaaatcaaaacaagctatatattgccgctttcacatttggccctgaaagttattatttattaatttacttaaaaacatttgtagtactcaggcaatgactaacaggagttgaataagaaagaaaaaaaatgttyacagtaataactattgccaagcactattaaacaaaagacaagttctatcttcatggagtttataatctagtagaagacatagggttaaataaatacatatgcatatatatactaatatgccagtaaatactaattacttactaattgtgctaggtgccacaaaggaaaacctgtttaccatgaacgagagtgagagatgaaacctaggttcagagaagtcccctccccacagtgaggaactgaaatagaaacagagtaggtagctgaagaaggcatgagatttagaagatcctattactt

SEQ ID NO: 49569 - DNA, 601 bp, Human
attcacataaagtagtgaaatggctttattatccttcatgatctcccatttcatgtgaagtcaaagtccttaattgtgacctctgacttcagttgctaccactctccccctgctctcagcttcagccacgctggcctccatgttatttctcaaacacacctcatacattcctatttcagggcctccgcacctgctgctctcatcattttgaatgttcaggtcccagagaagagctgcccgccctactcccttgctacctttgtgcttcttttcaaatgtcttattcaagaggtttttttttgactatccaataattatattattatatatagtaataataacatataatattagcttctttcacccccacacccccagttctctttgtcctgctaattttgcatcatctaatatgctgtgtatgtatttattagctctttctcccccactggaatgtaagtttgatgagtatcccctgtgtctagaacagggcctgccaaatagtaagtgcttgataaatatctgttgactgagtgattttgcccagactaggatttccttagtgcaatttcagatgtcatttggaaacttagtgactata

SEQ ID NO: 49570 - DNA, 601 bp, Human
aggatgctcatgtaattgattgtccaaagtggaacacttatgagagtaaagagaaataattaataatggtatcaaaacaacgagagttagctggagttgtcctgggccaactgggatgtatagttatgctaactctgctgcctcttgctaaatacatgttggttgaatgaatgaataaatgataaatggatggttaaagcattcatgtcatttcacccttgtgggtcagttgcattatggaaactttgatttcaagagatgaggttcaaactgacctgatgagattgatatagactcataragatgatcatcactgactaccagcgataatcaaagaatggagaaaaagcagggaaagggcttattctttttatgacaagcttcttctattatctaatcactggagcactaattctggttcaaaggagcccgagggagtatcctccaacctagtaaccagatggtcagtgctgcaatagtgtcaacagatggaatggggaggtggggacattgccaaaacattgaacacaaagtgaatctgagcccaagtggcgatgcctctgtggcagccttccagctataaacccagaaagccccccaa

SEQ ID NO: 49571 - DNA, 601 bp, Human
ttttaagtggtggaaccaggatttgaacacagacattctcttaaccacatgttcttaaagacaatattttaaagatgcccttaaacactgtgccctgctaaggatgctcatgtaattgattgtccaaagtggaacacttatgagagtaaagagaaataattaataatggtatcaaaacaacgagagttagctggagttgtcctgggccaactgggatgtatagttatgctaactctgctgcctcttgctaaatacatgttggttgaatgaatgaataaatgataaatggatggttaaagcrttcatgtcatttcacccttgtgggtcagttgcattatggaaactttgatttcaagagatgaggttcaaactgacctgatgagattgatatagactcatagagatgatcatcactgactaccagcgataatcaaagaatggagaaaaagcagggaaagggcttattctttttatgacaagcttcttctattatctaatcactggagcactaattctggttcaaaggagcccgagggagtatcctccaacctagtaaccagatggtcagtgctgcaatagtgtcaacagatggaatggggag

SEQ ID NO: 49572 - DNA, 601 bp, Human
atttaatggggttagtacttttgttgctattggggctaaatgagattacacagcataggtgtcaagtgcatttctttagcacaattaatggggtgaaacagaaacagaaggcagtacagagtgtggtcacgtgagtctgctgctaactcacagagacctgccaaactaggccaggctgtgcttcagggctgctcacttctgtggtaccttttcttacaccctggaagggaatgttatatccactattaactcacacatttgcaggacttaataattgtctgtgtttcaaatatttaaaacytaagtccacacatacaaaaatacaggatgtcaagtcaattatggtggaaagcattctatcccaaggaaatacttatgacttcctatattagtctctattcataagcattcaatatttttttttaaatttagagacagggtcttgctttgttgctcaggctggagtatagtggtgtgaccttagtttactatagcctcaaattcctgggctcaagagatcctcttgcctcagcctcctgcacagctgggactacaggcgtgcaacacgacacctgtccagcagtcaatttttgaacaaatt

SEQ ID NO: 49573 - DNA, 601 bp, Human
tttttagtggaaccaatgctttcttactttgtattggtttcaggaaaaccaatacaaaaataataagaaaattataacataaattgagttcaaactccaatggagcctttctggaagaaatatgaataaaatattttctagctggttcactctcctgcctctaggtgggactgttggtaaagcatcctacacagactttgcttatttgctgttatcaggactacggaattgttacagggagagaggtgtgtgtgtaaatatttaaagtttctctctctgggaaaagtcttcatgaaattawtttttttggtaatggataagaatagtacctatctcatatggttgtcaggatcaaacaaaataatgtttgcaaggtatttaatgcagtgtctaatatcaagtaagttagtactgaatgagtggtaatcattattatcaaaagcaaaatttaagacacttgtgacaaggagatgatggcaactggacttactggtataacaactcaaatgcaaaattttggcaatttcatgtgtgtgaagtatttgttcaaacttctttgattatgaacagttagtggattcagggatcctgatggttgatg

SEQ ID NO: 49574 - DNA, 601 bp, Human
accagccctgcctcttgctttaaccccataatggtttcaggacattttactatttatgtgtttatttttttttagatagagtctcgctctgtcacccaggcagaagtacagtggcgtgatctctgctcactgtaatctctgcctctgaggttcaagcgattctcatgtctcagcttcctgagtagctgagattacaggtgtgtgctaccacaccctgctaatttttgtatttttagtagagatggggtttcgtcatgttggccaggctagtcttgaactcctggcttaagtgatccacccrcctcggcctcccaaagtactgggattataggtgtgagccactgtgcttggctggttttaggacatttttagtggaaccaatgctttcttactttgtattggtttcaggaaaaccaatacaaaaataataagaaaattataacataaattgagttcaaactccaatggagcctttctggaagaaatatgaataaaatattttctagctggttcactctcctgcctctaggtgggactgttggtaaagcatcctacacagactttgcttatttgctgttatcaggactacggaattgttaca

SEQ ID NO: 49575 - DNA, 601 bp, Human
attttagttgatggtagtggttgtggacatttactggaaaggtctttttgtataaacaatatggggcctggagaaaggagaaacttctcttcaaataaaattctacagaaatgggaaagtcagacagccttacacatctttactgatgtgtttattctcaagttgatcaggaataggtctgtggctcactggagattagacagaaaatcctgggaaccagccctgcctcttgctttaaccccataatggtttcaggacattttactatttatgtgtttatttttttttagatagagtctcrctctgtcacccaggcagaagtacagtggcgtgatctctgctcactgtaatctctgcctctgaggttcaagcgattctcatgtctcagcttcctgagtagctgagattacaggtgtgtgctaccacaccctgctaatttttgtatttttagtagagatggggtttcgtcatgttggccaggctagtcttgaactcctggcttaagtgatccacccgcctcggcctcccaaagtactgggattataggtgtgagccactgtgcttggctggttttaggacatttttagtggaaccaatgctt

SEQ ID NO: 49576 - DNA, 601 bp, Human
cctggcatctacctccaaagattctgattccaaggttctttggtgaggcccagtgataagcatcactagtgactcaaatgcaggtagtccagtctaccttttgtaagtcatactggcatgggctttgatgtcaggcctgtgttcaagtcttacctctgtttgtgacccaggatgtgttacgtaacttctttccatattctttttattctccccattatgcagctgagaaaagtcccacccaatactgacctatttaggtttaagactaaattattacacactcatggcttctggataattyctcaggatcagctgatgccccgaggcaatccttcacaggagtaattataagtgggaatatctaaacaatggttgatcaaaaaataatcctaagtgccctgttaaatactgattaccattgaaagcattagtgggaaaacattttagttgatggtagtggttgtggacatttactggaaaggtctttttgtataaacaatatggggcctggagaaaggagaaacttctcttcaaataaaattctacagaaatgggaaagtcagacagccttacacatctttactgatgtgtttattctcaa

SEQ ID NO: 49577 - DNA, 601 bp, Human
tcctgagactggggaagaaaaacatagccatcttataattatccaaacacaaacctagcagaataacggcccaccaattggagggagcattcttttcagatgaatagtactcccagccttgagcactattgtcaagtctgtactcatctgcatggcttagagttttctatagaatgtggctagttgggaaatgcggttagctgaattttcagctgtgagtatatttcggactgtcttagaagaagaagcatttaatcctcattgaggagttacaaatttttttaaaaaaaggctttgttgstaagcgtttatgcaacagaaaatgctataatgaattacaggatggcaatattcaaccaaagcctgaggaaaacagttgaggactgagacaagttctgatcttcttcctgatccattgttttttcatcaactgtaggctaggccctacaataagcttttcaattttcatcaatcaaataatcaaattcactttctccttttatttcacacccccttcccccctccctatcccccatacaccaaagtctctttggagatctgagaacagtgcaaacttagtgtccccttggccacagagagc

SEQ ID NO: 49578 - DNA, 601 bp, Human
catgaaactctgagaaatagaaaacaggaggctcatctaattaaactctcagggctctgatgacaggcacactcctgttttgctctgcatctccaatgcctatcacacaaaggcacttgctactggcgggaagggtgactgactgctcagaaaaggattgaggcgtctttctcaaacatcccatttctcaatgcttattccaatttctggaaacggacacagctaaactactcacagctatactgtatattttcaaaggaaaggttttttgaggggataggtgggagacagcatagagagyacaaaagtgaaagacagcatttttcagaagaactccagcacagctcctcctgactcatgggaatgaatatatgtttaggttgttgaagagaagggcaccaggataccagaactggatgaaacatcccctatgagctaatctttgctatggtcccatgtgatgctattataccctagaatgggcttaccagtgttcataaataccctggccttttctggcaaatatatttttctaatttaatattttaattaaatatatatttaatgtcatatattaaacaaatattaaatcaaatgttat

SEQ ID NO: 49579 - DNA, 601 bp, Human
tttaagcactctttgggttgattatttgcaggaaaagtggtgtgcagatgtacatgtatgcatgtatgggggagggcactaaatttggttgggagtggaaagagtacaaaaatgagctgagcatggctgggctaggtgaagagaaaaaaacacacagaggaaaaaaatggtccgttaaaagctagcacttctggaaatattagataaaatatggaaaatttttgaactattttacaattgaaatcaagaaggatatgccctggctgggcacggtggctcacacctgtaatcccagcacttygggaggccgaggtgggtggatcacttgaggtcaggagtttgagaccagcttggccaacacggcaaaaccctgtctctactaaaaatacaaaaattagctgggcgtggtggtatacgcctgtaatctcagctacttgggaggctgagacatgagaatcacttgaacccaggaggcagaggttgcagtgagctgagatcgtgccactgcactccagcctgggcgacacagcgagactctatctcaaaaaaacaaacaaacaaaaaaggaggctatgccgtgtgtttgggtatgtgtaatttg

SEQ ID NO: 49580 - DNA, 601 bp, Human
atattggaactatatggagagtttttaaaatgtatggatgctgggtcccatccttggagattctgtgggttgatgtcaggaattttaagcactctttgggttgattatttgcaggaaaagtggtgtgcagatgtacatgtatgcatgtatgggggagggcactaaatttggttgggagtggaaagagtacaaaaatgagctgagcatggctgggctaggtgaagagaaaaaaacacacagaggaaaaaaatggtccgttaaaagctagcacttctggaaatattagataaaatatggaaawtttttgaactattttacaattgaaatcaagaaggatatgccctggctgggcacggtggctcacacctgtaatcccagcacttcgggaggccgaggtgggtggatcacttgaggtcaggagtttgagaccagcttggccaacacggcaaaaccctgtctctactaaaaatacaaaaattagctgggcgtggtggtatacgcctgtaatctcagctacttgggaggctgagacatgagaatcacttgaacccaggaggcagaggttgcagtgagctgagatcgtgccactgcactccagcct

SEQ ID NO: 49581 - DNA, 601 bp, Human
tttactgttattactgaccctcttttaaatttctaatttaataggagtaacttcattcaaacaaaatgctaaatattacttccaatataaaactttgtcttattttaggaaaaagcaaagtagttttagtatacacattcacaatatgtaaaccacaattttgtattaaatccacctatgtgatatacatcaaatcaaagtaaatatggtatttcctttttattgaggagataaaagatcttgactgacactggccaaagatcctattagatttgaaaagcacctcattagctatgaaatrccagaaaaaaatgtggtcctagaatttctctgggctgcattatgtgacgtgggatagactgctgagagctgagatttaaatcagaacaggctacgaaccactagttctcaaatctggctgcatattggaactatatggagagtttttaaaatgtatggatgctgggtcccatccttggagattctgtgggttgatgtcaggaattttaagcactctttgggttgattatttgcaggaaaagtggtgtgcagatgtacatgtatgcatgtatgggggagggcactaaatttggttgggagt

SEQ ID NO: 49582 - DNA, 601 bp, Human
acaagaaaacaaaagatgagaagaatgcaataggtgtaaattgataatagctggaatctataactaaagagttaaatattgtcaacatcagggaaatgcaaattaaaaccacaatgaaataccaccttactcctgcaagaatggccgtaattaaaaagtcaaaaaacaataggtgttggcatgggtgtgatgaaaagggaacactttacactgttgatgggaatgtaaattagtatgaccactgtggaaaacataaagaactgaaagtagaactatcatttgatccagcaatcccactgcygggtatctacccaaaggaaaagaagtaattatatgaaaaagacacaggctcatgcatgcttatagcagcacaacttgaaattacaaagatatggaactaatgttaagtgtccattgaccaacaagtggataaataaaatgtggtatatatacaccatgtaatactactcagccataaaaaggaactaaatagtgtcttttgcagcaacttgggtggagctggaggccattattctaagtgaagtaactcaggaattgagcactaactatcatatgttctcataagtgggagctaagctat

SEQ ID NO: 49583 - DNA, 601 bp, Human
taattctttcctctgatttcatagaaagatttctctactggaaggtaagaaatatgaggtctttcctttctttactttttaatgtccctttaatctcactaggtatcaaatataaacaaggacttggactatatgacctaggatgtcaattccatctatggaattctgtcatatgagcctaattaaattcaagatgaggtcagtatcatcaaaaatccttctttttactaatgactatgcacttgcaatataaaaaaggggtcaggagtgagttgtgtgagctaagaaagcacatgttcayacattgagatgttggtgatcaggggtcatgggcagatagtaaaaaggtttggagtcaaacagacttgcattcaaatctagtctctgtggtctacttgtgatcttggccaaatgacttaatcttcctaaagaccaggttccttagatgtgaaatggggataatcacagtattttcttttaggttgttgtttggatgaaatgtgatagtacatccaaaaatgtctggcctatagcaaacaattaataaaggctagttttaatcccttttcctatttcattattcattcatcagacatgttca

SEQ ID NO: 49584 - DNA, 601 bp, Human
cagagaaggttcatcaagaagactactctttgataatatttatttcattattgatctcctgatatttgctaggcactgtcagaggcccaagcatatctaaatttacaatgttttctgcaatttacccccttcctcccatcaatataaaggaaatgtaatacaatattttagcattgtatgcagctatgccttttatatgaaaaaagatgtatgaaagttgattttaggaaaaattctggtcctctaattctttcctctgatttcatagaaagatttctctactggaaggtaagaaatatgrggtctttcctttctttactttttaatgtccctttaatctcactaggtatcaaatataaacaaggacttggactatatgacctaggatgtcaattccatctatggaattctgtcatatgagcctaattaaattcaagatgaggtcagtatcatcaaaaatccttctttttactaatgactatgcacttgcaatataaaaaaggggtcaggagtgagttgtgtgagctaagaaagcacatgttcatacattgagatgttggtgatcaggggtcatgggcagatagtaaaaaggtttggagtc

SEQ ID NO: 49585 - DNA, 601 bp, Human
attattaggctactttggagtacacttcttgttaaactcaaaattagtgttaacaaaatggattttgccataggaaagaataaatataatttgtgagcttgagataatgtggaaaaagagaaaataaatgattatgagtttctaattaaaaattatttgttttcaggcattttagtcactctattatttgaacactttacgttcacattatcgaatatttactcatgaactgttaatgtgactttatatcaaaatgtgggagaacaaaaggcagtcatgcaggaagcatgtaatttcccayacagtctgtttttcttatcagctcactgtttgcaattactagaccttgaatctagaggttcctaaagcagttgtgatactcagagaaggttcatcaagaagactactctttgataatatttatttcattattgatctcctgatatttgctaggcactgtcagaggcccaagcatatctaaatttacaatgttttctgcaatttacccccttcctcccatcaatataaaggaaatgtaatacaatattttagcattgtatgcagctatgccttttatatgaaaaaagatgtatgaaagttg

SEQ ID NO: 49586 - DNA, 601 bp, Human
gtattttttagtatgtggctatacatcagatgactaaaatcaaactgtcttgcatatatcataggcgctaaataaatgttcattgaattgaaattttaagatgctaattattagtagtattatttatatttctgtagaatgttgcttacattgcttctctccttccctctgaagctccagaaattgagactctatagattcttttagttcagaagaaataaacttgaccagctataaagtaaaacttatcgttaaactctattaatctcaaggagtctacacttatagggttctttatatyataatactgaatatttattaggcacttaatgtgtaccagacctgcatcagtacacgttttacctgtattaattcccttaatcctcacaataatcttatagtggacattctattattgtccccattttgcagatgaagaaactgaaacacaggaagggtaagtaacttgcccatcttcatgatactaacaagtgggatttaaacccagggaacctggctctacagctcactctcttaatcactgctatacaatttcaatgttgagtgaggagaacattttatagttgcatggaaaaatgtg

SEQ ID NO: 49587 - DNA, 601 bp, Human
tcattgagggcctggactatgttttatcatttttttttccatttgcagggcctagcagagtgctttgcagatagcatgtaattggtggatgtttatttacataaggaaccaaggtactagcctggggttgggaactgaacttcctgaggagggaactgatggaggaagtattttttagtatgtggctatacatcagatgactaaaatcagtattttttagtatgtggctatacatcagatgactaaaatcaaactgtcttgcatatatcataggcgctaaataaatgttcattgaattgawattttaagatgctaattattagtagtattatttatatttctgtagaatgttgcttacattgcttctctccttccctctgaagctccagaaattgagactctatagattcttttagttcagaagaaataaacttgaccagctataaagtaaaacttatcgttaaactctattaatctcaaggagtctacacttatagggttctttatatcataatactgaatatttattaggcacttaatgtgtaccagacctgcatcagtacacgttttacctgtattaattcccttaatcctcacaata

SEQ ID NO: 49588 - DNA, 601 bp, Human
acacacacttgatgtttcagtttaatggaattgtcttgtcatgcaattttcaatgctagtctttcatctccactggtcaggattataaacttactctttaagccctatgaccattgtccttttctccataaagatttttatgagactgcaaagactaacctgcaaacttatctcactttccatttgaacacctgcataaatctttccttttattcggcagtcattttattctagttgtattatgagcctctctgttcttgtctcctctattatatttgactgtaagctcattgagggcctrgactatgttttatcatttttttttccatttgcagggcctagcagagtgctttgcagatagcatgtaattggtggatgtttatttacataaggaaccaaggtactagcctggggttgggaactgaacttcctgaggagggaactgatggaggaagtattttttagtatgtggctatacatcagatgactaaaatcagtattttttagtatgtggctatacatcagatgactaaaatcaaactgtcttgcatatatcataggcgctaaataaatgttcattgaattgaaattttaagatgct

SEQ ID NO: 49589 - DNA, 601 bp, Human
gcgcacctccgcagcatgcctctcctaaaaaacacaaaaggaagaagaaatgtcacaggccctttttgtctggtcctttgcgtaccatgcgcttgactagaagtaacccagtttggtgtctacttttatgaatttttcccatttcagaaggaaaatatgggccctgcaaaatgtcatgttagaaaagatcttacaagacttactgtgttttaaaaaatatatttaacactgtttttgtttaaaactatgaccaaaagttcatgttattaagatagttttgaatattaggatcagagtataratccagagaaaggtaataaaacatcacattattgtttctctatcatttctaatgatgtcgttccttttgactaatattttaaggactttataatcctgatggacactctgggagggctagatccaggacgaagactttctatactgcttcttaaactcttgacctgtttgtcaaggcccttcataattgcagtccaagtgacgtttccagtcataacccccatcttttcctacacacacttgatgtttcagtttaatggaattgtcttgtcatgcaattttcaatgctagtctttcatct

SEQ ID NO: 49590 - DNA, 601 bp, Human
cagacagttcaacctggagttccttgttcctgcgcacctccgcagcatgcctctcctaaaaaacacaaaaggaagaagaaatgtcacaggccctttttgtctggtcctttgcgtaccatgcgcttgactagaagtaacccagtttggtgtctacttttatgaatttttcccatttcagaaggaaaatatgggccctgcaaaatgtcatgttagaaaagatcttacaagacttactgtgttttaaaaaatatatttaacactgtttttgtttaaaactatgaccaaaagttcatgttattargatagttttgaatattaggatcagagtataaatccagagaaaggtaataaaacatcacattattgtttctctatcatttctaatgatgtcgttccttttgactaatattttaaggactttataatcctgatggacactctgggagggctagatccaggacgaagactttctatactgcttcttaaactcttgacctgtttgtcaaggcccttcataattgcagtccaagtgacgtttccagtcataacccccatcttttcctacacacacttgatgtttcagtttaatggaattgtcttg

SEQ ID NO: 49591 - DNA, 601 bp, Human
gcgtgccagaccctcccttgcttcagccagacagttcaacctggagttccttgttcctgcgcacctccgcagcatgcctctcctaaaaaacacaaaaggaagaagaaatgtcacaggccctttttgtctggtcctttgcgtaccatgcgcttgactagaagtaacccagtttggtgtctacttttatgaatttttcccatttcagaaggaaaatatgggccctgcaaaatgtcatgttagaaaagatcttacaagacttactgtgttttaaaaaatatatttaacactgtttttgtttaaractatgaccaaaagttcatgttattaagatagttttgaatattaggatcagagtataaatccagagaaaggtaataaaacatcacattattgtttctctatcatttctaatgatgtcgttccttttgactaatattttaaggactttataatcctgatggacactctgggagggctagatccaggacgaagactttctatactgcttcttaaactcttgacctgtttgtcaaggcccttcataattgcagtccaagtgacgtttccagtcataacccccatcttttcctacacacacttg

SEQ ID NO: 49592 - DNA, 601 bp, Human
ttttgtttttttttttttataatgagttctttttaaaccatgtcatacattccccatcctgatatcgcatgatccattataatataggcagggggatttactattggtggggcgtgccagaccctcccttgcttcagccagacagttcaacctggagttccttgttcctgcgcacctccgcagcatgcctctcctaaaaaacacaaaaggaagaagaaatgtcacaggccctttttgtctggtcctttgcgtaccatgcgcttgactagaagtaacccagtttggtgtctacttttatgartttttcccatttcagaaggaaaatatgggccctgcaaaatgtcatgttagaaaagatcttacaagacttactgtgttttaaaaaatatatttaacactgtttttgtttaaaactatgaccaaaagttcatgttattaagatagttttgaatattaggatcagagtataaatccagagaaaggtaataaaacatcacattattgtttctctatcatttctaatgatgtcgttccttttgactaatattttaaggactttataatcctgatggacactctgggagggctagatccaggacga

SEQ ID NO: 49593 - DNA, 601 bp, Human; identical to SEQ ID NO: 19412

SEQ ID NO: 49594 - DNA, 601 bp, Human; identical to SEQ ID NO: 19413

SEQ ID NO: 49595 - DNA, 601 bp, Human; identical to SEQ ID NO: 19414

SEQ ID NO: 49596 - DNA, 601 bp, Human; identical to SEQ ID NO: 19415

SEQ ID NO: 49597 - DNA, 601 bp, Human; identical to SEQ ID NO: 19416

SEQ ID NO: 49598 - DNA, 601 bp, Human; identical to SEQ ID NO: 19417

SEQ ID NO: 49599 - DNA, 601 bp, Human; identical to SEQ ID NO: 19418

SEQ ID NO: 49600 - DNA, 601 bp, Human; identical to SEQ ID NO: 19419

SEQ ID NO: 49601 - DNA, 601 bp, Human; identical to SEQ ID NO: 19420

SEQ ID NO: 49602 - DNA, 601 bp, Human; identical to SEQ ID NO: 19421

SEQ ID NO: 49603 - DNA, 601 bp, Human; identical to SEQ ID NO: 19422

SEQ ID NO: 49604 - DNA, 601 bp, Human; identical to SEQ ID NO: 19423

SEQ ID NO: 49605 - DNA, 601 bp, Human; identical to SEQ ID NO: 19424

SEQ ID NO: 49606 - DNA, 601 bp, Human; identical to SEQ ID NO: 19425

SEQ ID NO: 49607 - DNA, 601 bp, Human; identical to SEQ ID NO: 19426

SEQ ID NO: 49608 - DNA, 601 bp, Human; identical to SEQ ID NO: 19427

SEQ ID NO: 49609 - DNA, 601 bp, Human; identical to SEQ ID NO: 19428

SEQ ID NO: 49610 - DNA, 601 bp, Human; identical to SEQ ID NO: 19429

SEQ ID NO: 49611 - DNA, 601 bp, Human; identical to SEQ ID NO: 19430

SEQ ID NO: 49612 - DNA, 601 bp, Human; identical to SEQ ID NO: 19431

SEQ ID NO: 49613 - DNA, 601 bp, Human; identical to SEQ ID NO: 19432

SEQ ID NO: 49614 - DNA, 601 bp, Human; identical to SEQ ID NO: 19433

SEQ ID NO: 49615 - DNA, 601 bp, Human; identical to SEQ ID NO: 19434

SEQ ID NO: 49616 - DNA, 601 bp, Human; identical to SEQ ID NO: 19435

SEQ ID NO: 49617 - DNA, 601 bp, Human; identical to SEQ ID NO: 19436

SEQ ID NO: 49618 - DNA, 601 bp, Human; identical to SEQ ID NO: 19437

SEQ ID NO: 49619 - DNA, 601 bp, Human; identical to SEQ ID NO: 19438

SEQ ID NO: 49620 - DNA, 601 bp, Human; identical to SEQ ID NO: 19439

SEQ ID NO: 49621 - DNA, 601 bp, Human; identical to SEQ ID NO: 19440

SEQ ID NO: 49622 - DNA, 601 bp, Human
catgtctggatgtctcccttacatgctgcccccaaaatgcccaaacacttgcctggcgaacaaatacaggcccatcacaggagcttgcaacaacaggtattgtttgtggattttcttaatcttctcgtgaaagttggatctgaacatgactagatgccatcatgaaggaacttctaccaccactggtggatctgtatccacccctgagcccctggttcctgtccttggcctccccgacatggcctcctgcatgcctggtggtgcctcaagcagcgtgccaagcagtactgtcattcccagmcacaacgtcccatccacataggtgcttacaggtgactcttaacttcctaaccccacaaattccaccgcccttcacctaagagctcaagccacgtgcttaggcgccatccttgatttcgctagctccgctacccattgtttccaatgcacccccaagactgtcacttttacctccaaaatgagtcctctccactccctgtcaccttagctgaagccaaaataaccatccagctgccatcacgtggtggtcccctcactggttctcctaatttaactcttgctttccccattcacgctccct

SEQ ID NO: 49623 - DNA, 601 bp, Human
agagggagagcagccgggattgtggcgcctgtggggtctgggggaaacagtgtgcccggtggtcacctagaagctttgtcacaatagtgtggcgccaggatggctgcaggcttgatgttcaccgatgcaggcagcaaaggtgcttagcatggaagaactcctcaaagggactcgagctcctcactgctgggtgtgctgaggtcagaaggaagatgccccccccgagagagggatcagcgggacccaggcagagccctggcttggacaggccctgtcctgagacagagagcaggggctttgygacaatgaacaggaatcggggtcctgggtatatgatgatggttaagaacaacagctttgcaactggacagccctggatttgaaacctggaatcaccacctatcagagggcagtttgtttcaattctttgagctgtaagagcttgtttgttaagcccacagcaggaatgcataacctggccatgtgtgaggatctgatcttaggactgcggagccccggctggaagaggcagcctgtgctgaacacagagatgggtcagggccacacaggaggctgctgtccacccctcctgccctgaagc

SEQ ID NO: 49624 - DNA, 601 bp, Human
caggcagagccctggcttggacaggccctgtcctgagacagagagcaggggctttgcgacaatgaacaggaatcggggtcctgggtatatgatgatggttaagaacaacagctttgcaactggacagccctggatttgaaacctggaatcaccacctatcagagggcagtttgtttcaattctttgagctgtaagagcttgtttgttaagcccacagcaggaatgcataacctggccatgtgtgaggatctgatcttaggactgcggagccccggctggaagaggcagcctgtgctgaacrcagagatgggtcagggccacacaggaggctgctgtccacccctcctgccctgaagcctgggggggggtctgtgccttcccgtggaagtgggctcagaggtggagatggcatgtgtcctgtcctcagagctcagtgggagacatagatgtagacaaaggatgcacaggagatgatgcctgggagtatggggacactgagatggctggtgggatgcacggctggagggaccaggcctggatggaggaggggatggggctggagggcctgggtggaggagggcagggggtaggtgcactgttg

SEQ ID NO: 49625 - DNA, 601 bp, Human
aggaatcggggtcctgggtatatgatgatggttaagaacaacagctttgcaactggacagccctggatttgaaacctggaatcaccacctatcagagggcagtttgtttcaattctttgagctgtaagagcttgtttgttaagcccacagcaggaatgcataacctggccatgtgtgaggatctgatcttaggactgcggagccccggctggaagaggcagcctgtgctgaacacagagatgggtcagggccacacaggaggctgctgtccacccctcctgccctgaagcctgggggggggtctgtgccttcccgtggaagtgggctcagaggtggagatggcatgtgtcctgtcctcagagctcagtgggagacatagatgtagacaaaggatgcacaggagatgatgcctgggagtatggggacactgagatggctggtgggatgcacggctggagggaccaggcctggatggaggaggggatggggctggagggcctgggtggaggagggcagggggtaggtgcactgttgagtcagaagccggagcggagatggcttggactacacggggaggagcagggtcttcagaaggacaggg

SEQ ID NO: 49626 - DNA, 601 bp, Human
ctttgcaactggacagccctggatttgaaacctggaatcaccacctatcagagggcagtttgtttcaattctttgagctgtaagagcttgtttgttaagcccacagcaggaatgcataacctggccatgtgtgaggatctgatcttaggactgcggagccccggctggaagaggcagcctgtgctgaacacagagatgggtcagggccacacaggaggctgctgtccacccctcctgccctgaagcctgggggggggtctgtgccttcccgtggaagtgggctcagaggtggagatggcaygtgtcctgtcctcagagctcagtgggagacatagatgtagacaaaggatgcacaggagatgatgcctgggagtatggggacactgagatggctggtgggatgcacggctggagggaccaggcctggatggaggaggggatggggctggagggcctgggtggaggagggcagggggtaggtgcactgttgagtcagaagccggagcggagatggcttggactacacggggaggagcagggtcttcagaaggacagggtggggtctaacgtgcaggtacatgttgagggtggggatcccggg

SEQ ID NO: 49627 - DNA, 601 bp, Human
ccacacaggaggctgctgtccacccctcctgccctgaagcctgggggggggtctgtgccttcccgtggaagtgggctcagaggtggagatggcatgtgtcctgtcctcagagctcagtgggagacatagatgtagacaaaggatgcacaggagatgatgcctgggagtatggggacactgagatggctggtgggatgcacggctggagggaccaggcctggatggaggaggggatggggctggagggcctgggtggaggagggcagggggtaggtgcactgttgagtcagaagccggagcrgagatggcttggactacacggggaggagcagggtcttcagaaggacagggtggggtctaacgtgcaggtacatgttgagggtggggatcccgggggacagtggcgttggagatgtgggggcggggctgctctctgaatgggtttcatacttctgattttattaaagaaatataagacattgaattctgcattcctaagcacaattatcttaagaatcagcgagtcatactttccatatgttttcaacacctctagcgtgtcttaaacagcgttaacaagtctgggactctccgtggcccg

SEQ ID NO: 49628 - DNA, 601 bp, Human
ccgtggaagtgggctcagaggtggagatggcatgtgtcctgtcctcagagctcagtgggagacatagatgtagacaaaggatgcacaggagatgatgcctgggagtatggggacactgagatggctggtgggatgcacggctggagggaccaggcctggatggaggaggggatggggctggagggcctgggtggaggagggcagggggtaggtgcactgttgagtcagaagccggagcggagatggcttggactacacggggaggagcagggtcttcagaaggacagggtggggtctaacstgcaggtacatgttgagggtggggatcccgggggacagtggcgttggagatgtgggggcggggctgctctctgaatgggtttcatacttctgattttattaaagaaatataagacattgaattctgcattcctaagcacaattatcttaagaatcagcgagtcatactttccatatgttttcaacacctctagcgtgtcttaaacagcgttaacaagtctgggactctccgtggcccgaagcactttcaccagaggggtccgtgatggagctccttgggttctaggttttccttgagacc

SEQ ID NO: 49629 - DNA, 601 bp, Human
cctcagagctcagtgggagacatagatgtagacaaaggatgcacaggagatgatgcctgggagtatggggacactgagatggctggtgggatgcacggctggagggaccaggcctggatggaggaggggatggggctggagggcctgggtggaggagggcagggggtaggtgcactgttgagtcagaagccggagcggagatggcttggactacacggggaggagcagggtcttcagaaggacagggtggggtctaacgtgcaggtacatgttgagggtggggatcccgggggacagtggygttggagatgtgggggcggggctgctctctgaatgggtttcatacttctgattttattaaagaaatataagacattgaattctgcattcctaagcacaattatcttaagaatcagcgagtcatactttccatatgttttcaacacctctagcgtgtcttaaacagcgttaacaagtctgggactctccgtggcccgaagcactttcaccagaggggtccgtgatggagctccttgggttctaggttttccttgagacctcctaacttttttccatttccttttctgcctgctgccttctg

SEQ ID NO: 49630 - DNA, 601 bp, Human
cagtgggagacatagatgtagacaaaggatgcacaggagatgatgcctgggagtatggggacactgagatggctggtgggatgcacggctggagggaccaggcctggatggaggaggggatggggctggagggcctgggtggaggagggcagggggtaggtgcactgttgagtcagaagccggagcggagatggcttggactacacggggaggagcagggtcttcagaaggacagggtggggtctaacgtgcaggtacatgttgagggtggggatcccgggggacagtggcgttggagatrtgggggcggggctgctctctgaatgggtttcatacttctgattttattaaagaaatataagacattgaattctgcattcctaagcacaattatcttaagaatcagcgagtcatactttccatatgttttcaacacctctagcgtgtcttaaacagcgttaacaagtctgggactctccgtggcccgaagcactttcaccagaggggtccgtgatggagctccttgggttctaggttttccttgagacctcctaacttttttccatttccttttctgcctgctgccttctgtctgtcagcc

SEQ ID NO: 49631 - DNA, 601 bp, Human
ggatggggctggagggcctgggtggaggagggcagggggtaggtgcactgttgagtcagaagccggagcggagatggcttggactacacggggaggagcagggtcttcagaaggacagggtggggtctaacgtgcaggtacatgttgagggtggggatcccgggggacagtggcgttggagatgtgggggcggggctgctctctgaatgggtttcatacttctgattttattaaagaaatataagacattgaattctgcattcctaagcacaattatcttaagaatcagcgagtcatactktccatatgttttcaacacctctagcgtgtcttaaacagcgttaacaagtctgggactctccgtggcccgaagcactttcaccagaggggtccgtgatggagctccttgggttctaggttttccttgagacctcctaacttttttccatttccttttctgcctgctgccttctgtctgtcagccatgacccagacctcaggtgcattctgatggctctccctacggaggtcgacccaggggccaccccccacccacccccaccctgccccacgtccctcctccacgtcagggggatgatga

SEQ ID NO: 49632 - DNA, 601 bp, Human
actggagatttttttttttttttttgcaaatgcctggattaaagaaaaatgaaatataagcccgaccattccgaaactgccaactaacctgtttaactaggaaccttccagcaggacagaccaaataatgcgaaactgaagccagtcaaagcttttctccaatgacgtctacatccacctgcaaagcctgcccctgggtcctgcagtagagcctgaacctttctttggtttgatgcttcctgattcataaatcatgatcactcaaaaaaaactctttaaaaaatgtattgtgcctaagtttacattttaacaacctcaagaccagggcctcagccggcagcagtgagttcctgctcggcccttctgaaaggccctgctgctgtcttgggcgcctctgccccagctgctgggcgggctccactgacgctcctgggagaatctctgctgaccacacaatgacattggcactgggagctgtgatctggggacacttagatctgagctggtttctctccttctgtggtaacagctacagttttcattaagaattcacagcatctggatctaaaatctcctacgttcaaggcttcacacattgtat

SEQ ID NO: 49633 - DNA, 601 bp, Human
ttggtttgatgcttcctgattcataaatcatgatcactcaaaaaaaactctttaaaaaatgtattgtgcctaagtttacattttaacaacctcaagaccagggcctcagccggcagcagtgagttcctgctcggcccttctgaaaggccctgctgctgtcttgggcgcctctgccccagctgctgggcgggctccactgacgctcctgggagaatctctgctgaccacacaatgacattggcactgggagctgtgatctggggacacttagatctgagctggtttctctccttctgtggtracagctacagttttcattaagaattcacagcatctggatctaaaatctcctacgttcaaggcttcacacattgtattccaccaaaaataaaacatctgctcagaaatcggtcacttgttgttataaaagtgagccacagagggcccctgacccttggcccctgggtggtttattttttctctgcaggcctgttagtgccaaagcccaccaagaccaagctcaaatttactcatgcccaattgtgataaaaatagcccaaacaagcagacttttagccacttggagcctacctctttgcat

SEQ ID NO: 49634 - DNA, 601 bp, Human
ccccagctgctgggcgggctccactgacgctcctgggagaatctctgctgaccacacaatgacattggcactgggagctgtgatctggggacacttagatctgagctggtttctctccttctgtggtaacagctacagttttcattaagaattcacagcatctggatctaaaatctcctacgttcaaggcttcacacattgtattccaccaaaaataaaacatctgctcagaaatcggtcacttgttgttataaaagtgagccacagagggcccctgacccttggcccctgggtggtttawtttttctctgcaggcctgttagtgccaaagcccaccaagaccaagctcaaatttactcatgcccaattgtgataaaaatagcccaaacaagcagacttttagccacttggagcctacctctttgcatcttccacaaaacctctcccagcatctcaggccgttggtaagatacagcctcgtggtcatcagaccccaggtcgctgctgtctctggagttgcctgcccagagactccccctctccccctcaccatgttgctgagtaatgtcaccagacatggagaccctctgatgccccactg

SEQ ID NO: 49635 - DNA, 601 bp, Human
cgtttccaccgtgctgcgtttccaccgtgctgcatttcctgcattccaaagcgacctttgggtgttggctgcaatgacatctttaagacaaatgttagttggaattaacttttgaaattctaaatgtcgaaatggtggattttaaaactcatccatttctactagttttcttgctttatggtgtgatgtctgcatgtcacaagtggatggcagggtttctaaggcttgtttttcctttgttggtattttcctaattgcctaggacgtatcacataaaattacttaacaagtagtggaaaasaatgatttttctttcaccatttcacctggacattttgtttgtatggtgtagtcggtgccgcaggagctaccttgttgaaagagaagggggcaggctgcttctcctttgtgtggtgtagctaatgccacacctgtacttcttgtttgtatgaagtggtcagtgccacaggagctaccactttagaagggaatggagcaggctgcttcttgtttatatggtgtagtcagtgccgcaggaggcactatgttggaagagaatgggcaggcttcttcctgtttgtatgatctagtcagtgccgca

SEQ ID NO: 49636 - DNA, 601 bp, Human
aggcttcttcctgtttgtatgatctagtcagtgccgcaggacgtactatgttgtaagtgaatggagcaggctcattcctgtttttatggtgtagtcattgccgcaggaggtactacgttggaagcaagtagggcagggtccttcttgtttccatggtgtagtcagtgccgcaggaggcactacgttggaagggaacagggcagggtccttcttgtttgtatgatctagtcattgccacaggaggcactatgttggaagggaatagggcagggtccttcttgtttccatggtgtagtcagtrccacaggaggcactatgttggaagggaacagggcagggtccttcttgtttgtatgatctagtcattgctgcaggagctaccagttgtaaatgaatggagcaggctccttcctgtttgcatggtgtagtgagtgccgcaggaggcagtacgttggaagggaatagggcagggtccttcttgtttgtgtggtgtagtcagtgccgcaggagctaccgtgttggaagggaatggggcagactccttcttgttggtacggtgtggccaatgctgcaggacgtaccatgttggaagagaatgggg

SEQ ID NO: 49637 - DNA, 601 bp, Human
ggggggtaggaggtgggtgtgggcaggggtcacgtcacttgcaggttgcctttgctagaagcagtcacattggctgagaacagaatccccagggcctgaggatgtcctgcagaaatttgggttttagtgtgtagcttggcatcagcctagagataagacaaattctattttaaaaatcaagtgctccatggcgggatggtgatatagttggctgtgtccccacccaaatctcatttgaattcccacatgttgtgggagggaccaggtgggaggtaattgaatcatgggggcaggtctttcytgtgatgttctcgtgatagtgaataagtctcacgagatttgacagctttataaggggaagttcccctgcacaagctctctttctgcctgccgccatccatgtaagacatgacctgctcctccttgccttccaccatgattgtgaggcctccacgtggaatcgtaagtccattaaacctccttttcttctcagactcaggtatgtctttatcagcagcatgaaaacagactaatacagatggagtaggggagggctactgaagaaatgaagcctctcagctactggaaatagatgcaatca

SEQ ID NO: 49638 - DNA, 601 bp, Human
aaattccagccaccactttgtcagttacaagctgcttagacttcatgtcttgcttagtttctcaaattctctgcacctggaaactggcaaagatagtgatgctcatttctagggttgtcatgaggctgaagtgagacaatgcagcagaaataatttgtgagcaataatgatacaaaggtcagtgattgattatgtaaataatggccacctttgaagcccctttcttcaaagagtctgagtcttgattcttgaagaggtgtgatttttctttgaaaaattgcattatttcttgctgggcackttggctcacgcctgtaaagacagcactttcggaggctgaggtcgggggatcgcttgagcccaggagctcaagaccagcctgggcaacaaagcaatacctcatctctaaaacaaacaaacaaaaaattgtgttatttcttgagttttgatctgatgaactactgcagtaaaccactgtgtctcacagtgttggaagggaatggagccagctccttcttgttgtatggtgtaggcaatgccgcaggaggtaccgtgtttgaagggaatggggcaggctccttcttgtttgtatgatccagtc

SEQ ID NO: 49639 - DNA, 601 bp, Human
tcatattttctaaatatgtcttcagtgagaaatatgttttacaaatgtcttctcccagctgagattggccttttcactctccatgctgtcttttgaagaaacgttgttcatatttttaatgaagtcccctttatcaattacttatttcatggaaagaaaacttttttgttatgtttaagaatcttgctttctctgaagaatgtgaaggtatttttcttgtgttttctgctgaaaatgttattgttttacatgtcacatttagatctgtgacccatctcattttatgttttctgcaacataygaggtggcaaccatgaggggtgtgtgtgtgtgtatgtgtgtgtgtgtattgtaaaccaaaaataaaattctaagtcttgcgatcatctgaattgacccctcctgttggcaagggtgttccaaagctaacctgaaaaactaatctgaccgtgatggggagagtgaggtcagacgtgcctcatgacaccctcctcccttttggaatttctgctagaacagacttcttaactctgagaagaaacatttacagtctcttctctcagaagcctgctgcctggagacttcacctgcacgatgaaac

SEQ ID NO: 49640 - DNA, 601 bp, Human
atcacaaagtctccagtgccaggtgcctgggagaggggaactagggtcccagggaaatcagagtgactcggagcctcagcaggagcacagacctcagtctccctcataaaactctcctccagaaatgtttctctttgttcattttgtcagctttatgagcctttttccaatgctgccattaattcagatctaagaaaggaacagtgtggtacaatagatttccactgggaaaggatctttccaacaggagctgatcaaagtctcagagggacccttctcagtcctgctgacctgctgaccrtgaaggtcaggtgacacatttgcggagggtccacaacaaatgtctgtgagtgcccttgagccattgtaatgtcctagtgaactgctgacatataaaagtcaatcagcaaaaaaaatcactgcttaagcagttaaattaacattatttttaattgagtaatctaacacctccctatgagccatactttatggaatttcaataaagacaaaccaaccataacgaatctgaacactttattaaagcaatctttccaatcttcagttgctgacgtattgcagctgattatatgcattactctcc

SEQ ID NO: 49641 - DNA, 601 bp, Human
tagggtcccagggaaatcagagtgactcggagcctcagcaggagcacagacctcagtctccctcataaaactctcctccagaaatgtttctctttgttcattttgtcagctttatgagcctttttccaatgctgccattaattcagatctaagaaaggaacagtgtggtacaatagatttccactgggaaaggatctttccaacaggagctgatcaaagtctcagagggacccttctcagtcctgctgacctgctgaccgtgaaggtcaggtgacacatttgcggagggtccacaacaaaygtctgtgagtgcccttgagccattgtaatgtcctagtgaactgctgacatataaaagtcaatcagcaaaaaaaatcactgcttaagcagttaaattaacattatttttaattgagtaatctaacacctccctatgagccatactttatggaatttcaataaagacaaaccaaccataacgaatctgaacactttattaaagcaatctttccaatcttcagttgctgacgtattgcagctgattatatgcattactctcccatacatttttgcaaattgagccactttggtgtgctggaga

SEQ ID NO: 49642 - DNA, 601 bp, Human
gaaaggatctttccaacaggagctgatcaaagtctcagagggacccttctcagtcctgctgacctgctgaccgtgaaggtcaggtgacacatttgcggagggtccacaacaaatgtctgtgagtgcccttgagccattgtaatgtcctagtgaactgctgacatataaaagtcaatcagcaaaaaaaatcactgcttaagcagttaaattaacattatttttaattgagtaatctaacacctccctatgagccatactttatggaatttcaataaagacaaaccaaccataacgaatctgracactttattaaagcaatctttccaatcttcagttgctgacgtattgcagctgattatatgcattactctcccatacatttttgcaaattgagccactttggtgtgctggagattaatgaagtattaataacagaattattctccccttatggtccctgcagacatagagaagtaaccatgtccccaagcctcctgccgctgctgaccactcatcatccaatgtgtcctggatgaggtagcagctggtgcacaacagtaagaataaaagctcctctcctctaatgtacggagctgcgtgg

SEQ ID NO: 49643 - DNA, 601 bp, Human
gaggtagcagctggtgcacaacagtaagaataaaagctcctctcctctaatgtacggagctgcgtggtggccttagagacttttaaactggaagagtctcagctcttcagtctacctcaaggacaaaacggatctttccttcacaaatgttgcccaggttacaaacagttcttagtagaaccttagtcctttcattcctgtgcagaacatctaaatcggtcacatttaatacgaatgactaatgtatgttataaccataaaggcgatggtaatttatgacaaaaccactaatttttaaatrtttatattcccaaacactccaaatgttttaaaaagttatttatcttgtcacgattcttgtagacttcactccttgtattttttaagtgtgtacatatcagatacatgggaggattttcaaagcctgcatcctagtcacgcctgactcttttgtcatgtgccttgcaaagcctcccaataccagttgtccatgatgcagcttcagactctgcagactcagccctggttgtgttgcatgactctgcagctgccacacacagaacctcagtgctggttgttcccacacgggcgtgactgacag

SEQ ID NO: 49644 - DNA, 601 bp, Human
ggaagagtctcagctcttcagtctacctcaaggacaaaacggatctttccttcacaaatgttgcccaggttacaaacagttcttagtagaaccttagtcctttcattcctgtgcagaacatctaaatcggtcacatttaatacgaatgactaatgtatgttataaccataaaggcgatggtaatttatgacaaaaccactaatttttaaatatttatattcccaaacactccaaatgttttaaaaagttatttatcttgtcacgattcttgtagacttcactccttgtattttttaagtgygtacatatcagatacatgggaggattttcaaagcctgcatcctagtcacgcctgactcttttgtcatgtgccttgcaaagcctcccaataccagttgtccatgatgcagcttcagactctgcagactcagccctggttgtgttgcatgactctgcagctgccacacacagaacctcagtgctggttgttcccacacgggcgtgactgacagataccaatggaacccggatatcatgacaatgttagacccaaaacaatctgtatttatttttaacaaaaggaacctacttttttccacaa

SEQ ID NO: 49645 - DNA, 601 bp, Human
cacaaatgttgcccaggttacaaacagttcttagtagaaccttagtcctttcattcctgtgcagaacatctaaatcggtcacatttaatacgaatgactaatgtatgttataaccataaaggcgatggtaatttatgacaaaaccactaatttttaaatatttatattcccaaacactccaaatgttttaaaaagttatttatcttgtcacgattcttgtagacttcactccttgtattttttaagtgtgtacatatcagatacatgggaggattttcaaagcctgcatcctagtcacgcstgactcttttgtcatgtgccttgcaaagcctcccaataccagttgtccatgatgcagcttcagactctgcagactcagccctggttgtgttgcatgactctgcagctgccacacacagaacctcagtgctggttgttcccacacgggcgtgactgacagataccaatggaacccggatatcatgacaatgttagacccaaaacaatctgtatttatttttaacaaaaggaacctacttttttccacaaaaaatttctatttttttctctttgaattgacttttatattctaattctctca

SEQ ID NO: 49646 - DNA, 601 bp, Human
tggtaatttatgacaaaaccactaatttttaaatatttatattcccaaacactccaaatgttttaaaaagttatttatcttgtcacgattcttgtagacttcactccttgtattttttaagtgtgtacatatcagatacatgggaggattttcaaagcctgcatcctagtcacgcctgactcttttgtcatgtgccttgcaaagcctcccaataccagttgtccatgatgcagcttcagactctgcagactcagccctggttgtgttgcatgactctgcagctgccacacacagaacctcmgtgctggttgttcccacacgggcgtgactgacagataccaatggaacccggatatcatgacaatgttagacccaaaacaatctgtatttatttttaacaaaaggaacctacttttttccacaaaaaatttctatttttttctctttgaattgacttttatattctaattctctcatatttccttccaaatgcagaataatttatgccttataaattgagccattttcttccaaatgtagaatattttatacttgagaaatcctttatttttaataagttttacatatttctttacctatc

SEQ ID NO: 49647 - DNA, 601 bp, Human
atttttaaatatttatattcccaaacactccaaatgttttaaaaagttatttatcttgtcacgattcttgtagacttcactccttgtattttttaagtgtgtacatatcagatacatgggaggattttcaaagcctgcatcctagtcacgcctgactcttttgtcatgtgccttgcaaagcctcccaataccagttgtccatgatgcagcttcagactctgcagactcagccctggttgtgttgcatgactctgcagctgccacacacagaacctcagtgctggttgttcccacacgggcrtgactgacagataccaatggaacccggatatcatgacaatgttagacccaaaacaatctgtatttatttttaacaaaaggaacctacttttttccacaaaaaatttctatttttttctctttgaattgacttttatattctaattctctcatatttccttccaaatgcagaataatttatgccttataaattgagccattttcttccaaatgtagaatattttatacttgagaaatcctttatttttaataagttttacatatttctttacctatcctctacagatatgtatgctcatgt

SEQ ID NO: 49648 - DNA, 601 bp, Human
tataaattgagccattttcttccaaatgtagaatattttatacttgagaaatcctttatttttaataagttttacatatttctttacctatcctctacagatatgtatgctcatgttatatatttgatacattcatttatatattcttcacattcatatagtcttaccatgcatttatatatttgaatatgtattttattttgcatgttactttttatgtattttataaatttaaatttcatatttagaaaatgttcagtgagcacaagggcctcagtgttcattgttttcttcaagattkagttattttttacacattattagaacacaattgatttaataagcacggatctatgacagatgttggtaattattatgcatagagataaatatttattggaattagtttattgatgagatgggtggagttccagttagttccttcatcagttggctgaacatcacctgtgggccaaggggccatgcaccctggttacccgagatccttcctatttatgccttctgtcccaggaaattattaataactaatagtgctcctgtctcctcaaaagtattccactttggttaggaattatacggt

SEQ ID NO: 49649 - DNA, 601 bp, Human
attcatttatatattcttcacattcatatagtcttaccatgcatttatatatttgaatatgtattttattttgcatgttactttttatgtattttataaatttaaatttcatatttagaaaatgttcagtgagcacaagggcctcagtgttcattgttttcttcaagatttagttattttttacacattattagaacacaattgatttaataagcacggatctatgacagatgttggtaattattatgcatagagataaatatttattggaattagtttattgatgagatgggtggagttycagttagttccttcatcagttggctgaacatcacctgtgggccaaggggccatgcaccctggttacccgagatccttcctatttatgccttctgtcccaggaaattattaataactaatagtgctcctgtctcctcaaaagtattccactttggttaggaattatacggttgccctacatactatagatgagacagttcagcagcaaccctgtgattatttttacctttgcagatggaaggtgcctagaaacctgctcctgtgactatgtcgctgggaacagttttgccataggaatgcc

SEQ ID NO: 49650 - DNA, 601 bp, Human
gggcctcagtgttcattgttttcttcaagatttagttattttttacacattattagaacacaattgatttaataagcacggatctatgacagatgttggtaattattatgcatagagataaatatttattggaattagtttattgatgagatgggtggagttccagttagttccttcatcagttggctgaacatcacctgtgggccaaggggccatgcaccctggttacccgagatccttcctatttatgccttctgtcccaggaaattattaataactaatagtgctcctgtctcctcaraagtattccactttggttaggaattatacggttgccctacatactatagatgagacagttcagcagcaaccctgtgattatttttacctttgcagatggaaggtgcctagaaacctgctcctgtgactatgtcgctgggaacagttttgccataggaatgccatctggccctcaaaactccttctgagatatagaagaaaatgaacatgtaatgagctatcattaaaatgatttttattcatgtatcagcaatcaattcaataacattgtcctccaaatttctaaacaaaatattggaaa

SEQ ID NO: 49651 - DNA, 601 bp, Human
gggccatgcaccctggttacccgagatccttcctatttatgccttctgtcccaggaaattattaataactaatagtgctcctgtctcctcaaaagtattccactttggttaggaattatacggttgccctacatactatagatgagacagttcagcagcaaccctgtgattatttttacctttgcagatggaaggtgcctagaaacctgctcctgtgactatgtcgctgggaacagttttgccataggaatgccatctggccctcaaaactccttctgagatatagaagaaaatgaacatrtaatgagctatcattaaaatgatttttattcatgtatcagcaatcaattcaataacattgtcctccaaatttctaaacaaaatattggaaaatacctcatttgcacaaaggattagttaccaatctttagtcttttatttcctcagtttctagaagatgctctgagacatatcaagtgactgttaattgtgcctacaccccttcaacttaggggcaccttgcttaacacagtacactcggaactaagtgtgaaatcaaaatattcaacacacctttaccttatcatgcacttcaaataca

SEQ ID NO: 49652 - DNA, 601 bp, Human
ttgcacaaaggattagttaccaatctttagtcttttatttcctcagtttctagaagatgctctgagacatatcaagtgactgttaattgtgcctacaccccttcaacttaggggcaccttgcttaacacagtacactcggaactaagtgtgaaatcaaaatattcaacacacctttaccttatcatgcacttcaaatacatttttgtcagaatatattttgaccaatagaacaaaactgcagaccagcctacttatgggaaacttcaccatctagcctattggctgaagccattgtcatcrccaaatcaaacagccaaatacaactgactctctctctctctcaggagagacttaactttatttttaacttactttattttaattcaaattcatttattaatggttcctttgacaacccgctcacttctgaaatcagaaaaccagcaacttcctcagttcccacaagttcgcctggacaatcacacgggcaggaacaggcgcgacaccctggtggcttcatggtgctttgattaaaggatgttttatgccacaggatttcaaatgatctctttgtttggagtaccagaagtttctgtcctc

SEQ ID NO: 49653 - DNA, 601 bp, Human
ggatgttttatgccacaggatttcaaatgatctctttgtttggagtaccagaagtttctgtcctccagagaactgcccctggtacattctagaagggtgggagaccctccttcggaaaacaggggagtgggaaggaaccctgcaggcagccacctccagacagcatgtgctgagctcgggagagggtgcctgtgggaaccaagcctctggaatgagctcccttgaagccagtcatgacctgggcctccaggaggcctttcgggtcttctggggagctgtgccccttgggcctccggagagrccccacttattctccctgagaatggtgtcttatatctggaactcactgcttctgtgttcttctcccccatctcaaacacatccttgcatttgtctccacagagaccaccccagatggggcgcctccaacacggccctggcacgatggctccctccagtctatgaggacggcttcagtcagccccgaggctggaaccccggcttcttgtacaacgggttcccactgcccccggtgggtactcagaacgctactatcctggactaagattgggtcctgtgatgctgagggagggaaatagcc

SEQ ID NO: 49654 - DNA, 601 bp, Human; identical to SEQ ID NO: 19441

SEQ ID NO: 49655 - DNA, 601 bp, Human; identical to SEQ ID NO: 19442

SEQ ID NO: 49656 - DNA, 601 bp, Human; identical to SEQ ID NO: 19443

SEQ ID NO: 49657 - DNA, 601 bp, Human; identical to SEQ ID NO: 19444

SEQ ID NO: 49658 - DNA, 601 bp, Human; identical to SEQ ID NO: 19445

SEQ ID NO: 49659 - DNA, 601 bp, Human; identical to SEQ ID NO: 19446

SEQ ID NO: 49660 - DNA, 601 bp, Human; identical to SEQ ID NO: 19447

SEQ ID NO: 49661 - DNA, 601 bp, Human; identical to SEQ ID NO: 19448

SEQ ID NO: 49662 - DNA, 601 bp, Human; identical to SEQ ID NO: 19449

SEQ ID NO: 49663 - DNA, 601 bp, Human; identical to SEQ ID NO: 19450

SEQ ID NO: 49664 - DNA, 601 bp, Human; identical to SEQ ID NO: 19451

SEQ ID NO: 49665 - DNA, 601 bp, Human; identical to SEQ ID NO: 19452

SEQ ID NO: 49666 - DNA, 601 bp, Human; identical to SEQ ID NO: 19453

SEQ ID NO: 49667 - DNA, 601 bp, Human; identical to SEQ ID NO: 19454

SEQ ID NO: 49668 - DNA, 601 bp, Human; identical to SEQ ID NO: 19455

SEQ ID NO: 49669 - DNA, 601 bp, Human
catgctgtgtgggcacatgtgtttatagcatataagacagtttgtgggcacatgtgtatatggcatataagacagtttgtggacatgtgtgtatatggcatataagatagtgtgtggacatgtgtgtatatggcatataagatactgtgtgggcacgtgtgtttatagcatattagtttgtgggcacgtgtgtaaatagagcctattatcccatgtgtacctgcactttttctcatcctctgtgtcacatcatgtgcatgctcagtgcctggtaaggaccacttagcaatagttcttatayatgtctgcttaacattaagtgaacagaaatgtaattgtttacaacttagtattccatttgtgtgtgcattataatctatctaaccactttccctattaatgagcatgagttgccttctgcttcattgctgtttttatgctgtcacaaataatgaagcaaagagcacacttggccctcaatctttgtgcccatgtgcacacctgatagatccaggggtaagattgctaagtcacggtggaggtgcctgtggaattttgataaatattgcagaattactctccattaatattgcacaaatgt

SEQ ID NO: 49670 - DNA, 601 bp, Human
attccatttgtgtgtgcattataatctatctaaccactttccctattaatgagcatgagttgccttctgcttcattgctgtttttatgctgtcacaaataatgaagcaaagagcacacttggccctcaatctttgtgcccatgtgcacacctgatagatccaggggtaagattgctaagtcacggtggaggtgcctgtggaattttgataaatattgcagaattactctccattaatattgcacaaatgttcactcttaccagaaaagaaagagacaatataggtagatttttaattttayttctctctggaaaccagccttgaagttaacaagggacattttctttttttttttttaagacagggtctcacccagtcgcccaggctggagtgcagtggtgcaatctcggctcactgcaacctccgcctcccgggttcaagcaatacttctgcctcagcctccctagtagctgggactacaggcaggtgccaccacacccggctaatttttgtatttttagtagagacggggtgtcaccatgttggccaggctggtctcgaactcctgaccttgggatccgcctgccttggcctctcaaag

SEQ ID NO: 49671 - DNA, 601 bp, Human
cggggtgtcaccatgttggccaggctggtctcgaactcctgaccttgggatccgcctgccttggcctctcaaagtgctgggattacaggtgtgagccaccgtgctcagccaacaagggacattttctacttaagagcacagatggtttcgatctcatgtcctctctaacattcattcaataaaacttcactggcagttattctgtgccatgctgtgctgtgtgctaggcaggctgaaaaggaagacaggctggtccctggaaggtgggcaggacagttacataaaccagcagttacaaaaytctgggcatctgcagaggaggtcccagtgggcaaaatcaagacatctaaacaaaatatcccaaaaggaataatattgggggaaaggtggaaaaggagcaccataaagactgtgtcaatcatagaaactgaatttcagccaggtccagcctctgtccctgggaggaggtctctctctctcacacgctggggctcagaccctgggagacagggggccccttgctcttctctgcagagccccctcaccagggcggccccctgcatgtgttccctgctgcatgtacctctaacctgggattctt

SEQ ID NO: 49672 - DNA, 601 bp, Human
gaaaaggagcaccataaagactgtgtcaatcatagaaactgaatttcagccaggtccagcctctgtccctgggaggaggtctctctctctcacacgctggggctcagaccctgggagacagggggccccttgctcttctctgcagagccccctcaccagggcggccccctgcatgtgttccctgctgcatgtacctctaacctgggattctttctttctttttttttttttttgagctggagtcttgcccaggctggagtgtagtggcgcaatctcagctcactgcaacctccgcctcccrgatataagcgattctcctgcctcagcatcctgagtagctgggactacaggcatgcgccaccatgcctggctaatttttctatttttaatagagatggggtttcatcgtgttggccaggctggtctcaaactcctgaactcaagtgatctgcccaccttggcatcccaaagtgctgggattacaggtatgagccactgtgcctggccctagtgttattcttcaccactcaggaccccaaagttctcatctgttaacattagagctgttagatcttgcagaagtacctgtatcttcagcaat

SEQ ID NO: 49673 - DNA, 601 bp, Human
ctctgcagagccccctcaccagggcggccccctgcatgtgttccctgctgcatgtacctctaacctgggattctttctttctttttttttttttttgagctggagtcttgcccaggctggagtgtagtggcgcaatctcagctcactgcaacctccgcctcccggatataagcgattctcctgcctcagcatcctgagtagctgggactacaggcatgcgccaccatgcctggctaatttttctatttttaatagagatggggtttcatcgtgttggccaggctggtctcaaactcctgamctcaagtgatctgcccaccttggcatcccaaagtgctgggattacaggtatgagccactgtgcctggccctagtgttattcttcaccactcaggaccccaaagttctcatctgttaacattagagctgttagatcttgcagaagtacctgtatcttcagcaatgaacagtctgccaagcagaggccctcgttcccagctaagtggctccccagcagaatctgtgcaaaaaaatgactgagttatgcagcctggagaagcagtggagatgggcacctattatctatcaggtcttgggttcc

SEQ ID NO: 49674 - DNA, 601 bp, Human
ttgggttccaggcttgccttgtaacttattatctgcgtgtatataggtttgttgtccataaaaagagtatatttcccaggctggccttgtaacttattagctgcatgtatataggtttgttgtccataaaaagagtatatttcccacctaataatgtagcaattagaatgaaatgagatcgaatttgcaaaaccaggctcagagaaggaattcaatgaacgtgtattgttattgctgtgttgctggaagcgtagacctctgagagggatgtggggtgattagggaagctcagcagggaggsagcacgttgggtagggagctgcactgagagaactactctgtgtggaggttgggctcccctggagctgcactgagagaaccactgtgtagtggggtgggggctccacctttgggctcccctggagctgcactgagagaatcactgtgcgtgggggctccacctttggggatctcctggagtttcgctggtttgggcaagagctggtgaaaagcagccttggaagaaggagggattgttcttgcaagtctgcggctgctattggggtaatttatgtttgtccagacaggtgggacagttggg

SEQ ID NO: 49675 - DNA, 601 bp, Human
gtttgttgtccataaaaagagtatatttcccacctaataatgtagcaattagaatgaaatgagatcgaatttgcaaaaccaggctcagagaaggaattcaatgaacgtgtattgttattgctgtgttgctggaagcgtagacctctgagagggatgtggggtgattagggaagctcagcagggagggagcacgttgggtagggagctgcactgagagaactactctgtgtggaggttgggctcccctggagctgcactgagagaaccactgtgtagtggggtgggggctccacctttgggstcccctggagctgcactgagagaatcactgtgcgtgggggctccacctttggggatctcctggagtttcgctggtttgggcaagagctggtgaaaagcagccttggaagaaggagggattgttcttgcaagtctgcggctgctattggggtaatttatgtttgtccagacaggtgggacagttgggggccaccatctgggtgggaaggacacgggtagccctgaggccagacaaggaccccaggaaaagcccagcccttcagggccacacacaccgtgggggaggttggggggcctctgg

SEQ ID NO: 49676 - DNA, 601 bp, Human
ggtcacgtgatggttgtggtgagccccacacacccgcccccagaggctccttcctccacccacaatactcagttatgtggatggctgcgttcgtataaagataaatatattaatgtgggttcaaacgttctttggcctaaatgtttattattttcttctgattttaaagcaagttaaagattttgtgaccacacttgctcctgtggccctaggcactgtggctatggtgccgcctgggtaggctggccctggggaaactggacttccacctgcctcaggggaggaattggcctttcgtccyaagaaaagtctcctcagaagaacccgagtgggagtgaaaagcaaaagtgagttgggccccagggccccctgccccaccgggcataaatatacccacaggcatgcacacactcacaggcacaggtgaccgtgaccgcccgtacacctgtgtgcacgcccttgtgcacacacacgcacacccacccacacccatacacacacgtgcacacaggcacacgcacctatacatgctcatgacacacagacccacacacacacctgcacacacctcacatgcacacagctgctccaggatccttct

SEQ ID NO: 49677 - DNA, 601 bp, Human
cctaaatgtttattattttcttctgattttaaagcaagttaaagattttgtgaccacacttgctcctgtggccctaggcactgtggctatggtgccgcctgggtaggctggccctggggaaactggacttccacctgcctcaggggaggaattggcctttcgtcctaagaaaagtctcctcagaagaacccgagtgggagtgaaaagcaaaagtgagttgggccccagggccccctgccccaccgggcataaatatacccacaggcatgcacacactcacaggcacaggtgaccgtgaccrcccgtacacctgtgtgcacgcccttgtgcacacacacgcacacccacccacacccatacacacacgtgcacacaggcacacgcacctatacatgctcatgacacacagacccacacacacacctgcacacacctcacatgcacacagctgctccaggatccttctgctgacatgcggaccctgtgtaactcaggagtgtattggacgagggcagggggggccgtggcgaggagcaggatactgtgatgcccgtggagacccccgcagaggttccggggggtccgggcactggctccttcg

SEQ ID NO: 49678 - DNA, 601 bp, Human
gttaaagattttgtgaccacacttgctcctgtggccctaggcactgtggctatggtgccgcctgggtaggctggccctggggaaactggacttccacctgcctcaggggaggaattggcctttcgtcctaagaaaagtctcctcagaagaacccgagtgggagtgaaaagcaaaagtgagttgggccccagggccccctgccccaccgggcataaatatacccacaggcatgcacacactcacaggcacaggtgaccgtgaccgcccgtacacctgtgtgcacgcccttgtgcacacacaygcacacccacccacacccatacacacacgtgcacacaggcacacgcacctatacatgctcatgacacacagacccacacacacacctgcacacacctcacatgcacacagctgctccaggatccttctgctgacatgcggaccctgtgtaactcaggagtgtattggacgagggcagggggggccgtggcgaggagcaggatactgtgatgcccgtggagacccccgcagaggttccggggggtccgggcactggctccttcggggctccctactggatctcaagggaaaggcgggtgct

SEQ ID NO: 49679 - DNA, 601 bp, Human
gtctcctcagaagaacccgagtgggagtgaaaagcaaaagtgagttgggccccagggccccctgccccaccgggcataaatatacccacaggcatgcacacactcacaggcacaggtgaccgtgaccgcccgtacacctgtgtgcacgcccttgtgcacacacacgcacacccacccacacccatacacacacgtgcacacaggcacacgcacctatacatgctcatgacacacagacccacacacacacctgcacacacctcacatgcacacagctgctccaggatccttctgctgacaygcggaccctgtgtaactcaggagtgtattggacgagggcagggggggccgtggcgaggagcaggatactgtgatgcccgtggagacccccgcagaggttccggggggtccgggcactggctccttcggggctccctactggatctcaagggaaaggcgggtgctctcatcagccatgtcactctccagtgtcctcctttctttttagggctcagttagagtgagcccggtcaccccaggtaccgtctctctgccctatttcaactttctcttctggctcttctgggccagcctgtctttc

SEQ ID NO: 49680 - DNA, 601 bp, Human
cgcacacccacccacacccatacacacacgtgcacacaggcacacgcacctatacatgctcatgacacacagacccacacacacacctgcacacacctcacatgcacacagctgctccaggatccttctgctgacatgcggaccctgtgtaactcaggagtgtattggacgagggcagggggggccgtggcgaggagcaggatactgtgatgcccgtggagacccccgcagaggttccggggggtccgggcactggctccttcggggctccctactggatctcaagggaaaggcgggtgcyctcatcagccatgtcactctccagtgtcctcctttctttttagggctcagttagagtgagcccggtcaccccaggtaccgtctctctgccctatttcaactttctcttctggctcttctgggccagcctgtctttcgtggggcaggactggggttgacagcacttcccttccacacggagcacatgcttgtgggaccctgaaggcagagaggctggggcaggtgctgcgggcagcaggcggggaggggctggaccatctcaggcggggagcctgcagggcttgttcccaggagctgagga

SEQ ID NO: 49681 - DNA, 601 bp, Human
cagaggttccggggggtccgggcactggctccttcggggctccctactggatctcaagggaaaggcgggtgctctcatcagccatgtcactctccagtgtcctcctttctttttagggctcagttagagtgagcccggtcaccccaggtaccgtctctctgccctatttcaactttctcttctggctcttctgggccagcctgtctttcgtggggcaggactggggttgacagcacttcccttccacacggagcacatgcttgtgggaccctgaaggcagagaggctggggcaggtgctgygggcagcaggcggggaggggctggaccatctcaggcggggagcctgcagggcttgttcccaggagctgaggagctgactccagacctcagggctctgcgctaaggtccctggacacaaactcagggcacagacaagaggcaaaccctcaggggacgacttgaaaatatggaatcacaaggaattgttatcttcattctataaagagctcttataaagcaatgagaaaaaaataaacacccaatggaataaacacccgatgtgaacaagaaaattacaagaaaacccaaatacgtgtgtgt

SEQ ID NO: 49682 - DNA, 601 bp, Human
ctccagacctcagggctctgcgctaaggtccctggacacaaactcagggcacagacaagaggcaaaccctcaggggacgacttgaaaatatggaatcacaaggaattgttatcttcattctataaagagctcttataaagcaatgagaaaaaaataaacacccaatggaataaacacccgatgtgaacaagaaaattacaagaaaacccaaatacgtgtgtgtaggtaaacacacacacacacacacacacacagatatcaatgaaagataaatgaacagcaagatgctgtttttaaacayacagactggaaagaaattatgaaattttaatttagtgttgttgagggtattgagaaatcatttgcatccatgcattgctgtgcaaaagtaaactggtgaatacattcgggacacgatgtgacataaggtatgaaatgaaatcaggcccattcacagcaccacaagaatcttccctagggacaatgtccaaactgcccttaaaagtgggtgaatatattagtttgtcacgattgtttatatcaccaaaatactgaaaaactttaaacgttgatcacaggctatgagcatgagaaacacaag

SEQ ID NO: 49683 - DNA, 601 bp, Human
accaaaatactgaaaaactttaaacgttgatcacaggctatgagcatgagaaacacaagcaactttagacaatcatgttatacagtgatattatggaaatggtaaaatgttgcccagcttagtaaaattttagatgatattgtacttgtcacttttcttatttcaaaatgttcattattgagcatatattatctttgtacttagagaaaaataacaataaaattatttgtaaacaattttaaaaataaaaggcaagaccacatctggcagggaggacacctgcgtgcccgtgggtgagaamgtgggagaggccccagggtgggtctccagggcactttccagggctcttggtgtcaggcatgaacctcctggcttgcagttaagagtgtccatcaattattcagatcctgtccatccccagggcagccttcagtagttgagtgattgagctaacagtcactccagtgagatgaaaaatataccgtatactctaggagtagctccataaacccaatagatgacacatcataaatcagtgcttttaaatgtttgatgtcctttacactcaaagcatccagtttggtctctgagtatttacggt

SEQ ID NO: 49684 - DNA, 601 bp, Human
cattcctaccagcagggtagaagtgttgttcccttttcaccatatccacaccaacatctattattcgttgattttttttattatggccattcttgccagagtaaggtgctaatgtgttgtgttttgatttgcatttccctgatcattagtgatgagcattttttcatatgtttgttggccatgtgtgtatcttcttttgagaattctctattcatgtccttagcccactttttgatgggattgtttggtttttcttactgatttgtttgagtttgttgtagattctggatattaatccttygtcagatgtgtggattgtgaagattttctcccactctgtgagttgtctgtttactctactgactgttccttttgctgtgcaaaagctctttagtttaattaagtcccaactatttatctttctttttattgaatttgcttttgtgttcttggtcattaaatccttgcctgagccaatagcaagaagaatttttccaatgttatcttctagagtttttatggtttcaggtcttagacttaagtccttgatccatcttgagttgtttttgtataaggtgagagatgaggatctagtttcatt

SEQ ID NO: 49685 - DNA, 601 bp, Human
tggatgccctttatttcttttgtctgattcctctggctaggatttcgagtactatgttgaagaggagtggtgagagtaggcatccttgtcttgttcccattctcagagggaatgctttcaacttttccccattcagaattatgttggctgtgggtttgtcatagatggcttttaatacattgagctatttcccttgtatgccaattttgctgagttttgatcataaaaggatgctggatctttttgaatgctttttatgcatctatcgagacgatcatgtgatttctgcttttgattctgyttacatggtgtatcacatttattgacttgtgtatgttaagccatccctgcatccctggtatgaaacccacctgatcatggtggattatctttttgatatgcattggatttggttagctagtattttgttaaggattttagcatctatgttcatcagggttattggtccgtagttttcttttttggttatgtcctcttctggttttactattagggtgatactggccttacagaatgatttaggaagggttgcctgtttctctatcttgtggagtagtgtcaataggattggtaacaattc

SEQ ID NO: 49686 - DNA, 601 bp, Human
ttctaattgagcttatttggattttctcttcttttcttggttaaccttgctaatggtctatcaattttatttatcttttcaaagaaccaggtttttgtttcatttatcttttgtattttttttgttgttgtttcaatttcatttagttctgctctgatcttggttatttcctttcttctgctgggtttgggtttggtttgttcttgtttctctaattccttaaggtgtaaccttagattgtcagtttgtgctctttcagattttttatgtaggcatttagggctatgaactttcctcttarcaccgcctttgctgtatcctagaggtttcgataggttgtgtcattattgtcattcagttcaaagaatttttttttttttgagatggagtttcgctcttgttgcccaggctggagtgtagtggcacaatctcggctgattgcaacctctgcctcctgggttcaagtgattctcctccctcaggatcccgagtagctgggattataggcatccaccaccatgcccagctaatcttttgtatttttagtagagattgggtttcaccatgttggccagactggtcttgaattcctggtctcagg

SEQ ID NO: 49687 - DNA, 601 bp, Human
agttctgttagtaattgttttataaatttgggaactccagtgttaggtgcacatttatttaggattgtgatattttcctgttggacaaggccttttatcattatataatgaccctctttgtcttttttaaccactgttgctttaaagtttattttgtctgatataagaatagctacactgctcgcttttggtgtccatttgcatggaatgccttcttctacccctttaccttaagtttatgtgagtccttatgtgttaggcatgtctcttgaaggcagcagatggttggtgaattcttatscattctgcaattctgtatcttttaggtggagcatttagaccatttacattcaatgttagtactgagatgtgaggtatcattccattcattgtgctatttgttgcctgtaccccttgggtttttgtgattttgctggtttttttaattgtatttttgttgtataggtcctgtgagatttatgctttaaagaggttgtgttttgatgtgtttccaggatttgtttcaagatttagagctccttttagcagttcttgtagtgctgccttggtaggggtgaattttctcatcatttgtttgtct

SEQ ID NO: 49688 - DNA, 601 bp, Human
tttatcattatataatgaccctctttgtcttttttaaccactgttgctttaaagtttattttgtctgatataagaatagctacactgctcgcttttggtgtccatttgcatggaatgccttcttctacccctttaccttaagtttatgtgagtccttatgtgttaggcatgtctcttgaaggcagcagatggttggtgaattcttatgcattctgcaattctgtatcttttaggtggagcatttagaccatttacattcaatgttagtactgagatgtgaggtatcattccattcattgtrctatttgttgcctgtaccccttgggtttttgtgattttgctggtttttttaattgtatttttgttgtataggtcctgtgagatttatgctttaaagaggttgtgttttgatgtgtttccaggatttgtttcaagatttagagctccttttagcagttcttgtagtgctgccttggtaggggtgaattttctcatcatttgtttgtctgggaaagattgttatctttccttcatttatgaagcttagctttgctggataccacatttttggtggataattgttttgtctgaggaggctgaa

SEQ ID NO: 49689 - DNA, 601 bp, Human
ggactcagctccgggtaaagtcagaatcttctcccgtaatctagaccttcaggttccgcagtgggggtgcatgttcagggtggacgatctctcccacttcctcagtttgggcactcacagtatttggggtgtctcccgagtcctgcaggagccatccgctttcttcagagggtctgcggtttctcttggctttcctaatgtattcctgccgtcgttctggagcaaaagttcacgacgtgaacctccacacactgctctgtttgtccaagtgagagctgaaacctagtcctgcctcttgtcygccatgatccgtcacaaaaaatcctcctcatgttggaattttaataggtactcccaaatttctctgcagcaatgagatggcgaattgtattttctaattgattatttttcagcaacaattaatcttacataattcctattattttccaatgcggtaaagaagaaaatcttgaattttacattattggctttaaaacctgtatctgtgtctcttttgttgacctaaagcaagaagctgaggcacaaaatacattttaaagagtttacttgagccaaaatgagaatagctgcccggaatact

SEQ ID NO: 49690 - DNA, 601 bp, Human
gggcactcacagtatttggggtgtctcccgagtcctgcaggagccatccgctttcttcagagggtctgcggtttctcttggctttcctaatgtattcctgccgtcgttctggagcaaaagttcacgacgtgaacctccacacactgctctgtttgtccaagtgagagctgaaacctagtcctgcctcttgtccgccatgatccgtcacaaaaaatcctcctcatgttggaattttaataggtactcccaaatttctctgcagcaatgagatggcgaattgtattttctaattgattatttytcagcaacaattaatcttacataattcctattattttccaatgcggtaaagaagaaaatcttgaattttacattattggctttaaaacctgtatctgtgtctcttttgttgacctaaagcaagaagctgaggcacaaaatacattttaaagagtttacttgagccaaaatgagaatagctgcccggaatacttagatccaaataactttggacgtgagctttgttagatctttgctgcaaacaggtttcaaaggcgaaaaaggtggacaaggagtgagccttggtccttcactctatatg

SEQ ID NO: 49691 - DNA, 601 bp, Human
tcctgcaggagccatccgctttcttcagagggtctgcggtttctcttggctttcctaatgtattcctgccgtcgttctggagcaaaagttcacgacgtgaacctccacacactgctctgtttgtccaagtgagagctgaaacctagtcctgcctcttgtccgccatgatccgtcacaaaaaatcctcctcatgttggaattttaataggtactcccaaatttctctgcagcaatgagatggcgaattgtattttctaattgattatttttcagcaacaattaatcttacataattcctatwattttccaatgcggtaaagaagaaaatcttgaattttacattattggctttaaaacctgtatctgtgtctcttttgttgacctaaagcaagaagctgaggcacaaaatacattttaaagagtttacttgagccaaaatgagaatagctgcccggaatacttagatccaaataactttggacgtgagctttgttagatctttgctgcaaacaggtttcaaaggcgaaaaaggtggacaaggagtgagccttggtccttcactctatatgattgcttggcttttcattttgtttacggtgcc

SEQ ID NO: 49692 - DNA, 601 bp, Human
tgagatggcgaattgtattttctaattgattatttttcagcaacaattaatcttacataattcctattattttccaatgcggtaaagaagaaaatcttgaattttacattattggctttaaaacctgtatctgtgtctcttttgttgacctaaagcaagaagctgaggcacaaaatacattttaaagagtttacttgagccaaaatgagaatagctgcccggaatacttagatccaaataactttggacgtgagctttgttagatctttgctgcaaacaggtttcaaaggcgaaaaaggtrgacaaggagtgagccttggtccttcactctatatgattgcttggcttttcattttgtttacggtgccattattcataaatttaggtcgattttcgtcaattttttttcttctctatgacatctacattgttatcttactgagcaggtcttccttatctggtatatataataatatatatataaatatatttttctatattttattttaaacatattaaaaactgggcttgatatacaactttgttttattctgactctattttgtgtagataaaatactgctttagtgagtaacatttaa

SEQ ID NO: 49693 - DNA, 601 bp, Human
tgttgttaacaaaaacaagactatgctgagtacacgttctgtatcttggattctcactcagtagtgatgtgtcctgggaatccccccagtggagcgccaagccatccctgcttacggctggactgttccacactccgggtcacagccatgggtgtgcccttccgtgttacagcctctgccacagcgtggatcaccagaagtgacactgccaggttggaaggcagctttagcactgctatgctggtactactgtctaaaaattctgtgaccctcacagcaacgactgagtgtaccccttacycacattcgccatccacactggcaacagccttgtttttttctcatttttttctgcttgtttggcggcaaaaaaaaaaaaaaaaaaaaaaaaggagagagagagatatttcgttgttacattagttgctttccctgaatattagtgaattttaaagttgtcctttatttatctttttttggcaatttgtatttgttcaacgaatgatctgttcatagcctttgtccatttttctactatttgactgttaattgattttaattgctcctttccactctagatgttaactctctatctctcact

SEQ ID NO: 49694 - DNA, 601 bp, Human
tcctttatttatctttttttggcaatttgtatttgttcaacgaatgatctgttcatagcctttgtccatttttctactatttgactgttaattgattttaattgctcctttccactctagatgttaactctctatctctcacttttcttacaaatgtttttctacagccccatcaatacagaactgtcagcatgaagcactttcatattttataaggccaggtctacttatgtgttgatggcttctaggctcagttttggttcaggaatctcctttgctcgaagtcgacagtgacctcctkggtggtattacagcacgggtttccattcattttgcacagtggacagtctgggtgcgttttattcccattcagatggaaaaccagctggttctgccctccttctccccacaggcctagatagcactttgtcacagaagaactggggtctggttctgggctctctgtcttcttttattaacagattcatctgttcttgttgacaataccgtgtggacttggtcatagcggccttatagtatatcctattatctgtcaagtcaataccgcatcaccattcttttccctagtttattaaggaat

SEQ ID NO: 49695 - DNA, 601 bp, Human
aatctcctttgctcgaagtcgacagtgacctcctgggtggtattacagcacgggtttccattcattttgcacagtggacagtctgggtgcgttttattcccattcagatggaaaaccagctggttctgccctccttctccccacaggcctagatagcactttgtcacagaagaactggggtctggttctgggctctctgtcttcttttattaacagattcatctgttcttgttgacaataccgtgtggacttggtcatagcggccttatagtatatcctattatctgtcaagtcaataccrcatcaccattcttttccctagtttattaaggaataaataaataatggaatttgtatcttcatataaactttaaaattaatttatctatttcaaaatgaaaaagtactatcattattattgtaaatgaaattgcatttaatttatacattcatttagagagaaatgatcttttcccaaattttttgtatatttaatgatgttttatgattttctttttgtagatcatgtgattattttgttaaatttacacacctgattttgatcaacttttttgtcattatgaaagggatttttttttct

SEQ ID NO: 49696 - DNA, 601 bp, Human
cagctcctccctgggttccctgctggccccaagtactcacctcgtctactctaagcctcgcaggcctccctgaggctctcagtggaagcgctttttttttttcttttttcttttttttgagacggaatctcgctctgtcacccaggcaggagtacagtggcccaatctcggctcactgcaagctccgcctcccaggttcacgccattctcctgcctcagcctcccgagtagctgggactacaggtgcccgccaccgcgcccggctaattttttgtattttaagtagagacggggtttcacygtgttagccaggatggtctcgatctcctgacctcgtgatccgcccacctcggcctcccaaattgctgggcgcccacctcagcctcccaaagtgctgggattacaggcgtgagcccccgcgcccggccggaagcgcttgtttaatgcacgatcttttttaacgtggaccctgtgctggctctgagccaaggctggggcctcgttgctgccccgacccccagctggccttgggctgcacagctgccaggcctgggcgctgcccagaggggttctgacagcatctgctttgctgcttcaccac

SEQ ID NO: 49697 - DNA, 601 bp, Human
tactctaagcctcgcaggcctccctgaggctctcagtggaagcgctttttttttttcttttttcttttttttgagacggaatctcgctctgtcacccaggcaggagtacagtggcccaatctcggctcactgcaagctccgcctcccaggttcacgccattctcctgcctcagcctcccgagtagctgggactacaggtgcccgccaccgcgcccggctaattttttgtattttaagtagagacggggtttcactgtgttagccaggatggtctcgatctcctgacctcgtgatccgcccrcctcggcctcccaaattgctgggcgcccacctcagcctcccaaagtgctgggattacaggcgtgagcccccgcgcccggccggaagcgcttgtttaatgcacgatcttttttaacgtggaccctgtgctggctctgagccaaggctggggcctcgttgctgccccgacccccagctggccttgggctgcacagctgccaggcctgggcgctgcccagaggggttctgacagcatctgctttgctgcttcaccacaaggccgactccctctcacctacattctttctgctgcacctcctgt

SEQ ID NO: 49698 - DNA, 601 bp, Human
ccaatctcggctcactgcaagctccgcctcccaggttcacgccattctcctgcctcagcctcccgagtagctgggactacaggtgcccgccaccgcgcccggctaattttttgtattttaagtagagacggggtttcactgtgttagccaggatggtctcgatctcctgacctcgtgatccgcccacctcggcctcccaaattgctgggcgcccacctcagcctcccaaagtgctgggattacaggcgtgagcccccgcgcccggccggaagcgcttgtttaatgcacgatcttttttaaygtggaccctgtgctggctctgagccaaggctggggcctcgttgctgccccgacccccagctggccttgggctgcacagctgccaggcctgggcgctgcccagaggggttctgacagcatctgctttgctgcttcaccacaaggccgactccctctcacctacattctttctgctgcacctcctgtgcctgggtccatcaggagctcggcctgtctccctgcaccgcacggcaccgagcggccaacccctgagcggctgctggctcgctggccgcatttccctaatgcagcccaggtcttc

SEQ ID NO: 49699 - DNA, 601 bp, Human
gctcactgcaagctccgcctcccaggttcacgccattctcctgcctcagcctcccgagtagctgggactacaggtgcccgccaccgcgcccggctaattttttgtattttaagtagagacggggtttcactgtgttagccaggatggtctcgatctcctgacctcgtgatccgcccacctcggcctcccaaattgctgggcgcccacctcagcctcccaaagtgctgggattacaggcgtgagcccccgcgcccggccggaagcgcttgtttaatgcacgatcttttttaacgtggaccckgtgctggctctgagccaaggctggggcctcgttgctgccccgacccccagctggccttgggctgcacagctgccaggcctgggcgctgcccagaggggttctgacagcatctgctttgctgcttcaccacaaggccgactccctctcacctacattctttctgctgcacctcctgtgcctgggtccatcaggagctcggcctgtctccctgcaccgcacggcaccgagcggccaacccctgagcggctgctggctcgctggccgcatttccctaatgcagcccaggtcttccgttccttc

SEQ ID NO: 49700 - DNA, 601 bp, Human
actgcaagctccgcctcccaggttcacgccattctcctgcctcagcctcccgagtagctgggactacaggtgcccgccaccgcgcccggctaattttttgtattttaagtagagacggggtttcactgtgttagccaggatggtctcgatctcctgacctcgtgatccgcccacctcggcctcccaaattgctgggcgcccacctcagcctcccaaagtgctgggattacaggcgtgagcccccgcgcccggccggaagcgcttgtttaatgcacgatcttttttaacgtggaccctgtgstggctctgagccaaggctggggcctcgttgctgccccgacccccagctggccttgggctgcacagctgccaggcctgggcgctgcccagaggggttctgacagcatctgctttgctgcttcaccacaaggccgactccctctcacctacattctttctgctgcacctcctgtgcctgggtccatcaggagctcggcctgtctccctgcaccgcacggcaccgagcggccaacccctgagcggctgctggctcgctggccgcatttccctaatgcagcccaggtcttccgttccttcctac

SEQ ID NO: 49701 - DNA, 601 bp, Human; identical to SEQ ID NO: 19456

SEQ ID NO: 49702 - DNA, 601 bp, Human; identical to SEQ ID NO: 19457

SEQ ID NO: 49703 - DNA, 601 bp, Human; identical to SEQ ID NO: 19458

SEQ ID NO: 49704 - DNA, 601 bp, Human; identical to SEQ ID NO: 19459

SEQ ID NO: 49705 - DNA, 601 bp, Human; identical to SEQ ID NO: 19460

SEQ ID NO: 49706 - DNA, 601 bp, Human; identical to SEQ ID NO: 19461

SEQ ID NO: 49707 - DNA, 601 bp, Human; identical to SEQ ID NO: 19462

SEQ ID NO: 49708 - DNA, 601 bp, Human; identical to SEQ ID NO: 19463

SEQ ID NO: 49709 - DNA, 601 bp, Human; identical to SEQ ID NO: 19464

SEQ ID NO: 49710 - DNA, 601 bp, Human; identical to SEQ ID NO: 19465

SEQ ID NO: 49711 - DNA, 601 bp, Human; identical to SEQ ID NO: 19466

SEQ ID NO: 49712 - DNA, 601 bp, Human; identical to SEQ ID NO: 19467

SEQ ID NO: 49713 - DNA, 601 bp, Human; identical to SEQ ID NO: 19468

SEQ ID NO: 49714 - DNA, 601 bp, Human; identical to SEQ ID NO: 19469

SEQ ID NO: 49715 - DNA, 601 bp, Human; identical to SEQ ID NO: 19470

SEQ ID NO: 49716 - DNA, 601 bp, Human; identical to SEQ ID NO: 19471

SEQ ID NO: 49717 - DNA, 601 bp, Human; identical to SEQ ID NO: 19472

SEQ ID NO: 49718 - DNA, 601 bp, Human; identical to SEQ ID NO: 19473

SEQ ID NO: 49719 - DNA, 601 bp, Human; identical to SEQ ID NO: 19474

SEQ ID NO: 49720 - DNA, 601 bp, Human; identical to SEQ ID NO: 19475

SEQ ID NO: 49721 - DNA, 601 bp, Human; identical to SEQ ID NO: 19476

SEQ ID NO: 49722 - DNA, 601 bp, Human; identical to SEQ ID NO: 19477

SEQ ID NO: 49723 - DNA, 601 bp, Human; identical to SEQ ID NO: 19478

SEQ ID NO: 49724 - DNA, 601 bp, Human; identical to SEQ ID NO: 19479

SEQ ID NO: 49725 - DNA, 601 bp, Human; identical to SEQ ID NO: 19480

SEQ ID NO: 49726 - DNA, 601 bp, Human; identical to SEQ ID NO: 19481

SEQ ID NO: 49727 - DNA, 601 bp, Human; identical to SEQ ID NO: 19482

SEQ ID NO: 49728 - DNA, 601 bp, Human; identical to SEQ ID NO: 19483

SEQ ID NO: 49729 - DNA, 601 bp, Human; identical to SEQ ID NO: 19484

SEQ ID NO: 49730 - DNA, 601 bp, Human
gtgccacagcacagccctgcagactgggggtgccacagcacagccctgcagactgggggtgccacagcaaagccctgcagactgggggtgccacagcgcagccctgcagactgggggtgccacagcgcagccctgcagactgggggtgccacagcgcagccctgcagactgggggtgccacagcgcagccctgcagactgggggtgccacagcgcagccctgcagactgggggtgccacagcgcagccctgcagactgggggtgccacagcgcagccctgcagactgggggtgccacagcrcagccctgcagactgggggtgccacagcgcagccctgcagactgggggtgccacagcgcagccctgcagactgggcacttgaacaagagatttctctctcagcaagtcctggaggctggagtccaagatcaaggggagggcacggttggctccccctgaggactcaccccttggctgcagataccaccttctccccatgtcctcccagggcagtccctctgtgtgtccatggcctcatctcctcatctcataaggacatagctgccttgggccacggcccacagtgacatccccatgcca

SEQ ID NO: 49731 - DNA, 601 bp, Human
tgccacagcacagccctgcagactgggggtgccacagcacagccctgcagactgggggtgccacagcaaagccctgcagactgggggtgccacagcgcagccctgcagactgggggtgccacagcgcagccctgcagactgggggtgccacagcgcagccctgcagactgggggtgccacagcgcagccctgcagactgggggtgccacagcgcagccctgcagactgggggtgccacagcgcagccctgcagactgggggtgccacagcgcagccctgcagactgggggtgccacagcgmagccctgcagactgggggtgccacagcgcagccctgcagactgggggtgccacagcgcagccctgcagactgggcacttgaacaagagatttctctctcagcaagtcctggaggctggagtccaagatcaaggggagggcacggttggctccccctgaggactcaccccttggctgcagataccaccttctccccatgtcctcccagggcagtccctctgtgtgtccatggcctcatctcctcatctcataaggacatagctgccttgggccacggcccacagtgacatccccatgccac

SEQ ID NO: 49732 - DNA, 601 bp, Human
gtgccacagcaaagccctgcagactgggggtgccacagcgcagccctgcagactgggggtgccacagcgcagccctgcagactgggggtgccacagcgcagccctgcagactgggggtgccacagcgcagccctgcagactgggggtgccacagcgcagccctgcagactgggggtgccacagcgcagccctgcagactgggggtgccacagcgcagccctgcagactgggggtgccacagcgcagccctgcagactgggggtgccacagcgcagccctgcagactgggggtgccacagcrcagccctgcagactgggcacttgaacaagagatttctctctcagcaagtcctggaggctggagtccaagatcaaggggagggcacggttggctccccctgaggactcaccccttggctgcagataccaccttctccccatgtcctcccagggcagtccctctgtgtgtccatggcctcatctcctcatctcataaggacatagctgccttgggccacggcccacagtgacatccccatgccactgcaattacctcctcaaatgctccatccccaaatcagccacattctgaggcccaggg

SEQ ID NO: 49733 - DNA, 601 bp, Human
catagtgccatcttttaatcttcagaataaaactttagaagaagtgtatacaacaggagcatgagttgcataaactaatttccaatattttgtttcaaacgtcttgttttagtttttgtcctgagaacaattacaacatacatttatctatttcctgcatcttttttttttttgagacggagtctcgctctgtcgcctagactggagtgcagtggcgcgatctcagcccactgcaagctccacctcccgggttcacgccattctcctgcctcagcctcccgagtagctgggactacaggcrcccgccaccacgcccggctaatttttgtttttgtatttttagtagagacggggtttcaccatgttagccaggatgtatttcctacatcttaaggactcttttctataaacgctgaagccaaatgtgtctctagagttgagacgttccctcccagtgctacctctttgctaaggaatcctcctgcctggacactgtccatctgcctctccagatcctgcccccgccaagggcgtccgagagagcccctgagcccggcccggaccagcgcccgtgctcagggcagctgtgcgctccgcgctg

SEQ ID NO: 49734 - DNA, 601 bp, Human
gaagccaaatgtgtctctagagttgagacgttccctcccagtgctacctctttgctaaggaatcctcctgcctggacactgtccatctgcctctccagatcctgcccccgccaagggcgtccgagagagcccctgagcccggcccggaccagcgcccgtgctcagggcagctgtgcgctccgcgctgccttctggttctgtgtgatggatgtgatgcttgcatggtgctgtccctgccccgctccgcccctgctgggctcctggctgccgaacctgaagtcagggtccgccgcagaacacrtcttcccgctgagccctgcagcccctcaagcagctggctgcctccgaggagcttcctctccgacagctgccgtgtacctccctgacctccctggctgtgactcaggccctccggaggcactgggccaggccgccggtggagcctgatggtggacgatggtggacagtgaccttctccttctaaggaagggactgagggagggaaagtgcccccagagcatctcaggagctgggaggtgaacagctggggatgctggcttcagtgcttcccccaccaccagcacccttatgattatactgc

SEQ ID NO: 49735 - DNA, 601 bp, Human
tagttttaggtacagatgcagatataaaaatatagatataaatttacacataggtatagaatagatttaggtgtagctatacctatgtaagtttagatatagacacaatatagattttggtatagatgtaaatatagaggtagttacccatacatagacatagttttacatgtgcttctagctctatgtaccgatatgtgaaagcatctctattctgcagaattggtcatgaaattagagaggctgaggagtcccaggatctgctgtctgcaaactggagccccaggggagctggcggggyagttccagtctgagggcaggtgaagctgcaatgagatgtcccagctcaagcagagagtcaggaaaagagaagtgaagccctttttcctccacttcctgctctactggggccctggaaggatgggacagggcccacccatgttggggagagccgtctgcttttctcagaccacagattccaatgctgatcccttccaggacccaactcaaaaacacagtgggaataatgtctaatctgggcgcctgtgctccagtcaagcggacacataaaattaaccatcccagtcatgttattctgacc

SEQ ID NO: 49736 - DNA, 601 bp, Human
taggtacagatgcagatataaaaatatagatataaatttacacataggtatagaatagatttaggtgtagctatacctatgtaagtttagatatagacacaatatagattttggtatagatgtaaatatagaggtagttacccatacatagacatagttttacatgtgcttctagctctatgtaccgatatgtgaaagcatctctattctgcagaattggtcatgaaattagagaggctgaggagtcccaggatctgctgtctgcaaactggagccccaggggagctggcggggcagttcyagtctgagggcaggtgaagctgcaatgagatgtcccagctcaagcagagagtcaggaaaagagaagtgaagccctttttcctccacttcctgctctactggggccctggaaggatgggacagggcccacccatgttggggagagccgtctgcttttctcagaccacagattccaatgctgatcccttccaggacccaactcaaaaacacagtgggaataatgtctaatctgggcgcctgtgctccagtcaagcggacacataaaattaaccatcccagtcatgttattctgacctgaatt

SEQ ID NO: 49737 - DNA, 601 bp, Human
agaattggtcatgaaattagagaggctgaggagtcccaggatctgctgtctgcaaactggagccccaggggagctggcggggcagttccagtctgagggcaggtgaagctgcaatgagatgtcccagctcaagcagagagtcaggaaaagagaagtgaagccctttttcctccacttcctgctctactggggccctggaaggatgggacagggcccacccatgttggggagagccgtctgcttttctcagaccacagattccaatgctgatcccttccaggacccaactcaaaaacacagygggaataatgtctaatctgggcgcctgtgctccagtcaagcggacacataaaattaaccatcccagtcatgttattctgacctgaattctccaaaatcccagtgccctctgtctgcccagggcctgcccaaacccgatgccgtttctttccaaaggccctcgttggccttcacccagcctcagggactcccccttgcccagccccaccagaggggcacccacgcccacagcagagaactccagggctccccggggtggcactgaagaggtcggaaagccactccggcagcagccgtgacc

SEQ ID NO: 49738 - DNA, 601 bp, Human
atatttggctatagttgattttagactctggagttctaaaaatacgctaccaagcaccaatttagtttgcaaaatgccacttagctgaaagatatgaaaaagtggatgttaatgtgccatcacacgcttgagaacacaggcagttacagagtcagagaccataacagggaagaccctggggctccagggcagaaacatcctggaccaaaaccacagcacccccagacctgtgattaggtgagctcagaaggtcaagtcactcattaggaaatgtcttcccaccacctaccctgagaccccyattctgctcccagcaaatgggctcaacacaatcccagcctcgcctccctgtgtcttattcttcagcttttaaaaacatgatcttatttccaccttagggcattattgtgcggtgaggagtagggaggagaacagagagggataggaagaaagagagacagagacagcagagagagacacgggaggggagagaacccagcacggtgtggcacacagcaggtgctcagcaaacacgtttcctctcctagtgagacaaaggtgtttgcttctctactctcctcgttttctacccaccctgctg

SEQ ID NO: 49739 - DNA, 601 bp, Human
caaatttctcccactctgggcaacctccccaaatcccccccactctgtgcaacctcccaaaatcccacacactgtatgcaacctcctcaaatccccatactgtgtgcaacctcctcaaatcccccccactgtgttcaacctcctcaaatccccccactgcgtgcaacctcctcaaatccccccaatgtgagcaacctcctcaaatccccccactgcgtgcaacctcctcaaataccccactgcgtgcaacctcctcaaatccccccaatgtgaggaacctcctcaaatcctcccactatgwgcaacctcctcaaatctccccactgtgtgcaacccccccagatctcccccactgtgagcaaaagcacaaatcccccactgtgtgcaacattcctcaaatccccgcactgtgtgcaacccaaccaaatctcacccactgtgagcaaacccccacatccccccactgtgtgcaacctcctccaatccccccactgtgtgaaacctccccaaatccccccaatgtaggcaaccccccaaatctcccccacagtgagcaaaaacacaaattcccccactgtgtgcaacctccacaaatcctccc

SEQ ID NO: 49740 - DNA, 601 bp, Human
agctctccacgcctcccagagaccagggggcctccacccttgctcctctgggacggcgcttcctccccctcatctccaggtcggggctggggtcttcaggctcaggttgaagatgctgttgggccctttgcctgtacagggatggcgcccgacccaggaaaagcctaacgttgtctgtcatttggatgcgtctcttggcagtgactggggggaaatcctcactgcagcccgcgtcccttgcatgattgttgtaagaaagccccagctcagctgcgtggagacagggtcctcttggctgcawattctaaaatcatttttcctatgaagagagcagtgctaattttttccaaaatatatcagattatgatcgacttgactgaagtgtgaaatgaaagtgggttggagtgttcctgccaaagacaagcacggctgccttgccgtcgctcgtgccgtgctctctaccctccacagtcacggtgccggaccctctcccgataactggacacgtgtctcccacaggacacgcactggcactaaatccacactgcccatctcggagacaggcggaggaactcccgagctgagatgcggaaagcaccag

SEQ ID NO: 49741 - DNA, 601 bp, Human
ttgtaactgattagtgtcccccatcatctttccttttctaatttttttttagaagtgtggaaatcatattcaggtttgtgattctgcataggggaaaaatcagtaggccgttacttagtgtgtgaggtcgtctctggagaaaagtaaatgtgtaccaatacttggacattggaatacctattttgattgtccagaggctttttctttgtgatttatttgttgtgttctgtttaggtgagttttcatatagacttggatatcaatgttggtatactctcgactacttagaatgtgttttgarggtatgttactgagggcatttgtggttaagtttttgtaaagtgtttgtgaaacatttccatatcaatatatatattctttaagtttattggtcatgtaataataaaattcccaagttcacttaaagggagtttgctctttaatataaatctcatttatttggttttaccagccatccttttttcttatgattttagatgcagcctaaaatatttacatgatattttatctaatttgtcacaaaatgaaaaaatctgaaattttttttgtgtgtaagataatttggatgcctattaaatgg

SEQ ID NO: 49742 - DNA, 601 bp, Human
tctttccttttctaatttttttttagaagtgtggaaatcatattcaggtttgtgattctgcataggggaaaaatcagtaggccgttacttagtgtgtgaggtcgtctctggagaaaagtaaatgtgtaccaatacttggacattggaatacctattttgattgtccagaggctttttctttgtgatttatttgttgtgttctgtttaggtgagttttcatatagacttggatatcaatgttggtatactctcgactacttagaatgtgttttgaaggtatgttactgagggcatttgtggktaagtttttgtaaagtgtttgtgaaacatttccatatcaatatatatattctttaagtttattggtcatgtaataataaaattcccaagttcacttaaagggagtttgctctttaatataaatctcatttatttggttttaccagccatccttttttcttatgattttagatgcagcctaaaatatttacatgatattttatctaatttgtcacaaaatgaaaaaatctgaaattttttttgtgtgtaagataatttggatgcctattaaatggtggttcttaagtttaggtggtacagc

SEQ ID NO: 49743 - DNA, 601 bp, Human
tctcatttatttggttttaccagccatccttttttcttatgattttagatgcagcctaaaatatttacatgatattttatctaatttgtcacaaaatgaaaaaatctgaaattttttttgtgtgtaagataatttggatgcctattaaatggtggttcttaagtttaggtggtacagctagagagttaaaagcatgggctctggacagagactacttgaggtcaaattctcttctacctactggctgtgtgactgagcacattacttctctgtgcttcagtttctcaatctataaatggartaaaatatcaacctcataggttgttaggaggattgaatgagttactacttgtaaagtgcttagaacactgccagtgctggcggtggtgattttcattttcaaatgatttccctaattcttgtaccaacttgggaaaaaaaaaatctcaatttttgacctttgttagaagtaggatattttctttaaataaaggaccagagggatgagatgattttgcactaaggcagaaattgaattttatgtgatataaccttacagaaaccacatagatacttttttcaatgttggatgtactgtgcg

SEQ ID NO: 49744 - DNA, 601 bp, Human
gcggtgaactttttagtttattttataggctctcgtatataaaacatatcagtcatgtggtggtgtttttttgtttgtttgtttgtttttttgatggagttttgctctgttgcccaagctggagtgctgtggtgcgatctcggctcaccgcaacctccgcctcctgggttcaagggattctcttgtctcatcctcctcagtagctgggattacaggtgtgtgccaccatgcccagctaatttttgcatttttagtagagacagggtttcaccatgttggtcaggctggtctcgaactcctracctcatgtgatctgcccgctttggcctcccaaagtgctgggattacaggcgtgagccactgcacctggcctcgtggtggttttaatagacaaatttgtggttggtttagatgatatatgcacttctataatagagtgatttctttatgttactttgttgtactgtttggagaaaatattttaaaaatttttatttatatgttatttatttacttatttttagagacaaggtcttgctctgttacccaggttggagttcagtggcatgatcatagctcactgcagcctcaaactcttgcc

SEQ ID NO: 49745 - DNA, 601 bp, Human
gtagctgggactacaggcacgtgccaccatgcctggctaattttttgtatttttagtggagatggggtttcaccgtgttagccaggatggtctcgatctcctgaccttgtaatctgcccccctcagccttccaaagtactgggattataggcgtgagccaccttgcccagcgtgtatctttctaattgagggatttgcaaactaaaatgacatcatattaactaaaatctaatttttaagacatttaaaataaatagaaaactcaaagtgcttcatttttatttattcataattcagatcwgtcagagaatcctgtcagagaatatcttcccctgttattaaatatattttgaacgataaaaatgcttactttaatatatataaaaaattgtaattgtgtcaagggcttgcagataggtagagaaagaagtataatgattattcatttgggtgagaattgggtggagctgcagacctgtttcttaggtaaactgatgaagcaagttgtgaaagatctgaaagttttcagattttatgttcagaaaagaaagagcaaataaaaactagtaagatgtgattgaaatttaggtaaattgggtaa

SEQ ID NO: 49746 - DNA, 601 bp, Human
gttagccaggatggtctcgatctcctgaccttgtaatctgcccccctcagccttccaaagtactgggattataggcgtgagccaccttgcccagcgtgtatctttctaattgagggatttgcaaactaaaatgacatcatattaactaaaatctaatttttaagacatttaaaataaatagaaaactcaaagtgcttcatttttatttattcataattcagatctgtcagagaatcctgtcagagaatatcttcccctgttattaaatatattttgaacgataaaaatgcttactttaatrtatataaaaaattgtaattgtgtcaagggcttgcagataggtagagaaagaagtataatgattattcatttgggtgagaattgggtggagctgcagacctgtttcttaggtaaactgatgaagcaagttgtgaaagatctgaaagttttcagattttatgttcagaaaagaaagagcaaataaaaactagtaagatgtgattgaaatttaggtaaattgggtaattattatgatggagctgttactgcttagttgtagcatttgatatctgactgctattcagatttaacacaagcagga

SEQ ID NO: 49747 - DNA, 601 bp, Human
tcatacccaatgtgaagcagattacaaaacctcagcatatccttctgtttcagaaacaagtacacaatccttcagggtgttaagcagttataactgcaaatataataaatgaccaagtaaggcagaagaaacttgaaagtattagtaattatcagtctcttggtttcactgaagtggtggttggctagttattagaaagaccttttttgttgttgctttttaaatttttttttggtaatgtgtacctgtctttggcaatactccctcatactcctcccagcttttgtttattttggcttaygttaggtagatctttagacagtagctcacagtagagacatttattatgtctcttaaacagataaaattttattgggacttcactaacctgagaccatgctgtactcatttttgaatcataaccttggttttaaccacaaatgaagtaggcattttccttctgggctcctaaatgttttctttggactaaacttgatattacctcttttttttttttttgttatgttttggtttttgtttctgaaggtctcagcttcctagatgttctacactcttcctgaccattttcactgaaccctat

SEQ ID NO: 49748 - DNA, 601 bp, Human
cttaaacagataaaattttattgggacttcactaacctgagaccatgctgtactcatttttgaatcataaccttggttttaaccacaaatgaagtaggcattttccttctgggctcctaaatgttttctttggactaaacttgatattacctcttttttttttttttgttatgttttggtttttgtttctgaaggtctcagcttcctagatgttctacactcttcctgaccattttcactgaaccctatttgatttactgaaagcatatttactaattgtttgcacttaaaggtgcttttwtcctagaataaacaatgcttttaaaacaattcactattctaaattgatactggcttaagatgttgttccagtgtcaggtattgttatcgattttttctttcctagaacctgtcctttccagtggctccagtagacttgtattttataatctttcaaatattatgtagcttgttaaacttcccatcatgatcttgttcagtttctcaactcatttgcaaaagagatgactagcatgggagcctggattccagtatctgttttagtgccttattagtgcctcttagcttaggttctttttga

SEQ ID NO: 49749 - DNA, 601 bp, Human
cagttgtataaaagtatagcatgtacatacatttatatgtagtacatatattgataataaatggctgtgttactggcttatgtatttactatgttttttaattgttattttacagagtacatcttctacttattaaaagaagttaactgtaaaacatcctcaggcaggtccttcagggggtattccagaaaaaggcattgttatcgtaggtgatgacagccctatgcacgtttttcaccagtgggatgaaatatggagatggaagacagtgatattgatgatcctgatctttgcaggcctrggctaatgtgtgtttgtgtcttataagaaaaaggattaaaaaagaaagaatttttaaatggaaaaaagcttatagaatatgaatataaggaaagaaaatatttttgtacaactatacaatgtgttggtgttgtaaactaaatgttattacaaaaaagttaaaaaatttataaagtaaaaagttatagtaagctaaggttaattttgaaagaaaattagaaagaaagaaataaaaaaatgtagttagctttagtgtatggtgtttataaaatctatagtagtgtatactaatgtcctaggc

SEQ ID NO: 49750 - DNA, 601 bp, Human
gcaggcctgggctaatgtgtgtttgtgtcttataagaaaaaggattaaaaaagaaagaatttttaaatggaaaaaagcttatagaatatgaatataaggaaagaaaatatttttgtacaactatacaatgtgttggtgttgtaaactaaatgttattacaaaaaagttaaaaaatttataaagtaaaaagttatagtaagctaaggttaattttgaaagaaaattagaaagaaagaaataaaaaaatgtagttagctttagtgtatggtgtttataaaatctatagtagtgtatactaatstcctaggccttcacatttgctcaccactcactgactcacccagtgccatttccagtcctgtaatctctattcatggtaggtacaccctatgtaggtgtaccatttttattacttatactgtatttttactataccttttttatgtttaaatatacagatacttaaccattgtgttacagttgcctacagtattgagtacaatagcatgctgtacagttttgtagcctaggagcaataggctataccctatagcttaggcatgtagtgggctgtaccatctaggtttaagtacactctatg

SEQ ID NO: 49751 - DNA, 601 bp, Human
ttttttttttttttttaagaaataaactctttaattctttctgtgtggttcattgaagctcttaagtccctttaatagagaatcaataatcagtgatgttaagcatcttgtcaggtgaatctgctgattacctactccgtgtgtataaataaagggaaagtttggcagagagagacatttctgtatgagtctccaatttaacatgttaaacacatttaggcataaaggcttaatttttagcttaaagagtttgttcaaaataacttaatgtttgaactgtaaaattataaaatctttaagrtaggtgttgtgaagcaagtatacatatactttgagacatactgagttgttacgtatgtgtaattttaaattttctagtagctacatttaaaaaggaacatgtgaaattaattttaataatattttgaatgtatgttggtttaaagaaagtacattatttcataatgtattcagtataaaaagttattaatgagatagcttacattttttcttatatatgaaagaaatcttgacatctgatgtatattttacatttatataacatttcagtttggactagccacatttcaagtgctcaata

SEQ ID NO: 49752 - DNA, 601 bp, Human
tgaagctcttaagtccctttaatagagaatcaataatcagtgatgttaagcatcttgtcaggtgaatctgctgattacctactccgtgtgtataaataaagggaaagtttggcagagagagacatttctgtatgagtctccaatttaacatgttaaacacatttaggcataaaggcttaatttttagcttaaagagtttgttcaaaataacttaatgtttgaactgtaaaattataaaatctttaagataggtgttgtgaagcaagtatacatatactttgagacatactgagttgttacrtatgtgtaattttaaattttctagtagctacatttaaaaaggaacatgtgaaattaattttaataatattttgaatgtatgttggtttaaagaaagtacattatttcataatgtattcagtataaaaagttattaatgagatagcttacattttttcttatatatgaaagaaatcttgacatctgatgtatattttacatttatataacatttcagtttggactagccacatttcaagtgctcaatattttttgattataagaatttactgaggcaggaggattgcttgagactagtagt

SEQ ID NO: 49753 - DNA, 601 bp, Human
ctcggcctcccaaagtgctgggattacaggcatgagccaccgtgcccggctgcactcgactagttttttaaaaaataaaggtctgtttggaaactgagggaagttcttacatagcaacttcccattttttggtaattttaaaattcattttcagttgatacttagttactagcatttagggaattcttactatgctaggctgaatgtacggagcattcggttccccacaagaatatgaggtaaaacattagtcttcccattcttcaggttcaggaaatgaagttagagggattgttacttstccaagtcagaggtaagatgtggaggagacagaatcaaactttcattgttctcattttaaaactcgtcctcttaattatatcttaaaacattttgagaaggaagattgttgagttaaacagagcaagtaatatgaccttcagactctcctagtgtggtttaaaaaataaagaaatttaaatatttatcttctaaaaactgtggattggtattcgtttgagtaactattttctctaaagagactttttttttttttttttttttttaaaggaacagggtcttgctctgtcgcctaggctgg

SEQ ID NO: 49754 - DNA, 601 bp, Human
ttagtcttcccattcttcaggttcaggaaatgaagttagagggattgttacttgtccaagtcagaggtaagatgtggaggagacagaatcaaactttcattgttctcattttaaaactcgtcctcttaattatatcttaaaacattttgagaaggaagattgttgagttaaacagagcaagtaatatgaccttcagactctcctagtgtggtttaaaaaataaagaaatttaaatatttatcttctaaaaactgtggattggtattcgtttgagtaactattttctctaaagagacttttgttttttttttttttttttaaaggaacagggtcttgctctgtcgcctaggctggagtatagtggtactatcatagttcacagcaaccttgacctcctggggtcaagtaatccttccaccttagtctcctgagtagctgggactaaggcatgtgccatcgcacctggctaatttaaaaaaataaacaaaaactgtagacatagggtcttgccatattgcccaggctggtcttaaactcttgggcttcaagcagtcctcttacctgggcctcccaaagtgctgggtttacaggcatgagccac

SEQ ID NO: 49755 - DNA, 601 bp, Human
aggttcaggaaatgaagttagagggattgttacttgtccaagtcagaggtaagatgtggaggagacagaatcaaactttcattgttctcattttaaaactcgtcctcttaattatatcttaaaacattttgagaaggaagattgttgagttaaacagagcaagtaatatgaccttcagactctcctagtgtggtttaaaaaataaagaaatttaaatatttatcttctaaaaactgtggattggtattcgtttgagtaactattttctctaaagagactttttttttttttttttttttttaaaggaacagggtcttgctctgtcgcctaggctggagtatagtggtactatcatagttcacagcaaccttgacctcctggggtcaagtaatccttccaccttagtctcctgagtagctgggactaaggcatgtgccatcgcacctggctaatttaaaaaaataaacaaaaactgtagacatagggtcttgccatattgcccaggctggtcttaaactcttgggcttcaagcagtcctcttacctgggcctcccaaagtgctgggtttacaggcatgagccactatgcctggcctcttaag

SEQ ID NO: 49756 - DNA, 601 bp, Human
agacagaatcaaactttcattgttctcattttaaaactcgtcctcttaattatatcttaaaacattttgagaaggaagattgttgagttaaacagagcaagtaatatgaccttcagactctcctagtgtggtttaaaaaataaagaaatttaaatatttatcttctaaaaactgtggattggtattcgtttgagtaactattttctctaaagagactttttttttttttttttttttttaaaggaacagggtcttgctctgtcgcctaggctggagtatagtggtactatcatagttcacwgcaaccttgacctcctggggtcaagtaatccttccaccttagtctcctgagtagctgggactaaggcatgtgccatcgcacctggctaatttaaaaaaataaacaaaaactgtagacatagggtcttgccatattgcccaggctggtcttaaactcttgggcttcaagcagtcctcttacctgggcctcccaaagtgctgggtttacaggcatgagccactatgcctggcctcttaagagacttttaacaaattttaactgttacacattggtcttttacttacatacccaaaagttttc

SEQ ID NO: 49757 - DNA, 601 bp, Human
acagggtcttgctctgtttcccaggctggagtgcaaatgtgtgattgtagctcactgcaacctcaaactcctgggttcaagtgatcctcccccgttaggctcccaagtagctaggactataggtgctgccccacacacctgttgttattttttgtagagatagcatcttgctatgttgcccaggctggccttgaactcctggcctcaggttatcctcccgcctgggattacaggtgtgagctactgtgcctggcctctgtgtgtacattcttgtttatgctttttccttattgttttaatraatgtaaggtctgtagagatactctgtcttttattcctgatataagtaatctgggccttctgtttttccccttggtcattctttctagagatttattgattttattgatgttttcaaataacagtttttggttgcattattttttttccatttttctgttttctttgagtgttttatatgattccattttatgtcctcttttaacattcaattatacttaatttttatttttagtgcttgccctagagtttgcagtatacatttataactaatgttaaattcagctttaaataacactgc

SEQ ID NO: 49758 - DNA, 601 bp, Human
tcctttaacatgtcttttgtgttgggtctgttggcaatgaattcttgtttttgtttgaaaaagtctttatttctctttcccttttaaggataattttactagatacagatttctaggttggtgtttttttttttttccaatgctttaaatattttattccatcctttcttgccttcatgttttctgatgagaagcctgctgtaattcttatccttgttcctcaataggtagggtgatattttgtgatggtttctttaaagattttctctgcctttgattttcttccattaaatgtgatacrtctaggtgtagttttttttgtttgtatcctaattttgttctcttagttttccggatgtgtggtttggtgtaccttattatttttggaaaattcttagccattattatttcatatattctgctctgtttccccatcttctggaattccaattacgtgtgtttatacctcttgaagtttttcacagttcttggatgttctgtcctgggatttttttgttttttataattctttttctctttgcatttcagtttggaaaatttcttttgacctctcttcaagcttactgattctttccttggc

SEQ ID NO: 49759 - DNA, 601 bp, Human
ttacagtgtttttgatttccagcttttccttctgtttcttttctagagattctatgtgcttaccatatccatttttttcttacatgttgtctgctttttatgttatcacccttagcatattaatcatagttattttaaatttcctgtcagataactaaaaaaaatgtgttgtatctgagtcgggttcagatgcttgctttgtctctttagacttgctttttcttgccttcttagcatgacttgaaattttttgaaggctggatatgtcatattaggtaataggaactgcggtagttaaatmgttagtgtgaggatttatatttatctgcctaggagttggattgtgtttaatatttgctctagctgtaggtgccagggggttcacattcctgtagtgtctttgtttttgtcttccttgctttctttgggtttccctaagaactctttctcagatagaatctgtatcttgcagctttttcagctgtaaatactggagcctcattgatatggtggtagcatgtgggaaaggggaaatatactattataatcttaattattaaatctctgttttttagtggatcgatgtcctggagctgtggag

SEQ ID NO: 49760 - DNA, 601 bp, Human
gaggtggaggctgcagtgagccgaaattactccattgcactccagcctgggtgacagagtaaggctttgcgtcaaaaagagagagagaaatagtcttttcaggtgtgattaaggatttcgagatgaagaaattcttaataaattgaatgattggtgtccttggaaaagagtaaggagagggtgagatttgagatggagacgtaacagtggaacagtcacgtcaagatggaggtagaggttggagttacgtaagcaaaggaacactaaaaattgctggcagccaccagaagccagatagggkcatggagtgattcttcagagtctccagaaagaactaaccctgctgataccttgattttgccctctcgcctcccgaaagaggagaataaatttctttcaagctacccactttgtgatggtttgttacaactgctgtaggagactactagtgttcctgctaatttatggctccagcagcttctactctaggtaataaatagatctcgtccgtgactctctggctttacctgcctcctgtctgtatctttaggtggtagtttgctctgtgtcctcaattttctaatgggtccaaggaaattaa

SEQ ID NO: 49761 - DNA, 601 bp, Human
gcttctactctaggtaataaatagatctcgtccgtgactctctggctttacctgcctcctgtctgtatctttaggtggtagtttgctctgtgtcctcaattttctaatgggtccaaggaaattaaatgattttcagttggtttagcctttttcttgtaagggtgggagtgatgactttaaagctttttacttgttggagctgaaactgccagttgagtattttaaaaatttgtttgttctttctccccacaatttttggcgtttttatgctttttctgttattttagtgatcactacatgyattctcaacttataaaaacctgatgttaataactttactctcttataccatacaaggatcttggaacaattttaactcccaactttgttactggttctgttattttaatttttctgtatttttaatttcctatatgatgttactgtttttattcatttggtgtttttatacctgtatacttaccacttcttttgtttttcctttcttttctacattgctgatacttcatatttaatctttttcctttcctttgctgttctcagagaacatccatcagagttttctttttgtgtagcaaag

SEQ ID NO: 49762 - DNA, 601 bp, Human
tggaacaattttaactcccaactttgttactggttctgttattttaatttttctgtatttttaatttcctatatgatgttactgtttttattcatttggtgtttttatacctgtatacttaccacttcttttgtttttcctttcttttctacattgctgatacttcatatttaatctttttcctttcctttgctgttctcagagaacatccatcagagttttctttttgtgtagcaaagtcccacttctggcttgtcagaagtgtccttattttttcttcttttttaaaggatattttctygggtgtagagagtttaagatttgtaggtattttctttccacacatttaagatactaatctgctgccttctggctcccatcgttgttgctaagtcacccattagtctgaatgttgcttctttgataacctttgttttacgattttctttcctctttgtctttcactttttgcagtttaatattacaaacttaattatgaataagtttaaaagagcagggaatttaaccctatttaccatatggcattttctctaagggaaataaaatagattttctttgagtcaatgaacttcttaattat

SEQ ID NO: 49763 - DNA, 601 bp, Human
tttcctatatgatgttactgtttttattcatttggtgtttttatacctgtatacttaccacttcttttgtttttcctttcttttctacattgctgatacttcatatttaatctttttcctttcctttgctgttctcagagaacatccatcagagttttctttttgtgtagcaaagtcccacttctggcttgtcagaagtgtccttattttttcttcttttttaaaggatattttctcgggtgtagagagtttaagatttgtaggtattttctttccacacatttaagatactaatctgctkccttctggctcccatcgttgttgctaagtcacccattagtctgaatgttgcttctttgataacctttgttttacgattttctttcctctttgtctttcactttttgcagtttaatattacaaacttaattatgaataagtttaaaagagcagggaatttaaccctatttaccatatggcattttctctaagggaaataaaatagattttctttgagtcaatgaacttcttaattatcacagatgtatgcagttatgtggtgctataaacatttttgctgtaatattgaacaaaccacttt

SEQ ID NO: 49764 - DNA, 601 bp, Human
tgctgatttggcagagtatgcaattaattttccttcaatacttcagtgacttttaatttttctttttctagaatccagtattgccaatgagaagtgttccaagatgattctcaatcttttgtagatgaaatttttatttcctgtcagagagctttctaggatcgtttattgttattatgaaattgcaccgaatatgaatacgttttaaaatttgttcatttcattggattctcacagacctgtttccatttgaagattgttttaggattattttcttgtattatttcatggttaattcccygtttttttctccttgaatttctgttaattggatgttggattgattgggccttttccttattttcatctttttctttgtgcctttgttttacctgttttggaacattttcttggatttatctctgcctcttcaaaaaacagtaagatactttggaagacataaactttaaaaactttttaattttctcacttcttattttatagcattctgttcttttagaaactttacatctcttgaggatatacatttgtgtgtgtattttaactttttaattttgaaataatcatgaagttgtagaaa

SEQ ID NO: 49765 - DNA, 601 bp, Human
cagagagctttctaggatcgtttattgttattatgaaattgcaccgaatatgaatacgttttaaaatttgttcatttcattggattctcacagacctgtttccatttgaagattgttttaggattattttcttgtattatttcatggttaattccccgtttttttctccttgaatttctgttaattggatgttggattgattgggccttttccttattttcatctttttctttgtgcctttgttttacctgttttggaacattttcttggatttatctctgcctcttcaaaaaacagtaasatactttggaagacataaactttaaaaactttttaattttctcacttcttattttatagcattctgttcttttagaaactttacatctcttgaggatatacatttgtgtgtgtattttaactttttaattttgaaataatcatgaagttgtagaaatgttagatgtatagtacaaatcatttttttcctgactgatatctttcatccaagtattttagtgtgtatttttaacaaaccaggaccatatcacaatacaaccataacatttaagaaattaacattgatttgtaatctgtatgg

SEQ ID NO: 49766 - DNA, 601 bp, Human
tcatgaagttgtagaaatgttagatgtatagtacaaatcatttttttcctgactgatatctttcatccaagtattttagtgtgtatttttaacaaaccaggaccatatcacaatacaaccataacatttaagaaattaacattgatttgtaatctgtatggactcatggcttattttattcgatggggtatattcttttaatttcattattttgatgctcaaaatgtcctgatttggccagtaagaacccttttgatatcacttctgtgggtcagtttgataccatttcattttttttgayaacttccttactttctggcacaacaaaatgttccaggctaatcttatacttttcctgcttagccttggaattggccattttcctaaagagtcctgattccttttagtagtaggtggtatttatgaagtcgtggcatttggttttctcattaccattgggatgttgctggtttcaggtccattagttggacagagctagggtgtatgtgcatgtgtgtgtgtgtgtgtgttgaatatatgtgtatctgtgtatacatacatgtatacatatatctgtttatttctccatgttacgtattga

SEQ ID NO: 49767 - DNA, 601 bp, Human
cttatcatgttgggatgttttcagctgtaaatagaaatcctgtctaaaatttacttaaacgttaagaaactacttcatgtaacgaatctgaaggtattatagttaaaggtggttaatctagcagtttgatgaatccagcaaagatccaggttattttcatcttttttctcctccacgttaattaagtatccgctgtttttctggtctcaagtggttatagcaattgtaggtatcaaattctcattaaagaacatccagagtctgcaggaggccattccttccttggtttttttttttttttgagacggagtcctgccctgtcacccaggctggtgtgcagtggcacaatcttggctcaccgcaacctccgcctcccggattcacgccatttctcctgcctcagcctcctgagtagctgggactacaggcgcctgccaccacgcctggctaattttttatatttttagtagagatggggtttcaccatgttagccaggatggtcttgatctcctgaccttgtgatccgcctgcctccgcctcccaaagtgctgggattatgggcgtgagccactgagcctggcctgtgttttgtttttaaag

SEQ ID NO: 49768 - DNA, 601 bp, Human
atctcagctgggcatggtggctcacgcctgtgatcctagcactttgggagggtgaggtgggaggatcgcttgagcccaggagtttgagagcaggctgagtaatatagccagaccccatctctatttaaaaaataaaaataaaaagaattccttcatctcatgcttatttgaaaaccattcactgtgtatgtttaattgtatgtgattaaggttgctatacatagactatctgtagacctttgcctctttggcagttagatatcctggcacctgctcaactgtagttggcatttaaacaagrtttttcagctgacctgattgtacttagtgtctgagaagtacatacctagactagtgaatatgtaactccctggggctgagagaatcttcgcctgtaaagtacagggtctcaaaatactgaacagaattaaggttctatgagaaaggaaggaggggaatgggcaatgtgggaatggcacttggcttaacaaacaacagtgtctggtcatactcactttcctttttttttttggtggtggtggttgtgattgttgttgtggttgttggtgtgtgtgtgtgtgtgtattttctttttagtcag

SEQ ID NO: 49769 - DNA, 601 bp, Human
ataaaaagaattccttcatctcatgcttatttgaaaaccattcactgtgtatgtttaattgtatgtgattaaggttgctatacatagactatctgtagacctttgcctctttggcagttagatatcctggcacctgctcaactgtagttggcatttaaacaaggtttttcagctgacctgattgtacttagtgtctgagaagtacatacctagactagtgaatatgtaactccctggggctgagagaatcttcgcctgtaaagtacagggtctcaaaatactgaacagaattaaggttctrtgagaaaggaaggaggggaatgggcaatgtgggaatggcacttggcttaacaaacaacagtgtctggtcatactcactttcctttttttttttggtggtggtggttgtgattgttgttgtggttgttggtgtgtgtgtgtgtgtgtattttctttttagtcagtcttgtaggaggaagaaaagatgaatggggatatggctagtctgctatcttgagcaggaaagctgttattgctttttaaaaattgaaccttgtaaaatattaaaaatatgcttatgtgatcctataatctaaaatcc

SEQ ID NO: 49770 - DNA, 601 bp, Human
actcctgagtttttttttttttttttttgagacggagtctcgctctgttgccagcctggagtgcagtagcgcgttcttggctcactgcaacctctgcctcctgggttcaagctattctcctacctcagcctcccgagtagctgggattactggcgcccaccaccatgccgggctaatttttgtatttttagtagagatggggtttcaccaggttggccggggtggtctccatctcttgacctcgtgatctgcctgccttggcctcccaaagtgctgagattacagatgtgagctattgcamctggcctgaactcctgagtttaagtgatctgtctgcctcggcctcccaaagtgctgggattataggagtgagacattacgccctgccatcatattctgttggttagaagtcagtcacaggtcacattggcagtcaaagagagagaattacataaggacatgaatacgaggaagtggggatcatggagaccacctcagagtctgtctgctacaaaggatatgcatgtgattgttaagagtgtctgatggcatgaattatgcattatttttcttttgaggctcccacttaatagctgtattg

SEQ ID NO: 49771 - DNA, 601 bp, Human
taggaaggttagagtatgtatctcatttgcttgtccagcttggacagtagttgttagcagaatacctgcacagaatggatacatagttaatatttatttcttgaataaacttgtgtttattttagttgtggtttcacctccaagtatgaaaacatacagttgtctcagtatccaggaaacaccgtggataccaaaatatgcagatgctcagatctgttatataaaatggcatagtatttgcatataacctatgcacattctcccatatactttaaatagtctctaggttaacttataatayctagtaaagtgtaaatgttatgtaaataattgttatgcagtatcacaattggtgagtctgcagttgtggagcctgcggatgtggagggccgactgtattttattctgctacaggggtaccttggagatactgcaggttcagttccagaccaccacaatagagcaaatgtcatagtagagcagatacctcaataaagtgagtcacatgaatgttttgatttctcagtgatgtaaaagttatgtttacattatactgtattgagagtgcaatcgcattatattaaaaaaagcaatgtggata

SEQ ID NO: 49772 - DNA, 601 bp, Human
tttagtgaaagatttccctgtagcatgtgagctgtttgatagcattttactcatagtagatctttcaaaattgtagtcagtcgtttcaaaccctccttctgctttgtcaactaagtttatgtaatattttgaatcctgcattgtcatttcaacaatactcaccgtgtcttcaccaggagtagattccagctcaagaagccactttctttgctcctccataggaagcaactcctcatctgtccatgttttatcacaaggttgcaataattcagtcacatctttatgcttcacttctaattcyagttctctattttcaccacatctaccgttaacttcccccacttagtcttgaacccttcaaagtcatcctttagtgttgtgatctgtttcttccagactcccattaatgttgatatttttagctcctctcatgaatcacagatgttattaatggcttctagaatggtgactctagaaacctttccgggaggttttcaatttactttgcccagattgagcagaagaatcactatctatggcagtgatagccttacgaaatgtgggctggaatttagtggggcgatcttggctcactgcaacc

SEQ ID NO: 49773 - DNA, 601 bp, Human
tccctgtagcatgtgagctgtttgatagcattttactcatagtagatctttcaaaattgtagtcagtcgtttcaaaccctccttctgctttgtcaactaagtttatgtaatattttgaatcctgcattgtcatttcaacaatactcaccgtgtcttcaccaggagtagattccagctcaagaagccactttctttgctcctccataggaagcaactcctcatctgtccatgttttatcacaaggttgcaataattcagtcacatctttatgcttcacttctaattctagttctctattttyaccacatctaccgttaacttcccccacttagtcttgaacccttcaaagtcatcctttagtgttgtgatctgtttcttccagactcccattaatgttgatatttttagctcctctcatgaatcacagatgttattaatggcttctagaatggtgactctagaaacctttccgggaggttttcaatttactttgcccagattgagcagaagaatcactatctatggcagtgatagccttacgaaatgtgggctggaatttagtggggcgatcttggctcactgcaacctctgcctcccaggt

SEQ ID NO: 49774 - DNA, 601 bp, Human
agtcagtcgtttcaaaccctccttctgctttgtcaactaagtttatgtaatattttgaatcctgcattgtcatttcaacaatactcaccgtgtcttcaccaggagtagattccagctcaagaagccactttctttgctcctccataggaagcaactcctcatctgtccatgttttatcacaaggttgcaataattcagtcacatctttatgcttcacttctaattctagttctctattttcaccacatctaccgttaacttcccccacttagtcttgaacccttcaaagtcatcctttagkgttgtgatctgtttcttccagactcccattaatgttgatatttttagctcctctcatgaatcacagatgttattaatggcttctagaatggtgactctagaaacctttccgggaggttttcaatttactttgcccagattgagcagaagaatcactatctatggcagtgatagccttacgaaatgtgggctggaatttagtggggcgatcttggctcactgcaacctctgcctcccaggttcaagcgattctcctcgcctccctagttcaagcgattctccttgcctccccttggattac

SEQ ID NO: 49775 - DNA, 601 bp, Human
tttatgcttcacttctaattctagttctctattttcaccacatctaccgttaacttcccccacttagtcttgaacccttcaaagtcatcctttagtgttgtgatctgtttcttccagactcccattaatgttgatatttttagctcctctcatgaatcacagatgttattaatggcttctagaatggtgactctagaaacctttccgggaggttttcaatttactttgcccagattgagcagaagaatcactatctatggcagtgatagccttacgaaatgtgggctggaatttagtggggcgatcttggctcactgcaacctctgcctcccaggttcaagcgattctcctcgcctccctagttcaagcgattctccttgcctccccttggattacaggctcccaccaccacgcccagctaattgtttgtattttcagtagagatgggctttcactatgttggccagactggtctcaaactcctgacctcgtgatctgcccgccttggcctcagaaaatgcagagattacaggtgtgagccaccgtgcctggccaaaatgtatttcttaaataagaatacttgcaagttgaaatactcctt

SEQ ID NO: 49776 - DNA, 601 bp, Human
tccagactcccattaatgttgatatttttagctcctctcatgaatcacagatgttattaatggcttctagaatggtgactctagaaacctttccgggaggttttcaatttactttgcccagattgagcagaagaatcactatctatggcagtgatagccttacgaaatgtgggctggaatttagtggggcgatcttggctcactgcaacctctgcctcccaggttcaagcgattctcctcgcctccctagttcaagcgattctccttgcctccccttggattacaggctcccaccaccacrcccagctaattgtttgtattttcagtagagatgggctttcactatgttggccagactggtctcaaactcctgacctcgtgatctgcccgccttggcctcagaaaatgcagagattacaggtgtgagccaccgtgcctggccaaaatgtatttcttaaataagaatacttgcaagttgaaatactccttgatcaatgggctgcaaaatggatattatgttagcaggcatgaaaacaacattcatcttcttgtacatttccaacagagctcttgggtgatcagatgcatcatcaatatgcat

SEQ ID NO: 49777 - DNA, 601 bp, Human
cagtgatcttagctagatcttctggttaacttgttgcagcttctctgtcagcactagctgcttcatcttgcactattatgttatagaaatggcttctttccttgaacctcatgagccaacctctgctagcttcaaacttttcttctgcaacttcctgacctctctgtattcagtgagttgaagagaattagggccttgctctagatgaggctttagcttagggaaaagttgtggctggtttgatcttctaatgactcaaactttctttctttcttttttttttgtttttttttttttttttgggacggagtctcgctctgttgcccagggtggagtgcaatggcacgattttggctcactgcaacctctgcctcccaggttcaagtgattctcctgcccagtctcctgagtagctgggattacaggggcgtgccaccacgcccagctaatttttgtatttgtagtagagataaggtttcaccatgttgaccaagctggtcttgaactcctgacctcaggtgatcttcttgcctcagcctcccaaagtgctgggattacaggtgtgagcctggcctcacactttcttcatatcagcaataag

SEQ ID NO: 49778 - DNA, 601 bp, Human
gtgggaaagggtaggaaatgaccagttggtggaacagttagaagacacacaatatttattaaatttgctgtctgacaagggcacagtttgagatacctcaaaacaattaaaatggtaacattaaagatcactaatcacagatcaccataacagatataatgaagaagtttgaaatattgcaagaatgacaaaaatgtaatacagagacataaagggagcccatgccgttggaaaaatggcattgatgggcttgcttgacacagtgttgcacagaccttcaatttgtaaaaaaaaaaaaaaattcagttatttgtgatgtgcaatgaagcgaagtgcagtaaaacgaggtaggcctgtaactgttttcagaggtgaagtaactacactttatattttatctcttgaaacaacagagagaggctatagtagggaattgaatatttagagcaaggtcacttcattttttgttttatgaatttacttctttttttgatctataatagattgtcatgcagataccatggaaactgaagtcagaataactggatttaaatgcagtcaagttccagctttgccctttgctggcagtgtggtattagac

SEQ ID NO: 49779 - DNA, 601 bp, Human
tgaattaagagtgtgggaactttctacttcctttgtaactcttctgtaaatctttttattccaaagcaaaattttatttaaaaaaaattacccttaggtaatcaacagcaatggataatacacaaattaataaggtagttggctttatcacttcagatgtgtatgttaaaattcaggggaaagctgtaatttaaaattcactgtccatttgaaaataagcttcctattgggacattaaggtgcacgttcatcctggctaacacggtgaaacctcaactctactaaaatacaaaaaattggycgggggtggctcacacttgtaatcccagcactttgggaggccgaggtgggcggatcacgaggtcaggagattgggaccatcctggctaacacggagaaaccccgtctctactaaaaatacaaaaaattagctgggcgtagtggcgggcggctgtagtcccagctacttgggaggctgaggcaggagaatggtgtgaagccgggaggcggagcttgcagtgagccgagatcgcgccactgcactccagcctgggcaacagagcgagactccgtctgaaaaaaaaaatatatataaaataaa

SEQ ID NO: 49780 - DNA, 601 bp, Human
agtgtgggaactttctacttcctttgtaactcttctgtaaatctttttattccaaagcaaaattttatttaaaaaaaattacccttaggtaatcaacagcaatggataatacacaaattaataaggtagttggctttatcacttcagatgtgtatgttaaaattcaggggaaagctgtaatttaaaattcactgtccatttgaaaataagcttcctattgggacattaaggtgcacgttcatcctggctaacacggtgaaacctcaactctactaaaatacaaaaaattggccgggggtgtctcacacttgtaatcccagcactttgggaggccgaggtgggcggatcacgaggtcaggagattgggaccatcctggctaacacggagaaaccccgtctctactaaaaatacaaaaaattagctgggcgtagtggcgggcggctgtagtcccagctacttgggaggctgaggcaggagaatggtgtgaagccgggaggcggagcttgcagtgagccgagatcgcgccactgcactccagcctgggcaacagagcgagactccgtctgaaaaaaaaaatatatataaaataaaatacaaaaa

SEQ ID NO: 49781 - DNA, 601 bp, Human
gtattttgtgtgatttagacacttacataattgtttcacattgcaccttttctttatatttaatgtgagatttcaacatggatacataatgtagttgcatctgttacaaatgggttttataacactagttagcttataggtaattagtagagagaaatgatgtcaggacaatgagaaagtgtgttagtttattttctaggtaagaagagctgtaataaagattgtaggattatgacttcagcaagaaaatggaagcagcttggagttcttttgaatctgaataccttttttttttttttttcttcttttaaagtaaccatctgtatctctaagggtatcttcctcaaagtttacagttctggcattgagggctcttaaatcctggtgctcactttcactgtctcagcatccataagccaaccaacattcccacttaattgttttttgttttacatttttaatagctactgaagaattcttcagtcatgactgcttgggcagtctaagttattgcctatctatgtaggttctagttattatttgttttcgtttatagtgttgaggtcccaaactgcataggtttttgcataaattgagtggt

SEQ ID NO: 49782 - DNA, 601 bp, Human
gatacataatgtagttgcatctgttacaaatgggttttataacactagttagcttataggtaattagtagagagaaatgatgtcaggacaatgagaaagtgtgttagtttattttctaggtaagaagagctgtaataaagattgtaggattatgacttcagcaagaaaatggaagcagcttggagttcttttgaatctgaataccttttttttttttttttcttcttttaaagtaaccatctgtatctctaagggtatcttcctcaaagtttacagttctggcattgagggctcttaaatsctggtgctcactttcactgtctcagcatccataagccaaccaacattcccacttaattgttttttgttttacatttttaatagctactgaagaattcttcagtcatgactgcttgggcagtctaagttattgcctatctatgtaggttctagttattatttgttttcgtttatagtgttgaggtcccaaactgcataggtttttgcataaattgagtggtctgcaaactctattttttatatagtcactggtatttttagtgtttgattttgaagttttcacataataagtggtatttta

SEQ ID NO: 49783 - DNA, 601 bp, Human
aaacaactttactattagctgtaaaattttcatttttagtatgtcatcaatctttttttgtgtttagtatgattaaatgtttttcacttggaaagatatgaatagtctacttcattgatcttttttaagtcatttcatttttattttgtagctacaaatcataaactatacctcattaatttgttatgtttaagaagtaagctaaaactgaggagaaaccaggctaacttagcagatattactacattcttaacttcaatgttttagactaaagtagagaataaagatttatttgtgggtrtaactttgattcagtatcaatgtcttggctagttcatatttggcacttggttgttggagttgctactttgtaattgagataaaacaaaataaacacattccagtaaacaaatgcttagttgactgtgacatattttggggtgtggtgagaagaatctttcccacaatttattttattgggggaaataacagtgtaaaacaggataaattgtaatgccttacatgactgaatggcagacatgtgataagatgataggtgttacagaatctttgaaaaaatgtctttcagaaaggggattaa

SEQ ID NO: 49784 - DNA, 601 bp, Human
taagtcatttcatttttattttgtagctacaaatcataaactatacctcattaatttgttatgtttaagaagtaagctaaaactgaggagaaaccaggctaacttagcagatattactacattcttaacttcaatgttttagactaaagtagagaataaagatttatttgtgggtataactttgattcagtatcaatgtcttggctagttcatatttggcacttggttgttggagttgctactttgtaattgagataaaacaaaataaacacattccagtaaacaaatgcttagttgactrtgacatattttggggtgtggtgagaagaatctttcccacaatttattttattgggggaaataacagtgtaaaacaggataaattgtaatgccttacatgactgaatggcagacatgtgataagatgataggtgttacagaatctttgaaaaaatgtctttcagaaaggggattaaaagtaaaactaggctgggcgcagtggctcacacctgtaatcccacccttttgggaggccaaggcaggtggatcacctgaggtcaggagttggtgaccagcctggccaacacggtgaaacccagtc

SEQ ID NO: 49785 - DNA, 601 bp, Human
gtaaaatgcatttaatcattgtgttctgcctctatccctggaaattttgctgaaaaccaagattttattatacagtttaaggaaattaggaagttcattttgtaagtcaggatagtttacattgtggtaccaacatcaaaatctcagtggtggcgtagcacaaggaaagactacatcctttcatgcaaagtttggtccagctagccaagtcactgtgctgcttttcatgtggcggcacaaccttctgggctgctttagtcttgtggcaagtcattgtcaatttgtgcttttgtaatttttsaggacagagcaacagagcatagaaaatcacgttccagttttaaatgcttccctctggaagtggtccatattactttttcatttcattggcccatagcaatgatgtggtcatgtgtactatcaaaggggcagaaaaatatgatcttgctttatatgcaaaagaacagtagaactagagcattagtaatgcctatcacacccagtgtgtgtgttgactggtactcatgaaggtcttttcatgatgtgcaatggatgctttgtttacttgattttatagcttctggattgagagaagatcctg

SEQ ID NO: 49786 - DNA, 601 bp, Human
ctcatgttgaaatgtgattcctaatatgggaggtggggcctggtgggaggtgattgacccatgggggctgatctggcatgaatgatttagcgccatgcccttggtaataaatgaattctcacccagttcacttgggatctggttatttaaaagagtttggaacctccctcctctttctcttgttcctgctctcactatgtgatgcgcctgctcccctttcttcttctgccatgattggaagcttcctcaggccctcaccaggaagagatgctggagccatgcttgtatagcttgcagaacygtgagccaattaaacttctttttttttttttttggaggcggtttcttactctgtcacccaggcgggagtgcagtggtgcggtgcgatcacagctcactgcagcctcgactttctgggctcaagcgatcctctcacctcagcctgacaaatagctgcgactacaggtgtgtgccaccatgcctggctaatgttttttctattttttgtggaggtggggtttgccatgttgcccaggctggtcttgaacttctgggctcaggtgatatgcctgccttgacctcccaaagtgctgagattgca

SEQ ID NO: 49787 - DNA, 601 bp, Human
gcccttggtaataaatgaattctcacccagttcacttgggatctggttatttaaaagagtttggaacctccctcctctttctcttgttcctgctctcactatgtgatgcgcctgctcccctttcttcttctgccatgattggaagcttcctcaggccctcaccaggaagagatgctggagccatgcttgtatagcttgcagaactgtgagccaattaaacttctttttttttttttttggaggcggtttcttactctgtcacccaggcgggagtgcagtggtgcggtgcgatcacagctcrctgcagcctcgactttctgggctcaagcgatcctctcacctcagcctgacaaatagctgcgactacaggtgtgtgccaccatgcctggctaatgttttttctattttttgtggaggtggggtttgccatgttgcccaggctggtcttgaacttctgggctcaggtgatatgcctgccttgacctcccaaagtgctgagattgcaggcctaagccaccgcgcctggccctaaacctctttttaaaataaattacccagcctcagatacttctttataacagcacaggaacagactaataat

SEQ ID NO: 49788 - DNA, 601 bp, Human
agttcacttgggatctggttatttaaaagagtttggaacctccctcctctttctcttgttcctgctctcactatgtgatgcgcctgctcccctttcttcttctgccatgattggaagcttcctcaggccctcaccaggaagagatgctggagccatgcttgtatagcttgcagaactgtgagccaattaaacttctttttttttttttttggaggcggtttcttactctgtcacccaggcgggagtgcagtggtgcggtgcgatcacagctcactgcagcctcgactttctgggctcaagygatcctctcacctcagcctgacaaatagctgcgactacaggtgtgtgccaccatgcctggctaatgttttttctattttttgtggaggtggggtttgccatgttgcccaggctggtcttgaacttctgggctcaggtgatatgcctgccttgacctcccaaagtgctgagattgcaggcctaagccaccgcgcctggccctaaacctctttttaaaataaattacccagcctcagatacttctttataacagcacaggaacagactaataatagttgccaagtcttcatgatatttcttt

SEQ ID NO: 49789 - DNA, 601 bp, Human
ggagaagaaaatcacctaaattataaaattagtcaacaaatttttttgaatacctataatatggcaggcactgttaagtattaacaataaaatagggaaaaaggcagaacttttcaaattgcccttttaaaagaagttagtagttttcaaggaaggagaaaaataaagaggaaaacagttaaaatgagaaaatgtggaactagcagttagcttgattagtctatttgcttaaactagatagtaaaaaagattttagtgtgttaggatttgagtataagttctaacttcttagggcaaaacraattttgttaggtcttttttgtggaactaaagtgttgtgtttagaaaaatgacctgtggaaatgattttttttttttgttgagtcctttggaatggaaaaaaggtagttcattttaggtgaggggctaaattgactatggaaagttatttcagttactgagactggggataaagcagacatctctggggcctcgttattaaaagctgaagatttgtgttcaagtcctggtagaagtatcagtggtaaaaatatttataacagtcaatattggttgaggaccttggatctaaatataagct

SEQ ID NO: 49790 - DNA, 601 bp, Human
tgctgaaaaaagtgaaatgaattgtgccaaagtccagtgcctcacttggtctctgttgacagttgtcgggaggggctccccactgtgtttccatcgatacctgccttggctggagaggcagatgtacttcattagtgctgtccatatggcctccgctgacagcagggggaaggaaggtgtggtttgttttcacctagtgtggagggaagtcccggctgtatactgggccttttctggtaaccatgcctctggtgggtggtggttgggggcgaaagtggggtctatggtggtgattggggcrccttattatagcctgatgaggatggaagtctaggttccctacttggtcattgctaccatgggcaggactggtgctacagttttttttttttttttttttttgtccctgtggtgtttgactgtggcacagtggttattgtctaagagctctctgtcttgccagtctgcctgtttcctggtcatttggctagggctaacactagtgggcttttcttgagttttgttttcttcttctctgcttgcattggcatttctatgttgcagacttctccagtacctagcctgggatataggcaaaaag

SEQ ID NO: 49791 - DNA, 601 bp, Human
atgtaaggtccagagctttaaaatatatttagcaggaagaatagggaaacacctactccatctttctgtaagggaaaatctagatggtgatgcttgtaatgcacatccataacagttgcttatcttgctcataagtaaggtttttactcagtctaaatactcataattataaaagttcttttctattagaagtggcatagtaggccaggcgtggtggctcacacctgtaatcccagcattttgggaggtcgaggcgggcagatcacctcaggtcaggagtttgagaccagctttgccaacrtggtgaaaccccgtctctactaaatatacaaaaattagctgggcgtggtggcgggcgcctgtaattccagctactcgggaggctgaggcaggagaagtgcttgaacccgggaggtggaggttgcagtgagccgaaatcgcaccagtgcactccagcctgtgttgcagagtgagactccgtctcaaaaaagaaatggcacagtaatagctgtttttaagctgttgttattaagctagtgtttggaaaagtttaaatattagttgccattaaaaaagaagaatagatttgcattcagcaaaa

SEQ ID NO: 49792 - DNA, 601 bp, Human
taataaacgtagttgataccctttaagttatgacttgcttctgaaggttaagataacacatgagatttaagataactctcacgcctgtaatcccagcactttgggaggctgaggcgggcaggtcacctgagttctggagttcaagaccagcctgaccaacatggagaaatcccgtctctactaaaaatacaaaattagctgggcttggtggtgcatgcctgtaatcccagctacttgggaggctgaggcaggagaattgcttgaacctgggaggcggaggttgcagtgagccgagatcatrccattgcactctagcctgggcaacaagagcgaaactctgcctcaaaaaaaaaaaagaaagaaagataacctaacagagcaagtgactaattggagacattgaataattattggtggactctgttcactgatgagtttcatataaaagggtgcagagtccgatcacctgaggaggctggggaggagcaggtgaggaggaatacttagaaggtgcatttggtagtgaattttgcaagcgccagagcacagagagtcatggaaaaagcagagaaatatcagcggaatgatatcaaaagagaag

SEQ ID NO: 49793 - DNA, 601 bp, Human
acacatgagatttaagataactctcacgcctgtaatcccagcactttgggaggctgaggcgggcaggtcacctgagttctggagttcaagaccagcctgaccaacatggagaaatcccgtctctactaaaaatacaaaattagctgggcttggtggtgcatgcctgtaatcccagctacttgggaggctgaggcaggagaattgcttgaacctgggaggcggaggttgcagtgagccgagatcatgccattgcactctagcctgggcaacaagagcgaaactctgcctcaaaaaaaaaaaagaaagaaagataacctaacagagcaagtgactaattggagacattgaataattattggtggactctgttcactgatgagtttcatataaaagggtgcagagtccgatcacctgaggaggctggggaggagcaggtgaggaggaatacttagaaggtgcatttggtagtgaattttgcaagcgccagagcacagagagtcatggaaaaagcagagaaatatcagcggaatgatatcaaaagagaaggttaacaaagtatttttattcgctgtacttaaaagagtgttagcaggacagtatt

SEQ ID NO: 49794 - DNA, 601 bp, Human
aattttgatcccttgtgaagagtttcttgaccttgatataaagtgttctagactttttgatatagtcaggaagaagaaaacaaaaattacccagtaagtttttcaggaagctgacaaatgaataaaaatcactcagatgttttttcttggtttcaacctaaatttctagcaatttttttctcttcgtttagaatacaggtttttaaaaaattagtttgaaaaattatcttttatttaaaaatgtttattttcagtttatttgcagatttccatagtaaatataatgtaaattatatttacwttaaatctttaaatataattaaaatcttttttaaagctacttgaaaaattagcaatatgaagaataagagatgtatgtatatagctactttggaaagtctcattgatttagaaaaaaattctttttttagaaggatgctgatttagtttttgactgttgttattccagttttcataagaagaaatatttaagtaaaggaaatgacaatttggtgttatatggtgtttagttttaaaaatcttttgctttatgaaactgttagatcttttggatggatgtcagtgatgttttccagtattt

SEQ ID NO: 49795 - DNA, 601 bp, Human
aaattagtttgaaaaattatcttttatttaaaaatgtttattttcagtttatttgcagatttccatagtaaatataatgtaaattatatttacattaaatctttaaatataattaaaatcttttttaaagctacttgaaaaattagcaatatgaagaataagagatgtatgtatatagctactttggaaagtctcattgatttagaaaaaaattctttttttagaaggatgctgatttagtttttgactgttgttattccagttttcataagaagaaatatttaagtaaaggaaatgacartttggtgttatatggtgtttagttttaaaaatcttttgctttatgaaactgttagatcttttggatggatgtcagtgatgttttccagtatttatagaaatgtattgacgactttaatagaacaattcaagagctagctttataatagttcatatagagaacattttgatgtttgatttactttcattaattggagacagattaagggagaaaaccttgcagatattggaatattaaatggaagacaagtttactggctaattgggaattgtaatgaaaatggtagatgttaattagctt

SEQ ID NO: 49796 - DNA, 601 bp, Human
ttcatatagagaacattttgatgtttgatttactttcattaattggagacagattaagggagaaaaccttgcagatattggaatattaaatggaagacaagtttactggctaattgggaattgtaatgaaaatggtagatgttaattagcttgactgtagtaatcatttcactatctacacatatgtcaaaagatgttgtataccttaagtatatgcaatttttatttagagaaaagaacagatctccatttccacttgtgttgaatatgttgcttaagcaagaaataaatcttcattgamaataagtaaaaataaaaataaaaaacggttgaaagaatgccaaagttgtgtatagttattgatgatacatcatagtatgttttctgttactgttaaagcattaactattttacacatatattaagagtaattcattctgtgacttgagttattttagataatactattctgaatttcacatagactatattcagtgagttggagaaatactttatacaggtaatactagaaaatatatataaggatttacatttgataaagtgtactcgcatagcatatgtgtctttttccaaatgccct

SEQ ID NO: 49797 - DNA, 601 bp, Human
agttcatttcaatcattgtggtatgtctgaaagaatgagtaaagagaaaagttcttaagtgtttttttttccactgtacttcacttggctctcatttacattcctggatagaaaaaaggaaaggagtaggatgccattgacagtgaatttatataacttcccccaccccatttctacttttgccttctctgaatacaggaggaatagtttaaataggaagttcctttgtccaaaatgtggagagcaattgtgtaacaaaaagcatagtagaggagagaagtttagaaactttcaaagtaggtctgctatatctgtcatttttgttttccttgccgattttgatctattgacacttagacgatacgtactgatttcatattaaggacattttttcttgttggtcatttttctttgaacttaagtgctttagtgaatatccaatttaatttaatcataataaaaaggaaaatcaaatgactttaagtagtttttcctggatattccttatatattattacttatattaaaaaaaacaaaaatacttcaggagtatggtaggccattttgttaggttaaaatctaaatcaatcatttctagact

SEQ ID NO: 49798 - DNA, 601 bp, Human
ttcatttcaatcattgtggtatgtctgaaagaatgagtaaagagaaaagttcttaagtgtttttttttccactgtacttcacttggctctcatttacattcctggatagaaaaaaggaaaggagtaggatgccattgacagtgaatttatataacttcccccaccccatttctacttttgccttctctgaatacaggaggaatagtttaaataggaagttcctttgtccaaaatgtggagagcaattgtgtaacaaaaagcatagtagaggagagaagtttagaaactttcaaagtaggtctgctatatctgtcatttttgttttccttgccgattttgatctattgacacttagacgatacgtactgatttcatattaaggacattttttcttgttggtcatttttctttgaacttaagtgctttagtgaatatccaatttaatttaatcataataaaaaggaaaatcaaatgactttaagtagtttttcctggatattccttatatattattacttatattaaaaaaaacaaaaatacttcaggagtatggtaggccattttgttaggttaaaatctaaatcaatcatttctagactat

SEQ ID NO: 49799 - DNA, 601 bp, Human
taggtaacctgcctgtttcatttgagaaatgaaatgaagttcttgacttctcacctggtttttattattctttgcgacctttgagtctatggaatacaagtaaattgctttctattttcaaatcatgataatggccacagccatgattagatagccagattattatatggacatattacaacatgaaggagtggtttgtgaattttgttgattatctttttagttgtttgttttggttaatacaatcaaaattatgtatctttgattaccttaatagatgaagagtagatataccctttarcttcccccaccatttgcatatgtatttcagtttttatcctcttgttgtactacctactctttatctataagcaaaaccaatcagtatagcacattcttatctatatggagattatccatattgtattttttcttggcaagttttgtattgacattacctattgtgcaagtggcttccctcatttgaagtatgaaactcgagtttttcagagtttgctttgactatacatgattgctttccaagtgaggactcttttttactacatctcctgaagttattttccaagtcaggaaaggaagt

SEQ ID NO: 49800 - DNA, 601 bp, Human
ctgtgccaggaagctgcttggagtacgttgagtgatacctgcagattagttgtttgtccccaaccagagaaagtactagatactgcttgtgccagtggccctgccctggatttcattatttttgaaagtgacaaggtttagttttctacccagagttacatgggagttcagagtcaagaaaattgggttcactagtaaaaatcaagtcgtcgtctttacctacatttgttttttggttcatacctgtaaatatatatttgtgtcatattgttggctaagaagcttctgggtagcatgtatktttaatagaaacatgttttatatatgtggtgttgtaaaattggtttgttttattcaatagtgtgattcagatatcatttctaatacagatatatcattctttaatgactacagtattttatcagatgcatgtactgtagtttatttaaatagttcacaactaatggctgtttgagcttctaatttactacttcttttgggggatgagacagagtctctttctgtcacccatgctggagcgcagtgctgtgatcttggctcactgcaacctccgcctcctgggttcaagtgattctcatac

SEQ ID NO: 49801 - DNA, 601 bp, Human
ttattcttaatcagaattattactaatgaaatgtgtacaccttttgggcactgcactgttgcgggaaaccgaggactggagagacgatatgaggggaaacaggaggattgtttatttaaggtatgtactggctcagctttttggatatgaatccactgagccagtgcataccttaaataaacaatcctcctgttctccatattggtctctctggtcctcagtttcctgcaacagcacaactctcaaattttggaaatgataggttaccagtactcttcttttcctgttccacattgatttytaaaaaactatagctagtaataattatagtacataatagttattttgcactgtattaaaaaactagcacattatcagttctcaagtatttgaagtatgttttataagaatccttttcggccgggcgtggtggctcacgcttgtaatcccagcactttgggaggtcgaggcaggcggatcacctgaggtcaggggtttgtgaccagcctggccaacatggtgaaactccgtctctactaaaaatacaaaaattagccaggtgtggtggtgcatgcctgtagtcccagctgctcaggaggct

SEQ ID NO: 49802 - DNA, 601 bp, Human
tttaaaacaatctgtaatacttttataatcataagaatttataaacttgaaatagaaatattctattgtaaaggttaagaaaagtatacttggttggccaccgaggctcactaccataatcccagtacttcgggaggcagggtggaaggattgctcgagcccagaaggtggaggctgcagtgagccatgatcatgccactgcactccaacctgggtaacagagggagaccttgtctgaagaaaaaaaaaaaaagtatatatatatatgtatacacacacacacacacacacacacacacayacaatacttgccatatcaagttaaaattgttaattttaatatgaaatgtgtgagataggtatccagtttcattccctattaaatatggaacgtttttcttgcacaatgtattttaagattccatctttcctcatttttttctgttttaaatgaagtttgtctgtttatggatttcctattttgtttcatttatcagtactgtctttatgccagtagcacattgtctaattctatcgttatagttttcctttgtattttcgttaacaaaaactccctccgctttcttttccttgaagtatt

SEQ ID NO: 49803 - DNA, 601 bp, Human
taaaacaatctgtaatacttttataatcataagaatttataaacttgaaatagaaatattctattgtaaaggttaagaaaagtatacttggttggccaccgaggctcactaccataatcccagtacttcgggaggcagggtggaaggattgctcgagcccagaaggtggaggctgcagtgagccatgatcatgccactgcactccaacctgggtaacagagggagaccttgtctgaagaaaaaaaaaaaaagtatatatatatatgtatacacacacacacacacacacacacacacacayaatacttgccatatcaagttaaaattgttaattttaatatgaaatgtgtgagataggtatccagtttcattccctattaaatatggaacgtttttcttgcacaatgtattttaagattccatctttcctcatttttttctgttttaaatgaagtttgtctgtttatggatttcctattttgtttcatttatcagtactgtctttatgccagtagcacattgtctaattctatcgttatagttttcctttgtattttcgttaacaaaaactccctccgctttcttttccttgaagtatttt

SEQ ID NO: 49804 - DNA, 601 bp, Human
tttatctttcagactctgctgaatgattaccattttaccttaactatattttaataccatttatttagtgggattctgaaatatctgctgattcttagcatagatacaagaattttgatagtgctttttcttcagttgttaaacatctgaacataaacatttccaaggtggttggccttgcaaattaccttgtaaggatttggtactgtgtaaatatgttaggggaacaacttggcaaagaaggagagcattacatttgaaatcagataagggtttgagtctgtcttatgacctcagaaasatcatttaaactgttgagttttatttgctgctagtgagaaagtggttaagaaaaaaagcaaaacaaaacaaaaaacaccaggtaatattgctgttctcaaagagcttacattcttggaaaagaaattgttatttaaggccaagtgcagtggctcactcctgtaatcccagcactttgggaggcctaggtaggtggatcacctgaggtcaggagttcgagaccagcctgaccaacatagtaaaaccccatctctactaaatatacaaattagccgggcgtggaggaacttgcctgtaattc

SEQ ID NO: 49805 - DNA, 601 bp, Human
ctctgctgaatgattaccattttaccttaactatattttaataccatttatttagtgggattctgaaatatctgctgattcttagcatagatacaagaattttgatagtgctttttcttcagttgttaaacatctgaacataaacatttccaaggtggttggccttgcaaattaccttgtaaggatttggtactgtgtaaatatgttaggggaacaacttggcaaagaaggagagcattacatttgaaatcagataagggtttgagtctgtcttatgacctcagaaagatcatttaaactsttgagttttatttgctgctagtgagaaagtggttaagaaaaaaagcaaaacaaaacaaaaaacaccaggtaatattgctgttctcaaagagcttacattcttggaaaagaaattgttatttaaggccaagtgcagtggctcactcctgtaatcccagcactttgggaggcctaggtaggtggatcacctgaggtcaggagttcgagaccagcctgaccaacatagtaaaaccccatctctactaaatatacaaattagccgggcgtggaggaacttgcctgtaattccagctacttggga

SEQ ID NO: 49806 - DNA, 601 bp, Human
accaacatagtaaaaccccatctctactaaatatacaaattagccgggcgtggaggaacttgcctgtaattccagctacttgggagactgaggcaggagaatcacttgaactcgggaggtgagccgagatctgccattgcactccagtctctgctccaaaaaacaaaagaaactgttatttaaaaagtgtaaaatattaaacgtgtacaaagaattacggtgttatgggagcacatagcaaatgttttaacacagtaaaaccagaagacccttcagagattgaatacttttttttttttttgagatagactctcactctgttgtcctggctgcagtggtgcagtcacagctcactgcggccttgacctcccaggctcaagcagttttcccatttcaggctactgagtagctgtgactacaggtgtgtgccaccacgtctgctaatttttgtatttttctttgaagagatggggttttgccatgttgcctgagctgttcttgaactcccgggctcaagtgatttgcccccattggcttcccaaagtgctggaattacagacgtgagccaccatgctagcctagagattgcatacttattact

SEQ ID NO: 49807 - DNA, 601 bp, Human
tactatggtcaatttgatttaacccatctatgcctagtgtcccattattggaatgctaagaatgtaggagttattactatcctgctgttcaaggtcattgccaaggtctgattgcaaaaattcaaaaaactgcaacctctggcataaatgggttaatagttaatgaatatttaatcacatttactttaatgtctttgaaattatggtgtataaatccctgtagtacaaaatattctacaataaagaaattttgtttacatacatttcccaaattgtaattgtaaggctattaataattttyatagagtccccttatgtctcagtctattactttcataagctgttgtctgtcaagtttggggaaacctctacttttggattacatcatcctttgattattttcataaaataaaaacaggttgtcataaaaatgaaacagattttatgacacttggaccaattctagggttctatttgttctttgtttctcaaggaaatacaatatccagggaatatttgcatattatatatactgctttctagcattattgcctgaaggtggatggtttcagcagttctgatgatgatgaattctgaaact

SEQ ID NO: 49808 - DNA, 601 bp, Human
taatagttaatgaatatttaatcacatttactttaatgtctttgaaattatggtgtataaatccctgtagtacaaaatattctacaataaagaaattttgtttacatacatttcccaaattgtaattgtaaggctattaataatttttatagagtccccttatgtctcagtctattactttcataagctgttgtctgtcaagtttggggaaacctctacttttggattacatcatcctttgattattttcataaaataaaaacaggttgtcataaaaatgaaacagattttatgacacttrgaccaattctagggttctatttgttctttgtttctcaaggaaatacaatatccagggaatatttgcatattatatatactgctttctagcattattgcctgaaggtggatggtttcagcagttctgatgatgatgaattctgaaactgcttggagactgggggacaaataacagttttatatcatacagctgaacctctatatagaatgtctgtgctgagggagaatttttaggcccacgggaggttttttcatgacctctgtccatagtaaaatccatttacaactttctttcactcta

SEQ ID NO: 49809 - DNA, 601 bp, Human
ctgtcaagtttggggaaacctctacttttggattacatcatcctttgattattttcataaaataaaaacaggttgtcataaaaatgaaacagattttatgacacttggaccaattctagggttctatttgttctttgtttctcaaggaaatacaatatccagggaatatttgcatattatatatactgctttctagcattattgcctgaaggtggatggtttcagcagttctgatgatgatgaattctgaaactgcttggagactgggggacaaataacagttttatatcatacagctgawcctctatatagaatgtctgtgctgagggagaatttttaggcccacgggaggttttttcatgacctctgtccatagtaaaatccatttacaactttctttcactctagggagctataaagggataagtttcttcttaagtagaagttagacaaagaggttgaaggttctgaatattttttcactttctcttctaataggaaaggatacagtaaattttgcctttcgtaagaacactggatgtaaattcttttctcttgtaagaaggaaaaatcattatgcagttggtgccaggaagcttag

SEQ ID NO: 49810 - DNA, 601 bp, Human
aacccaaaaccattgtattaacataaggttaatagtgtaaacactgcagtgtatatgttcagtttaaatccctgtgtgccaagacaaaatgaatctgtgtatgtgttgaattttgtctaagcaactacaaaggagaggttcaaataagtataatgatgttgagtatccaaaaactggattggactagtgagctattcttctctagtctccagtatattggcttttttgggatagtaatgaagccgtgaaaacttttgctatgatccattgctaagcatggtagctcatttggtaaaacaargaagtattaattttttttagagcaaacatggaatagtgtttctcaggaaaaagttgattactgtaagttgctaaagtcagagaagagaacaaatgtgcatttctcaaagcaaaaacaggttgcaagtcacattacttctgacacccttgtaaaatcagccacaaagataatggtaaaatattgtgtttagagagtaaataaattgacgtgtttcagcatcagaatattagcagtcagcgtggaatattggtagatgtttcactttacatttggaagaaactgataccagatgaaatctct

SEQ ID NO: 49811 - DNA, 601 bp, Human
gcaatacatagtgtttgctaattgtattttccttagtagtggaaactcacgctacagcagaagtgatttttcatgtagttaattattttgagtgtaaaagatacattgagattgatactgatagatcactagtgtttatactgcaagggatgatgttgcacatgaaaagctagttgaaacaatgccagtctacacattacttcactcccataaaacctttgggtagcaaatagtatgctttcttattttgagtcagtgctgaagaaaatagtaacattctgaatgctgtcagattatgtcyactgactatgcatctttgcagcataccttttgaaaaaatgagtgtgttggttcatggtggctctttgacattgaagtattctgactggtaaggagaaaaagactcactcaaatgactagatcatcttggggttagaacaccctaccctcttgaacagggtaggctgttctaactttctattttatttggaaaattttaaaatatctggaaaagttgaaggaataattgtgcagtgaacatagtatacccttcacctacatatgctgttaacattttctcacattggctttatcttaatat

SEQ ID NO: 49812 - DNA, 601 bp, Human
acgccactgcacctggctaattttttctatttttagtagtgatggggtttcaccatgttggcaaggctggtctcaaactcctggcctcaagtgatctgcccgcctcagcctcccaaaatgctgggattacagacccaagccactgctccgggcaagaaaattttttaaaaagatacgactgtatgaatggctgattgatacatatgtcatgtattcatgtaatgaatatttcattacatgaaaatgatgtattcattcatcattcatgtaaaatggccgaatcagtgtttctcataacatktgattatttgcttattgaagaaataaattgatttttattttattttatttatttattttttgagacagagtttcgctcttcttacccaggacggagtacagtgccatgatctcggctcactgcacccttcgccttccaggttcaaccgattctcctgccccaacgtcccaagtagctgggattacaggcgtgcaccaccatgcctggctaccttttgtatttttagtagagacagggtttcaccatgtttgttggtcaggctggtctcgaactcctgacctcaggtgatccacctgcctc

SEQ ID NO: 49813 - DNA, 601 bp, Human
tggtacatgaaagaaatgcagtatgtccccgcctttgctgtacctcctttattctcttccttgttagtagctttacttatataatgatttttagaagacaatttttgtacaattaatttttttgtagaactggaaagtattaaaggttacttatgataagaaaatactaatagctgagtgtggtggctcacacctgtaatcccagcactttaggaggctgaggtgggtggatcacttgagcccaggagttcaggaccagcctgagcaacatggcaaaccccatctctacaaaaaaaaaaaatacaaaaattagcccagtatggtggtgagcgcctgtggtcccagctacttgagaggctgaggtgggaggattgcttgagcctgggaggcagagattgcagtgaacagagttcttactactgcctgggtgacagagtgaggccctgtctcaaaaaaaaaaaaaaaaaaagaaaaaagaaaaaatactagttacagtgttttttttaaaatggacttaatttcatgtatccttttattgacacctctcttcttttttgtgcttagcatgggttctgatacattatagaaattaacatttatt

SEQ ID NO: 49814 - DNA, 601 bp, Human
aaccctatttaaatatgaaataatgtggaattatttttttctttttaaaataaatgactcataatttgtggtaataatagctatttagatgtttttatctaatgtgactccttcctttgattaaatctttttttttcattttttgcaaatgattctgttaatacaaactacttgggaaaaattatgtttagtgtgagaggaagaaataaagctcttgggtaaaatataactaggctgctcagacttcattgacttgcctgggttggggctaatgagtagtccatttcaccttaagtccaaytttaagagatattaaaattcatgaaaaagaaaccacattttaaaaaaggtctgaaattatcagaaagaaaggattttattcttataagagcaccttgaacaaaatagacatttcttttcaataatatggattgtttgcctcttgtctatgaagtgctaactgcaaataacacattaatgaacacagtttctcaaggtcactggaacaacttgcaaaggtatttagggacactatatttcaagagatgagaagttttcctatagcacgcaaaaaactatttaaattacttaaaaatttacc

SEQ ID NO: 49815 - DNA, 601 bp, Human
ctcggcctcccaaagtgctgggattacaggcatgagcctccacgtccagtctgtttgctttctttggcttcttttattataaaaactacaataaaaaatcagatacaaattattaattgctttaggaaggggaaaaaaccttacacagatgtaactttcttatttggagactcaattattttatctacttgatggttatctctgttttgtacctttccatgctattggttgcatgtagtgtgcttcttttgttgttttgggggtgaagttagattactttttgtcttgataaacaatttcrtagattcacagaatgtcagagctgaggtaactgtagtggttttctagttccgcattgtaattttatggcccaggaaattgattcctagagaatttcagtgaaataactaggtaatgacaactgtacaagaacataagtcttctgacttccagtacagctgatatttctattgtagcatgacatctttctttacaaagagtttatttggagatcatgatttgatgcagtgaaattcttcctgtccagattacttcttaggattctcctttgttgtcctctctccttagagtccttgtatca

SEQ ID NO: 49816 - DNA, 601 bp, Human
taccacagacttagtagcttaaacatcagatttatcttctcacagttttggacgattagaagtccaagatcaagatactgtcagggttggtttctggtgatgcccctcttctggcttgtagaggaccactgtctccttgttttctcacttggtctttcctttgtattggagggttggggagggcaatggtgggctgatgtctcttcctcttttgtaaggatactagtcctatctcattagggtgttacccttaggacctcatttaaccctatttaccacccccacaaaggcactattgccrgacacattgggtgttagggtttcaatatatgaatttcgagggaactttttattcagttcctagtaagtagatgtggggtggagcttgagatactacatatctcacaagctcccaggttacactgttgctgctggtctaagaaacacactttgagtatcaagaagtagtcaactattcctgatcatctacccatagctgcttaatgattcacttttgaagatgggagtgagtctgagttctcagttcttagagcttgaaaaaggttgagaacacaagcgcgaatggttataaatgatcact

SEQ ID NO: 49817 - DNA, 601 bp, Human
tatagtcgtaaaagtactaattttaagtagtattcccagacttgattaggaagtagtctgaaaatcactagcctagaggacttgtctatgatgaatttgttgtgccagaagtgtcttttattgtcggtttttttagtctcaaaaatggtaatgggtatttggatattttgcttttgtgtaaatggtgggataagatgtataaagagattttattgcctgaagccttaatatttgtagtttggggcttggggtaaaaagctaaccagggctgattgtgattagctgtttagaatgctcataygttctgtttttatttatttatataagtcctgtgactaaacatggcatgtaaatatactgtttttaaaaatgatcattcttaatctaatttcttattatgttactttctttagagaccaagaagcgtcagtgtaaagttctttttgagtacattccacaaaatgaggatgaactggagctgaaagtgggagatattattgatattaatgaagaggtaaggaaaaaatgtgttacaggtaaaacagtaatggtaattgatgctatggattttagaaaaattaattgtaagaatattagtctt

SEQ ID NO: 49818 - DNA, 601 bp, Human; identical to SEQ ID NO: 36452

SEQ ID NO: 49819 - DNA, 601 bp, Human; identical to SEQ ID NO: 36453

SEQ ID NO: 49820 - DNA, 601 bp, Human; identical to SEQ ID NO: 36454

SEQ ID NO: 49821 - DNA, 601 bp, Human; identical to SEQ ID NO: 36455

SEQ ID NO: 49822 - DNA, 601 bp, Human; identical to SEQ ID NO: 36456

SEQ ID NO: 49823 - DNA, 601 bp, Human; identical to SEQ ID NO: 36457

SEQ ID NO: 49824 - DNA, 601 bp, Human; identical to SEQ ID NO: 36458

SEQ ID NO: 49825 - DNA, 601 bp, Human; identical to SEQ ID NO: 36459

SEQ ID NO: 49826 - DNA, 601 bp, Human; identical to SEQ ID NO: 36460

SEQ ID NO: 49827 - DNA, 601 bp, Human; identical to SEQ ID NO: 36461

SEQ ID NO: 49828 - DNA, 601 bp, Human
gagtagatcataaccttaaggttgccagtatcattggtttttgtttttagaaccggcttaatgcaaatatatgaaaactaaatattaaaaataatgagatgaagttgtaagattgctcagactgcttatgtactgaatacttgtcattgtgtcccaatgctacacttatatgttttaatctatctttacatacaagatcatactaaggtgttagtcttccgtgatggcagaaaactgtgccttggttgtctttgcttaactgtagtttttttgtttgcaaaacaggaataattttttttttaacgtgaaagggctgtttcgtgcattgacagtttctaagcataatgtttgcagcgtcataggttgttgtgagctattagttttttttttcttgctttcttttatcagtactttcagtgtcttacatatggaagagtaaaaattttgaaattaagtaggaaaacataaagttggtatagcaaatgggtttataaacctcagtgcactcagtggtaaaagaatgcaatttttttttccttttcttttttttttttttttaattatactttaagttctgggatacatgtactgaacgtgcagg

SEQ ID NO: 49829 - DNA, 601 bp, Human
aactgtagtttttttgtttgcaaaacaggaataattttttttttaacgtgaaagggctgtttcgtgcattgacagtttctaagcataatgtttgcagcgtcataggttgttgtgagctattagttttttttttcttgctttcttttatcagtactttcagtgtcttacatatggaagagtaaaaattttgaaattaagtaggaaaacataaagttggtatagcaaatgggtttataaacctcagtgcactcagtggtaaaagaatgcaatttttttttccttttcttttttttttttttttaattatactttaagttctgggatacatgtactgaacgtgcaggtttgttacataggtatacatgtgccatggtggtttgcacctatcaacccgtcatctacattaggtatttctcctaatgctatccttccccttgcgcccccctcacccccctccccctgataggccccggtgtgtgatgttcccctccctgtgcccatatgttcttactgttcacctcccatttatgaatgagaacatgtagtgtttgcttttctgttcatgagaatgatggtttccagcttcattcatgaccctcca

SEQ ID NO: 49830 - DNA, 601 bp, Human
gtcttcatccataattatggtttgtttgtacatgaatgattcatgcagctttttcccacctaattcttgtatggagcctgcagaagagtcaggcttttgctgtggtagaaaagagcatgaagcaatagagcaagttcataaaaatctagatatagagctagaaagtcctagtacaaccccttcattttatagtagagaaacctaagtcatgatttacatattattttatatatttatttttgttagaaccaggacttctaagaatttgggcttttggatcccattcctctatacatttccrtactattatattactcatctctgggtccatccttctaactccagtacagtgatttattttgaaacttttttttaacttggagaaaaattataaaaataaaacaaagacctctcttagatcctttaccctgatttacgaatttttaacatttcaccccatttgctaacttatcattcaccttctatctagatatctgtattttatctttattctttagtatttcaatgtgtatttcccaagaataaagttagtctcttatgtaactacagtacagttatcaaaatcaagacatttaatatt

SEQ ID NO: 49831 - DNA, 601 bp, Human
tgctatcttcatctaattttcttttaggtatgcttatagaactatcttttcatgtacgttcagctctttgagggttgtgagtagtaatatgtgcgtatactagcatttctcatgaaggcagggtattccaaaatctgaaatttaaaagtcaaagccggcaaagggaaattctagatataaatacaattgtttagttaattcagcattcatatatttattcattcaatatattgagtgccttttgttaatgtattgtacaaagtcctgggaatacagtgatcagcaacataggcatgatttmccccccttgtttgaagcttttttttccattgggaaagaaaagatgatttaaaaaagtgattgtaatttagcaggagaaatatttgttacaggaaagggtgcaataaatgtatataagtgggctaatccagacttggcaagctgtgaaggaatgtgccctagaagaagtcatagattgagatcccaaaatggctaggaaatttctaagcaagtttgtggcagagggtgaggaaaagcatagcactgcaagatcctgaaagagatttaattcagaggcattatagagtatataattagatgt

SEQ ID NO: 49832 - DNA, 601 bp, Human
tatactcctcctggtgagcagctttgcaaggaaactttttctggagttttgatgcccttactggtagtacgttgtggatctttctaagttattgctaacagccagaccttctttctatgtgtactttttaggaactatgcaatattgattgattttaagtccagttaaaacacccgcacccacacctgcatgatcgacttacaaaatccttgagaataatggtgaaagatgactttaatggtgaacttggattgattctattaaatgctttttattttcatcagatttcttttttttttttaagctttcagtgcagttcacatgtggtttcttgtttccgtttttctccaaacaagtaattgcattttgcagttcttttaagtcactttatatgaagatacaagccatcaagtagcttttgctatagagatttaatgaagaaggaggagggagggtttaggctcgatagacagatttgctgtttgttttatgactgatagcaacatacataaaatgcagatgtttttcttcaagcatagcaattcaaggacaatcagatgggtaaagtatatgggtattaaagtgttagaagtaccatata

SEQ ID NO: 49833 - DNA, 601 bp, Human
cgatagacagatttgctgtttgttttatgactgatagcaacatacataaaatgcagatgtttttcttcaagcatagcaattcaaggacaatcagatgggtaaagtatatgggtattaaagtgttagaagtaccatatagataaggttactgttttgtctcattatggcacctcctgcatgccctttttcctcctcctttttcctttctccttgctccttatcctctttcttctttccagtggctgttttcccttttatactttactgcttctttgtgatcagtgctctctctgtcacttaatggttctcagtgatacatcttttaaagttttaaaaaaataatagacactgagccaggcactgtttaaagcacttcacaggaataaattagtttacttctcatagcaatcctgtgaagttccccattttacaggcaaagagattgggcaaatataatggagggggcaagatatgaatcaagaaaattcgaccctagagttcatatactttaccgctataccatgctgccttgcaaccattgatttaatagcaaacgtggtagtaaaatttggtatttttcatttagccaaaaatagcctat

SEQ ID NO: 49834 - DNA, 601 bp, Human
tcttaaagttgtctttatcaatatatgatttattaataccatggatagtttcattttaaaaatgccttttagatatgcacctaatatactaatctgtatcagaatattgctttgtccaacaggctggttattggaggtatatattaaaactatatagaatacacttctggcaatgcaggagcaagatggtatggaattcacttttccaccatacaaacttgagaactggagaaaatataggaagcaaatttttccaaaaagtagactgcacaggactggtattcctgagaaaaggggaaaraacaaggggaaaggagagctctaccattgtcctaggtttctgccaggagctaatttctgaactgcattataaggaaaggggacctaaccacagcagaaggctatggttttgttgaggattgatcaaaattcagggaaacaaaggcagttagaattttgtgttgctgaacacctgaagtgagaactatatgtagagagcgcaccagaactgttcttgggtgttgttttgagggtttagctgagcaccagtctgtgaatgcatacagtgaaaccccagagactgaacatgagcagcttgtga

SEQ ID NO: 49835 - DNA, 601 bp, Human
ttcagtcttctgtgtgacttaggataatattgaaaatggttagggtagatcactatacttgttagcattatatttcttaagttaataacttgttttggcaagccacctgtaaaatggtcatttcgatagatgcaaaaagattctcacgtttgattggagacttttctggtctgagccattatattaaattgtttaagactgtggttttggggtcatctagaattcacttcaaaaattgactttgttactgactacctgtaggtccctgggaaagtcattaatatccctttgtccaagtttrtttatttgtaaaatgaggagtaatagtgctgaatgttaagaagctcatgtgggcttataaaaatgagataattcatatgcggtgcttagccaaatgcctggtacagaattagctctgaataaatggtaactactatttttattgtccctattgttcttactgttattttttaacagactaccttagttcagtgaactgttaccacatatttttccttaccccgtacccccggtcttaaatgtttctggatttttactctagaactttgtttcttacttagattataaggctctttgagga

SEQ ID NO: 49836 - DNA, 601 bp, Human
ttcccagttttatattgagaaactcatgctaactttgattggattgaatcatatagctttaaaaaataatcttatgtctttattgtttgtctcacattatatcatctttggccaaaagctataaattgacatgctgtgtgttttttttttttttttttttttgagacggagtcttgccctgtcgcccaggctggagtgcagtggcgtgatcttggctcactgcaagctccacctcccaggttcacgccattctcctgccttagcctcccgagtagctgggactacaggcacctgccaccaygcccggctaatttttttatatttttagtggagacggggtttcaccgtgttagccagaatggtctcgatctcctgacctcgtgatctgccagtctcagcctcccagagtgctgggattacagacgtgagccaccacaacatgctgtttttaaggacctcgtatgacatgatttcctaattaggatttcttaattttactaattaaatttacctaaaattattatcgttttgcacaataaaaaagtctgtgtaaattgcataaattgcatcttgctcttctggatatttcagtactgaatag

SEQ ID NO: 49837 - DNA, 601 bp, Human
ttgattggattgaatcatatagctttaaaaaataatcttatgtctttattgtttgtctcacattatatcatctttggccaaaagctataaattgacatgctgtgtgttttttttttttttttttttttgagacggagtcttgccctgtcgcccaggctggagtgcagtggcgtgatcttggctcactgcaagctccacctcccaggttcacgccattctcctgccttagcctcccgagtagctgggactacaggcacctgccaccatgcccggctaatttttttatatttttagtggagasggggtttcaccgtgttagccagaatggtctcgatctcctgacctcgtgatctgccagtctcagcctcccagagtgctgggattacagacgtgagccaccacaacatgctgtttttaaggacctcgtatgacatgatttcctaattaggatttcttaattttactaattaaatttacctaaaattattatcgttttgcacaataaaaaagtctgtgtaaattgcataaattgcatcttgctcttctggatatttcagtactgaatagtttaattttttttctactgtgttttattagaagg

SEQ ID NO: 49838 - DNA, 601 bp, Human
agctataaattgacatgctgtgtgttttttttttttttttttttttgagacggagtcttgccctgtcgcccaggctggagtgcagtggcgtgatcttggctcactgcaagctccacctcccaggttcacgccattctcctgccttagcctcccgagtagctgggactacaggcacctgccaccatgcccggctaatttttttatatttttagtggagacggggtttcaccgtgttagccagaatggtctcgatctcctgacctcgtgatctgccagtctcagcctcccagagtgctgggaktacagacgtgagccaccacaacatgctgtttttaaggacctcgtatgacatgatttcctaattaggatttcttaattttactaattaaatttacctaaaattattatcgttttgcacaataaaaaagtctgtgtaaattgcataaattgcatcttgctcttctggatatttcagtactgaatagtttaattttttttctactgtgttttattagaaggcatatagaatgtagacattatgacaggatgtcaagcgttttgtgattctaggtgtcattcttcaaaaacaaattattgtttc

SEQ ID NO: 49839 - DNA, 601 bp, Human; identical to SEQ ID NO: 36462

SEQ ID NO: 49840 - DNA, 601 bp, Human; identical to SEQ ID NO: 36463

SEQ ID NO: 49841 - DNA, 601 bp, Human; identical to SEQ ID NO: 36464

SEQ ID NO: 49842 - DNA, 601 bp, Human; identical to SEQ ID NO: 36465

SEQ ID NO: 49843 - DNA, 601 bp, Human
gaaattgagcctggtaattccggtacattgttctttctattaaaccatggtttcatctgatgttatttttcaactcatctttactttttagaagtgtaattgtctctgtgctttaaaactgtcttcttaaaaaagtattaatgttttttcccatagctccaaagcctgaactgatagctgcagagaagaaatatttttctttaaagcctgaagaaaagggtgaggctaattttcaactttcaaaaaagcaattatttcttttattgtcattttaaagagaattatttctccacactgagtyatttacactgatttttaacaggtattcagtatgtatttaacaatgcttggagttttctgggagggagtagttcatttctcaaacagataacaatttacattcattaaaaaattaaactattcagtaggatgttgtctttattcagttatttcacagactgtataagaaaactaagcattaaataactatgcttttattatttttatagtgtttcagtttttaaaaaattccttagaatgttgaagacccagttcctacttaagcatgaaaataattaattacatattatttaatctcact

SEQ ID NO: 49844 - DNA, 601 bp, Human
ggtaccacatgtattttgctaaaaaccttattggtttgttgtgaatttggagaaaataagtccttctcattgcacataaagatttgcaatgattgtcactagtagattagtttatatacatcaagaaacttgaatactattttagaatgctttttgtttcttcctccagtgttgtagtctaatccatccttgtttcttgcctaaagtattgtatcctcttacttgatttctctcactttagctccttttctggctcatacttcatgttgttgccaggatcatgttttttttgtttttttttgttttgtttttttttttttgtctcgctctctggcccaggctggagtgcagtggcgcaatatcggctcactgcaagctccgcctcctgggttcatgccattctcctgcctcagcctcctgagtagctgggactacaggcacccgccaccacgcccggctaattttttgtattttttagtagaggcggggtttcaccatgttagccaggatggtctcgatttgctgacctcgtgatccacccacttctgccttccaaagtgctgggattacaggtgtgagcctccgtgcctgggccagtatc

SEQ ID NO: 49845 - DNA, 601 bp, Human
acatgtattttgctaaaaaccttattggtttgttgtgaatttggagaaaataagtccttctcattgcacataaagatttgcaatgattgtcactagtagattagtttatatacatcaagaaacttgaatactattttagaatgctttttgtttcttcctccagtgttgtagtctaatccatccttgtttcttgcctaaagtattgtatcctcttacttgatttctctcactttagctccttttctggctcatacttcatgttgttgccaggatcatgttttttttgtttttttttgttttgtttttttttttttgtctcgctctctggcccaggctggagtgcagtggcgcaatatcggctcactgcaagctccgcctcctgggttcatgccattctcctgcctcagcctcctgagtagctgggactacaggcacccgccaccacgcccggctaattttttgtattttttagtagaggcggggtttcaccatgttagccaggatggtctcgatttgctgacctcgtgatccacccacttctgccttccaaagtgctgggattacaggtgtgagcctccgtgcctgggccagtatcattttt

SEQ ID NO: 49846 - DNA, 601 bp, Human
tattttgctaaaaaccttattggtttgttgtgaatttggagaaaataagtccttctcattgcacataaagatttgcaatgattgtcactagtagattagtttatatacatcaagaaacttgaatactattttagaatgctttttgtttcttcctccagtgttgtagtctaatccatccttgtttcttgcctaaagtattgtatcctcttacttgatttctctcactttagctccttttctggctcatacttcatgttgttgccaggatcatgttttttttgtttttttttgttttgttttkttttttttgtctcgctctctggcccaggctggagtgcagtggcgcaatatcggctcactgcaagctccgcctcctgggttcatgccattctcctgcctcagcctcctgagtagctgggactacaggcacccgccaccacgcccggctaattttttgtattttttagtagaggcggggtttcaccatgttagccaggatggtctcgatttgctgacctcgtgatccacccacttctgccttccaaagtgctgggattacaggtgtgagcctccgtgcctgggccagtatcatttttttaag

SEQ ID NO: 49847 - DNA, 601 bp, Human
taggcgcaactgccaaacttcttccaatgtggctgaaccattttgtactccccctagtaatcagtgagaatttctgttctacgttctagccagcatttggtattttaagtgttttggattttggcctttctaataggtgtgtagtggtattttacttttgttttcagttgcaattccgtaatgatatatgatgttgaatatcttctcatatgcttaattgtcatttgtatatctttggtaaagtgttctggtcttttgttcattttttattcaggttttttttccttcagtttctttcttygtatattttgtatagcaatcctttagtagatgtcttttgcaaatattttctcccagtctgacttgttttcttcacagagcagaagttttaaatttgattgaagcttatcaattacttcttttatggatcatggctttggtgttgtatctaaaaagtcattgccatacccaaggtcatctggattttctcctgtgtaatcttctaggaattttatagttttgtgttttacatttaggtttgtgattcattttgagttaatttttgtgaaagttgtaaggtcattgtctagattcatttttt

SEQ ID NO: 49848 - DNA, 601 bp, Human
tctacgttctagccagcatttggtattttaagtgttttggattttggcctttctaataggtgtgtagtggtattttacttttgttttcagttgcaattccgtaatgatatatgatgttgaatatcttctcatatgcttaattgtcatttgtatatctttggtaaagtgttctggtcttttgttcattttttattcaggttttttttccttcagtttctttctttgtatattttgtatagcaatcctttagtagatgtcttttgcaaatattttctcccagtctgacttgttttcttcacaragcagaagttttaaatttgattgaagcttatcaattacttcttttatggatcatggctttggtgttgtatctaaaaagtcattgccatacccaaggtcatctggattttctcctgtgtaatcttctaggaattttatagttttgtgttttacatttaggtttgtgattcattttgagttaatttttgtgaaagttgtaaggtcattgtctagattcatttttttttttttttggcatgtgaatgtctagttgatccaacaccgtttgttgaaaagactttcagttttcagataaaaatca

SEQ ID NO: 49849 - DNA, 601 bp, Human
tgtatagcaatcctttagtagatgtcttttgcaaatattttctcccagtctgacttgttttcttcacagagcagaagttttaaatttgattgaagcttatcaattacttcttttatggatcatggctttggtgttgtatctaaaaagtcattgccatacccaaggtcatctggattttctcctgtgtaatcttctaggaattttatagttttgtgttttacatttaggtttgtgattcattttgagttaatttttgtgaaagttgtaaggtcattgtctagattcatttttttttttttttggcatgtgaatgtctagttgatccaacaccgtttgttgaaaagactttcagttttcagataaaaatcaaaagttcaaattcaaggccctccagtaactaactgaccccccgattacatttttgatatcatcttccaccctttttgtttactaaatgtagcactcactctctagtccctaaatatgtcatgtactttcctagctttatctttcgttttactttcaaaatggaagtttttttatattctttttttatacttaagaattttaaaaatatgctgcacaaacaatttatgcttaa

SEQ ID NO: 49850 - DNA, 601 bp, Human
tcctttagtagatgtcttttgcaaatattttctcccagtctgacttgttttcttcacagagcagaagttttaaatttgattgaagcttatcaattacttcttttatggatcatggctttggtgttgtatctaaaaagtcattgccatacccaaggtcatctggattttctcctgtgtaatcttctaggaattttatagttttgtgttttacatttaggtttgtgattcattttgagttaatttttgtgaaagttgtaaggtcattgtctagattcatttttttttttttttggcatgtgawtgtctagttgatccaacaccgtttgttgaaaagactttcagttttcagataaaaatcaaaagttcaaattcaaggccctccagtaactaactgaccccccgattacatttttgatatcatcttccaccctttttgtttactaaatgtagcactcactctctagtccctaaatatgtcatgtactttcctagctttatctttcgttttactttcaaaatggaagtttttttatattctttttttatacttaagaattttaaaaatatgctgcacaaacaatttatgcttaataaaaatatt

SEQ ID NO: 49851 - DNA, 601 bp, Human
ctttattatctatttttttactattaaaaaaaatcatgtcaccagttagtcagcagttttgttaaaattcagatagtgacttccccttttccctaaaatcagtcagttgttcttataaataaattggaggccgggcgcggtgtcttacgcctgtaatcccagcactttgggaggccgaggtgggcggatcatgaggtcaggacattgagaccatcctggctaacacggtgaaaccccgtctctactaaaaataaaataaaaaaaaaaaaaccagctgggtgtagcggcgggcgcctgtagwcccagctactcaggaggctgaggcaggagaatggcgtgaactcgggaggcggagcttgcagtgagccgatattgcgccactgcactccagcgtgggcgacagagcaagactccgtctcaaaaaaaaaaaaaggaaggtgatgcatttttgttacttttatctatgcaaaatcctgcccatggtggaatgacagggaccgaatttacactcctgagttaaacaactggaaaattggacaaaatgtatgaaacagtggctttcacatatcggacatcagacagtataagtcactgtgacact

SEQ ID NO: 49852 - DNA, 601 bp, Human
tcttggaaatacggccaacaaattccagaataaaatttggtacaacttaaaagcatataatgaaattttgtattcaagagagtaaaaatcacggcgtccattgtctgattaaagattgccaggcatagaaagagcaagaaaatagcaatacacaaccagggaagaaaaatcagtcagcagaaaagagcaagaaatgacagagatggtggagatagaaggcaagtacattaaaacagctatgataaacgtttcccatgtgtttaaaaaggtagaagaaaatgtgaacattacagtgcaaaamctggaaaatataagaaagacccaaattgaacctttagaaaagaataatacagtatctgaaatgagaaacactgaatggaatgtccagtagagtggaaactgcagaagaaaatgttagtgaacttgaagacatagcaaatagaaccattaaaaatgtatagaaaaaaagtgaacagaatattggttacctgagtgacaatatcaagtggttttacttacctgtaattgggatacctaatggaaaggtgagagaatggggacatgaaaaaacttaaagaaataatggctgaaaattttaatt

SEQ ID NO: 49853 - DNA, 601 bp, Human
aaacagctatgataaacgtttcccatgtgtttaaaaaggtagaagaaaatgtgaacattacagtgcaaaaactggaaaatataagaaagacccaaattgaacctttagaaaagaataatacagtatctgaaatgagaaacactgaatggaatgtccagtagagtggaaactgcagaagaaaatgttagtgaacttgaagacatagcaaatagaaccattaaaaatgtatagaaaaaaagtgaacagaatattggttacctgagtgacaatatcaagtggttttacttacctgtaattgggrtacctaatggaaaggtgagagaatggggacatgaaaaaacttaaagaaataatggctgaaaattttaatttgatgcaaatttatgacaaaaagcttaaagccaggaagaaaataactgtcaacctatagttttctacctaacaaaaataccttttgggaatgggtcaaaattaaaaccttttgagacaaaatctcagagaacttattgccagtagaactgtattacagaaaatgttaaaaaattacttttggtagaaggaaaacgatactagattggcagttggtattactcaaagcaat

SEQ ID NO: 49854 - DNA, 601 bp, Human
gtaattgggatacctaatggaaaggtgagagaatggggacatgaaaaaacttaaagaaataatggctgaaaattttaatttgatgcaaatttatgacaaaaagcttaaagccaggaagaaaataactgtcaacctatagttttctacctaacaaaaataccttttgggaatgggtcaaaattaaaaccttttgagacaaaatctcagagaacttattgccagtagaactgtattacagaaaatgttaaaaaattacttttggtagaaggaaaacgatactagattggcagttggtattackcaaagcaatgaagaatgccagaagtagtaaatatgtgaatagatatagaagacattttccctccatttaaaaatctcacaagaactgttcactggaatgacttgaaaacttaatataaagtgttggttttggagttttagggtagatatgagaatttttttgtatataggttaaacaagagaaggcataacaaaggaaatgattctaagtattttcagaatgttctcatacacctgatatgcctttaatagatcaggtaccatgaataagaaaaatgtcagtgttttgccagtgaccttt

SEQ ID NO: 49855 - DNA, 601 bp, Human
tttcattttcccagaagtacctaaaatcctggcaagctgtgtcccagaatggtaataatattaccactttgaagcacaagttatcctgctttttgagatgtccttttttgtatttatctttcagtaagatactcatcatgtcattggtatgaaattcatgatacaaagggaggaactcataattattttggaatgcaagtagggaggcatgtaaatgtgtagaagagaatgtaacaaaggtgctgtttcttataaaatcacttaaatggtaacttttatcttatgtcctcctcacttcctmtacacacatacacagtcatacccacagaaagagcataaaatggtgctgaaggccagtctggttctatactttcactggtagaagcagtgaatctgctcacttttgctttaggagcatttccttctgaattctattattgtaggctcatggcttcagccaccatttgtatacttctgattcccagtcagtggatggatttatttacatttattgctttccgtgtgtttgcagttccatctgtttgcatttcatactttctgtctaaaatacatacttttttaggggacatccttctttctc

SEQ ID NO: 49856 - DNA, 601 bp, Human
aaaatacatacttttttaggggacatccttctttctctggaattgtacttctctcagaatctttcatggccaggtttttctcatcttttagattccagcttaaaattttgcttccttgacagtattttccttacctacactatttaaaagtaggtatttctcattattgtctgttacatattagtttagatgtttgttttgggatattctttaccctgcacttggttaaactccatgagggaaaaggtgtgtgtatagatacctgtaccttacttgccattggttctctaatgcgttacayaataggtatataatacatagggaatacttaatgcagtacttattatataatatgaaggattctttaaaatctgaaggattccagattatgacgtgtttacatttgtttttctgaaacttccttctagtggtatttagctagataatggtggtgtggatagtggaaggtggtatgggtaaaaggaagctgaagtgtttcaagagcaaagaacagaaaatccttattgaaactgacttaaacaatagggaaaacatctcacataattgaaagtctagaagtaggagtcatatgacctgccac

SEQ ID NO: 49857 - DNA, 601 bp, Human
gacttaaacaatagggaaaacatctcacataattgaaagtctagaagtaggagtcatatgacctgccactcagtgattctgttatggacctgaattatatctttccattctgccatcctcagtgtacactttatcttcagactgtctcctcttgtgatcacaagaatgctgagagtggcaatcagggcgacatgatttcttgtccatttgacagaaaagagaggaaaacctctccccaaccatagaatgtaagtcctttcagtttcttggaccacttttgagcacatttacctctagaccmatgaaacttataagaagaatactatttactgattgtctcagtgtaatcatatgaaagtaggattgatttgggaggactcaactgcattgtctgctgaagactttgagatatatttaggatctatcataaggaatgcaatttaggttctactttgacatcttgttgactaatgagatactaatgattatgacgatggggaaatgagataggaagtatggaatagagacagtttctggaggaaaccatgtgaattcagcttttgacatgggatttgatacgaaatattggctgaacttttac

SEQ ID NO: 49858 - DNA, 601 bp, Human
tagagaagaagacatcatctagagttttaaattatctctatgttttcctgtaaatcttttgtgtcttgtactcattcagagataattaggcatactgatagatatgacacatggctagaaaccaagaacaacagacaatggaacctggcctttaggggatctagatattagagatactagatataagctttaaagtaactgtgcttaataaatgttagaagtaataaaagatggggttgataattttgacagaactagaaccttgtaagtatatatgaatatgagtcagtctaagcttaawtgaatttgtttacatatataagtatatataaatatatacacacaaatgttaatatatgtgtgtatatttttaaaagaaaatatctgaactgaaacataaggagacaaaaaagatagaaaatatggaaaagaccttaagagacataaagaatatggttgactcttgaacaacatgagtttgaactatatggggtccacgtatacacagatttttttcagcctaatggggaataaaaatacagtatttgtgagaatacaaaaccgcatatgaggagagccaacttttgtgcaggcacgttcc

SEQ ID NO: 49859 - DNA, 601 bp, Human
aatcaatattgttaaaacttccatactacccaaagcaatctgcacattcagtgcaatttataacaaagtttataaatttataacaaagttgccattggaaacagcacaaatgttcaacagcaaaagaatgggtaaaagagttgaggtatattcacataccatgttaccacgtagcaacaaataaatgaacgagagctacacacagcaaaatgaatcttaggatttcgttgacataaagttaaaaatattcataaataatctgtggtgttagaagacagcttgggtggaagcaggtggggtrgtgattgggaagaaggataagggtaacttcagagatgtggatcatgttcagttcttggcctatgtggtggttactctggtatgttcatgtggtaatagtttctcaaactttatacttaccatttctgaaaatgttatgctgcagtttaaacttcagtgagataaatacgaataaatatattttgtcctaaaattttctaaaatgttaggaaaataggttcaattaagaatagactcactactttttaggtagtacattttttctctaaggcatctccaagtgatcacaaagaatagaata

SEQ ID NO: 49860 - DNA, 601 bp, Human
cagttcttggcctatgtggtggttactctggtatgttcatgtggtaatagtttctcaaactttatacttaccatttctgaaaatgttatgctgcagtttaaacttcagtgagataaatacgaataaatatattttgtcctaaaattttctaaaatgttaggaaaataggttcaattaagaatagactcactactttttaggtagtacattttttctctaaggcatctccaagtgatcacaaagaatagaatatttgatttttttaaattagaatttatgcacttggaatcactcctgttttggtgcccatattatcacttatttttccatttcaattaatgcagtaggacattgaccctcatctgaattaataaatgggttaacttattacgtacagtgttggtaatgtattgctatattctgaagcaaataaaaggacatattttggttattttgttgtattttgttagcatacattttagacatttttgttaaaaaaattatatacttgagataactcttttctgtatttcattttctttcttggagacagggtctcactctgttgcccaggctggagtgcagtgatgtcatagcccac

SEQ ID NO: 49861 - DNA, 601 bp, Human
aatacgaataaatatattttgtcctaaaattttctaaaatgttaggaaaataggttcaattaagaatagactcactactttttaggtagtacattttttctctaaggcatctccaagtgatcacaaagaatagaatatttgatttttttaaattagaatttatgcacttggaatcactcctgttttggtgcccatattatcacttatttttccatttcaattaatgcagtaggacattgaccctcatctgaattaataaatgggttaacttattacgtacagtgttggtaatgtattgctrtattctgaagcaaataaaaggacatattttggttattttgttgtattttgttagcatacattttagacatttttgttaaaaaaattatatacttgagataactcttttctgtatttcattttctttcttggagacagggtctcactctgttgcccaggctggagtgcagtgatgtcatagcccactgcaacctcaaactcctaggctcaggtgattctctcacctcggcctccagagtagctgggactaaaggtacatgtcaccataactggctaattttttaatttatttttttctttt

SEQ ID NO: 49862 - DNA, 601 bp, Human
caaatgatgaccagaattttatagactaagctatattttcatatgattcaaagtattaaataagtggtaaaagtgagaaaatagtattttgtattcattgtgaaataagacttgtaatttttaaaaggaagaggtttagctatgtgctacgatgttcaggttttataatcaccagtttctggttgatatgaaatcttacagaattatttgtggtcttgtgatagacatttttttcaaagaccaaataaattttgaaaattattcagtatggtgcttaggagcttcttatttttgtatataygtcttaagacacattttagctgactgctgtattatgactatctcatgtatgcatgtgtcaattttaatacctatttatgagcacctgaaagatcaggaagcaggtatgtcatgtgtaataaaagagtacttgttgcctttttggtgataaaattgtctttattgacatagtataaaattgtcaaaattgtttttttccagcttattttcttctacttcaaatggaaatacccatttcattgcattattaaatgaaatggtattaataaaattcttagtgcagtactaagaattacaaata

SEQ ID NO: 49863 - DNA, 601 bp, Human; identical to SEQ ID NO: 36466

SEQ ID NO: 49864 - DNA, 601 bp, Human; identical to SEQ ID NO: 36467

SEQ ID NO: 49865 - DNA, 601 bp, Human; identical to SEQ ID NO: 36468

SEQ ID NO: 49866 - DNA, 601 bp, Human; identical to SEQ ID NO: 36469

SEQ ID NO: 49867 - DNA, 601 bp, Human; identical to SEQ ID NO: 36470

SEQ ID NO: 49868 - DNA, 601 bp, Human; identical to SEQ ID NO: 36471

SEQ ID NO: 49869 - DNA, 601 bp, Human; identical to SEQ ID NO: 36472

SEQ ID NO: 49870 - DNA, 601 bp, Human; identical to SEQ ID NO: 36473

SEQ ID NO: 49871 - DNA, 601 bp, Human; identical to SEQ ID NO: 36474

SEQ ID NO: 49872 - DNA, 601 bp, Human; identical to SEQ ID NO: 36475

SEQ ID NO: 49873 - DNA, 601 bp, Human; identical to SEQ ID NO: 36476

SEQ ID NO: 49874 - DNA, 601 bp, Human
caatggactactattcagtcacaaaaaaagaatgagatcctgtcatttgcaacaacatggatggaactggaggtcattatgttaagccaggcacagaaagagaaactgcatgttcccacttatttgtgggagctaaaaaaaattgaaacgattgaactcatagagatagagaacagaaggatggataccagagggtgggacggatattagtggaattaattagtggcaagggtattcttttgaaattggagtcagtcctcttaaaccctgcctctgctttatcaactaagtttatattttrtaaatcctttgttatttccacaatattcacaggatcttcaccaacagtagattccacctcacaaagctactttctttgctgatccaaaagaagcaactcctcatctgttcaagttcgatccacttttaattctcattgtcttgctgtttttaccacatcttcagttcttttctccactgaagtcttcaatcctcaaagtcatccctgggagttggaatcatcttccaaaatattgacattttgactttctcttatgaatcgtgaatgttcctcatggcatctaaactgatgaattttttc

SEQ ID NO: 49875 - DNA, 601 bp, Human
gtgaatgttcctcatggcatctaaactgatgaattttttccaaatggttttcagtttatttgcctacatttatcagaggaatcactatctatggcagctatagccttccaaaatgtgtatcttaaataataagaattgaaagtctaaatgtctccttgattcatgggctacagaatggatgttgtgttagcagacctgaaagtaacattaatctccttgttcatttccatcagagttcttgggtgactaagggcatggtcagtgagcgttcatattttaaaaataatccttttttttttttcctgagcagtaggtctccactgtgggcttaaaatattcagtaaatcatgctgtaaacagatgtgctgttatccaggctttgttgttccatttgtagagcataggcagagtagatttatcataattcttaagggccaaggattttcagaatgataaataagtgatggtttccattaaagccaccagctgcattcacctaacaagagtcagcctgtcctttgaagctttgaagccagggattgacttctctctagttatggaagtcctagatgatatcttctttcaatagaaggctgtttta

SEQ ID NO: 49876 - DNA, 601 bp, Human
tcacttgaacacttagagaccatttttgggttattaattggcctaattttattattaggcgtgttctatctcagataataaggaaggccaagtagagggggagagagtcagaagaaaggctgatcagtgtagcagttagaacacacatgacatttatcaattaagtttgctgttttatatgggtgccagaacaattacaatattaacatcaaagatcactggtcacaaatcaccattaacatatataattacagtgaaaacatttgaaatattgtgaaaattgtcaaaatgtgacacagtratacaaagtgatcacatattgttggaaaaatggcatcaatagagttgctcagcacaggattaccacaagcctttgattgtagacaatgcagtatctgtgaagcacagcaaaacgaagtacaataaaaagaggtatccctgtagttctctcttctgtgcagttaagctattttcattctttctttgctcagggacaggactggtagtggtgacatatggctgtagattcactgcctcccatttaaacttaagagtttatcttaattctccactggtgattggcaatttcgactatttcctt

SEQ ID NO: 49877 - DNA, 601 bp, Human
attaggctactcttgcattgctataaagaaatacctgagactggataatttataaagaaaaatttaattggctcatggttctacaggctgtataggaggaagcatggttcctgcatctgctcagcttctggggaggcctcagggagcttttactcatggtgaaaggggaagtaggagcacacagttcatgtggcgagagagggagtaagagagagagtgggaggggccacgcagttttaaacaaccagatcttgtgtgaacttactcatcatgaaggggatgatccaaacatggatcatcyaaacaccccatgatccaaatacctctcacctggccccacctccaacactggggattacttttaatctgagatttggtggggacacagatgcaaatcgtatcaatgattaagtaacagcaatggagctgaaatttaattttaattttaattttaatttaatttaatttatttatttatttatttatttatttatttatttattagcagtggtacgaactcggctgactgcaagctccacctcctgagttcactccgttctcccacctcggtctccagagtagctaggactacaggcgcccg

SEQ ID NO: 49878 - DNA, 601 bp, Human
tggtaccttgtacatagttctcttctagttccattcacttctagtcctattagctttacctcctaatctttatgtctttatccccactgtatctgtcttgttctgatgcttactatcttctgcttagctttcttgagtactctaattcttatctcagattaacctttccttcatggagtactttcaagagctttccattacatgctgaataaagttccaacaacttactatatgaggtgtttttataatttggtcctagctatctttctttacttgctgattctccattgtgcctcttacrattgataagtccgaatttttattcttactgtgttttcttggattgtccttttgcctcatcttctaatgcccacgttctacagattctcaaggccctgctcaaacaattaccttcattaaattgatactagtctgtctctgattaaaagtaatttagtggccgggcacggtggctcacacctgtaatcccagcactttggaaggtcaaggtgggtggatcacctgaggtcaggagttcaagaccagcctggccaacatggcaaaaccttgtctctactaaaaaatataaaaattagctggg

SEQ ID NO: 49879 - DNA, 601 bp, Human
tacaattgataagtccgaatttttattcttactgtgttttcttggattgtccttttgcctcatcttctaatgcccacgttctacagattctcaaggccctgctcaaacaattaccttcattaaattgatactagtctgtctctgattaaaagtaatttagtggccgggcacggtggctcacacctgtaatcccagcactttggaaggtcaaggtgggtggatcacctgaggtcaggagttcaagaccagcctggccaacatggcaaaaccttgtctctactaaaaaatataaaaattagcygggcatggtggtacacacctgtaatcccagctactagagaggctggggcatgagaatcacttgaacccaggaggcagaggttgctgtgagccgatatcatgccactgcactccagcctgggtgacagaacgagactgtctcaaaaaaaaacgagtagtcttccaaatttgcaagacttgtagttttataagagatgtatatataataacttcctatattttcactgttagggtatgtacttattctacctgtctttgagactgtaaggttgtttgggtaggatccatgtttttttttatc

SEQ ID NO: 49880 - DNA, 601 bp, Human
cttctaatgcccacgttctacagattctcaaggccctgctcaaacaattaccttcattaaattgatactagtctgtctctgattaaaagtaatttagtggccgggcacggtggctcacacctgtaatcccagcactttggaaggtcaaggtgggtggatcacctgaggtcaggagttcaagaccagcctggccaacatggcaaaaccttgtctctactaaaaaatataaaaattagctgggcatggtggtacacacctgtaatcccagctactagagaggctggggcatgagaatcacttsaacccaggaggcagaggttgctgtgagccgatatcatgccactgcactccagcctgggtgacagaacgagactgtctcaaaaaaaaacgagtagtcttccaaatttgcaagacttgtagttttataagagatgtatatataataacttcctatattttcactgttagggtatgtacttattctacctgtctttgagactgtaaggttgtttgggtaggatccatgtttttttttatctttgctcatagctcctaacacaatgctatatacatattagatatctaataaattattgacaaa

SEQ ID NO: 49881 - DNA, 601 bp, Human
tcattcttatgcctttgcttcctcatagcttagctcccacatgtccatgagaacatacaatgtttgattttccattcctgagttacttcattagaataatagtctccaatttcatgcaggtcactgcagatgctgttaattcattcctttttatggctaagtagtattccatcatatacatcacagtttctttatccagttgttgattgatgggcacttgggttggttccatgattttgctgttgtgagtcttgctgctgtaaacatgtgtgtgcaagtatctttttcgaataatgacttcttttcctctgggtagatacccagtagtgggattgctggatcaaatggtggttctacttttagttcttaaaggaatctctgcactgttttctgtagtgggctgtactagtttacgttcccaccagcagtgtagaagtgttccctgatcacctcatccatgccaacatctactgttttttgattttttgattatggccattcttgcaggagtaaggtggtatcggattgtggttttgatttacatttccccgatcattagtgatgttgagcatttcttcatatgtctgttggccatttgcac

SEQ ID NO: 49882 - DNA, 601 bp, Human
tagctaggaggaatatggctgcctatgctgaatcatgctggttgtcagggaagtaggggaaagctggcagtcacaggcctcacccagctcccacgcaaactgaaggagcagtcttaatcccaccgtgcctcccccaacagccctgtttccagacagtgggcgagatgggcttgaaaacttgccccaggctacctgccttctagctgcgaaagaaaagggcttggttcttccctcgcctgtggagtctgcaaaccagatttgccgccctacccagagttgtggcctggaggtctctcgcccygttcaaattgttacaaagtttagctagagatttccttctccctgtggagttttaccccctgcttctctggctgccctccctatggatccctgtggtgccaggcaggaatggcctgcttggggactcagcaagctcccagggcctttcagctgcttcctctaccccccttgtattttgcttggctctctaaattgagtcagatccaggtgaagttggaaacttctgcaaacagaccttcagtttctccagtgcggggtgtgtgttcgggagaggagggtctccctttctcacttccgcagt

SEQ ID NO: 49883 - DNA, 601 bp, Human
gaaagctggcagtcacaggcctcacccagctcccacgcaaactgaaggagcagtcttaatcccaccgtgcctcccccaacagccctgtttccagacagtgggcgagatgggcttgaaaacttgccccaggctacctgccttctagctgcgaaagaaaagggcttggttcttccctcgcctgtggagtctgcaaaccagatttgccgccctacccagagttgtggcctggaggtctctcgccccgttcaaattgttacaaagtttagctagagatttccttctccctgtggagttttacccsctgcttctctggctgccctccctatggatccctgtggtgccaggcaggaatggcctgcttggggactcagcaagctcccagggcctttcagctgcttcctctaccccccttgtattttgcttggctctctaaattgagtcagatccaggtgaagttggaaacttctgcaaacagaccttcagtttctccagtgcggggtgtgtgttcgggagaggagggtctccctttctcacttccgcagttgggacacacacactatttggggtgtttcccaggtcctgcaagagcagtccgctttct

SEQ ID NO: 49884 - DNA, 601 bp, Human
gaagatcctgaaattaataaacggttcttgagtagttataatcctttaggagattgtgaacatataaaaattatactttttgactatggcaaagtcctaatcgtttaataatgtgctgtttgtcgaagctagccaaagcatgtattgtttatgtgcactcttgaggaaggtgatgccatcaggataaggcaaggcctatatatttcctcatgcagggaaaggttaaagatgatcaaaatgttatagaattgagaagagaaatcaatataaaaaccatgggctttaaagccctaaatcttamcatgacaagtcctgtgtcacttgttagtgtggaacattggcatcctgtttaatgtctttgagcctcaacctagccatttgaatatggcagtattgaataactctgtgtagttattgtgcaaacttaatgaaatgatctccttcttcataaattccttaagttatgaatttccttctgcctaaaggtggaactatatcaagcaccttgactgaatcttagatatattcctgggctttaagatatttaatgtagtatatactggttacagataagtaaattgaaaccaagtcaagtgattta

SEQ ID NO: 49885 - DNA, 601 bp, Human
gatgatcaaaatgttatagaattgagaagagaaatcaatataaaaaccatgggctttaaagccctaaatcttaccatgacaagtcctgtgtcacttgttagtgtggaacattggcatcctgtttaatgtctttgagcctcaacctagccatttgaatatggcagtattgaataactctgtgtagttattgtgcaaacttaatgaaatgatctccttcttcataaattccttaagttatgaatttccttctgcctaaaggtggaactatatcaagcaccttgactgaatcttagatatattyctgggctttaagatatttaatgtagtatatactggttacagataagtaaattgaaaccaagtcaagtgatttaacaataattataattataattaagtataattagtgaaaaacatggaactaaacaggtctctattctttttactgttgtttatgtatcctttgtttaattatagatacatgtacatttcttaatttggtttcaaggattcttttgttctttgtaggactgactgatttttttacagctttaattttaaatgctcacatgacttaacatttgttctggctgaaagggct

SEQ ID NO: 49886 - DNA, 601 bp, Human; identical to SEQ ID NO: 36477

SEQ ID NO: 49887 - DNA, 601 bp, Human; identical to SEQ ID NO: 36478

SEQ ID NO: 49888 - DNA, 601 bp, Human; identical to SEQ ID NO: 36479

SEQ ID NO: 49889 - DNA, 601 bp, Human; identical to SEQ ID NO: 36480

SEQ ID NO: 49890 - DNA, 601 bp, Human
ccagcatcctcatgcaatatctcaccagtgccaggaggggtcgcctgccccagcagtgcctctgagccctgggtagtaacaacagcagctgtactccccgatgtggtaccccctgccccatctcccactgccgtgctggggaagtaagtatagtgcgtctcagcagctgtcccctccgtgtcaactgcatcatcactggtgaaagcaccctggatcaccgcctgggaaggggagcaagaaaactgattctggtaacagtcaaaaacttcttcccactacaccactctgcagcttctatccsttggggtggtaggtagggtggagagagagagagagagagagagaaacatccagaaaaggagagcctagtgctttgggacaaggcagccttagatgcctcactgttcctagcttcacccccatcctactgattcccttcttcatcttacttctcagaactctagtgacctccccagcccataccctgtacctgggtcatggattgagtggcagggtagccactgatggcgccagttccctcagtttggccatccagctgcccctcagacacctggatcaccctgtacatcacctagaagtg

SEQ ID NO: 49891 - DNA, 601 bp, Human
tgcaagggccggcatagccaagcccagctatggtgctgaagccctgggaatgggggtggagggagcattgccctctgtcacacaggctcatgacctcagggtcataacctcagcttctctgttactctcatccccacagccaggcaccaatcccatcagtcctccttcggctgtctgagctgcattcaaggatccttagaccaggttccaacctagctctcctgcctagaatcctgggccactaggccccccaacccacccacaagagctgcaggctccactcctccctccctgctccctrttcctcatcatgctctgccctaggctgcctgcatccttacaaatgttgagtccacctgagccttgactgtgtcttcctgaaggacacaagaatgctcagggactcggtaactgaattgagtacctgggcatgggactttattgcatatggggcttctacctggccctgaacccacacaacactatgcctcagtttcccctctttgtgcccagagtgtaccctcctctaattccacgctctccacctccgtgaagcccctgcagagtcactgatctaaaatgcagaaccctggctgggcat

SEQ ID NO: 49892 - DNA, 601 bp, Human
ttttttaaatttcactgtcatcatatgactcctgatgggatgcgctgaaaaagacacagtatcacttttgtggtattcctgtcaaaaatgcatataatatctgctgtcaatgggcacagaaaaaaatttttttaaagaaaaaataattttaaaaatgcatatgatggctaggcatgatggctcacacttgtagtcccaccactttgggagactgaggcaggtggatcgcctgagcccgggagttcaagaccaccctgggcaacatggggaaaccctgtatctacaaaaaaaaaaaaaaaaattagccaggcatggtggcacagacctctagttccagctaccagggaggctgaggtgggaggatggcttgagcctgcgaggtcgaggctacagtgagccgtgagcatgccactgcactccagtctgggtgaaagaaccagatcctctcttgaaaaataataataggccgggcacagtggctcacacctggtatcccagcacttttgagaggcggaggtgggtggatcacttgaggtcaggagtttaagaccagcctggccaacatggtgaaaccctgtctccaccaaaaatacaaaaatta

SEQ ID NO: 49893 - DNA, 601 bp, Human
acagaaaaaggattccataattacctcttttaatcaacattgtactggaggtcatggctagttcaacaaaacaaggaaaatagtcaaagggaataaaaattagaaatgaatatgtgaggctgggcgcagtggctcacgcctgtaatcccagcactttgggcagctcacctgaggtcaggagttcgagaccagcctggccaacacagtgaaactccatctctactaaaaatacaaaaattagccaggcgggtggcagtcacctgaaatcccagctactcgggaggctgaggcaggagaatcrcttgaacccgggaagcggaggctgcagtgagccaagatggcaccattgcactccagcctgggcaacaagagcaaaactccatctcaaaaaaaaaatgaatatgtgaaactgtcattattcacaaactatatacctgtgtatataggaaaccaagaggactatatgaaaaattatttgagtgtagaagtcagttttgcaaaattgctagatataaggtcaatatacaaaaatcatttttatttctatatattagtacaaacagataaaaatgaaattttgaaaacaatactatttacagca

SEQ ID NO: 49894 - DNA, 601 bp, Human
gtggtgtttggttacaagagaaagttcattagaggtgatttgtgagtcggtgcacccatcacccgagcagtatacactgcactctatttatagtcttttatccctcactcccctcccacttttcctcccaagtcaccaaagtccactgtatcattcttatgcctttgcatcctcgtagcttaactcccacgtatcagtgagaacatacgttgtttggttttccaaggaatgatatatttaaagtgctgaaagaaaataactgcctatctagaatttcggtacttcaaagatgaaagcagaygcagtggctcatgcctgtaatccccgcactttgggaggctgaagcaggtgaatcagttgaggtcgggagttggagaccaggctggccaacatggcaaaccccatctcgactaaaaatacaaaagttagctgagcgtggtggcacgcgcccataatcccggctactcaggaggctgaggcacgagaatcacttgaacccaggaagtcaaggctgcagcgagccaagatggtgccactcccctcctgcctgggtgacaaagtgagactgtctcaaaaaatagtaataattttttaaatgaag

SEQ ID NO: 49895 - DNA, 601 bp, Human
ggccattctaaatcagctagccctggcctggtgcggtggctcatgcccgtaattccagcactttgggaggccaaggccggcagatcactcaaggtcgggagttcgagaccaccctggccaacatggtaaaacctcgtctctactaacgatacaaaaattagccagacatggtggcacacacttgtaaccccagctacttgggagtctgaggcacgagaactgcttgaacccgggagatggagcttgcagtgagccgagatatcatgccactgcactctagcctgcatgacagagcaagacytaatctcaaaaaacaataaaaaataaataaatgaatcagccacccgtggccagtctggcagctgaccacacatgcatgactgatgcaagaggaaaccaaaagaaccacctagctgagcccagcccaaattgccaactagcagaatcactaactaaataggtagttgttttaaactactggattttggagtaggtcattatgcagcaatagttacctgaaattggattttttttaaagaattcaatgaaaattacagaaataaaatgtaaaataactgtaaaacaaactcaattgaaaggt

SEQ ID NO: 49896 - DNA, 601 bp, Human
gaaaaggcattgcacatttctacttgttctcttggaacctcatctggctgacctgtgaacaagcctaaaatagcctgctggagaataagatatcacatgatacagagataagccaacacagctaaggccattctaaatcagctagccctggcctggtgcggtggctcatgcccgtaattccagcactttgggaggccaaggccggcagatcactcaaggtcgggagttcgagaccaccctggccaacatggtaaaacctcgtctctactaacgatacaaaaattagccagacatggtggcrcacacttgtaaccccagctacttgggagtctgaggcacgagaactgcttgaacccgggagatggagcttgcagtgagccgagatatcatgccactgcactctagcctgcatgacagagcaagacctaatctcaaaaaacaataaaaaataaataaatgaatcagccacccgtggccagtctggcagctgaccacacatgcatgactgatgcaagaggaaaccaaaagaaccacctagctgagcccagcccaaattgccaactagcagaatcactaactaaataggtagttgttttaaact

SEQ ID NO: 49897 - DNA, 601 bp, Human
gcctagatctgaaaaggcattgcacatttctacttgttctcttggaacctcatctggctgacctgtgaacaagcctaaaatagcctgctggagaataagatatcacatgatacagagataagccaacacagctaaggccattctaaatcagctagccctggcctggtgcggtggctcatgcccgtaattccagcactttgggaggccaaggccggcagatcactcaaggtcgggagttcgagaccaccctggccaacatggtaaaacctcgtctctactaacgatacaaaaattagccagrcatggtggcacacacttgtaaccccagctacttgggagtctgaggcacgagaactgcttgaacccgggagatggagcttgcagtgagccgagatatcatgccactgcactctagcctgcatgacagagcaagacctaatctcaaaaaacaataaaaaataaataaatgaatcagccacccgtggccagtctggcagctgaccacacatgcatgactgatgcaagaggaaaccaaaagaaccacctagctgagcccagcccaaattgccaactagcagaatcactaactaaataggtagtt

SEQ ID NO: 49898 - DNA, 601 bp, Human
aacatgaagttcacgtccctcctattagaaagcgggtatacataaaatccatcagtgttgaggttggtaccacagagggctatacccaaagagtaagagtgaacgagaaatgaacagccctcacaggaactgaagctcaattttgaatcatcacaaccctggattgaactaatgatctggaatctctggtagccctaacctggctgccaactagaggcaaatataagttatgactagaggaaaataacatcaaccagagcattaaattattcctagaatgtttcatacacaatatccaaartgaagtataagaaaaggaaacatctccaaaaaccaacagaagaatagagacaacagaaaccaacaaacagggcatctacataatagagttgtcagtcataaactttaaagtaatcatgtctaatatgttcaaggaaataaaacataagtttaagaatttcagcagagaactagcgtgatagaatgcaaaaataccatgtccttgcaatgtgactttacagctccttctgttatcaagaaatggggttcatttccctgtctcttggaactgggctggtcttcatgatgaaacgcagcaaaa

SEQ ID NO: 49899 - DNA, 601 bp, Human
aagacatgctaaccaatcctcccactaaaaatagctagaagaaaaatgaacaacatgtaaaagcacattgttaaagttatcagagagtttataaagcagtgaaaaattatggggccaatatctggaagaaggaaattcagagaggtgagatcagcatttctgactgttgttccctggaggcatcttctgattccataaatggcagctaaaaggctgagaagctgagcagagctcacaataaaactcaaggaactaagagaacatgaagttcacgtccctcctattagaaagcgggtatacmtaaaatccatcagtgttgaggttggtaccacagagggctatacccaaagagtaagagtgaacgagaaatgaacagccctcacaggaactgaagctcaattttgaatcatcacaaccctggattgaactaatgatctggaatctctggtagccctaacctggctgccaactagaggcaaatataagttatgactagaggaaaataacatcaaccagagcattaaattattcctagaatgtttcatacacaatatccaaagtgaagtataagaaaaggaaacatctccaaaaaccaacagaa

SEQ ID NO: 49900 - DNA, 601 bp, Human; identical to SEQ ID NO: 38329

SEQ ID NO: 49901 - DNA, 601 bp, Human; identical to SEQ ID NO: 38330

SEQ ID NO: 49902 - DNA, 601 bp, Human; identical to SEQ ID NO: 38331

SEQ ID NO: 49903 - DNA, 601 bp, Human; identical to SEQ ID NO: 38332

SEQ ID NO: 49904 - DNA, 601 bp, Human; identical to SEQ ID NO: 38333

SEQ ID NO: 49905 - DNA, 601 bp, Human; identical to SEQ ID NO: 38334

SEQ ID NO: 49906 - DNA, 601 bp, Human
catagcctcagctgacctactaagtaccccgtagtctctctgtgcaaagcacctcctttctgtctctgactgtcctttacctcccacagaaactcccaaaaactcatctagtctactgttctcttagtctagaagctgttatttttctccagacagaaccagtaaggcatttctcattggcccattgacatttaaatacagtcatttaacagaagctactcagatacacacaataaagaacaacttgccaggatgtgcacacacactctcactgcaaacacatgcaaaatacacatctacrtcaacaacaccccaccaccaccacgggaagaggctcaccttcctggaaggctgaattaatgaatataatgtatatgcaggttcttgtgacgtgggagcagaagactaatgagaagagaaataaaatcatttcagaagcacagatccagcacaatcttacaaaggttatctcttccgtttctcctcctcaaccctgcccagatggaagcttcaagtgttagtgaaaagagccctggactagccaggaggtcagacaacctgagtgctagtctcgctctgtcattaatgaaagcttctattt

SEQ ID NO: 49907 - DNA, 601 bp, Human; identical to SEQ ID NO: 38335

SEQ ID NO: 49908 - DNA, 601 bp, Human; identical to SEQ ID NO: 38336

SEQ ID NO: 49909 - DNA, 601 bp, Human; identical to SEQ ID NO: 38337

SEQ ID NO: 49910 - DNA, 601 bp, Human
cacgggacaaaatatgaggagcctacttctcttgctccccaggttcctgttttgatcacatccccgtgggaaaggagatgaagctccattcatcagtgctaagaaaggctccccaaccatgccatggccatgctattggaatggaaatacctgctttccagacaccagatctggcttctagggttgaactacatcccgtctcccctttcccaactgaccatgccttcagtgcacaatcacagatacacagttggtggaaagtaccttgaatgctggtcaccaggagtgacagaggcagcartagcaattccagagccagacacgaatcccaacctctggagcacatgcttccttccagaacttcccagcaacgcaggagacagttgagagcctggctagaaaaaggccggggctaaaaacggaacttaccaaacagggttagagagaaaaaaaaaaaaaccactgagattttctctccacccagcacacttgtgtggggccccagaaaccagaaaccggaggtcttgtaaatttttttatctaagagcatcacggaaactgagaacaattttgtttgaaggtacatgagtgcttttttgta

SEQ ID NO: 49911 - DNA, 601 bp, Human
gtgagagaccgatcctccacacattctacctcatctccccaaaagttacaaactatcatcattttatgccacagtgtgactaccacatgtttgttgatttttactgttttactcagagtggtgagcattaaagccctttaaattaaaaagacttgagtatttacttgggggaatagcaagaaagtcaaaggtttcactgctgtttctcagctggcataagaagagaggtactggatgaagaaagagggtgaggcagctctaacaggagaaggaaagttagctcagcccttggtcacacacyggggaccgaacaggctgtggcagaggaatggaccttaactcttagcaatcagatgtgttaaggttcctttgatgctgaagcacttccagcctcttctcagaccctcattcagagaccccagacagcaatcctttccaagcttttcttcctataattttgatctatcttttctttgggtcaatgacaatatcatttaccttggctcaggatgcaacacctcacatatacagaggtctcaaagaatgcctaagggagtacagtgtgtctgagcataaaatgcagcagctgtcagtgtagagc

SEQ ID NO: 49912 - DNA, 601 bp, Human
acactgcacatggtttctgtcctcaaaaagttcaaggaaacagatgatccaccaagcaattcacaaaccataatctggagcctgaggttcccatctaaccatgccttcagaacacagtcacaggcagacagtccaagaagaagtcacataaaaacagaagcctaaaagagaggcagggagagggcaggagggagagaaatctaggtggaaagaaggcatgtacataagcccagaggtaagagaaaacgcctcttttaaggcaaacagtaaaattaagagatttagacacattgaccttcaycaagattccctcgccttagtctaggaaaggtataatcataatagaatggtttggaagttagacctgtgtgcccttaggagaatttcttaatctctctgcaagacagtattctcatctgaaaaatgtagataataatagccacctcactattttctaatgaaagttaaatgaaaaagtatgcaaaaggcctagcacaatgtctgacacacagtaagtgcttaatttgtattttactaacccaggttatagcccgggtgttataacccaggtttactaacctcatcaaaaccaatattatcc

SEQ ID NO: 49913 - DNA, 601 bp, Human
aggaagaagagagctaagagtgcttctcaaacttttccacagaagcatcccttacggcagaggagagaactacttgcacttctcaggaagatatggatgtgtagtccaaaaggaagttttttgaagttgttcattcatttgtgtaacaattatttattgagcacatgccacactccaggcctgtgctaagttcagcagcacaacactgcacatggtttctgtcctcaaaaagttcaaggaaacagatgatccaccaagcaattcacaaaccataatctggagcctgaggttcccatctaaycatgccttcagaacacagtcacaggcagacagtccaagaagaagtcacataaaaacagaagcctaaaagagaggcagggagagggcaggagggagagaaatctaggtggaaagaaggcatgtacataagcccagaggtaagagaaaacgcctcttttaaggcaaacagtaaaattaagagatttagacacattgaccttcaccaagattccctcgccttagtctaggaaaggtataatcataatagaatggtttggaagttagacctgtgtgcccttaggagaatttcttaatctctctg

SEQ ID NO: 49914 - DNA, 601 bp, Human
accatgatctgattgcaagcacatgaaaagcacatgaaagtgagacaggatgaacagtcttcccccaaatctgtgggcaaagtaaatcattgttattattttaagccacggtattgtggcagcttgttaaatagcaatacatagcggaaacagagatgatgacttaagttttagacacgtgtctggagagtctagagaagatgtttaagagacagaagttctgatcttgggctcaggagactgcttggggcttaagaatttactgatgctcttcccaggttttcatctgtatcggattccrcatgtgtcacaattgcaaagcaattgcacattttttattttatttgatcttaatagcaaccccttgaagaaatgaggaacagattattatacccattatggagctgaggaagctgaggctcaggaagctttaatgacttgttgaaaattccacagcatggaacccagatagaactaggtcatctcatttctagtacaatactctgtctacttcatcctgctaagtgttgtggacagatggggaattgggtagttgtggagcatgccctaaatcattgccttgaaaccaaagaactgagaa

SEQ ID NO: 49915 - DNA, 601 bp, Human
tgaatggaatacaccggaagtgtgacctgcaaagctagcttagaaaagaccatgcagcatttgcctatttctcttgggacaccaactctgggaggcttctgctgagtggcactagccacccagcactttgagcctccctctgttcaggcagtagccctgtgagtgaagagccttgcatgactctaggccacaccatgatctgattgcaagcacatgaaaagcacatgaaagtgagacaggatgaacagtcttcccccaaatctgtgggcaaagtaaatcattgttattattttaagccacrgtattgtggcagcttgttaaatagcaatacatagcggaaacagagatgatgacttaagttttagacacgtgtctggagagtctagagaagatgtttaagagacagaagttctgatcttgggctcaggagactgcttggggcttaagaatttactgatgctcttcccaggttttcatctgtatcggattccgcatgtgtcacaattgcaaagcaattgcacattttttattttatttgatcttaatagcaaccccttgaagaaatgaggaacagattattatacccattatggagctgagg

SEQ ID NO: 49916 - DNA, 601 bp, Human
agacagctggtggtggagaaaagttaccagtttgaagatagtgggcaggaagttgaagggcttcctgcctaatggtctctagtttcgatttcttctgcaaagaaggaggcacatgctttgctgagagggcagaggactgaggtaaggggccttgaggatagggtgaaagtttgaaatagccactgtgggaaatgggagaaagaatttatcagggccagtaagagctactctgagaccccagcttgactgaaacaatgactcaaaatttattccttccttctttcctttgctccctccctcyatccacccatccctccatgcatacatgcgtacatgaacttcctcatgtattcactcatcgaataactatgcagtaagcagttactatgtgcttggctctgtaagggtgcaatagatagatgtggctccttcccttgagcttcattccagtgaatcaacaaaattaatcagatgatttcgctattggtgataagtgttaggaaaaggaaaatacggaatgcttagagggcatataaaagggagcacctcacttgaatttgggggttgagaatggcttctgtacgaggaattagcctaagtg

SEQ ID NO: 49917 - DNA, 601 bp, Human
gaagcttcagggcttcttggatggccctggaggagccctagcagtattcatgtaatccattttacaaaacatatcttaaacattaattagaccacagcctctgtctactctaacatccccttcatcacatttctgtttttgttgggtggcatctcagttatgggcattttgaggtctggccaaggggaagtagaaatgggaagtacttagttggggttagcgggatacatgtatgagggttgcaaactcttgtgtgtgaagttcccgctacccacttcagtgaagaaatggcatccaggamtattcttgctgccctctgcactgactcactggcaatggccatggacatgttgcaatcgggctgcaggtgggaagcagaggagaaagcaggttggaagtgaacaacagccagagctattcagtagcaaagtattgtggaagcacgaaggcatttaattaactaaaattatgctgctattttttatgctgtcatgttctttgtagtatttgtatttttttaacctgaactaattccctgggatttctttttttttattctaattgaatttatttttgttcctatttgtatttccagttttgt

SEQ ID NO: 49918 - DNA, 601 bp, Human
tagagtggggtgaaaaaacgtaagcaatcaacacactaacagaacacactgtatagtatgtaaggagatgataactgccatgacagaggagaaaacctagaataaggtaaggggagtcacaagtactggtaggggcaaaagggtgaacttcatttataaggtgataagtaggtcacatctgagtaaagacttggaggagagaggtggccaagagggtatctggggtaggagggacccagacagaggaaagagccagagcaaaggccctggggcagggatttgcctgccatacataaacaamagcaaggaggtggcgagtgggtagtgtggagtgaacaaggggattgggtgttgagagacacagtcagagagggagtgagattggagagagtagatacattttagctttattaataatgtcttgtcctgtaaaaaaaaaatgctttcctgtaaaagtggctcatgtcttgtgtgtgcatttacaatgtatttagaagcaagttattagaaggtaacaaagtggagactgtataaaccattgtttcacaaagtttggatcagaggcagatttcccgtgaaagtgatgaagctgaagcttcag

SEQ ID NO: 49919 - DNA, 601 bp, Human
gttacttgttctgtggtaagggcatcaaagtttaactgggcataagcatcagagaaactatcggagcctgtgagctgagcctgagtaattagaatgccattactgctatttagctgagcctgcaaatgggcctcttctgaccaccaggtatggaatacggaattgtaaatgctgagatggggttagaacagcttttgccaaaaggtcccaatctaagggaagtaagtgacttcagtacgaaaagtttgtaaaaccatcttaacataaggagaagtaggaccatactgagtacaagcatccytaaattcttttaaaaaaggtaagattgaacagcgcatatcgatgcagaccggtttaggacccgaaacgacaggagggtgaggggctgtagtggatgggggatggcctggagaatgataggtaaagtgtagtttggtcctggagccattagctgatgctggaggtttgaagagagaagaattagcatatctatggtacatgcagcaaagatccctaccttaacagagcttgcattagagtggggtgaaaaaacgtaagcaatcaacacactaacagaacacactgtatagtatgtaaggag

SEQ ID NO: 49920 - DNA, 601 bp, Human
gcatttggccatgtttgttgaaccgacttggccgcttgtaagtttttaacagtgcaacttttttgaatatgaccaagttggccacaattatagcaggctccaagagaagaattaatgggaccagtttggttggtgtccttcatggccggtgcccacagaatagctttgtgggtatctgatccaatgccttcacaagctttaatatatgcaggcaacacctcgtgatcaggtaaattttgcgttggacagaatgcatggccattttacattcatggtttgcattttcaaaagctaacatatraaggagaatgccttgagtgcgctcatcagagacagatttttgaacagcatcttgtaatttagccaaaaaatctgggtataattcagagtgactttgtttaactatggtaaaaggaacaggagcttggcctggagcgtgtaatttatcccaagctctcatacacacctttgttacttgttctgtggtaagggcatcaaagtttaactgggcataagcatcagagaaactatcggagcctgtgagctgagcctgagtaattagaatgccattactgctatttagctgagcctgcaaatgggc

SEQ ID NO: 49921 - DNA, 601 bp, Human
ttgcccaatgtttacctttgcgacaacgtgggcaaacagtaggagcagcatttggccatgtttgttgaaccgacttggccgcttgtaagtttttaacagtgcaacttttttgaatatgaccaagttggccacaattatagcaggctccaagagaagaattaatgggaccagtttggttggtgtccttcatggccggtgcccacagaatagctttgtgggtatctgatccaatgccttcacaagctttaatatatgcaggcaacacctcgtgatcaggtaaattttgcgttggacagaatgyatggccattttacattcatggtttgcattttcaaaagctaacatataaaggagaatgccttgagtgcgctcatcagagacagatttttgaacagcatcttgtaatttagccaaaaaatctgggtataattcagagtgactttgtttaactatggtaaaaggaacaggagcttggcctggagcgtgtaatttatcccaagctctcatacacacctttgttacttgttctgtggtaagggcatcaaagtttaactgggcataagcatcagagaaactatcggagcctgtgagctgagcctga

SEQ ID NO: 49922 - DNA, 601 bp, Human
gctttgtaaagcattgagatgtttatgtgtatgtatatctaaaagcacagcacttgatcctttaccttgtctatgatgcaaacacctttgttcacgtgtttgtctgctgaccctctccccactattgtcttgtgaccctgacacatccccctctcggagaaacacccacgaatgatcaataaatactaagggaactcagaggctggcgggatcctccatatgctgaacgctggttccccgggcccccttatttctttctctatactttgtctctgtgtctttttcttttccaagtctctcrttccaccttatgagaaacacccacaggtgtggaggggcaacccaccccttcatgagacaatatttaaaggtttggggaaatcctgtaaggcagtaatcacagcaattaactccgccttttgagcagaagtataagaggtagaaataagtttgtctgtaggacttacatagccagcattgccattactggagccatcagtgaacactgtaacagcctcaggaatgggttgatttttggttaatcgaggaaccacctaagaagtcatttttataaaatcaaataatttgttttttggataat

SEQ ID NO: 49923 - DNA, 601 bp, Human
gagacaggctcatgaccttagaacatcatttccagttacagtgtgactggaatacgtcagatttttgtattacaccccaaatttataatgagtctgagcatcactgggacatggttagacgccatctacagggaagagaagataatctcactttagacatttccaaattaaaagaacaaattttcgaagcatcaaaagcccatttaaatttggtgccaggaactgaggcaattgcaggagttgctgatggcctcgcaaatcttaaccctgtcacttggattaagaccatcagaagtactaygattataaatctcatattaatcgttgtgtgcctgttttgtctgttgttagtctgcaggtgtacccaacagctccgaagagacagtgacatcgagaacgggccatgatgacgatggcggttttgtcgaaaagaaaagggggaaatgtggggaaaagcaagagagatgagattgttactgtgtctgtatagaaagaagtagacataggagactccattttgttctgtactaagaaaaattcttctgccttgagatgctgttaatctatgaccttacccccaaccccgtgctctctgaaacat

SEQ ID NO: 49924 - DNA, 601 bp, Human
attcacttatcacatggtaagcgggatgtcactcaggccacgggtaaattatttacaagacttttcttatcaaagatcattaaaatttagacctaaagggaaaacttgccccaaggaaattcctaaaggatcaaagaatacagaagttttagtttgggaagaatgtgtggccaatagtgtggtgatattacaaaacaatgaattcggaactattatagattgggcacctcgaggtcaattctaccacaattgctcaggacaaactcagtcgtgtccaagtgcacaagtgagtccagctgtygatagcgacttaacagaaagtctagacaaacataagcataaaaaattacagtctttctacctttgggaatgggaagaaaaaggaatctctaccccaagaccaaaaataataagtcctgtttctggtcctgaacatccagaattgtggaggcttactgtggcctcacaccacattagaatttggtctggaaatcaaactttagaaacaagatatcgtaagccattttatactatcgacctaaattccattctaacggttcctttacaaagttgcataaagcccccttatatgctagttgta

SEQ ID NO: 49925 - DNA, 601 bp, Human
tagggagagcaccaggatgtttaatgcctgcagtccaaaattggttggtagaagtacctactgtcagtcctaacagtagattcacttatcacatggtaagcgggatgtcactcaggccacgggtaaattatttacaagacttttcttatcaaagatcattaaaatttagacctaaagggaaaacttgccccaaggaaattcctaaaggatcaaagaatacagaagttttagtttgggaagaatgtgtggccaatagtgtggtgatattacaaaacaatgaattcggaactattatagattrggcacctcgaggtcaattctaccacaattgctcaggacaaactcagtcgtgtccaagtgcacaagtgagtccagctgtcgatagcgacttaacagaaagtctagacaaacataagcataaaaaattacagtctttctacctttgggaatgggaagaaaaaggaatctctaccccaagaccaaaaataataagtcctgtttctggtcctgaacatccagaattgtggaggcttactgtggcctcacaccacattagaatttggtctggaaatcaaactttagaaacaagatatcgtaagcc

SEQ ID NO: 49926 - DNA, 601 bp, Human
cctccacggagatggtaacaccagtcacatggatggataatcctatagaagtatatgttaatgatagtgtatgggtacctggccccacagatgatcgctgccctgccaaacctgaggaagaagggatgatgataaatatttccattgggtatcattatcctcctatttgcctagggagagcaccaggatgtttaatgcctgcagtccaaaattggttggtagaagtacctactgtcagtcctaacagtagattcacttatcacatggtaagcgggatgtcactcaggccacgggtaaattrtttacaagacttttcttatcaaagatcattaaaatttagacctaaagggaaaacttgccccaaggaaattcctaaaggatcaaagaatacagaagttttagtttgggaagaatgtgtggccaatagtgtggtgatattacaaaacaatgaattcggaactattatagattgggcacctcgaggtcaattctaccacaattgctcaggacaaactcagtcgtgtccaagtgcacaagtgagtccagctgtcgatagcgacttaacagaaagtctagacaaacataagcataaaaaattaca

SEQ ID NO: 49927 - DNA, 601 bp, Human
gatcttgtggagtggtcattccttcctcacagtacagttaagacttttacattgtacttggatcaaatagctactttaattggtccgacaagattacgaataataaaattatgtggaaatgacccagacaaaatagttgtccctttaaccaaggaacaagttagacaagcctttatcaattctggtgcatggcagattggtcttgctaattttgtgggaattattgataatcattacccaaaaacaaaaatcttccagttcttaaaattgactacttggattctacctaaaattaccagaygtgaacctttagaaaatgctctaacagtatttactgatggttccagcaatggaaaagtggcttacacagggccaaaagaacgagtaatcaaaactccatatcaatcggctcaaagagcagagttggttgcagtcattacagtgttacaagattttgatcaacctatcaatattatatcagattctgcatatgtagtacaggctacaagggatgttgagacagctctaattaaatatagcatggacgatcagttaaaccagctattcaatttattacaacaaactgtaagaaaaagaaact

SEQ ID NO: 49928 - DNA, 601 bp, Human
tgacttatgtccaagatgtaaaaaaggaaaacattgggctagtcaatgtcattctaaatttgataaaaatgggcaatcattgtcgggaaactaccaaaagggctagtcaatgtcgttccaaatttgataaaaatgggcaaccattgtcgggaaactagcaaaggggccagcctcaggccctgcaacaaactggggcattcccaattcagccctttgttcctcagggttttcagggacaacaacccccactgtcccaagtacctcagggaataagccagttaccacagtacaacaattgtcycccgccacaagtggcagtgcagcagtagatttatgtactatacaagcagtctctctgcttccaggggagcccccacaaaaaatccccacaggagtatatggcccgctgcctgaggagactgtaggactaatcttgggaagatcacgtctaaatctaaaaggagttcaaattcatactggtgtggttgattcagactataaaggtgaaattcaattggttattagctcttcaattccttggagtgccagtccaggagacaggattgctcgattattactcctgccatatattaaggttgga

SEQ ID NO: 49929 - DNA, 601 bp, Human
ctgattttgtggcaaggctccaagatgttgctcaaaagtcaattgccaatgaaaaagcccgtaaggtcatagtggagttgatggcatacgaaaacgccaatcctgagtgtcaatcagccattaagccattaaaaggaaaggttcccgcaggatcagatgtaatctcagagtatgtaaaagcccgtgatggaattggaggagctacgcataaagctatgcttatggcccaagcaataacaggagttgttttaggaggacaagttagaacatttggaggaaaatgttataattgtggtcaaawtggtcatttaaaaaagaattgcccagtcttaaataaacagaatataactattcaagctactacaacaacaggtagagagccacctgacttatgtccaagatgtaaaaaaggaaaacattgggctagtcaatgtcattctaaatttgataaaaatgggcaatcattgtcgggaaactaccaaaagggctagtcaatgtcgttccaaatttgataaaaatgggcaaccattgtcgggaaactagcaaaggggccagcctcaggccctgcaacaaactggggcattcccaattcagccctttg

SEQ ID NO: 49930 - DNA, 601 bp, Human
aaaatccaagacccaggaagcgcctgctccacatttaatacagtaagacaaggttcaaaagagccctaccctgattttgtggcaaggctccaagatgttgctcaaaagtcaattgccaatgaaaaagcccgtaaggtcatagtggagttgatggcatacgaaaacgccaatcctgagtgtcaatcagccattaagccattaaaaggaaaggttcccgcaggatcagatgtaatctcagagtatgtaaaagcccgtgatggaattggaggagctacgcataaagctatgcttatggcccaarcaataacaggagttgttttaggaggacaagttagaacatttggaggaaaatgttataattgtggtcaaattggtcatttaaaaaagaattgcccagtcttaaataaacagaatataactattcaagctactacaacaacaggtagagagccacctgacttatgtccaagatgtaaaaaaggaaaacattgggctagtcaatgtcattctaaatttgataaaaatgggcaatcattgtcgggaaactaccaaaagggctagtcaatgtcgttccaaatttgataaaaatgggcaaccattg

SEQ ID NO: 49931 - DNA, 601 bp, Human
atgtgctttgttaaacagatgcttgaaggcagcatgctcattaagagtcatcaccactccctaatctcaagtacccagggacacaaaaactgcggaagcctgcaggggcctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtataagaggaaagcatgtctcttgcagttgagacaagaggaaggcatctgtttcccrcccatccctgggcaatggaatgtctcggtataaaacccgattgtacgttccacctactgagatagggagaaaccaccttagggctggaggtgggacatgcaggcagcaatactgctttgtaaagcattgagatgtttatgtgtatgcatatctaaaagcacagcatttaatcctttaccttgtctatgatgcaaagacctttgttcacgtgtttgtctgctcaccctctccccactattgtcttgtgaccctgacacatctccctctcggagaaacacccacgaatgatcaataaatact

SEQ ID NO: 49932 - DNA, 601 bp, Human
tgtcaaactcagggttaaatggattaagggcggtgcaagatgtgctttgttaaacagatgcttgaaggcagcatgctcattaagagtcatcaccactccctaatctcaagtacccagggacacaaaaactgcggaagcctgcaggggcctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtataagaggaaagcatgyctcttgcagttgagacaagaggaaggcatctgtttcccgcccatccctgggcaatggaatgtctcggtataaaacccgattgtacgttccacctactgagatagggagaaaccaccttagggctggaggtgggacatgcaggcagcaatactgctttgtaaagcattgagatgtttatgtgtatgcatatctaaaagcacagcatttaatcctttaccttgtctatgatgcaaagacctttgttcacgtgtttgtctgctcaccctctccccactattgtcttgtgaccctgacacatct

SEQ ID NO: 49933 - DNA, 601 bp, Human
tctatgaccttacccccaaccccgtgctctctgaaacatgtgctgtgtcaaactcagggttaaatggattaagggcggtgcaagatgtgctttgttaaacagatgcttgaaggcagcatgctcattaagagtcatcaccactccctaatctcaagtacccagggacacaaaaactgcggaagcctgcaggggcctctgcctaggaaagccaggtattgtccaaggtttctccccatgtgatagtctgaaatatggcctcgtgggaagggaaagacctgaccgtcccccagcccgacacccrtaaagggtctgtgctgaggaggattagtataagaggaaagcatgtctcttgcagttgagacaagaggaaggcatctgtttcccgcccatccctgggcaatggaatgtctcggtataaaacccgattgtacgttccacctactgagatagggagaaaccaccttagggctggaggtgggacatgcaggcagcaatactgctttgtaaagcattgagatgtttatgtgtatgcatatctaaaagcacagcatttaatcctttaccttgtctatgatgcaaagacctttgttcacgtgtttgt

SEQ ID NO: 49934 - DNA, 601 bp, Human
ataggagactccattttgttctgtactaagaaaaattattctgccttgagatgctgttaatctatgaccttacccccaaccccgtgctctctgaaacatgtgctgtgtcaaactcagggttaaatggattaagggcggtgcaagatgtgctttgttaaacagatgcttgaaggcagcatgctcattaagagtcatcaccactccctaatctcaagtacccagggacacaaaaactgcggaagcctgcaggggcctctgcctaggaaagccaggtattgtccaaggtttctccccatgtgakagtctgaaatatggcctcgtgggaagggaaagacctgaccgtcccccagcccgacacccgtaaagggtctgtgctgaggaggattagtataagaggaaagcatgtctcttgcagttgagacaagaggaaggcatctgtttcccgcccatccctgggcaatggaatgtctcggtataaaacccgattgtacgttccacctactgagatagggagaaaccaccttagggctggaggtgggacatgcaggcagcaatactgctttgtaaagcattgagatgtttatgtgtatgcatatctaaa

SEQ ID NO: 49935 - DNA, 601 bp, Human
tgtggggaaaagcaagagaggtcagattgttactgtgtctgtatagaaagaagtagacataggagactccattttgttctgtactaagaaaaattattctgccttgagatgctgttaatctatgaccttacccccaaccccgtgctctctgaaacatgtgctgtgtcaaactcagggttaaatggattaagggcggtgcaagatgtgctttgttaaacagatgcttgaaggcagcatgctcattaagagtcatcaccactccctaatctcaagtacccagggacacaaaaactgcggaagsctgcaggggcctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtataagaggaaagcatgtctcttgcagttgagacaagaggaaggcatctgtttcccgcccatccctgggcaatggaatgtctcggtataaaacccgattgtacgttccacctactgagatagggagaaaccaccttagggctggaggtgggacat

SEQ ID NO: 49936 - DNA, 601 bp, Human
gcactatttgagacacttgggatacatcaatgaactaagcagctatcggggaatctgccctgatattcacataggttcttttctatttttcctaagcattggccagcttgagaaataaagggacagagtacaaaagagagaaattttaaagctgagcatctgggggagacatcacatgtcggtaggttccgtgatgccccacaagctacaaaaaccagcaagtttttattagagattttcaaaaggggagggagtgtgcaaataggtgtgggtgacagacatcaagtacttaacggggtawtagaataccataaggcaagaggaggcagggcgagatcacaggaccacaggaccgaggtgaaattaaaattgctaatgaagtttcgggcaccattgtcattgataacatcttatcaggagacagggttttgagatcaaccagtctgaccaaaatttattaggcaggagttttctcttcctaataagcctgggagtgctatgggagactggagtctatttcacctctgcagtttcgaccataagagacaggagcacctgggggtgctgtttataagcctatacctccaggcgcgtattctct

SEQ ID NO: 49937 - DNA, 601 bp, Human
ttgttaatttggatatctgttgacctaggctcactcccaaatagaattggatcaaggaaaaatgaatcaaacctgtcctgaggtttttctctcctcctccccgagagtgccccatgcctcccaggaagccctacagtggtccatctggggccactggagtggggatttgctctttggctcccctgactcaccaagcacttgcagcttgatcttccattcttgctcattcccagtctttttcaacaccctcatgatgtaggtgctgttgtcctctttctggaccttagagatgtacagtgcrccactctgaggatcaagtctgaccctgcctttaaatttggattcaaagtacttagattttctggaatcccattctacaatcttctggtcgaaagtataaaaccaggttagttgtttgtagttctcaggcaggctctcagagatgttcagagtcacgttgctgccggagaccacggtcatatgtaccaagtgacctgccaatgagattcagagtgagacctgcgctagaggaggcagtgttgctgacaggcccagggtatagcctgggctggtggaacaggtgagaaggaagggatttctg

SEQ ID NO: 49938 - DNA, 601 bp, Human
tgaactaaattgggactatcagtttctctctctttaaattgccctgagaattgaaactcagaggagcaaaagtctaagttttgagagataacatgtgtaaaatggcaggaatccaaatccataggcacagtccacagattcctgaagctaggggttctggcccgaacctggttttcaatcttctccccttaagcccttcctagctcttttaaactctttgaattgctttaaatagccctagtttcttaaactaaattctccttttttggtaaaggtacattgaattagtttctgttatttkctatcaaaagaatcttacctaatatgggcacagagatgtgaagatcttttttcaaggctgcacagctagtgagcaactgaccagttttgaacccaagtctgtctggctccaggtataatgcctgagtccttattccatatacactggttagactggagctatgagtggaagtttttttgtcctgcccattatgaaagttgaaaaattctcctgataactcctgccccattctttatattaatacattctcttttttcttaagtccaatgaagcctaatttcggagatataatcaagatga

SEQ ID NO: 49939 - DNA, 601 bp, Human
gatcagcacagcactgggcactttgctgatggaattaattgagccagcttgggttgtccagctccaagatgctcgctttgagctgtcagaaatgcttgggctggaccagaggaccattttttctgctaatcacttcctggaaatcttaccctcaggcaggatgtgctgaagcccaagccagtttgtggatttttaagtactcagaaattttgcaagctttttgtgaaaccattagtttattgaaatcaactgtggtagcagtatttaaaccacagaaattacaaagttggtaaatgctacrctttagggcttttttttttttttttaaatcttgtagagcttgttaaccagaacaccactgtaagagaccttgaatctttttgttcccaggactttctgaattttcagcccatatgacatggaagaagagttagaaggggaatctgactgcttggatcagggactgtctggctggtggaacttgaatgtatacaacactcttcatttgcatgttttgacattttaaaaaatgttttcactttccttatctactttgactctaataacatcctgaaaggtaagtagaattattctcataata

SEQ ID NO: 49940 - DNA, 601 bp, Human
cccaggagttccagggtgcaataaactatgattataccactgcactccagcttgggtaaggagaagaccttcaaaaaaaaaaaaaaaagaagaaagaaaggaagaaagagagagagaagggaagagaagagaggaaaaagaaaaagaagggagggagggagggagggaggcaagtagacacaaaaacactagttttggagtgagaccagcctgggtcctggacttgactctagtggagtgacattaggcaaggtagttaacccccttgctgtcatctgtaaactgactctacctcatcgcrcaatgttagtaagataaaacgtcacctgtcatggataattgctttttgaagagtgtaagtattgcatacattctagaggccattttaccattattactgttgtactgctgccggagagaatgagagatagtcccagcatctggtccttccttggctaaggccggtttacctgcaatcctctgagatcttttcattctggtcagggtgaaacatctgcagaatcaatgcaactcaaatcccataagattaaaaattggcagagaattgaccagatcagagcttgcctcttggttgtatgtg

SEQ ID NO: 49941 - DNA, 601 bp, Human
tgcagcggctcacacctgtaatctcagcaatttgggaggctgaggcaggaggattgcttgcagccaggagttaagagaccagcctgggcaacattgagagactcagtttctaaaaaaaaaaaagaaagaaaagaaaagaaaagtagccaggtgtggtggtgtgcacttttagtccctgctactcaggaggctgaggtaggaggattgctggagcccaggagttccagggtgcaataaactatgattataccactgcactccagcttgggtaaggagaagaccttcaaaaaaaaaaaaaaaagaagaaagaaaggaagaaagagagagagaagggaagagaagagaggaaaaagaaaaagaagggagggagggagggagggaggcaagtagacacaaaaacactagttttggagtgagaccagcctgggtcctggacttgactctagtggagtgacattaggcaaggtagttaacccccttgctgtcatctgtaaactgactctacctcatcgcgcaatgttagtaagataaaacgtcacctgtcatggataattgctttttgaagagtgtaagtattgcatacattctagaggccatttta

SEQ ID NO: 49942 - DNA, 601 bp, Human
agcggcttctaggcagtgaagctaagctgcgtcctggagggggcgccacagtccatcatatgctctgggaacaaaatggggttatgatcgtgtgtgagcctgaacgaacagcccagagacttgctggggtcagacttagtatatcaactgcctgagatgctcagggacccttctctagcaacggttcatggcgggcaccttggctggtctgtctttccaattatcggattcagcttcagcaagagtcctaaggtaagaggtacctgtctgcgcgtggcaaagtcctttgcacaaccatccrgtgcaggtgccagccttctagactctggcagagctacagagaagaacttcatgtaacttccagccgcatcaattgtgataaacagattggtctgctaactttggtatctccatgtctagcacaatccctgccacatggcaggtattctataagtatctcatgaaaggatgaatgaagtagttatgagatagaaaggataaaacacagccgggtgcagcggctcacacctgtaatctcagcaatttgggaggctgaggcaggaggattgcttgcagccaggagttaagagaccagcctggg

SEQ ID NO: 49943 - DNA, 601 bp, Human
agtttacagactcgccaggtatcacacatgacagtttcagataacagttgtcatccatgtcttctatcttctcaattttgatgacaggcttgggtacagggtctgaaagtgaggaggatgttataagatgagacagtgaggcattcatgctgtgaaggtttagccaacaaagaacaaagggatccagggaaggggcctgaatgccccaggaggcagagtcatgaagaagaagttctacagagggagccagtgagcagccttgacctcctgaggcctcacagactcactgcaagagcggctyctaggcagtgaagctaagctgcgtcctggagggggcgccacagtccatcatatgctctgggaacaaaatggggttatgatcgtgtgtgagcctgaacgaacagcccagagacttgctggggtcagacttagtatatcaactgcctgagatgctcagggacccttctctagcaacggttcatggcgggcaccttggctggtctgtctttccaattatcggattcagcttcagcaagagtcctaaggtaagaggtacctgtctgcgcgtggcaaagtcctttgcacaaccatccagtgcagg

SEQ ID NO: 49944 - DNA, 601 bp, Human
tatgactgactctaaaacccatggccttagctgtcccatgctagcaccagtgtaggcctgatctagagccaggtgtgacactcatgagtggatcctcccaggagacaggggaatctggcttcctaagttcatctaggaacatcaggctggggaggagaagcttcgcctgaggctcaggctctcacgcctcctcgacggcctctctcaggcccgtctcctcagtccctctttccctggctgactttggcggtctaatgacctcggtccctctttccttggctgacttcggctgtctaatgargcccctctagacagctgctcgcccacttgcccttccttctccctgctcaccctgatgtttcagtctactctatgatgaccctggcctcagatgttaggactatgctttgttagagcgggagagggaagaggagtatcagagatctctcccaaacgtcctttgcaggtgagaacactgagccccacgaagttgaggtaagctggctgggaggtggtggtagagctggtggcagaacccacgtctcccagctctcccagacaccttagggattcaccaccacactgtgcaaggaggctgagt

SEQ ID NO: 49945 - DNA, 601 bp, Human
gagtagagataaagaaatcagtgcagttaaggagggtagacagagcccaggaagaccacaaaacagcaacgttctcagaggccagaatccctgatgactgggcatgacaggggtcacaggtgaatgtgagcacctcaggtctgagttattctagaagaatgtgtacgctagggctcagggatctgacttcaggattgtggagggtatctgactctggtatttcccagagtgctggagatattgatccaagtttattaagggtccccaaaactctaagagactgcgtctcatttagctcccrcttactaaggacttgtcagccactgtgataggcagttacgtgtcttgtctcattgaatccttagcacgagataggaactgttattttgtcctttatttaggaagaacatgacttggggaagctaagtaacttgtttagctagtaagtgacagtcctagaagtgaccccaggtatgactgactctaaaacccatggccttagctgtcccatgctagcaccagtgtaggcctgatctagagccaggtgtgacactcatgagtggatcctcccaggagacaggggaatctggcttcctaagtt

SEQ ID NO: 49946 - DNA, 601 bp, Human
gtcttcctttttctggatctcaggatgtgatattgatatgagggtggtgttggaaccaccagccaaattgtgttctcatggtcagataccacactgtcacagtgggtctgtggtggcagaagagcaaggcatatcaggagaggctggtagagacagggccaattagttaggaagaataaggaagagcatacacagtctccgtagtccacatgtgggagtagagataaagaaatcagtgcagttaaggagggtagacagagcccaggaagaccacaaaacagcaacgttctcagaggccagratccctgatgactgggcatgacaggggtcacaggtgaatgtgagcacctcaggtctgagttattctagaagaatgtgtacgctagggctcagggatctgacttcaggattgtggagggtatctgactctggtatttcccagagtgctggagatattgatccaagtttattaagggtccccaaaactctaagagactgcgtctcatttagctcccgcttactaaggacttgtcagccactgtgataggcagttacgtgtcttgtctcattgaatccttagcacgagataggaactgttatt

SEQ ID NO: 49947 - DNA, 601 bp, Human
aggtaccatggcaagtgttgtacatgcattatcatcattttgattctcaaaacaattctactgtattaatacctccccattttgaagctgaaacaagagtcagaggaggaatgtaacttcgtctaggtcacaaaacttgtaaacaattcactactagctgatttgacaactttatttcagtttcagtagatgaaagaagtgtatcctagagctaccttttatcttagcaggtattaaccttttgaagagcatcaaaaatttgaaagcaatgagtgaagaggtcaggtggagcagaaagaaraaccaatgggattgggattaaccttggaattagaaaaaccaatgtctatttccagctctaccaatttaggtagtgaaatttcaggtgaatttttaaacccctaaatcttaatttattatttttcttgcataatgggattaataacgtctatcttgctcatctcaatggttttcatatggatgacataagaatgtaggcataaacattgtagaatgttttgcaaattaagtggtatcaaatgctaccttgtctggtctctctctggaagattagggacatccctagtaccattcctcatct

SEQ ID NO: 49948 - DNA, 601 bp, Human
ccactgccttccactgaaggcctgagttatcacagggggaacagctttccaccctctgtttggaagctgggtttttgataagcagttttacccatatgtaatatatttccatttctataactggatttctgcttttgagcccttttctgaatgtctgtggtagtcatctgcttaaatctcattctaatacagaggccttgtccttatcttgaagacccctcaatgcaaggacttcagatcagtggcaggttgttttgtcagcatacttccacaggtatgcttcctgtctctgagccccagratgatggttggggtccagttacccatagtgagcccactcatttcttagaattttaggtctcaactgctgaaatgcccatgaccatgtttaacatccaacaagacatcaacatcatgctgatattggacttttatttgtttaaagaaactaattcaaatcacatttgaataatattaaagtgaacggtatttgaaatatgtctggagatggttgtttgcttgggtattctgcctcactgccctgcctaaacttccgttattggcaaggacctgccaacagctccttcctcctctgtgggtg

SEQ ID NO: 49949 - DNA, 601 bp, Human
tggaaaaacctgttcactgtgactcttaggtagctatggcaaagagggagcccaggactcagggagcaggatgaccagtgttgaaagagatcactgaggactggttgctcactggaggttgccttcccctcctggattgggctggggcacccttcccaatgcaatacacctttctgtgtctaagatgataaccctgtttccctggatgatcctagggatatggatggattttacaaatgtacatttcatggttaggcagctcaaagccactgactagaagaagacaatagggatcgtgagwaaaagaagaatatttgaaaaaacaaaaaacaaatagaaaagaatcagaaacccatatatatagattgtataaagattgttgaggtatgaggcttttaactcatgagaggaaaattcttcaaggctgggcaagcaacacttactgatgttttgggtggaatccaaagtcaaatatggatgacaatggagaggttatatagacctaaaaccccataattctccttagtttctattaaaaatgaacacagtgtacccttggagtctggggagctctctattctcctttcataatcttaaccat

SEQ ID NO: 49950 - DNA, 601 bp, Human
ggagaggagggtcattcaggaagagtaagcctgaagtccacgactgagccctgcgagagtgctcacatttatagaagagacaccatcaaaagaaacagaagagaccaagcagtaagagtgcaagagaggcaccaatagtgggccatatcacagagaggagaaagagtctcaaggaggagattgccactgatgtctaatgattcagcgttcaacgggataaagactgaaaatggccctgggtttgcccgttacgaggttattgatggcctttgagaatgtagtacaagtaagacaactcgayggaaggccagagtctaggggactgacagagtaggtggtaaagcatggaggaaaaacttgacagtgaaagaagggtgatgagataggacagtagctagaaggtcaggtgaaactaatttatttttgttttaaaatagaagagactgggggttgggggggaggagctagggagggtaagcagagagagatgtccccagtgggcctgctctaggttagatgctcctgctcatggcctctctggaactccaggtttccctctcatagcacttgccacattgtgtggtggtcatcaatctgcgtg

SEQ ID NO: 49951 - DNA, 601 bp, Human
accctggatagactttattctgctcttaaaagattttaagatttaaaagaaagagtgtccatatcaatcaatcccaatatttatttttctgggtgctaaagggactctaacattatgttatcactggaagtgaccttagtaaaatctaatttcagagataacttgtggcacaaaaacatcttgaggacttaccatgaaatgcactatgctagtctatggcaaagacagattctctgcctttcggggggaatttgatacccggttagggaaataagatacacacacacacacacacacacaagcacgcacgcacgcacgcacacacacaattctcctttgcaatatgagatagtgaataataaattcaagtgaatggtagaaacagtgattacggtaggaattctaagaagggagggattgctgagctgtagtggttagaaaaaacatctcaaagaaagtagaatttgaggaggattttgaaggctgaatagaattctacttgatggaaagggaaaggaggggtgtctcaagtcctcggatcctgaacaaaagtttagaagcagaacctgtgatgttaattggatgaatatagatttgcata

SEQ ID NO: 49952 - DNA, 601 bp, Human
tggttgcatgtatttattcaggatcagttttgctccagatactatggtgggtatttgttaatttaatttataatgtaagtgtttgttggacatctactcttttaaacaagatacgaggagctgaggatacaacggcgagaagaaacagatataattcttgctctttgagacttacaatcagaggaagataccaatgttgatcagataaccatagaaacaaatggataggcacaaaatatgtaagcattatggtgatttgagagagaccagcaaggggacttgatctgttctgggaatcgarggaacatttcctagtgaaaacttaaggatgaatacttttaaaatgtaacatgggaagatgaaaagcttattttctcctcccttttctctcctctatcacttttgaagataaactgatttaatatatagtttgtaaaatgagagacaatgtaacttcaagacattatttttctgctctttctcctcctcttcttcattatcctataattctcaatgagggctctttagtgagaaacactgtttggggcaagcatagatgatatccaaagtatttaataaccaatatgacgtgggccttgac

SEQ ID NO: 49953 - DNA, 601 bp, Human
ctgaagtaagcaagtttcgtttattcattcatacatttgtgaatggttgcatgtatttattcaggatcagttttgctccagatactatggtgggtatttgttaatttaatttataatgtaagtgtttgttggacatctactcttttaaacaagatacgaggagctgaggatacaacggcgagaagaaacagatataattcttgctctttgagacttacaatcagaggaagataccaatgttgatcagataaccatagaaacaaatggataggcacaaaatatgtaagcattatggtgattkgagagagaccagcaaggggacttgatctgttctgggaatcgagggaacatttcctagtgaaaacttaaggatgaatacttttaaaatgtaacatgggaagatgaaaagcttattttctcctcccttttctctcctctatcacttttgaagataaactgatttaatatatagtttgtaaaatgagagacaatgtaacttcaagacattatttttctgctctttctcctcctcttcttcattatcctataattctcaatgagggctctttagtgagaaacactgtttggggcaagcatagat

SEQ ID NO: 49954 - DNA, 601 bp, Human
tattagtacacacaagagtttggatgaatctcagtgacattacgctaagtgaaaaatacccaacctcaaaaagatacgtccttcattattccatctacataacatgtgtgaaatgacatagttgtagatgtgaacaaactggttgtttttcagggactggggaagggaaagatggagatgtggctataaagggagagtatgagggaatcttgtgatggttaatcttgattatggtagtggttacacaaaactacccatgtgattaaattgtacagagctacacacatactcacacataaawgaatgcatgcatacgtggtgaaacctaaataagctctatagattgtgctaatgtcaatttcctgtttttgatattgtgctatagttatgcaaggtgttaacacagggtgaagggtacatagaacctccctgtatatttatttgtaccttctttgcatctatcatgatctcaaaatgaaaagtttttttaaagcactttgcatacactatctcatttgatcctcatgataaccctgggaagtgagtagtatgatcattgacattatgtaaaaaagaaaaccaaggcccaggggaccaacta

SEQ ID NO: 49955 - DNA, 601 bp, Human
ttcacaatagctaagatatggaatcaacccaaatgcccatcaatgatagattggataaagaaaatgtggtacatatatgccatggaatactatgcagccataaaaaggaacaagatcatgtccttttcagggacatggatggagttggaagccattaccctcagcaaactaatgcaggaacagaaaaccgaacaccacatgttctcacttataagtgggagatgaatgatgagaacacatggaggggaacaacacacactgggacctgttggagaggggttgggggagagagaggatcagraaggttagctaatggatgttggtcttaatacctagatgatggaatgatctgtgcagcaaaccaccatggcacacatttacctatgtaacaaactttgacatcctgcacatgtacccctgaacttaaaataaacattgaagaaaaaaaagaaaattattgagatattttatatatttttttggtgctaagatttcaagatctggtatgaattttacacttacagcacatctcaatttggactcaccacatttcagatgctcaagagctgcatgtgtctagaggctaccatagtgaataggg

SEQ ID NO: 49956 - DNA, 601 bp, Human
atatcatgaaaatggccatactgcccaaagtaatttatagattctaagctattcacattagactactattgacattcttcatagaattagaaaaaactactttaaaattcatatggatgaaaaagagcctgaatagccaagacagtcctaagcaaaaagaacaaaactggaggcatcacactacccaacttcaaactatactacaaggccaaggtaaccaaaacagcacggcactggtacaaaaacagacacatagaccaatggaacagaataaagaactcaaaaataagaccacacaccwgcaattatcagattttcgacaaacctgacaaaaacaatgggaaaaggattccctatttaaaaatggtgcagggagaactggctagccacatgcagaaaattgaaactggaccactcccttataccttaaacaaaaattaattcaaggtgaattaaagacttaaatgtaaagccccaaagtataaaaaccctataagaaaatctgggcaataccattcaggacataggcacgggcaaagatttcatgatgaaaatgtcaaaagcaattgcaacaaaagcaaaaattgacaaatgggatctg

SEQ ID NO: 49957 - DNA, 601 bp, Human
ctataagctgattagggatataaatgcttagcaaaaatcaatgaaagcattctgtaagaataattggaatttatcctctagtgccctctcagcaaaataaattctatatagaatttacaataaagactattatatatttattatcattaatgaaactgtgtgctacacatccttcaagtcaataaaatttgtactaaacataaattttatatatatatatgaatacacacacccaattaagagctaattaaatatttatcagcacacaactacatgaaataatctttttttttttttttttgagacggagtcttgctctgtcacccaggctggagtgcagtggcatgatctcggctcactgcaagctccgcctcctgggttcaagccattctcctgcctcagcctcccgaggagtagctgggactacaggtgcccaccaccacgcctaattttgtttttgtatttttagtagagatggagtttcaccgtgttagctaggatggtctcaatctcctgacctcgtgatccacccgcctcggcctcccaaagtgctgggatgacaggtgtgagccaccgcacccagccaaaataatctttaaaa

SEQ ID NO: 49958 - DNA, 601 bp, Human; identical to SEQ ID NO: 28967

SEQ ID NO: 49959 - DNA, 601 bp, Human; identical to SEQ ID NO: 28968

SEQ ID NO: 49960 - DNA, 601 bp, Human; identical to SEQ ID NO: 28969

SEQ ID NO: 49961 - DNA, 601 bp, Human; identical to SEQ ID NO: 28970

SEQ ID NO: 49962 - DNA, 601 bp, Human; identical to SEQ ID NO: 28971

SEQ ID NO: 49963 - DNA, 601 bp, Human; identical to SEQ ID NO: 28972

SEQ ID NO: 49964 - DNA, 601 bp, Human; identical to SEQ ID NO: 28973

SEQ ID NO: 49965 - DNA, 601 bp, Human; identical to SEQ ID NO: 28974

SEQ ID NO: 49966 - DNA, 601 bp, Human; identical to SEQ ID NO: 28975

SEQ ID NO: 49967 - DNA, 601 bp, Human; identical to SEQ ID NO: 28976

SEQ ID NO: 49968 - DNA, 601 bp, Human
tgacatactactgtcttccttcctggctaatgaggtaatggatgtgttggtttataataaggacgcagtaaatggtagttattgttatattaactattttacagcctacccttccaaacttgaattaaatttctctctttgctcaatcatcattcccaaggaaggattttgtttttaaaatatgttaagtattcacacatttcttttcatctcaaagtaacaaaccgacttcctttcagaatattgtaaaactctgagtacacttttttgattaaaactccattaacttcctacatcataytaaataccccttcttattccttagggtcctcacatgaaatctagggttcccttcttataactccattcttagaactctctctcctccaaagttacctttggccctttcagtggggaatgcaaaggaagcgtgatacttttctttgcagaactagtgaccaactgaaggaaaaaggtcatttagcagtagataagcaatacaaaaggcatcaattattttaattttcagcttcttgttctgatattttaataggaaaaagttccaaccaagcaccttaatcacagagaagaagaccagatg

SEQ ID NO: 49969 - DNA, 601 bp, Human
gggggtggggcgaggggtgatcagattaaattgaagcaatatccgctcagcaaattacaaatatccatacggtattgttaactatcatcattatgttgcacactagatgtccaaaaattatacatctatagctaggctactgaaaaatgaccatgtttagtgactttccttcaacctggtgttgatctcaaattgtgaattgaaattttacctagaagctttgatgctgggacttagaaagttcagcttgaatgatacaattattaagctcttaaagtcttaagataactttatttaaatmatattaatcttagatcatatttttggcatttttaacattgtattgcatctctttgtttacaagtgtatcagatagtggagtcttagaataaaagaatcatatttgttttattttttaataaatttgctgtagcacatgcttagtgcttaataaaatatgtactaaatgaataaatggatgaatgaatgaaatgtacaaaagcatacatagatgaacagaattttttctgttttattctctaacttgcaaactataaaacttatttaatcaagaaccctctcagacatctatgcagtgtaa

SEQ ID NO: 49970 - DNA, 601 bp, Human
ttaaaatgtagattaatatacaatttcatttatttttgaaatactcaaatcttttaccacactacaattgagaactatcataatgtactgtgaacttcttggggaggaaccgagccttttctttgcttgaatccctgcactggcactgggcatggaactaggtaggcacccaaaatgtttactcatttgacttgaacattgttttctattaatgaatattaactatctgttctccattaacttataccattacataaactttgtgtaagtcaattatttgaaatgtagggaaatccatatwgcatatatatgtatataacacctcagtcatgtactttctcagtctattctacaaacaattttaagcaggaataatataactgaactggaagatgagaattttccagaattttgagtcttgagacccacctttcctgaagagagaacttttaattgtgaatagactgggttatggacagcattttgagtgaatgatggctacctttcatgtaaaatttcactttgtggcattctaggtgcataggagacaagttaattaattgcacgcaatggatgccttgagtcattaggattttgttct

SEQ ID NO: 49971 - DNA, 601 bp, Human
tccatgtattcctaatttggcctgttgatgccccattcaagcaggatcctgtgtccttttcacatggccctgttagtctttaagcacttgggttaccttgtgctttctttgccccaacctggaaccagcaatttctccaatgagtccctgagtggggaatgatatttcaaatccaaggtcttagttctatttgtgcccatggcttgcaggccttttaagtaggcaaaactgtccaattcaaaggcatcacatcggttctgctagagactagtatcttattgttaggtcatatattacagamagtatattaattcagttatcatgacaattccaggtaacaatgcagcagcaaaccatttcctaggaattgtttacacagtagaaatcagctacctttgtttgtaacatgaagatttgctgaatcttttggtgaaagtcatgaaatgatttcgagtgatgtgtagatcctttgccagttcacctctatcttcagtggttcccaaactgtgatccacagatatctgggtgtcctgcagactgactttcagggagtctgagaagttaaaactattttcatgacaattctaggatcgtatttgcc

SEQ ID NO: 49972 - DNA, 601 bp, Human
tatgggcttattgaatccctttttccttatttgaatttctattaccattatgtcattattattttaacactccatgtattcctaatttggcctgttgatgccccattcaagcaggatcctgtgtccttttcacatggccctgttagtctttaagcacttgggttaccttgtgctttctttgccccaacctggaaccagcaatttctccaatgagtccctgagtggggaatgatatttcaaatccaaggtcttagttctatttgtgcccatggcttgcaggccttttaagtaggcaaaactktccaattcaaaggcatcacatcggttctgctagagactagtatcttattgttaggtcatatattacagacagtatattaattcagttatcatgacaattccaggtaacaatgcagcagcaaaccatttcctaggaattgtttacacagtagaaatcagctacctttgtttgtaacatgaagatttgctgaatcttttggtgaaagtcatgaaatgatttcgagtgatgtgtagatcctttgccagttcacctctatcttcagtggttcccaaactgtgatccacagatatctgggtgtcc

SEQ ID NO: 49973 - DNA, 601 bp, Human
aataacttttcacccaatgattttagcttccatgatgaacattgctgaaatgaattattacattggtaatttcaaaattgtaattttctatgtctattctcctttatattaattagtattcttctataaagaagagcttcctccttctcctctttttctcttttatgcaatatttctatgggcttattgaatccctttttccttatttgaatttctattaccattatgtcattattattttaacactccatgtattcctaatttggcctgttgatgccccattcaagcaggatcctgtgtmcttttcacatggccctgttagtctttaagcacttgggttaccttgtgctttctttgccccaacctggaaccagcaatttctccaatgagtccctgagtggggaatgatatttcaaatccaaggtcttagttctatttgtgcccatggcttgcaggccttttaagtaggcaaaactgtccaattcaaaggcatcacatcggttctgctagagactagtatcttattgttaggtcatatattacagacagtatattaattcagttatcatgacaattccaggtaacaatgcagcagcaaacc

SEQ ID NO: 49974 - DNA, 601 bp, Human
gtgttgccagacctctccactataagtgtaactttgaccctgtaagtatcaagtaatctctgggtgactctttcagaacatgtgaatgccatgttatccaataacttttcacccaatgattttagcttccatgatgaacattgctgaaatgaattattacattggtaatttcaaaattgtaattttctatgtctattctcctttatattaattagtattcttctataaagaagagcttcctccttctcctctttttctcttttatgcaatatttctatgggcttattgaatccctttttcmttatttgaatttctattaccattatgtcattattattttaacactccatgtattcctaatttggcctgttgatgccccattcaagcaggatcctgtgtccttttcacatggccctgttagtctttaagcacttgggttaccttgtgctttctttgccccaacctggaaccagcaatttctccaatgagtccctgagtggggaatgatatttcaaatccaaggtcttagttctatttgtgcccatggcttgcaggccttttaagtaggcaaaactgtccaattcaaaggcatcacatcggt

SEQ ID NO: 49975 - DNA, 601 bp, Human
accttgggcaaattgcttaatctttttaaacctcaactttaccataggtatttcttcttaacatgtgtattccaagggtagttttgaggattagaaaataaatacacgataagttcacacagtgcctatgacaaattaagcatcattataatcagtggttttattataatttaaaatttgttctacttttctgctaaaaataaatttggatttgaggttggtaaccagaacctgacaggatacaatttcaccatcatcatcaccatcaccaccaccatcagcagcagcagcatcctcaacrtcatctcattcattagtagagtttaatttatgttgttaattttgttctattctacttttatatcttgcaataggatatcttgcaagccctaatgtgttactctgttctcccagttctaataaagacatacccaggactgggtagtctgtagaggaaaaaggtttaattgactcacagttccacaaggctggggaggcctcacaatcatggtgaaaggcaaaggaggagcaaagtcatgtcttacatggcggcaggcaagagagcttgtgtaggacaactcccctttataaaaccatcagc

SEQ ID NO: 49976 - DNA, 601 bp, Human
tgttggccaggttggtctcgaactcctgacctcaggtgatccaccagcctcggcctcccaaagtgctgggattacaggcatgagccactgtgcctggcatctttcacatttagagaggcatcacactgatcaaagacactgtattagctctatgctagctagtagtttatattccattctaattgtttactagctgtgtgtctttggataaccagtgatttcctcatctgtaaaatgggactaatacttcataaggctccatgagggcatgtgttttatttacctcctcatgtctccagtrtctggtacagagtgcatgtgaaatatatccagaataaacatgtaaactgtggtgtacatctaacatctaacacacttttatgttttgatattcgtgtatattaaggactatcacatgtaggatcaatcttcagggagaccacaatatttagccgttttcaaatagccaaacctgtttctttgctattagttgatgacatgcataaaaccccccatattatcagctgtgtaaaaatcaattttatctctatgtgtaaatatgtgtttgtctgtatatatctttatatattttaagctcaca

SEQ ID NO: 49977 - DNA, 601 bp, Human
actatgcttttaaggattcatagtaagcggtgtaaaactttaattttctttaaacattttagaccaaaacagaaaatgctggcttgatttacttaaaaatttctgcccagcagcacagcaaattttgcactctgttttgggccaagatagcaggggggagggaaccaggtgcctacattttccttgctcccttctcccattccttgctgccccctgagatcatagcaactcagtgtttttatttcaagcattttcctgaaagttgttaacagaaaataaaagagaatagtgaaaagtataraagcgaagaaatctcaaggcattagaatcctacactgttcttagcgttcccatcctcctggctgtgataagttgtgtctttcacatttatttattacttattatttttattaattaattaatttattttgagatggagtctcactctgtcttgcctaggctggagtgcagtggcgcaatctcggctcactgcagcctctgcctcctgggttcaagtgattctcctgtctcagcctcccgagtagctgggactacaggcgtgtgccaccacacctggttaattttgtattttcagtacaga

SEQ ID NO: 49978 - DNA, 601 bp, Human
ctgctgtggagaaaccctcatctaaatcaactatgcttttaaggattcatagtaagcggtgtaaaactttaattttctttaaacattttagaccaaaacagaaaatgctggcttgatttacttaaaaatttctgcccagcagcacagcaaattttgcactctgttttgggccaagatagcaggggggagggaaccaggtgcctacattttccttgctcccttctcccattccttgctgccccctgagatcatagcaactcagtgtttttatttcaagcattttcctgaaagttgttaacakaaaataaaagagaatagtgaaaagtataaaagcgaagaaatctcaaggcattagaatcctacactgttcttagcgttcccatcctcctggctgtgataagttgtgtctttcacatttatttattacttattatttttattaattaattaatttattttgagatggagtctcactctgtcttgcctaggctggagtgcagtggcgcaatctcggctcactgcagcctctgcctcctgggttcaagtgattctcctgtctcagcctcccgagtagctgggactacaggcgtgtgccaccaca

SEQ ID NO: 49979 - DNA, 601 bp, Human
atttatcctgctttaagagtttgtgggtggggaccagggagagggccacaactatagttgtgtggtgcaaggctctgccactaaaggaatacagtgtccattttatagaagaaaaggaatttctttaggggttcgcactttggagaaatcttccaacaggttttaaggattgtcaagtcttgtctaaatcagtgattctcaacaagaggtaatattaacccccagactacatttgacaatgtctggagacatttgtggttgttgcaacttgaggaagtagagtggtgccgctgatgtcctsagggtacagactagggatgctgccaaacttgctgtggtgaataggacagcttcccacaaggaagtattgggctcaaagtgttaagggtgctgctgtggagaaaccctcatctaaatcaactatgcttttaaggattcatagtaagcggtgtaaaactttaattttctttaaacattttagaccaaaacagaaaatgctggcttgatttacttaaaaatttctgcccagcagcacagcaaattttgcactctgttttgggccaagatagcaggggggagggaaccaggtgcctacattttc

SEQ ID NO: 49980 - DNA, 601 bp, Human
tattctgcagatttcaccccccttcccctttgatggaaaaccagacttttttttttttttttttgttttgagacggagtctcgctctgtcgcccaggccggactgcagtggcgctatctcggctcactgcaagctccgcctcccgggttcacgccattctcctgcctcagcctcccgagtagctgggactacaggcgtccgccactacgcctggctaattttttttgtatttttagtagagacggggttttcaccgtgttagccaggatggtctcgatctcctgacctcgtgatccgcccrcctcggcctcccaaagtgctgggactacaggcgtgagccaccgcgcccggccattgagacattttatattggggtaaagaaatttcatatattaactgtgcttcactgtttttccctcttctgatgtaattcttgttactgcttttcgccacaagggggcttaagaacctcatttattatttaaattaatgagagcttaaaagttgtggaggctcttgacagataatgattccgtgtgaaatatacgaataaaaaggtttataaacaactaggattattgcattatcatttatcctgctt

SEQ ID NO: 49981 - DNA, 601 bp, Human
tcaggggctagtgtgttgagggtaagagactgtggtacactactcaggcttgtctactgcagtggatgctgagatgcgctgcccagatgcccccttcagatcaaaagacttattcctctcattttccctggcggtcaggagtgccgccagatgaaaccctaagctctcaattctctctggaaaatgctcttcttttgctcaagatcatagctcttccttcgggtagtctggacacaataactgattcacatgagcaaccgcttgtctcagaaaaggaccacctaaaactggataatcctascttcagagcctcctgaagggtcagctgaggccttctccttctctgcccaaattctttccctcaggtgttgatccttaaggtgttgattcccatcccatacctacccagggtaccctagaactgagattttacctgactcgctgatgggcatttgtcaattaatatcaacctgtttccctttttgctttttgaagtagagataatcacatatattcatttttctttacacattgatttgtcacccaccatttaatttttgtatgtaaaaatttgatctagatcatagaataaattggacag

SEQ ID NO: 49982 - DNA, 601 bp, Human
ttgcaggattccctgtacaatagtgccccactggaggcccaaagcagcaacgagtaggttgatacccacactgctgaagccatatttcttcaggaaggtcatgaggaagccaaacccaacaaatatcataacatgtacatcttggaacactggaaaagaggaaaggaaaaaatatctgcattatgagagcatgaagaaagtactgcatcatagtataccccacttattaagtgctaccacctttgtataacacactaggaaaagagagcatttaactgggaagcaaaagtcttgttccaaygccagcttgactacttactaaccaagagactttggcaagttattcagtgttggagctttttattgggaagactatgcactattacaacagtgtgtctttcatcctgtccctgagaaattctacattgttttccacctgaggacagacttacaaagcacagagcaagcatcaccccttcttgaagactttcccaatactctcaggaaacagaattattttctgttttcatttacatagctttgtgtatatactttagctttatcattgtcatgctataatagcatttatttagcatttgtc

SEQ ID NO: 49983 - DNA, 601 bp, Human
ccagagaggttacagacatgaatgtattatccagctcagtagaggaaggcattgattcagatttttgaatttaaacaattttctgttgcataagggaggcaatttgccagccagtacagtaaatgacaggggactaccagagaaacgattgatttgaaaatgaaatggctgataaataaagaattgtcttagtctgcttggactgctataacaaaataccataaactgggttgtttataaataacagaaatctatttcttatggttctggaggctgggaagcccaagatcaagatgctgasagacttggtgtctgatgagggctccctttctggttggtagatggtgccttccagctgtgttctcacacagtggaaggggtcaggagtctcctgtggacctctttcacaaggacactgatcccattcataaacactctgccttcatgacctggtcacctccccagtcccccacctcttaatatcatcatgttggaggttaagagtgtaatatatgaattctggaggatgcaaacattcagcccacagtaaggatgctcactttttgattccaatgttaaatttctgtccctggctttgcag

SEQ ID NO: 49984 - DNA, 601 bp, Human
tgggaaatttttgctccctgtagctgagatggaaggaataatacttttatggaagagggtttctcatatcctcaaagtcaaaccagagaggttacagacatgaatgtattatccagctcagtagaggaaggcattgattcagatttttgaatttaaacaattttctgttgcataagggaggcaatttgccagccagtacagtaaatgacaggggactaccagagaaacgattgatttgaaaatgaaatggctgataaataaagaattgtcttagtctgcttggactgctataacaaaatamcataaactgggttgtttataaataacagaaatctatttcttatggttctggaggctgggaagcccaagatcaagatgctgacagacttggtgtctgatgagggctccctttctggttggtagatggtgccttccagctgtgttctcacacagtggaaggggtcaggagtctcctgtggacctctttcacaaggacactgatcccattcataaacactctgccttcatgacctggtcacctccccagtcccccacctcttaatatcatcatgttggaggttaagagtgtaatatatgaatt

SEQ ID NO: 49985 - DNA, 601 bp, Human
caccttttatctcatttagggttttcctttatattctttgatctaataagtgaattatttcctggggtgtgtgtttactattgcacaacaagaatacatgtttacattttagaaacaatctgaaaaataactaatgggaaatttttgctccctgtagctgagatggaaggaataatacttttatggaagagggtttctcatatcctcaaagtcaaaccagagaggttacagacatgaatgtattatccagctcagtagaggaaggcattgattcagatttttgaatttaaacaattttctrttgcataagggaggcaatttgccagccagtacagtaaatgacaggggactaccagagaaacgattgatttgaaaatgaaatggctgataaataaagaattgtcttagtctgcttggactgctataacaaaataccataaactgggttgtttataaataacagaaatctatttcttatggttctggaggctgggaagcccaagatcaagatgctgacagacttggtgtctgatgagggctccctttctggttggtagatggtgccttccagctgtgttctcacacagtggaaggggtcagg

SEQ ID NO: 49986 - DNA, 601 bp, Human
ttctgaatatggaagacagtccagaggatgcagtttgctttatttatttatttacttatttatttgtttatttatttatttttgagatggagtgtccctctgtcacccaggctggagtgcagtggcttgatctctgctaactgcaacttccacctctcaggttcaagcaattcttctgcttcagcctcctgagtagctgggattacaggtgcgggctaccatgtccacctaacttttttttgtatttttagtagagacggggtttcagcatgttggtcaggctggtctcgaactcctgacytcgtgatccacccgcctcggcctcccaaagtgctgggattacaggcgtgagccaccacgcccagcctggaggatgtagtttcctttggccactgacaatgtctctgtttagtcttgattatctacagttaagagaaaagaggagaattgagccagcataaagtagtatgcaaaagatgctcattttttcaaagtttaattgaatttattattattattattattttttagagatggagtctcattatgttacccaggctggactcaaactcctgggctcaagtaatcccacctcagcctc

SEQ ID NO: 49987 - DNA, 601 bp, Human
ctccacctcccaggttcaagtgattctcctgcctcagcctcccgagtagctgggatgacaggtgtctgcctccacgcctggctaattttttttttttttgtatttttagtagtcacagggtttctccatgttggccaggcttgtcttgaactcttgacctcaggtaatccccctgtctaggcctcccaaagtgctgggattacaggcattagccactgcgcccagcccagggtacagatttgatgaataagtgaattaatgaataaatgttgttgtttttagaacattctacaaggtctgyttctgatttgtcttgagagttcagcagtgatgcagaaattacctactacttatctgagcaactgtcagtgttgtgaagcaaaatttccatgagggctaaggcggcacttaccatgttgagcttgcctcggtgctccactaggctggagaaggcaaaggctgtgagcacacaggcagcgagagagaagtacgtgtttacaatggccctgcactgtttgtctccaggttcagcaatggccgagttaaagctgggccaaaacatccacagaaagagagtccctgtagtgaaccaaaagagggg

SEQ ID NO: 49988 - DNA, 601 bp, Human
ctgatgacatcctaaatctctcttttttttttttttcttttgagacagagtctcactccattgcccaggctggagggtaatggtgccatctcggctcactgcaacctccacctcccgggttcaagtgattctcctgccttagcctccccagtagctaggattacaggtacccgccaccatgcccggctaatttttgtatttttttttttagtagagacgggggtttcaccatgttgtccaggctggtcttgaactcctgacctcaggtgatctgcctgcctcagcctcccaaagtgctgggattatagctgtgagccaccatgcttggccgacatcctaaatctcttaaaagagcagagtccttaattacataagacaaataacaacaacaacttcaatggagcagtcccaaaggaaagtaatggccatgtacttaacatttaattcaaactaaattataaataattgatactggattctttcctgttacacagaagtcagggcagagtagaaccactgaaccactgaaatgggagtggtatttccaaaaagaaggcaaatggtctccaaataaaaatgtttataaaataaaacttagtag

SEQ ID NO: 49989 - DNA, 601 bp, Human
ttttcacattaaatatgttttagggatccgtttatgtgagtcagtgtagatctggaccatagtttgaattgtgcaaagtattggttgcttccagtgtttcatatttttaaaaatgctgtgagaacatctcctctgaacatgcttatgaacttgtctgattattttcctaatataaaacctatctagaaatgagaatattagtaaaaggctacatatacctcttttttttgagacggagtctcgctctgttgccaggctagagtgaagtgaggtgatctcagctcactgctgtctcctcccmgcgttcaagcaattctcctgactcagcctcgcaagtagctgggattataggcacccaccaccatgccgggtactttttgtgtttttagtagagatggggtttcaccatattggccaggctggtctcaaactcctgacctcagatgatccacctgcctcggcctcccaaagtgctaggattacaggcttgagccaccgtgtccggtctatatacttcttaagaacttttccaaatagaaaattgtacaatttatattccaattttttactttagccattattcagtattattattattatt

SEQ ID NO: 49990 - DNA, 601 bp, Human
gcgcctggcgcccacacctccttcccccccccgaatcctaatgttggggtgtgtgtatgtgtggaggtatgtaggagagaggaggaggagataagagaggagagggagaaaagcaggagagagcgcgagagagcagagaggagagagattggtcttgttgctgaatgatgcttggggttttccttttctctttgtggttgtgtatcgactgtaacgaagagccgcgcctacgcgcctggtggggattgtttcggttcggcctccttttctttccttaacaggcgggataatggtaaagtcsaaggcgctagaactgtcctaaagaatattagcgcccaaagtgggcatgacattagcaagcacggggccatggtgaaaacagctcaagctatatgcatgcagaggcatttcagtgggttctaaaaagtaaccagggtaacattcgttctttacagaaagtaaagtagctaaatggaaaaggaaggagggagagaagaaaggagggagggagagaggaagagggaggggtggagtggaagggagggaagagagaagagaaaagaggggagggagagagagaaagagaaataaacagggagag

SEQ ID NO: 49991 - DNA, 601 bp, Human
aggcgaccaagtcctccggattagggaagtctctctccaggtaggaggacacctccattctatacaacctcccagcactgttctccctcactgccttatccaaaggagcaggggctgctttactcgtgtccccggcacagttaattgaagttctgcctctttcctgctaaactttttccccagtctgcctttgccagccccctcgtctgattacatctagtaattctccactgaatgaacgtcatttacaatagtaggggagctctgcgctcgctgctgcttcacgctccatttgtcctcyattctccctttaaagtactcgtgtaatattaatagtcatgaatatcaattattatgaggcggtgtaggcaagcggagggaggaaggggcggccgagcagtctgagcccagcttcgggtgaaagaggactgcatctggagccccgaagaacggcagaagaaaagaggccaaaaagacagcaaagagacagatgaatagttctgtctgtgtgtgacaggcatcgccaatcttgttggggtggggggcgggtgtaattttttttttttttttttgatggcttgtcctggaaacacatcaagct

SEQ ID NO: 49992 - DNA, 601 bp, Human
tttacaatagtaggggagctctgcgctcgctgctgcttcacgctccatttgtcctctattctccctttaaagtactcgtgtaatattaatagtcatgaatatcaattattatgaggcggtgtaggcaagcggagggaggaaggggcggccgagcagtctgagcccagcttcgggtgaaagaggactgcatctggagccccgaagaacggcagaagaaaagaggccaaaaagacagcaaagagacagatgaatagttctgtctgtgtgtgacaggcatcgccaatcttgttggggtggggggcgggtgtaattttttttttttttttttgatggcttgtcctggaaacacatcaagctcagctcctgtgtccagctcgcttctctgctggactccttgattttttttttaatcattgtttgattttgagcagtaaccaggcttttttttccagatgttagtccacacctattcatccatggtgagtttggattcacgtgttaccagaattgcatgctccctcctctcactgtctctctgtctctgcgtctctgtgtgtgtgtgtgtctcacactctctgtctctctctgtcttcctttgagc

SEQ ID NO: 49993 - DNA, 601 bp, Human
attatgaggcggtgtaggcaagcggagggaggaaggggcggccgagcagtctgagcccagcttcgggtgaaagaggactgcatctggagccccgaagaacggcagaagaaaagaggccaaaaagacagcaaagagacagatgaatagttctgtctgtgtgtgacaggcatcgccaatcttgttggggtggggggcgggtgtaattttttttttttttttttgatggcttgtcctggaaacacatcaagctcagctcctgtgtccagctcgcttctctgctggactccttgattttttttttaatcattgtttgattttgagcagtaaccaggcttttttttccagatgttagtccacacctattcatccatggtgagtttggattcacgtgttaccagaattgcatgctccctcctctcactgtctctctgtctctgcgtctctgtgtgtgtgtgtgtctcacactctctgtctctctctgtcttcctttgagcgcctttggcttggtaatttagcaccataattggacgaggctgcagctgcttctctctgcattgtgtgttctccgtctgagctccatgagtcagctgggaggggagag

SEQ ID NO: 49994 - DNA, 601 bp, Human
tttcacatcctgagtataacagcattagatatagaaaaacagtcttagaaataactcctatgaaccacaactcaacttaattcatcattggcttaggatatgatttcgaatgagatccatttcaatgaaacactatttaagttatttaatttctcctggagagggaggagtgactgggaactcagaccaggtggattccttggagctcttggaatgatcaggttgtgtggaaagctcctcctaatcagccagctgcatttccagcgaaggcagaagttggtttttaatcagggggagcagyacagcaaatactatgaagttttatttgttgtgatttgtacctctggaagagttagaaaaaagtagttaaaaacacccagaggagcaaacaccatatgtaagactcctacaattttaattaaggcatttagaatctccctccatacacactgttcctgtacccctgccttttgcctgctttgcactccccaaaaagcggctaaaatgttatagttaagtgggtgattcctttcccattttctccccaagcctggggtttgaaattgctgaaatcatgtggccctctgagtcaacttggggg

SEQ ID NO: 49995 - DNA, 601 bp, Human
agttgaagatgccaataacagcggcatgaatctattggaccagtctgtcattaaaaaaggtatggataattccccccaaaaagtaagcaaagttctctcatgcattaacgtctttatgatgaattttcactttgggggaattcattatttgacaagacataaatgtttgttcacaattataggacaatggctgtcagattaggggaaagggcatgttgggaagatggaagttgggcaagggagaatgaaaacatcagacacaaattcagatgagtgagacagactgttgcaatttttctcrtggcatatttggtagccattcttgatacatcttaaataattgagctatcatcatgtgtggaattggctggtaaacactggtttcaagaaggtgctacaattatttcaatgataactggagtttgctgagttaaagcttatgttattgagatagctctttcttcgttttgtatttgatttttttggtgataattttgttcccagttctctatgttttatgagttgtttttatttatttattttttcattgtgccaaatttgttgctaaatatgcgcatcctgagaagctgagacagcctat

SEQ ID NO: 49996 - DNA, 601 bp, Human
atgcaatctgcagggaccgtggcccctctcctcttagctgccccattagagctcccattaagctgcctagtctcaactccatggcgggagtgggcggggggagtaatgaaaggtgctttttaaactctcctaatctaaaccggcagagggtggttaatacgatttgaagggggctggtcaatgagcaatcaataaagtaataatgagaaggattcggtacattaacagtctaaaaatccaacgagacattaaaaaatcattcttaactctcagttccattaagattagaaatctgggggggaggaagagggtgtacccagctaataaaaatgatcactgccaccatcatgttgcttaactcaaaaaaaggctcacctaaactttaagaaaaagtttttggtgcaataagaagccaatatgcaatctgtttaacaccttagacagcagaaaatattctgggatttcttggaaaggctagcgtggctggaatccaaggttcaaatgttgtgactgtggggcattttcattggtcttagggatatcctgtttggttagtttcagttcatcctccattctctcccactttctttcccgttagttc

SEQ ID NO: 49997 - DNA, 601 bp, Human
cccgcgccgcgcaagtcctaccgcagattttgccgccctgggaacctttcactttcctggccctgcgcctggcgcctctcttcctgtcacccctaggacatctcagggggcattctccagcctgagtacaacgcggaactaacagccccccagcccccccacaaaaaaccccataagtttcatgaagcaactctcttcataccttcagtgtactctttctcttttattgcatgttttaaatgcagttggcacccagtgaaattggtctttcaacctgctgatgcactgtaacccagtttgrtaaactctttttctaaatttgtgacatccctctttcaataacaccaccaccaataatagcaataatatcactttagaagtatttataggtattcctgggagccattcaggtgcttcacagtattccacagcccagagactgactcctcctcgtggaaatgtgagagaatgtggattttatcttaagatgtaatgcctcccttgaagtccctgccaatgcctgaacactttggcagtgtccctgatatgaaagtgactttgtctgagacaaaactttccaagatgaccccttctgggggtt

SEQ ID NO: 49998 - DNA, 601 bp, Human
taagtcatcctccttaaaaataatgtagctatggggtatttcaacatatctgtttttcatgtatgggatctgtccttgaaccccaaaaggctgtgtttaaagggtaataatgctttacttgaaaggggctttcacataagctgagtaataccttagataccccagttttctgtagctgctgtgtcatctttgtgcagtgaaaagtcctgaagtaggaggatgatgacaggaacctctgaaggggagaaacctgaaacttgactagcaggaaaagtgacaaggagaattattatttcattgyagatagaaatactctttccatatacattttacatatagtgtttaatatatgtggacatatatacacatgggcttgtttttatatatttgttggaatacagttgtagcaagatgatggtcacttttaaattttatttaaagcaagtgtgacagatgctttaaaaagaaagaggaatctggcttaaatgtccagccaaatgtccaaattcaattataaggtggctcttgacaaaaagattagggtgtaggagaccccgtagctattcaggggatgtctagctaggagttggctcagggagag

SEQ ID NO: 49999 - DNA, 601 bp, Human
aaaagaggacatggtctttaggaacatgaatttctgcccttcccattttccttcagaaggagagattcttctatgacctcattgggggcggaaattttaaccaaaatggtgtcacccctgaacccactgcgacacgccacgtaagtgaccacagaaggagaaaagccctataaaaagagagacgatagcgctacattttgtccatctcatagcaggcacaaactcatccatccccagttgattggaagaaacaacgatgactcctgggaagacctcattggtggtgagtcctgcactaacrtgcgatgctcttgctgatttggaccagatagtatttctggaccgtgggcatgaaacgctgggttctgactatggagatccaggaatactgtatatgtaggataggaaatgaaagctttggtaggtatttaagtcattgtgcagcattttcaagaactgatacacagcagtttgaaagataagattaaaactgaaagatagctatattggggctaaaccacacaagaagtgtcacatgatgctgtgcagtaagaaagaaaatttattgaaagtctgtttttctgagtacaaaggatttaat

SEQ ID NO: 50000 - DNA, 601 bp, Human
aacccgttaaaaatgcaaaatgagccgccgaggcgcgcccaggcttcgcagaatcgcaggggaaggtgggcgtggaagcagaggcgagacctcagaaataatgggtttccccctgccttgttggtttcagcccgaccggcaggccaggaaaccacctgagctttgtttgcggactgttgggctgcgcgatccgggctcgggggcgcctcggcctgcgggcagggcccggctgggcagggcggggtggcccggcgactccgcccctcctcgcctgcctgcgcccaacgcggcgcggtggagrcacagcgccccctgccggtgccaaaggcctgggtgggcgcaggagctcggagggccccgcgcgggcgctcctggctcgagtgctgtgatccccctgggaattcctggtattttgaagaggcctttatgtatttagggcgaaagagggatgtgaaacgtaggcgcgaaccaccagctctggctctgtgccttcttccaaagggcgtttgctgtgtcaactagtccctggcaccttttttcccccaagcccccgataaagcgagggctggcatggttagcctttgcttgctacgtttcggac

SEQ ID NO: 50001 - DNA, 601 bp, Human
gaatccttgtccttcctcttgtttccacctcttcaagattgggccaattgcaatggaatatccattggttgtgaggcctttgtactctgcaaggaaaagaaaagaaatgtgtgtatgtatgagtgtgtgatggagctaacttttctacaatgtctactaacatgtcctagcctttacttcattcgcctgtttccttctcacaaaaaccctgtatgggagtttttctttactttttattattatttttttgagacaaagtctcgctctgtctcccaggctggagtgcagtggcgctatatcrgctcactgcagcctccacctcccgggttcaagcgattctcctgcctcagcctcctgagtagctggtactacaggcgtgcaccaccatgccactattttttgtatttttagtagagacggggtttcactatgttggccagactggtctcgaactcttgacctcaggtgatccgcccgcctcggcttcccagagtgctaggattacaggcgtgagccactgcgcccagccaggagtttttcttatactcattttacagatgagaaaactgagactcaaaaaatacaagtgacccgtccacag

SEQ ID NO: 50002 - DNA, 601 bp, Human
cactttattttaagatacactgctaaagagccctccaaaaagactaaaacctatgcccccactagcaatatgtgagaatgcatattttcatacactttgaatattatcaaagttaaaattttttgataatctcataggtgaaaatggtatttagttatagtaatatccattttcctaattattattagtttcagatattttctgtgtttactggccacttgtgtttccactttggtgaatttcctttttgtatcctttgccaatttctctcttgggttgtttatcctttctgtttttattwataggaatcgtttatatattgtttgtactaatatttttggtgttatttatgttgtaaatatttttatccatttttatatatttagctttgtttgtgatgccttaacctctgtcttacatttcaacgttctcaaatgtattcttttcctatttacttcttatttaataaagtccttctcaatccccaaatccataaagatcataaatatattttctcccaataattttataattttcagtctttaatccatctgagatgtattttccaagaatgattcataaagatgtctttatttttacc

SEQ ID NO: 50003 - DNA, 601 bp, Human
tgctcattcagatgtgagttcaactggaatgaaaggactgagatggcctcactcatgtctggggtcttgatgtggccgtcagctgggatagttggaagagctggacttctttctccatgagatttttaaatctgagatatctgcaaacagtatggcaatctcagggcagcattctttcttagatatggaaaacagaagctacaaggtctcttaaagcctggcttagaagtccccaacctcacttccaccacattctgttggtcaacgaatttattagaccagctcaggtccaagggctagygaaacagactttgtgcattgatgagaggtgtggcaaactcacattgtaagagcgtgtggaaaggaagcaattgtggtggccatctttgcaaacaatttccatgagtaagaggcataatatttcaaagatccaattaagtatttgaaaaaaaaaatgacaagttagtcacggagaaagcattcaacaaatagcttcttgaccattttgactaatgtacataatgcgaaaaaagaaaaaacaaactttcctgattatgaagagtgaacattaagaagaccaaacaaccacaacaacaaaact

SEQ ID NO: 50004 - DNA, 601 bp, Human
aatctcggctcactgcaacctctgcttcctgggttcaagcaattcttctgcctcagcctcccaagtagctgggactacaggcgtgtgccaccgtgcccagctaatttttgtatttttagtagagatggagtttcaccatgttggccaggctggtctcaaatccctgacctcaggtgatccacccacctcagcctcccaaagtgctgggattacaggcatgagccactgtgcctggcctgtcatagttcttgacaaacaagtcatatttcttgctgctaatgggcacaaacaaaactgaggktgattagtttgaatatcagtataagttgatcatagatatgatccagagaatgctattattaaaaatttaattaaaatgttaatttaaatattaaattttattttaatctatcactaaaaatctatgtagtggttactaagatagtaataaaaattgtttggttcttatagagcactgtcttcagaatgatgtggtccaatggtcatattggctcgcagccatccttgttggccatatgttgtccttgacgtgtctctggattttcggaagtatctatttattctaaatctgtatttctgt

SEQ ID NO: 50005 - DNA, 601 bp, Human
actttgcagaccatatggactgtattgcaaccacagtacttaactctgtactgtggctcagaaaggagccatagagagcaagtaaacaaaagggcaaatctggtccttggcaggctgggttgggtctgagagtcatagtttgctgatctctgcagtagagtaacagtaataatatgtagcactgctttgcatatctttatatcaaactgtatgtattattctgcaacctgattcttttgctcaatatgatgtttccccatttattcatatgaatacatctagttctagttcattttattttattttattttttaattttttttgagatggagtgctctgttgcacaggctggagtacagtggtgcgatctcggctcactgcaacctccacttcctgggttcaagtgattctcctgcctcagcctcccgagtagctgggattacaggcatgtgtcaccacccccggctaattttttgtatttgtagtagagaagggatttcaccatgttggccaggctggtctcgaactcctgacctcagctgatctgcccacctcggcctcccaaagtgctgggattacaggtgtgagccactatgcccag

SEQ ID NO: 50006 - DNA, 601 bp, Human
attttaaaaatactttagcttaaaaataaattttaataacttttcagaaaaacagtggatgaaggaatgcttaaagttggggttttattaagttaacaaactattaattgagactgattaggctaacagagggggcagctggctaatctatcctgcatccaccctatccctcttccaggacaggggtggggaatgggggagtcagggggaaggtagggaagtgatcatgttcaaatcagatctttttcttttctttacctgctctgattcttcttcttcttctttttttttttttttttttgagacgagtctcactctgttgcccaggctggagtgctggagtgctggagtgcagtggcgtgatctcgagttactgcaacctctgcctcccaggttcaaatgattctcctgcctcagcctcctgagtagcttggattacaggcacctgccaccacgcctggctaatttttatatttttagtaaagacggggtttcaccatgttgaccaggctggtctcaaactcctgacctcaagtgatccgcctgtctcagcctcccaaagtgttgggattacaggtgtgaaccactatgtctggccttt

SEQ ID NO: 50007 - DNA, 601 bp, Human
gtgaaagacattagatgtcaacccaaaaagtgtgttgaaggagcatattgtttttcaagggtctttcaaaggttaaaattctcaacctataacatgactccttttatggaagggaggatttgaaggaaaaaagactatagagctaaagtcaagggtctcctgggagttcttcttttgcagttccttccccaaaatgaaagtgaagagtattagagaaagaagagcaccaaagtaaccgtaattagacaaataatgtatatggaaactcttggcaaataggctaaagttgctaatcccagtragaagctgttaagaggtaaagaaaatctgactattatgagatgtatttaattaagtgggtttatatccccaaggtaatctttacatttattcatagtttacctctaacactactttgattgtttgaatcccttctgttctttgtttcaggcagggattaacatactttttgtgtaaaaggctagatagtaaatatttttgggtttctgaaccgtgcagtcttgtgttgcaactactgtactcaactctgctactgcagggagaaaagagccatagatattccataaacaagtggctgtgg

SEQ ID NO: 50008 - DNA, 601 bp, Human
gagtgattctcctgccttggccttccaaagtgatgggattacaggcagtagccactgtgcctagccagaaactcaacttttactggcttactcttcaggacctcccgctcctatcagagcctccctccccgacaacaccccagttatttcaggagtgccttggggtctcttcatgtttataactaagtctgctctggctgttccttccactccattttgtgtccatggggcagagcagtgcccaaccagtagtcatgattcctctgctgggcacctctgctgcccagccctcttgggttcrgagttccactgtgatatatggcatagttgtttgaggatgagggtgaggttgaagtgagttctctctctcttctgcttgttgcattggacggatctgccttatacctcaatgtttccagacttcatttttatttacaacccttttcttctcacctctgggtggtaggaaggtctcctgaatctagtatgggttggtcaaacacagctacactgaaaattacatatgtctctaatggctaaggctttcctttggggtgaagttcatggtccctagctctctatgagtttagaatggattttc

SEQ ID NO: 50009 - DNA, 601 bp, Human
ggtgacttaatggtactcacttggtacacggctcaacaagtccttttaaggtggtcctgggcatggtccccttcactgcaggttattataaaggtcataattcaatgacaactttaaggcatttagaaggtgacctgaagacaaatacagacaagcactcactactgggtcctggagacaataatgaccttttcagtgataacttgcagcttcttctagaggtgaccatgggccccttactcttcaaaggctttgcttaaggtgaaggggaaatttcttcacccctgtaatgtttattccraaaagcagagcccaaatgaggacttgtgtgaaggcagtttatgtgagacatgatgagggagtggaggcgagggagtgggcgatgcaacagggaaggagggaaaaccaaagaggtcagttgtcaagatccctggtgtgggggaggccagcttgatgccactgggagcagcacagagaactgtcagcagaggggtcagggactggagcatatattaatattaactgcccctcggctcccgttggttgagcgtcaccccagggggcattaattccccgcacttctggactgtttttgagctca

SEQ ID NO: 50010 - DNA, 601 bp, Human
gacaactttaaggcatttagaaggtgacctgaagacaaatacagacaagcactcactactgggtcctggagacaataatgaccttttcagtgataacttgcagcttcttctagaggtgaccatgggccccttactcttcaaaggctttgcttaaggtgaaggggaaatttcttcacccctgtaatgtttattccaaaaagcagagcccaaatgaggacttgtgtgaaggcagtttatgtgagacatgatgagggagtggaggcgagggagtgggcgatgcaacagggaaggagggaaaacmaaagaggtcagttgtcaagatccctggtgtgggggaggccagcttgatgccactgggagcagcacagagaactgtcagcagaggggtcagggactggagcatatattaatattaactgcccctcggctcccgttggttgagcgtcaccccagggggcattaattccccgcacttctggactgtttttgagctcaggccaagctgtctcctgtgggattagagaagttctgggcagaaagcataggaacgtgcggcatgctcttgaaatgacaggtggtcagcctgcagtcatcatctgag

SEQ ID NO: 50011 - DNA, 601 bp, Human
ctgtcctctctcactccttacctagtctcattttcagtggctgtgaataagctaagaatggtaatgcagtttcaggggttagaaaatccaattcaaattagtcctcactgcagctgtacgccgtcaggatttttcatggaaatgatgagtatgaagcccgcgaaaggtaggacactgttcacaggtgctttcaggtcgagctcttgcaactggactgaggaaatctggggactttggttggagatgacagtaacagatgtctgtcaaagatagtggctcagtcagacccagaagactggartgagagtttgggttggggtgatttttatagggttctaaacagacgaatatcttatggggatgaaatccaaggatgtttcccctaatattcttcatagactcttatgtcaaattatcactattcttccaaaccaaacattagacaattctaatattaatatcaatggacacttgaaaaaacattttaacagacattatttaatgcagtgctcctaaaatggcaagtctcagttcccaggggatcacaaaatttatttagtgtctcgtgaccagcattaaaaactggattagaatataatag

SEQ ID NO: 50012 - DNA, 601 bp, Human
gttggggtgatttttatagggttctaaacagacgaatatcttatggggatgaaatccaaggatgtttcccctaatattcttcatagactcttatgtcaaattatcactattcttccaaaccaaacattagacaattctaatattaatatcaatggacacttgaaaaaacattttaacagacattatttaatgcagtgctcctaaaatggcaagtctcagttcccaggggatcacaaaatttatttagtgtctcgtgaccagcattaaaaactggattagaatataatagaatagaaatatyagtgtccctcaaggagtaaagacaagtggtatttcatgaaattttgtttcagttacatgtgtataagtatgtacgagggatatgagataaaatgtatctaaaaccgtaggttgtggtaaaaaaaaaaatgaaaagagtttgggaaacacgaattaatgaagtagtttcacagcaggtttctcccaatagtccatgaaaaatcagataagcacagagttgagctttaggcccaggctcttggttttctctgaattaaaacatcgattataattaaaacacagtataatgtaaatcatattt

SEQ ID NO: 50013 - DNA, 601 bp, Human
cagactcccctggagtccatccatgtgttctcatttaagaactcgtccctaaacttccatggagaaccgtcacaaaggaatcctaattctcatactctttgataggctaattccaaaataaagattcctaaatctaaattttaatatgtattttcccttttaaattgtatcaaaatagaaataaatttaccttttcagaaagcatactctaaattaaagtcgaactacctctactccctccacatcttattttctgccaatgttgtatttgtttacttgtttacttatttttgtcctaacscttgacatccccacttcccaaaacacacaaacaagagaaaggctgggccttcgtatgtgtcttttcactttcatatgttcagaccctaacacagtgactgctaaatagcaagtgtttataacacacacacacacacacacacacacacacacacacacacagagagagagagagaacatgagcatatgtttataaataataatttgtaatgaaagaactatcctaatacttatatcatcaagacagactgtgttaataattacttattaactatcaattaactatgattaaaatcaggat

SEQ ID NO: 50014 - DNA, 601 bp, Human
gaagtttgcctttgccattttgtcaaagctttttttttttttttttttttttgagacagagtcttgctctgttgcccaggctggagggcaatggcatgatctccactcactgcaacctctgcctcctgggttcaagtgattctcctgcctcagcctccccgagtagctgggcttacaggcgccctccactatgcccagctaatttttgtatttttagtagagatggagtttcaccatgttggccaggctggtctcaaatccctgacctcaggtgatccacccacctcagcctcccaaagtkctgggattacaggcatgagccactgtgcctggcctgtcatagttcttgacaaacaagtcatatttcttgctgctaatgggcacaaacaaaactgagggtgattagtttgaatatcagtataagatgatcatagatatgatccagagaatgctattattagttttttaaagactggcataaaataaaaatgtaaaaaataaatttaatatgtgtaaaggccttagaaaaaagtgtggcacatagtcaaaactcaatagatgtctattgttattattgttatggtcctagaattgatttaca

SEQ ID NO: 50015 - DNA, 601 bp, Human
gtgtatggatagatttgcataagtataaatacagtatatgtacccatatttaaatgatataatgataatattgtgttgctattcagagtgaaagctaattaattcagctattgagatgataatgatttctttttcagttaataccagagtcaaaaaaccctgcagaatggttctacgcactgttcctttgactcatcttggaagaaagacctttattctgttaactattaagctgtctatcagtatctatgacagttttaaaggaaatcattcctgggaggggtagaagattattagtagraaggctgactcatgtaggctcaagtggacattgaggtcatgatttggtaccaggaaagaaaaagtcctctttttgcttttagtctcttaaaatgcatgctttggtatttgcactctcaatatcaacactgatctgcagcacaaagtctttttttagactttatttggttggatttgacatttagaaaaatgttaagatctttcctactgaaatttacaccagctgaaaaattcacaagcaagtccatgactttcttaaccttgacatctctaacttttccttcagcctctgttttcatat

SEQ ID NO: 50016 - DNA, 601 bp, Human
ttatggggttatcttaggtccatgtgaagagaaccacatagagtgacctcagtgtaaaaattgtggagtgaatcgccagattcctagatgttgaaggagacacataccatgggctagaatagatatgtatttgccctcatcaaaaaagttcagatgaggctgggcgtggtggctcatgcctgtaatcccagcactttgggaggctgaggcgggcagatcacttaaggtcaggagtttgagaccagcctggccaacatggtgaaaccccatctctactaaaaatacaaaaattagtcggccrcggtgggcggcgcctgtcatcctagctgctccagagggtgaggcaggagaatccattgaacctgggaggcagagactgcatgagctgagattgtgccactgcactccagcctgggcgacagaacaagactctgtctcaaaaaaacaaaaaacaaagttcagatgaaagtatcccgaagatgagaggtctctaaacaacccaacccaatggagaaagagacaactttgaaaacttgctatgcacaaaccagcttacagaaatactaggcgagtaactgccttcctgtcatttcttctctta

SEQ ID NO: 50017 - DNA, 601 bp, Human
aacaatgaaagaggaacttaatttactatatgctaattaaactgaaggcaagctcaataaaaaactggattatataagagtaaaaactgtggaggaaagaactggaaaaaggagatatttttggttatttatgggaagagattttttaagttcaaatggtcagttggttttgaatcaagaaataattgaagacaaataaaaaccttattcataagaaggtagcttatctgaaagcaatagcaatatcttggcatctcttaattcccagtgcctagcctcgttcctgagggagcaagtacarttagtgtgtgttcaatgagtaaagcagaaggaaaaaatttaaaatatggaaagaaataaaaggcaaaaacccttgagaaggaaaaaaattgacaataatgacagagatagcattattacaagtagtaacaatagggatataataccagtactgaagggatattttgtgaaaaactgaattgaatcattccattcagtattcattgagcacaacctgtgccaggcactgtccaaggtgctggagtccctgagggcaataagacagggcccctttcctcaaagaagctcttagattctctcg

SEQ ID NO: 50018 - DNA, 601 bp, Human
aacacataaaaacctgatctcgcaagatgacctttcagactaactttttattcttatgctaatacaatcattcttatttctattatacatttaattccagagtaacataatgctcaaagttactctgtttatgcctatgcaactctttaaagaatatgatgtgaaatctcttttcttgttcttcaaattcatactcttttgtttgctgttattaaatcccaatcacatacacaaagataactgtctctgagatgcttttaatgagaattagagtatttatgttaattgaggctttagaacrtatatctgatataatttgtgcttgagttgtttctatacaattctagtgcatcattgattttattcctaatgtaccattacttacaaactaggggtttaagttggaattgttaataaaaataggaataatcatagtatataaaatattatagactgaaataggtttgctaacactgaatgagtttatattttgttttgttttgattttttttgagacaaagtttcattcttatcgtccaggctagagtgcaatggcacgatctgggcttactgcaacctccgcctcctgggttcaggcaat

SEQ ID NO: 50019 - DNA, 601 bp, Human
ataagcagttgttagcaatttcaaattgctttaagtcagtgatcaaatgaatagacaatgaagtcagagaaaggagataatcttgttagggtgatgaagttgtagcccttaatagtaccatactaaaatatactgtgcttatttttgttatatgatttcactgctttagccttttcagcttgcacaaaatgaaaacagttaccagaactatgttttccaaagatgcaaatctaagctgattatcagttcagatactgtctttgagaggggttagaaatgtaaagaaacaaatgatagactrtttataagaagggtaaatgctttagttaaatttagaaatcttaacacctctacttttgcttttgaaagtggtcacatgctaacttttgcatgggcaaatttaggactcaaattataggaagaaaccttccttggattaagaggaaacattaaagaaatacaagtgaggttatttccattgcccctaggcagaatccattgttcctcagctgtatttcccaagctttttgtacttgctcggttttagatattatgtatttatttatgtcaagtcgccccttggtatccacagaggattggt

SEQ ID NO: 50020 - DNA, 601 bp, Human
tggggtttcaccgtgttagccaggatggtcttgatctcttgaccttgtgatccgcccgccttggcctcccaaagtgctgggattacaggtgtgagtcactgcgcccggccgattcccactcttataaaatgtatatggtatttcacactccagtgagaaggagagatatgaattgtgataagttgcaatagaactgaacctagaaaaggaagtaactaattctgcttctctgtgacagggaaagctccatagaggaagcaaaatttgaacttggccttgaaccatggatggggtgccttaktctaacagggatcctgccttgtatttcaggaaaaagcatgaagacataaaaagtgtatcccacttgttaggggagctgtcagaatgctcttggccgatagctacagaaaataaactcattatggcctaaaaaagtaagaaaatgtatgagctcaaacaagaaacccagaggaagggtgacagcagaattggttaatttaggggcagaacccaccatcggaaacacagatccatctcatctttctgctttgctatccttggcgtattgaccttccccacaggctggttctcctcctggtca

SEQ ID NO: 50021 - DNA, 601 bp, Human
aaaatttgaacttggccttgaaccatggatggggtgccttagtctaacagggatcctgccttgtatttcaggaaaaagcatgaagacataaaaagtgtatcccacttgttaggggagctgtcagaatgctcttggccgatagctacagaaaataaactcattatggcctaaaaaagtaagaaaatgtatgagctcaaacaagaaacccagaggaagggtgacagcagaattggttaatttaggggcagaacccaccatcggaaacacagatccatctcatctttctgctttgctatccttrgcgtattgaccttccccacaggctggttctcctcctggtcatctaatggccacagcagtgctaggcactatgtctgggcacaacactggtcaaaggaaaaagaaatgctgtcttcctcagtatggaaatctttcttaggaacttcccagtagactcccctttagtctcatgggcccaaatttcactgctgtccctaactacaccaacctctgatgtgggaaatgagaccaacagtggctggaccttgggctggagctgggatttgcctctaccatagtgtatggccatggggcagggagg

SEQ ID NO: 50022 - DNA, 601 bp, Human
tgttcccaattacgactagaaagctaattaggaaataaaaacttttaacatttaaaacacctaaagcagtatagtgttaattctatcaaatggttattctctcaaagaatatttctgatcattgaacataatttattaatcacagacctctttttaaaaaagggaaaacaaataggaaacaggagcagaaacataacattatttttgcattttcagacttttccatggcaaagtctttggtagttaagttagaaaatagcccccccttgtgaccaaaaatcaggtaattggtcattcaagygaaaatgaagcaaattttaagcaattctccaggaagaaggaagcaggaaaacaggaaaaggctgtccccttcaggatgatgttagtgttacatctccagtgttagaaattgctggttcacaagccctttgtttatgttggcatggttaactctgattgttgactctaattccaaaagtagatttatatttatctatcttgtaggaaaattattttttaactctcccattatttcttttttacattttctctatattcactcttggcttttacaacatgcacaagatgaaataatcatttt

SEQ ID NO: 50023 - DNA, 601 bp, Human
ataattctctttataggctgggtgcggtggctcatgtctgtaatcccagcactttgagaggctgaggcgggtggatcacctgaggtcgggagttcgagaccagcctgaccaacatggagaaaccccgtatctactaaaaatataaaattagctgggcatggtggtgcatgcctgtaatcccagctactcgggagactgaggcaaaagaattgcttgaacctgggaggcggagtttgcggtgagcctagaccgtgccattgctctccagcctgggcaacaagagtgaaactccgtctcaaaraaaaaaaaaacaaaaaacaaaaaacaactctcttttaaagtacaaaataattcatcaccttcctttattatttacccattatttcatctaaatgtttgtagctaagattttcttaaagcaggttacccatgattacagctgcctgagaggcctgtctcgtggcatgtatatatgtttcaccaaaggcaatttgggaatgtgtgttggatcaagattcagataatgtagacttgggttttccatttattatgccagtaaacttagtcaactcagattacccattctgagccttactttctc

SEQ ID NO: 50024 - DNA, 601 bp, Human
tataggctgggtgcggtggctcatgtctgtaatcccagcactttgagaggctgaggcgggtggatcacctgaggtcgggagttcgagaccagcctgaccaacatggagaaaccccgtatctactaaaaatataaaattagctgggcatggtggtgcatgcctgtaatcccagctactcgggagactgaggcaaaagaattgcttgaacctgggaggcggagtttgcggtgagcctagaccgtgccattgctctccagcctgggcaacaagagtgaaactccgtctcaaagaaaaaaaaaamaaaaaacaaaaaacaactctcttttaaagtacaaaataattcatcaccttcctttattatttacccattatttcatctaaatgtttgtagctaagattttcttaaagcaggttacccatgattacagctgcctgagaggcctgtctcgtggcatgtatatatgtttcaccaaaggcaatttgggaatgtgtgttggatcaagattcagataatgtagacttgggttttccatttattatgccagtaaacttagtcaactcagattacccattctgagccttactttctcaagtctgaaat

SEQ ID NO: 50025 - DNA, 601 bp, Human
ccccgtatctactaaaaatataaaattagctgggcatggtggtgcatgcctgtaatcccagctactcgggagactgaggcaaaagaattgcttgaacctgggaggcggagtttgcggtgagcctagaccgtgccattgctctccagcctgggcaacaagagtgaaactccgtctcaaagaaaaaaaaaacaaaaaacaaaaaacaactctcttttaaagtacaaaataattcatcaccttcctttattatttacccattatttcatctaaatgtttgtagctaagattttcttaaagcagkttacccatgattacagctgcctgagaggcctgtctcgtggcatgtatatatgtttcaccaaaggcaatttgggaatgtgtgttggatcaagattcagataatgtagacttgggttttccatttattatgccagtaaacttagtcaactcagattacccattctgagccttactttctcaagtctgaaatggggatagtaatactggcttatcagtacttcctgcacaggattgttgtacagaatcaaattcgtttatatatttgaaaaatatctacggaagggatgggtgtaattattga

SEQ ID NO: 50026 - DNA, 601 bp, Human
tgtaagatagagaaaaatgagagctgtgtccatgcatgttagaagtaatttttttcctttttgtattcattttattttaattttttttacattttattttagattcaggaggtacatgtgcaggtttgttacatggtgcgttagtctgttttgcattgctataaaggaatacctgagactgggtaatttataaaggaaagaggtttatttggttcatggttctgcaggctgtgcaagcatgacaccagcatctgctcagcttctggggaagccccagggagcttttactcatggtggaagrtgaagggggagcaggcatgtcacatggtgagacagggagaaagagagatgctaggctcttttaaacattcatatttcacagtaactaataaagtaagaactcattcattaccatggggagggcaccaagccattcatgaggggtctaccccaatgacccaaacaccttccaccaggccccatctccaacactgaggattacatttcaacatgagatttagaggcaaaaaacatccaaactatttcacatggatatattgtgtaatgatgtgatttggacttctggtgaacgcatccctca

SEQ ID NO: 50027 - DNA, 601 bp, Human
gcatctgctcagcttctggggaagccccagggagcttttactcatggtggaaggtgaagggggagcaggcatgtcacatggtgagacagggagaaagagagatgctaggctcttttaaacattcatatttcacagtaactaataaagtaagaactcattcattaccatggggagggcaccaagccattcatgaggggtctaccccaatgacccaaacaccttccaccaggccccatctccaacactgaggattacatttcaacatgagatttagaggcaaaaaacatccaaactatttcayatggatatattgtgtaatgatgtgatttggacttctggtgaacgcatccctcatccaaatagtgaacattgtacccaataggtaatctttcaaccctcaccttcatcccaccctcccgccttttggagttgccagtgtctattatttccatttgtatgtccatgtgtatccattgttcagtgaggacatgcggtatttgattttctgcttctgagttatttcacttatgatactcttctaacagtgagaatttaggctttctggtaagtataccttagatgataattgtactctttagcg

SEQ ID NO: 50028 - DNA, 601 bp, Human
atgtccatgtgtatccattgttcagtgaggacatgcggtatttgattttctgcttctgagttatttcacttatgatactcttctaacagtgagaatttaggctttctggtaagtataccttagatgataattgtactctttagcgtctggaatcaaagtttattctggtttgctcagccaaagctctttaactctggatctggtttggaagaaatggagcagtctattctcatctggaccaatcccaggaaacatcctcatctcaattaatccataagtcacatcacaggtttttgtgttkgttttgttttgtttttctgtcaccacgattctccatccaatggctcttgtggaataaagcaatgcacagaagtggcactaagaagtctgttttttttgtttttgtttttgtttttagagatagcatcttggcccgggcgtggtggctcacgcctataatcccagcactttgggaggctgaggtgggtggatcacaaggtcagggtttcgagatcagcttggccaatatagtgaaaccctgtctctactaaaaatacaaaaaaaaaaaaaaaaaatcagccaggtgtggtggcacacacct

SEQ ID NO: 50029 - DNA, 601 bp, Human
tcatctcaattaatccataagtcacatcacaggtttttgtgtttgttttgttttgtttttctgtcaccacgattctccatccaatggctcttgtggaataaagcaatgcacagaagtggcactaagaagtctgttttttttgtttttgtttttgtttttagagatagcatcttggcccgggcgtggtggctcacgcctataatcccagcactttgggaggctgaggtgggtggatcacaaggtcagggtttcgagatcagcttggccaatatagtgaaaccctgtctctactaaaaatacaaaaaaaaaaaaaaaaaatcagccaggtgtggtggcacacacctgtagtcccagctacttgggaggccaagggacggaggttgcagtgagccaagatcacgccactgcactccagcctgggcaataagagtgagattccatctcaaaaaaaaaaaaaaaaaaaaaaaaaaagagacagcatctcactttgtcacacagactggagtgcagtagcacaatcacagcttactgcagcctcaacctccaggcttaagcgatcctcccacctcagcctcctgagtagctgggaccacaggcatgt

SEQ ID NO: 50030 - DNA, 601 bp, Human
gagcacaacatgtacaaaaactgggcaatgtgaattgtttagggaactacaagtggccgaggtggctagaggaaaggcagtgtgatagagtgatagagtgcagcttagccgtagccactgtcaggactttggagcctgccagctttggtttgaaacctagttccacctctctcagccgagtgcctttgggctagttatataacctctctgtatctacctcacggggtttagaactattaaatgaattatggtatattaaatgcttaaaatattgcataatacataatgagtactcctactrttactattgttattgtgaatagttagataggcaggggacaggtcctagaggctcctacgttaaaaggaagaaaattaaaactatatgcctaaagccatggggaggtttagaaggtttttgtaagaagtagagagaaagtatgtgatctgatttttagaaaggtcattccaatgagaggtgacagcgtgctggcagtcctcagagccctcgcttgctctcggcacctcctctgcctgggctcccactttggcagcacttgaggagcccttcagcccaccactgcactgtgggagccccttt

SEQ ID NO: 50031 - DNA, 601 bp, Human
acttacctgctggcaaggctgagcaattcatgtttatctgcaacagctgacttcttttcaagttcccacattaggacattgatcagatgtgaatttttaattacaatcggcacttcttcaaacatgtactcaaaggtgatatttgcttttttcaatctgtgaagcatgttaaaaatactttagtctgatggtcaaaagtaagtgctaaactgactacttcataaaatttacctaattacaggccctatccaagatctttgtttcattagcactcttaaaaaaaaaaaaagtagagaaactrgagttttacagagtcaagcataagttgagtgatttgagtaactttgaaaatgatgcgaatttgagctaaagcccagaaaatgagattcttggcagaagaaactactcattctttgttatcaggtatctttaaaatttcactgatactaaaatgtaaatgtcacagtaagttatgctacacaacctacacctacaacttaatttaaaatagctagaaatgagaaatactctatttcttgaaaagttcatttaaaaagcctcttgaattagagtttaacaagtagcagaacacaaggagact

SEQ ID NO: 50032 - DNA, 601 bp, Human
acatagtgacatcaaagtcttctgtgactttggagggaggtcttactacatataatgggtggaacaccacaaactgttgacaatcactgggaaatcagtgggaaatgaggaaacagtgacatcaaaattctatcgagaagtttgattatgaaacaaatagaaaaatttagcagaagacaaaaggagatggatactaaaggcatgagattaaaaggtattcttttcataagtttttcttttgagatggggggatgtaaacaagtttaaatgtctttgtttttaggagatgcacgcattttaraagtatttaggggttaaaagtcatgtctacaatttactttcagatggttcagaaagaaaaagtgtttacgtacgtagatagagtgcaaatgtggcatgatatacaattggtgaatctaaatgaaaggtttatggatggatgttcactgtatttttctttcaaattgtctaaagagttgaaaatttaaacataaatttttaattggaaaaatgagcctataaagattgaaaaaaaaaaactagtatagaaagaaactgaaaatctatgaagaaggaaggagtagatcaacctaatgaggtc

SEQ ID NO: 50033 - DNA, 601 bp, Human
aacctcaagaaaatcaggaagttttggctctttctcaaataatggaaggagcatagaactaaggtgtatgtgagtaaatttatcttttaatcccagcctggcactacctagataaccttggtccagtaacatggtctgatgacttcacctgctgaggaatcaagtgcttctttcatatttattttgttgtgttgtaattttttaaatcacttttaacttcaaaacatttcttcttctctggatacaatgtatttgcttctgttttaccctaatttctaaatagttgatttaaattcactcmgacttaagtattagaattgggcaagactgaggaaaagagaggcagacaacggtcaaagtgcaatgacttaaaaacatactacaagtctggaatctgtcctaaggacagtgggaaaccagctaaagattttaagcaaaggagtaatatgagcatctaatttgcatttagcaagatcattacaattttgaaagaggaaaaggtcaaaaaacaggaagtgaggaagctgtgaaagtaatgaggaagagaaataaggtcctagactaaggcagtaagtcacaggagtaagacaaaatcgcccca

SEQ ID NO: 50034 - DNA, 601 bp, Human
aaccttgaaaacatttgctaagggaaagaaggtagacacaaaaggctgcttattgtaggactcttttcttttttttgagacagagtttcactcatcatccaggctggtgcagtggggcgacctccacctcccgggttcaagcaattcttgtgcctcagcctctcgagtagctgggactacaggcatgcgccaccacacctggctggattttttgtattttcaatagagacagggttttgccagaactcctgacctcaagagatcctcccacctcggcttcccaaagtgttgggattacagscatgagccactgttcctggccaggactccattttataaaatatccagaataggcaaatctgtagagatagaaagtgactagaggctgccaggggttaggggaataggaatgacagcttaatgggtttgggttcccgttcagggtgatgagaatgttctagagctagtaatggttgtaaaacattgtgaatatactaaaaatgactaaagtgtacatctgaaaagggtttaaatggtcaattttttctctatattaaaaactgcacctccagcaaataatctatcgtgatattacagagag

SEQ ID NO: 50035 - DNA, 601 bp, Human
ttcacctttactcctattgacctaaaataacaatacagatgatgttattactgctatgttcactactgttacggctttttttcttttcttttcttttttttgacacagagtctcattctgtcacccaggctggagtgcagtggcacaatcttggctcactgcagcctccgcctctccgcctccccgcctccccagttcaagcaattctcctgcctcagcctcccgagtagttggggttacaggcgcccaccaccacacccggctaatttttgtatttttagtacagacaggattttaccaygttggccaggctggtctcaaacccctgacctcgtgatccacccgcctcggcctccccaagtgctgggattacaggcgagagccaccactcctggcctattgttactattcttaacagataattgtctgtaccttagctctataactaaagatggataatattaatagctcagataatgcttcaaatactttcaaactctggattcctatgattcgctgaagagaaagcagggatatatataaactttaactataaacttatagatcaactacaataagagctaacagctatgactgctcc

SEQ ID NO: 50036 - DNA, 601 bp, Human
taaggagttttctcctacgagccagacagagtaagagtaaagagttcacttgaagaaagggctccatcattgctttttatgtctttaatgatctaatcccatgcaacagttacatcagttacatacttcttcaaaatataaggatctcaattctgtttgaattggacctttgggaaggaattgtgtctcatttccaaatttaatttgtatgtacactagaaaatgttaaggaatttggaatttcctcccacattacaaatgtatcaatataatttgagaaattgccaatcagcttttgagwaggattttcactttgataaaatcttctcacaggtaaggatctgactgaatcagatggcatttaacatttctataagattatagccaaataagggcatgaatgtcatatattcaaaatcaagtcctagtacaggacacaggacctctcctgcttaaaggtggtattaaacattaagtataaccagaaaaagtttatccggaaatacatttgtgctgccacaatttaagtccaagtaagggaaataatttcctaaattcaagtcaagtacccactgtacagtgctgtgctggaaaaggaaga

SEQ ID NO: 50037 - DNA, 601 bp, Human; identical to SEQ ID NO: 25068

SEQ ID NO: 50038 - DNA, 601 bp, Human; identical to SEQ ID NO: 25069

SEQ ID NO: 50039 - DNA, 601 bp, Human; identical to SEQ ID NO: 25070

SEQ ID NO: 50040 - DNA, 601 bp, Human; identical to SEQ ID NO: 25071

SEQ ID NO: 50041 - DNA, 601 bp, Human; identical to SEQ ID NO: 25072

SEQ ID NO: 50042 - DNA, 601 bp, Human; identical to SEQ ID NO: 25073

SEQ ID NO: 50043 - DNA, 601 bp, Human; identical to SEQ ID NO: 25074

SEQ ID NO: 50044 - DNA, 601 bp, Human; identical to SEQ ID NO: 25075

SEQ ID NO: 50045 - DNA, 601 bp, Human; identical to SEQ ID NO: 25076

SEQ ID NO: 50046 - DNA, 601 bp, Human; identical to SEQ ID NO: 25077

SEQ ID NO: 50047 - DNA, 601 bp, Human; identical to SEQ ID NO: 25078

SEQ ID NO: 50048 - DNA, 601 bp, Human; identical to SEQ ID NO: 25079

SEQ ID NO: 50049 - DNA, 601 bp, Human; identical to SEQ ID NO: 25080

SEQ ID NO: 50050 - DNA, 601 bp, Human; identical to SEQ ID NO: 25081

SEQ ID NO: 50051 - DNA, 601 bp, Human; identical to SEQ ID NO: 25082

SEQ ID NO: 50052 - DNA, 601 bp, Human; identical to SEQ ID NO: 25083

SEQ ID NO: 50053 - DNA, 601 bp, Human; identical to SEQ ID NO: 25084

SEQ ID NO: 50054 - DNA, 601 bp, Human; identical to SEQ ID NO: 25085

SEQ ID NO: 50055 - DNA, 601 bp, Human; identical to SEQ ID NO: 25086

SEQ ID NO: 50056 - DNA, 601 bp, Human; identical to SEQ ID NO: 25087

SEQ ID NO: 50057 - DNA, 601 bp, Human
ctgtcctcccagtatccctggccagcagccgaagcttcagaattgtctggctgctgtgagcgtggtgtaaagtcccctgccttcctgggctctttggggatccctgtgcaggagactgcaggtctcccgttcagagtctcacttagcttggagagaaggcatctggcctttggggaacttggtcaggaagctgtgtctagttccttttgtccctttttttccttgcgttcattttgctgtacttctgtcccgaagtaaatgtcagaatcagatatgttctgtatgttggggtgtctgcagsgagatgtttgcagctgggcaagtgttaagaggagggggtgggagggacagagctggatcccaggatctttcactaaagggacatttgccagtggagggggtcaccaaactgttggagactcctccccttccctgcctccccccccgcccaacaatggacccacattgatgatacaggtcctgggtggcaggacctgaaggaccctgctaggactcccctgagaaatgcgcctgccctgtggatgccacttgtagtgtggctggtttacattgttctggttgcagattatgaaaaattatt

SEQ ID NO: 50058 - DNA, 601 bp, Human
ctcccctgagaaatgcgcctgccctgtggatgccacttgtagtgtggctggtttacattgttctggttgcagattatgaaaaattattgacttgctgaaggcggtgaaaggtgggaggggacggtagggatggaagagggaatttgaatatttgaccaggttaatgtgaagaacagagataaacccttacattaacccctcgctcggagcacctagggctgcagattaaaatcccatgggcctgccagtcaaaggcaaggccccaagctactctctcacactggcctcccacagcaatgaracagtggcttggagggtgatgcatgctttatgtgttcctgagccggtgtgcagcgggagcacccggggagaaggaaagcccagaaatgggcaaaagatgttggttccctggacggtgaaatttcccaaataggccttttaaatgtgggtctcagaggttaaccaaacaaagacagtctcggcaggaccacaccggagaggattttagcctgacttaacccactgagaacagagtcttgttcaattttatgggaatttcaacaagtaaccaatacaggcggccttcccctcttatttttgt

SEQ ID NO: 50059 - DNA, 601 bp, Human
cacacacacacacccctcggtgcactggccccttcccttccccgcctgcctgctcctctcccagcctgccagctgccctccctgctccccttcttctcctctcccggcagatccactcaacttgaacccggactctgaggcttagcagccttggagaaaccgtactctaggaagaaaaaaaagcacacaggaaagagactcctgacccttcctcaaggctgctctcgccccacctcataacactgggcgcaggcacaagctcccaaaacttcggaatctggatacattactgtcttggagsgggtgaaaactgcccagcaaagcaagccggcctctgtgcccctacccagcggcctcccgcggccggccttccctgggagcctcgcagaacccccgaccgagtctgggaacgcccgggggagacaatagctcgggcctgacgcccgacagggaccctctgcccttccttcctcgctgtcttgctcccgtccctataggatacccacccggccctgttgccatctccctggagcgccagcggtggaggcttcggaggagccggccggatgcaccgggaccccgcggggcctagttgggagcg

SEQ ID NO: 50060 - DNA, 601 bp, Human
tcgtgggcaggtgtgagcgctcgccctctctcctcccgagcctgctattttgtggtccaggacttgccatcagaacttgctttaacgcgacgagggaactcacctgtgtgcagagcgccgcgcacacatcggggctcgcgggacagggcagctgcgttagcgcagcgccgggtgtgttcgggtaggtgttgcgggcaaggaagtaggcagcggcccctgagcagccgcctcgctccggcattgcggggacacggcggggctgaggccacgagagcagggcccgagcccggcgggccgtggktacggttttcttgcactgaaaaactgaatccggcccgaagcgacgtgcactttatggtccccacaccactcggttaactaagaaaagacccgggcgaatggacctaacgcagcccggtgccgagagggcccggtccagcagcctctggggcccagtgcgcagggcactgcgggccgattgcgccccggggccaggaggcgccgagaaagcaaaagcaaaagccggcggcgggtggaggtcaagcggcccggtgcaggccggggaccggggagccgccccgggagagcagggtccaggcct

SEQ ID NO: 50061 - DNA, 601 bp, Human
aaagcaattctatgacgtgcagttggtgtgtttgagctacttctaaagctgggctttctctaccagctgtctagcaatttactaaaaggcacagcagcaccttttgtactctgaggcaaaataagacaccctgccatccactggatgactttgtttctgaagaggtttttttttctttcttctttcagtgggactgccccgttaccagcatcactctactccagtgtgtgacagaaaagatttcgtcctcaacttcaatgggatttcttctttccatccctcagctagcgggtcgtattaycaccatcaccaccagagcgtctgtcaggatattaagccctgcgtcatgtgaacggaaagaggccaagcgatggccgctctctcctctcccctcctcagagggggcagatagaaactgggacggattcaagtcacatgcacgcggatagcagtaagccacacacctgccacttagccagaatgcccaggatcgcgttggtcactgttatttgcctactgctggaagaaggacaaccgctggcaaggtagcgttccccaatctgaatacctgcaggctcccacatgagggagagggcagact

SEQ ID NO: 50062 - DNA, 601 bp, Human
agcctcttcttgttgcctagctgagtgggagagtcattttccccagacactacatttggatacaggtgccaaagaacattattaaggaattatttagaaacaatgtgtctagtttaagaaagtggttttcagtattgtgacaatacaacgtttttacaaggttgttttctaccaccatattttaaagatatttttatgaccgtgtatactcacactttgcttgtattttaaaaggaggatatatttgcacttatgtatacttttacagtttgccaaaatattttgttgtaaaattttttttcaataaaatgtatataacaaatagttgttttaggggctgattttctcttcgggcaccctgagagcaatggatgccagtttctcctccccggcaggcagctgtgcaactctacccacaccccctccagtggtgtaactgacatggtgtggggtctgtgccttgagtaacacaggccaggttctgattgtgagtcttctcaggagaaaaacagtggaagaaacgttttctgttatttctttctttacttcaccccagctttttctggcaaaacaaaaaccagaaggtgaaaggaactagaag

SEQ ID NO: 50063 - DNA, 601 bp, Human
cgactctgagaatccctggtcagacacatgcatgggggatgggctcgagctcctgaaggattgacctgggcaaccttccagagccacctgggaatcaagtgggacttcccctcgacgatgaggcaggtaactaacacctgctgcagactttgtacagattgatacatttgataaagacagtctggccccagcccctggagctcgcctcgctgtggtgaggtcagtatagcccggcactgcatccccctgcaggcccaggttacctgcttggtgtggagacccctccccagctgcagccagmctttgtcctaaggcgaagtgccacgtacagccagcagggggcgccaggagcaaggcggaggctcagctaaagctgcgtgctgggtgctgggtgctgcggggcactgttcagttcacagcccaccagtggcacggtgcacacaggagagcctcccagccctgaggcagggccccacacaggaggaggcagcgtccttgtgtctgcatgttttggcctggccgtgcatgggggcggggcagctcacagcttgctgggtgaggaccttcctgcctctaggagcaaggtccttgccctgtcctc

SEQ ID NO: 50064 - DNA, 601 bp, Human
ggtgccagcgaggggagggggcagctgcccaagggctttgcgtccactggggggtataaagttggacaactgctttgggagaaaggggtcaacacaatgtatcttctaaaagcaaggcattcatctggtaacaaaataaatctgttgaagccaaacaggagacaggaattctgcagacactgcactgtatcccaaagctcagaagggaattgctggggggagcacggtgggaggacgctttcaacagctaacggaattataaacctattatgtattcaagtcgaacaaaagctctttgctytccctaccgaaatttgtttttacaaaaatcacgttcccctcctaaatctttcctggctatctgatgagcgcagccaagcaaaggccttcacgagcaaagcaccccttccgtgcccacttctgggaggcacaggatggatttgtctcctgcccgtaaaatgtcactcaggcccaaccacctccctgggcaacttctgagtgcccgggagccatggaatgagctcgtcttgccttgagtaaggtgccggaacctgaggtcccaggaaggttcagaattgggacttcctgccagccctgtcct

SEQ ID NO: 50065 - DNA, 601 bp, Human
accctagggccagtgcctttccatagcacagggcccacctgggggccaagggcagcaaggaggagccttttcagccccaatggagcagggcacccagggtgcgggacaggcaggaacaggtgcgtgggccaggcctgctctgccagattttcgctgcattctccagacccggaaagggccacttgccagtcgttgcaaaattgaggccggagtctctgccttgaagtatctgggggcgctgctgccaggtgccagcgaggggagggggcagctgcccaagggctttgcgtccactggggggtataaagttggacaactgctttgggagaaaggggtcaacacaatgtatcttctaaaagcaaggcattcatctggtaacaaaataaatctgttgaagccaaacaggagacaggaattctgcagacactgcactgtatcccaaagctcagaagggaattgctggggggagcacggtgggaggacgctttcaacagctaacggaattataaacctattatgtattcaagtcgaacaaaagctctttgctctccctaccgaaatttgtttttacaaaaatcacgttcccctcctaaatctttcc

SEQ ID NO: 50066 - DNA, 601 bp, Human
tggatgcggggccatgttctcattgggacccggcatagatgcggcacacgggacagaagatggttctgcggatggccaactgggaaggggtgattacaaacttccctgatgaggaggaaacaggttcggtcagccaaggcctacgggaccctagggccagtgcctttccatagcacagggcccacctgggggccaagggcagcaaggaggagccttttcagccccaatggagcagggcacccagggtgcgggacaggcaggaacaggtgcgtgggccaggcctgctctgccagattttcgmtgcattctccagacccggaaagggccacttgccagtcgttgcaaaattgaggccggagtctctgccttgaagtatctgggggcgctgctgccaggtgccagcgaggggagggggcagctgcccaagggctttgcgtccactggggggtataaagttggacaactgctttgggagaaaggggtcaacacaatgtatcttctaaaagcaaggcattcatctggtaacaaaataaatctgttgaagccaaacaggagacaggaattctgcagacactgcactgtatcccaaagctcagaaggg

SEQ ID NO: 50067 - DNA, 601 bp, Human
cccctgtcactcagccagctgcccctcccagcccgcatctcaggaaaggcccaacccctcagaagggcttttctggtctgcaccagggccccgcttattccccactgcgactctcccattcacgtgcctatggctctcaggtccccccatgagctctggatgcggggccatgttctcattgggacccggcatagatgcggcacacgggacagaagatggttctgcggatggccaactgggaaggggtgattacaaacttccctgatgaggaggaaacaggttcggtcagccaaggcctacrggaccctagggccagtgcctttccatagcacagggcccacctgggggccaagggcagcaaggaggagccttttcagccccaatggagcagggcacccagggtgcgggacaggcaggaacaggtgcgtgggccaggcctgctctgccagattttcgctgcattctccagacccggaaagggccacttgccagtcgttgcaaaattgaggccggagtctctgccttgaagtatctgggggcgctgctgccaggtgccagcgaggggagggggcagctgcccaagggctttgcgtccactggg

SEQ ID NO: 50068 - DNA, 601 bp, Human
aagggctcccgaccactcaggcccctgcagagtcgcccctgtcactcagccagctgcccctcccagcccgcatctcaggaaaggcccaacccctcagaagggcttttctggtctgcaccagggccccgcttattccccactgcgactctcccattcacgtgcctatggctctcaggtccccccatgagctctggatgcggggccatgttctcattgggacccggcatagatgcggcacacgggacagaagatggttctgcggatggccaactgggaaggggtgattacaaacttccctgaygaggaggaaacaggttcggtcagccaaggcctacgggaccctagggccagtgcctttccatagcacagggcccacctgggggccaagggcagcaaggaggagccttttcagccccaatggagcagggcacccagggtgcgggacaggcaggaacaggtgcgtgggccaggcctgctctgccagattttcgctgcattctccagacccggaaagggccacttgccagtcgttgcaaaattgaggccggagtctctgccttgaagtatctgggggcgctgctgccaggtgccagcgagggga

SEQ ID NO: 50069 - DNA, 601 bp, Human
acaaagcgccccattgtgtcctccaggagggacgtgctgctgctgctgggctgggacggcagagcctgtgccctcgctcccaccctccgccctgcaggcgaaggcccagccaccctctccttaggcaacagcctgcgagtggactcatgggacggtgggtcagatctgaaccctcatgagtactgtctccctttcgaaaaggctgggactaactgcagaacctcatgtgacacctaagcctgcgtgtccccatgccccagcctaggggcagccatgactcccccaagacgcggaggaggcragggctcccgaccactcaggcccctgcagagtcgcccctgtcactcagccagctgcccctcccagcccgcatctcaggaaaggcccaacccctcagaagggcttttctggtctgcaccagggccccgcttattccccactgcgactctcccattcacgtgcctatggctctcaggtccccccatgagctctggatgcggggccatgttctcattgggacccggcatagatgcggcacacgggacagaagatggttctgcggatggccaactgggaaggggtgattacaaacttccctgat

SEQ ID NO: 50070 - DNA, 601 bp, Human
ttaaatctgcccaactatccaatctgtaactgttcaaggagagattagtttgttctgccgctgacggctgcagcccaagcaaagcacaaagcgccccattgtgtcctccaggagggacgtgctgctgctgctgggctgggacggcagagcctgtgccctcgctcccaccctccgccctgcaggcgaaggcccagccaccctctccttaggcaacagcctgcgagtggactcatgggacggtgggtcagatctgaaccctcatgagtactgtctccctttcgaaaaggctgggactaactgyagaacctcatgtgacacctaagcctgcgtgtccccatgccccagcctaggggcagccatgactcccccaagacgcggaggaggcaagggctcccgaccactcaggcccctgcagagtcgcccctgtcactcagccagctgcccctcccagcccgcatctcaggaaaggcccaacccctcagaagggcttttctggtctgcaccagggccccgcttattccccactgcgactctcccattcacgtgcctatggctctcaggtccccccatgagctctggatgcggggccatgttctcattg

SEQ ID NO: 50071 - DNA, 601 bp, Human
tcaaaactgtcacgtgacacacaaatgcaggcccctgccccacagcccagtggcacacacgtatttaccgcctgggacacgggaccgtccagaagtgccctactcataggtgtaggtcacatccaggggtctcggccaccgggacccagggcccagcagctcagcaaagccattcagccggggtctgagccctgcccaggggaagcattttcccctcctggggtgaaggacagcaagaggcacgccgccctggcaggctgcggctttctttcctttttgtggacagagtgaaagggcaaacttgctccaggggaatactgacctccaacagtacaatgtgggaggagaaggaaaagaaagtttttatgcaaccttttttttaaatctgcccaactatccaatctgtaactgttcaaggagagattagtttgttctgccgctgacggctgcagcccaagcaaagcacaaagcgccccattgtgtcctccaggagggacgtgctgctgctgctgggctgggacggcagagcctgtgccctcgctcccaccctccgccctgcaggcgaaggcccagccaccctctccttaggcaacagcctgcg

SEQ ID NO: 50072 - DNA, 601 bp, Human
gggcctccccccagcagcgcatgaccctgcacactgcacccagggtcacagtgggggtggggagggacctgcccactgctcacggctgtgggacctggggcagggcaccccacttctctgagtctaaggggccctactagctgaagaaccaaaggaaaaccatcatttcaaaactgtcacgtgacacacaaatgcaggcccctgccccacagcccagtggcacacacgtatttaccgcctgggacacgggaccgtccagaagtgccctactcataggtgtaggtcacatccaggggtctcsgccaccgggacccagggcccagcagctcagcaaagccattcagccggggtctgagccctgcccaggggaagcattttcccctcctggggtgaaggacagcaagaggcacgccgccctggcaggctgcggctttctttcctttttgtggacagagtgaaagggcaaatttgctccaggggaatactgacctccaacagtacaatgtgggaggagaaggaaaagaaagtttttatgcaaccttttttttaaatctgcccaactatccaatctgtaactgttcaaggagagattagtttgttc

SEQ ID NO: 50073 - DNA, 601 bp, Human
gtcctcagcgacacagagacagatccaggggagacagagccagagccagcccaggatgcctggagccaagggcagctggaaggggaaggtggcaccttgggtctggacctctggctgccaggaccgggaccgtctgcatgtctgttgctaaagccagtctgtaggcatctgtcaccacacatgaggggccaaccgtgccacccaggggagacctcccggcttctcagtgcatcaggcatggtcaggggcaggacagctgcagctcacaccccacttctcagtcaccagccgagtgcacagscaatggcacctcatctaagagggggctgtgagtcccatgtggtcagcaccctggagctagctgccctgtgggctcagggaggtcgtgcagtgaccgccacatgggttcagtccagagcccaggccagagtccatgcccaccccacagagtccacgcccaccccagagtccatgcccactccaggcagagtccacgcccaccccacagagtccacgcccaccccagagtccatgcccactccaggcagagtccatgcccaccccacagagtccacgcccaccccagagtccatgcccactc

SEQ ID NO: 50074 - DNA, 601 bp, Human
gcgaaggaccttgagatgagatcatcccggattagagtaggcactaagaccgacgacaagtgtcctcagcgacacagagacagatccaggggagacagagccagagccagcccaggatgcctggagccaagggcagctggaaggggaaggtggcaccttgggtctggacctctggctgccaggaccgggaccgtctgcatgtctgttgctaaagccagtctgtaggcatctgtcaccacacatgaggggccaaccgtgccacccaggggagacctcccggcttctcagtgcatcaggcatrgtcaggggcaggacagctgcagctcacaccccacttctcagtcaccagccgagtgcacagccaatggcacctcatctaagagggggctgtgagtcccatgtggtcagcaccctggagctagctgccctgtgggctcagggaggtcgtgcagtgaccgccacatgggttcagtccagagcccaggccagagtccatgcccaccccacagagtccacgcccaccccagagtccatgcccactccaggcagagtccacgcccaccccacagagtccacgcccaccccagagtccatgcccact

SEQ ID NO: 50075 - DNA, 601 bp, Human
tgcggtctccgcaggtgcaattagcgaaggaccttgagatgagatcatcccggattagagtaggcactaagaccgacgacaagtgtcctcagcgacacagagacagatccaggggagacagagccagagccagcccaggatgcctggagccaagggcagctggaaggggaaggtggcaccttgggtctggacctctggctgccaggaccgggaccgtctgcatgtctgttgctaaagccagtctgtaggcatctgtcaccacacatgaggggccaaccgtgccacccaggggagacctcctggcttctcagtgcatcaggcatggtcaggggcaggacagctgcagctcacaccccacttctcagtcaccagccgagtgcacagccaatggcacctcatctaagagggggctgtgagtcccatgtggtcagcaccctggagctagctgccctgtgggctcagggaggtcgtgcagtgaccgccacatgggttcagtccagagcccaggccagagtccatgcccaccccacagagtccacgcccaccccagagtccatgcccactccaggcagagtccacgcccaccccacagagtccacgc

SEQ ID NO: 50076 - DNA, 601 bp, Human
tctggccccttggggctctaggtggagtgtgctgaacagtgtccccaaaattcacgtccagtggagctgcgggatgtgtcctagctgcaaatgcggtctccgcaggtgcaattagcgaaggaccttgagatgagatcatcccggattagagtaggcactaagaccgacgacaagtgtcctcagcgacacagagacagatccaggggagacagagccagagccagcccaggatgcctggagccaagggcagctggaaggggaaggtggcaccttgggtctggacctctggctgccaggaccrggaccgtctgcatgtctgttgctaaagccagtctgtaggcatctgtcaccacacatgaggggccaaccgtgccacccaggggagacctcccggcttctcagtgcatcaggcatggtcaggggcaggacagctgcagctcacaccccacttctcagtcaccagccgagtgcacagccaatggcacctcatctaagagggggctgtgagtcccatgtggtcagcaccctggagctagctgccctgtgggctcagggaggtcgtgcagtgaccgccacatgggttcagtccagagcccaggcc

SEQ ID NO: 50077 - DNA, 601 bp, Human
agtcactcctcaagcgcggactttccactgtgctggggccttccgccttccaaccactctggccccttggggctctaggtggagtgtgctgaacagtgtccccaaaattcacgtccagtggagctgcgggatgtgtcctagctgcaaatgcggtctccgcaggtgcaattagcgaaggaccttgagatgagatcatcccggattagagtaggcactaagaccgacgacaagtgtcctcagcgacacagagacagatccaggggagacagagccagagccagcccaggatgcctggagccamgggcagctggaaggggaaggtggcaccttgggtctggacctctggctgccaggaccgggaccgtctgcatgtctgttgctaaagccagtctgtaggcatctgtcaccacacatgaggggccaaccgtgccacccaggggagacctcccggcttctcagtgcatcaggcatggtcaggggcaggacagctgcagctcacaccccacttctcagtcaccagccgagtgcacagccaatggcacctcatctaagagggggctgtgagtcccatgtggtcagcaccctggagctagctgccctg

SEQ ID NO: 50078 - DNA, 601 bp, Human
aatgtggagatggagggcatcccggaacctcagggctgacgggcccctgccccagccctggaaacacctcagggacaagagagtcactcctcaagcgcggactttccactgtgctggggccttccgccttccaaccactctggccccttggggctctaggtggagtgtgctgaacagtgtccccaaaattcacgtccagtggagctgcgggatgtgtcctagctgcaaatgcggtctccgcaggtgcaattagcgaaggaccttgagatgagatcatcccggattagagtaggcactaagrccgacgacaagtgtcctcagcgacacagagacagatccaggggagacagagccagagccagcccaggatgcctggagccaagggcagctggaaggggaaggtggcaccttgggtctggacctctggctgccaggaccgggaccgtctgcatgtctgttgctaaagccagtctgtaggcatctgtcaccacacatgaggggccaaccgtgccacccaggggagacctcccggcttctcagtgcatcaggcatggtcaggggcaggacagctgcagctcacaccccacttctcagtcaccag

SEQ ID NO: 50079 - DNA, 601 bp, Human
ctccaagcctctggctcctgactcagaggacgatgtctccccatgaacgcagtgtccctggagagaagagcctgcccagcgtggggaacatgggaatgtggagatggagggcatcccggaacctcagggctgacgggcccctgccccagccctggaaacacctcagggacaagagagtcactcctcaagcgcggactttccactgtgctggggccttccgccttccaaccactctggccccttggggctctaggtggagtgtgctgaacagtgtccccaaaattcacgtccagtggagctrcgggatgtgtcctagctgcaaatgcggtctccgcaggtgcaattagcgaaggaccttgagatgagatcatcccggattagagtaggcactaagaccgacgacaagtgtcctcagcgacacagagacagatccaggggagacagagccagagccagcccaggatgcctggagccaagggcagctggaaggggaaggtggcaccttgggtctggacctctggctgccaggaccgggaccgtctgcatgtctgttgctaaagccagtctgtaggcatctgtcaccacacatgaggggccaacc

SEQ ID NO: 50080 - DNA, 601 bp, Human
ggtggggggaaggcaaactgcaaacgccgcggcgaccccggcacagcagccctgtcagcaggattcccccgagagcggggtaattgcggtgggaacgagcgctccaaaggccctggggagatgatttcagggaaaagtggccttgatccctgagtcaggcagatgcggccatgggaaccatccaccccgaggctggaggggagactccgccggtggctaaagccatcctgctgacggggcccagggacgcccccagtggccaaacgcacgtgggaacgggatcttccccctcctctgtgaygcggccaaccctccaagcctctggctcctgactcagaggacgatgtctccccatgaacgcagtgtccctggagagaagagcctgcccagcgtggggaacatgggaatgtggagatggagggcatcccggaacctcagggctgacgggcccctgccccagccctggaaacacctcagggacaagagagtcactcctcaagcgcggactttccactgtgctggggccttccgccttccaaccactctggccccttggggctctaggtggagtgtgctgaacagtgtccccaaaattcacgtc

SEQ ID NO: 50081 - DNA, 601 bp, Human
ccgggtggggggaaggcaaactgcaaacgccgcggcgaccccggcacagcagccctgtcagcaggattcccccgagagcggggtaattgcggtgggaacgagcgctccaaaggccctggggagatgatttcagggaaaagtggccttgatccctgagtcaggcagatgcggccatgggaaccatccaccccgaggctggaggggagactccgccggtggctaaagccatcctgctgacggggcccagggacgcccccagtggccaaacgcacgtgggaacgggatcttccccctcctctgkgatgcggccaaccctccaagcctctggctcctgactcagaggacgatgtctccccatgaacgcagtgtccctggagagaagagcctgcccagcgtggggaacatgggaatgtggagatggagggcatcccggaacctcagggctgacgggcccctgccccagccctggaaacacctcagggacaagagagtcactcctcaagcgcggactttccactgtgctggggccttccgccttccaaccactctggccccttggggctctaggtggagtgtgctgaacagtgtccccaaaattcac

SEQ ID NO: 50082 - DNA, 592 bp, Human
ccccttccttgtccctaagaggcatcttcctcaggggctggtggagctgccatgtaaagcaaacgcacagccaaaccccgggtggggggaaggcaaactgcaaacgccgcggcgaccccggcacagcagccctgtcagcaggattcccccgagagcggggtaattgcggtgggaacgagcgctccaaaggccctggggagatgatttcagggaaaagtggccttgatccctgagtcaggcagatgcggccatgggaaccatccaccccgaggctggaggggagactccgccrgtggctaaagccatcctgctgacggggcccagggacgcccccagtggccaaacgcacgtgggaacgggatcttccccctcctctgtgatgcggccaaccctccaagcctctggctcctgactcagaggacgatgtctccccatgaacgcagtgtccctggagagaagagcctgcccagcgtggggaacatgggaatgtggagatggagggcatcccggaacctcagggctgacgggcccctgccccagccctggaaacacctcagggacaagagagtcactcctcaagcgcggactttcc

SEQ ID NO: 50083 - DNA, 588 bp, Human
ccccttccttgtccctaagaggcatcttcctcaggggctggtggagctgccatgtaaagcaaacgcacagccaaaccccgggtggggggaaggcaaactgcaaacgccgcggcgaccccggcacagcagccctgtcagcaggattcccccgagagcggggtaattgcggtgggaacgagcgctccaaaggccctggggagatgatttcagggaaaagtggccttgatccctgagtcaggcagatgcggccatgggaaccatccaccccgaggctggaggggagactcmgccggtggctaaagccatcctgctgacggggcccagggacgcccccagtggccaaacgcacgtgggaacgggatcttccccctcctctgtgatgcggccaaccctccaagcctctggctcctgactcagaggacgatgtctccccatgaacgcagtgtccctggagagaagagcctgcccagcgtggggaacatgggaatgtggagatggagggcatcccggaacctcagggctgacgggcccctgccccagccctggaaacacctcagggacaagagagtcactcctcaagcgcggact

SEQ ID NO: 50084 - DNA, 540 bp, Human
atggaatgttctggaatgtgcagacccttcacatctgcatagccctactgtgtctcgcccacttacttctgctggggggagcatctgtcctacaagtgggggaatgcagacctgccaggctgcttgagaatcaaggtcctgcctcccccatctggcactcatggtgggagggggtgaaggtgagccctggaggccagaaacacgtgccccattcactgtgaccacccccggactcagcctgagctgatggacaggaggcctcagtccaaggtccccgccagacacatcaatcctcatagcygacctccagcctcatgacagaaaggcggctgatcctacacagagggcggctgcttttgctaaggacaatataccgaggcttgacatggtatgaggtcttcagtcaggagccagatattggcagccctaaggcctgagtaactttttttttttttttttttttttttgagacagagttccaccacgcctggctaatttttgtatttttagtagagatggggtttcaccatgttggccagg

SEQ ID NO: 50085 - DNA, 601 bp, Human
gcggctctgcctccagctctgtctgtcccagatgccaggtgtgctggggcctttgatcttcagcctacactgggggtgctggtgggttccctgagggctgcccgccaccctgccctgctgaggccttgatctcctgagaaggagctccagggcccactgcctgcgtgtgatgtattctggtcaccaggtggtcagcaggcggagcttgactctgcaggcctggagcgggggcagctcagagcagctcaggacagggcactttgcacagcacctcggcacagcccctctggcctctctcccrtctgctctctgatggaatgttctggaatgtgcagacccttcacatctgcatagccctactgtgtctcgcccacttacttctgctggggggagcatctgtcctacaagtgggggaatgcagacctgccaggctgcttgagaatcaaggtcctgcctcccccatctggcactcatggtgggagggggtgaaggtgagccctggaggccagaaacacgtgccccattcactgtgaccacccccggactcagcctgagctgatggacaggaggcctcagtccaaggtccccgccagacacatca

SEQ ID NO: 50086 - DNA, 601 bp, Human
tccccgtggcgtgctggatgcctgcggctctgcctccagctctgtctgtcccagatgccaggtgtgctggggcctttgatcttcagcctacactgggggtgctggtgggttccctgagggctgcccgccaccctgccctgctgaggccttgatctcctgagaaggagctccagggcccactgcctgcgtgtgatgtattctggtcaccaggtggtcagcaggcggagcttgactctgcaggcctggagcgggggcagctcagagcagctcaggacagggcactttgcacagcacctcggcacagcccctctggcctctctcccatctgctctctgatggaatgttctggaatgtgcagacccttcacatctgcatagccctactgtgtctcgcccacttacttctgctggggggagcatctgtcctacaagtgggggaatgcagacctgccaggctgcttgagaatcaaggtcctgcctcccccatctggcactcatggtgggagggggtgaaggtgagccctggaggccagaaacacgtgccccattcactgtgaccacccccggactcagcctgagctgatggacaggaggcctcagtc

SEQ ID NO: 50087 - DNA, 601 bp, Human
ttccccgtggcgtgctggatgcctgcggctctgcctccagctctgtctgtcccagatgccaggtgtgctggggcctttgatcttcagcctacactgggggtgctggtgggttccctgagggctgcccgccaccctgccctgctgaggccttgatctcctgagaaggagctccagggcccactgcctgcgtgtgatgtattctggtcaccaggtggtcagcaggcggagcttgactctgcaggcctggagcgggggcagctcagagcagctcaggacagggcactttgcacagcacctcggcacagcccctctggcctctctcccatctgctctctgatggaatgttctggaatgtgcagacccttcacatctgcatagccctactgtgtctcgcccacttacttctgctggggggagcatctgtcctacaagtgggggaatgcagacctgccaggctgcttgagaatcaaggtcctgcctcccccatctggcactcatggtgggagggggtgaaggtgagccctggaggccagaaacacgtgccccattcactgtgaccacccccggactcagcctgagctgatggacaggaggcctcagt

SEQ ID NO: 50088 - DNA, 601 bp, Human
aacaaagtgcgcacttcaaaggtggcaccagatttcctacggcagagcccacggtggggtcccttcctgatgggtggacccagttcctgttttgcacctgcttccccgtggcgtgctggatgcctgcggctctgcctccagctctgtctgtcccagatgccaggtgtgctggggcctttgatcttcagcctacactgggggtgctggtgggttccctgagggctgcccgccaccctgccctgctgaggccttgatctcctgagaaggagctccagggcccactgcctgcgtgtgatgtatyctggtcaccaggtggtcagcaggcggagcttgactctgcaggcctggagcgggggcagctcagagcagctcaggacagggcactttgcacagcacctcggcacagcccctctggcctctctcccatctgctctctgatggaatgttctggaatgtgcagacccttcacatctgcatagccctactgtgtctcgcccacttacttctgctggggggagcatctgtcctacaagtgggggaatgcagacctgccaggctgcttgagaatcaaggtcctgcctcccccatctggcactcatgg

SEQ ID NO: 50089 - DNA, 601 bp, Human
cccgccccacatcctgctggccccagaggccccaatcacggcccgactgtgaactggcctgagccgaccaacaggcttcgagtggaatgtggctgcttcctgcctcacattaaaataatgaaaaaagacggctccatccattcttgcacgtacctgtaggggttgatcatttcctctgtgacgaaattcaagtaattcctaaaatttagagaacagcgttcaaattatatgatcctcatcagggaaaataaatcaccggggagagagcatcccagggcagctggtgagcctgccccccggyggtctgctcgctgggctggaaagcggacctggagtgggagggagctcagcctcctgcgtgttccggggggtccctgctaccctttccaggccctcccgcacattccctgcctgttcgccctactggggtgattctcaggtccctgtgaggcccgcttgagcgcaggagtcaggctggggacctggaggaaaggggccgcagggctcagccgcctccacctgccaccttcgccaagactgcgacgtggagctagagccagagtagggctgcagcgggcggcctccccacgcttcgtcggga

SEQ ID NO: 50090 - DNA, 601 bp, Human
ccctggtggaagctggcgggtagcggctcaccacggccacggcctcggacgacagcatctgctcggtggacagggtggtgaagtaggccaggttggtcagcacgtacaccagcgtcacgatgggcagggagatgatgatggccaggggcaggtttctggaaagaacagggacgacatgtcacccaacgcagcccgggctgaaggccaaaccctgtgcccaggagccaggtgggctcctcgcaagcagtagctccagcctctgtgctgggcttctcggggaaggtgggaagcagcaagagarcacaggctggcggcaggaggctgtgcctggagcgggacactgcacagccctggctggtgccttggccgcggcctcagcttccccacctgagaaatggggattcttcggggtgacctcaagggctcaggagagttaagtcaggccacctggtctgaattctaaggctctgcccacgagctgcacagccggggaccagagccgagagcccaggcagctcctctgtaccgtcccgccctgagtggggccctcacttgccacccgttctctggagaaaccgtgctcaaggacacacggccagaa

SEQ ID NO: 50091 - DNA, 601 bp, Human
agaggacctctcaggctggattctggcctctggggggacttcccaggacagggctttccagtgacccctgcccagcctgcttgttggggagcccttgctggtcctgatttgccccctcctctgggactccctggagcaagctacggcctgcaggtggggatcttgccttcccccctggggtcctccacaggctcagcacggtgccctgccggcagcgggctgggagtcagagcttgttcagtaggaagctggccagagcacccactccctgttcccccagccctgggagggcagtgggagragcctcgggaactgcgaggccagcctggctgagctgcccggtgacaccgcccgggcctggcctcccgcctgccaagccagcagcagccgtgccttctaacgaaccccactctgtggcagactccaatctttctgtactcagatttaaaatgacctctgccctggactccccaggcattctggcttatagctggttctgggtgtggcttggtatcagattttaaacccttctcccctttgactcccccagcagctgagcttgaggatgatccccagacacttcctctgcggtcgctgtgag

SEQ ID NO: 50092 - DNA, 601 bp, Human
gagctgggccccaccgggccggccctcgccctccctgtgctcactgggagccctctgcaccgggccagccctcgccctctgtgctcacaagagccctctgcagaggacctctcaggctggattctggcctctggggggacttcccaggacagggctttccagtgacccctgcccagcctgcttgttggggagcccttgctggtcctgatttgccccctcctctgggactccctggagcaagctacggcctgcaggtggggatcttgccttcccccctggggtcctccacaggctcagcacrgtgccctgccggcagcgggctgggagtcagagcttgttcagtaggaagctggccagagcacccactccctgttcccccagccctgggagggcagtgggagaagcctcgggaactgcgaggccagcctggctgagctgcccggtgacaccgcccgggcctggcctcccgcctgccaagccagcagcagccgtgccttctaacgaaccccactctgtggcagactccaatctttctgtactcagatttaaaatgacctctgccctggactccccaggcattctggcttatagctggttctgg

SEQ ID NO: 50093 - DNA, 601 bp, Human
catgcctggcctatttgagcaattatgcatccccagtatcacagagacaaaccttttacagacatggaacatgttgaacctggccatgaggcctgggcctccctcacctgtggtgggtcgggctgtgctcacctggaggatgtgaacagggacccattgacggagccgaagcaggacaggcccacgaagacggggatgatccaggacatgacgcccaggtgatagttcccgaagtcctaggcaggcacaaccagtgagctgggccccaccgggccggccctcgccctccctgtgctcactrggagccctctgcaccgggccagccctcgccctctgtgctcacaagagccctctgcagaggacctctcaggctggattctggcctctggggggacttcccaggacagggctttccagtgacccctgcccagcctgcttgttggggagcccttgctggtcctgatttgccccctcctctgggactccctggagcaagctacggcctgcaggtggggatcttgccttcccccctggggtcctccacaggctcagcacggtgccctgccggcagcgggctgggagtcagagcttgttcagtagg

SEQ ID NO: 50094 - DNA, 601 bp, Human
cagggatgtagggcacagggccgtgcagcaggcttaccgtgaacacgagggacggcacgggggtgaggagctgtgggtggatcatggagaggatggagggcaggtggccttcccgggaccccacgaagaagagcctgtggacagacaagagtggcagagtcagccaccgccccacaactcagcacgtggacaggggacacgcaggctggggagtggcagggcctgtgcctggcttgtctgggcctctctggccacagtgggaaccaggcccctccagccgctggctgtgggcctctcagtkcccccaaccaactcggcaaggacagcaacttgggagccactgctcactccagcccggggggtcaagcggcggccacagggcatctaggacaccacagctgtgtcacctccaggcaggagtggggaggcgagggccaaagttcatgcttcctttatttctgtattatttgggcttgctgctgccttttttttttttttgagatggtctcactttgtcacccaggctggagtgcagtggcaccatctcggctcactgcagtctcaatcttctggtctcaagcaatccttccacctcagcccc

SEQ ID NO: 50095 - DNA, 601 bp, Human
aaagcccctccagcgctctctggcattcagcggagctcggcaggaggccacatttgagctgtcacccagtccacaccccagacagagctgcaagctgtggcagcctccctctgggagcccccggacaacccccagggatgtagggcacagggccgtgcagcaggcttaccgtgaacacgagggacggcacgggggtgaggagctgtgggtggatcatggagaggatggagggcaggtggccttcccgggaccccacgaagaagagcctgtggacagacaagagtggcagagtcagccaccrccccacaactcagcacgtggacaggggacacgcaggctggggagtggcagggcctgtgcctggcttgtctgggcctctctggccacagtgggaaccaggcccctccagccgctggctgtgggcctctcagtgcccccaaccaactcggcaaggacagcaacttgggagccactgctcactccagcccggggggtcaagcggcggccacagggcatctaggacaccacagctgtgtcacctccaggcaggagtggggaggcgagggccaaagttcatgcttcctttatttctgtattattt

SEQ ID NO: 50096 - DNA, 601 bp, Human
gcagtcacgcgggctggcacggaaagatgcaggagaagcggaaggaaactgtgtgtgatgcaccccgctgagaaacgaacagagtgggcgcccacggaggtgcagtgagccaggcggctggcagagcagcaccccgggtcagcttctgcctcccgcatttccgatggtctgaatcgtttgtggcagccaccatatattatttttggaataaaatctaaagcccctccagcgctctctggcattcagcggagctcggcaggaggccacatttgagctgtcacccagtccacaccccagacasagctgcaagctgtggcagcctccctctgggagcccccggacaacccccagggatgtagggcacagggccgtgcagcaggcttaccgtgaacacgagggacggcacgggggtgaggagctgtgggtggatcatggagaggatggagggcaggtggccttcccgggaccccacgaagaagagcctgtggacagacaagagtggcagagtcagccaccgccccacaactcagcacgtggacaggggacacgcaggctggggagtggcagggcctgtgcctggcttgtctgggcctctctggcc

SEQ ID NO: 50097 - DNA, 601 bp, Human
tccctgaattcctgacttacggaaactgtgagataataagtgcttttccttttagaacactacattttggagtgatgtgtgacacagccagagggaacaaaggcagtcacgcgggctggcacggaaagatgcaggagaagcggaaggaaactgtgtgtgatgcaccccgctgagaaacgaacagagtgggcgcccacggaggtgcagtgagccaggcggctggcagagcagcaccccgggtcagcttctgcctcccgcatttccgatggtctgaatcgtttgtggcagccaccatatattrtttttggaataaaatctaaagcccctccagcgctctctggcattcagcggagctcggcaggaggccacatttgagctgtcacccagtccacaccccagacagagctgcaagctgtggcagcctccctctgggagcccccggacaacccccagggatgtagggcacagggccgtgcagcaggcttaccgtgaacacgagggacggcacgggggtgaggagctgtgggtggatcatggagaggatggagggcaggtggccttcccgggaccccacgaagaagagcctgtggacagacaagag

SEQ ID NO: 50098 - DNA, 601 bp, Human
tctccagccctggtcacaccctacgatgagaacacagcttcaggcaccagctccctgaattcctgacttacggaaactgtgagataataagtgcttttccttttagaacactacattttggagtgatgtgtgacacagccagagggaacaaaggcagtcacgcgggctggcacggaaagatgcaggagaagcggaaggaaactgtgtgtgatgcaccccgctgagaaacgaacagagtgggcgcccacggaggtgcagtgagccaggcggctggcagagcagcaccccgggtcagcttctrcctcccgcatttccgatggtctgaatcgtttgtggcagccaccatatattatttttggaataaaatctaaagcccctccagcgctctctggcattcagcggagctcggcaggaggccacatttgagctgtcacccagtccacaccccagacagagctgcaagctgtggcagcctccctctgggagcccccggacaacccccagggatgtagggcacagggccgtgcagcaggcttaccgtgaacacgagggacggcacgggggtgaggagctgtgggtggatcatggagaggatggaggg

SEQ ID NO: 50099 - DNA, 601 bp, Human
gcttcctctgctgtatctcactggctttgggggaagcagcctgttgggggagcccagtgtgctcaggggcggggcctgcagcccacagccctggaggaagccactgtgggagtggcctctccagccctggtcacaccctacgatgagaacacagcttcaggcaccagctccctgaattcctgacttacggaaactgtgagataataagtgcttttccttttagaacactacattttggagtgatgtgtgacacagccagagggaacaaaggcagtcacgcgggctggcacggaaagatgcrggagaagcggaaggaaactgtgtgtgatgcaccccgctgagaaacgaacagagtgggcgcccacggaggtgcagtgagccaggcggctggcagagcagcaccccgggtcagcttctgcctcccgcatttccgatggtctgaatcgtttgtggcagccaccatatattatttttggaataaaatctaaagcccctccagcgctctctggcattcagcggagctcggcaggaggccacatttgagctgtcacccagtccacaccccagacagagctgcaagctgtggcagcctccctctggg

SEQ ID NO: 50100 - DNA, 601 bp, Human
acggccgtggtggccaccggggactgtccagcctggctgggcccagctgagcaccagggaattttgttttaaaggagaaacctcatctgagcaacatgcaaggtcttgaaggaggaaaggagggaaggagggaggagaggaggagggaagaggcggggaggagggaaggagggaggagaggagggaaggagggaggagaggaggaaatggagaccacatttgggttaaggacaggtgaagaacacagtgtacatacacagctgggctctgctggactgtggctctgtgtgcgagggccacracctgacctaacccagtggtcaccaagaaaacagtttctgtaacccccggcacagccgtgctcccgaggaccgtgcagctgccaaagagtccaggacttgctgcccttcctgactggcttctaactcagggaaggagtagtaagcaagggccaggacctctgaggccagcccacagctgccagaccccagcttcctctgctgtatctcactggctttgggggaagcagcctgttgggggagcccagtgtgctcaggggcggggcctgcagcccacagccctggaggaagccactgtggga

SEQ ID NO: 50101 - DNA, 601 bp, Human
ggtgagcgggaggccccgggctcaccttgatgggccgctcaagctcaggctttctgtggcgcagccagatcatgccgatgatggccagggccacgcagagccagttgaagaagctgaagaagttgatgacggagaagatgtccttggagaaggcgtagagcagcgtcatcacacactggaagagagaggcggctggctgagccctggggcccacgagcagggctgtggacggccgtggtggccaccggggactgtccagcctggctgggcccagctgagcaccagggaattttgttttaarggagaaacctcatctgagcaacatgcaaggtcttgaaggaggaaaggagggaaggagggaggagaggaggagggaagaggcggggaggagggaaggagggaggagaggagggaaggagggaggagaggaggaaatggagaccacatttgggttaaggacaggtgaagaacacagtgtacatacacagctgggctctgctggactgtggctctgtgtgcgagggccacaacctgacctaacccagtggtcaccaagaaaacagtttctgtaacccccggcacagccgtgctcccgaggacc

SEQ ID NO: 50102 - DNA, 601 bp, Human
ctgggatgctggctcccaactcagggtccttaggacccacggaccctgcctctgtgaagggtgcctgggtgagcgggaggccccgggctcaccttgatgggccgctcaagctcaggctttctgtggcgcagccagatcatgccgatgatggccagggccacgcagagccagttgaagaagctgaagaagttgatgacggagaagatgtccttggagaaggcgtagagcagcgtcatcacacactggaagagagaggcggctggctgagccctggggcccacgagcagggctgtggacggcygtggtggccaccggggactgtccagcctggctgggcccagctgagcaccagggaattttgttttaaaggagaaacctcatctgagcaacatgcaaggtcttgaaggaggaaaggagggaaggagggaggagaggaggagggaagaggcggggaggagggaaggagggaggagaggagggaaggagggaggagaggaggaaatggagaccacatttgggttaaggacaggtgaagaacacagtgtacatacacagctgggctctgctggactgtggctctgtgtgcgagggccacaacctg

SEQ ID NO: 50103 - DNA, 601 bp, Human
cccggggcccccaggcttcgggaacacagagggagagatggtccgggcagggaagcaggggctactgtgacagccataggccagctgagtgacaaaagctgctggctagcagccaccaggggctctggcctcttgttctgtgtcagggccagggcggcgggacttgctgggccccaggcaagagcatggcctctgctggacggccccgtttttggagaaggcagcccacggataacagctacccctctgaatgagccgctggggacggggagagtccaggagagtccagctgggcccaggygctcctcgggccgggttccctgcattcctcctgccagcacagccccgacggccctttgaatgctgcgccaggcccggctctgccccgcccctgccggggctcaccaccgcccacctatgactgcagtgtccttatctgcttccctccacccaacggagcacaagctctgtgccatctgctgtcctttgaggaaccccggctcctgcagtcacacttggcaccctcgtagctggtggtcaagtcatcaccggaattagtcgacccaggtgcatgcaggcaggggcaggtccagaggctgag

SEQ ID NO: 50104 - DNA, 601 bp, Human
ccccatgggggctgagcccccgctgtgcgcagtgactgccctgtgccctaggcactgccccaggctggcacagcaggcacaagctggtgcccatgtagggcggctcctccctgccctctgcagccttctcttggggcagcatctgggttcttgtgctgactgtattttaaagcccctgttttttttgtttgtttgagacggagtctcactctgtcgtccaggctggagtacagtggcgcgacctcggcctcccaggttcatgccattctcctgcctccacctcccgagtagctgcaactayaggcgcccgccaccacgcccagctaatttttttgtatttttagtagagacggggtttcaccgtgttagccaggatggtctctatctcctgactttgtgatctgcccgcctcggcctcccaaagtgctgggattacaggcgtgagccaccgcgcccagcctaaagcccgttcaacagcattcacaggcacccccggggcccccaggcttcgggaacacagagggagagatggtccgggcagggaagcaggggctactgtgacagccataggccagctgagtgacaaaagctgctggctagc

SEQ ID NO: 50105 - DNA, 601 bp, Human
gggagatgcagggctgaccacaggtcccagcccatcagtgtgggctgcatgactgccctgtccccagggaacagacgccaacccgtgcccaggctcacaacagtgggtagagcctaccccatgcccaggtccccatgggggctgagcccccgctgtgcgcagtgactgccctgtgccctaggcactgccccaggctggcacagcaggcacaagctggtgcccatgtagggcggctcctccctgccctctgcagccttctcttggggcagcatctgggttcttgtgctgactgtattttaawgcccctgttttttttgtttgtttgagacggagtctcactctgtcgtccaggctggagtacagtggcgcgacctcggcctcccaggttcatgccattctcctgcctccacctcccgagtagctgcaactataggcgcccgccaccacgcccagctaatttttttgtatttttagtagagacggggtttcaccgtgttagccaggatggtctctatctcctgactttgtgatctgcccgcctcggcctcccaaagtgctgggattacaggcgtgagccaccgcgcccagcctaaagcccgtt

SEQ ID NO: 50106 - DNA, 601 bp, Human
gcctcagcctcctgagtagctgggattacaggtgtgtgccactacacccagctgatctgtgtatttttagtagagacagagtttcaccatgttggccaggctggtcttgaactcctgacctcaagtgatccgcctgcctctgcctctttctgcctttctgggtaagtctgctgtgtccgctggtggcagccagcaggattttgttacttggcagcagtagcctggttttccggaatccctcgtcctgagagattagctggtgctgcgctgtgtgtcttatccctgaaccatgtgggctgcrtgtcactggcggacactgcagtgacctgaaccctcctgccacccaacacgcttcgccccatgtgggtggagacggccgacgcctctcaactcccttcgctgcccagggcagagggtaccacgggctgtgggccagcgagatactcacagatgccctggaggagccacttgggcttgtttttccaccagaccccgaagaagtagacgggcagcccgctgaggatgatggtgaagccgatgccacactccacgggtgtcttccagaaggagacggcgatcaggaagaggcaggccaggatga

SEQ ID NO: 50107 - DNA, 601 bp, Human
ccaagccacccagtgacatggggatcagcatgtaggcccgcaagcaccccggcctttttctacgagcctggccacatttgcaggcgctgaggacggggtcctgagcttggtgacaaagcacccctggggctgccgctgcacacagggccggggggcgggtttctccttctgcctttttttttttttttgagaagagtctcgctctgtcgcccaggctggagtgcaatggtgcgatctcggctcactgcaacctccgtctcccgggttcaagtgattctcctgcctcagcctcctgagtagytgggattacaggtgtgtgccactacacccagctgatctgtgtatttttagtagagacagagtttcaccatgttggccaggctggtcttgaactcctgacctcaagtgatccgcctgcctctgcctctttctgcctttctgggtaagtctgctgtgtccgctggtggcagccagcaggattttgttacttggcagcagtagcctggttttccggaatccctcgtcctgagagattagctggtgctgcgctgtgtgtcttatccctgaaccatgtgggctgcgtgtcactggcggacactgc

SEQ ID NO: 50108 - DNA, 601 bp, Human
gggggatgacaggccttcctgcaggtccacacccgggccaccacctggacacatgcctggactgttcacagcaggcagggccggaggggccaatctgctaacgggtcctcggaagacctgtcgcgcctgggactgtctacagagacatcactctgtggagggggactgctttcaggatagagacgggggtttgctttaagctcttggtgtcctgaatgacagttaatgcagatcccactgcaaagcttgaggcaaatgttctaccatgaccctggcggtgatcagagtgtggggtaggggyggggggtctccctgcctgtgttgctgccatcccgggaattctccaagccacccagtgacatggggatcagcatgtaggcccgcaagcaccccggcctttttctacgagcctggccacatttgcaggcgctgaggacggggtcctgagcttggtgacaaagcacccctggggctgccgctgcacacagggccggggggcgggtttctccttctgcctttttttttttttttgagaagagtctcgctctgtcgcccaggctggagtgcaatggtgcgatctcggctcactgcaacctccgtc

SEQ ID NO: 50109 - DNA, 601 bp, Human
cggcctcctggctatgtctcctgggggaccacctgcatgagcttctgacacaggacggtcgtggagactgtcaggagagaagacagctgtgttagcctgggggctgggtaggcacccgtgggacacgggggcgtgagctggggctcccccagccctgctgtcaccaaacccagcgccgctgcccagcgctgggattttaaggaaccttcccttgtgtacttgcgcatgtgggtgccgggtgcccgaggcgctgtcttcaactgaaatgcggaagtgccacatcccactcggcccacccctygcctgcttcagaaccctggggaggcagagtgcggcccctggggcacacgaaccaggccctggtgtctcagcaaagtgcaacggggggatgacaggccttcctgcaggtccacacccgggccaccacctggacacatgcctggactgttcacagcaggcagggccggaggggccaatctgctaacgggtcctcggaagacctgtcgcgcctgggactgtctacagagacatcactctgtggagggggactgctttcaggatagagacgggggtttgctttaagctcttggtgtcctgaatg

SEQ ID NO: 50110 - DNA, 601 bp, Human
cccagatcccccaccccctcccagtgccaccctacggctgagtttccactctgcaaaccctaaggcagagacataagcccacagggttggttttcacgaatgtcacaagcccatgtgtctgggcagctgtccggcttcagtgcaagtctgtggtagcaatgaggttccaagtctcagtagctctgtttgcccagggtctgggcccttggggcaggagaaaggaaggctcctgccttcccccagctccttaaaaaatcatcttagtggtgtcaagttgacccaaaatttaagtttaaaaaawatatatatataagtaaacaaaggagggaagggaaaaagggcccaaggagaccaaaagctgctcctgggcaggagcacaggcacacctgggtccctggccctcagttgagggatgagattcgtaccagagttttcacagcagcctccactgcccgacctgggagggacggcgagggactgggatgggcagctgagctgtgggttgcggggaaccggagtgggttcgaggaggtgatctactttaactggcctctgcgcatgctcctccggcagccactcggcctcctggctatgtctcctg

SEQ ID NO: 50111 - DNA, 601 bp, Human
cactggatggtgagggggtcccggtgcccaggcgggggcggcaggctccactgggcacttgctgagagcttgcggcttgagcagccgctggtcagtgaagccgtgtccggcttcgttggctcccggcttgggacactcagggctgtgccacaggccagctcctccagccacagctgagcactggagtgacgctggaccacttggctccacctctggctggggagaagggaagcccggggcctgagaaggcagagccccccgagctcaggagggatcctgcggggtcttcttgttctgggggtccctggctgctgccatggaggcagcgacagctcaggaaagtgggccgcattggccaggcctcggctgcctcccatagcgaaaaaaattcacgggaacaacagaaacaaggggtgccctagttccctctctgcaggcgggtggggactgggtgagagcccaggggcctccaaacgcaggcggcagagacgtgagcagtgcttggctctgtctcctagacaacgggcatcaggaccaggacaggacatgagcgtgacagggagagcggggaggtgcctaggccgggagtgggaacccagca

SEQ ID NO: 50112 - DNA, 601 bp, Human
tccagcctggtcggccgacgtcacagtggatggccctgcgtggctgggacacagacagggagcaggcatggcacctgcgccacgcagagcagcaaggctgagcatgaccactggaaataaataaacatggtgccgacagcatctttaaattagtaagacgttagcacaaaacaaaaaagcacaacgactgaaaatgcacttgcttgttgtggtgggttgtgcttgaaaacacctgaagcccacaagtggaaaccgctggggacgtttgtcagtggagtgtggagaaaaagggacggaaaartcaagtcttctgagacagtcccctgcggtggccctggtccctgtggaattccagcacagcaggagggggagggggaagcaggcctcagtcagcaccgcgggacacggcccctaccttctgaagtggggtccccaggctggagtggggcacacagcaccaaggatcacagactggaccccccaccaaccttctgcggaggagctcccaccccagctcagacgcccagaagagacctgcgcagtgtgaagacggaccccagcggccccagccatttcactagcagctactttccacaacaga

SEQ ID NO: 50113 - DNA, 601 bp, Human
ggagcgctaggggcgggggatgccaacccgaaccaaaacagccaggcagtacacttctaggtggttggacgcggactagcgctgtcgaagcaggctgctggagggaggagggaggcccatctgctcagtgagagcccaggaatctcgtctttcagtggctgcatcgttttcaccattagttgagggaatcgatctgtgccttcattctaagatgccaccgcattcggggcagagccggggccggaagccagggagctgcctgctgctgctgctgctgctgctgctgctgctgctgctgctgctgctgtaagatggtttctgtgcagggaaccttggccggctctgcagctgcccgcctgcctggactctccgatatccactcctcagtgcacctgacacgcatggagccggtcctttcctggaagccagaccccaaacaaactggcttccccgaccagtccactcccatgtgggagcttatcctcagaggcactgggtcctctgcctccctcgggcggctcgcctgtttcaggcatggatgcctgggaagggagtgagacgcagcaatgacttgtgcttctgccgagaataaaaatcctga

SEQ ID NO: 50114 - DNA, 601 bp, Human
gggctttgtgattcaggagtcccagcctttggctgcagggatccccgatctgtctgggaccaaacccccctcgttcttgcatcacattgccggaagaagcccagattgtcaacatcctctcaaggggtatgcggttcttagctctcccataagcaaagccaggcagggatgcagatggggagcttcatggccggctctcccttttggttggcaacatggcatgacaggaaatagaattgacccttctggtcttgaggactcgggcctggacatctgggccacttttctggagggctcccakcttcctgttgggaagggggtgattatggcactgagtgtccccaggcagcccatggaaggagcctgcagggtgtggggatcgccagaatggggcagagacctccatgcctccttcccagtcaactggtgggtggtgacagccatgtcgcagtgaggaaggagttaatggccccagctccactctgacttttcctttgcacaagaagtgggggaatattgggcagccatcagcgaagctctggaacctcagcccagctctgggcgctgacttggggaaatggcgattttcatgaatgatgca

SEQ ID NO: 50115 - DNA, 601 bp, Human
tgactatgactatgcaacaagtaatttctttttcaaatgagtgcccaggttagaaggaatcaggttcattggtgcggagattatgccaacagaaactcatttcagaaacaagaagcaagccctgagcagttggagacgaaagcgttttctccgagattctctttccgctacttcggggggcgggtggtgaaaggctccgtaaggtgaaaagagaaaggaagaagcaaacagctatttttttgttgccagttatagctgagaaacaaatgtggctgaagggcacccctacccacgttggccrtgaggccgtttgatgggctttgtgtgaggaatcctgagatgagctggccggggagtgaggaccggcacccgcctacagcagcgatctggagtagtgagtgagcagccccagctgacacagagaaggagagagagaactctgaccccttctcttctgaggacacccagccggagagagcaagaaggggtggagtgtgggggtgggggcaggagcctctgctgttcctttccaagactttttcttcctgttttccccaagcctccacaactctaaatatgatgagctctcaactgtgagcta

SEQ ID NO: 50116 - DNA, 601 bp, Human
cacccctacccacgttggccgtgaggccgtttgatgggctttgtgtgaggaatcctgagatgagctggccggggagtgaggaccggcacccgcctacagcagcgatctggagtagtgagtgagcagccccagctgacacagagaaggagagagagaactctgaccccttctcttctgaggacacccagccggagagagcaagaaggggtggagtgtgggggtgggggcaggagcctctgctgttcctttccaagactttttcttcctgttttccccaagcctccacaactctaaatatgaygagctctcaactgtgagctaataatgttgaatgtaacgccctttgtgtccttagatgacaaaaagacttgtgagtactagcggagagggtgatgttggtgtgaattttccacattggtccgtgtctccgtggactggccgcttcccccgctggtagcttcctggctgtgagaggccatgcggtggatggagccaccgctgcactggggtcctggctcgaacttgagtaaggtgctgtcttccaagtctggagaggagaggagaagagaagagaggcagtcccttcagcaccttggagagc

SEQ ID NO: 50117 - DNA, 601 bp, Human
accggcacccgcctacagcagcgatctggagtagtgagtgagcagccccagctgacacagagaaggagagagagaactctgaccccttctcttctgaggacacccagccggagagagcaagaaggggtggagtgtgggggtgggggcaggagcctctgctgttcctttccaagactttttcttcctgttttccccaagcctccacaactctaaatatgatgagctctcaactgtgagctaataatgttgaatgtaacgccctttgtgtccttagatgacaaaaagacttgtgagtactagmggagagggtgatgttggtgtgaattttccacattggtccgtgtctccgtggactggccgcttcccccgctggtagcttcctggctgtgagaggccatgcggtggatggagccaccgctgcactggggtcctggctcgaacttgagtaaggtgctgtcttccaagtctggagaggagaggagaagagaagagaggcagtcccttcagcaccttggagagcgctcccggctgcctgcctgggttgggtggacggctggactcactttcgctctaggcatcctcttcaagccaaaccatctct

SEQ ID NO: 50118 - DNA, 601 bp, Human
tgatttgtctgtaccagtcagtgaaactgtttcaccaccattctctttacatctgcctcaatgggtgagtcctctagaccaatggtccccaacctttttggcaccagggacctgtttcatggaagacaatttttctaccgcccagggttgagggatggttttgggatgattcaggcgcattctatttattgtgtgctttatttctattattattacattgtaatatatagtgaagtaataatacaactcaccatcatgtagaatcagtgggagccctgagtttgttttcctacaactagayggtctcatctgggggtgatgggagatagtgacagatcatcggacattagattatcataaggagtgtgcaaactaggtccctggcatgagcagtttccagtaggctctgcattcctatgagaatctaatgctgctgctgatctcacaggaggcagagctcaggcagtaatgcaagcgttggagagcggctgtaaatacagacgaagcttcacttgcttgcttactcactcgccactcacctcctgctgtgtggctgggttcctaacaggcaacgaaccagtaccagccacatttcacgggc

SEQ ID NO: 50119 - DNA, 601 bp, Human
ttatttctattattattacattgtaatatatagtgaagtaataatacaactcaccatcatgtagaatcagtgggagccctgagtttgttttcctacaactagatggtctcatctgggggtgatgggagatagtgacagatcatcggacattagattatcataaggagtgtgcaaactaggtccctggcatgagcagtttccagtaggctctgcattcctatgagaatctaatgctgctgctgatctcacaggaggcagagctcaggcagtaatgcaagcgttggagagcggctgtaaatayagacgaagcttcacttgcttgcttactcactcgccactcacctcctgctgtgtggctgggttcctaacaggcaacgaaccagtaccagccacatttcacgggctcaacagccacatgggactagtcgccaccatattggacaatgtaaatccagaacattccatcagtgcagaaagctttattgggcaggcagcactggtctggagtgtaagttccatatgggaagcggtttgtgtccatgctggtcactgccatgtgcccagtgactaaaatggtgctggcacgtggtggtcaataaat

SEQ ID NO: 50120 - DNA, 601 bp, Human
gacgtagttaaaggaaagtttttccgtgagaccctcatgtccacaggtcagtctccctttacaattagcattaaaacatgcctgttctaattccttgatcagttttgttttgtggttggctttgtcattgctccttaagagactgccagtgtttcatatgagaaagatgatggtgttgaatgcagtgaataatggagcgataccagcagtcatgactgggaggcatttttggaccacgatttaatgagtagcattcattgcaaagtgcaaagaaaggcccatggaaagatgagtaccctcyagtctgcttaattcctcactatctttttactgctcccttttccttggcttgattcgttcagtcattggagaagcatttgccaagttcagaccgtgttcaaggcacaaagacagaaaagctcaggtccaacctcagtgaatcagccttaagtatttgctgagcattgagtatgtacgcagtacagagtttgtggtaacgtggaagattggaaaaaaagaaacaaacacataaaaatgaaaatgcaagaaataggatgtcctatgttctaccaggaagaataaggagtctgaacagggatgc

SEQ ID NO: 50121 - DNA, 601 bp, Human
tcgatctcctgacctcgtgaaccgcccgcctcggcctcccaaagtgctggaattacaggtagcgtgaactcagctcactgcagcctctgcttcccgagttcaagccattctcctgcctctgcctcccgagtagctgggattacaggtgcccacgaccatgcctggctaatttttgtatttttggtagagacggggtttcaccatgttggccagactggtcttgaactcttgacctcaagtgatccgcccacctcagcctctcaaagtgctgggattacaggtgtgagccacctagcccagsctattgtgttgtttttgaatatatttttgatctgcagttggttgaatttgtggacttggaacctgaagctatagagggctgactgtgtatgataacctagaactgcaaagccagggaattcctttgaaagaaaaacactttttctttctaaaacatctattttgttccaagtattgtgctgggcattttatcatagacgttatatcttacgttccttaagataatgccttgagataaggcattccgctcccatttaaaagacaggaaaggtgaggctcacggggtcacactcgctgagat

SEQ ID NO: 50122 - DNA, 601 bp, Human
acacgtgtggagctgtcttttccctcccaggataaacgctggtccctgcacacaagggggtctgcgcctccccgtcccaggataaaggcaggtccctgcacacgtgaggagccgcgcgtcccctcctgggataaactctggtccctgcacacacgaggagccacgcgtcccctcccgggataaacgctggtccctgcacacacgaggagccgcgtgtcctctcccaggataaacgctggtccctgcacacgtgaggagccgtgcgtcccttcccgggataaacgctggtccctgcacacaygaggagccgcgcgtcccctcccgggataaacgctggtccctgcacacacgaggagccgcgcgtcccctcccgggataaacgctggtccctgcacacacgaggagccgcgcgtcccctcccgggataaacgctggtccctgcacacacgaggagccgcgcgtcccctcccgggataaacgctggtccctgcacacgtgaggagctgtgcgtcccttcccagaataaaggaaggtccctgcacacatgagggttggtggctctcctgagggttcacaggttcccggggacccatccacagat

SEQ ID NO: 50123 - DNA, 601 bp, Human
agctgtcttttccctcccaggataaacgctggtccctgcacacaagggggtctgcgcctccccgtcccaggataaaggcaggtccctgcacacgtgaggagccgcgcgtcccctcctgggataaactctggtccctgcacacacgaggagccacgcgtcccctcccgggataaacgctggtccctgcacacacgaggagccgcgtgtcctctcccaggataaacgctggtccctgcacacgtgaggagccgtgcgtcccttcccgggataaacgctggtccctgcacacacgaggagccgygcgtcccctcccgggataaacgctggtccctgcacacacgaggagccgcgcgtcccctcccgggataaacgctggtccctgcacacacgaggagccgcgcgtcccctcccgggataaacgctggtccctgcacacacgaggagccgcgcgtcccctcccgggataaacgctggtccctgcacacgtgaggagctgtgcgtcccttcccagaataaaggaaggtccctgcacacatgagggttggtggctctcctgagggttcacaggttcccggggacccatccacagatccccagataa

SEQ ID NO: 50124 - DNA, 601 bp, Human
acacacgaggagccgcgcgtcccctcccgggataaacgctggtccctgcacacacgaggagccgcgcgtcccctcccgggataaacgctggtccctgcacacacgaggagccgcgcgtcccctcccgggataaacgctggtccctgcacacgtgaggagctgtgcgtcccttcccagaataaaggaaggtccctgcacacatgagggttggtggctctcctgagggttcacaggttcccggggacccatccacagatccccagataagaacctgtccatcctccccggggcctaagcgtgmccagattgatctcagtttgcccagtgagtagaaaaataggccgggatcagcagattcctatagacctggtggaggcctgggctggagtagacccaggcagagttggtctttcacctcgcccccttccggaggccccgtacccttggggtcagcatccaggcaacatgggatacccagaaccttctttcttgtcctgagcccttctctcccagctcggcatggacttgagtgacagctgctgtgtttctttcctgcccagtgagtggggccgggccctggagctttccctgttcatttgtt

SEQ ID NO: 50125 - DNA, 601 bp, Human
tgtttctttcctgcccagtgagtggggccgggccctggagctttccctgttcatttgtttcgtctccttgtggggaaagcatggctcccccattttccagatgggaagcaggctcagagatgcaacagaagtgggaagtgatggagcagggactccatagctccagtcacgagtctcaaactctgtgcgcatctgggtcgcctgacccggcctccctgacccgggctgcccagaagggagcccaggaatgccggggagggtcacacagccagggccattcaatgcaggtggtgctgggacyacgccttgagaagctccagtcgccttccctcctctgcaatgaggcattgctagggggaggcgagtgggggaagagaccgggtctgttggggtcagccccgggcacagcacccgacagcagaggagacctccggaaatcatggctggatgggtcaatgagtggtcaatcaggcgagctctgagcgacaggaggggccggtggtgtggagagagggaagaagagcctgcaggagggagacggtgcgtgcaggggcaccacggccagagcctgcttggtgttcagagagccctgtggctgccg

SEQ ID NO: 50126 - DNA, 601 bp, Human
gagaccgggtctgttggggtcagccccgggcacagcacccgacagcagaggagacctccggaaatcatggctggatgggtcaatgagtggtcaatcaggcgagctctgagcgacaggaggggccggtggtgtggagagagggaagaagagcctgcaggagggagacggtgcgtgcaggggcaccacggccagagcctgcttggtgttcagagagccctgtggctgccgcagttgggagaagggcacggggtctgagcacagacagcttccaggccccagggttgggggactttgaattttstccagggcccgggaacgacattgtctgatttaagcagaacagcaacgcaatctggttttgtgtgtgtgtgtgtgtgtgtgtgtgtgtgtgtgtgtgtgtgtattatttttttttttttgagacagagtcttgttctattgcccaggcgggagagcagtggcgcgatctcagctcactacaggctccacctcctgggttcacgccgttctcctgcctcagcctcccgagtagctgggactacaggcgcccgccaccacgcctggttaagtttttgtattttttttttttttgtatttttag

SEQ ID NO: 50127 - DNA, 601 bp, Human
cctgtaatcacagctactcggaggctgaggcaggagaatcacttgagcctgggaggcggaggttgcagtgagccgagattgcgccgttgcactccagcctgggtgacagagtgagactctgtctcaaaaaacaaacaaacaacaaaccaaaaaaccaaataaaatagtcctttctttcttattgctgggcggtgtcccacggtgtggatgggccgtttgtttaaccatctgtcccttgaagggcatctggggtgtctccagcgtgggatgtcgtgaatttaaaaagctgctgccaactctaggtccaggttttcctgtgcacagatgtcttcgctttcccccagtggatgccaggagagctggtgctgggccgtgtggaagttgtatggctgagttcacgtggtcactctggtgctggcagggcagggaaatggggggccagagaggaagctgggggtcatgggagggatgccacctctagggaggggtgcctgtgtccaaggagtggagatagtggctgggtctggtgggggctgtggaggtaggggggctgcatggtagggcagaggccaggagtctgggactgggtggtcctgtcttt

SEQ ID NO: 50128 - DNA, 601 bp, Human
gcagccggggcaggggtgcgtccatggtggggatggtgtgtctgggtggaaggggcggggcatctcccactcccggtggcattgaatagtgggaggggagtggctgggcgcggtggctcatgcctgtaatcccagcactttgggagactgaggtgggcggatcacttgagttcaggagtttgagaccagcctgggcatcataacgaagccccgtctctacagaaaatacaaaaattagctggggcatggtagcctgcgcctgcagtcccagccactccggaggctgaggtgggagaatcasttcagcccgggaggtgcaggttgcagtgagttgagattgggccactgcactctagcctgggcgacataatgagacgctgtctcaaaaaaataaataaataaataataaaacttggaaataaggcaaaaaatattatttaaagaaaacagaaagtgggaggggagaaatgcacaggatggagcctaggggagccccaggactcgagaagtgggcagaggaagaggaggcaggaggagggagggaggccgggcagcagctgggggaggagggcgtggacaggccgggaaaaggagcaaaggc

SEQ ID NO: 50129 - DNA, 601 bp, Human
ggcaggggtgcgtccatggtggggatggtgtgtctgggtggaaggggcggggcatctcccactcccggtggcattgaatagtgggaggggagtggctgggcgcggtggctcatgcctgtaatcccagcactttgggagactgaggtgggcggatcacttgagttcaggagtttgagaccagcctgggcatcataacgaagccccgtctctacagaaaatacaaaaattagctggggcatggtagcctgcgcctgcagtcccagccactccggaggctgaggtgggagaatcacttcagccygggaggtgcaggttgcagtgagttgagattgggccactgcactctagcctgggcgacataatgagacgctgtctcaaaaaaataaataaataaataataaaacttggaaataaggcaaaaaatattatttaaagaaaacagaaagtgggaggggagaaatgcacaggatggagcctaggggagccccaggactcgagaagtgggcagaggaagaggaggcaggaggagggagggaggccgggcagcagctgggggaggagggcgtggacaggccgggaaaaggagcaaaggcaggatgag

SEQ ID NO: 50130 - DNA, 601 bp, Human
ggccactgcactctagcctgggcgacataatgagacgctgtctcaaaaaaataaataaataaataataaaacttggaaataaggcaaaaaatattatttaaagaaaacagaaagtgggaggggagaaatgcacaggatggagcctaggggagccccaggactcgagaagtgggcagaggaagaggaggcaggaggagggagggaggccgggcagcagctgggggaggagggcgtggacaggccgggaaaaggagcaaaggcaggatgaggacacaacactggcctgtgcctggccttgtgrcaaacacctcatcccttaggccattggccatcgtccctgctgtcctacagccccgagaggccaggtacgtccatgtgtcgtgcccattttacagacggtggagctcaggcctgggagacagactgacagtgttcggcactaactccaccccagcctttttccacctggccacactgtttactcgttcccgccagcagcatgggggctctggtgtttctgcgtcctcatccgcacctgtcatcgcctgtctttttggttgcagccacttctgggatggatttcctggaggctggtgctgag

SEQ ID NO: 50131 - DNA, 601 bp, Human
agtaagactctgtctcaaaaaaaaaaaaagggggggcactgcgcaccagcctgggcaacatggcaaaaccccatttctataaaaaatgcaaaaaattagctgggcatggtggtgcctgtagtcccagctatgaggaaggctgaagcaggagtatcacttgagctcaggaaatcaaggctgccgtgagctatgatcacgccactgcattccagcctgggtgacagagcgagaccctgtcttaagaaaaaaaaaaaaaaagaaggattatttgtcttcttactgttgagttgtgacattttcrtaggctgtagacaccactgtgagccaccggctcccctgcaccccagcccacctggctgcaggctgcctgctccgttggaggttggacttctgagataaactgcgctgggtgtctgtctcttggctccagagtaccaggcacagtgccatgcacacagtaggtgctcagtaagcggcgacaggacaaagccaggatctcagtctgcggcttggaggggtctggggtccggctgtcactatctggctctgcttaccagctccggtcctcggacaccacgacggctgcaggcagagggaggag

SEQ ID NO: 50132 - DNA, 601 bp, Human
agtcccagctatgaggaaggctgaagcaggagtatcacttgagctcaggaaatcaaggctgccgtgagctatgatcacgccactgcattccagcctgggtgacagagcgagaccctgtcttaagaaaaaaaaaaaaaaagaaggattatttgtcttcttactgttgagttgtgacattttcgtaggctgtagacaccactgtgagccaccggctcccctgcaccccagcccacctggctgcaggctgcctgctccgttggaggttggacttctgagataaactgcgctgggtgtctgtctyttggctccagagtaccaggcacagtgccatgcacacagtaggtgctcagtaagcggcgacaggacaaagccaggatctcagtctgcggcttggaggggtctggggtccggctgtcactatctggctctgcttaccagctccggtcctcggacaccacgacggctgcaggcagagggaggagccacggagtctggggggatgttgggccacacaagtatctactgagcgccgactgtgtgctaggcaacaagctggccctggggacagtggtgaacaaagagccctaggacttcttggttg

SEQ ID NO: 50133 - DNA, 601 bp, Human
aggcagagggaggagccacggagtctggggggatgttgggccacacaagtatctactgagcgccgactgtgtgctaggcaacaagctggccctggggacagtggtgaacaaagagccctaggacttcttggttgggggaataggacccgtcagtcagccctgcacagcttcctgcggggcacggatggggcgcaaggaaggggctggagatgccttctagggagtgaggctggtgagcgggttggggaggaaccatggggcctcccagacttcaggaggcgcatctgtgagcaccagggasagaaggaacagggccaccctgggacccagtgcgcaaggagcccaagggccctcacacgtcacccttgggtgtgccagagccagtccagttgttaagaaaaacaagagccggaggtaaaccccttgggaaacagaggtcccagcccacagtactgcgtgggagggagaagtgtgggagtcacctgggctctggggtccctcaggccagcaatggggactgggatcccagcgcaggctgagcctgggtggctatgtccacactgcagagacctatcgtgagcaagtttatggtgcattcctg

SEQ ID NO: 50134 - DNA, 601 bp, Human
gccacacaagtatctactgagcgccgactgtgtgctaggcaacaagctggccctggggacagtggtgaacaaagagccctaggacttcttggttgggggaataggacccgtcagtcagccctgcacagcttcctgcggggcacggatggggcgcaaggaaggggctggagatgccttctagggagtgaggctggtgagcgggttggggaggaaccatggggcctcccagacttcaggaggcgcatctgtgagcaccagggacagaaggaacagggccaccctgggacccagtgcgcaaggagcccaagggccctcacacgtcacccttgggtgtgccagagccagtccagttgttaagaaaaacaagagccggaggtaaaccccttgggaaacagaggtcccagcccacagtactgcgtgggagggagaagtgtgggagtcacctgggctctggggtccctcaggccagcaatggggactgggatcccagcgcaggctgagcctgggtggctatgtccacactgcagagacctatcgtgagcaagtttatggtgcattcctgtgtggaagagtacagcagaggccaggggggtggggctgc

SEQ ID NO: 50135 - DNA, 601 bp, Human
ggggaggaaccatggggcctcccagacttcaggaggcgcatctgtgagcaccagggacagaaggaacagggccaccctgggacccagtgcgcaaggagcccaagggccctcacacgtcacccttgggtgtgccagagccagtccagttgttaagaaaaacaagagccggaggtaaaccccttgggaaacagaggtcccagcccacagtactgcgtgggagggagaagtgtgggagtcacctgggctctggggtccctcaggccagcaatggggactgggatcccagcgcaggctgagcctkggtggctatgtccacactgcagagacctatcgtgagcaagtttatggtgcattcctgtgtggaagagtacagcagaggccaggggggtggggctgcagcgacagtgaccaggagtcacccataggggcagggtcctggtgtcatgggccagagcgggccagagcggggacggggggcaaagggaaggagcatttgagcctggatgggggtgtggttagcagagaggtgggaggggagggagagagagagagaaggagagagagggagagaaggagagaagagagggagagggggagggga

SEQ ID NO: 50136 - DNA, 601 bp, Human
gtcagtcctgccatgggggggacgtgcgttgttcctcgcccctcccttccaggttttgatggtgctgtttcctgcgtttacaccacagctctttttgcgtctttccttggattccacacagcagccctgtgaggcgctgtcctcctgctgcccggaggaggagactgaggccagagatgcggcaaatttcccaaggccacacggttctgctgttggggcggcactgggcctccctgcccgcctgcctcagtctggccctgtgaagaggtctcttggaactgttaggagcattcgaaagaarctgggcccctgggctgggtacggtggctcgcgcctataatcccagcactttgggaggctgaggcctgagcacttgaggtcaggagtttgagaccagcttggccaacatggtggaaccccatctctaccaaaaaatacaaaaatcagccaggcatggtggcgggcgcctgtagtcccagctactcaggaggctgagacaggagaattgcttgagcccgggaggcggaggttgcagtgagccgaaatcgtgccactgcactccagcctgggcaacagagcgagactctgtctcaaaaggaaa

SEQ ID NO: 50137 - DNA, 601 bp, Human
ccagccatttcctcctctcctcctgggcttgggtctgaggtcagcttcccagggggcacccaagcctccgtgagcaaggacagagagtggctggagtgagaacgggtgctgctgacctttggcggtgggagggtgtctccagctgtgttcccatttctcagtgactaccaggtgctgtggcccttggctgcagaggggcgtgcaggcagcctctccttcctgtgaagcagcagctgtggcagggccgggaagtagagctcccctctgtgaggctgtggctggggtaggaggagagctctcycttctgcgaggctgtggctgggatggaagtctgccagaggcgggctcagaagaagttccatgaggaactgagggctgggacctgcaggaggagctgagggtgcatggggtctgggggagccccagagatggtcagggtctcctcctgataaatcagaccccccccccgccccaccctgccgctgagaggcctggtcctgctctaaacctggagtggatggggagcgtgggctggggctggggggctggggaggtggtgtagccagtgccctgccccaactcagcctctggtcacccttcc

SEQ ID NO: 50138 - DNA, 601 bp, Human
ttgggtctgaggtcagcttcccagggggcacccaagcctccgtgagcaaggacagagagtggctggagtgagaacgggtgctgctgacctttggcggtgggagggtgtctccagctgtgttcccatttctcagtgactaccaggtgctgtggcccttggctgcagaggggcgtgcaggcagcctctccttcctgtgaagcagcagctgtggcagggccgggaagtagagctcccctctgtgaggctgtggctggggtaggaggagagctctcccttctgcgaggctgtggctgggatggargtctgccagaggcgggctcagaagaagttccatgaggaactgagggctgggacctgcaggaggagctgagggtgcatggggtctgggggagccccagagatggtcagggtctcctcctgataaatcagaccccccccccgccccaccctgccgctgagaggcctggtcctgctctaaacctggagtggatggggagcgtgggctggggctggggggctggggaggtggtgtagccagtgccctgccccaactcagcctctggtcacccttccagggctggcaaggcattgggggtatgag

SEQ ID NO: 50139 - DNA, 601 bp, Human
acctctatttccttctgtgaaccccttgggagctgcagaccccgagttccggaccccctcacctcactctcctccttcggagccaaagtggtgcctgaaatctgaggccccatctctgagtcctgcactggtcctggcccgaacactcccccacaacgcatgggccacaaggaccctctgggcagattttggggtgtctttggaggtttaggggcaaagcttgaaaactgtggggtcctccctggggaccacatgcccagctgtggggtcccccgaggccgcagagcaagctttctggaaratcctcctcctttgagagccaccatggagcccccataatgggaatggagggtgttgccattaaacatggccttggcgttgcccagaagtctaggtgtgtccctgtcagctgggaggggacagggtaactgtgcggccctccccagggctgaggctggggcagcctccagaggccaggttgtcgctgtcactccccaaatggagggtccccctcattccctgattgcagaaaaagggctccagtaagtctggcttttaaaaaatacagctttgctgacatatgtttcacacaccgtacaat

SEQ ID NO: 50140 - DNA, 601 bp, Human
aaagtggtgcctgaaatctgaggccccatctctgagtcctgcactggtcctggcccgaacactcccccacaacgcatgggccacaaggaccctctgggcagattttggggtgtctttggaggtttaggggcaaagcttgaaaactgtggggtcctccctggggaccacatgcccagctgtggggtcccccgaggccgcagagcaagctttctggaagatcctcctcctttgagagccaccatggagcccccataatgggaatggagggtgttgccattaaacatggccttggcgttgcccrgaagtctaggtgtgtccctgtcagctgggaggggacagggtaactgtgcggccctccccagggctgaggctggggcagcctccagaggccaggttgtcgctgtcactccccaaatggagggtccccctcattccctgattgcagaaaaagggctccagtaagtctggcttttaaaaaatacagctttgctgacatatgtttcacacaccgtacaattcacccatttaaactgtacagtccagtggtttctagaatattcagagttgtgtcactctcaccataatcaattttagaacattt

SEQ ID NO: 50141 - DNA, 601 bp, Human
gggcaggtgggtcattcctgaaccctcagtgtttccctcctcgggggtcctggccagtcactctcctcctccacaccagcccccagcagctcgcaggctgcctgggcccagccccatcatcagccgctgggcacccacctgagaggtctgaaccctgcccttggtgctgcacggtcacttgccattttcgcagaggggccccctgagcaggaggagcagggccagcatgcacactgcagccaaggtcccaagaaggaagtggcgaggaggaggaggaggactggccccacctgttgccctwtgtctcacagcgcagactgggggagacgtgaggatctaacaggggttcctggggggccttcatcaagctgtaatgaatgttgtgccaaacccctgtcaacaccagtgggtacagcacagggttcaagggctgaagaagtgacccagggctagcaaaggagacccggggtttactgcgagccgtggggtggggagggaagtgcagggacgggagaaccgcagcggcttgtagacagcgcaaagttcctatggcatgttcaccccataccctcccctgatgacctccacctgccaaccttca

SEQ ID NO: 50142 - DNA, 601 bp, Human
gagtcttgtccccacagcacagattggtggaccttcagcccccacactggaggcactggccttccgaatcccttctcacctgagtggggtcaagacgcacctgggtcctatttgctgcccacctctggggccagctgctgttcttggcacctcccaccctagggggatggtgtctgcaaacggtgcttttggcctctggcatgtccaccctgccacaatcatcttcctcaccctcatctgcagaccttctgacaccacctctgctgacccctctccccttgtccttctggggagatcacgracctgccccttcctggcattccccagccagtcctccctggggagcaggactgtgcatcgaggccaggctcaggtcttcacccacacccacgttgacaacgtacgagtcccctctgagccttagtttctgtggctggaaaaatgaggttaatatcactattgtgagaatcttctcataaacgcatctttccttcccctcctccttaaaatttttaatccttattgagctattatgtgcccatagtttaaggtgacatttggtgctaaaaacaaaatagagcttggagcaaaaatcatgtgt

SEQ ID NO: 50143 - DNA, 601 bp, Human
cagtcctccctggggagcaggactgtgcatcgaggccaggctcaggtcttcacccacacccacgttgacaacgtacgagtcccctctgagccttagtttctgtggctggaaaaatgaggttaatatcactattgtgagaatcttctcataaacgcatctttccttcccctcctccttaaaatttttaatccttattgagctattatgtgcccatagtttaaggtgacatttggtgctaaaaacaaaatagagcttggagcaaaaatcatgtgtgtcttcagagactgaccaccatgttttyaagtgggtgtgtttgccgcttcctgagctcatggtcacttttagccattatctgttgactcctactgtagtagatggagattttcaatcccttagacccccattctccccactcccagctatctcaatattgctatattgcattttttgttgttaaatccatactcagtgtttttcattatgactatgtaagtattgcttactgctgagccaggcaatggagtctgattctgtacacttctcatgcataacttgagttagtaattgtctcgctttttttcagttgcaattttctttaaat

SEQ ID NO: 50144 - DNA, 601 bp, Human
gccaggctcaggtcttcacccacacccacgttgacaacgtacgagtcccctctgagccttagtttctgtggctggaaaaatgaggttaatatcactattgtgagaatcttctcataaacgcatctttccttcccctcctccttaaaatttttaatccttattgagctattatgtgcccatagtttaaggtgacatttggtgctaaaaacaaaatagagcttggagcaaaaatcatgtgtgtcttcagagactgaccaccatgtttttaagtgggtgtgtttgccgcttcctgagctcatgstcacttttagccattatctgttgactcctactgtagtagatggagattttcaatcccttagacccccattctccccactcccagctatctcaatattgctatattgcattttttgttgttaaatccatactcagtgtttttcattatgactatgtaagtattgcttactgctgagccaggcaatggagtctgattctgtacacttctcatgcataacttgagttagtaattgtctcgctttttttcagttgcaattttctttaaatcactggttcttttttcaccttccaactgctcagt

SEQ ID NO: 50145 - DNA, 601 bp, Human
tgcaattttctttaaatcactggttcttttttcaccttccaactgctcagtgaaacacctctcaaatgcagcttgcacttgagcaaacctgccagattcagtaatacacacaaatgtacaaatacgtttgtttattgattgattgccttcttcccaattcttcccccattttcctgggtatttccttcacttctcctgtgtttgatcttctcatgtcttctttcatggtttcctccctcatttgggtggagcacatcctggagtagcttcctaagaaaggatgcatggaagatatagtttctgtggcttgattatttgataaattggtatgcatagtatgctaggttgaaaatcatttctgctcataatttggggcggtgggggtgcagtttcccactgacttctaggttcagtgttgctcttgagaagcccatgctgttctgattctcagtccttcatttgtgatctgtttttatgtttctctggaagcatttagggtctttgtcatttgagttctgaatttcatgccactgtatcttggttgggtgtctctcccctcattgtgtggtatctgtgagccctccagtctggacgctcacac

SEQ ID NO: 50146 - DNA, 601 bp, Human
aggaatttatcctaaggataaattttaatgtcatatgaagattagctgtgaaaacggaggagcgacccgaataccttgcggcataggattagcttgtaatttatgtgcttgtgaaacggccgtgcaatgaatggggctccgtgcagccggggacaaagtgggtgcagagaggcaggagggacaggcacggggcatgggggccacccgtggagaaagccctggagctttgtgaatgccgtctgttggccagcgcagggctctcactgtcacgttggacctgtgcccagggtctggtccctgrtctgtgagggtcccagagggggcacaacaggcgaagaccccaaagacaggggtctgttccggggcatcctgggcagagagtgggtataggggacagaaacccagccaaagcggctcaagtggaagatgggtgctggtcgatatgggccagcctgaggggtgtcagagccgggaatggggaggccatcggaagcccacaggagccacttctgagttccctcagggtggaggcctggccgccttcccagtggtgcctgtttcttcctttctctgcgggttggcttctctgcgtccctgcctc

SEQ ID NO: 50147 - DNA, 601 bp, Human
acaaagtgggtgcagagaggcaggagggacaggcacggggcatgggggccacccgtggagaaagccctggagctttgtgaatgccgtctgttggccagcgcagggctctcactgtcacgttggacctgtgcccagggtctggtccctgatctgtgagggtcccagagggggcacaacaggcgaagaccccaaagacaggggtctgttccggggcatcctgggcagagagtgggtataggggacagaaacccagccaaagcggctcaagtggaagatgggtgctggtcgatatgggccagcctgaggggtgtcagagccgggaatggggaggccatcggaagcccacaggagccacttctgagttccctcagggtggaggcctggccgccttcccagtggtgcctgtttcttcctttctctgcgggttggcttctctgcgtccctgcctccaggtgggaaggggtccctgcaggcttcgtctcctcccagccgcagagccaccaccttgggctcccctgccccaggcccaggctggtggatctaattgggatttggtaagctgtgacgggaggggggctctggcccgtgcccacccatggga

SEQ ID NO: 50148 - DNA, 601 bp, Human
tgaggggctgtgctggcccagggctctggctttcggacccagacaatgctgctgaccaagcaggccaggcgctgagtgactgtcccagcggatctccgagcagggtcccttgagcattaggaatgcagcttctcaggccatgccagcctggcagaacaggaagggaggggtacagccctgtggggacgcagctgtggctcgagtgacacctgctggcggcctcatctcatccgctctctgcgagtctgtggtggttctagtcggcgtttcacgggcaaggtttagggggtttgttcctcasctggggtccacccacgtcttccgacttcctctctcggtgtttgggccatcggtgggtgaggtggctgcagcagagccgggggctcctgtgtgcggaggcagcaccgacatccactgcagccacaccctcctgagagggtctggaaggaagcagggcaccctgcgaacccacctgcctctggggtgtcttccggggccccagggccagggcaactggagcagacaggacattatctagctctgggggccgtgctgaccgagccagaccctcgcggcggcccacagagatgggcagcttgcg

SEQ ID NO: 50149 - DNA, 601 bp, Human
acccagacaatgctgctgaccaagcaggccaggcgctgagtgactgtcccagcggatctccgagcagggtcccttgagcattaggaatgcagcttctcaggccatgccagcctggcagaacaggaagggaggggtacagccctgtggggacgcagctgtggctcgagtgacacctgctggcggcctcatctcatccgctctctgcgagtctgtggtggttctagtcggcgtttcacgggcaaggtttagggggtttgttcctcacctggggtccacccacgtcttccgacttcctctctcrgtgtttgggccatcggtgggtgaggtggctgcagcagagccgggggctcctgtgtgcggaggcagcaccgacatccactgcagccacaccctcctgagagggtctggaaggaagcagggcaccctgcgaacccacctgcctctggggtgtcttccggggccccagggccagggcaactggagcagacaggacattatctagctctgggggccgtgctgaccgagccagaccctcgcggcggcccacagagatgggcagcttgcggggcagctttgtccccccgacactgggtcctgtctt

SEQ ID NO: 50150 - DNA, 601 bp, Human
gaggggtacagccctgtggggacgcagctgtggctcgagtgacacctgctggcggcctcatctcatccgctctctgcgagtctgtggtggttctagtcggcgtttcacgggcaaggtttagggggtttgttcctcacctggggtccacccacgtcttccgacttcctctctcggtgtttgggccatcggtgggtgaggtggctgcagcagagccgggggctcctgtgtgcggaggcagcaccgacatccactgcagccacaccctcctgagagggtctggaaggaagcagggcaccctgcsaacccacctgcctctggggtgtcttccggggccccagggccagggcaactggagcagacaggacattatctagctctgggggccgtgctgaccgagccagaccctcgcggcggcccacagagatgggcagcttgcggggcagctttgtccccccgacactgggtcctgtcttcatgcacacaagccgcctgttctgcaggtgaccagttaggttcgatgggacaggctttgggaatcagcggcttgggtttgccccccacagccttggatcttgaccttgggagaggcctccaccacgtg

SEQ ID NO: 50151 - DNA, 601 bp, Human
aactggagcagacaggacattatctagctctgggggccgtgctgaccgagccagaccctcgcggcggcccacagagatgggcagcttgcggggcagctttgtccccccgacactgggtcctgtcttcatgcacacaagccgcctgttctgcaggtgaccagttaggttcgatgggacaggctttgggaatcagcggcttgggtttgccccccacagccttggatcttgaccttgggagaggcctccaccacgtgccctggggtggggtgggggcgggggcgtcctgcatctgcgccgttcrgctcagttgccctcagccgcggttggccgccaagcactagggtgttgctggcacagccaaggaactgagcccagactttttgtttacttaatcaagcataaatgcaaagggctgggggtggccgagctgatggtgcaggcgtgtgtgctcaatagctccatcacagtggctgtcgctttattgagcaaccgagggagcgagggagaggagcaactgcggcgagcgtggaggcccagcccgcagagctcccgtctgggggaagccctgtccctcactgcctgttcccggcgctttggtgcc

SEQ ID NO: 50152 - DNA, 601 bp, Human
cacagagatgggcagcttgcggggcagctttgtccccccgacactgggtcctgtcttcatgcacacaagccgcctgttctgcaggtgaccagttaggttcgatgggacaggctttgggaatcagcggcttgggtttgccccccacagccttggatcttgaccttgggagaggcctccaccacgtgccctggggtggggtgggggcgggggcgtcctgcatctgcgccgttcggctcagttgccctcagccgcggttggccgccaagcactagggtgttgctggcacagccaaggaactgarcccagactttttgtttacttaatcaagcataaatgcaaagggctgggggtggccgagctgatggtgcaggcgtgtgtgctcaatagctccatcacagtggctgtcgctttattgagcaaccgagggagcgagggagaggagcaactgcggcgagcgtggaggcccagcccgcagagctcccgtctgggggaagccctgtccctcactgcctgttcccggcgctttggtgccctctgctgtggggtgatgaggtcaggctacgcaggcagtcacggcagaactgaaggccgtgtgctttcg

SEQ ID NO: 50153 - DNA, 601 bp, Human
agtttgctgcgagatcctgggtccctgactgtgttctcaaagcccctaggatttgaccagccgttcttttatcttaggagtcggaaatcttacatctgtatttttatttcgctgtgcttccgccccctgctctgctaccctcacctcactacgttgttttattggcatagtataaaattcacattttacaatatgcaattcagtggcactagcacattcacggggttctgatcatcagctctatcaggttgcaggccactttcatcaccccaaaaccccagccctgtgagcagccattccygctcctccccggccaccatccatctgtctctggatttacctgttcatgttatgggggggagagagagagagagtgtgtgtgtttgtgtgtgtgtgtgtgtgtgttttaaatgaaggcttgtggtacggggtctgttctcattttgcgccggtgttgggcctgaagtgtgtcctgtgtgcatgtctctgacccccggagtcatgggacccagtcacgtgctgcgctgacgtggagtccgaagttgtaaagacaaagctgggtgagaccctagtgactcacaggcccttctgctctcctttc

SEQ ID NO: 50154 - DNA, 601 bp, Human
ctgggtccctgactgtgttctcaaagcccctaggatttgaccagccgttcttttatcttaggagtcggaaatcttacatctgtatttttatttcgctgtgcttccgccccctgctctgctaccctcacctcactacgttgttttattggcatagtataaaattcacattttacaatatgcaattcagtggcactagcacattcacggggttctgatcatcagctctatcaggttgcaggccactttcatcaccccaaaaccccagccctgtgagcagccattcccgctcctccccggccaycatccatctgtctctggatttacctgttcatgttatgggggggagagagagagagagtgtgtgtgtttgtgtgtgtgtgtgtgtgtgttttaaatgaaggcttgtggtacggggtctgttctcattttgcgccggtgttgggcctgaagtgtgtcctgtgtgcatgtctctgacccccggagtcatgggacccagtcacgtgctgcgctgacgtggagtccgaagttgtaaagacaaagctgggtgagaccctagtgactcacaggcccttctgctctcctttccagatctgggactttc

SEQ ID NO: 50155 - DNA, 601 bp, Human
ccctgactgtgttctcaaagcccctaggatttgaccagccgttcttttatcttaggagtcggaaatcttacatctgtatttttatttcgctgtgcttccgccccctgctctgctaccctcacctcactacgttgttttattggcatagtataaaattcacattttacaatatgcaattcagtggcactagcacattcacggggttctgatcatcagctctatcaggttgcaggccactttcatcaccccaaaaccccagccctgtgagcagccattcccgctcctccccggccaccatccrtctgtctctggatttacctgttcatgttatgggggggagagagagagagagtgtgtgtgtttgtgtgtgtgtgtgtgtgtgttttaaatgaaggcttgtggtacggggtctgttctcattttgcgccggtgttgggcctgaagtgtgtcctgtgtgcatgtctctgacccccggagtcatgggacccagtcacgtgctgcgctgacgtggagtccgaagttgtaaagacaaagctgggtgagaccctagtgactcacaggcccttctgctctcctttccagatctgggactttctcgggg

SEQ ID NO: 50156 - DNA, 601 bp, Human
cagccgttcttttatcttaggagtcggaaatcttacatctgtatttttatttcgctgtgcttccgccccctgctctgctaccctcacctcactacgttgttttattggcatagtataaaattcacattttacaatatgcaattcagtggcactagcacattcacggggttctgatcatcagctctatcaggttgcaggccactttcatcaccccaaaaccccagccctgtgagcagccattcccgctcctccccggccaccatccatctgtctctggatttacctgttcatgttatggggaggagagagagagagagtgtgtgtgtttgtgtgtgtgtgtgtgtgtgttttaaatgaaggcttgtggtacggggtctgttctcattttgcgccggtgttgggcctgaagtgtgtcctgtgtgcatgtctctgacccccggagtcatgggacccagtcacgtgctgcgctgacgtggagtccgaagttgtaaagacaaagctgggtgagaccctagtgactcacaggcccttctgctctcctttccagatctgggactttctcggggacaaccctgggataacagccaccactggagtctat

SEQ ID NO: 50157 - DNA, 601 bp, Human
agccgttcttttatcttaggagtcggaaatcttacatctgtatttttatttcgctgtgcttccgccccctgctctgctaccctcacctcactacgttgttttattggcatagtataaaattcacattttacaatatgcaattcagtggcactagcacattcacggggttctgatcatcagctctatcaggttgcaggccactttcatcaccccaaaaccccagccctgtgagcagccattcccgctcctccccggccaccatccatctgtctctggatttacctgttcatgttatgggggagagagagagagagagtgtgtgtgtttgtgtgtgtgtgtgtgtgtgttttaaatgaaggcttgtggtacggggtctgttctcattttgcgccggtgttgggcctgaagtgtgtcctgtgtgcatgtctctgacccccggagtcatgggacccagtcacgtgctgcgctgacgtggagtccgaagttgtaaagacaaagctgggtgagaccctagtgactcacaggcccttctgctctcctttccagatctgggactttctcggggacaaccctgggataacagccaccactggagtctatg

SEQ ID NO: 50158 - DNA, 601 bp, Human
ttaggagtcggaaatcttacatctgtatttttatttcgctgtgcttccgccccctgctctgctaccctcacctcactacgttgttttattggcatagtataaaattcacattttacaatatgcaattcagtggcactagcacattcacggggttctgatcatcagctctatcaggttgcaggccactttcatcaccccaaaaccccagccctgtgagcagccattcccgctcctccccggccaccatccatctgtctctggatttacctgttcatgttatgggggggagagagagagagaatgtgtgtgtttgtgtgtgtgtgtgtgtgtgttttaaatgaaggcttgtggtacggggtctgttctcattttgcgccggtgttgggcctgaagtgtgtcctgtgtgcatgtctctgacccccggagtcatgggacccagtcacgtgctgcgctgacgtggagtccgaagttgtaaagacaaagctgggtgagaccctagtgactcacaggcccttctgctctcctttccagatctgggactttctcggggacaaccctgggataacagccaccactggagtctatgcttgaaggccattcc

SEQ ID NO: 50159 - DNA, 601 bp, Human
ttatttcgctgtgcttccgccccctgctctgctaccctcacctcactacgttgttttattggcatagtataaaattcacattttacaatatgcaattcagtggcactagcacattcacggggttctgatcatcagctctatcaggttgcaggccactttcatcaccccaaaaccccagccctgtgagcagccattcccgctcctccccggccaccatccatctgtctctggatttacctgttcatgttatgggggggagagagagagagagtgtgtgtgtttgtgtgtgtgtgtgtgtgttttttaaatgaaggcttgtggtacggggtctgttctcattttgcgccggtgttgggcctgaagtgtgtcctgtgtgcatgtctctgacccccggagtcatgggacccagtcacgtgctgcgctgacgtggagtccgaagttgtaaagacaaagctgggtgagaccctagtgactcacaggcccttctgctctcctttccagatctgggactttctcggggacaaccctgggataacagccaccactggagtctatgcttgaaggccattccgcctcgtggtgccctgggcgaatgtcgagg

SEQ ID NO: 50160 - DNA, 601 bp, Human
agggctgaggtgggtcggcttggttcatggcagggcttggggagtgaggagagtgaggagtaccgggacccggggtccctgctctgctcacctgctgagaatgagccagtgttggcctctggtctccatgtctgtagagaggcttctctgcttcccctcctgtagaatgggaacgacaacatccagccatagagtgctgagaattcagggacaggacacagcgaaggtgccccagtcccccttcctgaccccagcctggcgtcaccctctatccaagggaagaagcagggatctgcctacraatctctcaggatgtgaagtgtggcccccagcctggtgcctttgcagtgggcccaggacggagggtagccttggcacctggggaggacaggtgaacctggatccagactctgcctcaggtgacagccctgggttctaacgctgccccttccgcttcctggctgtgtgttcctagggcggccacagcccctctccagcctcagttgcctcacctgggaagagaggtgcagggcttttgcgatgatcataatagttaccatcaatcgagcattagcgactttccagcaccttaaggcagtta

SEQ ID NO: 50161 - DNA, 601 bp, Human
tctgcttcccctcctgtagaatgggaacgacaacatccagccatagagtgctgagaattcagggacaggacacagcgaaggtgccccagtcccccttcctgaccccagcctggcgtcaccctctatccaagggaagaagcagggatctgcctacaaatctctcaggatgtgaagtgtggcccccagcctggtgcctttgcagtgggcccaggacggagggtagccttggcacctggggaggacaggtgaacctggatccagactctgcctcaggtgacagccctgggttctaacgctgccscttccgcttcctggctgtgtgttcctagggcggccacagcccctctccagcctcagttgcctcacctgggaagagaggtgcagggcttttgcgatgatcataatagttaccatcaatcgagcattagcgactttccagcaccttaaggcagttaccctgtgatctgcacagccgccctcccctcgttgcagatgaggagactgagtcagagagaggttaacccagacattcccaaggttgtagattgagaaagtgttgagttgggattcgaactcaagtctgtctgaggcctcctagccc

SEQ ID NO: 50162 - DNA, 601 bp, Human
cagctcttgttcccatctgtatctgtaagctggagcatcccttgatggaggagggatctcagggagtgggtgagcctctcctctttccagggtcatcctccactttgcgggggcagcccaccttcctggagttccagctgagggggggcccaatttaacaagcactttgggaggttgaggtgggcggatcatgaggtccagagattgagaccatcctggccaacatggtgaaaccctgtctctactaaaaacagaaaaaaattagctgggtgtggtggtgcatgcctgtagtcccagctamtcaggaggctgaggcaggagaatcgattgaacctgggaggcaaaggttacagtgagctgagatcgcgctactgcactctagcctggcgacagagcaagactccatctcaaaaaaaaaagggttgtccggttacctgtgcatgccaggtaatcgacaaatgctttttatttttatttatgtatttgtttagagacagagtcttgctctgtcgcccaggctggagtgcagtggcatgatctgtgctcactgtaacctccacctcccaggttcaagtgatcctcctgcctcagcctcttgagt

SEQ ID NO: 50163 - DNA, 601 bp, Human
gatggcagtgaggttgtttccgacgttgatggcagtggacttgcctccaggttagctgcctccccaagcagctttgggggtacagaatgaccgaccagtgtgggatcccaaacatcctatccccttgcctgaaagtgggacgaggctgaagctgacctctcgctgagaccacctcattcggccccgtcctctgctgccacgtccttcttcctggtaccccccttctccagccccaaataagtcacgttcacaggatccccagctcaggctctgctcctggagaagctgccctcagaggctrcgttgccgattcctttttcaacggagaggctgcagcgtgtggcaggtgccaccatctcttggagtgaggcagcctcaggggctctgtccggggctgcagcctgattggtgatctttgcacgccccttctctgccctggctgggccatatgccacatggggcgtgaggggcctgcaacacaagtccctctgggggctcgtgatgtggttgagctggaagatacattctggaacatctaagaccccagccactgtcctgagtctggatgccgcgggtgccgggcatgggggctctgggcccg

SEQ ID NO: 50164 - DNA, 601 bp, Human
aagctgacctctcgctgagaccacctcattcggccccgtcctctgctgccacgtccttcttcctggtaccccccttctccagccccaaataagtcacgttcacaggatccccagctcaggctctgctcctggagaagctgccctcagaggctgcgttgccgattcctttttcaacggagaggctgcagcgtgtggcaggtgccaccatctcttggagtgaggcagcctcaggggctctgtccggggctgcagcctgattggtgatctttgcacgccccttctctgccctggctgggccatrtgccacatggggcgtgaggggcctgcaacacaagtccctctgggggctcgtgatgtggttgagctggaagatacattctggaacatctaagaccccagccactgtcctgagtctggatgccgcgggtgccgggcatgggggctctgggcccgggcactggggtgcttggaggtgctgtggaggaggggtggggctggcttggagcccatgggattcgattggagggtgggagtgtgagagaggagagagcgtgaacagagccttggacagaaaagcctggaaggatcaggaccctttggg

SEQ ID NO: 50165 - DNA, 601 bp, Human
gtcacttgaggctacaggactttgaattccacacttagtttggatcccaccctctggtgtggggcgtgtgagtggagggggcctggctagggaaagggggggggcagtggggagtggagggctgcttcgctccgagagatggcggcacctgccacccgctgcagcctctccgtttaaaaagtgactggcagaacaggagcagctgctgccagctcctgtccattttgtcctctgaaaagagaggtcggggtggccaggtcctcatttttcaggagacagaagagagctgaatttttatgtsaaatctcttggttttgagttgttagcaggtaattccaatgttttatgaaaacagcggtgggacgaataaaacctacgtatcagtaagtctcggcctccaggcctctggtctgcagcctgtgccaccgtgagttggaagagtggtggacggactctgttctccccgcaaaagccctttccagggtggcacatccacgccgttagtgcccggctgcagggagaagctcaaatgacaaatgaggcttgaggtttgccgcgttgggcgtcgtgctgaggcccagccgtcctcacggtgaccttt

SEQ ID NO: 50166 - DNA, 601 bp, Human
cccggctgcagggagaagctcaaatgacaaatgaggcttgaggtttgccgcgttgggcgtcgtgctgaggcccagccgtcctcacggtgacctttggcatgaggagtcctggttccactctacagacgaggacactgagggccagcggggcccagaaacttccctgagtcacagctcacagagcaagacatgggcccaggtctgctgaccgggtttcctttttattttattgtggtaagagaaatacagaatgtaccacgttagctacttttaagtatacaattcagtggtattaattacmttcacggtgttaggtagctgtcatcactgtttacctccaaggctttcccatcatcctactgcaaaactctgtccctattcaacactgaccccacaaccctccccagcccctgcacccaccgcgctttctgcatctctgagcgtgactactctaaggaccccgtgtacatggaatcatccgatatgtggccttttgtgcccagctcagttcactctgtgtaatgtcttcagcgttcatccacattgcagcctgtgtgagaatgttctaccttttcaaggctgaatgatgttccatcgtatg

SEQ ID NO: 50167 - DNA, 601 bp, Human
gtttgccgcgttgggcgtcgtgctgaggcccagccgtcctcacggtgacctttggcatgaggagtcctggttccactctacagacgaggacactgagggccagcggggcccagaaacttccctgagtcacagctcacagagcaagacatgggcccaggtctgctgaccgggtttcctttttattttattgtggtaagagaaatacagaatgtaccacgttagctacttttaagtatacaattcagtggtattaattaccttcacggtgttaggtagctgtcatcactgtttacctccaagrctttcccatcatcctactgcaaaactctgtccctattcaacactgaccccacaaccctccccagcccctgcacccaccgcgctttctgcatctctgagcgtgactactctaaggaccccgtgtacatggaatcatccgatatgtggccttttgtgcccagctcagttcactctgtgtaatgtcttcagcgttcatccacattgcagcctgtgtgagaatgttctaccttttcaaggctgaatgatgttccatcgtatggacggaccgcatggcgtctgtccatttaccaggtgatggact

SEQ ID NO: 50168 - DNA, 601 bp, Human
agagaaatacagaatgtaccacgttagctacttttaagtatacaattcagtggtattaattaccttcacggtgttaggtagctgtcatcactgtttacctccaaggctttcccatcatcctactgcaaaactctgtccctattcaacactgaccccacaaccctccccagcccctgcacccaccgcgctttctgcatctctgagcgtgactactctaaggaccccgtgtacatggaatcatccgatatgtggccttttgtgcccagctcagttcactctgtgtaatgtcttcagcgttcayccacattgcagcctgtgtgagaatgttctaccttttcaaggctgaatgatgttccatcgtatggacggaccgcatggcgtctgtccatttaccaggtgatggacttgtgggttgcctttccctttccagccatggaaacagtgctgctgagaacccaggtgcacaggcagctgctgcagtccccaccctcccttcttctggggatatcaggtctgctgattttatgtctgaaggtcatgggccactgtcccttccctatgcccttgaatctcttccatggtgtgtccactgtgtggtctt

SEQ ID NO: 50169 - DNA, 601 bp, Human
tactgcaaaactctgtccctattcaacactgaccccacaaccctccccagcccctgcacccaccgcgctttctgcatctctgagcgtgactactctaaggaccccgtgtacatggaatcatccgatatgtggccttttgtgcccagctcagttcactctgtgtaatgtcttcagcgttcatccacattgcagcctgtgtgagaatgttctaccttttcaaggctgaatgatgttccatcgtatggacggaccgcatggcgtctgtccatttaccaggtgatggacttgtgggttgcctttmcctttccagccatggaaacagtgctgctgagaacccaggtgcacaggcagctgctgcagtccccaccctcccttcttctggggatatcaggtctgctgattttatgtctgaaggtcatgggccactgtcccttccctatgcccttgaatctcttccatggtgtgtccactgtgtggtcttcctggatacctccagcaatggggagctcactgtctcccagagcagcccattcagggcttagtgtgtagcccacacctgtgtccctgtagctgccactcattagcctcctaacccaggacg

SEQ ID NO: 50170 - DNA, 601 bp, Human
ctgcacccaccgcgctttctgcatctctgagcgtgactactctaaggaccccgtgtacatggaatcatccgatatgtggccttttgtgcccagctcagttcactctgtgtaatgtcttcagcgttcatccacattgcagcctgtgtgagaatgttctaccttttcaaggctgaatgatgttccatcgtatggacggaccgcatggcgtctgtccatttaccaggtgatggacttgtgggttgcctttccctttccagccatggaaacagtgctgctgagaacccaggtgcacaggcagctrctgcagtccccaccctcccttcttctggggatatcaggtctgctgattttatgtctgaaggtcatgggccactgtcccttccctatgcccttgaatctcttccatggtgtgtccactgtgtggtcttcctggatacctccagcaatggggagctcactgtctcccagagcagcccattcagggcttagtgtgtagcccacacctgtgtccctgtagctgccactcattagcctcctaacccaggacgcgtttccttgtgcccttggcaggggctccgtattcactctgggttctgtggtc

SEQ ID NO: 50171 - DNA, 601 bp, Human
catctctgagcgtgactactctaaggaccccgtgtacatggaatcatccgatatgtggccttttgtgcccagctcagttcactctgtgtaatgtcttcagcgttcatccacattgcagcctgtgtgagaatgttctaccttttcaaggctgaatgatgttccatcgtatggacggaccgcatggcgtctgtccatttaccaggtgatggacttgtgggttgcctttccctttccagccatggaaacagtgctgctgagaacccaggtgcacaggcagctgctgcagtccccaccctccctycttctggggatatcaggtctgctgattttatgtctgaaggtcatgggccactgtcccttccctatgcccttgaatctcttccatggtgtgtccactgtgtggtcttcctggatacctccagcaatggggagctcactgtctcccagagcagcccattcagggcttagtgtgtagcccacacctgtgtccctgtagctgccactcattagcctcctaacccaggacgcgtttccttgtgcccttggcaggggctccgtattcactctgggttctgtggtcctcactctgcaccacagactc

SEQ ID NO: 50172 - DNA, 601 bp, Human
atctctgagcgtgactactctaaggaccccgtgtacatggaatcatccgatatgtggccttttgtgcccagctcagttcactctgtgtaatgtcttcagcgttcatccacattgcagcctgtgtgagaatgttctaccttttcaaggctgaatgatgttccatcgtatggacggaccgcatggcgtctgtccatttaccaggtgatggacttgtgggttgcctttccctttccagccatggaaacagtgctgctgagaacccaggtgcacaggcagctgctgcagtccccaccctcccttcttctggggatatcaggtctgctgattttatgtctgaaggtcatgggccactgtcccttccctatgcccttgaatctcttccatggtgtgtccactgtgtggtcttcctggatacctccagcaatggggagctcactgtctcccagagcagcccattcagggcttagtgtgtagcccacacctgtgtccctgtagctgccactcattagcctcctaacccaggacgcgtttccttgtgcccttggcaggggctccgtattcactctgggttctgtggtcctcactctgcaccacagactct

SEQ ID NO: 50173 - DNA, 601 bp, Human
atcacagcacttctggaggctgaggcaggatcacttgagcccatgagttagaaaccagcctggccaacataatgagactgccatctctacaaataatttacaaagtagtggagcatggtggtgcacgcctgtagtcccagctgcgcaggaggctgaggcaggaggatcgcctgagcccaggggttcctggctgtcgtgagctgtgatggtctcactgcactccagcctgggcaacacagcgagaacctgtctcaaaaaacacaaaacaacaggaagctcagacaggactgtggctgcttcmaccctgtccgtggccaggctgtgccccctcctctgtcgctgggcactcacccctctctcattttctccccagggacctaccagggccagtgggtcggtggcatgcgccagggctacggcgtccggcagagcgtcccgtatggcatggccgcggtcatccgctcacccctgaggacgtccatcaactccctgcgcagcgagcacaccaacggcacggcgctgcatcccgacgcctctccggcggtggccggcagcccggccgtgtcccgcgggggcttcgtgctcgtggcccacagtgact

SEQ ID NO: 50174 - DNA, 601 bp, Human
ctctctcattttctccccagggacctaccagggccagtgggtcggtggcatgcgccagggctacggcgtccggcagagcgtcccgtatggcatggccgcggtcatccgctcacccctgaggacgtccatcaactccctgcgcagcgagcacaccaacggcacggcgctgcatcccgacgcctctccggcggtggccggcagcccggccgtgtcccgcgggggcttcgtgctcgtggcccacagtgactccgagatcctcaagagcaagaagaaggggctgtttcggcgctcgctgctgagygggctgaagctgcgcaagtcggagtccaagagcagcctggccagccaacgcagcaagcagagctcctttcgcagcgaggcgggcatgagcaccgtcagctccacggccagcgacatccactccaccatcagcctgggcgaggctgaggccgagctggcggtcatcgaggacgacatcgacgccaccaccaccgagacctacgtgggcgagtggaagaacgacaaacgctccggcttcggcgtgagccagcgctcggacgggctcaagtacgagggcgagtgggccagcaaccggcgccat

SEQ ID NO: 50175 - DNA, 601 bp, Human
gacctaccagggccagtgggtcggtggcatgcgccagggctacggcgtccggcagagcgtcccgtatggcatggccgcggtcatccgctcacccctgaggacgtccatcaactccctgcgcagcgagcacaccaacggcacggcgctgcatcccgacgcctctccggcggtggccggcagcccggccgtgtcccgcgggggcttcgtgctcgtggcccacagtgactccgagatcctcaagagcaagaagaaggggctgtttcggcgctcgctgctgagtgggctgaagctgcgcaagtcrgagtccaagagcagcctggccagccaacgcagcaagcagagctcctttcgcagcgaggcgggcatgagcaccgtcagctccacggccagcgacatccactccaccatcagcctgggcgaggctgaggccgagctggcggtcatcgaggacgacatcgacgccaccaccaccgagacctacgtgggcgagtggaagaacgacaaacgctccggcttcggcgtgagccagcgctcggacgggctcaagtacgagggcgagtgggccagcaaccggcgccatggctacggctgcatgaccttc

SEQ ID NO: 50176 - DNA, 601 bp, Human
ccgctcacccctgaggacgtccatcaactccctgcgcagcgagcacaccaacggcacggcgctgcatcccgacgcctctccggcggtggccggcagcccggccgtgtcccgcgggggcttcgtgctcgtggcccacagtgactccgagatcctcaagagcaagaagaaggggctgtttcggcgctcgctgctgagtgggctgaagctgcgcaagtcggagtccaagagcagcctggccagccaacgcagcaagcagagctcctttcgcagcgaggcgggcatgagcaccgtcagctccacrgccagcgacatccactccaccatcagcctgggcgaggctgaggccgagctggcggtcatcgaggacgacatcgacgccaccaccaccgagacctacgtgggcgagtggaagaacgacaaacgctccggcttcggcgtgagccagcgctcggacgggctcaagtacgagggcgagtgggccagcaaccggcgccatggctacggctgcatgaccttcccggacggcaccaaggaggagggcaagtacaagcagaacatcctcgtcggcggcaagcgcaagaacctcatccccctgcgggcc

SEQ ID NO: 50177 - DNA, 601 bp, Human
gagtgggctgaagctgcgcaagtcggagtccaagagcagcctggccagccaacgcagcaagcagagctcctttcgcagcgaggcgggcatgagcaccgtcagctccacggccagcgacatccactccaccatcagcctgggcgaggctgaggccgagctggcggtcatcgaggacgacatcgacgccaccaccaccgagacctacgtgggcgagtggaagaacgacaaacgctccggcttcggcgtgagccagcgctcggacgggctcaagtacgagggcgagtgggccagcaaccggcgycatggctacggctgcatgaccttcccggacggcaccaaggaggagggcaagtacaagcagaacatcctcgtcggcggcaagcgcaagaacctcatccccctgcgggccagcaagatccgcgagaaggtggaccgcgccgttgaggccgctgagcgggccgccaccatcgccaagcagaaggctgagatcgcggcttccaggtaggagggcgagggggcggggggcccttcttggtgcccagaaggtgtttgtgagcccagtctgttcagtcctgctgtcgctcaaggccttgggctaggc

SEQ ID NO: 50178 - DNA, 601 bp, Human
tggtccccgccaagctgtggctggcaggagccacctgctgcaggttggaggaagttcccctgtggaaagccacgggccccacaggtaggcatttgggttctaaagtaactgaggttactaaagggctttgtcaagacttgggaaggcatttcagaaaacccagagcctttgctttccaccggcatttgctttcctgggccagacgagggcccttggggtagcccggagagtcttggggcagggatctgggagctgcgggggagtccatgggctgcccaggcaggaggcttcccagggcacsttcccctgcgtctttctggatggctttgtgttctcagccaggggcagacctggagttcctccaggaaagctcccagcctgggtgcggctcagcccttcccgacctgtcgctaattaaagttcagcccatttggttctgattttcagtgacctttgatctatagtgaaaaacaaaaatggtggctgcggtttgttggcagaatatgttgctcgcgacttctattgttttagagggaatcaagatcgattccaagaagctgaaagaaacatggaattactacctgacaccgaggtccaaact

SEQ ID NO: 50179 - DNA, 601 bp, Human
tgatctatagtgaaaaacaaaaatggtggctgcggtttgttggcagaatatgttgctcgcgacttctattgttttagagggaatcaagatcgattccaagaagctgaaagaaacatggaattactacctgacaccgaggtccaaactcgctgtttgcccctccctgctccctcagaaatgttcaggcagggaaataaacagcagcccacgtgtgactactcatctggggttttaagaacaaattagaatcagtagttattttttccatcataaatgtaatacttgttccacaggaaaatamataacactgagaagggagaaagcagcattagctctggtctgatggatcggccgagcgctctccttggcattttggtgaatttctttcctctgtgttttgtttttcgaccctttctattttgtatagttgcttttttgaccctagtggacaagaagcagttttgggggctgggggacagcggcgtcacggaattgaggaagctcgtggcagcttccgtgtgacctgcagattggttcatgagttcattggttcatgagttctcagcagctcgaggacttagtggacagtgccctgcaggac

SEQ ID NO: 50180 - DNA, 601 bp, Human
tatagttgcttttttgaccctagtggacaagaagcagttttgggggctgggggacagcggcgtcacggaattgaggaagctcgtggcagcttccgtgtgacctgcagattggttcatgagttcattggttcatgagttctcagcagctcgaggacttagtggacagtgccctgcaggactgagcttatttcacagccttggcactgggtggatgtctgtaggactggggggacctgcgacctgagatagttttcagacgaattcccctagacattaagagaagcgggttcccattaaggarcccaggtggcatggacagggctgggggcagcacaggtgaggagctgctccaaggcaggttgtcagcctctctggacctcaacttctaatctctgaaggcctgtgaagcttaggtggtaacagctcccttcctggggcatccaacctcttcctggggttttggggggcccaggggctctgtggagcattgctgggggagatgcctacgtataagtgggcatcatgctggggtgaaagcccaggggctgggccgggagggcgagacctgagacccatgcaaaggagccggggccagggtggg

SEQ ID NO: 50181 - DNA, 601 bp, Human
gtacggctgcacaggtgcgcctaggtggaggtctccaggtcactggaacttaaagtgtccaagagaggaggtgtcaggcctcaaaggggcactaggaactggcgtctcacccttgcctctgagacccgcagacccacatccagcctgggctgtcgtggctgagtgccccaggccggtcgcctcccctctctgggctgggttccctgctgaaggggggcggggctccctgctccctgtagtggcctcggcgtggggccgggcctgtggttgcaccatctccattggtgtcatcctcccccagccctgctgtgacaggcatgggaggcaggtgtgtttgtgagctcactggtgcgacccttggaggtgggaggctacacagtatttttggtcatcagaggatggaggatgagcctgcattctgggctgcagggcctggagctgtgctttctcaatggacttagaatttggggaaaaaaaaaaggaaaaaaaggagggaagagagtctgccgccctggagagtgaagctgatgaatggctggctcaggcgcccacagccccagggccaaccctccactggagcatgagagcggccgcaccacgt

SEQ ID NO: 50182 - DNA, 601 bp, Human
tctgccgccctggagagtgaagctgatgaatggctggctcaggcgcccacagccccagggccaaccctccactggagcatgagagcggccgcaccacgtgggctgaggagtgactggccccgggcgggctcctgccactatcacagtcgagagatgcgagggagttgtagggcagctggcactgtcctcacccgccccggccggcagggcttgtcaggccgcgtgaagtgagaaacggtttgcggtgtcctccgcggagtgccgggcccttccccggagagcagctctgcagggaagggamgtgggttttcctggaaaacggggcgggaggtgtggagctcggagagactgaggtcctgcactgctaaggggactggccccggccctgggctgggagagggggagctgggactcagcccagggtggagtcaccatgggttctaaggcacaggatggataccctcctcggccatgtgacatcattgtttgggatgcgcccagtgttcggagccttcgaggctctccaggtgcctggagggcttgtagaaatggtggtcaggccccacgccccagactttgtctcatcatgtctaggtggggg

SEQ ID NO: 50183 - DNA, 601 bp, Human
tgggggccccagcacctgcatgctgacctggtccccaggacgcagatgctgctggcctgagcgtccccggctgtctcctgtctggtgtgggtgctgccgccgggaggccttggccccacggggagatgaggcatcacacacgcagccacaacacgggtcggaggcagagtccagcccagcaagggtgtggcagtggagacgagggaggggtgaagctggtggttccaggaggttccgtctgggtgagaccctctgctgcagagaggggcgggagccagtggccccgcggagctgaggtcakgtgagaaggggctgcagtctcttctgtgtcattctcctgtggggtcagcctcaccccagtgggaactcccactagtgaaagtctgagatggccccatcctgccgtgtcgcctagcagtgcaccacagggcattcggcccctcctgccttcacacactcaagacgttttcatgactcatctcctgccaggagggcacacacagggcacctttgcacggcgctgcctgtcctgaatgcctcgctgtccccgggtggacataggaattcatcacagtcctcctcgaagcccgggttgctctag

SEQ ID NO: 50184 - DNA, 601 bp, Human
ggtccccaggacgcagatgctgctggcctgagcgtccccggctgtctcctgtctggtgtgggtgctgccgccgggaggccttggccccacggggagatgaggcatcacacacgcagccacaacacgggtcggaggcagagtccagcccagcaagggtgtggcagtggagacgagggaggggtgaagctggtggttccaggaggttccgtctgggtgagaccctctgctgcagagaggggcgggagccagtggccccgcggagctgaggtcatgtgagaaggggctgcagtctcttctgtgycattctcctgtggggtcagcctcaccccagtgggaactcccactagtgaaagtctgagatggccccatcctgccgtgtcgcctagcagtgcaccacagggcattcggcccctcctgccttcacacactcaagacgttttcatgactcatctcctgccaggagggcacacacagggcacctttgcacggcgctgcctgtcctgaatgcctcgctgtccccgggtggacataggaattcatcacagtcctcctcgaagcccgggttgctctagaagatgaaactcaattgctgtccttgatc

SEQ ID NO: 50185 - DNA, 601 bp, Human
tggtggttccaggaggttccgtctgggtgagaccctctgctgcagagaggggcgggagccagtggccccgcggagctgaggtcatgtgagaaggggctgcagtctcttctgtgtcattctcctgtggggtcagcctcaccccagtgggaactcccactagtgaaagtctgagatggccccatcctgccgtgtcgcctagcagtgcaccacagggcattcggcccctcctgccttcacacactcaagacgttttcatgactcatctcctgccaggagggcacacacagggcacctttgcacrgcgctgcctgtcctgaatgcctcgctgtccccgggtggacataggaattcatcacagtcctcctcgaagcccgggttgctctagaagatgaaactcaattgctgtccttgatctgctgctcactagaggccctgggttgggaatcggaatgtaaatgtgtcacccatcctagagaagaaagtcctgcagtgtgacatggcttcattttcaacagctgagaccctctgccacaacaactctcacagccccctcatccccacccgccgtggaaaccaaataaaagcagaaagctctggtgga

SEQ ID NO: 50186 - DNA, 601 bp, Human
ccgtctgggtgagaccctctgctgcagagaggggcgggagccagtggccccgcggagctgaggtcatgtgagaaggggctgcagtctcttctgtgtcattctcctgtggggtcagcctcaccccagtgggaactcccactagtgaaagtctgagatggccccatcctgccgtgtcgcctagcagtgcaccacagggcattcggcccctcctgccttcacacactcaagacgttttcatgactcatctcctgccaggagggcacacacagggcacctttgcacggcgctgcctgtcctgaaygcctcgctgtccccgggtggacataggaattcatcacagtcctcctcgaagcccgggttgctctagaagatgaaactcaattgctgtccttgatctgctgctcactagaggccctgggttgggaatcggaatgtaaatgtgtcacccatcctagagaagaaagtcctgcagtgtgacatggcttcattttcaacagctgagaccctctgccacaacaactctcacagccccctcatccccacccgccgtggaaaccaaataaaagcagaaagctctggtggaagccgagctgggggcgat

SEQ ID NO: 50187 - DNA, 601 bp, Human
gcattcggcccctcctgccttcacacactcaagacgttttcatgactcatctcctgccaggagggcacacacagggcacctttgcacggcgctgcctgtcctgaatgcctcgctgtccccgggtggacataggaattcatcacagtcctcctcgaagcccgggttgctctagaagatgaaactcaattgctgtccttgatctgctgctcactagaggccctgggttgggaatcggaatgtaaatgtgtcacccatcctagagaagaaagtcctgcagtgtgacatggcttcattttcaacrgctgagaccctctgccacaacaactctcacagccccctcatccccacccgccgtggaaaccaaataaaagcagaaagctctggtggaagccgagctgggggcgatggggcagattgtagcccgtttctccttcccgtccccctccccactttggcccctgggacctgctcagaaccccagggtgaaggagacatctcaagtgtgacccattggctgcttctgctgcgggagagggagagacggggtggcccatgtgaaagctatgcctcctgcagccccgcaaagcctgcaaaagctcag

SEQ ID NO: 50188 - DNA, 601 bp, Human
catggcttcattttcaacagctgagaccctctgccacaacaactctcacagccccctcatccccacccgccgtggaaaccaaataaaagcagaaagctctggtggaagccgagctgggggcgatggggcagattgtagcccgtttctccttcccgtccccctccccactttggcccctgggacctgctcagaaccccagggtgaaggagacatctcaagtgtgacccattggctgcttctgctgcgggagagggagagacggggtggcccatgtgaaagctatgcctcctgcagccccgcraagcctgcaaaagctcagccagcatttgatgggattgtttctgctgggaccccctctctgctgcgtctcgtgcaaacgttgctgtgaagggatgccaaggggttttgcaaagcagaaacccaagctgagaggaggagaagggattgttctgggggcaggcccaccttgattcagggggtttcgcttcattgtgctttgcagacgctgtgtttttacacattggaggtttgtggcacccgtgcatggggcaagcctcttggtgccgttttcccaacagcacgtgctcacatcgtgtgtccg

SEQ ID NO: 50189 - DNA, 601 bp, Human
ttttcaacagctgagaccctctgccacaacaactctcacagccccctcatccccacccgccgtggaaaccaaataaaagcagaaagctctggtggaagccgagctgggggcgatggggcagattgtagcccgtttctccttcccgtccccctccccactttggcccctgggacctgctcagaaccccagggtgaaggagacatctcaagtgtgacccattggctgcttctgctgcgggagagggagagacggggtggcccatgtgaaagctatgcctcctgcagccccgcaaagcctgcaraagctcagccagcatttgatgggattgtttctgctgggaccccctctctgctgcgtctcgtgcaaacgttgctgtgaagggatgccaaggggttttgcaaagcagaaacccaagctgagaggaggagaagggattgttctgggggcaggcccaccttgattcagggggtttcgcttcattgtgctttgcagacgctgtgtttttacacattggaggtttgtggcacccgtgcatggggcaagcctcttggtgccgttttcccaacagcacgtgctcacatcgtgtgtccgtgccacactt

SEQ ID NO: 50190 - DNA, 601 bp, Human
agaccctctgccacaacaactctcacagccccctcatccccacccgccgtggaaaccaaataaaagcagaaagctctggtggaagccgagctgggggcgatggggcagattgtagcccgtttctccttcccgtccccctccccactttggcccctgggacctgctcagaaccccagggtgaaggagacatctcaagtgtgacccattggctgcttctgctgcgggagagggagagacggggtggcccatgtgaaagctatgcctcctgcagccccgcaaagcctgcaaaagctcagccagsatttgatgggattgtttctgctgggaccccctctctgctgcgtctcgtgcaaacgttgctgtgaagggatgccaaggggttttgcaaagcagaaacccaagctgagaggaggagaagggattgttctgggggcaggcccaccttgattcagggggtttcgcttcattgtgctttgcagacgctgtgtttttacacattggaggtttgtggcacccgtgcatggggcaagcctcttggtgccgttttcccaacagcacgtgctcacatcgtgtgtccgtgccacactttggtaattctcac

SEQ ID NO: 50191 - DNA, 601 bp, Human
aaataaaagcagaaagctctggtggaagccgagctgggggcgatggggcagattgtagcccgtttctccttcccgtccccctccccactttggcccctgggacctgctcagaaccccagggtgaaggagacatctcaagtgtgacccattggctgcttctgctgcgggagagggagagacggggtggcccatgtgaaagctatgcctcctgcagccccgcaaagcctgcaaaagctcagccagcatttgatgggattgtttctgctgggaccccctctctgctgcgtctcgtgcaaacgtygctgtgaagggatgccaaggggttttgcaaagcagaaacccaagctgagaggaggagaagggattgttctgggggcaggcccaccttgattcagggggtttcgcttcattgtgctttgcagacgctgtgtttttacacattggaggtttgtggcacccgtgcatggggcaagcctcttggtgccgttttcccaacagcacgtgctcacatcgtgtgtccgtgccacactttggtaattctcacggtatttcaagctttttcatgattatatctgttcatggtgatctgtgatcagtggtc

SEQ ID NO: 50192 - DNA, 601 bp, Human
gctggaaacgagcagaggctggttcatcaggtttaaggaaagaagccgcttccagaacataaagtgcaaggtgagggagcaggttacccagaagatctggctaagattgttgatgaaggtggctacactaaacagattttcagtgtcgatggaacagctttctattggaaggagattccatctaggactttcatgctaggaagaagctaatggctggatttgaaggacaggctgactctcttgttaggggccagcacagctggaaatgttaacttgaagccagtgttcattgaacattccmaaaatcctagggcccataagaattgtgtaaaatccactctgtgctctagaaatggaacaacaaagacctggatggctgcacggcttacagcatggtttccagaatagttttaagcccagtgttgtgatctactgctcagaaaaagattccttttaaaatattactactcaccccggagcgcccatggagatgtacaggaagatgaatgttgtttgcgtgcctgctaacataacatccagcatgcagctgtggatcaaggactaattttgactttgaggtcttattatttaagaaatacat

SEQ ID NO: 50193 - DNA, 601 bp, Human
ggagcctgccgatgggactgcattgctgcaagctcacgaccacactcgaaagactgaggagttgctgcttaggggtgaaacgagaaaatggtttcttgcgatggaatctactcctggcgaagatgctgcagacattgttgaagtgacagcaaagatttagaatgttccttcaatttagttgataaaacagcagcagagtttgaggggattgactccagtttccaatgaagctctaccgtgagtcaaatgctatcaaatagcatcacatgctacagagaaatcttttgtgaaaggaagagtycattgatgcagccaacattgttgtcgttttttttttgttttgttttgagatggagtctcgctctgttgcccaggctggagtgcagtggcacgatcttggctcactgcaagctccgcctcccaggttcacgccattctcctgcctcagcctcccaagtagctgggactacaggcgcccaccaccgtgcccagctaatttttttgtatttttagtagagatggggtttcaccgtattagctaggatggtctcgatctcctgacctcgagatccgcccacctcggcctcccaaaatgctggga

SEQ ID NO: 50194 - DNA, 601 bp, Human
cgaccacactcgaaagactgaggagttgctgcttaggggtgaaacgagaaaatggtttcttgcgatggaatctactcctggcgaagatgctgcagacattgttgaagtgacagcaaagatttagaatgttccttcaatttagttgataaaacagcagcagagtttgaggggattgactccagtttccaatgaagctctaccgtgagtcaaatgctatcaaatagcatcacatgctacagagaaatcttttgtgaaaggaagagttcattgatgcagccaacattgttgtcgttttttttttgttttgttttgagatggagtctcgctctgttgcccaggctggagtgcagtggcacgatcttggctcactgcaagctccgcctcccaggttcacgccattctcctgcctcagcctcccaagtagctgggactacaggcgcccaccaccgtgcccagctaatttttttgtatttttagtagagatggggtttcaccgtattagctaggatggtctcgatctcctgacctcgagatccgcccacctcggcctcccaaaatgctgggattacaggcgtgagccaccgcgcccagcctgttagaa

SEQ ID NO: 50195 - DNA, 601 bp, Human
ttcacattttttagcaacaaagtattttaaaattaagatttgcaattttttaagatataatgctatagcacgcttaatagactacaatatagtagaaacataacttttttctttttcgtgacagggtcttactctgccgtccaggccggagcgcagtggtgccatcacgactcactgcaaccttcacgtcccgggctcaagtgatcctcctgcttccgccttccgagtagcgtgtggggagggtgcacgcagctgggctaggatggcctggctggggtcagcccccgtctgtcctggaggscaggcaggtgcggagcttacggaggtggccacctagatgatggtgcctactctcgtgagttgaggcccttggatctctggcagtcagcaggactgtggtggcagccggtgtgctggttgtcagctgatgtccctgtctgtgatttttccgtgtgaatgcagccttgactgggcatgtagatcagaggtgacaagtcctgggcacctctgccactcttcttcctgccctgcacccactacagacacagctaattggtggctgcgttgagaatcttgtcaccaggcaggctcttctgtcggc

SEQ ID NO: 50196 - DNA, 601 bp, Human
cgggctcaagtgatcctcctgcttccgccttccgagtagcgtgtggggagggtgcacgcagctgggctaggatggcctggctggggtcagcccccgtctgtcctggaggccaggcaggtgcggagcttacggaggtggccacctagatgatggtgcctactctcgtgagttgaggcccttggatctctggcagtcagcaggactgtggtggcagccggtgtgctggttgtcagctgatgtccctgtctgtgatttttccgtgtgaatgcagccttgactgggcatgtagatcagaggtgasaagtcctgggcacctctgccactcttcttcctgccctgcacccactacagacacagctaattggtggctgcgttgagaatcttgtcaccaggcaggctcttctgtcggctcaggactgtcctgcgggcatagcaggaagtgaactgcagggggaagttggggcctggttgctgaggagggcagtgcgtggtctccaagccagtcagtgcctgcgggggggactagaattctcacccaggcctctgctctcagtcctgttcctcctctcacattcttcacacccaggctgggctcagggat

SEQ ID NO: 50197 - DNA, 601 bp, Human
cctactctcgtgagttgaggcccttggatctctggcagtcagcaggactgtggtggcagccggtgtgctggttgtcagctgatgtccctgtctgtgatttttccgtgtgaatgcagccttgactgggcatgtagatcagaggtgacaagtcctgggcacctctgccactcttcttcctgccctgcacccactacagacacagctaattggtggctgcgttgagaatcttgtcaccaggcaggctcttctgtcggctcaggactgtcctgcgggcatagcaggaagtgaactgcagggggargttggggcctggttgctgaggagggcagtgcgtggtctccaagccagtcagtgcctgcgggggggactagaattctcacccaggcctctgctctcagtcctgttcctcctctcacattcttcacacccaggctgggctcagggatccttgttgatgatggccttgaaatgtcctctgaacagtgtggctctgggggtgtgtaaaacccagggtgatgcctgctctgaaaggggcttccagatccctttgtgtctccagcacctgccgtgtgcctgccccaagctggggtctgtgagctgt

SEQ ID NO: 50198 - DNA, 601 bp, Human
gaggcccttggatctctggcagtcagcaggactgtggtggcagccggtgtgctggttgtcagctgatgtccctgtctgtgatttttccgtgtgaatgcagccttgactgggcatgtagatcagaggtgacaagtcctgggcacctctgccactcttcttcctgccctgcacccactacagacacagctaattggtggctgcgttgagaatcttgtcaccaggcaggctcttctgtcggctcaggactgtcctgcgggcatagcaggaagtgaactgcagggggaagttggggcctggttgstgaggagggcagtgcgtggtctccaagccagtcagtgcctgcgggggggactagaattctcacccaggcctctgctctcagtcctgttcctcctctcacattcttcacacccaggctgggctcagggatccttgttgatgatggccttgaaatgtcctctgaacagtgtggctctgggggtgtgtaaaacccagggtgatgcctgctctgaaaggggcttccagatccctttgtgtctccagcacctgccgtgtgcctgccccaagctggggtctgtgagctgtgccttggggcccctgc

SEQ ID NO: 50199 - DNA, 601 bp, Human
gccggtgtgctggttgtcagctgatgtccctgtctgtgatttttccgtgtgaatgcagccttgactgggcatgtagatcagaggtgacaagtcctgggcacctctgccactcttcttcctgccctgcacccactacagacacagctaattggtggctgcgttgagaatcttgtcaccaggcaggctcttctgtcggctcaggactgtcctgcgggcatagcaggaagtgaactgcagggggaagttggggcctggttgctgaggagggcagtgcgtggtctccaagccagtcagtgcctgsgggggggactagaattctcacccaggcctctgctctcagtcctgttcctcctctcacattcttcacacccaggctgggctcagggatccttgttgatgatggccttgaaatgtcctctgaacagtgtggctctgggggtgtgtaaaacccagggtgatgcctgctctgaaaggggcttccagatccctttgtgtctccagcacctgccgtgtgcctgccccaagctggggtctgtgagctgtgccttggggcccctgcctgtccccgctctgctctctgctgtggcttgctggctgcagg

SEQ ID NO: 50200 - DNA, 601 bp, Human
ggtgtgctggttgtcagctgatgtccctgtctgtgatttttccgtgtgaatgcagccttgactgggcatgtagatcagaggtgacaagtcctgggcacctctgccactcttcttcctgccctgcacccactacagacacagctaattggtggctgcgttgagaatcttgtcaccaggcaggctcttctgtcggctcaggactgtcctgcgggcatagcaggaagtgaactgcagggggaagttggggcctggttgctgaggagggcagtgcgtggtctccaagccagtcagtgcctgcggsggggactagaattctcacccaggcctctgctctcagtcctgttcctcctctcacattcttcacacccaggctgggctcagggatccttgttgatgatggccttgaaatgtcctctgaacagtgtggctctgggggtgtgtaaaacccagggtgatgcctgctctgaaaggggcttccagatccctttgtgtctccagcacctgccgtgtgcctgccccaagctggggtctgtgagctgtgccttggggcccctgcctgtccccgctctgctctctgctgtggcttgctggctgcagggtt

SEQ ID NO: 50201 - DNA, 601 bp, Human
ttgactgggcatgtagatcagaggtgacaagtcctgggcacctctgccactcttcttcctgccctgcacccactacagacacagctaattggtggctgcgttgagaatcttgtcaccaggcaggctcttctgtcggctcaggactgtcctgcgggcatagcaggaagtgaactgcagggggaagttggggcctggttgctgaggagggcagtgcgtggtctccaagccagtcagtgcctgcgggggggactagaattctcacccaggcctctgctctcagtcctgttcctcctctcacatycttcacacccaggctgggctcagggatccttgttgatgatggccttgaaatgtcctctgaacagtgtggctctgggggtgtgtaaaacccagggtgatgcctgctctgaaaggggcttccagatccctttgtgtctccagcacctgccgtgtgcctgccccaagctggggtctgtgagctgtgccttggggcccctgcctgtccccgctctgctctctgctgtggcttgctggctgcagggttctccagtgagtgagggatccctgctggccatgcctggagctgagggtggagggaggc

SEQ ID NO: 50202 - DNA, 601 bp, Human
tctccaggatgaagaccaggctccccagcaggacgtgcggccctcatggagttctggccttgttttcggctgttgcctggctgatattctgcacatctgcccaccgtcctctgggcggtccacgaatacattgtgccttcctctttgcatatgctggtccctctgctggcaatgcccttccttcttggtgagctccaatgcatccctcaagactcagttcagatgcgcctctctggactcatccccaactcccagacggggttggctgctcccttttttcagatcctgaaacacttacttktccccctttatgtgggcatttatctgatagtagagtttttctgtactgttggaatggtgagttccctgaagctaggtcagcttccttctcagcattcagcaggcggtgggggaggagggaaggagaggaacttcctaataaagatgaacacctctttgtggttaggtcagaccagcctgtgcctgtgcgacctggtgcagaccttcacctctcagagcctcggtttcctcatctgagcctcaggcacgacaatctgctagactctgcttcccggtggcagctggggaatgggatgggaag

SEQ ID NO: 50203 - DNA, 601 bp, Human
ccaggctccccagcaggacgtgcggccctcatggagttctggccttgttttcggctgttgcctggctgatattctgcacatctgcccaccgtcctctgggcggtccacgaatacattgtgccttcctctttgcatatgctggtccctctgctggcaatgcccttccttcttggtgagctccaatgcatccctcaagactcagttcagatgcgcctctctggactcatccccaactcccagacggggttggctgctcccttttttcagatcctgaaacacttacttttccccctttatgtgrgcatttatctgatagtagagtttttctgtactgttggaatggtgagttccctgaagctaggtcagcttccttctcagcattcagcaggcggtgggggaggagggaaggagaggaacttcctaataaagatgaacacctctttgtggttaggtcagaccagcctgtgcctgtgcgacctggtgcagaccttcacctctcagagcctcggtttcctcatctgagcctcaggcacgacaatctgctagactctgcttcccggtggcagctggggaatgggatgggaaggagccctgggatgct

SEQ ID NO: 50204 - DNA, 601 bp, Human
gcggtccacgaatacattgtgccttcctctttgcatatgctggtccctctgctggcaatgcccttccttcttggtgagctccaatgcatccctcaagactcagttcagatgcgcctctctggactcatccccaactcccagacggggttggctgctcccttttttcagatcctgaaacacttacttttccccctttatgtgggcatttatctgatagtagagtttttctgtactgttggaatggtgagttccctgaagctaggtcagcttccttctcagcattcagcaggcggtgggggargagggaaggagaggaacttcctaataaagatgaacacctctttgtggttaggtcagaccagcctgtgcctgtgcgacctggtgcagaccttcacctctcagagcctcggtttcctcatctgagcctcaggcacgacaatctgctagactctgcttcccggtggcagctggggaatgggatgggaaggagccctgggatgctcaggtcatccctgccaccagaatgtccccagagtcatgaccatcagcacctcagcctcgctgctttttccttggggtccgcaggggcaggacgcaaacc

SEQ ID NO: 50205 - DNA, 601 bp, Human
ttatctgatagtagagtttttctgtactgttggaatggtgagttccctgaagctaggtcagcttccttctcagcattcagcaggcggtgggggaggagggaaggagaggaacttcctaataaagatgaacacctctttgtggttaggtcagaccagcctgtgcctgtgcgacctggtgcagaccttcacctctcagagcctcggtttcctcatctgagcctcaggcacgacaatctgctagactctgcttcccggtggcagctggggaatgggatgggaaggagccctgggatgctcaggkcatccctgccaccagaatgtccccagagtcatgaccatcagcacctcagcctcgctgctttttccttggggtccgcaggggcaggacgcaaaccccacacgctcgctgcgcagtaagctgcaggggcttctccagcagcacctctgaggcctgcctaccacgtggagatgctgctcccgtgggctctgaccaccgctctgccctcttctcacaggaaccagcgaccactcggcccggcgtaaccacgcatgtccactggtcacctggtggccttcgacaggaacgtgtgataaatccctg

SEQ ID NO: 50206 - DNA, 601 bp, Human
attcagcaggcggtgggggaggagggaaggagaggaacttcctaataaagatgaacacctctttgtggttaggtcagaccagcctgtgcctgtgcgacctggtgcagaccttcacctctcagagcctcggtttcctcatctgagcctcaggcacgacaatctgctagactctgcttcccggtggcagctggggaatgggatgggaaggagccctgggatgctcaggtcatccctgccaccagaatgtccccagagtcatgaccatcagcacctcagcctcgctgctttttccttggggtcygcaggggcaggacgcaaaccccacacgctcgctgcgcagtaagctgcaggggcttctccagcagcacctctgaggcctgcctaccacgtggagatgctgctcccgtgggctctgaccaccgctctgccctcttctcacaggaaccagcgaccactcggcccggcgtaaccacgcatgtccactggtcacctggtggccttcgacaggaacgtgtgataaatccctgccggagtgcggctccgggaaaacgctgtcaccgcaaaccagctcctctttgttgcagtcccccgggggcatggc

SEQ ID NO: 50207 - DNA, 601 bp, Human
ggggaggagggaaggagaggaacttcctaataaagatgaacacctctttgtggttaggtcagaccagcctgtgcctgtgcgacctggtgcagaccttcacctctcagagcctcggtttcctcatctgagcctcaggcacgacaatctgctagactctgcttcccggtggcagctggggaatgggatgggaaggagccctgggatgctcaggtcatccctgccaccagaatgtccccagagtcatgaccatcagcacctcagcctcgctgctttttccttggggtccgcaggggcaggacgsaaaccccacacgctcgctgcgcagtaagctgcaggggcttctccagcagcacctctgaggcctgcctaccacgtggagatgctgctcccgtgggctctgaccaccgctctgccctcttctcacaggaaccagcgaccactcggcccggcgtaaccacgcatgtccactggtcacctggtggccttcgacaggaacgtgtgataaatccctgccggagtgcggctccgggaaaacgctgtcaccgcaaaccagctcctctttgttgcagtcccccgggggcatggcccggcaagtttcctt

SEQ ID NO: 50208 - DNA, 601 bp, Human
agggaaggagaggaacttcctaataaagatgaacacctctttgtggttaggtcagaccagcctgtgcctgtgcgacctggtgcagaccttcacctctcagagcctcggtttcctcatctgagcctcaggcacgacaatctgctagactctgcttcccggtggcagctggggaatgggatgggaaggagccctgggatgctcaggtcatccctgccaccagaatgtccccagagtcatgaccatcagcacctcagcctcgctgctttttccttggggtccgcaggggcaggacgcaaacccsacacgctcgctgcgcagtaagctgcaggggcttctccagcagcacctctgaggcctgcctaccacgtggagatgctgctcccgtgggctctgaccaccgctctgccctcttctcacaggaaccagcgaccactcggcccggcgtaaccacgcatgtccactggtcacctggtggccttcgacaggaacgtgtgataaatccctgccggagtgcggctccgggaaaacgctgtcaccgcaaaccagctcctctttgttgcagtcccccgggggcatggcccggcaagtttccttagccagg

SEQ ID NO: 50209 - DNA, 601 bp, Human
ggagccctgggatgctcaggtcatccctgccaccagaatgtccccagagtcatgaccatcagcacctcagcctcgctgctttttccttggggtccgcaggggcaggacgcaaaccccacacgctcgctgcgcagtaagctgcaggggcttctccagcagcacctctgaggcctgcctaccacgtggagatgctgctcccgtgggctctgaccaccgctctgccctcttctcacaggaaccagcgaccactcggcccggcgtaaccacgcatgtccactggtcacctggtggccttcgacargaacgtgtgataaatccctgccggagtgcggctccgggaaaacgctgtcaccgcaaaccagctcctctttgttgcagtcccccgggggcatggcccggcaagtttccttagccaggggccagtttgcctggggtcagtgggcagcgcctgggagtcgagtgtctcgagtggggctctgcttggtttctccttgaaggtctggcagggtcagaccctgcatcggcagtaaccgcggagatgggagagccgagtctgccgctgtgggcttcctgggccttcccgccacccccgccagggccc

SEQ ID NO: 50210 - DNA, 601 bp, Human
cagagtcatgaccatcagcacctcagcctcgctgctttttccttggggtccgcaggggcaggacgcaaaccccacacgctcgctgcgcagtaagctgcaggggcttctccagcagcacctctgaggcctgcctaccacgtggagatgctgctcccgtgggctctgaccaccgctctgccctcttctcacaggaaccagcgaccactcggcccggcgtaaccacgcatgtccactggtcacctggtggccttcgacaggaacgtgtgataaatccctgccggagtgcggctccgggaaaacrctgtcaccgcaaaccagctcctctttgttgcagtcccccgggggcatggcccggcaagtttccttagccaggggccagtttgcctggggtcagtgggcagcgcctgggagtcgagtgtctcgagtggggctctgcttggtttctccttgaaggtctggcagggtcagaccctgcatcggcagtaaccgcggagatgggagagccgagtctgccgctgtgggcttcctgggccttcccgccacccccgccagggcccttgggctgcatattcgaggcgcgcagcctgccaggccctccggc

SEQ ID NO: 50211 - DNA, 601 bp, Human
gtggccttcgacaggaacgtgtgataaatccctgccggagtgcggctccgggaaaacgctgtcaccgcaaaccagctcctctttgttgcagtcccccgggggcatggcccggcaagtttccttagccaggggccagtttgcctggggtcagtgggcagcgcctgggagtcgagtgtctcgagtggggctctgcttggtttctccttgaaggtctggcagggtcagaccctgcatcggcagtaaccgcggagatgggagagccgagtctgccgctgtgggcttcctgggccttcccgccacycccgccagggcccttgggctgcatattcgaggcgcgcagcctgccaggccctccggcctccctgcgtggccaccagggaaaatggcttcactttgctgagcctctgtctccctggttacaaaacaaataattttattttttgtgacagggtgttattttttgtgacagggtgttgttctgctctgtcccccgggctggagtgcagtggtacgatcatagcccactgcagcctcgatctcctgagctcaaacgatcctcccacctcagcctcctgagtagctgggaccgcagccgtgcacc

SEQ ID NO: 50212 - DNA, 601 bp, Human
ccagggcccttgggctgcatattcgaggcgcgcagcctgccaggccctccggcctccctgcgtggccaccagggaaaatggcttcactttgctgagcctctgtctccctggttacaaaacaaataattttattttttgtgacagggtgttattttttgtgacagggtgttgttctgctctgtcccccgggctggagtgcagtggtacgatcatagcccactgcagcctcgatctcctgagctcaaacgatcctcccacctcagcctcctgagtagctgggaccgcagccgtgcaccaccaygcccagctaacatttttatgtcttgtagagatggggtctcactgtgttgaccaggctggtctccaactcctggcctcaaaaattctcctgcctcagcctcccaaagtgctgggattacaggcgtgagccactatgcctggccaataatgttctattttaatttcctgtattccctaaatagtcataaccgtttccaagggcgatattcagaacacgtaacgagtgcagtgcaggcaccagcccacgtctcggccccccgtgtggggaaccagtctggccatctcatggtccctgcgtctg

SEQ ID NO: 50213 - DNA, 601 bp, Human
agggaaaatggcttcactttgctgagcctctgtctccctggttacaaaacaaataattttattttttgtgacagggtgttattttttgtgacagggtgttgttctgctctgtcccccgggctggagtgcagtggtacgatcatagcccactgcagcctcgatctcctgagctcaaacgatcctcccacctcagcctcctgagtagctgggaccgcagccgtgcaccaccacgcccagctaacatttttatgtcttgtagagatggggtctcactgtgttgaccaggctggtctccaactcytggcctcaaaaattctcctgcctcagcctcccaaagtgctgggattacaggcgtgagccactatgcctggccaataatgttctattttaatttcctgtattccctaaatagtcataaccgtttccaagggcgatattcagaacacgtaacgagtgcagtgcaggcaccagcccacgtctcggccccccgtgtggggaaccagtctggccatctcatggtccctgcgtctgctctgcccacctcgtaggaggctctggattgaatgaggttcgacagtgctgactgtgagcctggccctga

SEQ ID NO: 50214 - DNA, 601 bp, Human
tgcagcctcgatctcctgagctcaaacgatcctcccacctcagcctcctgagtagctgggaccgcagccgtgcaccaccacgcccagctaacatttttatgtcttgtagagatggggtctcactgtgttgaccaggctggtctccaactcctggcctcaaaaattctcctgcctcagcctcccaaagtgctgggattacaggcgtgagccactatgcctggccaataatgttctattttaatttcctgtattccctaaatagtcataaccgtttccaagggcgatattcagaacacgtaaygagtgcagtgcaggcaccagcccacgtctcggccccccgtgtggggaaccagtctggccatctcatggtccctgcgtctgctctgcccacctcgtaggaggctctggattgaatgaggttcgacagtgctgactgtgagcctggccctgagtccgctcaggggtctcacttgccactctgctgctgtcactgcgccgttccctttgcccacatgccctcctggtctctgcatagatgtcctgagtgggactgctgggagtggggcactgctgcgtggcagtggagcctcgatagtgggtc

SEQ ID NO: 50215 - DNA, 601 bp, Human
ggcgatattcagaacacgtaacgagtgcagtgcaggcaccagcccacgtctcggccccccgtgtggggaaccagtctggccatctcatggtccctgcgtctgctctgcccacctcgtaggaggctctggattgaatgaggttcgacagtgctgactgtgagcctggccctgagtccgctcaggggtctcacttgccactctgctgctgtcactgcgccgttccctttgcccacatgccctcctggtctctgcatagatgtcctgagtgggactgctgggagtggggcactgctgcgtggcrgtggagcctcgatagtgggtctcttgggggattattggcaagctgcaccccttgaaagttaaccgatcggggtgcatggcgtgaacttcccttcctgagctggtcagcccagtgtatgctgtgagccaggagccctgagggcgtctctgcccacctatctcagagcacactctgtgttgcaggtgccgtgacacctattttacagcccaggaaacagagtctttcatgctgttccttccagccgaaccctcagctggagtcactccagaagccgcaggcaggagagttcccacaaaggac

SEQ ID NO: 50216 - DNA, 601 bp, Human
actgtgagcctggccctgagtccgctcaggggtctcacttgccactctgctgctgtcactgcgccgttccctttgcccacatgccctcctggtctctgcatagatgtcctgagtgggactgctgggagtggggcactgctgcgtggcagtggagcctcgatagtgggtctcttgggggattattggcaagctgcaccccttgaaagttaaccgatcggggtgcatggcgtgaacttcccttcctgagctggtcagcccagtgtatgctgtgagccaggagccctgagggcgtctctgcccrcctatctcagagcacactctgtgttgcaggtgccgtgacacctattttacagcccaggaaacagagtctttcatgctgttccttccagccgaaccctcagctggagtcactccagaagccgcaggcaggagagttcccacaaaggactggatgcacaccttcctgagacggggggtgggttaggattccagcaaaggaagctctaaacaccagagtggccagtccatggcatttgttgggggacttacagagggggcttcagcttcctgtgggaatggggagatgagccacgttctgccc

SEQ ID NO: 50217 - DNA, 601 bp, Human
attcgaggccctggcttgggttcaagcctgcaggaaaaacgtgcagctggcgggtcaggggcagttaggacagaggacgaggaggaacgggggcccctacgtgccatgggcatgtgctcgtctctctcctggtgtccgcctttctcctctgccttgtggctcagcttggactgccataacaaaatacgatagagtgggtggcagaaatgcattttctccccgttctgaaaactggacagtccaaatgcatggtgcctgtggtgttccgacaggggatcactcctcgggctccttctcgctstgttcacggggctttccttggtgcatggagaggatctccctctcctcctcttcttataaggtcaccagtcccatcagattagggccccacccatatggcctcatttaaccttaattacctccttaaaggccctatctccacatataggcccttgtcatagcggaggcttcacataggaacctgagggggactcagcctggagcacctggtgtgttaggaggaggccaggccagcgctgagcaccctgcctgtgggtgagccctgcttctcaagcaacagtaataaataaaaaggaggagg

SEQ ID NO: 50218 - DNA, 601 bp, Human
gcaccctgcctgtgggtgagccctgcttctcaagcaacagtaataaataaaaaggaggaggccaaactgaccagacctaaaaaaacagtatcttaaggtctgacacctgccacggcatgaatgagccagagaaagtgatgctgagtgaaggaagcctgtcacaaaaggacaaatgtggcatgtgaaatctctagaacagggagattcatggggacagggagtggactgggttaccaggggctggggtgggaacaacggggagtggcttcttcatgggtgtagggtttctgttgagggcgaygacagtaccctgcaagtggaccggtgaccgatgcacagcgttgaatgtactgaatgccactgaactgtgaactttaaaactgttaaagtggcaagttttatgttatattaaaaaaatcatatatagaaaggatgttgtattaaacgagaaaaactcatttctctcaagtaccagtcactcattgtggagactgctcttgaggtcactgtgcccaggcctcttctgtcttgagccagtccatctctggggtgtgaccctagcttacccccatgaccacaggaagaccatgagctggtcctt

SEQ ID NO: 50219 - DNA, 601 bp, Human
tgagctggtcctttaaggatgcaacctgggagttgccccgaggactgtgctcacattctgttggccaaaactcggttacgtgaccacacctagctgcaagggaggctgggaaatgtagtccttagtctgggggcatgtgcctggctgacaatggggcttcagtgctgtgggagaggaggagctggtggctgccaggggatggacagctgtctctaccaacctggcctcacagtggtcacgctccaggacataaatgtcccctctgcagcaaagacttcctgggtgtggaggggactggggkcccacaccctggtcttcacaagatggtctcctaccccggaaggcaccatgcggcccacgcttcagtgtgaagacaccacctgtgtgttaatgggcccaacaccaacctgggtgcagggcaggtattcagcaaacagtgaatggacaccagggagctggctactatagcgacctcctgaggtcgcagggctaccaaacagtgcacggcatttgcaccccagctcaggcgtcccggcagggattctgcattgtctgcctttgaaaaaagggtgggagagttaggacaggaattttctctgtt

SEQ ID NO: 50220 - DNA, 601 bp, Human
agggaggctgggaaatgtagtccttagtctgggggcatgtgcctggctgacaatggggcttcagtgctgtgggagaggaggagctggtggctgccaggggatggacagctgtctctaccaacctggcctcacagtggtcacgctccaggacataaatgtcccctctgcagcaaagacttcctgggtgtggaggggactgggggcccacaccctggtcttcacaagatggtctcctaccccggaaggcaccatgcggcccacgcttcagtgtgaagacaccacctgtgtgttaatgggcccracaccaacctgggtgcagggcaggtattcagcaaacagtgaatggacaccagggagctggctactatagcgacctcctgaggtcgcagggctaccaaacagtgcacggcatttgcaccccagctcaggcgtcccggcagggattctgcattgtctgcctttgaaaaaagggtgggagagttaggacaggaattttctctgtttccctctctctctccttctccccgcttctccccctctctttttccctttctcttttcctccctctctgtccctccctctcttttcctctctatctccc

SEQ ID NO: 50221 - DNA, 601 bp, Human
gggagaggaggagctggtggctgccaggggatggacagctgtctctaccaacctggcctcacagtggtcacgctccaggacataaatgtcccctctgcagcaaagacttcctgggtgtggaggggactgggggcccacaccctggtcttcacaagatggtctcctaccccggaaggcaccatgcggcccacgcttcagtgtgaagacaccacctgtgtgttaatgggcccaacaccaacctgggtgcagggcaggtattcagcaaacagtgaatggacaccagggagctggctactatagygacctcctgaggtcgcagggctaccaaacagtgcacggcatttgcaccccagctcaggcgtcccggcagggattctgcattgtctgcctttgaaaaaagggtgggagagttaggacaggaattttctctgtttccctctctctctccttctccccgcttctccccctctctttttccctttctcttttcctccctctctgtccctccctctcttttcctctctatctccctatctgctttgctctctgtctctctgtcctatttttctccatcactctttgtccttgtctctttttctcg

SEQ ID NO: 50222 - DNA, 601 bp, Human
tggtctcctaccccggaaggcaccatgcggcccacgcttcagtgtgaagacaccacctgtgtgttaatgggcccaacaccaacctgggtgcagggcaggtattcagcaaacagtgaatggacaccagggagctggctactatagcgacctcctgaggtcgcagggctaccaaacagtgcacggcatttgcaccccagctcaggcgtcccggcagggattctgcattgtctgcctttgaaaaaagggtgggagagttaggacaggaattttctctgtttccctctctctctccttctccccscttctccccctctctttttccctttctcttttcctccctctctgtccctccctctcttttcctctctatctccctatctgctttgctctctgtctctctgtcctatttttctccatcactctttgtccttgtctctttttctcgttctctgtcactccgtttctgcttttgttcccccttctctctctctccccaacccccctgtttctctatctcttcacctgtgaattcctgaaacagacccagggcatgatgtcgtggagggcaggccccagaggcgtccaggtgacaccgtgtggg

SEQ ID NO: 50223 - DNA, 601 bp, Human
caagaagagctgcctttcctaagcccctctctcctccagccacccctcacctggggcctgctgagagggacaaggtggattggggcttgctgtggggctggtgctgaggcaggggtgggtggccccccagcccctatttcctcctctccaaacccagccatcccagttaattatttgcccagcagggcagcttgactggctggtgtcttgctgagcaataagcagctgaataagggtgcaattgctggaggcggggtcgcagctgcagacctgggcggtcacttagtctgggacagctgcrgcggccacagcgaaagccatgcagcctgccccatgcctggctttgtcgcgacggctgctggaacagacgggtgtggtggctcatgcttgtaatctcagccctttgggaggccaaagcaggcggatcacttgaggtcaggagttagagaccagcctggccaacatggcaagatcccctctctactgaaaatacaaaaaaattcagccgggtatggtggcaggcacctgtaatcccagctactcaggaagctgaggcatgagaatcacttgaacccaggaggcggaggttgcactgagccaa

SEQ ID NO: 50224 - DNA, 601 bp, Human
ggaacagacgggtgtggtggctcatgcttgtaatctcagccctttgggaggccaaagcaggcggatcacttgaggtcaggagttagagaccagcctggccaacatggcaagatcccctctctactgaaaatacaaaaaaattcagccgggtatggtggcaggcacctgtaatcccagctactcaggaagctgaggcatgagaatcacttgaacccaggaggcggaggttgcactgagccaagatcaagccactgcactccagcctgggtgacagagtaagactgtctcaaaaaaaaaaaaraaaaaaaaaaagaaaactacacacacatacacacaacataaaatgtatgattttggccaggcacagtggctcacgcctataatcccagcactgggaggttgaggtgggtgaatcacttgaggtcaggagttctggaccagtctgggccaacatggtgaaattccatctctactaaaaatacaaaaattagtagtgtattagtgggtgtggtgacaggtgcctgtaatcccagttactcaggaggttgaggcaggagaattgcttgaacgcaggagacgaaggttgcagtaagccgagata

SEQ ID NO: 50225 - DNA, 601 bp, Human
agactgtctcaaaaaaaaaaaagaaaaaaaaaaagaaaactacacacacatacacacaacataaaatgtatgattttggccaggcacagtggctcacgcctataatcccagcactgggaggttgaggtgggtgaatcacttgaggtcaggagttctggaccagtctgggccaacatggtgaaattccatctctactaaaaatacaaaaattagtagtgtattagtgggtgtggtgacaggtgcctgtaatcccagttactcaggaggttgaggcaggagaattgcttgaacgcaggagacraaggttgcagtaagccgagatagcaccactgcactccagcctgggcaacaaagcaagactccatttcaaaaaaaaaaaggatgatttttaaccatttttaagtgtaccgtaagtggcattaagcatgtggtgcaaccatgaccaccatctatctccagaactcctttcaccttgcagaaatgacaccctggacccttgaaacactaactccccctcccaggttccctcccccagcctggggattaggcatctagcagctgctgtctggagagggatagcatggccctgctccgtcccttc

SEQ ID NO: 50226 - DNA, 601 bp, Human
gaccagtctgggccaacatggtgaaattccatctctactaaaaatacaaaaattagtagtgtattagtgggtgtggtgacaggtgcctgtaatcccagttactcaggaggttgaggcaggagaattgcttgaacgcaggagacgaaggttgcagtaagccgagatagcaccactgcactccagcctgggcaacaaagcaagactccatttcaaaaaaaaaaaggatgatttttaaccatttttaagtgtaccgtaagtggcattaagcatgtggtgcaaccatgaccaccatctatctccwgaactcctttcaccttgcagaaatgacaccctggacccttgaaacactaactccccctcccaggttccctcccccagcctggggattaggcatctagcagctgctgtctggagagggatagcatggccctgctccgtcccttctgggcccgttgagctctgctgtgaaggggattcctttccttgtccctgtcactcctagtgtgggggtcgggggtaccaagccccagccctgccacctggaaaccctgggaaagcagcgtcacctccctgtgcctcagtttcctcatctgtaaagggg

SEQ ID NO: 50227 - DNA, 601 bp, Human
tttcaaaaaaaaaaaggatgatttttaaccatttttaagtgtaccgtaagtggcattaagcatgtggtgcaaccatgaccaccatctatctccagaactcctttcaccttgcagaaatgacaccctggacccttgaaacactaactccccctcccaggttccctcccccagcctggggattaggcatctagcagctgctgtctggagagggatagcatggccctgctccgtcccttctgggcccgttgagctctgctgtgaaggggattcctttccttgtccctgtcactcctagtgtggrggtcgggggtaccaagccccagccctgccacctggaaaccctgggaaagcagcgtcacctccctgtgcctcagtttcctcatctgtaaaggggagctgaggacaggacctgcctccgagcctggggagagacggcagtgcacagggactagctgtgcgtctcagtaatacggagagaactttgcaggccaatggcgtccctctgagaaagactctccctggattctgtttcagagagttgagcttttccccagagcagatgctttgaaactgtctcaggtggacagagggggctgcaggg

SEQ ID NO: 50228 - DNA, 601 bp, Human
tctgtttcagagagttgagcttttccccagagcagatgctttgaaactgtctcaggtggacagagggggctgcagggagggcacagaggacttcctgggagtgaggtttcctgggattgagtcccagccctgctgtagggctggagtgaaaggggcctccccagagagcctctcccagggctctgtccccaagtggccaagctaattcggttccgtgctccccttttgcccacccccaccagaggccacaggctggactgggcgccactgctcatgcttctgtcctgggatagcacagacyagtacaccagggtctggcacatgtccgttgtagtcactgcagccctcccagtctccccgttttgtagaggaagccacagctcggggcaaagccgcacctcgcagtggacaggtgagtctctgcctccccaccagctgcctcttccacagatggacccccaatcacactgtcatatcgcctgtctgagcctcactgtgctagtctgtaggagggggcacctcctcttgggccatccatataaggctggagacaaacagctccacccagttatgggagtcccatgccatccaggacacatcc

SEQ ID NO: 50229 - DNA, 601 bp, Human
agagggatccgtaggcctcccctgcctgccctgggcacagggacatcccgaagcgccggtcccagagcctgggctctgctgctgtttctctgtgacttgaggcaagatatcctacgctgccgagatagcagcccctctgcctggggaggtgagtgtgaggaacccggtgtactctgtcgatgtttaagggtcagtgggcgccgaatgaatggtttctgtcagcagcacattctgcatctcccaaaaccaaaaccaaaaggacagccggattttcccctctgcctgacttcactaggctcgygtctgattttttttttttagcaccgtcagcataagggcctgggtttattttgtggttgtttatagtggaattgggtgtattgtcctgatttgttttccaggatgttcgttttggggtcaagggtctttggggtggatgaggcgggagaaccaggcttgagtgaggctctgccctcctttcctggccccctggtggcccctccagagtctgtcccggccatggaccccagtccccgctgagccatgcggagagtttgggagaagtgcatacctgccttgggggcttgactggcaggctgct

SEQ ID NO: 50230 - DNA, 601 bp, Human
cccctgcctgccctgggcacagggacatcccgaagcgccggtcccagagcctgggctctgctgctgtttctctgtgacttgaggcaagatatcctacgctgccgagatagcagcccctctgcctggggaggtgagtgtgaggaacccggtgtactctgtcgatgtttaagggtcagtgggcgccgaatgaatggtttctgtcagcagcacattctgcatctcccaaaaccaaaaccaaaaggacagccggattttcccctctgcctgacttcactaggctcgtgtctgattttttttttttagcaccgtcagcataagggcctgggtttattttgtggttgtttatagtggaattgggtgtattgtcctgatttgttttccaggatgttcgttttggggtcaagggtctttggggtggatgaggcgggagaaccaggcttgagtgaggctctgccctcctttcctggccccctggtggcccctccagagtctgtcccggccatggaccccagtccccgctgagccatgcggagagtttgggagaagtgcatacctgccttgggggcttgactggcaggctgctttcctctggctcatcttg

SEQ ID NO: 50231 - DNA, 601 bp, Human
cgcggtggctcacgcctgtaatcccagcactttgggaggccgaggcgggtggatcacgaggtcagcagattgatagcatcctggctaacacggtgaaacctcgtctctactaaaaatataaaaaattagctgggcgtggtggaaggcgcctgtagtcccagctacatgggaggctgaggcaggagaatggcgtgaacccgggaggcggagcttgcagtgagccgagattgcgccactgcacctccagcctgggcgacagaatgagactctgtctgaaaaaaaaaaaaaaatcatatggccmgtcaggcgcggtggctcacgcagtttgggaggctgaggtgggtggatcacttgaggtcaggagttcgagaccagcctggccaacatggtgaaaccctgtctctactaaagatacaaaaattagccgggcgtggtggcatgcgcctgtaatcccagctactgaggagactgaggcaggagaattgcttgaacctgggaggcggaggttgcagtgagccgagatcgcgccattgcactccagcctgggcaacaagagtgaaactccgtcgcaaaaaatagtaataattcgtccgtctcctcg

SEQ ID NO: 50232 - DNA, 601 bp, Human
actctgtctgaaaaaaaaaaaaaaatcatatggccagtcaggcgcggtggctcacgcagtttgggaggctgaggtgggtggatcacttgaggtcaggagttcgagaccagcctggccaacatggtgaaaccctgtctctactaaagatacaaaaattagccgggcgtggtggcatgcgcctgtaatcccagctactgaggagactgaggcaggagaattgcttgaacctgggaggcggaggttgcagtgagccgagatcgcgccattgcactccagcctgggcaacaagagtgaaactccrtcgcaaaaaatagtaataattcgtccgtctcctcggcgagtggaggctggggccagggtggaacaggagctccacggtgagccaccccggagtgaaggccactggccctccttatccttgctgcggtgtgggggtgtgggtgtatgacccacagctcacatgtggaaacatggaggccccggggcctgtgtgacttgcccagggtcccagctagcaggtggcagagcaagacctgtatgcagaggcccaaggaagcgtcatgaggacccaggtcaccagtgcatctccagggtgaacctg

SEQ ID NO: 50233 - DNA, 601 bp, Human
ggccaacatggtgaaaccctgtctctactaaagatacaaaaattagccgggcgtggtggcatgcgcctgtaatcccagctactgaggagactgaggcaggagaattgcttgaacctgggaggcggaggttgcagtgagccgagatcgcgccattgcactccagcctgggcaacaagagtgaaactccgtcgcaaaaaatagtaataattcgtccgtctcctcggcgagtggaggctggggccagggtggaacaggagctccacggtgagccaccccggagtgaaggccactggccctcctyatccttgctgcggtgtgggggtgtgggtgtatgacccacagctcacatgtggaaacatggaggccccggggcctgtgtgacttgcccagggtcccagctagcaggtggcagagcaagacctgtatgcagaggcccaaggaagcgtcatgaggacccaggtcaccagtgcatctccagggtgaacctggcccctgcccagcgcatttgcctgtcccctgaaaccgccaccacacaaaaccatgtgcatcttcagagcaggaggcgtctccaccatctgtttgctcccgtttgacaaatggt

SEQ ID NO: 50234 - DNA, 601 bp, Human
tttttttttttgagacagagtttcgctcattgcccaggctggagtgcagcggcatggtcttggttcactgtagcctctgcctccctgatttaagcagttctcctgcctcaggctcccaagtatctgggattacaggcacctgccaccatgcccagctaatttttatatttttagtagagacagggtttcatcatgttggtcaggctggtctagaactcctgacctcaggtgatccgctcccctcgacctctcaaagtgcttatattacaggcatgagccaccgcgcctggcctattttttkttttttcccttggcaacagggtcttgctcttttgcccaggctggagtacagtggcgcagtcatggctcacttcagcctcaaattcctgggctcaagtgagcctctcaccttagcctcctaagcagctgcaactacaggtgtgcaccaccatgccttactaattttctttaaaatttttttgtagagataggggtctccctatgttggtcaggctggtctcaaactcctgggctcaagccagagaggggctggcctggtgctctgggttctccagaccccctcctgccttggtctcccaca

SEQ ID NO: 50235 - DNA, 601 bp, Human
gtttcatcatgttggtcaggctggtctagaactcctgacctcaggtgatccgctcccctcgacctctcaaagtgcttatattacaggcatgagccaccgcgcctggcctatttttttttttttcccttggcaacagggtcttgctcttttgcccaggctggagtacagtggcgcagtcatggctcacttcagcctcaaattcctgggctcaagtgagcctctcaccttagcctcctaagcagctgcaactacaggtgtgcaccaccatgccttactaattttctttaaaatttttttgtasagataggggtctccctatgttggtcaggctggtctcaaactcctgggctcaagccagagaggggctggcctggtgctctgggttctccagaccccctcctgccttggtctcccacagtgctgggattacaggatgagccacggtgcatggccacctgatggataatgtctaatataagagaacccctaatttagctgtccctgtacccttgtgaggtgagcagtattgttgcctacattctatagatggggaaacagaggccacagaggcctagcagcctgcctcgtcaccgagtgggag

SEQ ID NO: 50236 - DNA, 601 bp, Human
gaacccaggccgtcggctcctgggcctgtgtgccccctccatgaccatatcagcttcctacagcttccatgacaaagcaccacaaaaccggaggcttaaacacagaaacgcagtcccccagctccgggcagaagctcgagacgagggtgtggcagggccgtgccccctctgcagcctctggggagggtcccttccggcttctgggggctgccggcctccctggagtggccacgtcacttgttgctgctgtctccctcgtcacgtggcctctccttctctgtctcttagctccctctgcccygtcctgagcacagctgtgattgcattagggcccacctgtataaccgaggatgccctcttctcaagagccgtaccttgatctcatctgcagagatgcttttcccgacgtgaatggaatattctgaggattaggacgtggacctaccttgttaggggccaccattcagctgactgtctttgccaagcacaggcagtggagactgtgtcatgctctgatccgaacaatcgtccttctgtctgccgcccgacttccccagccctgttcagaaagacagaaggaactcctgccccaccctaagct

SEQ ID NO: 50237 - DNA, 601 bp, Human
tgggggctgccggcctccctggagtggccacgtcacttgttgctgctgtctccctcgtcacgtggcctctccttctctgtctcttagctccctctgccccgtcctgagcacagctgtgattgcattagggcccacctgtataaccgaggatgccctcttctcaagagccgtaccttgatctcatctgcagagatgcttttcccgacgtgaatggaatattctgaggattaggacgtggacctaccttgttaggggccaccattcagctgactgtctttgccaagcacaggcagtggagacygtgtcatgctctgatccgaacaatcgtccttctgtctgccgcccgacttccccagccctgttcagaaagacagaaggaactcctgccccaccctaagctgaagtcgggagcgtgaggaccctttatctggtctttgggggccaggtgggttcacgggcacaggacagcatgacaggcagggcctggcattgggacacctgggtcttagtcctcacctgtgacagcggggggtcttgggcaacgtcccacccctctctgggccttgaagatgaaggggttagatcctggcctcccggagct

SEQ ID NO: 50238 - DNA, 601 bp, Human
gacagcggggggtcttgggcaacgtcccacccctctctgggccttgaagatgaaggggttagatcctggcctcccggagcttcccctggtgtaggatcaacacactttttctgtcaaggactagagagtattttaggctttgctggccctgtggtctaagtcacatactcttctctgtctgtttttgtttgttttgttttgttttgttttgtttttgtttttcctacaacccctttaaaatgcaaaacccgttcctagctccaggccatggctgccattgggctgtgttgagcctgtggcrcgtgcacaggcccctgcccttggtggacactctgattccacctgcaaatcctgagcgcacaccggctctgaacaggctctgtggcttcagaaacttatcttctggcttcgtcgatctggctggtttgccctggggatcccgcatcctctgactaccgtgatgagcagagcgcagcgcccggctccgtgggccaacttttggtgtcttgccctgcctgagcctgttcctccttcctctccctgcccctccagccgctccgggtcctctgggaagctctggcctcttcaccagccctgcgcg

SEQ ID NO: 50239 - DNA, 601 bp, Human
aggccaaagaactggattccagacactgcctcctccactgtccccacagtgaaaatggggagggatgtccctgtggagccctaactgggacccagacagccctacccccagctcccaccccctccggctgtcccggaggccgtgctccgtggatctcctctccctcgcctccacgtgggctccaggtagctgcacacgcattacaaacatctcgttaatcttctcggaggtcctgcgaggcgaggcctgtggtagccctgcccttggagcactgagaattagtaaggaaatcgccgctgcrtctcccggtggcacaggggcgtggaggcgtggcgggccttccctcttgcaccactttggatcctgggtcctcacagcagtgttctctgcaggggaggtgcaggcattggtctgctctagggccaggtggtctaaaaagtccctggtcagccccgagtcctgcaggaatctgcatgttagtgggatttggggttcaggatgcttgcctgctgggtaggatggggttgctgagtgaggctgaaatcccagatgggatgtctgggctcctccatgcctgacttgggaggggtgagaaaaggaa

SEQ ID NO: 50240 - DNA, 601 bp, Human
acgtgggctccaggtagctgcacacgcattacaaacatctcgttaatcttctcggaggtcctgcgaggcgaggcctgtggtagccctgcccttggagcactgagaattagtaaggaaatcgccgctgcatctcccggtggcacaggggcgtggaggcgtggcgggccttccctcttgcaccactttggatcctgggtcctcacagcagtgttctctgcaggggaggtgcaggcattggtctgctctagggccaggtggtctaaaaagtccctggtcagccccgagtcctgcaggaatctgsatgttagtgggatttggggttcaggatgcttgcctgctgggtaggatggggttgctgagtgaggctgaaatcccagatgggatgtctgggctcctccatgcctgacttgggaggggtgagaaaaggaaggagacttggccatctttaggctaaaagcctagtgctgtctcacaggagggaagagcaggtctctgcaacacacgcctggggttccgtcccctctggccacttgtctgtcaccttggacacgttgcctggcagcctctgagcctcagtgtgcttctgtgaattggggtgacc

SEQ ID NO: 50241 - DNA, 601 bp, Human
gggttgctgagtgaggctgaaatcccagatgggatgtctgggctcctccatgcctgacttgggaggggtgagaaaaggaaggagacttggccatctttaggctaaaagcctagtgctgtctcacaggagggaagagcaggtctctgcaacacacgcctggggttccgtcccctctggccacttgtctgtcaccttggacacgttgcctggcagcctctgagcctcagtgtgcttctgtgaattggggtgaccctagcacggtgctcacgacagaaagcatgggagtgcagacgtgggtcartggcccgcggtgagagctccctgtctgccccatggtgagtttccacagcagtgagagaggcctggcgtgtggggtggaggccgggacagtgtgagggccgcctggtcagagcgggaggcaggaccccgtagggagatgaaagccaagctggacccaggcagaaaaagaggaacgaaggacaggaagtccaagagcagtcactgctgacgtgagtgcggcctgcaggcagccagtgtggatggactctcaggccctccgttgtgtgttaggggaccggaggagcagagaggttgcagcagc

SEQ ID NO: 50242 - DNA, 601 bp, Human
gccgtttccccgactcgctgacccctcctctgcccctgggccttttgcatcctggagctctcttccccttgccaactcctcctgcctcccaggcctcagccacgcctgcttcctttgggctgatgctgagcaccaacccagagtgtcggtgctgctcattgctccagtgaccccgtccagaccagcctccccgtccagccttcctcttgctcctgggcaggacctgccctgtgctttgaggccctggggcctgcacatatccagcatgtgggtgtgccctgtctgtgtgtaccaggtaagygggcagatgagcccagcagacactgctgcagccggaggctgccggcagcccgcagtggcacagccgtgctgtgggagggcctttctgtgtctggggctgtgttttccacactccccctctggcttttactgttttgctccgggagtgtggctttctagagttttgtctgattttatagcagagtttctgttaactcaaaaagggactccacagtgaaggtttaaaggtggtcccagctgcagcaggaagcaggtgtggggtgcctgctgcccaggccctgttccccagcactgcttctga

SEQ ID NO: 50243 - DNA, 601 bp, Human
cagccggaggctgccggcagcccgcagtggcacagccgtgctgtgggagggcctttctgtgtctggggctgtgttttccacactccccctctggcttttactgttttgctccgggagtgtggctttctagagttttgtctgattttatagcagagtttctgttaactcaaaaagggactccacagtgaaggtttaaaggtggtcccagctgcagcaggaagcaggtgtggggtgcctgctgcccaggccctgttccccagcactgcttctgacccaggaggggctggggagaggaccactwttcctcacctttcatacacccactcccatcctatttcgcaccccttcctccaggctgcctgcacctctgccctgctggcctttcgctctgtaattcctttctgaaagaaatgttttccatgaaacaacaacagcaagaagaaagcagatcagctgttggcaggagctgggaggagggatggggagggcagctgatggatatggggtttctgtcgcaggcgacgaaagtgctgtaaagttagatcacgatggtggtgacccgcctcagtaaatgtgctaaaaaccagtgaattatactctc

SEQ ID NO: 50244 - DNA, 601 bp, Human
tggggaggctgaagtgggcggatcacgaggtcaggagatcgaaaccatggtgaaaccccgtctctactaagaatacaaaaaattagccgggcgtggtggcgggcgcctgtagtcccagctactcgggaggctgaggcaggagaatggcgtgaacccgggaggtggagcttacagtgagctgagatcgtgccactgcaatccagcctaggcgacagagtgggactccattatacacacacacacgcactatatatatatacacacacacacacacacacacacacacacacacacacacaccaaaaaaaattagccgggtgtggtgggcgcctgtaatcccagccacgtgggaggctgaggcagaagaattgcctgaacctgggaggcagagtttgcagtgagccgtgatcatgccactgtactgcagcctgggtgacagagcaaaattctgtctcaaaaaacaaacaaaataaatgatatctcaataaagctgctaaaaaaaactcgcccaccaggtacccatcaggtatcttatccagcataagaacagctgggctgtgtgctgtctgcacctcatcccatgaatctttgcaggggttct

SEQ ID NO: 50245 - DNA, 601 bp, Human
aggctgaagtgggcggatcacgaggtcaggagatcgaaaccatggtgaaaccccgtctctactaagaatacaaaaaattagccgggcgtggtggcgggcgcctgtagtcccagctactcgggaggctgaggcaggagaatggcgtgaacccgggaggtggagcttacagtgagctgagatcgtgccactgcaatccagcctaggcgacagagtgggactccattatacacacacacacgcactatatatatatacacacacacacacacacacacacacacacacacacacacacaaaaamaaattagccgggtgtggtgggcgcctgtaatcccagccacgtgggaggctgaggcagaagaattgcctgaacctgggaggcagagtttgcagtgagccgtgatcatgccactgtactgcagcctgggtgacagagcaaaattctgtctcaaaaaacaaacaaaataaatgatatctcaataaagctgctaaaaaaaactcgcccaccaggtacccatcaggtatcttatccagcataagaacagctgggctgtgtgctgtctgcacctcatcccatgaatctttgcaggggttctacaag

SEQ ID NO: 50246 - DNA, 601 bp, Human
tgatatctcaataaagctgctaaaaaaaactcgcccaccaggtacccatcaggtatcttatccagcataagaacagctgggctgtgtgctgtctgcacctcatcccatgaatctttgcaggggttctacaagggtcctccttactaaaccccctgcacaggtgaggaaactgaggcccagagattatgcagcctgcccaggtaaagcagctggtgaacgtggacagcgtggcccccgtcataccttctcgccagctgacggtgctgtccagggagtctggaaagcagagatccaaaggaaytggctgggctggaaggctccttacagaagagctcgcttgcccattcactcattcatttgttcagctgaacacccacctacgagtgtgtaccaggcagacccgctcctgtctccacgaaccacaatcacagaattgtgtaaacgaggtaaagccggaggcctgagattgtggggatggggattgaggtcaggactgtcttaccaaggagtgacatttggcctgggattgaaaagtcacgaaggaactgaacattaagaccctgtatgtaaggctgggtgtggtggctcccactgtaatccc

SEQ ID NO: 50247 - DNA, 601 bp, Human
cccagagattatgcagcctgcccaggtaaagcagctggtgaacgtggacagcgtggcccccgtcataccttctcgccagctgacggtgctgtccagggagtctggaaagcagagatccaaaggaattggctgggctggaaggctccttacagaagagctcgcttgcccattcactcattcatttgttcagctgaacacccacctacgagtgtgtaccaggcagacccgctcctgtctccacgaaccacaatcacagaattgtgtaaacgaggtaaagccggaggcctgagattgtggggayggggattgaggtcaggactgtcttaccaaggagtgacatttggcctgggattgaaaagtcacgaaggaactgaacattaagaccctgtatgtaaggctgggtgtggtggctcccactgtaatcccagcactttgggaggccaaggtggaggaatgcttgaggccatgagttcggaatcagcctgggcaacatagtgagaccccatctctacaaaaataaacaaaattagccaggcgtagtgtcttcctgcccacttgggtggctgaagtggaaggactgcttgagcccaggagttcaaga

SEQ ID NO: 50248 - DNA, 601 bp, Human
acctgtgagaaagaggttgcagtgagccgagatcatgccactgcactccagtgtggacagcagagccagactccatcacacacacacacacaatatatatatatgtgtgtgtctgtgtatacacactcacatactcacactctctgtagtgggctgaatggtgtccccaaaagctaggtctgcctggcaactcacttccaacttcttggaataagggtctctgcaaatggaattagttaaggatctgcagatgagattctcctggatcaggctgggccccaatccaacgaagagtgccctygtgaggcagaagaggagagagacacgtgccggagaaggccacatgagggcagaggccgagaggcgggagtaaggccaccacgagcctgggaacgccgagggcgccagcagccgccagcagctggagagaggatggatgggaggattttctaaagccttccgataggggtgtgacttcttgattttggactccgggactgcaggaccgtgagaaaaggagtgagtgttaagtccacctagttagtggtcattcattaccgtagcccgggacacttacgtgaacttcagacctcaaatcctc

SEQ ID NO: 50249 - DNA, 601 bp, Human
cattcattaccgtagcccgggacacttacgtgaacttcagacctcaaatcctccccatcttgcagccccaggcgcagacctgggcagtggggcccccgtgtgcccatcccccagctggccaggctcagctgagagctcctcgacctcctgcctgtccctgccacccttaggagtccgagaaactggacctgcccgtggcctggacaccacttcctttattgcttagggtttctctctttctttctttaaaaattttttaaatgaaaaatggggctgagggaagactcggtctaaagataaagagaggggtcacctggatctggaatgttctctggctttccaggctgctctgatcgcagacctcctgtctttaacaacccagcctgggtcaggtctgatgaaatgcactttccagggaatggggctggtttgggctctgcagaagcttccctcttccatcctggcaccggcagaaaagcccattaaaataattgcagggagagactgttacctaagtttcctccccttgagctgttggagctcttctttgacctttatggtttttaaaaccctgccaatccttgccttgtcccccggacgc

SEQ ID NO: 50250 - DNA, 601 bp, Human
acctgggcagtggggcccccgtgtgcccatcccccagctggccaggctcagctgagagctcctcgacctcctgcctgtccctgccacccttaggagtccgagaaactggacctgcccgtggcctggacaccacttcctttattgcttagggtttctctctttctttctttaaaaattttttaaatgaaaaatggggctgagggaagactcggtctaaagataaagagaggggtcacctggatctggaatgttctctggctttccaggctgctctgatcgcagacctcctgtctttaacaayccagcctgggtcaggtctgatgaaatgcactttccagggaatggggctggtttgggctctgcagaagcttccctcttccatcctggcaccggcagaaaagcccattaaaataattgcagggagagactgttacctaagtttcctccccttgagctgttggagctcttctttgacctttatggtttttaaaaccctgccaatccttgccttgtcccccggacgcattcatccagtgggttgggaagctggtgttcgctgtccgggctgggtcgtgccggctctccgtgtgtgcacgtgtgg

SEQ ID NO: 50251 - DNA, 601 bp, Human
ggctcagctgagagctcctcgacctcctgcctgtccctgccacccttaggagtccgagaaactggacctgcccgtggcctggacaccacttcctttattgcttagggtttctctctttctttctttaaaaattttttaaatgaaaaatggggctgagggaagactcggtctaaagataaagagaggggtcacctggatctggaatgttctctggctttccaggctgctctgatcgcagacctcctgtctttaacaacccagcctgggtcaggtctgatgaaatgcactttccagggaatgrggctggtttgggctctgcagaagcttccctcttccatcctggcaccggcagaaaagcccattaaaataattgcagggagagactgttacctaagtttcctccccttgagctgttggagctcttctttgacctttatggtttttaaaaccctgccaatccttgccttgtcccccggacgcattcatccagtgggttgggaagctggtgttcgctgtccgggctgggtcgtgccggctctccgtgtgtgcacgtgtgggtctgggctgggtgttgacctgctcctgggccagggcccaccag

SEQ ID NO: 50252 - DNA, 601 bp, Human
aataattgcagggagagactgttacctaagtttcctccccttgagctgttggagctcttctttgacctttatggtttttaaaaccctgccaatccttgccttgtcccccggacgcattcatccagtgggttgggaagctggtgttcgctgtccgggctgggtcgtgccggctctccgtgtgtgcacgtgtgggtctgggctgggtgttgacctgctcctgggccagggcccaccagagccttagtccgggtggccaccatctgggaggcccggccgtgtcctctcttaccccagttctccrggcactggccaggggccccctcagcacacatgtcatagttggtccctccctgcccatggcccttcagaggcccccagctggtcttgggaggagggtgcctgtgtgggccagctttcagcacagcccccgccctctgctccagccttgggtgcaccccaaccccacccagctgaccagcctgttggggggcctgtggaccccgcctctaagcctgggtcttcctctgggcacccgttggggacagggcagccacacacccagcccagggtgtggtctccccacccagctgcctcccttgca

SEQ ID NO: 50253 - DNA, 601 bp, Human
cccagaaggaagcggagccctggtgggcagcctggctgtgctctggcccaggaaccgggccttttcttgcctcttgcctctgactcagagcggcttgtgggagcctcgcatgcagggccaggcagggcaagaacgatcgcgaccttttcctccagggaaggttgcaagaaaggcgggatctgtaacgtgactaggtggaggcactacggagccatggtgcaggggtggggggccccaggtgagctcagatgccctccctgcctgtgccaccgtggcctgaccctccacaggtgggagccayaggcgtcaggagccattaccccttggagaactgggtgccaggccgagacctggtgtctcatttatgacaaaccgctgcagtgcgtttgggagtctcctcctccatgacgtgcttgtctggattggttttattttagtgcaggcaccacgtcgtctttttatatacgtgtgaacgtatatatgtaaacacacgtatgatgttggtgagttcatgttggtggtatttttactaagcaaagatgtgggaaccaaatgggcccatccggggagtttcccatttggtccctcgtgctgtgtgtgg

SEQ ID NO: 50254 - DNA, 601 bp, Human
ccaggccgagacctggtgtctcatttatgacaaaccgctgcagtgcgtttgggagtctcctcctccatgacgtgcttgtctggattggttttattttagtgcaggcaccacgtcgtctttttatatacgtgtgaacgtatatatgtaaacacacgtatgatgttggtgagttcatgttggtggtatttttactaagcaaagatgtgggaaccaaatgggcccatccggggagtttcccatttggtccctcgtgctgtgtgtggtggggggcattgtggtcgaggtctgaacagccggggargtgaaagaccccgtcctctccgggagcttacgggagtgggagagacattgacgaaatattacccatcgcaggagtcaggtgcacacagtgatgatagttccgggaggtcaggtgcgcgcggtgatgacagttccggaaggtcaggtgcacgcggtgatgacagttccgggaggtcaggtgcacgcggtgatgacagttccgggaggtcaggtgcgcgcggtgatgacagttccagaaggtcacgtgcgcgcggtcgtgacagttccagaaggtcaggtgcgcacggtgatgacagttccg

SEQ ID NO: 50255 - DNA, 601 bp, Human
ttccgggaggtcaggtgcgcgcggtggtgacagttccgggaggtcaggtgcgcgcggtcgtgacagtgccgggaggtcaggtgcgcgcggtggtgacagtgccgggaggtcaggtgcgcgcggtggtgacagtgccgggaggtcaggtgcgcgcggtggtgacagtgccgggaggtcaggtgcgcgcggtcgtgacagtgccgggaggtcaggtgcgcctggtgatgacagttccgggaggtcaggtgcgcgcggtgatgacagtgccgggaggtcaggtgcgcgcggtcgtgacagtgcygggaggtcaggtgcgcgcggtggtgacagttccgggaggtcaggtgcatgcggtgattgttccggaaggtcaagtgcatgtggtcatagttccagaaggtgtccccggggcaggatatgttttcctattttccttggcttccggggagcttggagcctgctttcctttgggtcctgggctgattttcgggcaggtgctgggatgcagtgtcctgggtgctgcagcatggctgagcctcggattctctgtccagggctagctgtgttcaggccgcgcatctttagttttggggcatcgcaa

SEQ ID NO: 50256 - DNA, 601 bp, Human
ttccgggaggtcaggtgcgcgcggtcgtgacagtgccgggaggtcaggtgcgcgcggtggtgacagtgccgggaggtcaggtgcgcgcggtggtgacagtgccgggaggtcaggtgcgcgcggtggtgacagtgccgggaggtcaggtgcgcgcggtcgtgacagtgccgggaggtcaggtgcgcctggtgatgacagttccgggaggtcaggtgcgcgcggtgatgacagtgccgggaggtcaggtgcgcgcggtcgtgacagtgccgggaggtcaggtgcgcgcggtggtgacagttcygggaggtcaggtgcatgcggtgattgttccggaaggtcaagtgcatgtggtcatagttccagaaggtgtccccggggcaggatatgttttcctattttccttggcttccggggagcttggagcctgctttcctttgggtcctgggctgattttcgggcaggtgctgggatgcagtgtcctgggtgctgcagcatggctgagcctcggattctctgtccagggctagctgtgttcaggccgcgcatctttagttttggggcatcgcaaatcctcctggaatctgatgaaagctgtggaccc

SEQ ID NO: 50257 - DNA, 601 bp, Human
tgcgcgcggtggtgacagtgccgggaggtcaggtgcgcgcggtggtgacagtgccgggaggtcaggtgcgcgcggtggtgacagtgccgggaggtcaggtgcgcgcggtcgtgacagtgccgggaggtcaggtgcgcctggtgatgacagttccgggaggtcaggtgcgcgcggtgatgacagtgccgggaggtcaggtgcgcgcggtcgtgacagtgccgggaggtcaggtgcgcgcggtggtgacagttccgggaggtcaggtgcatgcggtgattgttccggaaggtcaagtgcatgyggtcatagttccagaaggtgtccccggggcaggatatgttttcctattttccttggcttccggggagcttggagcctgctttcctttgggtcctgggctgattttcgggcaggtgctgggatgcagtgtcctgggtgctgcagcatggctgagcctcggattctctgtccagggctagctgtgttcaggccgcgcatctttagttttggggcatcgcaaatcctcctggaatctgatgaaagctgtggaccctctgcttgtggcggggggtcatgcagaaaactttgagtacagtttcag

SEQ ID NO: 50258 - DNA, 601 bp, Human
tcaggtgcgcgcggtcgtgacagtgccgggaggtcaggtgcgcgcggtggtgacagttccgggaggtcaggtgcatgcggtgattgttccggaaggtcaagtgcatgtggtcatagttccagaaggtgtccccggggcaggatatgttttcctattttccttggcttccggggagcttggagcctgctttcctttgggtcctgggctgattttcgggcaggtgctgggatgcagtgtcctgggtgctgcagcatggctgagcctcggattctctgtccagggctagctgtgttcaggccgygcatctttagttttggggcatcgcaaatcctcctggaatctgatgaaagctgtggaccctctgcttgtggcggggggtcatgcagaaaactttgagtacagtttcaggagatgcacggaccacccaagggcctggaatcggagcccccacaagacagggggtgtgctctctgggccagcgtttggagcactctctggctcttggagccctggtggggcattcccagcagcttgcttcatttcctggacacgtgttcttggctgtggtttatattactctctgtatgtaaatgtcataggt

SEQ ID NO: 50259 - DNA, 601 bp, Human
tcgccaggatcactgccaaagagttctccccttccttccagcaccgggaaaacggtgagtctcgccgggcctgatactggcatcgtggggagggggtgcgtggatggctgggcagtcctggcagcagatgtgtcctccagagcgggtaggcttagatgggctcagccccagctgctcccctgcccggtgtcttcctctcccgccgaaggtgcttgtttgtgccaaggcctggcctggctccccgggacacaggacatgtgtcttggcaggtctctcccattcccacagtccttggggcacygcgtgttgcttgccggctgtccctgacggtgaattcccacctgcccagcctgtgctgtctgctgcccgccctcccccagtgttgttctagaaccttctgggatgatggaactatctgctgggtccagcgtggcagccattagctgggtgtgtctgcggtcctggctcttgacctgcctctgatgtgaactaacttaccattaaacacacccagtggctgctgggttggacagcgtcacaaatggcagctcccgctgtgcccctcggaaagagctggaagctgctgcctgatttaggaacc

SEQ ID NO: 50260 - DNA, 601 bp, Human
cccgccgaaggtgcttgtttgtgccaaggcctggcctggctccccgggacacaggacatgtgtcttggcaggtctctcccattcccacagtccttggggcaccgcgtgttgcttgccggctgtccctgacggtgaattcccacctgcccagcctgtgctgtctgctgcccgccctcccccagtgttgttctagaaccttctgggatgatggaactatctgctgggtccagcgtggcagccattagctgggtgtgtctgcggtcctggctcttgacctgcctctgatgtgaactaacttacsattaaacacacccagtggctgctgggttggacagcgtcacaaatggcagctcccgctgtgcccctcggaaagagctggaagctgctgcctgatttaggaacctcgtcctcccttcgagggggggatcatgggtgatacggcccagtgacagtggcgggggcgtggagggtgtggggtgggtggcggagaggccgtggccagctgcctcccatctcctacctcatcttggaggaagcttcctctgcaccaggaggccccagagaatggggttaggagcgcgccccctcaacccgagctctg

SEQ ID NO: 50261 - DNA, 601 bp, Human
ctgccactctggccaccaggacaggatgaggagcccagcctgggggctgcggggctgggcgctcccctgactggaacgcgagaccacatcatctctagaggtgaccgtccgccaccactccaagaccttgccttcactgggcgagtgccgggccctgcagagcctgcagctgcagcctggaggtcaggaggacgagcccccgcacccccaccgccttgggcagcttctattccactgcgtcccctccactctcctggcccctccagacacacgcaccccaaagtgtccaagtgggagggcmatgggccacgtgcccctgtggccattggcatcctccatggtctcgccctcaggccctgagtttccttctccctggggcccctccttgcctcgcccacgaccagctgcctgggctgggaggcggtggggcgcacacttgggggcacacgtgtagcgtgcacgtgcatgtggggagtgggtgcagtgctgcgggatggacgaacggaacagggatgctggagaggaagccagtgccgtcgggggcacctgccagaaccctggctgggccactccacgcagaatgcacgtaggacggcatggg

SEQ ID NO: 50262 - DNA, 601 bp, Human
gtaggacggcatgggattccacgtaccaaccctggcccatggtcgcctcagctccagccctgcctgcgactcacattccactgcctgcggcctgttttgtttcctctcagagcctcagttccatgtgtgaaaggaaggggaccagacagggaacattgaagcctccatcctgtgccaaatcccccaagagacgcatccaccggaagctcccaacgtgacttatttgggaggagggtctgtgcaggtgtcattatggaacagactttgagacaagatcagcctggattggggtgagtcctaratccacgcggcgtccttagaagagacagaagaggaggagacaggggcggatggagtgatgtcagagatcactggagactccgtggctggagggtggctggagcggagaccctggaaggaagcagcactcccgacacctggatcacggcttctaacttccagaaacacgagtttgccttttgggtgtttctacccccacccccgcgtggtgctttactgctccagtcccaagaaatgggtgcaggctcccccaccctgagaattccagttaagactctggagtcggagatgcttcctggag

SEQ ID NO: 50263 - DNA, 601 bp, Human
ggagggctcagtcctggattcagaggagatgcttcctggagggctcaggtccctgcaggaggggccttgggctgaccttttaagtcctgaagctgcctcctccgacagttcttgtcttcatgatacagatgcgggcccctgtgggggccgctgtgatggagagacggggccgctgctgcctcactggtgggagtccagtcctcgagggtctggccaagttggcctcacctcctgctgctgcaccttggagcctggctcactctgagcacctcggtccgatctgccacctctttgggtggcrccccggagccttctctgagcagcatcttccctggagggggcgttgggaccgtgtgttttttacaagcgctgggactggcatgagatttgatccaagcatttcttgtttccgccttggatgcattcaggatcagtgttcccagaccaggcaccccggggccttctcggctgctggggaggggtggggctgggggaagctgtccaggtccttcctcagtcgtcctcacagccaggagctgaggtcaccaatgacagatgacagaacagagcctccaagaggggaacagggttgccagagcgc

SEQ ID NO: 50264 - DNA, 601 bp, Human
ctgtggcagaagaggtgccactgaccaccccactctgtcctgctaccccactacaggctgactagcatccggcccttcctcctcgctggggtgggggaactttgcaccaggggtggcatcagtgggcagggctgggcccttggctgttctctgccccctgcaggctggcccggcccaaccaagttgtcatggggcccaagactcacaatacacctgcctgaggccacgatgccacggaaagctgggctcagggcagcttgctttctctctggctgagtggaggcccttgctgtgtccacamctccacttccatctgcgcctcaggtccctgataggctgggaggttgcggagggtgtgggcctggtgctgctgtggctgcaggtgccccctaggcagcacctcaccctctgaggaccctcctctctgagctgcatcccaaggacagtttacaaagccctttgctgactggggttcagcttatctgttgagcaaactttttctttaaaaagtttcttggccaggcacggtggctcacacctataatcccagcactttgagaggccgaggcaggtggatcacctgaggttatcagttcgagac

SEQ ID NO: 50265 - DNA, 601 bp, Human
tgtctgcgtggtaggaagtggagggctccgggggctctgaacagctccttaccacagtggggtctacatctccttccaggtggctgcgagatgcagggcgtggtgggggtggggagaggcaggggcaagtgtcctctggaagcagactgtgggcaagactggagtgggtgtcccagccattcctgggctggggccaccgtccaggaggcgtccattccctgtgcagcaggtactgtatctgtagggcagcacccacccctgccgtcctgggagcttcccagaggggccacgctccctctcacccctgcctggtgtgagcagaacacagcagagtgcaggactgcaagaatcactgcagaagggcgcccccggaaaaggctctgttgtgagacgtgtcctacctggccccggcaagcacagggaaggtggcagcttggtccgagtgcccaggctgtgcggctgaagggggagtctggcacttggggctccggcggaggctgaggacttgtgagccacttcagggaggtggtggcagcagcattcaggaccataacctaaatccaaggcagctcgcaattggacacagtcctccagagccagt

SEQ ID NO: 50266 - DNA, 601 bp, Human
gctgcatctgacactggccatggcagccatgcgggcccttctgagattctgaggtcccagttccacagggcaggagaagcctgctgactggcacaaaggccacacgcaccgagacgtttgcttgcagggaggcctgggtggttctctccaaggggaccctgggagagctggtactcagggtgtcggggccacaagggaattccaagggaattccaggaccagcaacctcagacgtacaggcagctggggcttctctcccgcgtctggacttcacggagctcaggttctggtgggcctttgstgtccaagcgtttctaacatcctcccgtacgcttccacccccgagggtctgctagcttggtgaaaagacgtgggtgggaggcgtggtggcccaggcagagccccccgcagctgtcgctcacctcttcccctcgctctcttccagggctcagcgcctatcctggtggtcatggtgatcttgctcaacatcggagtcgccattctgtttattaactttttcatctgatgagatgtcgcggtagcaaaaatagagaaagggtagaaaaaagggacattaaaattaaaagcaaaaccacaagaa

SEQ ID NO: 50267 - DNA, 601 bp, Human
gcccgtgccatgccctggggagggtgagaagagggacaccaccatgcaagtgcggggcagggcagcctgccaccatagcctcattccatgtacacacccagtctaccagagacgctgttggcccagtcagctggggcttggagagagcatgccaaagtcacacagatggagaagtgcaactcaaactgaggcctccctgcctcaaagccccagatcccccagctacacgctgccaggctggggctgagcactgtcacacggctgccacccaggcctgccttccccacagcccgccagccaygcagaaaagctgtccgtagttacctttcttctccttccacctggcaccccactcctcaggtggtcacactccagcagtgccctccctggccctggaggcccggcgtggctggtgtcatctgtgaggggaactaggcccagttccttggaattcctattttgtttccttgccatgggtctcagtgacccagctgatggctcagtccagggaccccagactctgccaaggcatttccgtgagtgaggaggcagagtccactggaaggagggcgggagttcctgacaggaagtgtggcaattt

SEQ ID NO: 50268 - DNA, 601 bp, Human
actgcacgggcagagggtgcccactgaccgacggtgctgctgcccgtgccatgccctggggagggtgagaagagggacaccaccatgcaagtgcggggcagggcagcctgccaccatagcctcattccatgtacacacccagtctaccagagacgctgttggcccagtcagctggggcttggagagagcatgccaaagtcacacagatggagaagtgcaactcaaactgaggcctccctgcctcaaagccccagatcccccagctacacgctgccaggctggggctgagcactgtcacacrgctgccacccaggcctgccttccccacagcccgccagccatgcagaaaagctgtccgtagttacctttcttctccttccacctggcaccccactcctcaggtggtcacactccagcagtgccctccctggccctggaggcccggcgtggctggtgtcatctgtgaggggaactaggcccagttccttggaattcctattttgtttccttgccatgggtctcagtgacccagctgatggctcagtccagggaccccagactctgccaaggcatttccgtgagtgaggaggcagagtccact

SEQ ID NO: 50269 - DNA, 601 bp, Human
tgagctgaatggggatccctgatggaacagaatcacatttcagatgaaacgcctgttctctatcactctttctctttaaacctatcctctgagtctcggcacagataccacttcttctgagcccctgggctgtgctgggcatcgtttctgtgctctgtgccttctttgctcccagccccgatgaccttagaggacacaaactcctccctggtctgcaccccatcagattgggagcacctggtgtgaagtgcccctgccagaggctggtgaagggcaggtgggggccatcttctcctgcctyagctgtgctccccggagccccctgcctgtgtggcccgcctgtgccctccacccgctccccactcactgcacgggcagagggtgcccactgaccgacggtgctgctgcccgtgccatgccctggggagggtgagaagagggacaccaccatgcaagtgcggggcagggcagcctgccaccatagcctcattccatgtacacacccagtctaccagagacgctgttggcccagtcagctggggcttggagagagcatgccaaagtcacacagatggagaagtgcaactcaaactgaggcctc

SEQ ID NO: 50270 - DNA, 601 bp, Human
tacctgctctgccaatctcgtttgtctcctctagtgccaccagccacgagatagagctttggggctttgagccaagtgatatcagctttacctccagggccagtcccctcagctgtaggagtctgagcaagtgacttgacttttctggggctcagcttgcccacctgtgaaatgggatcttaatagcagcactggccacatatgttgttgaggagcctgctgcagaggaggtgctccgtagaggctgctgatcacatgcgggggcaagagggaacatttataagccttggggatgggtgcygccaattgaaatgtagtaccagaatatttttctgcagtgagaggagcttgagctgaatggggatccctgatggaacagaatcacatttcagatgaaacgcctgttctctatcactctttctctttaaacctatcctctgagtctcggcacagataccacttcttctgagcccctgggctgtgctgggcatcgtttctgtgctctgtgccttctttgctcccagccccgatgaccttagaggacacaaactcctccctggtctgcaccccatcagattgggagcacctggtgtgaagtgcc

SEQ ID NO: 50271 - DNA, 601 bp, Human
gtggttcagggacccatatcagtcaaatcccgtctggaagggaatgcgggtctcttgatggccacttacctgctctgccaatctcgtttgtctcctctagtgccaccagccacgagatagagctttggggctttgagccaagtgatatcagctttacctccagggccagtcccctcagctgtaggagtctgagcaagtgacttgacttttctggggctcagcttgcccacctgtgaaatgggatcttaatagcagcactggccacatatgttgttgaggagcctgctgcagaggaggtgcyccgtagaggctgctgatcacatgcgggggcaagagggaacatttataagccttggggatgggtgccgccaattgaaatgtagtaccagaatatttttctgcagtgagaggagcttgagctgaatggggatccctgatggaacagaatcacatttcagatgaaacgcctgttctctatcactctttctctttaaacctatcctctgagtctcggcacagataccacttcttctgagcccctgggctgtgctgggcatcgtttctgtgctctgtgccttctttgctcccagccccgatgacc

SEQ ID NO: 50272 - DNA, 601 bp, Human
tgccgacagccagacagatgtgcacacacgcttacatgcacatactgttccagtctgaggcgtcaaactacaggggctggtccaagcctcaggacaaggacctgcagacgtagagatgcaaggtttggcacagagaacagggcgcctgccttggtgttgtcctgccctgcagccccatctaaggacagccaccaccagtacagggccatagggcagaaacacctggatccctggcaaaggctgacaagctggcatgagccagggcaggagggatggctgtcctcagctggtcagggaatayaggccaagtggacaggggccaggtgctccggaaggcaccttctttgccatcatttgacatatttgtgagtgtgtgtgtgtgtgtgtgtgtgtgtgttgtaggcgccaggccctgacaaagctgtgggggtgcaacagtgaagaagacatatggatccgtggttcagggacccatatcagtcaaatcccgtctggaagggaatgcgggtctcttgatggccacttacctgctctgccaatctcgtttgtctcctctagtgccaccagccacgagatagagctttggggctttgagccaagt

SEQ ID NO: 50273 - DNA, 601 bp, Human
ccgagtgggggctaatctctgtccccgcggtgtcccgcgccgcgagcgcaacaggagggggcgctggagcccagggcccttgcgcacccgaaggtttccgcagggccgcagcgccctctgccgggccttggcgcgcactcaccggggtgggggcattcaccaccgacaggttgtagccgtagaggaaggaggagccgaaggcgcccgcgagggaggccacgaggagcgagcaggaccagtcctgaggggagaggaaaccacgtcagagccggcaccgggcgcgcagccagggccgagggargacctggaacgttccctcagctgggggaggccttccggaggagaagtctttgtccttggctggggtagagacagagagaagagacgcaagttggggacctgcaagtagggttccagtccaggtccgcgtgcgcaggccgggcgccctcaggtttagcggccacgcccttgcgttccttccgggttgcgtgaggattcctgaaacgcagttttcagcagctgctctgggcagctccacacgatcctttcagcgaagttggcgagtgtccgacccagacagaaaaaagcaaagccagactcc

SEQ ID NO: 50274 - DNA, 601 bp, Human
ggcccctcctggttctttccccggcattaggggccagaggatcgccccccaccccaccccgggacttccgaagccccctctcatctagtctcccaacgttctcccaggacacccgccctccagccgcaagaactgtcatcccccgcccctgtccccgtgtcatcattgtctgtctctgtgcctcccctctcccccgagtgggggctaatctctgtccccgcggtgtcccgcgccgcgagcgcaacaggagggggcgctggagcccagggcccttgcgcacccgaaggtttccgcagggccrcagcgccctctgccgggccttggcgcgcactcaccggggtgggggcattcaccaccgacaggttgtagccgtagaggaaggaggagccgaaggcgcccgcgagggaggccacgaggagcgagcaggaccagtcctgaggggagaggaaaccacgtcagagccggcaccgggcgcgcagccagggccgagggaagacctggaacgttccctcagctgggggaggccttccggaggagaagtctttgtccttggctggggtagagacagagagaagagacgcaagttggggacctgcaagta

SEQ ID NO: 50275 - DNA, 601 bp, Human
atagatagatagatagatagatagatagatagataacaacaacaacaaaacaaatcaagaaaatgtccaagtttccatgcataaggcccctcctggttctttccccggcattaggggccagaggatcgccccccaccccaccccgggacttccgaagccccctctcatctagtctcccaacgttctcccaggacacccgccctccagccgcaagaactgtcatcccccgcccctgtccccgtgtcatcattgtctgtctctgtgcctcccctctcccccgagtgggggctaatctctgtcyccgcggtgtcccgcgccgcgagcgcaacaggagggggcgctggagcccagggcccttgcgcacccgaaggtttccgcagggccgcagcgccctctgccgggccttggcgcgcactcaccggggtgggggcattcaccaccgacaggttgtagccgtagaggaaggaggagccgaaggcgcccgcgagggaggccacgaggagcgagcaggaccagtcctgaggggagaggaaaccacgtcagagccggcaccgggcgcgcagccagggccgagggaagacctggaacgttccctcagctg

SEQ ID NO: 50276 - DNA, 601 bp, Human
aaaacggcctgtgctccaagaacctggagctccccgcatttccccagatgtgtcctatatccgtgtctccaaaacggcctgtgctccaagaacctggagctccccgcatttccccagatgtgtcctacatcccggccccccatccatcactccaccttccaaacttagtcaggcatcacttcctgcaggaaagcttccctcaagcctccaacctgcccttgcctgtgggtggtggtaggtcaaagccaaagccagcacccacaggatagcatctaaaccttacagcctaggtaggcagtayccaacctttaactgcaaaccagaggcacaatgtgaagagggcctgggagaattgcacctggatctgatttcagagtaaaacacaagccaaagatgggtcttatccagcagatacctgagtggcctctggttgtaatttaaagtcaacaacaccaggccgggcacagtggctcaagcctataatcccagcactttgggaggccaaggtgggcggatcgcttgaggctgggagttccagaccagcctagccaatatggcggaacaccacctctacaaatacaaaaattagtcgggtgtggtg

SEQ ID NO: 50277 - DNA, 601 bp, Human
cttcccctatgttttgtacacaaggatgctggactcccaagcaaggaaaagcctggaaggcacccagggctgtcctcagcctgcttcctgtctgcccccaaaacagcttgtgctccaagaacctggagctccccgcatttccccagatgtgtcctacatccgtgtccccaaaacggcctgtgctccaagaacctggagctccccgcatttccccagatgtgtcctatatccgtgtctccaaaacggcctgtgctccaagaacctggagctccccgcatttccccagatgtgtcctacatcscggccccccatccatcactccaccttccaaacttagtcaggcatcacttcctgcaggaaagcttccctcaagcctccaacctgcccttgcctgtgggtggtggtaggtcaaagccaaagccagcacccacaggatagcatctaaaccttacagcctaggtaggcagtacccaacctttaactgcaaaccagaggcacaatgtgaagagggcctgggagaattgcacctggatctgatttcagagtaaaacacaagccaaagatgggtcttatccagcagatacctgagtggcctctggtt

SEQ ID NO: 50278 - DNA, 601 bp, Human
aggggaagagtttggggaatgattctagctaataataaagctgtcttcggtttctcagttagatcaggtcctttatgagaattgctctatgagaaccccgagggagggaggggttgggacaggattcagacaatcacaggtgcctgcttgtaacacgatggcagcatcatccaccttatgcttgagcccctagggttgttgcagtgaaaccttgctctgtcttttggttggtagatggacaggtaagtagccctgggcttgctgtggctcctcccatctccccttgttcctctttgccttyattgatcatgccaaactccccccatggctggactgttggcgcctgccattagtggtcaggggcaggaaggaggggcagagagcatggcacggatcttggattcagacagacctgggtttgaattccaacactgccacctcctggctgtgtgaacctgggcaagttgcttaaactgagcttctgtttctttgttcatgaaatgaaggtaacatcagtaattaactaccttgacctgaattgtgtcccctccaaaaatgttgcatgacatttttgttgcaaggatagggcatgttgaagccc

SEQ ID NO: 50279 - DNA, 601 bp, Human
caggacctttaggcagagcaggaagaggttacatgaccccaaaccccatagggaggggaagagtttggggaatgattctagctaataataaagctgtcttcggtttctcagttagatcaggtcctttatgagaattgctctatgagaaccccgagggagggaggggttgggacaggattcagacaatcacaggtgcctgcttgtaacacgatggcagcatcatccaccttatgcttgagcccctagggttgttgcagtgaaaccttgctctgtcttttggttggtagatggacaggtaagyagccctgggcttgctgtggctcctcccatctccccttgttcctctttgccttcattgatcatgccaaactccccccatggctggactgttggcgcctgccattagtggtcaggggcaggaaggaggggcagagagcatggcacggatcttggattcagacagacctgggtttgaattccaacactgccacctcctggctgtgtgaacctgggcaagttgcttaaactgagcttctgtttctttgttcatgaaatgaaggtaacatcagtaattaactaccttgacctgaattgtgtcccc

SEQ ID NO: 50280 - DNA, 601 bp, Human
aacctttctgatctggcttcagctcccctttccagcctctacctctccaccccactggaccccacatccagctacccttaggtctccaccattcccagaaagccttgagctctctctttcaagccccagtgaggccccactgacctccccaggtagaatacagtccttcagctgtcctgtggctccatgcagcctgcctcactggtgattatttattgagcctctgtcactgctgctggtcttggggcacctcgaggacatggatgtgtgtcgttttcatctttctaccccagatacagcwaggtcaacacccagggaagggcactgaaggattgcctgaacagctacccctctcttctcacaaagcagcacaagtaaacataaaacatcaggacctttaggcagagcaggaagaggttacatgaccccaaaccccatagggaggggaagagtttggggaatgattctagctaataataaagctgtcttcggtttctcagttagatcaggtcctttatgagaattgctctatgagaaccccgagggagggaggggttgggacaggattcagacaatcacaggtgcctgcttgtaacacgat

SEQ ID NO: 50281 - DNA, 601 bp, Human
tcagggcagtttccacctcggaagggcctcccagggcgagccttggccctcagcctgctcatagcctgggtggtgctggatcatgctcctgttctggcctctgcaacctttctgatctggcttcagctcccctttccagcctctacctctccaccccactggaccccacatccagctacccttaggtctccaccattcccagaaagccttgagctctctctttcaagccccagtgaggccccactgacctccccaggtagaatacagtccttcagctgtcctgtggctccatgcagcctgyctcactggtgattatttattgagcctctgtcactgctgctggtcttggggcacctcgaggacatggatgtgtgtcgttttcatctttctaccccagatacagcaaggtcaacacccagggaagggcactgaaggattgcctgaacagctacccctctcttctcacaaagcagcacaagtaaacataaaacatcaggacctttaggcagagcaggaagaggttacatgaccccaaaccccatagggaggggaagagtttggggaatgattctagctaataataaagctgtcttcggtttct

SEQ ID NO: 50282 - DNA, 601 bp, Human
gtttctttctccttctcgagagcccagcaccccaggtgaagcctagctctcacaccctaaacccctgccaggcttgggtccttccagcctgtgttagattccattccttagaggctctgctctgttcctggtctccctggttctggggctgcctcactcacccgtttctaagcccactgcaaggagaagagagaattcgaggtgatcgctggacgctgggctgagctcctccagcatcacatctcctttcatttcgcagcgacctcacaaggggctcgacaccagccctttacagaggcasctacatggtgcctgggattctctgcaggattctgagctgggattctgtgcaggcctgctcagctcacactcagggcagtttccacctcggaagggcctcccagggcgagccttggccctcagcctgctcatagcctgggtggtgctggatcatgctcctgttctggcctctgcaacctttctgatctggcttcagctcccctttccagcctctacctctccaccccactggaccccacatccagctacccttaggtctccaccattcccagaaagccttgagctctctctttcaagcccc

SEQ ID NO: 50283 - DNA, 601 bp, Human
ggcagcctttgttcatcatctctgtgagcagataccctccccgcactccaaagcagcactaatatctgcacctcttctgttccaagggtttctttctccttctcgagagcccagcaccccaggtgaagcctagctctcacaccctaaacccctgccaggcttgggtccttccagcctgtgttagattccattccttagaggctctgctctgttcctggtctccctggttctggggctgcctcactcacccgtttctaagcccactgcaaggagaagagagaattcgaggtgatcgctggaygctgggctgagctcctccagcatcacatctcctttcatttcgcagcgacctcacaaggggctcgacaccagccctttacagaggcacctacatggtgcctgggattctctgcaggattctgagctgggattctgtgcaggcctgctcagctcacactcagggcagtttccacctcggaagggcctcccagggcgagccttggccctcagcctgctcatagcctgggtggtgctggatcatgctcctgttctggcctctgcaacctttctgatctggcttcagctcccctttccagcctct

SEQ ID NO: 50284 - DNA, 601 bp, Human
tctaaaacctctagcacaggggttagccaacaattggccagcaagggaaaccctagaccaccatctgtttcgtaaataaaatgttattggcacataccctcacccattcatttacatatcatctataactgctttatctctacatagcagagttcagtagttgcaacagagaccatatggccaacaaagaaaaaccacgcactatctggacctccacagaacatttgctggaccttcacagaacgtttgctgattcacagaatgcagcagatcagcctagtggaacagaaagaagggataytcaggaattagacagaccagtgtccaagtccccatctgtgaacatggtggaggtggtcccagaagttttccataggacagactcacagctggcaatttgtttgagagtgaagagacctaaggacttgccttggactcactttaaatttaaatttatccatttgctcatttagcaaatattttttataaatgcttacaatgtgtcagacattgttctaggtgctggcactgcagaagcaaggacctttctaaagtgaagggaaggaggacaagaagtaaaggaatatgtcatatctcaggt

SEQ ID NO: 50285 - DNA, 601 bp, Human
gaagccattttcaaggattcagattagcacatttgcatgcatgactgtctgaaaattcaggctacatttgattggtatgcaaattagccctaaatttggcagtcttttacaataacttcaggatgttttagacagacaggtaagtaagtagatggatagacagaaagatacaactatgccaattggagctagtcactggaaacagaaaggacaaagcctagacaatcagcaatacatgaacaaaagaaaggagattagaaagcaaacatcttcaggaagatttaggtgctcctatttagawgctatgcagcataggctgtggattaattattcagccagccagccctctgcccagaggtactaatgacacaaggaatctacaagagcctcctcccttttctaaaacctctagcacaggggttagccaacaattggccagcaagggaaaccctagaccaccatctgtttcgtaaataaaatgttattggcacataccctcacccattcatttacatatcatctataactgctttatctctacatagcagagttcagtagttgcaacagagaccatatggccaacaaagaaaaaccacgcact

SEQ ID NO: 50286 - DNA, 601 bp, Human
gatgattctagcagtataatgaagcaggttccaggcactgcaacattttcctactaaaggtcaacgattacaatggcataaatctgaagccattttcaaggattcagattagcacatttgcatgcatgactgtctgaaaattcaggctacatttgattggtatgcaaattagccctaaatttggcagtcttttacaataacttcaggatgttttagacagacaggtaagtaagtagatggatagacagaaagatacaactatgccaattggagctagtcactggaaacagaaaggacaaarcctagacaatcagcaatacatgaacaaaagaaaggagattagaaagcaaacatcttcaggaagatttaggtgctcctatttagatgctatgcagcataggctgtggattaattattcagccagccagccctctgcccagaggtactaatgacacaaggaatctacaagagcctcctcccttttctaaaacctctagcacaggggttagccaacaattggccagcaagggaaaccctagaccaccatctgtttcgtaaataaaatgttattggcacataccctcacccattcatttacata

SEQ ID NO: 50287 - DNA, 601 bp, Human
gacatctttcagcacaactctggcaatcatcccagatgattctagcagtataatgaagcaggttccaggcactgcaacattttcctactaaaggtcaacgattacaatggcataaatctgaagccattttcaaggattcagattagcacatttgcatgcatgactgtctgaaaattcaggctacatttgattggtatgcaaattagccctaaatttggcagtcttttacaataacttcaggatgttttagacagacaggtaagtaagtagatggatagacagaaagatacaactatgccarttggagctagtcactggaaacagaaaggacaaagcctagacaatcagcaatacatgaacaaaagaaaggagattagaaagcaaacatcttcaggaagatttaggtgctcctatttagatgctatgcagcataggctgtggattaattattcagccagccagccctctgcccagaggtactaatgacacaaggaatctacaagagcctcctcccttttctaaaacctctagcacaggggttagccaacaattggccagcaagggaaaccctagaccaccatctgtttcgtaaataaaatgt

SEQ ID NO: 50288 - DNA, 601 bp, Human
tcaggtggattctagacactgggtgctcacaggtaccaagaggacatctttcagcacaactctggcaatcatcccagatgattctagcagtataatgaagcaggttccaggcactgcaacattttcctactaaaggtcaacgattacaatggcataaatctgaagccattttcaaggattcagattagcacatttgcatgcatgactgtctgaaaattcaggctacatttgattggtatgcaaattagccctaaatttggcagtcttttacaataacttcaggatgttttagacagacaggtaagtaagtagatggatagacagaaagatacaactatgccaattggagctagtcactggaaacagaaaggacaaagcctagacaatcagcaatacatgaacaaaagaaaggagattagaaagcaaacatcttcaggaagatttaggtgctcctatttagatgctatgcagcataggctgtggattaattattcagccagccagccctctgcccagaggtactaatgacacaaggaatctacaagagcctcctcccttttctaaaacctctagcacaggggttagccaacaattggccagc

SEQ ID NO: 50289 - DNA, 601 bp, Human
atcagccctgtctgcccatttcagtccccagagaatgtcccttggggctcagaaccccccactccagtctgtgggtctccatccagcccttaacaacctctcaggtggattctagacactgggtgctcacaggtaccaagaggacatctttcagcacaactctggcaatcatcccagatgattctagcagtataatgaagcaggttccaggcactgcaacattttcctactaaaggtcaacgattacaatggcataaatctgaagccattttcaaggattcagattagcacatttgcatgyatgactgtctgaaaattcaggctacatttgattggtatgcaaattagccctaaatttggcagtcttttacaataacttcaggatgttttagacagacaggtaagtaagtagatggatagacagaaagatacaactatgccaattggagctagtcactggaaacagaaaggacaaagcctagacaatcagcaatacatgaacaaaagaaaggagattagaaagcaaacatcttcaggaagatttaggtgctcctatttagatgctatgcagcataggctgtggattaattattcagccagc

SEQ ID NO: 50290 - DNA, 601 bp, Human
ccaggcaccaccatcccacccaggcctgtatcagccctgtctgcccatttcagtccccagagaatgtcccttggggctcagaaccccccactccagtctgtgggtctccatccagcccttaacaacctctcaggtggattctagacactgggtgctcacaggtaccaagaggacatctttcagcacaactctggcaatcatcccagatgattctagcagtataatgaagcaggttccaggcactgcaacattttcctactaaaggtcaacgattacaatggcataaatctgaagccatttkcaaggattcagattagcacatttgcatgcatgactgtctgaaaattcaggctacatttgattggtatgcaaattagccctaaatttggcagtcttttacaataacttcaggatgttttagacagacaggtaagtaagtagatggatagacagaaagatacaactatgccaattggagctagtcactggaaacagaaaggacaaagcctagacaatcagcaatacatgaacaaaagaaaggagattagaaagcaaacatcttcaggaagatttaggtgctcctatttagatgctatgcagc

SEQ ID NO: 50291 - DNA, 601 bp, Human
ttaccatatgttcacggaacccctgagcctgtcgctggtgtctgaagtaaggccagtcttgtgaacggctgtgctcttaacctgtgaagtttggcctaaatggctagttagcatcaggagtcatggcgaagctgtgtgcgaggtactttgatagacgccagggaaacaaatgaacagtattgttttaggtgacactttgatctgtacaatcctgactgctatacttttgccaagcctccaagcatttcccccaagctacaggccagaaactgcacaaacaggcaccaagttcactgtctayccttttgattagccctgaactgtcccgcccacctcaccttctgttcccccaaccactgcattccctgtttgctttctaatttttattttcattcataactcctattcaacacattcattatctcaactttggtccttttttcttggcgacttttcttaatgtccatcccccagtggtcgttctgcctaggctgactgttctcttgggctcattgcaatgtgggatcctcctacaatcataggaagtgcgtgagtcccaggtcaggaatccatccaggtccatcacctcaatagttgcttc

SEQ ID NO: 50292 - DNA, 601 bp, Human
tcttcttgtggcttattctgattcgtatcctttttgctataataaagctgtaattctaagcatagcacttcctgagttctgtgagtcatttgagcaaattatcaaaccagaaggggtagtgagaacccccaaatgtgttaccatatgttcacggaacccctgagcctgtcgctggtgtctgaagtaaggccagtcttgtgaacggctgtgctcttaacctgtgaagtttggcctaaatggctagttagcatcaggagtcatggcgaagctgtgtgcgaggtactttgatagacgccagggwaacaaatgaacagtattgttttaggtgacactttgatctgtacaatcctgactgctatacttttgccaagcctccaagcatttcccccaagctacaggccagaaactgcacaaacaggcaccaagttcactgtctacccttttgattagccctgaactgtcccgcccacctcaccttctgttcccccaaccactgcattccctgtttgctttctaatttttattttcattcataactcctattcaacacattcattatctcaactttggtccttttttcttggcgacttttcttaatgtc

SEQ ID NO: 50293 - DNA, 601 bp, Human
tccttccagaccttgccctgtgatctcttcttgtggcttattctgattcgtatcctttttgctataataaagctgtaattctaagcatagcacttcctgagttctgtgagtcatttgagcaaattatcaaaccagaaggggtagtgagaacccccaaatgtgttaccatatgttcacggaacccctgagcctgtcgctggtgtctgaagtaaggccagtcttgtgaacggctgtgctcttaacctgtgaagtttggcctaaatggctagttagcatcaggagtcatggcgaagctgtgtgmgaggtactttgatagacgccagggaaacaaatgaacagtattgttttaggtgacactttgatctgtacaatcctgactgctatacttttgccaagcctccaagcatttcccccaagctacaggccagaaactgcacaaacaggcaccaagttcactgtctacccttttgattagccctgaactgtcccgcccacctcaccttctgttcccccaaccactgcattccctgtttgctttctaatttttattttcattcataactcctattcaacacattcattatctcaactttggtccttt

SEQ ID NO: 50294 - DNA, 601 bp, Human
gggtgcttctagtttcacttgtctggtttgttcacaccagctgtgcaactccaacacagccctccaagtttccctacctcccatcttgctggatcagctatccccagctctctggctgcagcaaccactgcccccactgcactaagctgagcttcctggagatttgatgggaccgagttcctttccccatttggctcaacaaaggcatttttcttggagaaactttatgaaatgagaaaattctatatcaaagaggcaggctgtccagctctaatcgctgggacctccagggcatggtgcrgggggagttggcactcacagcctgggacacctggacaccaacgccccaggctggaaaaggtccctgggccctcatcagtcagcagctgtgctggctctgatcaaatcaaaccaaaccaaacaatgactcacagatcccaatttaaacaatgcagcagcatctcatattagagaaaaattggaaacaacctcagaggcccacattaggaagataggacatcacaggaggcagctccacactgctgttaaacatcctggtgatgcagaacttccaatagcatagaaaggtgcttacaaataa

SEQ ID NO: 50295 - DNA, 601 bp, Human
cagctcccattttggcttgacttgagcattaggtttgcaggtttgtggtgttttttcctcctccccaagtgattctcccagaggagcctggctgactcactgggaaagaggctcctgtgcctccagacacctgagactattttgttcccacagttagctttcagaatgaaatgaaacatgatgaaagaggaaacatcaattacaagcaacagccaggcaagtaaggctttcagagcctcctgggtttcccctcagccacctttgcagtgagggggcagccaaatgcttgggtttaattagwtgaaacataaagaaggtaagtttcattgtctatttggccccaggcagaagcagagaagtgaatgcactcccaatattattcttattcaatcacagtcctgagccttcctcctgctggaacattcttttgagaggttgcatagctgtgtttacagggaacagtgcattttcgcagacttgagatgatattttgctctcctttttgcatatcctccggttggccggaatgaaaagggcaaattgttttcattaccagtcaattcacttctggatgcttgaggtagcaggggccccgtctgca

SEQ ID NO: 50296 - DNA, 601 bp, Human
agtgctacctaatgtcgcctggctccccgacgtaaggcctcctgtgtagaaaagagctctcacagcacgcctgagacttctcttcctagaaaaacctgctgcagggtaagtcccgggcttgcatctgggaacttggatgttggaagggttgccaccgttcccagatctggtaagagtgactcagtgtacctaaactgtgcaaacagtgtggtttatgctgtctcagtgtggtttatatctgctttctttctgggaatctggaattttctgcttgccaagcagagagtgcctatgtgaccamcccccgagaaaaaccctggactccaagtctctaatgagtttccttgttagacaaatttcacaagagttgtcacaactcgttgctgtggggatgaagcgcgtcccgtgaggctctgctagaagagttctttggagcttgcccctggtttcctctggacttcacccctgcacctttttcctttgctgacttagcattgtgttccaccactgtgatcagtcatagctgtgagtactaccgcattcctgtgccaacgcctgtgactcatgccagtgaattatcctacctgaaggtggtgttggg

SEQ ID NO: 50297 - DNA, 601 bp, Human
gatacagcacagtgctgggtcgatatgaagtacacaataaaaaccggaaattggggtggttggtggtagtgttgttgatatttttactgctatatttgtaaaataaggggcctaggctcatttatttgtcagattcaagaatccatgaatcacttaccattatctcccaggccaggaacctggggaccaagcctctggacataaaattgaactctgcaattcccagccaagactggcttagagcatctccaaataataaaagaaattgccagacaatgggaggcaaattacctcgtagccygtttaacaatattaatgtgccttactgattcacacagagcctcccgtgaactcacttggaacgattctcaggagtcctgtaaaaatacacggaagtaacacttggtagctgggccagagtacacacaccattgcataagagaggaagtcatgccacaatgccttagggctttataaagacagtctgcaccactgaacacactggcacagggaagaatgcagtccagaagtccttaaaaaagtacccattgttgaaccaggccctctgaagttagggccccacaagaacaaaattccacaa

SEQ ID NO: 50298 - DNA, 601 bp, Human
agggattagactagaggatgctaggcctgttaggaagctcctgcaattggtatgagatgatgagtctgatcaaaattgttatgagttgctccagaagcattgatgttacggctagtactaactatagcctaaactgcaaacaactgaataaaaggctacatggttaaagcaaaggaagcttaagaaagagccaagagttctggatttaacacttgcttgcatcactgagtctttctgtggccttgggtgatcttaagcaatctgtgtgcctctctggaagtgctgtcaatgttaaaggtasttggaattggcttttttccactctcagctctgccacttctttgctgggtgaccttgagtaagttacttaacctctctgcgcctcaggttcctcatctgttaaatcattgccctccttgaagagttactgtgaagatttaatgagagaatgaagatacagcacagtgctgggtcgatatgaagtacacaataaaaaccggaaattggggtggttggtggtagtgttgttgatatttttactgctatatttgtaaaataaggggcctaggctcatttatttgtcagattcaagaatccatga

SEQ ID NO: 50299 - DNA, 601 bp, Human
ctgtacctggctttgcctgccagcctcaggagtctacacaaaattccatgggcactggggagccattggagggttttagcacggaattgatagctctaatttgtggttaagaatgttcttcataggtgcagtgtgaaggacatttcagggattagactagaggatgctaggcctgttaggaagctcctgcaattggtatgagatgatgagtctgatcaaaattgttatgagttgctccagaagcattgatgttacggctagtactaactatagcctaaactgcaaacaactgaataaaagkctacatggttaaagcaaaggaagcttaagaaagagccaagagttctggatttaacacttgcttgcatcactgagtctttctgtggccttgggtgatcttaagcaatctgtgtgcctctctggaagtgctgtcaatgttaaaggtagttggaattggcttttttccactctcagctctgccacttctttgctgggtgaccttgagtaagttacttaacctctctgcgcctcaggttcctcatctgttaaatcattgccctccttgaagagttactgtgaagatttaatgagagaatgaaga

SEQ ID NO: 50300 - DNA, 601 bp, Human
agacgcagtgggttgaaaggtggcccagtagaaggttggaggctgcctgtacctggctttgcctgccagcctcaggagtctacacaaaattccatgggcactggggagccattggagggttttagcacggaattgatagctctaatttgtggttaagaatgttcttcataggtgcagtgtgaaggacatttcagggattagactagaggatgctaggcctgttaggaagctcctgcaattggtatgagatgatgagtctgatcaaaattgttatgagttgctccagaagcattgatgttayggctagtactaactatagcctaaactgcaaacaactgaataaaaggctacatggttaaagcaaaggaagcttaagaaagagccaagagttctggatttaacacttgcttgcatcactgagtctttctgtggccttgggtgatcttaagcaatctgtgtgcctctctggaagtgctgtcaatgttaaaggtagttggaattggcttttttccactctcagctctgccacttctttgctgggtgaccttgagtaagttacttaacctctctgcgcctcaggttcctcatctgttaaatcatt

SEQ ID NO: 50301 - DNA, 601 bp, Human
catggaataaaaatgccatgacaataggaagccaagaaaggctgtggaatccaagtcaagcaagcaagaagggcagacggagtgggctcagttacaggacgacaggcagagttaacagaattcttgaaggtgcagaaaccggagaccacaggttgccacacaggaggtataaaagacgcagtgggttgaaaggtggcccagtagaaggttggaggctgcctgtacctggctttgcctgccagcctcaggagtctacacaaaattccatgggcactggggagccattggagggttttagcayggaattgatagctctaatttgtggttaagaatgttcttcataggtgcagtgtgaaggacatttcagggattagactagaggatgctaggcctgttaggaagctcctgcaattggtatgagatgatgagtctgatcaaaattgttatgagttgctccagaagcattgatgttacggctagtactaactatagcctaaactgcaaacaactgaataaaaggctacatggttaaagcaaaggaagcttaagaaagagccaagagttctggatttaacacttgcttgcatcactgagtctttct

SEQ ID NO: 50302 - DNA, 601 bp, Human
attgcactgtgacctgaggcttcaagaaggaggagagatttaggccaagtcatgaaggcttggagatataaacctttacctagagctttccttttatgtgttgggagaactcgatcctgtttgaagaaaacaatctgcaataaaaatttgctttaagatcactgtggtaggtaacctctaggcctgctttgggacatctcactcattcctatcttacttgggattccttgttttactttttcattcagccaacagccacgaggcacattcttgtatctttctatctgactttacaggtctkcttcctcactaccaggggcccagcttcccatcctttcttctagatacaaattctgctgtttcttgccttcaaggagttcaagatctagtggagacagtagtcaagtaaacatacaattataacatggaataaaaatgccatgacaataggaagccaagaaaggctgtggaatccaagtcaagcaagcaagaagggcagacggagtgggctcagttacaggacgacaggcagagttaacagaattcttgaaggtgcagaaaccggagaccacaggttgccacacaggaggtataaaagacg

SEQ ID NO: 50303 - DNA, 601 bp, Human
caaggggccctcccaagctcacaccattggcatgcgatgtcaccaggactcagccccagtgagcagggatccagagtccatctcttaaccattacttttttccaactctaagtgtagaaaatataaagatgatgatatcaatacctctgttttaggggagaagaggagacatggaatgaagattggttgactgctaagtatgtatcagacatttggatatctcatctcattcaacccttgtagccatcctgagaagtttcattcacaacagagaagtctggagtggagaaacacatcccayagccatgccaaagatggtagaactgcagggcctgctagacctcacagtgctctcctcttcctggacatactgccaggccaccttacccagttccttgcatctaggtggggccatatgactacttctcaagcaaggagtgtaagtacaagggacatgtgtgacctccaccaagacgctgagaatgtgtttgcctgctccacgcttgctcctgtcagctggccagccacagaggatctagcagaggactccaaagtcctagagaatggtggaaccacttcacttaaggaacctgggtccctg

SEQ ID NO: 50304 - DNA, 601 bp, Human
gaaaggccttgttaccacaaggctgaagccagtgatgaagtttgctcagagaattcactgcactaacattccccaagcttgagatttgtgaacctcacctatggcaaaacatgactggtcatgcatgatacagaatgggtgcttaaataagaattcgttttgagtttctgctgtgtggcagtaaccatataataataaaacaggtaacccacacatcatagttacaatatgctctgtactattctaagaactggaggcatactgactcacttcttaccctccacaagggtactatttgttwcctctgttttgggcagatgtggtatctgagccacagagccacaaggggccctcccaagctcacaccattggcatgcgatgtcaccaggactcagccccagtgagcagggatccagagtccatctcttaaccattacttttttccaactctaagtgtagaaaatataaagatgatgatatcaatacctctgttttaggggagaagaggagacatggaatgaagattggttgactgctaagtatgtatcagacatttggatatctcatctcattcaacccttgtagccatcctgagaagttt

SEQ ID NO: 50305 - DNA, 601 bp, Human
gcatagcctaggccccctgcaggaacacttttctcaaaagttccccgaaagctgtttgccccaatgcttttggcaactgaacgtttgtcttccaggtctgaattcagcaatagcccaggtgaaaggccttgttaccacaaggctgaagccagtgatgaagtttgctcagagaattcactgcactaacattccccaagcttgagatttgtgaacctcacctatggcaaaacatgactggtcatgcatgatacagaatgggtgcttaaataagaattcgttttgagtttctgctgtgtggcartaaccatataataataaaacaggtaacccacacatcatagttacaatatgctctgtactattctaagaactggaggcatactgactcacttcttaccctccacaagggtactatttgttacctctgttttgggcagatgtggtatctgagccacagagccacaaggggccctcccaagctcacaccattggcatgcgatgtcaccaggactcagccccagtgagcagggatccagagtccatctcttaaccattacttttttccaactctaagtgtagaaaatataaagatgatgatatc

SEQ ID NO: 50306 - DNA, 601 bp, Human
tggtgaatacagcagcaaccacccccaaggagcacagagtctagtgggagaaacagtgatgattgctaagcgcaaggattagaggggccacagcaagacagggggtagaggctgccccaggaactactgcaagtatgtacagagtaaagacccttcagagaagctggcataagtaatgagtatccaggacttcacagacacccctcctgccacctgataaacaggagacctccacatgtgcaaggtcactcttgcacgtgaacttgctccctatggcactcttatagtaattcaagcaatygcagctgtcttgcaaggagtcaggctaatacccaccctggaaggcctcagtaatgactggcttcctggaattaatgtaaggaaatgaaaaggatgctgattgggaggaaattttgtcttttcctttgtgttgcactgcattcaggagcctggtgggaaaagagagggttttcagctcacccactaccaagcattgctttgggagtctgtggaagtttcttactgtgacgttgggaaatggctgacagaagcctctatagactctggaggggccagaagacttgctgcatagcctaggccc

SEQ ID NO: 50307 - DNA, 601 bp, Human
gatactccgtcagaccgtggtgaatacagcagcaaccacccccaaggagcacagagtctagtgggagaaacagtgatgattgctaagcgcaaggattagaggggccacagcaagacagggggtagaggctgccccaggaactactgcaagtatgtacagagtaaagacccttcagagaagctggcataagtaatgagtatccaggacttcacagacacccctcctgccacctgataaacaggagacctccacatgtgcaaggtcactcttgcacgtgaacttgctccctatggcactcttrtagtaattcaagcaattgcagctgtcttgcaaggagtcaggctaatacccaccctggaaggcctcagtaatgactggcttcctggaattaatgtaaggaaatgaaaaggatgctgattgggaggaaattttgtcttttcctttgtgttgcactgcattcaggagcctggtgggaaaagagagggttttcagctcacccactaccaagcattgctttgggagtctgtggaagtttcttactgtgacgttgggaaatggctgacagaagcctctatagactctggaggggccagaagacttg

SEQ ID NO: 50308 - DNA, 601 bp, Human
atatcaactaagcctttgcttgggctggatactccgtcagaccgtggtgaatacagcagcaaccacccccaaggagcacagagtctagtgggagaaacagtgatgattgctaagcgcaaggattagaggggccacagcaagacagggggtagaggctgccccaggaactactgcaagtatgtacagagtaaagacccttcagagaagctggcataagtaatgagtatccaggacttcacagacacccctcctgccacctgataaacaggagacctccacatgtgcaaggtcactcttgcaygtgaacttgctccctatggcactcttatagtaattcaagcaattgcagctgtcttgcaaggagtcaggctaatacccaccctggaaggcctcagtaatgactggcttcctggaattaatgtaaggaaatgaaaaggatgctgattgggaggaaattttgtcttttcctttgtgttgcactgcattcaggagcctggtgggaaaagagagggttttcagctcacccactaccaagcattgctttgggagtctgtggaagtttcttactgtgacgttgggaaatggctgacagaagcctcta

SEQ ID NO: 50309 - DNA, 601 bp, Human
actccagcctgggggactgagcgagactccatctaaaacaaaaaaaagagtaaatatcaactatatcaactaagcctttgcttgggctggatactccgtcagaccgtggtgaatacagcagcaaccacccccaaggagcacagagtctagtgggagaaacagtgatgattgctaagcgcaaggattagaggggccacagcaagacagggggtagaggctgccccaggaactactgcaagtatgtacagagtaaagacccttcagagaagctggcataagtaatgagtatccaggacttcasagacacccctcctgccacctgataaacaggagacctccacatgtgcaaggtcactcttgcacgtgaacttgctccctatggcactcttatagtaattcaagcaattgcagctgtcttgcaaggagtcaggctaatacccaccctggaaggcctcagtaatgactggcttcctggaattaatgtaaggaaatgaaaaggatgctgattgggaggaaattttgtcttttcctttgtgttgcactgcattcaggagcctggtgggaaaagagagggttttcagctcacccactaccaagcatt

SEQ ID NO: 50310 - DNA, 601 bp, Human
aaatattggctgggtgcagtggctcatgcctgtaattccaacactttgggaggccaaggcaggcagatcacctgaggttaggagtttgagactagcctggccaacatggtgaaaccccatctctactaaaaatagaaaaattagctgggtgtggtggtgcacgcctctagtcccagctactctggaggctgaggctggggaatatcttgaaccctggaggcagaggttgcagggagccaagattgcgccactgcactccagcctgggggactgagcgagactccatctaaaacaaaaaaaagagtaaatatcaactatatcaactaagcctttgcttgggctggatactccgtcagaccgtggtgaatacagcagcaaccacccccaaggagcacagagtctagtgggagaaacagtgatgattgctaagcgcaaggattagaggggccacagcaagacagggggtagaggctgccccaggaactactgcaagtatgtacagagtaaagacccttcagagaagctggcataagtaatgagtatccaggacttcacagacacccctcctgccacctgataaacaggagacctccacatgtgc

SEQ ID NO: 50311 - DNA, 601 bp, Human
cacaaatacaactgctccacaaactgaactcttgaacttatgattaagatgtgaaagttaagcagataaacctaatggtgcatttattgatttaagagtaaatattggctgggtgcagtggctcatgcctgtaattccaacactttgggaggccaaggcaggcagatcacctgaggttaggagtttgagactagcctggccaacatggtgaaaccccatctctactaaaaatagaaaaattagctgggtgtggtggtgcacgcctctagtcccagctactctggaggctgaggctggggartatcttgaaccctggaggcagaggttgcagggagccaagattgcgccactgcactccagcctgggggactgagcgagactccatctaaaacaaaaaaaagagtaaatatcaactatatcaactaagcctttgcttgggctggatactccgtcagaccgtggtgaatacagcagcaaccacccccaaggagcacagagtctagtgggagaaacagtgatgattgctaagcgcaaggattagaggggccacagcaagacagggggtagaggctgccccaggaactactgcaagtatgtacag

SEQ ID NO: 50312 - DNA, 601 bp, Human
gcagcagcaggggagctgcaatgtcctgtgccagcggtgcagtcaatggcagtggtggctgcagcggagcccataggaccagctctgggagtgatttagggtagtatctccagctacagagcttccaggcctggctctccagccctcccactgatcctgtgagcaacccactcttttcaacaacttttttggctttagttgttccttacaactatggaaatacagaaactctagcaaagcacataaataatctcacttcaccctcacgacaaccctagtggtaaaagccctcatttacaarcaaggggcctgagagttatataacctgcccacagtcacggcttatatgcactgggaggcttttgtggtggagctgccaaacttcagggcacaaatacaactgctccacaaactgaactcttgaacttatgattaagatgtgaaagttaagcagataaacctaatggtgcatttattgatttaagagtaaatattggctgggtgcagtggctcatgcctgtaattccaacactttgggaggccaaggcaggcagatcacctgaggttaggagtttgagactagcctggccaacatggtgaa

SEQ ID NO: 50313 - DNA, 601 bp, Human
acttctgacctctagaactatggaataacacatttcagttctttcagtcactcagtccgtggtactttgttacagcagctctagaaaagtaatatattgcctagcttccaaaaggcttctcaccacttccaccattccaccactcaaccggtccaaactgccatcccctcactggggctaccaggacactgattcctgagccttcatcagggtgctaccagcagccttcagaatggccactatgttctttcttagtggctggacatttacctgacattgaccatttagtcaatgtcaaggstttatgtcctctattggacatttatctgccttttaggctccccagcatcagaagccctcttcccgcctgggagactttcctgcctcagaatcctgagtggggaaacaaaggacacataactacagaagccaaacatgccagacacccgctctcccagcatcctctgcagctggaagtggacatgtgaccaaggctcagccaatcagatgctggaactttgatcaaggtgttactggggctaagacatggggctgaggaggattctccagcagcagagggagctctggtgggattgggttt

SEQ ID NO: 50314 - DNA, 601 bp, Human
agtactgggccctgagctagacacagagataaatggaacataaccctggatctcaaagatcttccatccactggagctgataatgcattgtatcatttaaggatgctcttggctgcaagtaacaggaaacctcaactcaaaatagctgaacaatgaggacacctacagaaatgcaaatttacaggagtggtgagcttcaaggatggcccatctggtgactcagtaatggccaagaatccaggtgccatctggttgcttcactctgctttccataattttgacctcatcctaagacagcatrcactcacaattgcaggatggctcctagtagcagttttggctacatgcttttctattcatgcatgactggagagagtaagcttggcctctcataggtctcttggtgctaagaggaactttcccggaagcttctaacaaacttctctttatgtcctgctggacatagttggggcacagatcccttactaaaccagtgtggaatgggacccatcagcctgtacctctgcccctgaattcctttcctttatctgttcctccctacgtgagtgaatgggaccaccattctccagttgctcagcca

SEQ ID NO: 50315 - DNA, 601 bp, Human
cttcctgggtgattggctccaggtttgagaacagatggtgttgcagaaagtgaaagaagatcacagaaaactcccagatttcagacataagcaaacggtctgatggaaggaaatgaggtgaggaggggagacaccctctgcttgcgaggtatttatcttctttctgttttctctttctttctggattcacaactatcttactcatagcacggagtgaggatagaatatattatcaatagctacagctatttctatcgatgatgaagtttccagacctcagtgcacaagatactgatctacrtcatccactgactcattcaacaaacatgtgctgagtactgggccctgagctagacacagagataaatggaacataaccctggatctcaaagatcttccatccactggagctgataatgcattgtatcatttaaggatgctcttggctgcaagtaacaggaaacctcaactcaaaatagctgaacaatgaggacacctacagaaatgcaaatttacaggagtggtgagcttcaaggatggcccatctggtgactcagtaatggccaagaatccaggtgccatctggttgcttcactctgct

SEQ ID NO: 50316 - DNA, 601 bp, Human
atatattttgagagtagaataggtaggacttcctgggtgattggctccaggtttgagaacagatggtgttgcagaaagtgaaagaagatcacagaaaactcccagatttcagacataagcaaacggtctgatggaaggaaatgaggtgaggaggggagacaccctctgcttgcgaggtatttatcttctttctgttttctctttctttctggattcacaactatcttactcatagcacggagtgaggatagaatatattatcaatagctacagctatttctatcgatgatgaagtttccakacctcagtgcacaagatactgatctacgtcatccactgactcattcaacaaacatgtgctgagtactgggccctgagctagacacagagataaatggaacataaccctggatctcaaagatcttccatccactggagctgataatgcattgtatcatttaaggatgctcttggctgcaagtaacaggaaacctcaactcaaaatagctgaacaatgaggacacctacagaaatgcaaatttacaggagtggtgagcttcaaggatggcccatctggtgactcagtaatggccaagaatcc

SEQ ID NO: 50317 - DNA, 601 bp, Human
gcaatggaaatggacagaagtggatggatttaagatatattttgagagtagaataggtaggacttcctgggtgattggctccaggtttgagaacagatggtgttgcagaaagtgaaagaagatcacagaaaactcccagatttcagacataagcaaacggtctgatggaaggaaatgaggtgaggaggggagacaccctctgcttgcgaggtatttatcttctttctgttttctctttctttctggattcacaactatcttactcatagcacggagtgaggatagaatatattatcaatarctacagctatttctatcgatgatgaagtttccagacctcagtgcacaagatactgatctacgtcatccactgactcattcaacaaacatgtgctgagtactgggccctgagctagacacagagataaatggaacataaccctggatctcaaagatcttccatccactggagctgataatgcattgtatcatttaaggatgctcttggctgcaagtaacaggaaacctcaactcaaaatagctgaacaatgaggacacctacagaaatgcaaatttacaggagtggtgagcttcaaggatg

SEQ ID NO: 50318 - DNA, 601 bp, Human
ctaagcaatggaaatggacagaagtggatggatttaagatatattttgagagtagaataggtaggacttcctgggtgattggctccaggtttgagaacagatggtgttgcagaaagtgaaagaagatcacagaaaactcccagatttcagacataagcaaacggtctgatggaaggaaatgaggtgaggaggggagacaccctctgcttgcgaggtatttatcttctttctgttttctctttctttctggattcacaactatcttactcatagcacggagtgaggatagaatatattatcmatagctacagctatttctatcgatgatgaagtttccagacctcagtgcacaagatactgatctacgtcatccactgactcattcaacaaacatgtgctgagtactgggccctgagctagacacagagataaatggaacataaccctggatctcaaagatcttccatccactggagctgataatgcattgtatcatttaaggatgctcttggctgcaagtaacaggaaacctcaactcaaaatagctgaacaatgaggacacctacagaaatgcaaatttacaggagtggtgagcttcaag

SEQ ID NO: 50319 - DNA, 601 bp, Human
ggagggtttttggcagggggaggacatggtgtggcttgcattttcagaggatccctctggcaagtggatgaaagaggagctagacaggaagccaggcacacttggggggcactgcagtggtccaaagatcatggtggacttcactaagcaatggaaatggacagaagtggatggatttaagatatattttgagagtagaataggtaggacttcctgggtgattggctccaggtttgagaacagatggtgttgcagaaagtgaaagaagatcacagaaaactcccagatttcagacataagyaaacggtctgatggaaggaaatgaggtgaggaggggagacaccctctgcttgcgaggtatttatcttctttctgttttctctttctttctggattcacaactatcttactcatagcacggagtgaggatagaatatattatcaatagctacagctatttctatcgatgatgaagtttccagacctcagtgcacaagatactgatctacgtcatccactgactcattcaacaaacatgtgctgagtactgggccctgagctagacacagagataaatggaacataaccctggatctcaaag

SEQ ID NO: 50320 - DNA, 601 bp, Human
tctcgggggatgacagaagaaataactggggagggacacttggtaggtccttcttttttttttttttcaggctggagtgcagtggcatgatcacagctcactgcagatttgatcccctggggtcaggaggtcctggtacttcagcctcccgagtagctgagacagacgactacaggtatgtgccactatgcctggataaattttttttgtttgtttcttgtacaaaggaggtctcgccatgttccccaaggctggtctcaaactcctgggctcatgcgatcctcccgctgcagcctccccrgaccttttattcttaacctggattgtgacatgagtgttagatttatactcagtctttaaagtgtgtgtgtgtgtgtacgggcacacaagcataatgcatatgtgtgtattttatatactcttttgtatgcataatacatgctgccatttaacatggaaaagaaaaatggtaggaaagtgttccaggcagagggagaattatgccaagacagcaggacagaagaaagcttgggtggccatggaattgcaaggaggccaataggggaggaacaggaccagaaagggaaggagtgggctggat

SEQ ID NO: 50321 - DNA, 601 bp, Human
atcatcatatgaaacatcacagccacaaacatgaatgaatacagctctgtccaaacacacatgggaaaacctggcaaaaataacaccgaccaaaagcagccaaaaacaaaacatacacagtctgattccatgtgtaaaacccaaaagtatgccaaattaaaattttttggagaattatatatagacggtaaaactacaaagaaagaattatttcaaatgtcaggtcaggggtcatctcgggggatgacagaagaaataactggggagggacacttggtaggtccttcttttttttttttttcaggctggagtgcagtggcatgatcacagctcactgcagatttgatcccctggggtcaggaggtcctggtacttcagcctcccgagtagctgagacagacgactacaggtatgtgccactatgcctggataaattttttttgtttgtttcttgtacaaaggaggtctcgccatgttccccaaggctggtctcaaactcctgggctcatgcgatcctcccgctgcagcctccccggaccttttattcttaacctggattgtgacatgagtgttagatttatactcagtctttaaagtgtgt

SEQ ID NO: 50322 - DNA, 601 bp, Human
tttggcatcagctagtcaaatggaagatgcctgtagcctacaactcagcaaatctacttctagaaaactcccctgaaaaactgtttctggggagccctaggatatatgtactcagatgtccatggcagcattgcacataataactccagacgagaaacagcccaggtgcccatggtcgatagcaggaataaacaaattgcagaatcatcatcatatgaaacatcacagccacaaacatgaatgaatacagctctgtccaaacacacatgggaaaacctggcaaaaataacaccgaccaaargcagccaaaaacaaaacatacacagtctgattccatgtgtaaaacccaaaagtatgccaaattaaaattttttggagaattatatatagacggtaaaactacaaagaaagaattatttcaaatgtcaggtcaggggtcatctcgggggatgacagaagaaataactggggagggacacttggtaggtccttcttttttttttttttcaggctggagtgcagtggcatgatcacagctcactgcagatttgatcccctggggtcaggaggtcctggtacttcagcctcccgagtagctgag

SEQ ID NO: 50323 - DNA, 601 bp, Human
aaacagctttggcatcagctagtcaaatggaagatgcctgtagcctacaactcagcaaatctacttctagaaaactcccctgaaaaactgtttctggggagccctaggatatatgtactcagatgtccatggcagcattgcacataataactccagacgagaaacagcccaggtgcccatggtcgatagcaggaataaacaaattgcagaatcatcatcatatgaaacatcacagccacaaacatgaatgaatacagctctgtccaaacacacatgggaaaacctggcaaaaataacaccraccaaaagcagccaaaaacaaaacatacacagtctgattccatgtgtaaaacccaaaagtatgccaaattaaaattttttggagaattatatatagacggtaaaactacaaagaaagaattatttcaaatgtcaggtcaggggtcatctcgggggatgacagaagaaataactggggagggacacttggtaggtccttcttttttttttttttcaggctggagtgcagtggcatgatcacagctcactgcagatttgatcccctggggtcaggaggtcctggtacttcagcctcccgagt

SEQ ID NO: 50324 - DNA, 601 bp, Human
aggcaaatgatacaattaaaaatgagcaaaaatttgaacagactccagagaaaatacaaatgactggtatgctaatgacagaatgcctgacatcattagtcaacagagaaatgagaccacaaggaaatacaacttcacattcactagagtctcatcgctgccaattctgattcagtgtgtttgggacagggactaggtgattctgatgtacaccaaagactgaggtccatggcactaagctccaaacagagttcagtccccaaggtacttagagttccctgttgctacccaacgtgagccygcaaacctcagctgagccagtatatgacactgcagaaaaagcttaggttcaggtcgctcagacctgggctcaaatcccagcacaacaacttggtaatgatttaaatcagctgaaccttggttttcttatctgcaaaatgggaatgatgacattgacctctcagggctgttgtgagggtcaaatgagagcttgaagcagtggccagtacttgaatggagcttacacaatcccacatagactaaaaattaaaagatctggtaagactgaggagtgacaagcagtgtgttgtctgctggtagg

SEQ ID NO: 50325 - DNA, 601 bp, Human
tcttggacccaggagacggaggttgcagtgagccaagattgcgccattgcactccagcctgggtgacagagtgacaccctgtctcaaaagaaaagtgggggggcacatacctaacaaaaaaaaaataggcaaaaatgcaacacacacaaaaaaactagccataaaagaaaaaaaaatgctcatttgaatataatcaagattaacatcttctgctcttccaaagacgtcattcagaaatgaaaagacaacccatagactgagataacatatttgcaacacatagaactacaaataaatcctrtctacgatatacaaagaactctaacatgtcaaaaaggaggcaaatgatacaattaaaaatgagcaaaaatttgaacagactccagagaaaatacaaatgactggtatgctaatgacagaatgcctgacatcattagtcaacagagaaatgagaccacaaggaaatacaacttcacattcactagagtctcatcgctgccaattctgattcagtgtgtttgggacagggactaggtgattctgatgtacaccaaagactgaggtccatggcactaagctccaaacagagttcagtccccaa

SEQ ID NO: 50326 - DNA, 601 bp, Human
aggagttcgagatcagtctggccaagatggtgaaaccctgtctctactaaaaatacaaaaatttgccaggtgtggtggcatgcacctgtaatcccagctactcaggaggctgaggcatgagaatctcttggacccaggagacggaggttgcagtgagccaagattgcgccattgcactccagcctgggtgacagagtgacaccctgtctcaaaagaaaagtgggggggcacatacctaacaaaaaaaaaataggcaaaaatgcaacacacacaaaaaaactagccataaaagaaaaaaaaatgctcatttgaatataatcaagattaacatcttctgctcttccaaagacgtcattcagaaatgaaaagacaacccatagactgagataacatatttgcaacacatagaactacaaataaatcctgtctacgatatacaaagaactctaacatgtcaaaaaggaggcaaatgatacaattaaaaatgagcaaaaatttgaacagactccagagaaaatacaaatgactggtatgctaatgacagaatgcctgacatcattagtcaacagagaaatgagaccacaaggaaatacaacttcac

SEQ ID NO: 50327 - DNA, 601 bp, Human
tgggtcacttgaggccaggagttcgagatcagtctggccaagatggtgaaaccctgtctctactaaaaatacaaaaatttgccaggtgtggtggcatgcacctgtaatcccagctactcaggaggctgaggcatgagaatctcttggacccaggagacggaggttgcagtgagccaagattgcgccattgcactccagcctgggtgacagagtgacaccctgtctcaaaagaaaagtgggggggcacatacctaacaaaaaaaaaataggcaaaaatgcaacacacacaaaaaaactagcyataaaagaaaaaaaaatgctcatttgaatataatcaagattaacatcttctgctcttccaaagacgtcattcagaaatgaaaagacaacccatagactgagataacatatttgcaacacatagaactacaaataaatcctgtctacgatatacaaagaactctaacatgtcaaaaaggaggcaaatgatacaattaaaaatgagcaaaaatttgaacagactccagagaaaatacaaatgactggtatgctaatgacagaatgcctgacatcattagtcaacagagaaatgagaccacaa

SEQ ID NO: 50328 - DNA, 601 bp, Human
gggcgcagaggcccacacctgtaatcccagcactctgggaggctgagatgggtgggtcacttgaggccaggagttcgagatcagtctggccaagatggtgaaaccctgtctctactaaaaatacaaaaatttgccaggtgtggtggcatgcacctgtaatcccagctactcaggaggctgaggcatgagaatctcttggacccaggagacggaggttgcagtgagccaagattgcgccattgcactccagcctgggtgacagagtgacaccctgtctcaaaagaaaagtgggggggcacawacctaacaaaaaaaaaataggcaaaaatgcaacacacacaaaaaaactagccataaaagaaaaaaaaatgctcatttgaatataatcaagattaacatcttctgctcttccaaagacgtcattcagaaatgaaaagacaacccatagactgagataacatatttgcaacacatagaactacaaataaatcctgtctacgatatacaaagaactctaacatgtcaaaaaggaggcaaatgatacaattaaaaatgagcaaaaatttgaacagactccagagaaaatacaaatgactggtat

SEQ ID NO: 50329 - DNA, 601 bp, Human
acataccgggtgggcgcagaggcccacacctgtaatcccagcactctgggaggctgagatgggtgggtcacttgaggccaggagttcgagatcagtctggccaagatggtgaaaccctgtctctactaaaaatacaaaaatttgccaggtgtggtggcatgcacctgtaatcccagctactcaggaggctgaggcatgagaatctcttggacccaggagacggaggttgcagtgagccaagattgcgccattgcactccagcctgggtgacagagtgacaccctgtctcaaaagaaaagtkggggggcacatacctaacaaaaaaaaaataggcaaaaatgcaacacacacaaaaaaactagccataaaagaaaaaaaaatgctcatttgaatataatcaagattaacatcttctgctcttccaaagacgtcattcagaaatgaaaagacaacccatagactgagataacatatttgcaacacatagaactacaaataaatcctgtctacgatatacaaagaactctaacatgtcaaaaaggaggcaaatgatacaattaaaaatgagcaaaaatttgaacagactccagagaaaatacaa

SEQ ID NO: 50330 - DNA, 601 bp, Human
agtgctaaacctgggagctggactcagatctgaccccaagcttatgatgagcttcatagctgggcttctccaattctagtgcaccgcagcattgctgtggaggtgtgttaaagggcacataccgggtgggcgcagaggcccacacctgtaatcccagcactctgggaggctgagatgggtgggtcacttgaggccaggagttcgagatcagtctggccaagatggtgaaaccctgtctctactaaaaatacaaaaatttgccaggtgtggtggcatgcacctgtaatcccagctactcagraggctgaggcatgagaatctcttggacccaggagacggaggttgcagtgagccaagattgcgccattgcactccagcctgggtgacagagtgacaccctgtctcaaaagaaaagtgggggggcacatacctaacaaaaaaaaaataggcaaaaatgcaacacacacaaaaaaactagccataaaagaaaaaaaaatgctcatttgaatataatcaagattaacatcttctgctcttccaaagacgtcattcagaaatgaaaagacaacccatagactgagataacatatttgcaacacat

SEQ ID NO: 50331 - DNA, 601 bp, Human
tatattcaaatgagcattttttttcttttatggctagtttttttgtgtttcttgcatctttgcctatcccaaggtactttttttgtaacaaaatgtttcctctttttacctcattttggagatagggaaactgaggctcagggagacaaagtgacttgctaggtaagtgctaaacctgggagctggactcagatctgaccccaagcttatgatgagcttcatagctgggcttctccaattctagtgcaccgcagcattgctgtggaggtgtgttaaagggcacataccgggtgggcgcagrggcccacacctgtaatcccagcactctgggaggctgagatgggtgggtcacttgaggccaggagttcgagatcagtctggccaagatggtgaaaccctgtctctactaaaaatacaaaaatttgccaggtgtggtggcatgcacctgtaatcccagctactcaggaggctgaggcatgagaatctcttggacccaggagacggaggttgcagtgagccaagattgcgccattgcactccagcctgggtgacagagtgacaccctgtctcaaaagaaaagtgggggggcacatacctaaca

SEQ ID NO: 50332 - DNA, 601 bp, Human
gctccctcccccccatgtgggtgctgtggctctgacacagcccagtccctatacgcttctgctgctgctcatcagcctgcagtccatggcttcagttatctttggaccttggtctctgatttcttcccctttcccctttgggcatttgaatctctccagttgaactgcctgagtggagttctgttgcctgtcaggaccctgacaatgacacagatatattatgaacatggagggcacccccagatagagacagcctcctactgacctcccaagaacctttccaatcatcttcacaattaaygtccccacaagtccaccgatggcgaatatggacacagtcacagaccagagcagagtcagagtgtctgggtctattggacgtccatgccttctttcccatgactcattgtaaaaggccttgatgtactgaaaataaacaacaaaccatgttatttccttctgttctctcctgctgcttgaagcaagccagtgtacaaaacaaaacagcttgtacagagcattttcatgcatagcactttgctaatttgtttgagctttatctcattggcctcttctaacaaattttgggaagagcagaaga

SEQ ID NO: 50333 - DNA, 601 bp, Human
cttacgtggaacaatttccaaggcactgcactgtgttttccatttgccccaacacccagatcaattcccctcccctccctgctctgctctatgccccgggagcatctcctggatggcaacatgacttcctggtttactggctttcacatgggtgtgaccagtgtgcacctctgcagcaggatggagggtgggaggagggaggggtcagggcatttcttccctgctccctcccccccatgtgggtgctgtggctctgacacagcccagtccctatacgcttctgctgctgctcatcagcctgcagtccatggcttcagttatctttggaccttggtctctgatttcttcccctttcccctttgggcatttgaatctctccagttgaactgcctgagtggagttctgttgcctgtcaggaccctgacaatgacacagatatattatgaacatggagggcacccccagatagagacagcctcctactgacctcccaagaacctttccaatcatcttcacaattaacgtccccacaagtccaccgatggcgaatatggacacagtcacagaccagagcagagtcagagtgtctgggtctattgga

SEQ ID NO: 50334 - DNA, 601 bp, Human
ttagtcgagtacttactaggtagtgatgtcaaggtgatgatgagggaaatgccaaataatgtggtcaatgacaagaatttttatttattcagctacaactcatggccattctccttccattcatttggtctaactcttgtaacattccctgcaggtagaaactatcatccctattttacagataagaaaattgaggctcaaataaattaaatgatttggccaagggcacacagctagtaagtggaagacacatgattcaagttaagacacgaatgttctggccccatcagattgatgtgaygactcctccatcacttggagaagctctactctttccacacactgctcactggctcccaggatgctgttgttatgaacaagaatacagagaaagcattgtttgtggggattcattgataagtcaatctgctctgagagaaggattcctgtctaaaataagtgaggaatgaggctcacaaggtcaagtgagatgattggagagggcctgggtaggaaaggctgatatgaagtttttgattctcactgcttccttatttgtaatgtaaacgatctgaaatgacccaaatgtctctcagtcagg

SEQ ID NO: 50335 - DNA, 601 bp, Human
tggatgttttcagggtggcttcctgtcccatcttttagaaatcttgctttgaaacatcgtcaactctagttttctccttgttgggctgtgaggaagaatgtaaaggattcggtcatttcagattgtgaaatgggctccttcttaatcgggtttctgtaatcccatggtctgaggagattttctggagtctgataaatctcctcttcaactcacgtcaatgcaataaggaggttagtcgagtacttactaggtagtgatgtcaaggtgatgatgagggaaatgccaaataatgtggtcaatracaagaatttttatttattcagctacaactcatggccattctccttccattcatttggtctaactcttgtaacattccctgcaggtagaaactatcatccctattttacagataagaaaattgaggctcaaataaattaaatgatttggccaagggcacacagctagtaagtggaagacacatgattcaagttaagacacgaatgttctggccccatcagattgatgtgacgactcctccatcacttggagaagctctactctttccacacactgctcactggctcccaggatgctgttg

SEQ ID NO: 50336 - DNA, 601 bp, Human
tactgctctgaaagtgggcttggggacaaggaaaatgtcagcacctcccctacctcacaggtatcacagaccctcataagcaccacttggatgttttcagggtggcttcctgtcccatcttttagaaatcttgctttgaaacatcgtcaactctagttttctccttgttgggctgtgaggaagaatgtaaaggattcggtcatttcagattgtgaaatgggctccttcttaatcgggtttctgtaatcccatggtctgaggagattttctggagtctgataaatctcctcttcaactcacrtcaatgcaataaggaggttagtcgagtacttactaggtagtgatgtcaaggtgatgatgagggaaatgccaaataatgtggtcaatgacaagaatttttatttattcagctacaactcatggccattctccttccattcatttggtctaactcttgtaacattccctgcaggtagaaactatcatccctattttacagataagaaaattgaggctcaaataaattaaatgatttggccaagggcacacagctagtaagtggaagacacatgattcaagttaagacacgaatgttctggcc

SEQ ID NO: 50337 - DNA, 601 bp, Human
caagagaatgtgtgagtggctggaaccttgaaggacctcagacaatggcatctctcactacatcatgcagtagttgtacttccaggccctgaattcccattaattactgctctgaaagtgggcttggggacaaggaaaatgtcagcacctcccctacctcacaggtatcacagaccctcataagcaccacttggatgttttcagggtggcttcctgtcccatcttttagaaatcttgctttgaaacatcgtcaactctagttttctccttgttgggctgtgaggaagaatgtaaaggattmggtcatttcagattgtgaaatgggctccttcttaatcgggtttctgtaatcccatggtctgaggagattttctggagtctgataaatctcctcttcaactcacgtcaatgcaataaggaggttagtcgagtacttactaggtagtgatgtcaaggtgatgatgagggaaatgccaaataatgtggtcaatgacaagaatttttatttattcagctacaactcatggccattctccttccattcatttggtctaactcttgtaacattccctgcaggtagaaactatcatccctattttac

SEQ ID NO: 50338 - DNA, 601 bp, Human
catgattccagcctaagctcagccacagtgcaagctagctaagcttgtgcagatgccctcacctctctaacctcccattccccatctacagaccccacagcagatagaaaattaaacaagagaatgtgtgagtggctggaaccttgaaggacctcagacaatggcatctctcactacatcatgcagtagttgtacttccaggccctgaattcccattaattactgctctgaaagtgggcttggggacaaggaaaatgtcagcacctcccctacctcacaggtatcacagaccctcataagyaccacttggatgttttcagggtggcttcctgtcccatcttttagaaatcttgctttgaaacatcgtcaactctagttttctccttgttgggctgtgaggaagaatgtaaaggattcggtcatttcagattgtgaaatgggctccttcttaatcgggtttctgtaatcccatggtctgaggagattttctggagtctgataaatctcctcttcaactcacgtcaatgcaataaggaggttagtcgagtacttactaggtagtgatgtcaaggtgatgatgagggaaatgccaaataatgtg

SEQ ID NO: 50339 - DNA, 601 bp, Human
attctagtgttccttttcctattccatctgcatgggttcagagcctccttgaggagcagccttggggtataaatgccacggtcaggtataaagcaaggagacatcacaggccagatcctggggcatggggagtgactccatcccactaggacaagcaagaggaccatgggcagggtctggcttgggcaggaggcttagtgaccatgcctcagggaccctggccagtgatgccaatctgagtgccagcctgttgtcaaacagtcatggttttacagtacattcccagcattgggaattggcmcctaactaagatctgcttggcatagtggaaagatcatgattccagcctaagctcagccacagtgcaagctagctaagcttgtgcagatgccctcacctctctaacctcccattccccatctacagaccccacagcagatagaaaattaaacaagagaatgtgtgagtggctggaaccttgaaggacctcagacaatggcatctctcactacatcatgcagtagttgtacttccaggccctgaattcccattaattactgctctgaaagtgggcttggggacaaggaaaatgtcagcacct

SEQ ID NO: 50340 - DNA, 601 bp, Human
ccactgctggagcagccagtgaccagccccatcggaactcttccccacttccctggaatgtctcccccagctatacctttgagcaccttccactgggcctcccaggctgccattgcagtttcctctccctccctgagaatccccatgggagaggaataacagagcatcaggaaggcgtttcaaatagcatcatgtcacaggaagagtgttggcctgtggtcaaacacatgcagatctgaacttcagttcaactccattttgaaaccttggtccaattgcccactgggtcttggactcatcwtttgaaaagtgcaggtaatgatgcaaacatggagttttaagaagtaaatgatatatgggatgtcaaggacaaggcaggaggtcaatagatggtagctttctttttcaatttttgctccttttctccccagcagagttgctcttcaagctgaaacttcagcccaaatcaacttttactctcataatgatgaaaaggaaactggcagctgcttggggcataacaaccaacacatcctttgatctgatctttttctgcatcctcacttctttatgactcctccattacttagagattgaaggt

SEQ ID NO: 50341 - DNA, 601 bp, Human
aattgtagggatgaacacttcacatccaccatttcatttaatcttcacaacaaccctctgacatggccattctttatcttcatgtcatcgtgaactaagtaaagatgaaagagtttaagaaacacatagctgtgtgtatcggagcccagacttgaagctgggcccgtagctagtgtttgtacaccaaacatagtcactgtcctgtctcatgagggaaggagggtcctgtcactatggtcatgcaagcagaggacagaggatgctaaatgggtcactgagcttcaaccagaattcttgatcrctgagaattccctcagccagagactccaagaggtgaggaacctgcatctgtgtgaggcccaggtcatgtggtatggcccatctccagagactcttcctggccccctttgcttccctgccctcctttgtcaccgaaatcacaaacgagctcaacattccctagctaggaacagccccactgctggagcagccagtgaccagccccatcggaactcttccccacttccctggaatgtctcccccagctatacctttgagcaccttccactgggcctcccaggctgccattgcagtttcctct

SEQ ID NO: 50342 - DNA, 601 bp, Human
ctgtcaagtgatggaatgacccgtctcaaataaagccaatgaggttggtgatggtgaagatgatgatgatgttgatgatgatgacactagtgaacaaaggctgggcgaagagtctgggtcaattgtagggatgaacacttcacatccaccatttcatttaatcttcacaacaaccctctgacatggccattctttatcttcatgtcatcgtgaactaagtaaagatgaaagagtttaagaaacacatagctgtgtgtatcggagcccagacttgaagctgggcccgtagctagtgtttgtrcaccaaacatagtcactgtcctgtctcatgagggaaggagggtcctgtcactatggtcatgcaagcagaggacagaggatgctaaatgggtcactgagcttcaaccagaattcttgatcgctgagaattccctcagccagagactccaagaggtgaggaacctgcatctgtgtgaggcccaggtcatgtggtatggcccatctccagagactcttcctggccccctttgcttccctgccctcctttgtcaccgaaatcacaaacgagctcaacattccctagctaggaacagccccactg

SEQ ID NO: 50343 - DNA, 601 bp, Human
agatgcacaattgactctgtcaagtgatggaatgacccgtctcaaataaagccaatgaggttggtgatggtgaagatgatgatgatgttgatgatgatgacactagtgaacaaaggctgggcgaagagtctgggtcaattgtagggatgaacacttcacatccaccatttcatttaatcttcacaacaaccctctgacatggccattctttatcttcatgtcatcgtgaactaagtaaagatgaaagagtttaagaaacacatagctgtgtgtatcggagcccagacttgaagctgggccygtagctagtgtttgtacaccaaacatagtcactgtcctgtctcatgagggaaggagggtcctgtcactatggtcatgcaagcagaggacagaggatgctaaatgggtcactgagcttcaaccagaattcttgatcgctgagaattccctcagccagagactccaagaggtgaggaacctgcatctgtgtgaggcccaggtcatgtggtatggcccatctccagagactcttcctggccccctttgcttccctgccctcctttgtcaccgaaatcacaaacgagctcaacattccctagct

SEQ ID NO: 50344 - DNA, 601 bp, Human
ctggtgcaaaccatgtcctctctcacctgcgctattgcaaggttctcccaaccaggctctgagaccccctgataacagcacacctttccaaatgcaagtcagatcagttcttaaaacgttccactgacttcccattttgctcagaggaagagtctcaaccctcgcctgcaaagtcctcaggatctgactccaaatatcccatctagcttcctatgattatctctacactgacctccactctcatcttcaaagaagtggagcctcttcttgcccctgggcttttgcacctgctgcctcctcygcttggagagctatttcccagggatgagcgtgctcactcccttgcttccttcagtgctccctgcacaagtcaccattttagagaatcctctgaacaaagtggtgagctcttcaccctccccagcatcttctgacctccttgagctgctctgttttctacattggtccttgtcacaggccgaatggcacagtctgcatgcttgttacttggctgtgctccccgcttggctgcatgcttcaggaggacagggactttggcagctttgctcatgcctgagtgcttggcacatagaaagtactc

SEQ ID NO: 50345 - DNA, 601 bp, Human
tgacttgaaacatgtgcaaacgggagtgcacactctctgggcaagtttatcatattaatatattccttcccaaaataaccctcagcctgacagcattgcagtgaggatggaaatgtgtgcaaatcctttgcaaagctgactcaccgggcttcagagcaggactttaatcattgtttccatttgtttcctgtggatgaacagcaacataaacaagggagatcaattctgaaagcagaactccagtgtccccagaactccacctaggatgcctgattcattgtttttagcttctccaatagtstagaatcttccccatgaaacccagaaagtcatcagctctcaaggggaaaaaaagaccaaatacaaggaagcatggtagggtgatgaggagattggagggcatgtcccttcagaagtgtcaaaggggctggagacatttcgcctggacaagaggtcagagaaagcaggagagccaccttccttcatgccatgctttaacttggtgcagagcaccaggacggattgggggaagacatagggaattctatttcagtttgaatttggaaagtacttttcattaaaccctagtagaccagagaac

SEQ ID NO: 50346 - DNA, 601 bp, Human
gctgatggactggacagaggtggagaggcatagaggagccaaggatgcctccaaaagctttggtctgaacccttactttggacatgatggtgtattttgtgctaattttaaaactgcatgaaaggtttgtgagaatgttaaaattatatgaaagtctgacttgaaacatgtgcaaacgggagtgcacactctctgggcaagtttatcatattaatatattccttcccaaaataaccctcagcctgacagcattgcagtgaggatggaaatgtgtgcaaatcctttgcaaagctgactcacygggcttcagagcaggactttaatcattgtttccatttgtttcctgtggatgaacagcaacataaacaagggagatcaattctgaaagcagaactccagtgtccccagaactccacctaggatgcctgattcattgtttttagcttctccaatagtgtagaatcttccccatgaaacccagaaagtcatcagctctcaaggggaaaaaaagaccaaatacaaggaagcatggtagggtgatgaggagattggagggcatgtcccttcagaagtgtcaaaggggctggagacatttcgcctg

SEQ ID NO: 50347 - DNA, 601 bp, Human
agcaatgcagcagaaattgcaaacccattattggccagcaaagtgtgcttcctggaaagaaaggaaagatttgatgaagatgtctaaccatgaggcatgtcactgaactgtccatcccaggagcaggagccaggcccttctgaagggtgagtagagcaagactcaggcacagtgcagggagcactggccttgccacctctggctgtgtgactgggttcagccctggggtctactaggtcacttacaaaggcaccatcagccttgacatctatgaattctctgtggtagtattttattgctktaattctaagactatcatttaacatttctgaagtcagtggtcatcttacaattcgtgagtcagggtccaggcaggaaaatggaaaccactctaggtattttaatggagagaatttaacatagggaattggttaagtggatattgaagaaccgagatgtcaaaaaggaagacctctgaagaaggggtgtttcccatgtggtgctgacacctcaggggcatggaggagggccccgaagacctttgagagtgggcactgtccactggactgtttcctctgaggagcaatatgattctggttct

SEQ ID NO: 50348 - DNA, 601 bp, Human
aggcatgacatgctgaagaccatccaggtctttggggtagactgcggaccctgcccagcattcctcaattaggggctagagcatcatgaatgggatggttcatcccacaggactgtcccactttatgcagagttccagcatccttggtccctgccaagtcaatgccagcagagagccccagtcatgtgacagccccaaacacttctcacattttgggacacccccaaggagtatgttactgttccctccccgtcatggtgaactctcacctccatctatgcccatgatgaagcgtcccacratgagcatttcaaaggctcctgcctggagcgagcaggccatcagcaatgcagcagaaattgcaaacccattattggccagcaaagtgtgcttcctggaaagaaaggaaagatttgatgaagatgtctaaccatgaggcatgtcactgaactgtccatcccaggagcaggagccaggcccttctgaagggtgagtagagcaagactcaggcacagtgcagggagcactggccttgccacctctggctgtgtgactgggttcagccctggggtctactaggtcacttacaaaggcaccatca

SEQ ID NO: 50349 - DNA, 601 bp, Human
tcagaggcccagagaagaaaccccatcctcataaaagccccatgaaaaccacaaataaccttggaatattaacattatgatgaaggtgaccaaacagaaggcatgacatgctgaagaccatccaggtctttggggtagactgcggaccctgcccagcattcctcaattaggggctagagcatcatgaatgggatggttcatcccacaggactgtcccactttatgcagagttccagcatccttggtccctgccaagtcaatgccagcagagagccccagtcatgtgacagccccaaacacytctcacattttgggacacccccaaggagtatgttactgttccctccccgtcatggtgaactctcacctccatctatgcccatgatgaagcgtcccacgatgagcatttcaaaggctcctgcctggagcgagcaggccatcagcaatgcagcagaaattgcaaacccattattggccagcaaagtgtgcttcctggaaagaaaggaaagatttgatgaagatgtctaaccatgaggcatgtcactgaactgtccatcccaggagcaggagccaggcccttctgaagggtgagtagagcaag

SEQ ID NO: 50350 - DNA, 601 bp, Human
gcctctgagacataatactcttctctctgctgggaacagttctcacccttggctcctctggtctctgctcaggtttccttctctgagcagtcttccctgattggcctttctaaaacagccctcaccaccctcctgtcctgctttgttttcttcctaggacatgctactgtctaccttatgtatctgtctgcccactagaatgtaagctccagggacagggtcttgttaatcattgtgtctccatcctatagtgtgccagccctcgcaggtgctctacaaatgcctggcgagtaaatgaaayaacgaatgagtcagaggcccagagaagaaaccccatcctcataaaagccccatgaaaaccacaaataaccttggaatattaacattatgatgaaggtgaccaaacagaaggcatgacatgctgaagaccatccaggtctttggggtagactgcggaccctgcccagcattcctcaattaggggctagagcatcatgaatgggatggttcatcccacaggactgtcccactttatgcagagttccagcatccttggtccctgccaagtcaatgccagcagagagccccagtcatgtgacag

SEQ ID NO: 50351 - DNA, 601 bp, Human
atgcctccttccgcctctgagacataatactcttctctctgctgggaacagttctcacccttggctcctctggtctctgctcaggtttccttctctgagcagtcttccctgattggcctttctaaaacagccctcaccaccctcctgtcctgctttgttttcttcctaggacatgctactgtctaccttatgtatctgtctgcccactagaatgtaagctccagggacagggtcttgttaatcattgtgtctccatcctatagtgtgccagccctcgcaggtgctctacaaatgcctggcragtaaatgaaataacgaatgagtcagaggcccagagaagaaaccccatcctcataaaagccccatgaaaaccacaaataaccttggaatattaacattatgatgaaggtgaccaaacagaaggcatgacatgctgaagaccatccaggtctttggggtagactgcggaccctgcccagcattcctcaattaggggctagagcatcatgaatgggatggttcatcccacaggactgtcccactttatgcagagttccagcatccttggtccctgccaagtcaatgccagcagagagcccca

SEQ ID NO: 50352 - DNA, 601 bp, Human
catactcggcacaggcacacagtcctcgccgtggcctacaaggtcttatgtgatctggccccagctcctctttggcgtcatcagcacccacacatctccttgctctttcccagacgtgccatgcctccttccgcctctgagacataatactcttctctctgctgggaacagttctcacccttggctcctctggtctctgctcaggtttccttctctgagcagtcttccctgattggcctttctaaaacagccctcaccaccctcctgtcctgctttgttttcttcctaggacatgctactrtctaccttatgtatctgtctgcccactagaatgtaagctccagggacagggtcttgttaatcattgtgtctccatcctatagtgtgccagccctcgcaggtgctctacaaatgcctggcgagtaaatgaaataacgaatgagtcagaggcccagagaagaaaccccatcctcataaaagccccatgaaaaccacaaataaccttggaatattaacattatgatgaaggtgaccaaacagaaggcatgacatgctgaagaccatccaggtctttggggtagactgcggaccctgcccagca

SEQ ID NO: 50353 - DNA, 601 bp, Human
gcctttaagaagctcatgctaggttccaggcagtacatatgtgtatatgtgtgtgtgtgagagagacagagagagagagagagacagagtgtgtgtttccgttcagccttattatagccttttgaagtaggtattattaccaccattttacaaatgggaaaaccaaggctcagagccattaagtaacttgcagcagaactgagatccaaactcagggatttctaatcctaaggcttgcaatctttccacaaatgcctaaaagtgatactttatggatttgcctatttagaaagagagcagygtttgtctgacaatatatcttgagtctcctactctcactcccatagccagcatctgtccccttctctgcagctccccacctagcccagtcccttcccctgaacagctggctcctctgattccactcctggcttcccctcatactccattactggaacaaaccagtccatgtcacattcatctcaaccctccctgcatactcggcacaggcacacagtcctcgccgtggcctacaaggtcttatgtgatctggccccagctcctctttggcgtcatcagcacccacacatctccttgctct

SEQ ID NO: 50354 - DNA, 601 bp, Human
gccgacccacagaagtgaaagcacaggaaaatggttactatttgaagccattaagttttgttttgttttttaagagacagggtttcgctctgtagccaaggctaaaatgcagtggtgccatcatggcttaagtttcggggtttttaaatacatcaaacctaacctatacagataaattaatgaaattaatggaagcaagtgagagcattcaggcagtctgactccatagtcttcacccttaaccactttcctgctccagctttctgagcattagggcccccatttgtaaaatgaacatgaraaaacagtctttcattacaggaggagatcaaaaaaaatgaaaagcatgaacacagttggtcagttataaaacattacatagacaccagccattattcttatggataaactctcaatagccatcaatagaaggagtctattcaagtagtatagacaaatgaatagacaaatgattgaggagtcatttcatcttgagtttggactattagagaggcctagattattcccctccagcagggcaacaaaagtaagtgaagcctcctcttctcaaccttacttccaggcccccactctcctgctc

SEQ ID NO: 50355 - DNA, 601 bp, Human
acagcccgtgagaccaggccacctgctaacacccaaacacaggcgtgagaccatcccaggtcatccagccactgaccaacctgaagccaccgcagacacatgagaaggcccagcagagattggcagagctggcccagagcagaactgcccagccgacccacagaagtgaaagcacaggaaaatggttactatttgaagccattaagttttgttttgttttttaagagacagggtttcgctctgtagccaaggctaaaatgcagtggtgccatcatggcttaagtttcggggtttttaaatrcatcaaacctaacctatacagataaattaatgaaattaatggaagcaagtgagagcattcaggcagtctgactccatagtcttcacccttaaccactttcctgctccagctttctgagcattagggcccccatttgtaaaatgaacatgagaaaacagtctttcattacaggaggagatcaaaaaaaatgaaaagcatgaacacagttggtcagttataaaacattacatagacaccagccattattcttatggataaactctcaatagccatcaatagaaggagtctattcaagtagta

SEQ ID NO: 50356 - DNA, 601 bp, Human
gcccccctggcccagggtgggaagccaagaaatgagctggcccactgacagcccgtgagaccaggccacctgctaacacccaaacacaggcgtgagaccatcccaggtcatccagccactgaccaacctgaagccaccgcagacacatgagaaggcccagcagagattggcagagctggcccagagcagaactgcccagccgacccacagaagtgaaagcacaggaaaatggttactatttgaagccattaagttttgttttgttttttaagagacagggtttcgctctgtagccaaggcwaaaatgcagtggtgccatcatggcttaagtttcggggtttttaaatacatcaaacctaacctatacagataaattaatgaaattaatggaagcaagtgagagcattcaggcagtctgactccatagtcttcacccttaaccactttcctgctccagctttctgagcattagggcccccatttgtaaaatgaacatgagaaaacagtctttcattacaggaggagatcaaaaaaaatgaaaagcatgaacacagttggtcagttataaaacattacatagacaccagccattattcttatg

SEQ ID NO: 50357 - DNA, 601 bp, Human
ccatcaaagccacaataaactatatatgtttatataggtttttaaagcacagaagatgcctaaacaaacacaaattgagctattaatgataattactgggtgggtgaacttaaacattctataaggtttcaatttgttgtgtattctttatgtccttaaaaaaaataaactcaaaggaactccacaacttttctccaataataagtaagaggcttgaataccagaaattgcaaaatacagggaccagcttttggagaaaaggctccttcctgcagtggtaacatgagatgagagcagatgyggttgaccagggagccacactcacctttcccagcagctcgggcaggcccagaagctgcccagtgaacacgccaatgcagataaagatggcagtcacctgccccagagagccacggatctccttgggtgagatctcactgaggtacatggggagcacactgagggcgacgcctgtagagagaaagcatagcagcagttagagaggtgtcttcccgggggagctgcactctggttacaatgcctctcttggctctgctttgccctggacattaaatagcactgtagccacggcatttttccc

SEQ ID NO: 50358 - DNA, 601 bp, Human
catttagaggccacctcttctaaaaagccttccttgagtttaccccaccccattcgacctgagtgaaatgtttcttttctccctgctaaggccatacagcaagtaaatcatcgaactgggattcaaattcaggcccacctgctcccaaaacagcaagccaaaaccggaagactctacttacttatctattcaggaaaaaagagactaaagaatgaggtagagctaagctaacgtcttgaaaagatgcccaaaatatattaaatgaaaacaccaggttgtagaacaatgtgtatggcataaytccatcaaagccacaataaactatatatgtttatataggtttttaaagcacagaagatgcctaaacaaacacaaattgagctattaatgataattactgggtgggtgaacttaaacattctataaggtttcaatttgttgtgtattctttatgtccttaaaaaaaataaactcaaaggaactccacaacttttctccaataataagtaagaggcttgaataccagaaattgcaaaatacagggaccagcttttggagaaaaggctccttcctgcagtggtaacatgagatgagagcagat

SEQ ID NO: 50359 - DNA, 601 bp, Human
attatcaacatgtggtggttattttgagaattttaaaatatctttagaaacaaaaagcaaaagagtctctttagtttggaacctcacttaggttgagagactgtttctaacacactcgcaattaattatagaaatcgtcatgcatatgacaaccacaaatgtaaaatgtgagttgtttctgtttttgcaaaagaagaaactaaagtcatagccgtaataacccagaatggtcataataaaagatcagaagcagatgcctctgaggtgacctcgattggctgaaatataaaaagtcacttayaatatcacagaaaagtacacttaagaatggtcaaaatggtaaactttatgtggattttaccacaataaaaaatgttcaaaacatttaaaatttgctttaaaaatggaatacagtgattcctccacttataaaaccttccactgaatgagaaaggagctggccctagagtcagtgaggctcagtagctgggacagaaaggaccctgtgggcagaattagccccttctctccagagagcccacattcccagaaacaccagtgtgatccatccttggatgtgtaagacacaacccatacgtgg

SEQ ID NO: 50360 - DNA, 601 bp, Human
tcctcctctctgggacaccacatcccatcaccactaacctcactcaacctcatctgcctctctccatccacactgccattactctgacccaactcataactggaccagtcaaccccttcagtcctggctgggatccaatcctttctccatgctgcaggccaaaagccttcttgaagcactcatcatgtcctcaatgatgtcccattgctttggggtacaaataagccttcacagttacacagtccccatcaaggtgtgtgaaaggtggccctaaggctagacccagcccacaggtgggacrttttttgttttttaaaggtcagtttccaatatttacaaattatgaaatatgacaaatctggatttgtaatgtctcttgaaaatcagaaaatctgtcatctctaggccagtgtctgtgatggaaacagtaggagatgcccttgtccctcaagcagccacaggtcctgggaacctctcaccttgcccatccttccctgtgctcatttacagcataggtgtggccctctctgctgcctgccttgccagcggtctctccctctccctctccccctccccctccccctccccctgctcctgacac

SEQ ID NO: 50361 - DNA, 601 bp, Human
ctccaccaaaagtctcctggaactgacaggggatttcaggaaagtttcaggatacaaaatcagtgtacaaaaatcagtagtatttctatacaccaataatgttcaagctgagagccaaagcaagaatgcaatcccatttataatagctgccaaaaaaaaaaactaggaaataattaaccaaggaggtgaaagatttaaataaagaaaactacaaaacattactgaaagaaatcacagatgacacaaatggaaaaacattctatgttcatggattagaacaatcaatatcattaaaatagcratactgcccaaagcaatctacagattcaacactatttctatcaagctaccaatgtcattttccaccaaactagaaaaaaaaattctaaaattcatataaaaccaaaaaagagcccaaatagcccaagccatcctaagcaaaaagaacaaaagccagaggcatcatattacctgacctcaagccatactgtaaacctacagtaaccaaaacagtatggtactggtacaaaaacagacacatagacaaatgaaacagaatggagaacacagaagtaaagctgtacacctacagccatctgat

SEQ ID NO: 50362 - DNA, 601 bp, Human
gatctcatattaataatcttatcaccactcctagaggaagtagaaaaacaagatcaaaccaactccaaagttagcaaaagaaaagaaacagctataaaatcagaacagaacagaacaaaattgagatccaaaatccatacaaagaatcaatgaaaccaaaagttcattatttgaaaggataaatgagattaatagaccactagctagattaaaaaagaaagagagacgatccaaataagcacaatcagaaatgatgaaggtgacattataactgattccacagaaatataaaatatcttcwgagactattatgaacacttctaggcacacaaactagaaaatctagaggaaatgaataagttcctggaaactcacaatttcccaagattcaattaggaagaaactgaaaccctgaacagaacaatatcaagatctgaaattgaaggagtaataaaaaacctaccaaccaataaaagccctgaaaagatggattcacagccaaattctattagatgtacaaagaagagctggtaccaatcctgctgaaactattccaaaaaattgaggagggactcctctctaatttgttctttgaaatcag

SEQ ID NO: 50363 - DNA, 601 bp, Human
aaaaagcaaaaataaaagcaaacccctgaaaaataaagctaaggaaggtcatgaaaggaagattctcatatacagatgcctgctggcaaaaactattgcaaaagactgcaaaaaccttgcacaaaggccactacaaccttacacgagaaaatactgctgcgagaacacctgcctagcaactgcctgtccaaccttggactgatgccacccttgttactgatccttctattcaaagataactatctcaaaaacaattacataattcgtctcattttttctttaaaatcctttgtcttctttyacctccctgaatatgcacatggtttactatggcacacctatgccaattgcaatgcccattcctgaataaacattgttttctttcagaaagtctccctgtttgttatttagattgaaaaaatttgcaaccattagtatatttctttccttgagaggaaagaaaagtgggagctcaaagttaatcattcttatctgacataaatgttcttctgagcatataaaatcgttcctttacggcctcacatcattcctaatctctcttctcatacttttgcctataattttcatctaagtctatttc

SEQ ID NO: 50364 - DNA, 601 bp, Human
ggttaaccagtgatttttttaaaaaatcttgatcaaaaaaggaaatgtgaaagttgtcagaataaaaataaagtcacctgtgttaaaaagcaaaaataaaagcaaacccctgaaaaataaagctaaggaaggtcatgaaaggaagattctcatatacagatgcctgctggcaaaaactattgcaaaagactgcaaaaaccttgcacaaaggccactacaaccttacacgagaaaatactgctgcgagaacacctgcctagcaactgcctgtccaaccttggactgatgccacccttgttaytgatccttctattcaaagataactatctcaaaaacaattacataattcgtctcattttttctttaaaatcctttgtcttcttttacctccctgaatatgcacatggtttactatggcacacctatgccaattgcaatgcccattcctgaataaacattgttttctttcagaaagtctccctgtttgttatttagattgaaaaaatttgcaaccattagtatatttctttccttgagaggaaagaaaagtgggagctcaaagttaatcattcttatctgacataaatgttcttctgagcat

SEQ ID NO: 50365 - DNA, 601 bp, Human
tttcactctgaccaccggtacatgcagcccccgtcatgtaccgcctgcttggtcaaatcaatcacgaccctttcatgtaaaatctttagtgttgtgagcccctaaaaaggacagaaattgtgcactcagggagctcggattttaagacagtagcttgccgatgctcccagctgaataaagcccttccttctacaattcagtgtgtgagaggttttgtctgtggctcatcctgctacaacaacaagtttcacctaatttgtcatgatcatttaattaatttaatttatttaatttatttaaytggttgcttttaaacctaagttcatggatcacaactaatatacaagctgagattgtcatattactattaattttactttgtatttttcttttaaaccttgtacctattacttgttaaatttctacagaacaaatcttcacagaataatactggcccaacacttttagataatagtaaatgcctacagaatagacaaaaacttaaacttaacacttgattttaggtagatgtagcctgagaaccactctctccaaacccctcttgttgctcaaatgtagctaaaagagtttagacactaac

SEQ ID NO: 50366 - DNA, 601 bp, Human
acctagtagttaaaattccacccctgacctagcaactgatgttatctatagattccagacattatatagaaggacattgtgaaacctcccattctgttctgtttcactctgaccaccggtacatgcagcccccgtcatgtaccgcctgcttggtcaaatcaatcacgaccctttcatgtaaaatctttagtgttgtgagcccctaaaaaggacagaaattgtgcactcagggagctcggattttaagacagtagcttgccgatgctcccagctgaataaagcccttccttctacaattcaktgtgtgagaggttttgtctgtggctcatcctgctacaacaacaagtttcacctaatttgtcatgatcatttaattaatttaatttatttaatttatttaactggttgcttttaaacctaagttcatggatcacaactaatatacaagctgagattgtcatattactattaattttactttgtatttttcttttaaaccttgtacctattacttgttaaatttctacagaacaaatcttcacagaataatactggcccaacacttttagataatagtaaatgcctacagaatagacaaaaa

SEQ ID NO: 50367 - DNA, 601 bp, Human
aaaaatgcaggttacaatgagggaagaaagagacctctcatattgttttatactcagtacctgttttaagaaaaaaacaaggaagtgaaaccaaaggcaggcagcccagcgccaggcgccagacccaaaaccggacccaaaaccaggcctgggcctgcctggcctaaacctagtagttaaaattccacccctgacctagcaactgatgttatctatagattccagacattatatagaaggacattgtgaaacctcccattctgttctgtttcactctgaccaccggtacatgcagcccccrtcatgtaccgcctgcttggtcaaatcaatcacgaccctttcatgtaaaatctttagtgttgtgagcccctaaaaaggacagaaattgtgcactcagggagctcggattttaagacagtagcttgccgatgctcccagctgaataaagcccttccttctacaattcagtgtgtgagaggttttgtctgtggctcatcctgctacaacaacaagtttcacctaatttgtcatgatcatttaattaatttaatttatttaatttatttaactggttgcttttaaacctaagttcatggatcac

SEQ ID NO: 50368 - DNA, 601 bp, Human
acacaaaattaaaaaaaaaaatgcaggttacaatgagggaagaaagagacctctcatattgttttatactcagtacctgttttaagaaaaaaacaaggaagtgaaaccaaaggcaggcagcccagcgccaggcgccagacccaaaaccggacccaaaaccaggcctgggcctgcctggcctaaacctagtagttaaaattccacccctgacctagcaactgatgttatctatagattccagacattatatagaaggacattgtgaaacctcccattctgttctgtttcactctgaccaccrgtacatgcagcccccgtcatgtaccgcctgcttggtcaaatcaatcacgaccctttcatgtaaaatctttagtgttgtgagcccctaaaaaggacagaaattgtgcactcagggagctcggattttaagacagtagcttgccgatgctcccagctgaataaagcccttccttctacaattcagtgtgtgagaggttttgtctgtggctcatcctgctacaacaacaagtttcacctaatttgtcatgatcatttaattaatttaatttatttaatttatttaactggttgcttttaaacc

SEQ ID NO: 50369 - DNA, 601 bp, Human
tgcactcctagactccagtggggatggagagaagacattcctgactctacttcacagggagccttgcagaagtcagccagccaactcgggtggcagtcacaggttgagagaaggtctcaactgtgattcacgacataatcttgagtggggatgagctcccttggccagaactaaggggcaagtgggggtactgtagtcacaagtacagaagctgggcatccctgctttggggtggaccaggaggggcacagcctgaaaaccacagtttctgtctgggtggggaaagcttatagcctgtggmagttttgagttctcagtgcaaggttcctggaacccagctagctgggttaaacaaacaaaaagagtttgtgctgttgctaatactacatgctatacttggataaattcccctagaagagttaagactcaaagacacaaaattaaaaaaaaaaatgcaggttacaatgagggaagaaagagacctctcatattgttttatactcagtacctgttttaagaaaaaaacaaggaagtgaaaccaaaggcaggcagcccagcgccaggcgccagacccaaaaccggacccaaaaccaggcctggg

SEQ ID NO: 50370 - DNA, 601 bp, Human
tgtagaagattattcatctgaagtttacaaatcacactttttcagtaataaacacactggaggctgggtgaagtggctcacatctgtaatcccagcactctgatgggccaaggtgggtggatcacctgaggtcaggagttcgagaccagcctggccaacatggtgaaactccatctctaccaaaaatacaaaaattagccaggtgtggtggtggatgcctgtagtcccagctactcgagcggctgaggcaggagaattgctagaacctgggaggcgggggttgagagccaaggtcgagccactgcactccagccttggcgatggagtaagactgtgtcgctaaataaacaaacaaacactggaaacaatccaaatgtccaggaaataaaagaaaaatgaaacaaattataactcataaatagaaactagtacaattattaaaacatggtgtaatgtaagcattgctttagtcttttttcctacccttttcccattttttcctaagctattcattaaaccaaacaacatttcctctgttgatttttgaggtttccttttgcacacattaaaatcatacatagaaatgaattttctgcttctg

SEQ ID NO: 50371 - DNA, 601 bp, Human
tgacatgggcagagtgagactaatgcccttgtgccctgccagcgggaatggaaattgaagcagactatccgaaaaaaaattgctcatatgtacgaaagccttaaaaaaatttacactctttaacctgttatttctatttctgaaacactaaactacatgaataattacagatttgaataatgattaatgtagaagattattcatctgaagtttacaaatcacactttttcagtaataaacacactggaggctgggtgaagtggctcacatctgtaatcccagcactctgatgggccaaggygggtggatcacctgaggtcaggagttcgagaccagcctggccaacatggtgaaactccatctctaccaaaaatacaaaaattagccaggtgtggtggtggatgcctgtagtcccagctactcgagcggctgaggcaggagaattgctagaacctgggaggcgggggttgagagccaaggtcgagccactgcactccagccttggcgatggagtaagactgtgtcgctaaataaacaaacaaacactggaaacaatccaaatgtccaggaaataaaagaaaaatgaaacaaattataactc

SEQ ID NO: 50372 - DNA, 601 bp, Human
tccccaaaagactacagggtgagatggttttactagtgaggtcttttaatactttgattatcaactaacgaaatgtgagaaattacatttctgtctctgctgtggttacttgttacagcatcaacaggaaacaaatatacttataagaaattctcatctattatttttgcctatcaaataccaaagcctcatttaaatgcttgtggatgacatgggcagagtgagactaatgcccttgtgccctgccagcgggaatggaaattgaagcagactatccgaaaaaaaattgctcatatgtacraaagccttaaaaaaatttacactctttaacctgttatttctatttctgaaacactaaactacatgaataattacagatttgaataatgattaatgtagaagattattcatctgaagtttacaaatcacactttttcagtaataaacacactggaggctgggtgaagtggctcacatctgtaatcccagcactctgatgggccaaggtgggtggatcacctgaggtcaggagttcgagaccagcctggccaacatggtgaaactccatctctaccaaaaatacaaaaattagccaggtgtg

SEQ ID NO: 50373 - DNA, 601 bp, Human
tttaaatggtgtaaatttatatagttgtatgctaacaaatttgaaagtttcgatgacataagtgactttattgaaaagacagaaattaatgacatcaactcaaaagaaaataaaaatagatttttacgaaagtagttaaaagatattcaaagcatttttttccccaaaagactacagggtgagatggttttactagtgaggtcttttaatactttgattatcaactaacgaaatgtgagaaattacatttctgtctctgctgtggttacttgttacagcatcaacaggaaacaaatatacwtataagaaattctcatctattatttttgcctatcaaataccaaagcctcatttaaatgcttgtggatgacatgggcagagtgagactaatgcccttgtgccctgccagcgggaatggaaattgaagcagactatccgaaaaaaaattgctcatatgtacgaaagccttaaaaaaatttacactctttaacctgttatttctatttctgaaacactaaactacatgaataattacagatttgaataatgattaatgtagaagattattcatctgaagtttacaaatcacactttttcagta

SEQ ID NO: 50374 - DNA, 601 bp, Human
ttttaaatggtgtaaatttatatagttgtatgctaacaaatttgaaagtttcgatgacataagtgactttattgaaaagacagaaattaatgacatcaactcaaaagaaaataaaaatagatttttacgaaagtagttaaaagatattcaaagcatttttttccccaaaagactacagggtgagatggttttactagtgaggtcttttaatactttgattatcaactaacgaaatgtgagaaattacatttctgtctctgctgtggttacttgttacagcatcaacaggaaacaaatatasttataagaaattctcatctattatttttgcctatcaaataccaaagcctcatttaaatgcttgtggatgacatgggcagagtgagactaatgcccttgtgccctgccagcgggaatggaaattgaagcagactatccgaaaaaaaattgctcatatgtacgaaagccttaaaaaaatttacactctttaacctgttatttctatttctgaaacactaaactacatgaataattacagatttgaataatgattaatgtagaagattattcatctgaagtttacaaatcacactttttcagt

SEQ ID NO: 50375 - DNA, 601 bp, Human
cggattaaccataattattgtgatataataaaaatcacttgtaattttggatctgttttttaccattataaaatggtaagtgctaagaaagagctgccatccttaagcaaacatggaatattaacaaaagatgatcacaaactgaccacagaataaactatcatatgttccccaaagaagaaacttatggatgacctttctttatgtaataaaacaaaactggtaatgaatgaggataacaaaatcccatctacaaaatcccaaaatcccaattgaaaacattgttctaaataattaatckgtattcatttgtgtgttgtttatggtatctgtttttacatttgattcttaaaatcatttcagttattttttaaatggtgtaaatttatatagttgtatgctaacaaatttgaaagtttcgatgacataagtgactttattgaaaagacagaaattaatgacatcaactcaaaagaaaataaaaatagatttttacgaaagtagttaaaagatattcaaagcatttttttccccaaaagactacagggtgagatggttttactagtgaggtcttttaatactttgattatcaactaacgaa

SEQ ID NO: 50376 - DNA, 601 bp, Human
ccgctctgagactgagcttttcatctgtaaaatagaaatttcataacatcttttctaagtactgccacatgacataaatgacgcgatgactgacatcaatttggcaccagttccaggcactgttccaagtgctgaacatgtattctctttcttaagccttacaaaatccccacgaaagaggtcccattattaatgctattgtataggtaacaaattaggcttggagaggttagcaacttgcccaaagtcccacagcaagtgtgtgtgtgagaggtgtggggagctgtgatgcagatccagkcagtcgggcacgagggcccaggtgcccactacacagccctgcagaggctgttttgggcctttccctttgaagctcatttctctctgatagaatcacacattatcacccttttttaatctcatgggaaatttttctgtattttacggattaaccataattattgtgatataataaaaatcacttgtaattttggatctgttttttaccattataaaatggtaagtgctaagaaagagctgccatccttaagcaaacatggaatattaacaaaagatgatcacaaactgaccacagaataaa

SEQ ID NO: 50377 - DNA, 601 bp, Human
agaaattatgggctgcaaaaccaggaagctcaagtcccactgcctccctgctgcagacattcggagtaattatcaccccgctctgagactgagcttttcatctgtaaaatagaaatttcataacatcttttctaagtactgccacatgacataaatgacgcgatgactgacatcaatttggcaccagttccaggcactgttccaagtgctgaacatgtattctctttcttaagccttacaaaatccccacgaaagaggtcccattattaatgctattgtataggtaacaaattaggcttgragaggttagcaacttgcccaaagtcccacagcaagtgtgtgtgtgagaggtgtggggagctgtgatgcagatccaggcagtcgggcacgagggcccaggtgcccactacacagccctgcagaggctgttttgggcctttccctttgaagctcatttctctctgatagaatcacacattatcacccttttttaatctcatgggaaatttttctgtattttacggattaaccataattattgtgatataataaaaatcacttgtaattttggatctgttttttaccattataaaatggtaag

SEQ ID NO: 50378 - DNA, 601 bp, Human
cctggacttgaatgaagtccagagagttctaagtcaaaaagttcacagaaaacaagtgctttcaaacacttagggtctggatgagaaaaatatgaggctgcaaaggactgttttgctcaaattcctataccagactctaacctttggggacagccctcttgcctctccatcaacaagtcaggacgttggtcctaccacagagaaattatgggctgcaaaaccaggaagctcaagtcccactgcctccctgctgcagacattcggagtaattatcaccccgctctgagactgagcttttcayctgtaaaatagaaatttcataacatcttttctaagtactgccacatgacataaatgacgcgatgactgacatcaatttggcaccagttccaggcactgttccaagtgctgaacatgtattctctttcttaagccttacaaaatccccacgaaagaggtcccattattaatgctattgtataggtaacaaattaggcttggagaggttagcaacttgcccaaagtcccacagcaagtgtgtgtgtgagaggtgtggggagctgtgatgcagatccaggcagtcgggcacgagggcccaggt

SEQ ID NO: 50379 - DNA, 601 bp, Human
aagaaacagcaaaggcagaggctgggaggtgggacccgcattgtgggatcctggaatgggatgtggagtcacagtgggatcctctaccttttgtgtgtgcaagaatcacatccagcgagtctgataaacaatgaagattcttggggaaccacctgcttcaagattcagatcttgaggtctggaatggggctgagaagtctcatttaacaaacacccaacacgcttgttaattccaatgtgctgtctattgggcttagctgctctgtgaggtggaggggtggatgggtggagataaagagcstggagccaggtcatacggacctggcacgtcaccatcctgggaggtctaaaccctgcagagggaaatcagggagtcaacactgaatatcgagggggagacattcgagaattcttacaaaagagttgctgaatgtttattaaagccaattttgtatgcacccgggtatacaaaagagtctgaaattatacatgtcgtgtaggtttcagaatcttggttcaacagggattggccagggcagggatgagaatttgcatttctaacaagtgccttcccagctggtgccagttctgctggtcctgg

SEQ ID NO: 50380 - DNA, 601 bp, Human
taaaaaagaacaaaatcatatcctttgcagggacatggatggagctggaagccattatcctcagcaaactaacacagaaacagaaaaccaaacactgcatgttctcacttataagtgggagctgaagaatgagaacacacggacacagtgaggggaacaacacacactggggcctatcgggggacctgggcagggggagggacagtaaacaacctaatgcatgctgggcttactacttatgcaatgggtcaataggtgcagcaaaccaccatgacacatgtttacccgtgtaacaaacctrcacaccctgcgcatataccccagaacttaaaataaaacttaaaaaaggaagatgtttgggcaggtgtgactgaaactgcagatgtgtgcagaggcagggagtggatgagtgtggccccagctgaccatccacctcatcacttgttgtcacctctggcactcttattaaatcactctcagtttctaaatgtgcagagctccctcttgttctttttttgtttttgcactggctattccctgtgcctggaatggtgttttccttcccttcatttggctaattgtcctccagaccccaaggtgg

SEQ ID NO: 50381 - DNA, 601 bp, Human
agacctagaaccagaaataccatttgacccagcaatcccattactgggtatatacccaaatgaatataaatcattctattataaagatgcatgcatgtgtaagttcattacaacactattcacaatagcaaagacatggaattaaccgaaatgcctgtcagtgataaactggataaagaaaatgtggtacatatatactatggaatactatgcagccataaaaaagaacaaaatcatatcctttgcagggacatggatggagctggaagccattatcctcagcaaactaacacagaaacakaaaaccaaacactgcatgttctcacttataagtgggagctgaagaatgagaacacacggacacagtgaggggaacaacacacactggggcctatcgggggacctgggcagggggagggacagtaaacaacctaatgcatgctgggcttactacttatgcaatgggtcaataggtgcagcaaaccaccatgacacatgtttacccgtgtaacaaacctgcacaccctgcgcatataccccagaacttaaaataaaacttaaaaaaggaagatgtttgggcaggtgtgactgaaactgcaga

SEQ ID NO: 50382 - DNA, 601 bp, Human
ttcctcaaagacctagaaccagaaataccatttgacccagcaatcccattactgggtatatacccaaatgaatataaatcattctattataaagatgcatgcatgtgtaagttcattacaacactattcacaatagcaaagacatggaattaaccgaaatgcctgtcagtgataaactggataaagaaaatgtggtacatatatactatggaatactatgcagccataaaaaagaacaaaatcatatcctttgcagggacatggatggagctggaagccattatcctcagcaaactaacamagaaacagaaaaccaaacactgcatgttctcacttataagtgggagctgaagaatgagaacacacggacacagtgaggggaacaacacacactggggcctatcgggggacctgggcagggggagggacagtaaacaacctaatgcatgctgggcttactacttatgcaatgggtcaataggtgcagcaaaccaccatgacacatgtttacccgtgtaacaaacctgcacaccctgcgcatataccccagaacttaaaataaaacttaaaaaaggaagatgtttgggcaggtgtgactgaa

SEQ ID NO: 50383 - DNA, 601 bp, Human
cagacagcctacagaatggaagaaaatttttacaatctatccatctgacagaggtctaatatccagagtctagaaggaacttaaacaaatttataaaaatcaaacaaacaaacaacatcattaaaaagtgggcaaaggacatgaacagacacttctcgaaagaagacattcatgtggtcaagaaacatatgaaaaaaagctcaacatcactgatcattagagaaatgcaaatcaaaaccacagtgagataccaatctcatgccagtcagaatggagattattaaaaagtcaagaaacaacrgatgctgatggggctgtggagagatacgaatgcttttacactgttagtgggagtgtaaattagttgaaccattgtggaagacagtgtggcaattcctcaaagacctagaaccagaaataccatttgacccagcaatcccattactgggtatatacccaaatgaatataaatcattctattataaagatgcatgcatgtgtaagttcattacaacactattcacaatagcaaagacatggaattaaccgaaatgcctgtcagtgataaactggataaagaaaatgtggtacatatatacta

SEQ ID NO: 50384 - DNA, 601 bp, Human
attgtgctgggagaactggttagccatagacagaaaatggaaactggaccccttccttacaccttatacaaaaattaactcaagatggattaaatgtaaaacccaaacctaaatgtaaaacccaaaactataaaaaccctagaagaaaatctagggaataccattcaggacataggcatgggcaaagatttcatgacaaaaacatcaaaagcaaaaattgacaaatggaatctaactaaactaaagagcttctgcgcagaaacaaaaccaaacaaaaaactatcatcagagaaaacagacrgcctacagaatggaagaaaatttttacaatctatccatctgacagaggtctaatatccagagtctagaaggaacttaaacaaatttataaaaatcaaacaaacaaacaacatcattaaaaagtgggcaaaggacatgaacagacacttctcgaaagaagacattcatgtggtcaagaaacatatgaaaaaaagctcaacatcactgatcattagagaaatgcaaatcaaaaccacagtgagataccaatctcatgccagtcagaatggagattattaaaaagtcaagaaacaacagatgc

SEQ ID NO: 50385 - DNA, 601 bp, Human
ttgcattaactccatggagtatgtattaatattattgtcctcattttacagaatcagaaactaagcctcagagaagtgaagtaacttgttcaagtcatacagctagaaagcagcagaggtagaattcaaaccttcaacttcctaactcccaagtcagagcaatttccgtcatgctatgccccttcccacagagaggcttggagtgacccagccaaagcacagtgctagaaagatgtttgggcagcatatagccaagacaatcctaagcaaaaataacaaagctggaggctggcttcaaacyatactacaaggctacagtaaccaaaacagcatggtactgatacaaaaacagacatatagaccaatgaacagaatagagaactcagaaataagactgaacacctacaaccatctgatcttcaacaaacctgacaaaagcaatggggaaaggattctgtatttaataaattgtgctgggagaactggttagccatagacagaaaatggaaactggaccccttccttacaccttatacaaaaattaactcaagatggattaaatgtaaaacccaaacctaaatgtaaaacccaaaactataaa

SEQ ID NO: 50386 - DNA, 601 bp, Human
atagaatgggttaaaattggagactgaacccaaattcgggagccttcaaggctagactgagggattagggcttcatttggtggacacaggatctgttgtttgactggatggctcccatttgcagaaacggtacaaagtcctttacatatagtgtctcttttaatcattgcattaactccatggagtatgtattaatattattgtcctcattttacagaatcagaaactaagcctcagagaagtgaagtaacttgttcaagtcatacagctagaaagcagcagaggtagaattcaaaccttyaacttcctaactcccaagtcagagcaatttccgtcatgctatgccccttcccacagagaggcttggagtgacccagccaaagcacagtgctagaaagatgtttgggcagcatatagccaagacaatcctaagcaaaaataacaaagctggaggctggcttcaaactatactacaaggctacagtaaccaaaacagcatggtactgatacaaaaacagacatatagaccaatgaacagaatagagaactcagaaataagactgaacacctacaaccatctgatcttcaacaaacctgacaa

SEQ ID NO: 50387 - DNA, 601 bp, Human
ctacactctcaggctccatttgctgtgactgagctgcacaaccagactgtatcctgggcctaagaaacgtggatgttctggctttcggggaggggctgagtcacattcagggtccgacttgactgctagatgaatttggtggtaggcagggagataatttatttccaagcattgtcccacttcaacaccacgcccttctgggcaggaaccagggctaactgggttatattctcccccagtgtttaaagcatggaaaggaatcattatcagtgggcattacttggaaaagccgcaagtcaaggaagttatacaggagaggagccttattgttccaaatattagaatttgaaatctgccagaagcaacatctgtctcatccagttattgaagtgcagcatttgaatttacatctctccagggccttgagcctacccaagtcactcaggctccgctaaaactgcacagactggcactaaagatgcaaaataggcctttctgcctggaaaataagttccccttcaccagccccaggtatcaccctctatacaagtaagttaatacaaaatgctgcctaactctccccatcaaatacctaagttgg

SEQ ID NO: 50388 - DNA, 601 bp, Human
tgagatttaggccaatctctactaaaaaaaaaaaaaaaatacaaaaattagccaggcgtggtggcgggggcatgtaatcccagctactctgatggctaaggcaggagaatcacctgaacctgggaggcagaggttgcagtgagctgagattgtgccactgcactgcactctagcctcggagatacacgaaactctgtctcaaaaaaaaaaaaaaaagaatactgaggcctcaatcatcagattgatgtctcaatcttagacatcaatggataatatctaaagaaaatgaatttaaaagttmtatcatcaattattttaaaatatggtggaattatcaaataacaggtaaaagagttgtaagagattgcctctggagagcagacagggagcttgagggggtgggacgatggacctctgtgtgtcactataagccttttagcagtattgaattttttcaatcatttgcttgcattgttttgactaaaataatttaaaatttaagacaaagattagttgaaatatgaatacttttcctttggggttccctttgtggagtttcaagtgcccctttgagatttgtttttggtagtgaatccctggt

SEQ ID NO: 50389 - DNA, 601 bp, Human
accagtggtttctacccaggagagaggcaagaatcccaggactgttctgcaccaggacctgtccagaaaagacccatttagacgaaagcaacaggctagagggctgaggtacaaaaataaagtggtagaacatctgtgatatacttaagaattttgtaaatttattaccaggtgtttaatgttggagaatttgaaaaaaattaattgtaggtagttagaaaactaagcaaataagaaaataaaaacaatgatggaattaataactccaggaaaaacaaaaggttgtacgagaaaggaaagtaatcggtaaatagtcataccaatataaatgttaaccagtgaactaataaaaaattgtactatatgtgtattggtaggttagagaaggggaagggagggatggtgctggaagaatgctaaggcaggtggatcacttgaggttaggagttggagatcagcctggccaatgtggttcgagatcagcttggccaatctctttagtgagatttaggccaatctctactaaaaaaaaaaaaaaaatacaaaaattagccaggcgtggtggcgggggcatgtaatcccagctactctgatggctaag

SEQ ID NO: 50390 - DNA, 601 bp, Human
ccaggaaccagtggtttctacccaggagagaggcaagaatcccaggactgttctgcaccaggacctgtccagaaaagacccatttagacgaaagcaacaggctagagggctgaggtacaaaaataaagtggtagaacatctgtgatatacttaagaattttgtaaatttattaccaggtgtttaatgttggagaatttgaaaaaaattaattgtaggtagttagaaaactaagcaaataagaaaataaaaacaatgatggaattaataactccaggaaaaacaaaaggttgtacgagaaaggaaagtaatcggtaaatagtcataccaatataaatgttaaccagtgaactaataaaaaattgtactatatgtgtattggtaggttagagaaggggaagggagggatggtgctggaagaatgctaaggcaggtggatcacttgaggttaggagttggagatcagcctggccaatgtggttcgagatcagcttggccaatctctttagtgagatttaggccaatctctactaaaaaaaaaaaaaaaatacaaaaattagccaggcgtggtggcgggggcatgtaatcccagctactctgatg

SEQ ID NO: 50391 - DNA, 601 bp, Human
ctatgtaacaaacctgcatgttctgcacatgtatcgcagaacttaaagtacaataataatttaaaaacaaaacaaaaaacaagaagaggaggacataggatccaggaaccagtggtttctacccaggagagaggcaagaatcccaggactgttctgcaccaggacctgtccagaaaagacccatttagacgaaagcaacaggctagagggctgaggtacaaaaataaagtggtagaacatctgtgatatacttaagaattttgtaaatttattaccaggtgtttaatgttggagaatttgaaaaaaattaattgtaggtagttagaaaactaagcaaataagaaaataaaaacaatgatggaattaataactccaggaaaaacaaaaggttgtacgagaaaggaaagtaatcggtaaatagtcataccaatataaatgttaaccagtgaactaataaaaaattgtactatatgtgtattggtaggttagagaaggggaagggagggatggtgctggaagaatgctaaggcaggtggatcacttgaggttaggagttggagatcagcctggccaatgtggttcgagatcagcttggccaatc

SEQ ID NO: 50392 - DNA, 601 bp, Human
ggcacatgtatacctatgtaacaaacctgcatgttctgcacatgtatcgcagaacttaaagtacaataataatttaaaaacaaaacaaaaaacaagaagaggaggacataggatccaggaaccagtggtttctacccaggagagaggcaagaatcccaggactgttctgcaccaggacctgtccagaaaagacccatttagacgaaagcaacaggctagagggctgaggtacaaaaataaagtggtagaacatctgtgatatacttaagaattttgtaaatttattaccaggtgtttaatrttggagaatttgaaaaaaattaattgtaggtagttagaaaactaagcaaataagaaaataaaaacaatgatggaattaataactccaggaaaaacaaaaggttgtacgagaaaggaaagtaatcggtaaatagtcataccaatataaatgttaaccagtgaactaataaaaaattgtactatatgtgtattggtaggttagagaaggggaagggagggatggtgctggaagaatgctaaggcaggtggatcacttgaggttaggagttggagatcagcctggccaatgtggttcgagatc

SEQ ID NO: 50393 - DNA, 601 bp, Human
aatgtagatcacgggttgataggtgcaacaaaccactgtggcacatgtatacctatgtaacaaacctgcatgttctgcacatgtatcgcagaacttaaagtacaataataatttaaaaacaaaacaaaaaacaagaagaggaggacataggatccaggaaccagtggtttctacccaggagagaggcaagaatcccaggactgttctgcaccaggacctgtccagaaaagacccatttagacgaaagcaacaggctagagggctgaggtacaaaaataaagtggtagaacatctgtgatayacttaagaattttgtaaatttattaccaggtgtttaatgttggagaatttgaaaaaaattaattgtaggtagttagaaaactaagcaaataagaaaataaaaacaatgatggaattaataactccaggaaaaacaaaaggttgtacgagaaaggaaagtaatcggtaaatagtcataccaatataaatgttaaccagtgaactaataaaaaattgtactatatgtgtattggtaggttagagaaggggaagggagggatggtgctggaagaatgctaaggcaggtggatcacttgaggtt

SEQ ID NO: 50394 - DNA, 601 bp, Human
cattaggagaaatacctaatgtagatcacgggttgataggtgcaacaaaccactgtggcacatgtatacctatgtaacaaacctgcatgttctgcacatgtatcgcagaacttaaagtacaataataatttaaaaacaaaacaaaaaacaagaagaggaggacataggatccaggaaccagtggtttctacccaggagagaggcaagaatcccaggactgttctgcaccaggacctgtccagaaaagacccatttagacgaaagcaacaggctagagggctgaggtacaaaaataaagtgrtagaacatctgtgatatacttaagaattttgtaaatttattaccaggtgtttaatgttggagaatttgaaaaaaattaattgtaggtagttagaaaactaagcaaataagaaaataaaaacaatgatggaattaataactccaggaaaaacaaaaggttgtacgagaaaggaaagtaatcggtaaatagtcataccaatataaatgttaaccagtgaactaataaaaaattgtactatatgtgtattggtaggttagagaaggggaagggagggatggtgctggaagaatgctaaggcag

SEQ ID NO: 50395 - DNA, 601 bp, Human
acttcaggaaatgatttagcaaaacaagaaaataaaccaagaaaaaaaggatgagttcatgtactttgcagggacatggatgaatctggaaactatcatcctcagcaaactaacaaaggaacagaaaaccaaacaccgcatgtcctcaactcataagtgggagttgaacaatgagaacacatggacacagggaggggaacatcacacaatggggcctgttggaggtgaggcctaagggagaaataacattaggagaaatacctaatgtagatcacgggttgataggtgcaacaaaccactrtggcacatgtatacctatgtaacaaacctgcatgttctgcacatgtatcgcagaacttaaagtacaataataatttaaaaacaaaacaaaaaacaagaagaggaggacataggatccaggaaccagtggtttctacccaggagagaggcaagaatcccaggactgttctgcaccaggacctgtccagaaaagacccatttagacgaaagcaacaggctagagggctgaggtacaaaaataaagtggtagaacatctgtgatatacttaagaattttgtaaatttattaccaggtgtttaa

SEQ ID NO: 50396 - DNA, 601 bp, Human
taattatacaatttcaaaactagggataaataagaagattctaaaagttaacacagaaacaacagttcacatataagtgatcaaaaataagaaaggcatcagatttctcatcagcaatgtcagatgctacaggacactgaagcaatgccttcaaaattctgaggaaaattatattcatacaagagttctatatctagcctaactatctactgggtataagtatagaataaagacatttttagacatggaaagtctcaaaagctttgtcttcattgcatgttttcttcttaagaaagtactkcaggaaatgatttagcaaaacaagaaaataaaccaagaaaaaaaggatgagttcatgtactttgcagggacatggatgaatctggaaactatcatcctcagcaaactaacaaaggaacagaaaaccaaacaccgcatgtcctcaactcataagtgggagttgaacaatgagaacacatggacacagggaggggaacatcacacaatggggcctgttggaggtgaggcctaagggagaaataacattaggagaaatacctaatgtagatcacgggttgataggtgcaacaaaccactgtgg

SEQ ID NO: 50397 - DNA, 601 bp, Human
atttatcttatccattccttaaacgtggcagtacagacatttcaaaggtattaaccacaaggacatgggaatgcaagaaatggcaatggtgagcaagaggtttttagcccagttttagaagatggaatagcaaagtggaggaagtggcacttggagcctctgtgggggcactgaagggaagtgaagacatttgccccaaagacccctggtggctcagcatggaggacccaccaaagacagggtgagggtgggaatgaaaacagagttttggtggcaggcctttagccccatgccctttatycacttcttgatgggaaccagaagatggggttcattctcacaatcaatggaaccaccgtcattccaggcttggacataccagatacagcagcaaaacaggaggccaaaaacatgaaaataaatctcagagccctcagtaatcagcagtgaatcttttcccagaataggcatctcccattctttggaggagaacccaaacctccaaagagaaaaggcattcacacactgacttgtggggcctcccagtacaaatcctgctcacgctgtcatcactcttgaatgaagccttgtccctcaccca

SEQ ID NO: 50398 - DNA, 601 bp, Human
attgtccatgccgatttatcttatccattccttaaacgtggcagtacagacatttcaaaggtattaaccacaaggacatgggaatgcaagaaatggcaatggtgagcaagaggtttttagcccagttttagaagatggaatagcaaagtggaggaagtggcacttggagcctctgtgggggcactgaagggaagtgaagacatttgccccaaagacccctggtggctcagcatggaggacccaccaaagacagggtgagggtgggaatgaaaacagagttttggtggcaggcctttagccycatgccctttatccacttcttgatgggaaccagaagatggggttcattctcacaatcaatggaaccaccgtcattccaggcttggacataccagatacagcagcaaaacaggaggccaaaaacatgaaaataaatctcagagccctcagtaatcagcagtgaatcttttcccagaataggcatctcccattctttggaggagaacccaaacctccaaagagaaaaggcattcacacactgacttgtggggcctcccagtacaaatcctgctcacgctgtcatcactcttgaatgaagcct

SEQ ID NO: 50399 - DNA, 601 bp, Human
cttttgtgtattgggtaccgaaaaattttttttaaaacttcttgataaacaaggcagattgtccatgccgatttatcttatccattccttaaacgtggcagtacagacatttcaaaggtattaaccacaaggacatgggaatgcaagaaatggcaatggtgagcaagaggtttttagcccagttttagaagatggaatagcaaagtggaggaagtggcacttggagcctctgtgggggcactgaagggaagtgaagacatttgccccaaagacccctggtggctcagcatggaggacccascaaagacagggtgagggtgggaatgaaaacagagttttggtggcaggcctttagccccatgccctttatccacttcttgatgggaaccagaagatggggttcattctcacaatcaatggaaccaccgtcattccaggcttggacataccagatacagcagcaaaacaggaggccaaaaacatgaaaataaatctcagagccctcagtaatcagcagtgaatcttttcccagaataggcatctcccattctttggaggagaacccaaacctccaaagagaaaaggcattcacacactgact

SEQ ID NO: 50400 - DNA, 601 bp, Human
agcaagactccatctcaaaaaacaaaaaaacaaaaaaacaaaaaaaagtatcatcggccattctgatacacagccacctccacctatgagcctcttctctggaggaattgagagctttgttaccagcggcgttcacatagaggctgggtgctatttgagtctcagtctcccatttataatatgaatgtctcaggctttccttaaagggttttctagggctagcatttcaaattgtgataattctaaaatttattcatttgaagtttcctgggtgccttttgtgtattgggtaccgaaaaattttttttaaaacttcttgataaacaaggcagattgtccatgccgatttatcttatccattccttaaacgtggcagtacagacatttcaaaggtattaaccacaaggacatgggaatgcaagaaatggcaatggtgagcaagaggtttttagcccagttttagaagatggaatagcaaagtggaggaagtggcacttggagcctctgtgggggcactgaagggaagtgaagacatttgccccaaagacccctggtggctcagcatggaggacccaccaaagacagggtgagggtgggaatg

SEQ ID NO: 50401 - DNA, 601 bp, Human
tggctaacatggtgaaaccccatgtctactaaaaatacaaaaaaaaattagccgggcatggtagcctgtagccccagctactcgggaggctgaggcaggagaatggcgtgaatctgggaggtagagcttgcagtgagccaagatcgtgccactacactccagcctggacaacagagcaagactccatctcaaaaaacaaaaaaacaaaaaaacaaaaaaaagtatcatcggccattctgatacacagccacctccacctatgagcctcttctctggaggaattgagagctttgttaccagmggcgttcacatagaggctgggtgctatttgagtctcagtctcccatttataatatgaatgtctcaggctttccttaaagggttttctagggctagcatttcaaattgtgataattctaaaatttattcatttgaagtttcctgggtgccttttgtgtattgggtaccgaaaaattttttttaaaacttcttgataaacaaggcagattgtccatgccgatttatcttatccattccttaaacgtggcagtacagacatttcaaaggtattaaccacaaggacatgggaatgcaagaaatg

SEQ ID NO: 50402 - DNA, 601 bp, Human
aggccaaggcaggtggatcacaaagtcaggagatcgagaccatcctggctaacatggtgaaaccccatgtctactaaaaatacaaaaaaaaattagccgggcatggtagcctgtagccccagctactcgggaggctgaggcaggagaatggcgtgaatctgggaggtagagcttgcagtgagccaagatcgtgccactacactccagcctggacaacagagcaagactccatctcaaaaaacaaaaaaacaaaaaaacaaaaaaaagtatcatcggccattctgatacacagccacctccrcctatgagcctcttctctggaggaattgagagctttgttaccagcggcgttcacatagaggctgggtgctatttgagtctcagtctcccatttataatatgaatgtctcaggctttccttaaagggttttctagggctagcatttcaaattgtgataattctaaaatttattcatttgaagtttcctgggtgccttttgtgtattgggtaccgaaaaattttttttaaaacttcttgataaacaaggcagattgtccatgccgatttatcttatccattccttaaacgtggcagtacaga

SEQ ID NO: 50403 - DNA, 601 bp, Human
gcgtgatccacccagtgagcatctggatttttaaaaagtatcatcggccgggtgcagtggctcacgcctgtaatcccagcactttgggaggccaaggcaggtggatcacaaagtcaggagatcgagaccatcctggctaacatggtgaaaccccatgtctactaaaaatacaaaaaaaaattagccgggcatggtagcctgtagccccagctactcgggaggctgaggcaggagaatggcgtgaatctgggaggtagagcttgcagtgagccaagatcgtgccactacactccagcctggrcaacagagcaagactccatctcaaaaaacaaaaaaacaaaaaaacaaaaaaaagtatcatcggccattctgatacacagccacctccacctatgagcctcttctctggaggaattgagagctttgttaccagcggcgttcacatagaggctgggtgctatttgagtctcagtctcccatttataatatgaatgtctcaggctttccttaaagggttttctagggctagcatttcaaattgtgataattctaaaatttattcatttgaagtttcctgggtgccttttgtgtattgggtacc

SEQ ID NO: 50404 - DNA, 601 bp, Human
gcctggccacagacatggggctccccactggaagacttgtctgcaactatatttgtttggacctagattgggcaggaaggggcaacccttgctccccactcctctgggctacataaagaagtctttgcctacacactactgacctcctgctctgccctaacttcacgacggagttacttatggggttactgggtgacagccattggtctatactggctggtggctggcatgtggagccatacatgcagggggtgagacctttttctccctcttcctctggatctgggtgtggtagcggccytgggtgagtgggtgtctacagactctacagacccaaatgttcccttgggtagagggtgcaaggcccagacaagacctgcttcctgctcacctagccaggacctaccatgacccctgatgagtaaaagaggtagtgtctgacccctgcctctgttatagtgggtagtcaggcattccccaccaggaatgtcaggtggccatcaggtgatggtcaggcagttgttaaactgtctctctaaaataatagttggtcacagctggcaattattgggaaaggcagtcagtctcccaatagaaaaaa

SEQ ID NO: 50405 - DNA, 601 bp, Human
agccaatgtgcccagccaatgcccagttcttagtaacactcactcaacagctgtcactgttaccatttcacacagcccaaagggcctggccacagacatggggctccccactggaagacttgtctgcaactatatttgtttggacctagattgggcaggaaggggcaacccttgctccccactcctctgggctacataaagaagtctttgcctacacactactgacctcctgctctgccctaacttcacgacggagttacttatggggttactgggtgacagccattggtctatactggcwggtggctggcatgtggagccatacatgcagggggtgagacctttttctccctcttcctctggatctgggtgtggtagcggccctgggtgagtgggtgtctacagactctacagacccaaatgttcccttgggtagagggtgcaaggcccagacaagacctgcttcctgctcacctagccaggacctaccatgacccctgatgagtaaaagaggtagtgtctgacccctgcctctgttatagtgggtagtcaggcattccccaccaggaatgtcaggtggccatcaggtgatggtcaggca

SEQ ID NO: 50406 - DNA, 601 bp, Human
ttgccttggcctcccaaagtgctgggattacaggcatgagccaatgtgcccagccaatgcccagttcttagtaacactcactcaacagctgtcactgttaccatttcacacagcccaaagggcctggccacagacatggggctccccactggaagacttgtctgcaactatatttgtttggacctagattgggcaggaaggggcaacccttgctccccactcctctgggctacataaagaagtctttgcctacacactactgacctcctgctctgccctaacttcacgacggagttacttrtggggttactgggtgacagccattggtctatactggctggtggctggcatgtggagccatacatgcagggggtgagacctttttctccctcttcctctggatctgggtgtggtagcggccctgggtgagtgggtgtctacagactctacagacccaaatgttcccttgggtagagggtgcaaggcccagacaagacctgcttcctgctcacctagccaggacctaccatgacccctgatgagtaaaagaggtagtgtctgacccctgcctctgttatagtgggtagtcaggcattcccca

SEQ ID NO: 50407 - DNA, 601 bp, Human
aagagatccacttgccttggcctcccaaagtgctgggattacaggcatgagccaatgtgcccagccaatgcccagttcttagtaacactcactcaacagctgtcactgttaccatttcacacagcccaaagggcctggccacagacatggggctccccactggaagacttgtctgcaactatatttgtttggacctagattgggcaggaaggggcaacccttgctccccactcctctgggctacataaagaagtctttgcctacacactactgacctcctgctctgccctaacttcacgayggagttacttatggggttactgggtgacagccattggtctatactggctggtggctggcatgtggagccatacatgcagggggtgagacctttttctccctcttcctctggatctgggtgtggtagcggccctgggtgagtgggtgtctacagactctacagacccaaatgttcccttgggtagagggtgcaaggcccagacaagacctgcttcctgctcacctagccaggacctaccatgacccctgatgagtaaaagaggtagtgtctgacccctgcctctgttatagtgggtagtca

SEQ ID NO: 50408 - DNA, 601 bp, Human
gatccacccacctcagcctcccaaagtgctgggattacaggcttgagccactgcgcccagccctaattttttgtagagatgaggttttgccatgttgcccaggccggtctcaaactccggggctcaagagatccacttgccttggcctcccaaagtgctgggattacaggcatgagccaatgtgcccagccaatgcccagttcttagtaacactcactcaacagctgtcactgttaccatttcacacagcccaaagggcctggccacagacatggggctccccactggaagacttgtctgmaactatatttgtttggacctagattgggcaggaaggggcaacccttgctccccactcctctgggctacataaagaagtctttgcctacacactactgacctcctgctctgccctaacttcacgacggagttacttatggggttactgggtgacagccattggtctatactggctggtggctggcatgtggagccatacatgcagggggtgagacctttttctccctcttcctctggatctgggtgtggtagcggccctgggtgagtgggtgtctacagactctacagacccaaatgttcc

SEQ ID NO: 50409 - DNA, 601 bp, Human
ttggtcaggctggtctctgactcccgacctcaggtgatccacccacctcagcctcccaaagtgctgggattacaggcttgagccactgcgcccagccctaattttttgtagagatgaggttttgccatgttgcccaggccggtctcaaactccggggctcaagagatccacttgccttggcctcccaaagtgctgggattacaggcatgagccaatgtgcccagccaatgcccagttcttagtaacactcactcaacagctgtcactgttaccatttcacacagcccaaagggcctggccrcagacatggggctccccactggaagacttgtctgcaactatatttgtttggacctagattgggcaggaaggggcaacccttgctccccactcctctgggctacataaagaagtctttgcctacacactactgacctcctgctctgccctaacttcacgacggagttacttatggggttactgggtgacagccattggtctatactggctggtggctggcatgtggagccatacatgcagggggtgagacctttttctccctcttcctctggatctgggtgtggtagcggccctgggtgag

SEQ ID NO: 50410 - DNA, 601 bp, Human
caggatggagtgcaacggcaacatcttggctcactacaacctccacctcctgggctcaagcaattctcctgcctcagcctcccgagtagctgggattacaggcatgagccaccatgcccggctgattttgtatttttggtagagacagggtttctccttgttggtcaggctggtctctgactcccgacctcaggtgatccacccacctcagcctcccaaagtgctgggattacaggcttgagccactgcgcccagccctaattttttgtagagatgaggttttgccatgttgcccaggccrgtctcaaactccggggctcaagagatccacttgccttggcctcccaaagtgctgggattacaggcatgagccaatgtgcccagccaatgcccagttcttagtaacactcactcaacagctgtcactgttaccatttcacacagcccaaagggcctggccacagacatggggctccccactggaagacttgtctgcaactatatttgtttggacctagattgggcaggaaggggcaacccttgctccccactcctctgggctacataaagaagtctttgcctacacactactgacctcctg

SEQ ID NO: 50411 - DNA, 601 bp, Human
ccacactgtatcatctgcctgtctcaaatctcagccacatgctgttgcttaaagagctggagccactgagggccaggtgggcccagatgtgggcactggtgccttgcccatctgagtttgagtcctctcctcactgcactgcctgctcccttggtcattttggacctcaaatttaaatttaacctctatgagcctcactttccttatcaataaaatagagataataaaacctgcattactggttgtgctggggattcaacagattacatgcaaagtgctcagcctaatgcccagtttaggrgttttttgtttgttggttgttttttgagacagggtctcactctgttacccaggctggagtacaggggtgcaatcatggctcactgcagccttgacttcccaggctcaggtggttctcccacctcagcttcctgagcagctaagatggcaggcatgcactaccgtgcccagctaaattttgtttgtttgtttgtttgtttgcttgtttgtttgagatggagttttgcttttgttgcccaggatggagtgcaacggcaacatcttggctcactacaacctccacctcctgggctcaagcaat

SEQ ID NO: 50412 - DNA, 601 bp, Human
aattcttgcattgtaagatgctttgcaaaagtcctagaatcatacacttgtgattttaatgttctatatccaagtttctctgattcacaagttctgtgactttaattcttcagatcctaaaagtcttttaggaggttcggatcgcatcttggtcattcctgactggaaactgggcaaagtggggcaagcttagcttgtgctgttttccaaatacccactgaacccgctatgcctcttggccatgggtaggaggtagagaaccaaagcccagagagccagtgcttctcctgaggtaacatcrttgggcagtgacgagaggtcccacactgtatcatctgcctgtctcaaatctcagccacatgctgttgcttaaagagctggagccactgagggccaggtgggcccagatgtgggcactggtgccttgcccatctgagtttgagtcctctcctcactgcactgcctgctcccttggtcattttggacctcaaatttaaatttaacctctatgagcctcactttccttatcaataaaatagagataataaaacctgcattactggttgtgctggggattcaacagattacatgcaaagtgctc

SEQ ID NO: 50413 - DNA, 601 bp, Human
gctggtctcaaacccctgggttcaagcgatctgcctgccacagcttcccagaatgctgggattaccggcgtgagtcaggtgtttacagccgtgcaagaatggccaaatacaatgtttgataaataatagaaataacaatgtcagagctgttttggaagagatttctgcattccagaagcggtcgggtcattttctgctatggtcaatttctattcacagattctgtgatctgaatgtcctataactctaacaagctgtaattcttgcattgtaagatgctttgcaaaagtcctagaatcayacacttgtgattttaatgttctatatccaagtttctctgattcacaagttctgtgactttaattcttcagatcctaaaagtcttttaggaggttcggatcgcatcttggtcattcctgactggaaactgggcaaagtggggcaagcttagcttgtgctgttttccaaatacccactgaacccgctatgcctcttggccatgggtaggaggtagagaaccaaagcccagagagccagtgcttctcctgaggtaacatcgttgggcagtgacgagaggtcccacactgtatcatctgcctgt

SEQ ID NO: 50414 - DNA, 601 bp, Human
gtagagatgggatttcaccatgttgcccaggctggtctcaaacccctgggttcaagcgatctgcctgccacagcttcccagaatgctgggattaccggcgtgagtcaggtgtttacagccgtgcaagaatggccaaatacaatgtttgataaataatagaaataacaatgtcagagctgttttggaagagatttctgcattccagaagcggtcgggtcattttctgctatggtcaatttctattcacagattctgtgatctgaatgtcctataactctaacaagctgtaattcttgcattstaagatgctttgcaaaagtcctagaatcatacacttgtgattttaatgttctatatccaagtttctctgattcacaagttctgtgactttaattcttcagatcctaaaagtcttttaggaggttcggatcgcatcttggtcattcctgactggaaactgggcaaagtggggcaagcttagcttgtgctgttttccaaatacccactgaacccgctatgcctcttggccatgggtaggaggtagagaaccaaagcccagagagccagtgcttctcctgaggtaacatcgttgggcagtgac

SEQ ID NO: 50415 - DNA, 601 bp, Human
atctgtctgtcttttttttttttttaaagacaggatctcattcagtctcccaggctgtagtgcagtgacgcaatctcagctcactgcatccccaacctcctaggctcctcccaccttagcctcccggtagctaggactacaggcatgcaccaccaaggccagctaatttctgtattttttgtagagatgggatttcaccatgttgcccaggctggtctcaaacccctgggttcaagcgatctgcctgccacagcttcccagaatgctgggattaccggcgtgagtcaggtgtttacagccrtgcaagaatggccaaatacaatgtttgataaataatagaaataacaatgtcagagctgttttggaagagatttctgcattccagaagcggtcgggtcattttctgctatggtcaatttctattcacagattctgtgatctgaatgtcctataactctaacaagctgtaattcttgcattgtaagatgctttgcaaaagtcctagaatcatacacttgtgattttaatgttctatatccaagtttctctgattcacaagttctgtgactttaattcttcagatcctaaaagtcttttagga

SEQ ID NO: 50416 - DNA, 601 bp, Human
tgctgtcctcatgatggtgaatgagttctcccaagatttggttgtttaaaatttgtggcaccttccctagccttacttctgcttttgccaggtgatgtgcctgctcctggagccctccccagaagctgagcaggtgccagtgccatgcatgtacagtctgcagaaccatgagccaattaaacctcttttctttataaattaccctgtctcagatctgtctgtcttttttttttttttaaagacaggatctcattcagtctcccaggctgtagtgcagtgacgcaatctcagctcactgcakccccaacctcctaggctcctcccaccttagcctcccggtagctaggactacaggcatgcaccaccaaggccagctaatttctgtattttttgtagagatgggatttcaccatgttgcccaggctggtctcaaacccctgggttcaagcgatctgcctgccacagcttcccagaatgctgggattaccggcgtgagtcaggtgtttacagccgtgcaagaatggccaaatacaatgtttgataaataatagaaataacaatgtcagagctgttttggaagagatttctgcattccagaagc

SEQ ID NO: 50417 - DNA, 601 bp, Human
actgattgtgagataacagataaaccacttcacccctctactcctcagtttgctcatccgtaaagtttagtccacagaggaggacctcacatgcagtaggggctttataagtgcttgacataattcgaatatatgtccctgccaaatatcatgttgaattataatcgccgatgttggaggtggggcttggtggaaggtgtttgggttatggggttggatccctcatggcttagtgctgtcctcatgatggtgaatgagttctcccaagatttggttgtttaaaatttgtggcaccttcccyagccttacttctgcttttgccaggtgatgtgcctgctcctggagccctccccagaagctgagcaggtgccagtgccatgcatgtacagtctgcagaaccatgagccaattaaacctcttttctttataaattaccctgtctcagatctgtctgtcttttttttttttttaaagacaggatctcattcagtctcccaggctgtagtgcagtgacgcaatctcagctcactgcatccccaacctcctaggctcctcccaccttagcctcccggtagctaggactacaggcatgcaccaccaa

SEQ ID NO: 50418 - DNA, 601 bp, Human
tcccacttaggaaggcttgaggagtaaatgtcaaaatgtcaatatggaatcagaaaagtttatttttaaaaaaacagtaatcatctttaggaatttggctttttgagaactgtcctttctgtctaaaggaaatgtacttctttctagaagaataagctaataaagatgtgagaaatcaaattttataaatgttcctcattattctcaatggaaaaaggtggtatgaaagtttttgatatggaatctttaaaaagcttgaaaagtaaaattgtcagaaaaggacaggaaatttacaaaagawtcatttaatgtttggatgaatggttgcagaattagagtaggtatcaaagcagtggggttaagctgactgcctggaaggcagaggctaaagcactgtggcttccatgtgccacggctcagctcataagactcccaatgccacagaagccaagaaagagagtgccctctggagttggcccacctctgaggttgggtcctgaaccctggtcctgccacttactgattgtgagataacagataaaccacttcacccctctactcctcagtttgctcatccgtaaagtttagtccacagaggagg

SEQ ID NO: 50419 - DNA, 601 bp, Human
attataattgccatatcccacttaggaaggcttgaggagtaaatgtcaaaatgtcaatatggaatcagaaaagtttatttttaaaaaaacagtaatcatctttaggaatttggctttttgagaactgtcctttctgtctaaaggaaatgtacttctttctagaagaataagctaataaagatgtgagaaatcaaattttataaatgttcctcattattctcaatggaaaaaggtggtatgaaagtttttgatatggaatctttaaaaagcttgaaaagtaaaattgtcagaaaaggacagkaaatttacaaaagattcatttaatgtttggatgaatggttgcagaattagagtaggtatcaaagcagtggggttaagctgactgcctggaaggcagaggctaaagcactgtggcttccatgtgccacggctcagctcataagactcccaatgccacagaagccaagaaagagagtgccctctggagttggcccacctctgaggttgggtcctgaaccctggtcctgccacttactgattgtgagataacagataaaccacttcacccctctactcctcagtttgctcatccgtaaagttt

SEQ ID NO: 50420 - DNA, 601 bp, Human
agataataaagaattataattgccatatcccacttaggaaggcttgaggagtaaatgtcaaaatgtcaatatggaatcagaaaagtttatttttaaaaaaacagtaatcatctttaggaatttggctttttgagaactgtcctttctgtctaaaggaaatgtacttctttctagaagaataagctaataaagatgtgagaaatcaaattttataaatgttcctcattattctcaatggaaaaaggtggtatgaaagtttttgatatggaatctttaaaaagcttgaaaagtaaaattgtcwgaaaaggacaggaaatttacaaaagattcatttaatgtttggatgaatggttgcagaattagagtaggtatcaaagcagtggggttaagctgactgcctggaaggcagaggctaaagcactgtggcttccatgtgccacggctcagctcataagactcccaatgccacagaagccaagaaagagagtgccctctggagttggcccacctctgaggttgggtcctgaaccctggtcctgccacttactgattgtgagataacagataaaccacttcacccctctactcctcagtttgctca

SEQ ID NO: 50421 - DNA, 601 bp, Human
cagagacagagaagggtggtggggtgagataaagagaagcacgctgaagggtataaaaaggaataaatccaatgtttgatagcagggtaggataactaaagttaacaaaaatgtattttattcaggtgatggataccttaaatattctgactcaatcaccacacaaatatgtgtaacaaaatttcacacataccccataaatttgtacagataataaagaattataattgccatatcccacttaggaaggcttgaggagtaaatgtcaaaatgtcaatatggaatcagaaaagtttatttwtaaaaaaacagtaatcatctttaggaatttggctttttgagaactgtcctttctgtctaaaggaaatgtacttctttctagaagaataagctaataaagatgtgagaaatcaaattttataaatgttcctcattattctcaatggaaaaaggtggtatgaaagtttttgatatggaatctttaaaaagcttgaaaagtaaaattgtcagaaaaggacaggaaatttacaaaagattcatttaatgtttggatgaatggttgcagaattagagtaggtatcaaagcagtggggttaagctg

SEQ ID NO: 50422 - DNA, 601 bp, Human
atgaataaagaaactttggtatatatacatcatggaatactatttagccattaaaaagaatgaaatcatgtcatttacagcaacgtggatggaattggggggcattaactaaagtgagataagccaggcacaaaaagacaaatattgcatgttctctctcacttatatgtggaagctaaaaaatttgatcatatggatgtggagagtgtaaagatagataacagagacagagaagggtggtggggtgagataaagagaagcacgctgaagggtataaaaaggaataaatccaatgtttgayagcagggtaggataactaaagttaacaaaaatgtattttattcaggtgatggataccttaaatattctgactcaatcaccacacaaatatgtgtaacaaaatttcacacataccccataaatttgtacagataataaagaattataattgccatatcccacttaggaaggcttgaggagtaaatgtcaaaatgtcaatatggaatcagaaaagtttatttttaaaaaaacagtaatcatctttaggaatttggctttttgagaactgtcctttctgtctaaaggaaatgtacttctttct

SEQ ID NO: 50423 - DNA, 601 bp, Human
acctaagtgtccatcaatggatgaataaagaaactttggtatatatacatcatggaatactatttagccattaaaaagaatgaaatcatgtcatttacagcaacgtggatggaattggggggcattaactaaagtgagataagccaggcacaaaaagacaaatattgcatgttctctctcacttatatgtggaagctaaaaaatttgatcatatggatgtggagagtgtaaagatagataacagagacagagaagggtggtggggtgagataaagagaagcacgctgaagggtataaaaasgaataaatccaatgtttgatagcagggtaggataactaaagttaacaaaaatgtattttattcaggtgatggataccttaaatattctgactcaatcaccacacaaatatgtgtaacaaaatttcacacataccccataaatttgtacagataataaagaattataattgccatatcccacttaggaaggcttgaggagtaaatgtcaaaatgtcaatatggaatcagaaaagtttatttttaaaaaaacagtaatcatctttaggaatttggctttttgagaactgtcctttctgtcta

SEQ ID NO: 50424 - DNA, 601 bp, Human
gcaaggatgcagagaaaaaggaaaacttaaacactgttcataggaacgtaaactagtatagctgtgaaagaaaacagtatggagatttctcaaaaaactaaaaatacaattaatattcaatccagcaatctcacctctgggtactactcaaaggaaaagaaattcatacgtcaaagggatacctgtactcacatgtttattgcagtactattcacaatagtaaagatatggaatcaacctaagtgtccatcaatggatgaataaagaaactttggtatatatacatcatggaatactattyagccattaaaaagaatgaaatcatgtcatttacagcaacgtggatggaattggggggcattaactaaagtgagataagccaggcacaaaaagacaaatattgcatgttctctctcacttatatgtggaagctaaaaaatttgatcatatggatgtggagagtgtaaagatagataacagagacagagaagggtggtggggtgagataaagagaagcacgctgaagggtataaaaaggaataaatccaatgtttgatagcagggtaggataactaaagttaacaaaaatgtattttattca

SEQ ID NO: 50425 - DNA, 601 bp, Human
attattaaatgacaaaaaataacagatgctggcaaggatgcagagaaaaaggaaaacttaaacactgttcataggaacgtaaactagtatagctgtgaaagaaaacagtatggagatttctcaaaaaactaaaaatacaattaatattcaatccagcaatctcacctctgggtactactcaaaggaaaagaaattcatacgtcaaagggatacctgtactcacatgtttattgcagtactattcacaatagtaaagatatggaatcaacctaagtgtccatcaatggatgaataaagaaamtttggtatatatacatcatggaatactatttagccattaaaaagaatgaaatcatgtcatttacagcaacgtggatggaattggggggcattaactaaagtgagataagccaggcacaaaaagacaaatattgcatgttctctctcacttatatgtggaagctaaaaaatttgatcatatggatgtggagagtgtaaagatagataacagagacagagaagggtggtggggtgagataaagagaagcacgctgaagggtataaaaaggaataaatccaatgtttgatagcagggtaggat

SEQ ID NO: 50426 - DNA, 601 bp, Human
tgtttagcagtggggcctcacagggaaatagtgacagccagcaaatgttcatggagcttctttgaccttaccgtccctcccaacaactgcctcctgggaaggaccctgctggccacagctttactgaatcctggggtggggagcatgtggctggtcgtgtttgccttaccaaccttacctgttgggcatgagggtcaatgtcaccctctccacacctgaccccacagagtacaagccagctagtaagatggctcaattcattgcagcaaatatgttgttctagaattgctatttttggtgygcattcatgctctgattctatttcaacactaacaataacaggtatctcaagaacatgggcttttgtgattacctctcatttttctctgttggaaataataatgagatgaacttccaaggctacaacactcaccacataaaaagtggttctgagaattggatgtgagagaagcacccacatagagcccccccatgggtcatctttcaagaaatgctccttcccctattcctaaaacattttctatttttcaaagggtttggatgtcctctgccttgcttggttctcaagcaatcttatggg

SEQ ID NO: 50427 - DNA, 601 bp, Human
gtcacactcctctatggcaggtcctatacagaactcatcagtgatcactcaagctcaactccaatagctcatgctattacaaaaacatcaagatagtgaagcctgcactcacattccatagggttgctttgttacatctttgaatgcttcctgcttgtttagcagtggggcctcacagggaaatagtgacagccagcaaatgttcatggagcttctttgaccttaccgtccctcccaacaactgcctcctgggaaggaccctgctggccacagctttactgaatcctggggtggggagcaygtggctggtcgtgtttgccttaccaaccttacctgttgggcatgagggtcaatgtcaccctctccacacctgaccccacagagtacaagccagctagtaagatggctcaattcattgcagcaaatatgttgttctagaattgctatttttggtgtgcattcatgctctgattctatttcaacactaacaataacaggtatctcaagaacatgggcttttgtgattacctctcatttttctctgttggaaataataatgagatgaacttccaaggctacaacactcaccacataaaaagtg

SEQ ID NO: 50428 - DNA, 601 bp, Human
ccttcccttccctcatggtggcagctgctagctgaatagggaatttatatgcagattctatcaggctgaacctgtcacactcctctatggcaggtcctatacagaactcatcagtgatcactcaagctcaactccaatagctcatgctattacaaaaacatcaagatagtgaagcctgcactcacattccatagggttgctttgttacatctttgaatgcttcctgcttgtttagcagtggggcctcacagggaaatagtgacagccagcaaatgttcatggagcttctttgaccttaccrtccctcccaacaactgcctcctgggaaggaccctgctggccacagctttactgaatcctggggtggggagcatgtggctggtcgtgtttgccttaccaaccttacctgttgggcatgagggtcaatgtcaccctctccacacctgaccccacagagtacaagccagctagtaagatggctcaattcattgcagcaaatatgttgttctagaattgctatttttggtgtgcattcatgctctgattctatttcaacactaacaataacaggtatctcaagaacatgggcttttgtgattac

SEQ ID NO: 50429 - DNA, 601 bp, Human
ctgcaggcactgatctgagctcattctccaatcagcttcctgcccacatctccatctcagggtctcttttctggggaactcaacctaagacacatctatgggcccatgattccaaatcttcatgtccatccatacatctgacaaaaattatttacttggccaaacattagtcagcccattgaaacttctcctaggcccatctgtgtacttccctgtaaaatacagctttagcaaaggacgctcctaggccattttagcaagaacccctttctgcagcacatctatctactcatcctttacmttatagcattccctcccgtggatgacttctctatctggtaccaatttccattaaagcacttgttattctgcatagcaatgtgctttttatgggtgtgtttccctatagacggagctcctgaagggccacccattgccttgttcctttatttatctgcccagtgccaggtaaaaggcaggtgtttagtaaatgcctgtttactgaatgcatgttggggaggatgaatgacagcacagataagagatgctccagctagatacagaaatccctgaaacgacagacactcctgctcttaaaata

SEQ ID NO: 50430 - DNA, 601 bp, Human
atggctgactgatgtgggggcataaagttctgttcccccacctccaaattatcccactctgatgggccatcccagctccagagctccctgtgggctcaactgagacctctgttgtgctgagggttgctcaccttttccctctgctgaatcctggtcccatctcttcccctgcaggcactgatctgagctcattctccaatcagcttcctgcccacatctccatctcagggtctcttttctggggaactcaacctaagacacatctatgggcccatgattccaaatcttcatgtccatccayacatctgacaaaaattatttacttggccaaacattagtcagcccattgaaacttctcctaggcccatctgtgtacttccctgtaaaatacagctttagcaaaggacgctcctaggccattttagcaagaacccctttctgcagcacatctatctactcatcctttacattatagcattccctcccgtggatgacttctctatctggtaccaatttccattaaagcacttgttattctgcatagcaatgtgctttttatgggtgtgtttccctatagacggagctcctgaagggccaccca

SEQ ID NO: 50431 - DNA, 601 bp, Human
gaatggattgactgacacttcttccatctcccataccccttcctccaagcctgctttaggctagaagcctgcagtggaaagagctggggtgggaggtagatggttgacttctctatttctctcctccttcctacccctcttccccaggcttgctagccagtgtctgacccctctaggaaccaagtgtgtgaggctgtacgttgggactctggggccaatggatgtgtaaaactgatattgtttcctcatgagcactttctgagggttctggagtgtcccaaccttgggaccacccacttgyccttgcagttgtcctagcctgcaggtttgcaggtgctctttctctgtctctgctgcaaggtgtacatctctttctgtctctctccattgcagctcaagggatccagggtcaaggctgctctgcatatttgtgaaaggtgcaccgagcactcagctccctgataagggggtgggctgaggctaaatccagcccactctgaccccaacctaggtggccatgaggttagtgtattaatattaatcatgttttatgtgttctgtattttatttcgctttcatattgtatgacctttctgatttc

SEQ ID NO: 50432 - DNA, 601 bp, Human
ttgaatggattgactgacacttcttccatctcccataccccttcctccaagcctgctttaggctagaagcctgcagtggaaagagctggggtgggaggtagatggttgacttctctatttctctcctccttcctacccctcttccccaggcttgctagccagtgtctgacccctctaggaaccaagtgtgtgaggctgtacgttgggactctggggccaatggatgtgtaaaactgatattgtttcctcatgagcactttctgagggttctggagtgtcccaaccttgggaccacccactygcccttgcagttgtcctagcctgcaggtttgcaggtgctctttctctgtctctgctgcaaggtgtacatctctttctgtctctctccattgcagctcaagggatccagggtcaaggctgctctgcatatttgtgaaaggtgcaccgagcactcagctccctgataagggggtgggctgaggctaaatccagcccactctgaccccaacctaggtggccatgaggttagtgtattaatattaatcatgttttatgtgttctgtattttatttcgctttcatattgtatgacctttctgatt

SEQ ID NO: 50433 - DNA, 601 bp, Human
agaattgccagtataaaataataatcaaaatcaaccgaattgaatggattgactgacacttcttccatctcccataccccttcctccaagcctgctttaggctagaagcctgcagtggaaagagctggggtgggaggtagatggttgacttctctatttctctcctccttcctacccctcttccccaggcttgctagccagtgtctgacccctctaggaaccaagtgtgtgaggctgtacgttgggactctggggccaatggatgtgtaaaactgatattgtttcctcatgagcactttcygagggttctggagtgtcccaaccttgggaccacccacttgcccttgcagttgtcctagcctgcaggtttgcaggtgctctttctctgtctctgctgcaaggtgtacatctctttctgtctctctccattgcagctcaagggatccagggtcaaggctgctctgcatatttgtgaaaggtgcaccgagcactcagctccctgataagggggtgggctgaggctaaatccagcccactctgaccccaacctaggtggccatgaggttagtgtattaatattaatcatgttttatgtgttctg

SEQ ID NO: 50434 - DNA, 601 bp, Human
taggctcttattctaataatggcttacattgatcaagtgggctccacgtgcccagctccctgctaagtgtgttacaaatgtaaccttgtgttacataagaacagtccagaatgtcatctaaatacaaccttgatctttgtctccttattcctctaaaatttaatccctggggctttatttccctgccccattctaggagctcatgtcttttctgctgaaactgagcagagtcctatcctagaatcacaatttcaatttagacatcagaattgccagtataaaataataatcaaaatcaacygaattgaatggattgactgacacttcttccatctcccataccccttcctccaagcctgctttaggctagaagcctgcagtggaaagagctggggtgggaggtagatggttgacttctctatttctctcctccttcctacccctcttccccaggcttgctagccagtgtctgacccctctaggaaccaagtgtgtgaggctgtacgttgggactctggggccaatggatgtgtaaaactgatattgtttcctcatgagcactttctgagggttctggagtgtcccaaccttgggaccaccc

SEQ ID NO: 50435 - DNA, 601 bp, Human
gtggcctctgagtgtctttttcaggtgctgttcaaaaaggaaggcatgttttaaaaaaccgcatattactcgcctgacacaagaccatgaggcgccaccaaacaacaacctcaaagatgagtctttgtggtgtcggtccagcctgctgggtttggtaaagccctagagcgtccatctaggagaacacaggcagagtctttgcacctgctatttcactcaggaggaaagaaaaggatagtcttgtcagccaaggtgatttttaactcccagtcaggtcaggcgaatgggctttgcaataactctattatcttgttctttaatctgcaggtttccatgttttaaatagacttccaggtcatatttcccccaagctatagactactttagtccataaataatatcatcctggactatgatgaatcagcaaaaaatgtttaagtagagttgaaatcattactcttaccccaagtcaagttcttataaaggatgttccaatatgctcatggcccccagacaagggagcacggtgagggggttgatgctggctgggccacttatgcctctgacagcaaaagggctccagaagtggccattgctccat

SEQ ID NO: 50436 - DNA, 601 bp, Human
cagtggcctctgagtgtctttttcaggtgctgttcaaaaaggaaggcatgttttaaaaaaccgcatattactcgcctgacacaagaccatgaggcgccaccaaacaacaacctcaaagatgagtctttgtggtgtcggtccagcctgctgggtttggtaaagccctagagcgtccatctaggagaacacaggcagagtctttgcacctgctatttcactcaggaggaaagaaaaggatagtcttgtcagccaaggtgatttttaactcccagtcaggtcaggcgaatgggctttgcaatawctctattatcttgttctttaatctgcaggtttccatgttttaaatagacttccaggtcatatttcccccaagctatagactactttagtccataaataatatcatcctggactatgatgaatcagcaaaaaatgtttaagtagagttgaaatcattactcttaccccaagtcaagttcttataaaggatgttccaatatgctcatggcccccagacaagggagcacggtgagggggttgatgctggctgggccacttatgcctctgacagcaaaagggctccagaagtggccattgctcc

SEQ ID NO: 50437 - DNA, 601 bp, Human
gacagtggcctctgagtgtctttttcaggtgctgttcaaaaaggaaggcatgttttaaaaaaccgcatattactcgcctgacacaagaccatgaggcgccaccaaacaacaacctcaaagatgagtctttgtggtgtcggtccagcctgctgggtttggtaaagccctagagcgtccatctaggagaacacaggcagagtctttgcacctgctatttcactcaggaggaaagaaaaggatagtcttgtcagccaaggtgatttttaactcccagtcaggtcaggcgaatgggctttgcaataactctattatcttgttctttaatctgcaggtttccatgttttaaatagacttccaggtcatatttcccccaagctatagactactttagtccataaataatatcatcctggactatgatgaatcagcaaaaaatgtttaagtagagttgaaatcattactcttaccccaagtcaagttcttataaaggatgttccaatatgctcatggcccccagacaagggagcacggtgagggggttgatgctggctgggccacttatgcctctgacagcaaaagggctccagaagtggccattgct

SEQ ID NO: 50438 - DNA, 601 bp, Human
aggctgttatcaagtttatggcatagcctttgatccctggtctcttaaatacaaggacatgtggactctttcttaaggggggtcgcatgggtgactatggtcttctttctacctctggagaaaaggtggattctttaaacctcagggtgggcagcccccggattgggatgccaacatttctgaactggggaaggacaatggcagtggccactctgcacacatccctggggtgaacagcggaaaaggtgagggtcgggagtgtccagagtggagctcagataagagtttactccagagggaytgagcttagccagcagaagagtctgaacctggctttttccagcaagtgttcagagatttcctggagatattagctggctgcagggagaggtgttatagttaggagagattattcccctcaccttctaccaagaaaagtgtgactgggtgtgtgggtagggtgtgtgttgaatgaagtgtttccacccatattatacatgtggcccacccaaataataaaaatagctaggatgacctgcgcacacgtcatctcaatgagtaagtgcctagcctgctcactcattcctgccgtggggccaca

SEQ ID NO: 50439 - DNA, 601 bp, Human
ggctggagccttgagcagaggtcaggtcatgggtggctttgctgcctttccatggctcttggacttggcttgaggacaacaggagcctttgaggggtctatgcactagctgagatggacactctctatttccttgaatctacaattcagtgtttttggaatcttagtcagtgggtatgtttcacattgcatgacttattcctgaaaggctgttatcaagtttatggcatagcctttgatccctggtctcttaaatacaaggacatgtggactctttcttaaggggggtcgcatgggtgacyatggtcttctttctacctctggagaaaaggtggattctttaaacctcagggtgggcagcccccggattgggatgccaacatttctgaactggggaaggacaatggcagtggccactctgcacacatccctggggtgaacagcggaaaaggtgagggtcgggagtgtccagagtggagctcagataagagtttactccagagggactgagcttagccagcagaagagtctgaacctggctttttccagcaagtgttcagagatttcctggagatattagctggctgcagggagaggtgtta

SEQ ID NO: 50440 - DNA, 601 bp, Human
acagaaggtcaggggatgccggagatgtgggagctgaggctggagccttgagcagaggtcaggtcatgggtggctttgctgcctttccatggctcttggacttggcttgaggacaacaggagcctttgaggggtctatgcactagctgagatggacactctctatttccttgaatctacaattcagtgtttttggaatcttagtcagtgggtatgtttcacattgcatgacttattcctgaaaggctgttatcaagtttatggcatagcctttgatccctggtctcttaaatacaaggacrtgtggactctttcttaaggggggtcgcatgggtgactatggtcttctttctacctctggagaaaaggtggattctttaaacctcagggtgggcagcccccggattgggatgccaacatttctgaactggggaaggacaatggcagtggccactctgcacacatccctggggtgaacagcggaaaaggtgagggtcgggagtgtccagagtggagctcagataagagtttactccagagggactgagcttagccagcagaagagtctgaacctggctttttccagcaagtgttcagagatt

SEQ ID NO: 50441 - DNA, 601 bp, Human
agcatagcccttccatcgccctttgaggaactggcaaggccaatgtcagctttccagtttcaggaggagctctcgctagaaggctgggaggggtaggctagggctgtcgggggcccaggagggccagggacaggggagtggggagtgactgcgcatgggtgtggggtttcatctagggtgatgcaaataccctggaattagggaaggccgatggtggcccgactccgtgaagataccaaaacccactgagctgtatactttaaaaggatgaattttatgatatgtgtgtcatagtttgatyaaaaagaaagaccaggaagaaaaaaccccaacatacatagaagtggaattttcgctaggcctgtgtgtggtggtgttgattttattttctctcggggtttggctgccgtctcagtaagggtaaaaacagaatctgagaaaacacgagggaaccaaccccatgaagctcctaccacgtgccggatgtgatgtgagcccttcccatggctgtctccttccaccgcacagccgccagccccacacacagccagcaatactgctgcatgttaaaggtgtggcaggcgattcctgtgctgaggcc

SEQ ID NO: 50442 - DNA, 601 bp, Human
accctgcagaaggtcttcctgcccagcatgatccccaggaacaaaggctgagggaaggaactgagccaggctgggcaccagtcccacgtatatagcattttccatgcatgagtccagagactcctcaagagtcccctgtgagatagtgacctgcaaggtagctctgaaaagcaggcggctctggttggccaaggccactcaagggctgcttgaccccactccctggggaaccatggtgagcctgggggatcttagggtctccttctcttcaacaccagggctgcctcccaggctgccccargaatggagcctgcatgtggaggtgacatgggcaccaccgctagatatctagacgcccacgacattcaaccatctctgtcttctcagtgaggacacaagaagggcagctggagctcttgcagaccccatgggagtgaggaagagggggccagtggggcacagcttaccccttagggagaggaggcctttcactttccagccagctatgaaaggcaaacagatccctacgacacgcactattcaagaggcaagtgatgcactccaagcagtgacatcccctgcagtgcagcttaaatgaagc

SEQ ID NO: 50443 - DNA, 601 bp, Human
aagatttgaatctgactcagcatccccccatttagggcatttaaagaaagctacatgagacaactcccaagcccctttgcgagccttatttttctcccctgtaaaatgagtgtatactccttcctccctcgaaggactgttggcaaggtcctgtgggtcattgtgaagaagcactcagaccagtgcctggtgggatctggtgttcactctgtgcttgcatcttttcctctcctggcaggtaaatattaagacagaggaagtcagtgaagggagaagaagtggaaggagggccgccatgcamctaagccactcagaaatttcagatggcttcatctctgtggctgggaacaactagagaggtggtagtgagacactgcacagaagtgagggaacctgcgtcttatcttgtctgttctggcttttccagattccctgggagactccctgggtgactctgtgtcccctctctgtcccccagcaaggctgttgggaagatgaaatgagaaggtaccctatgatacccagcccagtgcctgcaaaaaggaacaatgacaacaccccttcctgtgcccattggcccaggtcccagcatgccttgcag

SEQ ID NO: 50444 - DNA, 601 bp, Human
catctgcaaaatgaaggtaataacaattaccttctctgacttcactttagagaaatgttataaatgagaaaatgaatctgatccataaactgctagacaaatataggtaattgttaatatttcattatgccatttgttaactcagaaaatacttaggtagtgtgaatttcaaaagatgttgcacaaattgtatatataattctcaagtcttttcctggatttggacatagatgaaatttagaactaaaatgcacagagttctcagtaataatgatagcagataatactacgaaccttataygcaccatctaattcagtcctcacaatggccccatgagggaagtttatgtcatttcctttttacagatgagggttctggggctcagaaaggtttaaaaaattgctcaaggtcagacatcagagctggatgtgaaggtagtgctggttaccttcacatgcctaactaaccatggtgctgtcaactgcatctcattttataaaactaaaagaatcagaatgtgattgttcattctgcattgtctatctctaggcaacataattttgccttttcagggctctgtagagagatgtctctgattcc

SEQ ID NO: 50445 - DNA, 601 bp, Human
ctggagaaaagagggctcaagtcccaggtctatcaccaagccataggcagaattttgtgtatatggttactgtattgaagaaaacactatcatttccatcatattttcaaaagcctctataaatctctataaaccaaaacccacagctttgggaaacggaattcatccctgtaagcctcagtttcttcatctgcaaaatgaaggtaataacaattaccttctctgacttcactttagagaaatgttataaatgagaaaatgaatctgatccataaactgctagacaaatataggtaattgytaatatttcattatgccatttgttaactcagaaaatacttaggtagtgtgaatttcaaaagatgttgcacaaattgtatatataattctcaagtcttttcctggatttggacatagatgaaatttagaactaaaatgcacagagttctcagtaataatgatagcagataatactacgaaccttatacgcaccatctaattcagtcctcacaatggccccatgagggaagtttatgtcatttcctttttacagatgagggttctggggctcagaaaggtttaaaaaattgctcaaggtcag

SEQ ID NO: 50446 - DNA, 601 bp, Human
gttccagagccagactgtcagaattcaaatttcagtgctgtcattggctagctttatgtccttggccaagttatcccatccttggtttttttttttaggtcttaaaatgggaataaaaatattacctactttctatggttgttgtgatgatttaatgagctaatgtatgtgaagtgcttagaatgaaatagttttcaatacagatgagccattagtgggtgtttctgtccatctcccttaactagaccttcaccctccctcactcctggggggcaggaatgtcatctcataccactgtctyaccctgtcacctggcagaacacccaacatgctaaatatccattgcttgctgaatgtctggagtaaaattagcacttttataggtacagatgaaaatttcaataagctatttcaacttaaggccaatatctttgttctttttatagagtgcacatgtaatatttatcacgttttgtaactgtacttctccctcactccctactgtgctatgaaataaaactttaaaaccttcttcactgtctggcattgacatgcactattcattccaactgtacttaattgaagcatttctcaagagagc

SEQ ID NO: 50447 - DNA, 601 bp, Human
attatctaaagccaatgtgttttgggtgttttgttatgcagcattattacagtaatagttgactaacacagggcctcttttccccaaattatcaacagactggagaaggggtatctcccacagtgccgagcatggtgctaagtaataaagtgcattttgtttacattcataagttccagagccagactgtcagaattcaaatttcagtgctgtcattggctagctttatgtccttggccaagttatcccatccttggtttttttttttaggtcttaaaatgggaataaaaatattacctaytttctatggttgttgtgatgatttaatgagctaatgtatgtgaagtgcttagaatgaaatagttttcaatacagatgagccattagtgggtgtttctgtccatctcccttaactagaccttcaccctccctcactcctggggggcaggaatgtcatctcataccactgtcttaccctgtcacctggcagaacacccaacatgctaaatatccattgcttgctgaatgtctggagtaaaattagcacttttataggtacagatgaaaatttcaataagctatttcaacttaaggccaatat

SEQ ID NO: 50448 - DNA, 601 bp, Human
tttccgagctgtgttttcccgcccctttttggcccttgggttttctgtaggagacatttatctctgtgggcctctgtttcttcactcagcaccctgtcccaacaagttctctctagccagggaaaagggagtcctggggcttagctagtccatgggccaaaatgagaagactctcagaggccacctatcttggctcacatcttagaaatgaaacagagtaacagtgagggaggagggcgctggtcttccgggagcaggtgactgccagcagagaccgagagaagacctctgaggcagtgcrtccccacctccctctgcccagctccctctgcccggtttaggagatggggacatctttatcattgacaagggcaagcatggaacgttacacagcccctcttctctcctcagccatctccagatgggtataggtgagctgagggcctccaggtaaggccaccacagacagcagggcctgaagagccagctgatcaccccgtggcctccttcctgggttctgcgttggttgttggtgggtgtgtttggtgcacaggtgagggagtaagcgaggagtttacctctgttgcccctccctcagcaa

SEQ ID NO: 50449 - DNA, 601 bp, Human
agctctcaggggcacagagacctccagcaatctcaaaggttgcacgggaatggcacccatcacaggcacaacatagaaaacatcctctgcttcagcaaaaccctaagcaattctctaaatctaaagtgaggctggtccttacagcaagagttgcttgttctttaaaacgaagaagtgtgtgggcaatttctaggaacgacttcgtgctctgagggctggaggctttggtagggtggtttccgagctgtgttttcccgcccctttttggcccttgggttttctgtaggagacatttatctcygtgggcctctgtttcttcactcagcaccctgtcccaacaagttctctctagccagggaaaagggagtcctggggcttagctagtccatgggccaaaatgagaagactctcagaggccacctatcttggctcacatcttagaaatgaaacagagtaacagtgagggaggagggcgctggtcttccgggagcaggtgactgccagcagagaccgagagaagacctctgaggcagtgcgtccccacctccctctgcccagctccctctgcccggtttaggagatggggacatctttatcattg

SEQ ID NO: 50450 - DNA, 601 bp, Human
gggtgctgttgtttttgagaaaaccaaagaaggtactgaatttcaagttgggactatcatgtcatcccaagagcaacagaactggtccccaagaagcagaggagactcaaagcacagggatgctctgaatggtaaagaaatgttgaacttccttccctgtgctgtggaattgaaggtacgttgagaacttcctcccagctctcaggggcacagagacctccagcaatctcaaaggttgcacgggaatggcacccatcacaggcacaacatagaaaacatcctctgcttcagcaaaaccctmagcaattctctaaatctaaagtgaggctggtccttacagcaagagttgcttgttctttaaaacgaagaagtgtgtgggcaatttctaggaacgacttcgtgctctgagggctggaggctttggtagggtggtttccgagctgtgttttcccgcccctttttggcccttgggttttctgtaggagacatttatctctgtgggcctctgtttcttcactcagcaccctgtcccaacaagttctctctagccagggaaaagggagtcctggggcttagctagtccatgggccaaaatgagaag

SEQ ID NO: 50451 - DNA, 601 bp, Human
gatttttgggagctgttgtgtctgaacacaccaggcacatctgggaggcacatctatgaatctccttcctcattagcatggcagctcttcaccctagggccccagatggggcagttgtcttacgctgcctcctgcgagaaattggagcccttctgccaaaataccattgctatgggtggaatgtttgtgccccccagaagtaaaaagttgaaaatgaatccccaaactgatggtatcaggaggtggggcctttggggaggtgatcaggtcgggggtgcagaatccttacgaacaggattcrtgcctttataaaagagaattacaaagcactctgatatccatgatctgatatgatcatttctctgggccctagagataagcattcacaggcaagaaaactgagcctttgagataacgggcagctttcctgagtcacacagctgtggtatggggaagacggggctggaccccagctctgctaactctcagctaaccctgggccacatgctgtgacacacagtaggccttccagagagccagggagcatgatgatactagcagcaacattaccaggtacaaagaggggaagaaaagtgtgtca

SEQ ID NO: 50452 - DNA, 601 bp, Human
aacagtttccattccactctttcctgcaggaagctctgtggctcataaaacattaaaatgagcactgctgccatttcatgaaatgcccagcctgtgaagaatgggttaagggatttttgggagctgttgtgtctgaacacaccaggcacatctgggaggcacatctatgaatctccttcctcattagcatggcagctcttcaccctagggccccagatggggcagttgtcttacgctgcctcctgcgagaaattggagcccttctgccaaaataccattgctatgggtggaatgtttgtgycccccagaagtaaaaagttgaaaatgaatccccaaactgatggtatcaggaggtggggcctttggggaggtgatcaggtcgggggtgcagaatccttacgaacaggattcatgcctttataaaagagaattacaaagcactctgatatccatgatctgatatgatcatttctctgggccctagagataagcattcacaggcaagaaaactgagcctttgagataacgggcagctttcctgagtcacacagctgtggtatggggaagacggggctggaccccagctctgctaactctcagc

SEQ ID NO: 50453 - DNA, 601 bp, Human
gggtatatgcccagtaatgggattgctgggtcaaatcttatttctggttctagatccttgaggaatcaccacactgccttcctcaatggttgaactaatttacattcccaccaacagtgtaaaagtgttcctatttcttactggggggttttgagcccacttagtgctcattctgtgctgtctcactgtccctcggagggggagcaatgacacttacaaccacctgctgtgggagcctatgggtggtggcagagcccgaacacctgcttccaggagccttgggcctgacactagtccctgyccctatgtgccctggttctgacctcagaacctggagctgagctggttcttagagagcatcttgttctacttctgatggtgcaggtagagaaacacagcccagagaggtgttgtgaccaaaccagaactcctgacccctgcccagtgtcaacactcagatcccacagtctctctgcacctgctatgtggaagaactcaacaagattgctgtccaagaagtcattggtgaggaagcccaggagatgctgcatgttgttttaggacgtgtgcccctgaacatatgctcccagcaccgtctcgc

SEQ ID NO: 50454 - DNA, 601 bp, Human
agcagatgaggaaacagtcatctggagagatgcatgatggccagttagtagcagagctggatttaccatggggaattttttaatttttattttactttaagttccaggatacatgtgcagaatgtacaggtttgttacataaataaacatctgccatggcggtttgctgtacctatcaacctgtcgtctaggttttaagtcctgcatgcattagctatttgtcctaatgctctccctcccctcaccccctgcccacaggccctggtgtgtgttgttcccctccctgtgtccatatgttctsattgttcagctcccacttatgagtgagagcatgcggtgtttggttttctgttcctgtgttagtttgctgaggacaatagctttcagcttcatccatgtccctgcaaagaatatgatctaattcctttttatggctacatagtattccatggtatatatgcaccatattttcttcatccagtctatcattgatgggcatttggattggttccatgtctttgctattgtaaacagtgctgcaataaacatatatatgcatgtgtctttacagtacaatgatttatattcctttgggtatatg

SEQ ID NO: 50455 - DNA, 601 bp, Human
tctgggattgttgctggaaaggccctttggtaccatccagcactatcctagccatgagcagatgaggaaacagtcatctggagagatgcatgatggccagttagtagcagagctggatttaccatggggaattttttaatttttattttactttaagttccaggatacatgtgcagaatgtacaggtttgttacataaataaacatctgccatggcggtttgctgtacctatcaacctgtcgtctaggttttaagtcctgcatgcattagctatttgtcctaatgctctccctcccctcascccctgcccacaggccctggtgtgtgttgttcccctccctgtgtccatatgttctcattgttcagctcccacttatgagtgagagcatgcggtgtttggttttctgttcctgtgttagtttgctgaggacaatagctttcagcttcatccatgtccctgcaaagaatatgatctaattcctttttatggctacatagtattccatggtatatatgcaccatattttcttcatccagtctatcattgatgggcatttggattggttccatgtctttgctattgtaaacagtgctgcaataa

SEQ ID NO: 50456 - DNA, 601 bp, Human
tcactgttcttggaggaagtttccatcctgacagaggtctgggattgttgctggaaaggccctttggtaccatccagcactatcctagccatgagcagatgaggaaacagtcatctggagagatgcatgatggccagttagtagcagagctggatttaccatggggaattttttaatttttattttactttaagttccaggatacatgtgcagaatgtacaggtttgttacataaataaacatctgccatggcggtttgctgtacctatcaacctgtcgtctaggttttaagtcctgcatrcattagctatttgtcctaatgctctccctcccctcaccccctgcccacaggccctggtgtgtgttgttcccctccctgtgtccatatgttctcattgttcagctcccacttatgagtgagagcatgcggtgtttggttttctgttcctgtgttagtttgctgaggacaatagctttcagcttcatccatgtccctgcaaagaatatgatctaattcctttttatggctacatagtattccatggtatatatgcaccatattttcttcatccagtctatcattgatgggcatttggattgg

SEQ ID NO: 50457 - DNA, 601 bp, Human
taaatgatatctccttactcccatgctagcagagtcctgttagattccagcagtgagaggcactgatgcatcgttagaggaagaaaggacctcttctgctagtcaaagttccagcaccatcagctgtggctcctggttagcctcagaggctgtggttcccacgtcatctgtgccaagaacatcagccacgttaacgagagcagctccagcatctgccctgctgccacagtcatgcttccagcagtgtcagtaagagatgggatcagttcttgaacccaaactcacctggcatcaaaactgkctctgtaagaccacagaatctgggatatgcatggtgtggcccaaaaaggaggacaaagtttgacacaaatggaatgtgactggaggagagtagctgaactcagcctcggcaaagaggagcttcttttaggcttcagaaattagaagtgagccaatgccaatgcaactctttcattttgcagagaggtgagcactttgaggccactgggcaggccagtggctgagctgggactgagccctttctcctggaaaggggagggagggtgaacgcacgggctccagggtgactctgcccaactcc

SEQ ID NO: 50458 - DNA, 601 bp, Human
gaaagagccttccaggcgaaggagccagtgcacaggtgctgagatgaaatgtgctgacagcatcccactacttatgaacttgttgcatttgccctattgggactcagccccacaaccacccttttagaactcttctgtgtcatgggggctagcagcctacaaactgcctgtccttactccctataaatgatatctccttactcccatgctagcagagtcctgttagattccagcagtgagaggcactgatgcatcgttagaggaagaaaggacctcttctgctagtcaaagttccagcacyatcagctgtggctcctggttagcctcagaggctgtggttcccacgtcatctgtgccaagaacatcagccacgttaacgagagcagctccagcatctgccctgctgccacagtcatgcttccagcagtgtcagtaagagatgggatcagttcttgaacccaaactcacctggcatcaaaactggctctgtaagaccacagaatctgggatatgcatggtgtggcccaaaaaggaggacaaagtttgacacaaatggaatgtgactggaggagagtagctgaactcagcctcggcaaagagg

SEQ ID NO: 50459 - DNA, 601 bp, Human
acagcaagtaagtctccatccgattgctataaacacctccaagaatgtactacagagctttaagcagcagcgtgctacagactgtactcagcctttggtatactttggttttcttcattcatgcaacaattatttagtaagtaaatgcctactgtatgccaggcactgctctaggtgctggggtttcagcaataagtaaaataggaaaagtgtccctcctcgcatggagcttttcattctcatggaggggagtgatactaagcaaattcatttataaacatatcatttcaggtcataatgmgtgctaaaaagaaaaataaatcaaggtaagtggcagtgagaagaggggacactgagctatggcagctgggggagatgtttttgagaagatgctatttcactagagacctaaaggaagtgagggaggtgtgggtcatgcagacatctggggaaagagccttccaggcgaaggagccagtgcacaggtgctgagatgaaatgtgctgacagcatcccactacttatgaacttgttgcatttgccctattgggactcagccccacaaccacccttttagaactcttctgtgtcatgggggcta

SEQ ID NO: 50460 - DNA, 601 bp, Human
tgcttcatggaagaggttggttttcctctgggtctagaatgcagaggtgctcacagcatgctggatgaaggtaatgaacctactcatatttgcagatgtctagtctgcagaaaagagtttcccaagaggagatgcctggattggatttgctttccttggctctgaggtcagaacaagggctccaggcaagagctctgatgtgtgggaccacaaggaagaactgcctgatggatgtgtccaaggatgaacgtgttttttgcacagtgagttccccatccctgaaggtgtgcaagaggagccwggtgaccacctgtcaatcatattgtggaagggacccaggcactggagaggaagatgaacaacagggtctctaaagcaagcccagaaccccagatgtgtgcaggctgtgtagatgattggaaggagatggggcaatgtcacccatggggtgggaggggacagagctgatacctccagtttaaactggctgcccttggagagagaggaaatggcctgggaaattgctatctatcagcccatttaaaaattacatgagtttatggaaggtaactctctcagaggagttcattctcttcactct

SEQ ID NO: 50461 - DNA, 601 bp, Human
taacttaggttcagtgtgtttttattaccgacagcagttggatccaaggtagggtatgtaacaaggggtgtaggaggagatattggagctcctatttatagctttataacgttttattatggaccgaacctggagccttcacatggcctatgtgactggggatcagggctccaccgtgtggagaagctgacagggtgccttcgatctgtcttttgaatgacatattgctgtttacttgtgcaatttaccagttagcagatttggaaatggtagtatttggtttcaattgaattaaccccartgaatatacaggtggcttgtaaagaatccccaaaagctgagcatagtagtacatgcctgtatgtagttccaactaatctttttgggaggctgaggtgggaggacctcttgagcccaggagttcgaggccagcctcagcaacacagtgagacctcatctcaagaaaaaaaacaaaacaaaagaaaccacaaattaaaggtaaaactaacaactcccacacaaagaaagacaggacaatcaatagtggaacccgctatctccatttcaggtgcaagcctgctgctagcctcaatgaccattg

SEQ ID NO: 50462 - DNA, 601 bp, Human
agacctttgtcaatataattaatatgtaagttatgaggaagtcatactgtaggaggatggactctggatccaatatgactcttgtccttacaagaggagaagagacacagatagatacacacagggaaggcaagcttgtgttcacggaggagaggttggagtgatgcagctgcaagccagggagcaccaaggactgctggtccccgtcggaagccagaagagggagcatggccctgctggcaccttgaccttggacttctggcctccagaactgtgagggaatccatttctgttgttcgatttttttttttttttttttacagagttccgttcttgttgcccagactgcagttcagtgatgcagtctccactcactgcaacctccgcctcccagattcaagtgattcttctgcctcagcctcccaagtagctgagattacaggcatccgccaccacgcctgtatttagtagagatggggtttcaccatgttggtcaggctggtctcgaactcctgacctcaggtgatccacccgcgttggcctcccaaagtgctgggattacaggcgtgagccaccacgcccaaccccatttctattgttg

SEQ ID NO: 50463 - DNA, 601 bp, Human
ggcacataatttgtgttcaataaacaattattgttattttatttcctctctgttgagccttgcatagaatgtacatccaacccatgtgttttgaatgaaatagtaaaaatcaagactcaggtgacagggaaggagaaggagcatgttataaacacagaagcgggggagggctgagcaaacaggaacagaggaaaattatgctagatgtcaaccaaattgcatcagcaggggggccagtatctgttcggtgttctccctactgttccgggcatggtgtgattttccaatggcaggctccccrtggtcctcagacaccttcagagcacagcagagtgacagacactgatgcatctgggggtggcccacacacgactgcaagcagatgagatggagcccgccagcctcccttggggtcctcagagagccacgctgttagcacaggtgccatcctggcctggagacccctccaggtgtctgtacacctgctgagcccacacctgggagtgccccctgagcaagagccacttaagggacgttgtggtacagtgggagagggcaggtcttggagctggagaaacctgggcttcacattgtctcaggg

SEQ ID NO: 50464 - DNA, 601 bp, Human
tcgagtcacctctcaaataaacttcccatcttcaaaaccttgactcaggctttgggggcacctgacaacaatcacaaagtcacctaaactggatgcctgtggtcacataacccagacactgccttccgtgtctgatttgtctgatctagtgactaagccccttcagcgtctacagtccatgtgctcctctctgcctgagcccaggcctgccttagttcaggcctcagcctctccccactgggctcattatccccaggctaatccccaggaagatgattgggccactcttctgcacacaaayctgtgctgtcttgcccttgccagcaggatccagtccaaattctcatctgccatgcagagcctcctcccacggtccctgtggcatctggaggctccccccatctctcttggctgctgccctggaaaaggcactcgtcctccattccacatacccccatggccttgcctctgtgccctgctcgtgctgttccttgtgtccagaacaccctgccactttgttgcctgcctaggacatccttttccgaggatcccctcagcagttacatcttttggagaccttccctgcccccatgatggctaa

SEQ ID NO: 50465 - DNA, 601 bp, Human
aaacaacccagattgtcccatcctctggtccagcctcattatcttatgaccaacaaggaacaaagacagaacctggtgcttcaatttgctgacgtgttccttgtgtccctgtagccggcactgcatgccacccatgtctctcctgcacatggacagcttcctacacccagcacccgtgcctctccgcctgcggctttccctgggcacaggtgtgtgctcagccctcagcagttaacacccccaggagcagccctcggttaagacaaagctgatgttaacagaggtatacctagcttcctcrcagacacctgagtgagtcctacgctgtcccccagaggtgactgggtgggtggggtcccagttgcccacagctgacacctgctcattattgaacctcaatgcctcctccacttccctgtgccatttcccagctggggaagtgatgcttcctcaattgtaccctctccttccctgtcccatttcccagctggagaagtggtgcttcctcaattgcatcctccatttccctgtcccatttcccagctgggcaagtggtgcttcctcgagtcacctctcaaataaacttcccatcttcaaaacc

SEQ ID NO: 50466 - DNA, 601 bp, Human
gtgtttgcacggagatgaagttcctgcccacaggtcacagggggtggcaagacctatagttctgagacccctgaaggtgccaggcatggggcttgggagctgggcatatggtgattaaaaaaagaaaaacaacccagattgtcccatcctctggtccagcctcattatcttatgaccaacaaggaacaaagacagaacctggtgcttcaatttgctgacgtgttccttgtgtccctgtagccggcactgcatgccacccatgtctctcctgcacatggacagcttcctacacccagcaccygtgcctctccgcctgcggctttccctgggcacaggtgtgtgctcagccctcagcagttaacacccccaggagcagccctcggttaagacaaagctgatgttaacagaggtatacctagcttcctcacagacacctgagtgagtcctacgctgtcccccagaggtgactgggtgggtggggtcccagttgcccacagctgacacctgctcattattgaacctcaatgcctcctccacttccctgtgccatttcccagctggggaagtgatgcttcctcaattgtaccctctccttccctgt

SEQ ID NO: 50467 - DNA, 601 bp, Human
ttcagccttatctcagacacctccaggaagccttctctgatgctttcctggctggacgacaagggaggagcaagccgaggagggccttgagtgtttgcacggagatgaagttcctgcccacaggtcacagggggtggcaagacctatagttctgagacccctgaaggtgccaggcatggggcttgggagctgggcatatggtgattaaaaaaagaaaaacaacccagattgtcccatcctctggtccagcctcattatcttatgaccaacaaggaacaaagacagaacctggtgcttcaayttgctgacgtgttccttgtgtccctgtagccggcactgcatgccacccatgtctctcctgcacatggacagcttcctacacccagcacccgtgcctctccgcctgcggctttccctgggcacaggtgtgtgctcagccctcagcagttaacacccccaggagcagccctcggttaagacaaagctgatgttaacagaggtatacctagcttcctcacagacacctgagtgagtcctacgctgtcccccagaggtgactgggtgggtggggtcccagttgcccacagctgacacctgctca

SEQ ID NO: 50468 - DNA, 601 bp, Human
tttttcagctacctgtccatccatccaccctccttgggcctcagttggggctggaacctgacacattcatctgcatatctggctctttcctcaatctggaatgttcttttgacctttctgcacctggctacttgcctcgttctttcagccttatctcagacacctccaggaagccttctctgatgctttcctggctggacgacaagggaggagcaagccgaggagggccttgagtgtttgcacggagatgaagttcctgcccacaggtcacagggggtggcaagacctatagttctgagasccctgaaggtgccaggcatggggcttgggagctgggcatatggtgattaaaaaaagaaaaacaacccagattgtcccatcctctggtccagcctcattatcttatgaccaacaaggaacaaagacagaacctggtgcttcaatttgctgacgtgttccttgtgtccctgtagccggcactgcatgccacccatgtctctcctgcacatggacagcttcctacacccagcacccgtgcctctccgcctgcggctttccctgggcacaggtgtgtgctcagccctcagcagttaacaccccc

SEQ ID NO: 50469 - DNA, 601 bp, Human
ttcataacctatgttttttttttctcttttcaccatggctgccaggaagctctcagacaaatgcaatgtttagcccttaacagaatttcctgaaacaaaaaatctctcttctttctcttaaaatttcctatcttccagctccatccatgtccctgcaaaggatatgatgtcattcctttttatggattcatagtattccatggtgtatatgtaccacattttctttatccagtctatcattgatgggcatttgggttgattccatgtcattgctactgtgaacagtgctcagcaaactaaygccggaacagaaaaccgaacaccacatgttctcacttataagtggcagctgaacaatgagaccacatggtcacagggaggggaacaacacacaccagagcccattggggggtggggtggggggagggagagcattagaaaaaatagctaatgcatgcagggcttaatacctaggtgatgggttgataggtgcagcaaaccactatggcgcatgttgacctatgtaacaaacctgcacatcctgcacatgtatcctggaactttaaaatttaaaaaaaaaattctgatcttttcttaaagc

SEQ ID NO: 50470 - DNA, 601 bp, Human
cgggtcccacctcctagccacacaccttagctgggggcggaacttggcaggggcctttgaaactatggagtccaaagcccttgtttaaaaatgggaaaacagaggcccagagagatgccatgatttgctcaacatcacccagctggctgggagaaaagctgagaacgtgggtctcttgactgtccgcaacgcaaggcagagcacacccagagttcaaacccgtctataacattgggcagttgtgtccctgttcatcttttgttatcattcctgcctccaatggctgttgtaataattgcakgatatcatatacattcaaccatggctcggagcttcccacactggagttcgtttgctgaatattcactaagcacctcctgtttgcctggctcatgagttcatcctcattgcaggtgtccggagaccagtaggatgtcacttggccaggatgccctgcagtccatgctattgtgaaaagaaggattgagcttaacgactgcaaggccccttccatgtgatcctctgaaatacaagaaaacttgagtggaaatagtcccaaagagtgaatcttaccaggactcaaacccaccctcatgattta

SEQ ID NO: 50471 - DNA, 601 bp, Human
agcccagtaggtggaggccaagtgacggggagcagctggcccgggtttctcactgcaggtttgtgtcccactgagatgggaagccaggcctctgactcttggtccagagctctgctccaggtcaggtaaagcacgctcagctggaaatattatcccgacttaaagattgaagatcatcaacatgggagggcagaacactctgaggatggggcctcatgactgctggctttgggagcagctgagattttttttcaacaggtgcttagtcagtgcggcttgcaggtacaccatagaggaattwatgaagttatacgggggatgcaaatggaaaaatgatgtccctgtggagaattgaattctgtttagaactgatggttctcagtgtaaatgcctcattcactacaggttccatattcggtctttaaggcttcaggtgttagcttgaagaaacaattcacttcccctctctactctctgagaacaagcagcgcctccttcagactgtctggcaaaacctcggtctcgtcaacaggaagagacaacaggactctcccaggatcactcagttaatgtaggtacagccactgacccaggcgcctgc

SEQ ID NO: 50472 - DNA, 601 bp, Human
ggaagaagacttgtccccatggctgcctagggatggcctggggacacagcctgagtgacatgcatgggggtgctctgagggggaccttggggccagatagctagggctcaaatccttttactattcctcactgtttgaccttggaaaagtttctttatgtctttaggcctaacagtgcggcctaactcacagggcagccatggggacagctcctggcccactctgagtgctacatgcatgtgcacttgatgaggtttgcagcccagtaggtggaggccaagtgacggggagcagctggccygggtttctcactgcaggtttgtgtcccactgagatgggaagccaggcctctgactcttggtccagagctctgctccaggtcaggtaaagcacgctcagctggaaatattatcccgacttaaagattgaagatcatcaacatgggagggcagaacactctgaggatggggcctcatgactgctggctttgggagcagctgagattttttttcaacaggtgcttagtcagtgcggcttgcaggtacaccatagaggaattaatgaagttatacgggggatgcaaatggaaaaatgatgtccc

SEQ ID NO: 50473 - DNA, 601 bp, Human
ggcctaaagccaggagcctctttcacactggcaacagactgacactcacactgaagcctggttttcatgctgaggacaaactgctcgaaaggaaggcagctgcctaaaataagtcactttaagcgacaggtctaattttagagaatggaatttgaaagcctattgtgtaaggcagagggaaaaaaaaatccaacaccaaaaaggaatttagaaataaataaataaatgttggttatcccaacttttgaataatttcttttttcctttttttttttttttttttttttttgtgatggagtcwtgctctgtgtcccaggctggggtgtagtggtgcgatcttggctcactgtagcctccgcctcccaggttccagtgattctcctgcctcagcctccagagtagctgggactacaggtgcctgccaccatgcctggctaatttttatatttagtagagatggggtttcaccatgttggccaggatggtctcaaactcctgacctcaggtgatccgcctgcctcagcctcccaaagtgctgggattacaggcacaagacactgcacccagcaaaattttgagtgacttctaaagtacgtgaaaa

SEQ ID NO: 50474 - DNA, 601 bp, Human
ggggacggggatgggcctaaagccaggagcctctttcacactggcaacagactgacactcacactgaagcctggttttcatgctgaggacaaactgctcgaaaggaaggcagctgcctaaaataagtcactttaagcgacaggtctaattttagagaatggaatttgaaagcctattgtgtaaggcagagggaaaaaaaaatccaacaccaaaaaggaatttagaaataaataaataaatgttggttatcccaacttttgaataatttcttttttcctttttttttttttttttttttttytgtgatggagtcatgctctgtgtcccaggctggggtgtagtggtgcgatcttggctcactgtagcctccgcctcccaggttccagtgattctcctgcctcagcctccagagtagctgggactacaggtgcctgccaccatgcctggctaatttttatatttagtagagatggggtttcaccatgttggccaggatggtctcaaactcctgacctcaggtgatccgcctgcctcagcctcccaaagtgctgggattacaggcacaagacactgcacccagcaaaattttgagtgacttcta

SEQ ID NO: 50475 - DNA, 601 bp, Human
aggtgaggggagcacagtggaggggcaggaactgctgtggccaccccagcaatggggacggggatgggcctaaagccaggagcctctttcacactggcaacagactgacactcacactgaagcctggttttcatgctgaggacaaactgctcgaaaggaaggcagctgcctaaaataagtcactttaagcgacaggtctaattttagagaatggaatttgaaagcctattgtgtaaggcagagggaaaaaaaaatccaacaccaaaaaggaatttagaaataaataaataaatgttggttrtcccaacttttgaataatttcttttttcctttttttttttttttttttttttttgtgatggagtcatgctctgtgtcccaggctggggtgtagtggtgcgatcttggctcactgtagcctccgcctcccaggttccagtgattctcctgcctcagcctccagagtagctgggactacaggtgcctgccaccatgcctggctaatttttatatttagtagagatggggtttcaccatgttggccaggatggtctcaaactcctgacctcaggtgatccgcctgcctcagcctcccaaagtg

SEQ ID NO: 50476 - DNA, 601 bp, Human
tttttcaggatgggagactgaagcccagggaagtgactatgattggcttctgtgtttaagaaagaaggaatcccaaggaaggaagggtcatcccaagtagataagagaaccaccatgaccctgggcattctggaagataagggaaggttcaagaaaatgaaggcttccccacactgggcttgacaattggtattgatccaattttcagcccaagaactccctatctcctgccctcacctccttttctcccccagacactcaggtgcccaccatgtggcatgggctgctctggtgctggagrcacagggttgataagatgcagcctccatctcccaggatggagacccactaatagctctctccaggtgaggggagcacagtggaggggcaggaactgctgtggccaccccagcaatggggacggggatgggcctaaagccaggagcctctttcacactggcaacagactgacactcacactgaagcctggttttcatgctgaggacaaactgctcgaaaggaaggcagctgcctaaaataagtcactttaagcgacaggtctaattttagagaatggaatttgaaagcctattgtgtaagg

SEQ ID NO: 50477 - DNA, 601 bp, Human
acacaacgatttcccaactaagtggttagaggaacacaccaggaaccctgtaatgcatgggtatcccaccaagtgcaaagacccaggcagcagtccaccgccggtgagcacccagaaccaatgtcaccaggcccatatggctcattcacagctggcactctgatcctctttgctcttcttttacatctatttctaacacacttgggtgtcttgtttcccaaccaagactgcatatcaggaagcagcagattttgaaactgcatggcattgagagaggagaaaacaatgctagaaacagtcrtgctgatgacagcaaggttgggaggagattcatgcaagctgagcagctgccacctgtgagatattttacataattccacagattcctcacagcagttgtgcaaactgagtattatcatccccatttttcaggatgggagactgaagcccagggaagtgactatgattggcttctgtgtttaagaaagaaggaatcccaaggaaggaagggtcatcccaagtagataagagaaccaccatgaccctgggcattctggaagataagggaaggttcaagaaaatgaaggcttccccacactgg

SEQ ID NO: 50478 - DNA, 601 bp, Human
tttctggcctggtcttctttgaactctgacatgagtgattgaggctcagaggggtgaagtgtctcacccaggactacacagctgggaagtcagaggatgtgggctggaaccatagcctccctggtggtctcagtgtggggctccttcaacaaaataatagctaagattatggagcaccacctatgtgaatgaccccatgctgaacttatttatttgagacggagtttcgctcttgttgcccaggctggagtgcaatggtgcgatctcagctcattgcaacctctgcctcctgggttcaagygattctcctgcctcagcctcctgagtatctgggattacaggcatgtgccaccacgtccagctaattttctatttttagtagagacttgtttctccatgttggtcaggctgatcttgaactcccgacctcaagtgatctgcccaccccaggctcccaaagtgctgggattacaggtgtgagccaccatgcccagctgctgaactttaaatgcatcctttcatctatcttcaccaccactctacagctggggaaactgaggcacggaggagtcatgacaacttgtccaagatcccataactc

SEQ ID NO: 50479 - DNA, 601 bp, Human
ctgccaagcaaagcaagaccctctccaccaagggcaggctgtgtgcttcacggcaatgtatggaagcccactctctctcagcagagctgcttcatccacagccccaagcaaatgtcagctcccattctcatcagactttgcttcagcttggcagtggaggcagaggaatgagctgactctcccacatctctcactgggaccagttgcaccccgactacagctgcgcaccttacgcttcacaaaacaggacctgtgggtcactcactggccttgaagggttagctgggcttgaagctctggyccctggtggttgaatctccaaggcagggcaattgaccatctaacgtcccctctctgtgagctcctattcttgggagggacgggagtctgtgggctggacagaagggatttgaccccagcaattgctatggtggtgagaacgtgaatgcagatttcaaccaccccggccttgctttatatccttagagcacatgtgagcatgaaactggacagcatatctagatgcccaacagccggtccatgctcagtaaaaggctgcttccttctctgacctccactgtctttctttataaaaatccag

SEQ ID NO: 50480 - DNA, 601 bp, Human
agggatgaatcactaccggcagctgccaagcaaagcaagaccctctccaccaagggcaggctgtgtgcttcacggcaatgtatggaagcccactctctctcagcagagctgcttcatccacagccccaagcaaatgtcagctcccattctcatcagactttgcttcagcttggcagtggaggcagaggaatgagctgactctcccacatctctcactgggaccagttgcaccccgactacagctgcgcaccttacgcttcacaaaacaggacctgtgggtcactcactggccttgaagggytagctgggcttgaagctctggtccctggtggttgaatctccaaggcagggcaattgaccatctaacgtcccctctctgtgagctcctattcttgggagggacgggagtctgtgggctggacagaagggatttgaccccagcaattgctatggtggtgagaacgtgaatgcagatttcaaccaccccggccttgctttatatccttagagcacatgtgagcatgaaactggacagcatatctagatgcccaacagccggtccatgctcagtaaaaggctgcttccttctctgacctccact

SEQ ID NO: 50481 - DNA, 601 bp, Human
aatttcagagaagaagggggcttatctattgtaaatccccaaacctatcccctacatgacgtaactgcattcccagcacagcccagtgagggagctatcactgctccatttaacagatgtgaaactgaggctcagccaggtaagggtgacccagctatgagtggcagagctgagatcgagccctgatcatcccaaacatttctactgtcctctgctacctctgggtgagaaggaatctgttttccttccagagatgctaggggagggtgctaagtcctatggagcagggcaagtggaattrcccgagaggtgagaggaaatgggagcaccagggatgaatcactaccggcagctgccaagcaaagcaagaccctctccaccaagggcaggctgtgtgcttcacggcaatgtatggaagcccactctctctcagcagagctgcttcatccacagccccaagcaaatgtcagctcccattctcatcagactttgcttcagcttggcagtggaggcagaggaatgagctgactctcccacatctctcactgggaccagttgcaccccgactacagctgcgcaccttacgcttcacaaaacagga

SEQ ID NO: 50482 - DNA, 601 bp, Human
cttatgaagccatgctgtctaatccagctccactcaaaatagagctaacattttcatccccatctggttcttgtgcctctctctgtctccccctctctaaccttttctgaatttcagagaagaagggggcttatctattgtaaatccccaaacctatcccctacatgacgtaactgcattcccagcacagcccagtgagggagctatcactgctccatttaacagatgtgaaactgaggctcagccaggtaagggtgacccagctatgagtggcagagctgagatcgagccctgatcatcycaaacatttctactgtcctctgctacctctgggtgagaaggaatctgttttccttccagagatgctaggggagggtgctaagtcctatggagcagggcaagtggaattgcccgagaggtgagaggaaatgggagcaccagggatgaatcactaccggcagctgccaagcaaagcaagaccctctccaccaagggcaggctgtgtgcttcacggcaatgtatggaagcccactctctctcagcagagctgcttcatccacagccccaagcaaatgtcagctcccattctcatcagactttg

SEQ ID NO: 50483 - DNA, 601 bp, Human
ccgtcttccctggtttcaattctccccatagagacactgctatagatgtcccttagtaggttagtgaagagagtcattgtacataaaattctaagttcagtgagggacagttataacttttgcagggaaattgatgaagctggaaaccatcattctcagcaaactaacataagaacagaaaaccaaacaccacatgttctcactcataagtggaagttgaacaatgagaatacatggaaacagagaggggaacatcatacaccagggcctgttggggtgtgggggggctagaggagggatrgcattaggagaaatatccaatgcagatgacaggttgatgggtgcagcaaaccatcatggcacgtgtatacctatgtaacaaacctgcacattctccacaggtatcccagaacttaaagtataataataataataataaagcaataaaagccatatttagtcttatattcattcatgcaccaaaaggcagaaatcagtccacagatcctctcccgctgcccaggggctacaggggtcctgccgggctggccctgtctgccccggggcagacctgtacatcacacacactgccagtcttaat

SEQ ID NO: 50484 - DNA, 601 bp, Human
ggctcctctcacccctcacaaccccgtcttccctggtttcaattctccccatagagacactgctatagatgtcccttagtaggttagtgaagagagtcattgtacataaaattctaagttcagtgagggacagttataacttttgcagggaaattgatgaagctggaaaccatcattctcagcaaactaacataagaacagaaaaccaaacaccacatgttctcactcataagtggaagttgaacaatgagaatacatggaaacagagaggggaacatcatacaccagggcctgttggggkgtgggggggctagaggagggatggcattaggagaaatatccaatgcagatgacaggttgatgggtgcagcaaaccatcatggcacgtgtatacctatgtaacaaacctgcacattctccacaggtatcccagaacttaaagtataataataataataataaagcaataaaagccatatttagtcttatattcattcatgcaccaaaaggcagaaatcagtccacagatcctctcccgctgcccaggggctacaggggtcctgccgggctggccctgtctgccccggggcagacctgtaca

SEQ ID NO: 50485 - DNA, 601 bp, Human
taatattcgtgtaaaacaagaaccttcatgttctgcacctgtttctcacttgagtgaacgttagactccatcgttagcctgaacctttgctgtcacatccatggtgtacagaggtagtgcctaataaatccactaattcctattgttctcagggctgtgacagaagctgacattataacattatcctgaaaactctatgtccattgaatatgtttatacaattgcttcccctttagaaggtaactatgatccccagtgcaccgtcagggttggattccagaagtgtaacagcctttcttartcatcagccaaattcactgattttcaatggccaacgttctctagggaccctcttaatgccctcaggctgccaggctgtcacccatgtgaaggtgtctgacatttgtgttattcacagccgtggttctgatccccatggcctgaccagctcatggtcctgaggctcccagccctaggtcccacttaatgtgaatcctcttatgatgtggccagcacctccttctggctcctctcacccctcacaaccccgtcttccctggtttcaattctccccatagagacactgctatagatgtccctt

SEQ ID NO: 50486 - DNA, 601 bp, Human
cgcattttgctctttgtttctggatgaagctcttgtttctatagatctgttttattgccagatgtttttagcaaaaattattcatgcattggggggaagatataggacctacttatatctacagatggttaaattttgtgaagaaagtaaacctccataaagttatgggcataccaagagatgccagtgaaaactacgacacccatttcttcgagcttgcaggcatggatacatccatctattggcaaaaacaggttttaatattcgtgtaaaacaagaaccttcatgttctgcacctgtytctcacttgagtgaacgttagactccatcgttagcctgaacctttgctgtcacatccatggtgtacagaggtagtgcctaataaatccactaattcctattgttctcagggctgtgacagaagctgacattataacattatcctgaaaactctatgtccattgaatatgtttatacaattgcttcccctttagaaggtaactatgatccccagtgcaccgtcagggttggattccagaagtgtaacagcctttcttaatcatcagccaaattcactgattttcaatggccaacgttctct

SEQ ID NO: 50487 - DNA, 601 bp, Human
catcagacaagaactgattaggagtttggagacctggctccatcttgaactagctgtgtgacctcaggcaattcaccctgccatgaggagattcctactcctccccagtcaaatgaacatgaccatgcttattttgcctgtcccatgaggtgtcaggaactgggtgagaattgtcactcttcagtattcactttgaggattttagcctggacacaaatgatgtctgggttctccccatcccagccatttctttaaaaccaagagtttgctgaatgatagaaaaccacattgtcctaactgwtgaattctgatggggacaccccctgcattaaaggaccttatgaacatttatgaacagtttgatacttattcagcagaagtgttagagcacattgctcataacctgtcaggtccaacgttagctggccacactctcgcattttgctctttgtttctggatgaagctcttgtttctatagatctgttttattgccagatgtttttagcaaaaattattcatgcattggggggaagatataggacctacttatatctacagatggttaaattttgtgaagaaagtaaacctccataaagttat

SEQ ID NO: 50488 - DNA, 601 bp, Human
tgatgcccatggcatcagacaagaactgattaggagtttggagacctggctccatcttgaactagctgtgtgacctcaggcaattcaccctgccatgaggagattcctactcctccccagtcaaatgaacatgaccatgcttattttgcctgtcccatgaggtgtcaggaactgggtgagaattgtcactcttcagtattcactttgaggattttagcctggacacaaatgatgtctgggttctccccatcccagccatttctttaaaaccaagagtttgctgaatgatagaaaaccacaytgtcctaactgatgaattctgatggggacaccccctgcattaaaggaccttatgaacatttatgaacagtttgatacttattcagcagaagtgttagagcacattgctcataacctgtcaggtccaacgttagctggccacactctcgcattttgctctttgtttctggatgaagctcttgtttctatagatctgttttattgccagatgtttttagcaaaaattattcatgcattggggggaagatataggacctacttatatctacagatggttaaattttgtgaagaaagtaaacct

SEQ ID NO: 50489 - DNA, 601 bp, Human
ccccacaacaggccctggtgtgtgatgttctcctgcattactgggaatgtccagctaaaagactacacttcccagttttcttgcagccaagtgtggcagcgagataaaaacagtaatgttggtggggcttccgggaagtttcctttttttaaaaggaacttttcatcaaggaggtctgcttccatttttgtttgtccttccttctttctgtgtcaggatggtggaggtgatggctggagcctcagcagccttttttggattactaggtgacttcagaacagcactgccattaacctccatygtaactttatgagaaccagaaaaggtcgccactacacaaaacgctttactgtcatccactgaaaaattgccatagtaaatccacaatgcatacaaggtgaaagatgttccccagagttgggtaatgcacaacctgtttaactatacatagagcccctgccttgggataaaagccacttgtttagatgctggaccaggaagttagaaagagttagcctgtgcccttactgactacactggttctgtaatttattatccaaacatgaggacttttgagagtgttgataattatgctaggatg

SEQ ID NO: 50490 - DNA, 601 bp, Human
tattatactttaagttctagggtacatgtgcacaatgtgcaggttagttacatatgtatacatgtgccatgttggtgtgctgcacccattaactcgtcatttacattaggtatatctcctaatgctatccctccccactacccccaccccacaacaggccctggtgtgtgatgttctcctgcattactgggaatgtccagctaaaagactacacttcccagttttcttgcagccaagtgtggcagcgagataaaaacagtaatgttggtggggcttccgggaagtttcctttttttaaaaggaacttttcatcaaggaggtctgcttccatttttgtttgtccttccttctttctgtgtcaggatggtggaggtgatggctggagcctcagcagccttttttggattactaggtgacttcagaacagcactgccattaacctccattgtaactttatgagaaccagaaaaggtcgccactacacaaaacgctttactgtcatccactgaaaaattgccatagtaaatccacaatgcatacaaggtgaaagatgttccccagagttgggtaatgcacaacctgtttaactatacatagagcc

SEQ ID NO: 50491 - DNA, 601 bp, Human
tttttatttatatatatattttattatactttaagttctagggtacatgtgcacaatgtgcaggttagttacatatgtatacatgtgccatgttggtgtgctgcacccattaactcgtcatttacattaggtatatctcctaatgctatccctccccactacccccaccccacaacaggccctggtgtgtgatgttctcctgcattactgggaatgtccagctaaaagactacacttcccagttttcttgcagccaagtgtggcagcgagataaaaacagtaatgttggtggggcttccgsgaagtttcctttttttaaaaggaacttttcatcaaggaggtctgcttccatttttgtttgtccttccttctttctgtgtcaggatggtggaggtgatggctggagcctcagcagccttttttggattactaggtgacttcagaacagcactgccattaacctccattgtaactttatgagaaccagaaaaggtcgccactacacaaaacgctttactgtcatccactgaaaaattgccatagtaaatccacaatgcatacaaggtgaaagatgttccccagagttgggtaatgcacaacc

SEQ ID NO: 50492 - DNA, 601 bp, Human
ttttttatttatatatatattttattatactttaagttctagggtacatgtgcacaatgtgcaggttagttacatatgtatacatgtgccatgttggtgtgctgcacccattaactcgtcatttacattaggtatatctcctaatgctatccctccccactacccccaccccacaacaggccctggtgtgtgatgttctcctgcattactgggaatgtccagctaaaagactacacttcccagttttcttgcagccaagtgtggcagcgagataaaaacagtaatgttggtggggcttccrggaagtttcctttttttaaaaggaacttttcatcaaggaggtctgcttccatttttgtttgtccttccttctttctgtgtcaggatggtggaggtgatggctggagcctcagcagccttttttggattactaggtgacttcagaacagcactgccattaacctccattgtaactttatgagaaccagaaaaggtcgccactacacaaaacgctttactgtcatccactgaaaaattgccatagtaaatccacaatgcatacaaggtgaaagatgttccccagagttgggtaatgcacaac

SEQ ID NO: 50493 - DNA, 601 bp, Human
ctttttttccttattttattattttattttttatttatatatatattttattatactttaagttctagggtacatgtgcacaatgtgcaggttagttacatatgtatacatgtgccatgttggtgtgctgcacccattaactcgtcatttacattaggtatatctcctaatgctatccctccccactacccccaccccacaacaggccctggtgtgtgatgttctcctgcattactgggaatgtccagctaaaagactacacttcccagttttcttgcagccaagtgtggcagcgagataraaacagtaatgttggtggggcttccgggaagtttcctttttttaaaaggaacttttcatcaaggaggtctgcttccatttttgtttgtccttccttctttctgtgtcaggatggtggaggtgatggctggagcctcagcagccttttttggattactaggtgacttcagaacagcactgccattaacctccattgtaactttatgagaaccagaaaaggtcgccactacacaaaacgctttactgtcatccactgaaaaattgccatagtaaatccacaatgcatacaaggtgaaagatg

SEQ ID NO: 50494 - DNA, 601 bp, Human
ggtggtctctggattaaactcagagtcccaaggtggagaggcgtggatgctcatttttcattttcatcccaccttctccctttcttcattactttttttccttattttattattttattttttatttatatatatattttattatactttaagttctagggtacatgtgcacaatgtgcaggttagttacatatgtatacatgtgccatgttggtgtgctgcacccattaactcgtcatttacattaggtatatctcctaatgctatccctccccactacccccaccccacaacaggcccyggtgtgtgatgttctcctgcattactgggaatgtccagctaaaagactacacttcccagttttcttgcagccaagtgtggcagcgagataaaaacagtaatgttggtggggcttccgggaagtttcctttttttaaaaggaacttttcatcaaggaggtctgcttccatttttgtttgtccttccttctttctgtgtcaggatggtggaggtgatggctggagcctcagcagccttttttggattactaggtgacttcagaacagcactgccattaacctccattgtaactttatgagaa

SEQ ID NO: 50495 - DNA, 601 bp, Human
agtctcgatgccccctgtactcaaggtgacgtatgggatctttgccggagggatcccagcttttccaaagatgctgttggtatagaaccaaatctgtaattcaggaaagaatgagcagagagaatggtcagtggaaggacttaatctattttctaaatcaaatttgggtatcaggtggtctctggattaaactcagagtcccaaggtggagaggcgtggatgctcatttttcattttcatcccaccttctccctttcttcattactttttttccttattttattattttattttttatttatatatatattttattatactttaagttctagggtacatgtgcacaatgtgcaggttagttacatatgtatacatgtgccatgttggtgtgctgcacccattaactcgtcatttacattaggtatatctcctaatgctatccctccccactacccccaccccacaacaggccctggtgtgtgatgttctcctgcattactgggaatgtccagctaaaagactacacttcccagttttcttgcagccaagtgtggcagcgagataaaaacagtaatgttggtggggcttccgggaagtttcc

SEQ ID NO: 50496 - DNA, 601 bp, Human
caaagtctcgatgccccctgtactcaaggtgacgtatgggatctttgccggagggatcccagcttttccaaagatgctgttggtatagaaccaaatctgtaattcaggaaagaatgagcagagagaatggtcagtggaaggacttaatctattttctaaatcaaatttgggtatcaggtggtctctggattaaactcagagtcccaaggtggagaggcgtggatgctcatttttcattttcatcccaccttctccctttcttcattactttttttccttattttattattttattttttatttatatatatattttattatactttaagttctagggtacatgtgcacaatgtgcaggttagttacatatgtatacatgtgccatgttggtgtgctgcacccattaactcgtcatttacattaggtatatctcctaatgctatccctccccactacccccaccccacaacaggccctggtgtgtgatgttctcctgcattactgggaatgtccagctaaaagactacacttcccagttttcttgcagccaagtgtggcagcgagataaaaacagtaatgttggtggggcttccgggaagtt

SEQ ID NO: 50497 - DNA, 601 bp, Human
cttcagtacccactttgaggttttgggtcaatagcccagacacaaatgatgtctgggttctccccatcccagctatttctttaaaaccaagagtttgctgaatgataggaaaccacattgtcctaattgatgaattctgatggggaaagcctgtgccttaaaggaccttatgaacattcccactgtgctgtgtaaccccctgtggcattctcaggagtaaccctcagttgacttacagagaagacggcagccaaagtctcgatgccccctgtactcaaggtgacgtatgggatctttgccrgagggatcccagcttttccaaagatgctgttggtatagaaccaaatctgtaattcaggaaagaatgagcagagagaatggtcagtggaaggacttaatctattttctaaatcaaatttgggtatcaggtggtctctggattaaactcagagtcccaaggtggagaggcgtggatgctcatttttcattttcatcccaccttctccctttcttcattactttttttccttattttattattttattttttatttatatatatattttattatactttaagttctagggtacatgtgcacaa

SEQ ID NO: 50498 - DNA, 601 bp, Human
ttgttgcctgaggttcccacattgcagtgttgcctgccccggaggtgtcaggaactgggtgagaattgtcgctcttcagtacccactttgaggttttgggtcaatagcccagacacaaatgatgtctgggttctccccatcccagctatttctttaaaaccaagagtttgctgaatgataggaaaccacattgtcctaattgatgaattctgatggggaaagcctgtgccttaaaggaccttatgaacattcccactgtgctgtgtaaccccctgtggcattctcaggagtaaccctcagktgacttacagagaagacggcagccaaagtctcgatgccccctgtactcaaggtgacgtatgggatctttgccggagggatcccagcttttccaaagatgctgttggtatagaaccaaatctgtaattcaggaaagaatgagcagagagaatggtcagtggaaggacttaatctattttctaaatcaaatttgggtatcaggtggtctctggattaaactcagagtcccaaggtggagaggcgtggatgctcatttttcattttcatcccaccttctccctttcttcattactttttttcc

SEQ ID NO: 50499 - DNA, 601 bp, Human
atccttgggtcatagtcaacctcctccattggactgtgagctcctacaggcaggcaccatggcaaaggccctctgtaagcccagcacagggccaacagcctgaccatgggaggagctggcaagagcttgctaaatggcggggtaccaactggccatggtccagatgactgagatccactgggtccaaacttaaaggcagtggcaggagtgctctccagaggctgagactctgagttctgattttagaaaggactcttccttcccttccaggactgtgaagtcatttaccctcctttctggrgtttccaaggaatactttgcccaaaattgtcagcttttaaggaagatgatctgcctgccagagcatcgggatgagaaggagtggcttctggagtctggaatgaataagaatggcttcccgtgaagtcttcttggaccaagggaagaagtgtagccacttcctcagtgtgcccctctttcaaacaatggcagtcattggactttcaggcatgatgtgagcattcatgaggtcccatgtagaacactttggggtgtcggtggcagggacagtaggggccccatgatgttctctttccccact

SEQ ID NO: 50500 - DNA, 601 bp, Human
gtgacagctggcacagtatgagtgcaccttaggtgtctgtggaatggatgaatgcatgcctgcatgaaagaatccaccacccaagctctgaatcatcacttcctgctcagaggaacctcccacacagagattcctgcacctctagaacagcaaaacatcatttatccttgggtcatagtcaacctcctccattggactgtgagctcctacaggcaggcaccatggcaaaggccctctgtaagcccagcacagggccaacagcctgaccatgggaggagctggcaagagcttgctaaatggyggggtaccaactggccatggtccagatgactgagatccactgggtccaaacttaaaggcagtggcaggagtgctctccagaggctgagactctgagttctgattttagaaaggactcttccttcccttccaggactgtgaagtcatttaccctcctttctggggtttccaaggaatactttgcccaaaattgtcagcttttaaggaagatgatctgcctgccagagcatcgggatgagaaggagtggcttctggagtctggaatgaataagaatggcttcccgtgaagtcttcttggacc

SEQ ID NO: 50501 - DNA, 601 bp, Human
tggcacagagcaggggcccaagtgagcacttgctgagtgctggaggaagaagcatcctggccttgggctcgtcttctagtctttgagaggtagcagggcagcttcggcattttccatgtctgcttctcttcaggaatattaataacaagagtaactgcgtgagtttcccagggctgccgtgataaggtcccacagacagagcggcttcagcaatagaaacgtgttgtctcacagttctggaggctggaagtccaagatcaaagtgtctgcagggccctgcctctggaggcgccagggaagrgtctgttgcagggccctctcctggcttctagtgtgttttggctttcagcagcacaattctaatttttagagggcgttctgcctgtgtgtatgcctgcatctaaattttcccttttcataaggacagtcgtattggattaggggcccaccctattccagtataaccgtatcttaccttaactaattacaactgcaatgatcctatttccaattcaagtcacattccgaggtactagggacttcaacacatgcattttgaggaggtgcaattcaacccataacaatagtgaacatttattga

SEQ ID NO: 50502 - DNA, 601 bp, Human
ttgctacaaccctcatttctcctaaggtcctgtaacatttgttaaataaactgggaacttgatctagtattttagtggaggaagggtgtagtttcttctagtctgtgacctatagaaatgccatagaatcattatttatcaatgaaaaaggaatgtctgtcaagggaaattaattgaactcagtcctttcgaggccagttctagagcacatgtcagtgtgatgattcacagggaaaaccggcctctctccaagccttgtgacaacgctgtttctacccttgtcaccctctgccattatctrttttgtctacagcagtcagagggatttaaagcatgacctggcactctccttttaacacccctgtccactaaaagccttatagacagcaaagaaaacaatcaacagagtgaagagaaaacctacaaaatgggagaaaagatttgcaaaccatatttgaatcccctcaagccccatgcccccccaccagccccttggcccctcaagcggcagccacatccttgcccctgccttgggctgctgcagacatccctgtcacctctcagattcttgctgtctgtcctagagggagacccattggct

SEQ ID NO: 50503 - DNA, 601 bp, Human
attcaaggtgagatttgggtggggacacagagccaaaccatatcaacgagagtccacatttctctgcctgcttcctgctcaggcaatggtaacactaatgtttttgatctaagctctgaacatgaaaagccatttagcctgagttttaacttctcagatctggggatgccacccagctcagactgagctcaggcccccaggggtttgggttgggagccaaggggaaaatctagctttgtttctgcttgctacaaccctcatttctcctaaggtcctgtaacatttgttaaataaactgggracttgatctagtattttagtggaggaagggtgtagtttcttctagtctgtgacctatagaaatgccatagaatcattatttatcaatgaaaaaggaatgtctgtcaagggaaattaattgaactcagtcctttcgaggccagttctagagcacatgtcagtgtgatgattcacagggaaaaccggcctctctccaagccttgtgacaacgctgtttctacccttgtcaccctctgccattatctgttttgtctacagcagtcagagggatttaaagcatgacctggcactctccttttaa

SEQ ID NO: 50504 - DNA, 601 bp, Human
ggggaagcaaactcatccttcttcatgtggtggcaggaaggagaatgagtgtccagtgaagggggaagtcccttataaaaccatcagctctcatgagaactcactcactatcatgagaacagcatgagggtaactgctcctatgattcaattacctcccaccggtccctcccatgacacatggggattgtgggaactataattcaaggtgagatttgggtggggacacagagccaaaccatatcaacgagagtccacatttctctgcctgcttcctgctcaggcaatggtaacactaatgyttttgatctaagctctgaacatgaaaagccatttagcctgagttttaacttctcagatctggggatgccacccagctcagactgagctcaggcccccaggggtttgggttgggagccaaggggaaaatctagctttgtttctgcttgctacaaccctcatttctcctaaggtcctgtaacatttgttaaataaactgggaacttgatctagtattttagtggaggaagggtgtagtttcttctagtctgtgacctatagaaatgccatagaatcattatttatcaatgaaaaaggaatgt

SEQ ID NO: 50505 - DNA, 601 bp, Human
tcatgctgctataaagaactgccgaagactgggtagtttacaaaggaaagaggtttaattgacaaagttccacagggctggggaggcctcaggaaacttacaatcatggtggaaggggaagcaaactcatccttcttcatgtggtggcaggaaggagaatgagtgtccagtgaagggggaagtcccttataaaaccatcagctctcatgagaactcactcactatcatgagaacagcatgagggtaactgctcctatgattcaattacctcccaccggtccctcccatgacacatggggaytgtgggaactataattcaaggtgagatttgggtggggacacagagccaaaccatatcaacgagagtccacatttctctgcctgcttcctgctcaggcaatggtaacactaatgtttttgatctaagctctgaacatgaaaagccatttagcctgagttttaacttctcagatctggggatgccacccagctcagactgagctcaggcccccaggggtttgggttgggagccaaggggaaaatctagctttgtttctgcttgctacaaccctcatttctcctaaggtcctgtaacatttgt

SEQ ID NO: 50506 - DNA, 601 bp, Human
gaagctggtggggccggacacaggggagccaaaggatgttatcagagggatggggagtaaatcaggaaaatttggtgggaagtaaagactcaggagcacatcccaagagtcagagggtgagctgcaggaacggacttgtgggtatgtccttggccaaactcaaaaatagagctacttacttaaaagatattattcagagcttggggtgggtgggagtggaaactgcaggggaatgtgcttccagggcaaaaccccaccttttctgcttggggatgctggggcactgactctgtttcttccyttcctcatccccacccagtcctcaccccatgaggataacctgtcataaccagaagtattagttcattctcatgctgctataaagaactgccgaagactgggtagtttacaaaggaaagaggtttaattgacaaagttccacagggctggggaggcctcaggaaacttacaatcatggtggaaggggaagcaaactcatccttcttcatgtggtggcaggaaggagaatgagtgtccagtgaagggggaagtcccttataaaaccatcagctctcatgagaactcactcactatcatgaga

SEQ ID NO: 50507 - DNA, 601 bp, Human
aagtgaagcactccccctcatgctcttactcttctcaaaaaaggcaaaatgtggttctcaacaggtttgtgaggatacattcatattgttcttggaaatttgggcaagtagaaaaaaaaatagctcttcaaggagcagagaaagagacactggatgtccagatgacttaggagtcagggcttccatagcaggagcatcgagttggcagagggcagtgggcagtgggaacagccgccacttagaactgacacaaggggatggtaaatgctgtctccaccctgcatcccatgagccacatccrcactttcctttggtgagtgaagctggtggggccggacacaggggagccaaaggatgttatcagagggatggggagtaaatcaggaaaatttggtgggaagtaaagactcaggagcacatcccaagagtcagagggtgagctgcaggaacggacttgtgggtatgtccttggccaaactcaaaaatagagctacttacttaaaagatattattcagagcttggggtgggtgggagtggaaactgcaggggaatgtgcttccagggcaaaaccccaccttttctgcttggggatgctggggc

SEQ ID NO: 50508 - DNA, 601 bp, Human
gcgtccaaatttgatgtaatgtgctttcatattatttcacatacattactttatatacactttatttattgctcattgtctatattgtattcaatgtgtatatctctctatataaactgcatgcggtactccgtgcatggcaggagttcctgactttctcagggactacagcgtcctacatgagttcttccctgtgccagggtgagccttttggtcgtagaagatgccccattctctgtgtccaactccaggccggggcctttttaaattcttctgatttacataatccccatccttgccyggcttgatgcttctgggtctgtgggccgtgtggactgattgtgcgcaggggccctagaagcctaccaggaggaagccctgttggttgggctctgcctccctcaggacgtcctgtctgactgctccctgcagggatcccagccaaaggcaagagctccctctttagtcagctggtgtgatttcctcaacaggctttactagagccgtactccgttgagcaaccattaatggtattgaatgcatgacaactactatggccatttctttaaacatgatgcatgacacacactctctctctccc

SEQ ID NO: 50509 - DNA, 601 bp, Human
aatttttgtcaccattttggtgaacaatggtatctcactgttggttttagttttaatttccctggtgacagtaacaatgttgaagatcttttcatgtgatttttgatgttttggaactcttctttggtaaagcatgtgttcatatattttgctcattttcaagtgggcagttggtcttatttttgagttttaagagttctttatgtattctgaattcacgtcccctctcaaatgtgttttataggtatgttctccatgtctgtgacttacctttttatctccttaacaataccttttaaayagtcacagtttttaattttgatgaaatccaatgtatcatttgaaaaatggtttgtgattctgtatctttcctatcctaatgttgcaaaactttctcctttgcttctagaagttttagagtttagcttttatgtctagatacgtggtccattttgagttaattttttgtatggtataataagggttgccattcacatttttccatgtggatatctactttttatgacactacttgttgaaaagactatcctttcctcattgaattacttcagcaactttttgttttctggattccattctg

SEQ ID NO: 50510 - DNA, 601 bp, Human
catgagtgaagacattaactcagacgaacagcagactgaaggctactgatgtcagctagggatgactgtcaaaatcctaatgctcccaggaaacccctctggggactctggagccatggggtcacccatccactcagcagccattcacccagcacccagtgcccttccccacagggctgggacctctggtgaaataataatgggaaccttttgttctggttaggattttaagaagcagctttataaaggtgtagttttcattcagtctaatgtacccatttgaattgcacagtcttgtatrttttgacaaatgtatataccttataaccacaactacaattaggatattgaacatttccatcacttcccagaattatcttgtgtctcttcccccaactccaggcaacctccgatctgctttccagcacaaggattcgatttatcatttcatattgcttattgcagtgtttttgagattcatccttcttgtagtacatatcaacagttcttttgtattgctgatcagtattccattgcatggatataccaaaatttgtttctccattcacctgttgacccaatagctgtttccaattttcag

SEQ ID NO: 50511 - DNA, 601 bp, Human
gaacgtggtatttccacttgacattaaaatcatgagtgaagacattaactcagacgaacagcagactgaaggctactgatgtcagctagggatgactgtcaaaatcctaatgctcccaggaaacccctctggggactctggagccatggggtcacccatccactcagcagccattcacccagcacccagtgcccttccccacagggctgggacctctggtgaaataataatgggaaccttttgttctggttaggattttaagaagcagctttataaaggtgtagttttcattcagtctaakgtacccatttgaattgcacagtcttgtatgttttgacaaatgtatataccttataaccacaactacaattaggatattgaacatttccatcacttcccagaattatcttgtgtctcttcccccaactccaggcaacctccgatctgctttccagcacaaggattcgatttatcatttcatattgcttattgcagtgtttttgagattcatccttcttgtagtacatatcaacagttcttttgtattgctgatcagtattccattgcatggatataccaaaatttgtttctccattcacct

SEQ ID NO: 50512 - DNA, 601 bp, Human
gcccaggatcagaggccaagagtgattatgggatttaccaaaagtcacccagggctaactattcagagagaaggaagtgggatagatgctgttttacaccaaggggcagttgcaaacgtccacacccttggactcagtcactcaccttctgggcattgatcctaaggaaatagatgtttggtcaaagatgcatggacaacgatctttgttggtgtgttatttatactactggggaaatagaaataatctagaaatccaccaacaattagttaaataaatgctggaatatctagatggtaamtatgtagaaattaacatagtttaaagaattgtaaaatggtacagaaaaattctcagggtacaatcttaggcgaaaagagtaggacataaatctgtatatactaaaacatgtagttatataatatcaattacaattatgttaagctaatacaccctggaaaaatatatgcagaaatagtttataatggctaactctggttgggggaatatgtgattattattttatttgtctgtcagttttcctgattttctccggagagttttgacttaaaaacaccaaaaagtagatttagttgaagtg

SEQ ID NO: 50513 - DNA, 601 bp, Human
ttggtaacagcccagtgtctcacctggtccagctcccggacccgaacaagggcactgatcacttttctgcccccccaccccctcccccctccgcattcctggctctctgattctctttcttcacttgaaggctaggagccttcatctttgctttcccagagcctggaagaatacctgacaggtgtggcgtaagtgtttgctgagggagggaaggtctgtctttataacgcaggcagaatgattctcatttgcagggggagggcggggagggcagtgaggttcaagaatactgagggacagyaacttcacttggtgggaagtggggagggaagtcaggcccagtgagagtcaggagggaagcaatgaccaacagcttctgagaaagagagatagggggaggcagagagggacggagggagagaatgagggagggagggagggagtgagggagggagggagacacagagaaacctgcatttaaagcatcccttcctcttaggccctcatgagctgggtttcatcaaagaggagacactgatggggctgctgtgccaggtccagtgcaacatgggcaagggagctgggtcctagtgccaggagg

SEQ ID NO: 50514 - DNA, 601 bp, Human
gtgacaagagaatcaaaatatccttccacaagagtgtctggagtggaagggtgtgttaaataagagactgcactcaacacacaggttaggtactcggattatgtgaggtatcctcctctcatgctccatatcacaaaaagagaacacggagggtcagagaggtgagataacagcagacatcacagagcaagtaggtgagagagggccagaaattgagcccagaatgaatcagaatccatggcttttctcaatgaggcaatcaggcgaggcttcctggaggaggcaggagcagacagagatrtggagagcttgtcaggcagagggattagtgggggaaaaggttttggggctggatggtccccatcacgacagtcatttggcttggacaaggggaagcagtgacgctgctgagggccatgaagccagagcacacatggctcctgcctgccagcttcaggtgacagtgcgaaggtcacagcactgagacgaacagttgcaatccttccccaaagcctcagggtttctccacaatggaacccagctgcagggaccccagtgccctctacctgttcctctttcctcataccctgctccttagagg

SEQ ID NO: 50515 - DNA, 601 bp, Human
agtaattgtagccgaatgtcagagacaggaaaacctgggtttatattccggctttactattttccagatgcacgaactttggcatgtcacttcacttcccaaagccccagggcctttatctgtgacaagagaatcaaaatatccttccacaagagtgtctggagtggaagggtgtgttaaataagagactgcactcaacacacaggttaggtactcggattatgtgaggtatcctcctctcatgctccatatcacaaaaagagaacacggagggtcagagaggtgagataacagcagacaycacagagcaagtaggtgagagagggccagaaattgagcccagaatgaatcagaatccatggcttttctcaatgaggcaatcaggcgaggcttcctggaggaggcaggagcagacagagatgtggagagcttgtcaggcagagggattagtgggggaaaaggttttggggctggatggtccccatcacgacagtcatttggcttggacaaggggaagcagtgacgctgctgagggccatgaagccagagcacacatggctcctgcctgccagcttcaggtgacagtgcgaaggtcacagca

SEQ ID NO: 50516 - DNA, 601 bp, Human
ctgtcactgacctccatctggctggcccctgtgccccttgtccacttggtcaggaaacagctcctcaactgccaatgactgaaagagtaattgtagccgaatgtcagagacaggaaaacctgggtttatattccggctttactattttccagatgcacgaactttggcatgtcacttcacttcccaaagccccagggcctttatctgtgacaagagaatcaaaatatccttccacaagagtgtctggagtggaagggtgtgttaaataagagactgcactcaacacacaggttaggtactyggattatgtgaggtatcctcctctcatgctccatatcacaaaaagagaacacggagggtcagagaggtgagataacagcagacatcacagagcaagtaggtgagagagggccagaaattgagcccagaatgaatcagaatccatggcttttctcaatgaggcaatcaggcgaggcttcctggaggaggcaggagcagacagagatgtggagagcttgtcaggcagagggattagtgggggaaaaggttttggggctggatggtccccatcacgacagtcatttggcttggacaaggggaa

SEQ ID NO: 50517 - DNA, 601 bp, Human
ctggctccagagccactgttcctaaaattgtgacaactagggaagtggctgatatgcagcacctggcactcatgctgggaggtgacagctggaaggagcaccttaaggttgtctagtgcaagctcttctattccatagatgggtgaactgaggctcagagatggaaagtgtcttgcccaagatcacacggctcatcagtgagagtgacaggaccagaagtcaggtctctcatctcccagtccaaggacccctcaccaaaccctcttcactgagaccctcagcagctccagagatgagatgyccccggggagagctttatcacaagtgttttctgtagaagtatgaacccacaaatcaaaggccccaaaacgatgaagccagaagtcagctccatgcttatctccctcaaatgtgacaagaacatcgtctcacctgcagggtcagcgtgatggtgagggtcccaaagaagaggcccatgagcccaaagccaccaatgaggaggggtctccgtcccaggtgctcaatgaccaaaccctagtccagggtaaaagagagagagagagctattattccatttctaaccacaacaggggaatgtggc

SEQ ID NO: 50518 - DNA, 601 bp, Human
ttggggcttatgggaacacaggagagagcacctcacccagacttggaagcaaggggaggcttcctgcaggaagaggtgtccaggaatgtccaaggcctcctgagtccagaaagcaaggagaagctagccaagcacagaagagccctaggagaggaaactgccaggttccttgaggagctgccgggggcagggtgtggggcactggaggagacaagggtggccaagccaagaacagctctgaaaccttgtgaaatgaggcttagatggggtttgtgggcttcaggctttccttttaaacttyggacacaagtttcagaaagacaatggcctggaacatcgcctaactggcttcctgagaactttgaaggactgtaaagatgctggagcttgggacagcttgggcctggctgtcaggaaggaactgcatctgccagcacattgtccctgaaggcaatgcttccacctcctgccggtcagcgtgcttgccagccccacctcttcaaagggcacccatcagccaccaccatgctaacagtgccttcttctagaaacatttgggccactaagacatttgacaggtgatcaaaatgtgcacctatca

SEQ ID NO: 50519 - DNA, 601 bp, Human
ggtatgtgataagtgatctcacagggttcccccttggggcttatgggaacacaggagagagcacctcacccagacttggaagcaaggggaggcttcctgcaggaagaggtgtccaggaatgtccaaggcctcctgagtccagaaagcaaggagaagctagccaagcacagaagagccctaggagaggaaactgccaggttccttgaggagctgccgggggcagggtgtggggcactggaggagacaagggtggccaagccaagaacagctctgaaaccttgtgaaatgaggcttagatggsgtttgtgggcttcaggctttccttttaaacttcggacacaagtttcagaaagacaatggcctggaacatcgcctaactggcttcctgagaactttgaaggactgtaaagatgctggagcttgggacagcttgggcctggctgtcaggaaggaactgcatctgccagcacattgtccctgaaggcaatgcttccacctcctgccggtcagcgtgcttgccagccccacctcttcaaagggcacccatcagccaccaccatgctaacagtgccttcttctagaaacatttgggccactaaga

SEQ ID NO: 50520 - DNA, 601 bp, Human
agagggcagacagaggaatggggaactccctccttccccttgttctatgtccaaatccattagctttaggggttgagaggagcttcatggactcttgtacactgtatggcttgcttctgtaccaagtcactcactcactcactaattcagctgattgatccgagctgcccctgggtgccaggcactgggatgggaggtggaaatgcagatatggttcatgccaggcccttgccctacacaactcactcactgtctatttggagagagacatgtgccaacagtgaaagtcaatggtatgtgrtaagtgatctcacagggttcccccttggggcttatgggaacacaggagagagcacctcacccagacttggaagcaaggggaggcttcctgcaggaagaggtgtccaggaatgtccaaggcctcctgagtccagaaagcaaggagaagctagccaagcacagaagagccctaggagaggaaactgccaggttccttgaggagctgccgggggcagggtgtggggcactggaggagacaagggtggccaagccaagaacagctctgaaaccttgtgaaatgaggcttagatggggtttgtgg

SEQ ID NO: 50521 - DNA, 601 bp, Human
cacatttataaaagttcatcattctcagcaaactgacacaagaaccgaaaaccaaaccccacatgtctcactcataagtgggagttgaacaatgagaacacatggacacagggaggggaacatcacatgctggggcctgttttggggggtggggggctggaggagggatagcattaggagaaacacctaatgtagatgatgggttgatgggtgcagccaaccaccatggcacatgtatacctatgtaacaaacctgcacgttctgcacatgtatcccagaacttaaagtatatatatacatatatatatatatatgtatatatatgaatgtttcctcatatacattttaaaggcttctatattttgcttaaaagaagttatcttagttctgatattattacataaaggaccttatttgtacccctgccatcttgcaaggtgtgagatgcgttaattcatttcatggaatatgtctggagaagctgtcactcatccggggggtgggtggcttggtgctggttgggattgctcctgctctagcagactggacagctgagcattagaacacagtgtcaccagttctgaatctgtgggggtgcca

SEQ ID NO: 50522 - DNA, 601 bp, Human
atgagtccctgggcggggcagtggggagggtggggtgccttacctggcccactgcagaaagaggcgatgatggccagaatgcccacgatactcaggtaggggacccagggggcgtggtcctgggagagaacagggagtggtcaggtgaggaggtgatggtgtgaccggaggacctgagttcccaccccagctcctcctccatccatctgtgtgaccttggacaggtcacttgatgtccccaagccccagcttcagcatctataacatgggaacaatgataacccttcggtcactccatctrcttattttatagccatgatgaaatcagatgaagcctgtgatgagtttgacatagtcctggcatacaggaagtggtaaataaatcaataactcacattgattgagggcttagttggcatcaggcaatatgagcaattttcacagctttatcacatttataaaagttcatcattctcagcaaactgacacaagaaccgaaaaccaaaccccacatgtctcactcataagtgggagttgaacaatgagaacacatggacacagggaggggaacatcacatgctggggcctgttttggggggtg

SEQ ID NO: 50523 - DNA, 601 bp, Human
aagttcttagccaagtataacacaaaatcaatgaacaatatgtcttagacatgattattgccacatctttcaccatagacggtaactgcttaggcacagactgtgacttggttgtctttgattcaacacaaaccagtgtcacctctggatcagagccctcccgcgtatgaactgctcttgctgtgtggtgggaaattatctcccactcatcttcaggtgagtccattttcaccttctgtgggatagactgcagacagtcggctacatttaaatcgggccaaaagaaaggcagcagacacayatccccagtcaggctttgcttcttctgggctctgggttccccatctgtatgaggagagccccccagcttggtgatgccatgagtccctgggcggggcagtggggagggtggggtgccttacctggcccactgcagaaagaggcgatgatggccagaatgcccacgatactcaggtaggggacccagggggcgtggtcctgggagagaacagggagtggtcaggtgaggaggtgatggtgtgaccggaggacctgagttcccaccccagctcctcctccatccatctgtgtgaccttggac

SEQ ID NO: 50524 - DNA, 601 bp, Human
cctactgacccatggctaggaaacagcagggctagaagtgagtcccaggtaaactgaggctgggatactccagctgcacactcacacagctaccatgtaagctggtggttggggcctgggcctggcagtcaggccactccacctactcgctcatgcaagtcaccttccatctctgtcttctttggcactgtcctgagccttaaatgagctcacacaggtcaagttcttagccaagtataacacaaaatcaatgaacaatatgtcttagacatgattattgccacatctttcaccatagacsgtaactgcttaggcacagactgtgacttggttgtctttgattcaacacaaaccagtgtcacctctggatcagagccctcccgcgtatgaactgctcttgctgtgtggtgggaaattatctcccactcatcttcaggtgagtccattttcaccttctgtgggatagactgcagacagtcggctacatttaaatcgggccaaaagaaaggcagcagacacacatccccagtcaggctttgcttcttctgggctctgggttccccatctgtatgaggagagccccccagcttggtgatgccat

SEQ ID NO: 50525 - DNA, 601 bp, Human
tggggcctgtctggggtgggagtggagggagggaaagtatcaggaaaaatagctaatgcaggctgggcttaataccttaattgctgtcgataagtacagcaaaccaccatggcacacatttacctatgtaacaaacctgcgagtcctgcacatgtatcccggaacttaaaataaaaaagcaacatgtatcccatgaaaaaaaatatggttctattttatcttcctcctgcctacccctgctctcctctccctccagcttggcatacaacaggtgctcaataaaggcttgagaaattgatawgaatggaattcaaccttatatttgttctttctctgaaaagaatcttggtattagcttgactaatccttttgctccatgcaattggctagtgccaccttcatatttttctgatatcattaagccccagctgcctcttccctggagctcagggatactgcaggaaaaggggtctgctctctccacttcttctctcctccaaggtttgttttgaaaaaccctgctgccagggcaggctcccgtgttacgctgctcacaaaagcacacatcttccctgccagcctttgctcagttattttattc

SEQ ID NO: 50526 - DNA, 601 bp, Human
acatgttctcactcataagtgtgagctgaataatgagaacacatggacacaggaaggggaacaacacacactggggcctgtctggggtgggagtggagggagggaaagtatcaggaaaaatagctaatgcaggctgggcttaataccttaattgctgtcgataagtacagcaaaccaccatggcacacatttacctatgtaacaaacctgcgagtcctgcacatgtatcccggaacttaaaataaaaaagcaacatgtatcccatgaaaaaaaatatggttctattttatcttcctcctgmctacccctgctctcctctccctccagcttggcatacaacaggtgctcaataaaggcttgagaaattgataagaatggaattcaaccttatatttgttctttctctgaaaagaatcttggtattagcttgactaatccttttgctccatgcaattggctagtgccaccttcatatttttctgatatcattaagccccagctgcctcttccctggagctcagggatactgcaggaaaaggggtctgctctctccacttcttctctcctccaaggtttgttttgaaaaaccctgctgccaggg

SEQ ID NO: 50527 - DNA, 601 bp, Human
ggtagtgtgtagaggtgaatttcttatgtttgtcgtggaacgaaaacagcatagatttttaacacttgggttcacatcctagctccaacactcactagctgtttcttatcaggggagcccctaacccctgtggacttcagtttcttcatttgtagatgagagtggtaatcctaatttgcaagcccatcttgcacagtaggggtgatgtatataaggcagctggtgcagtgtctaagttaaagttgatgctcaagaaaggctagtggctgaatgccattatgagtggaaactgagcaagtgyggcaaggactgggcaaagaacaggacagagcctgggaagccctaagccactgcttctgggtttaaccaatcactttaagggtgccctgtgggttcagcacctcccagtccacatcttacagcttagtgcctactcagccccttctatctgagttccctggtcatgattaaaccacctgcaaatacgtcctgacaaccttctagatgtcaggccaggactgggcactttaggagaggctgatgtaaaagtgccaactctgcatccagggctggccatgggacttgtcatcaccactggaat

SEQ ID NO: 50528 - DNA, 601 bp, Human
ggcaggagaatggcgtgaacccgggaggcggagcttgcagtgagctgagatcgcgtcactgcactccagcctgggcaacagagtgagactctgtctcaagaaaaaaaaaaaaaaaaaggattagtttgggaaggaaggatttagcagctgatctataaaccatcttctatcctctaggacagacagacagaaaccagggaaataaatggccgtgtccattctccacataaacttcctaccccaacctcatgatggtatttattagcagaacaataagggagagtccttatattcacaatgyttttagtgggctatacctggtctacttagatggtaaggtttagctatggggctagcttgctggaaaatgtcagtgttagctgaaaaattatctgaatataaaatgcagaaaatagcttctttcatggaagtgatgcatgtatgtcctttttagagccctcatatgttaaatctggacaactatgcatcctaatgtggcaaagaagaacagcaagctatctacacacacacacacacacacacacatacacagatttgaaaatctgactctattatcttatattcacctagtatttttgtg

SEQ ID NO: 50529 - DNA, 601 bp, Human
gaggctgaggcaggagaatggcgtgaacccgggaggcggagcttgcagtgagctgagatcgcgtcactgcactccagcctgggcaacagagtgagactctgtctcaagaaaaaaaaaaaaaaaaaggattagtttgggaaggaaggatttagcagctgatctataaaccatcttctatcctctaggacagacagacagaaaccagggaaataaatggccgtgtccattctccacataaacttcctaccccaacctcatgatggtatttattagcagaacaataagggagagtccttatatwcacaatgtttttagtgggctatacctggtctacttagatggtaaggtttagctatggggctagcttgctggaaaatgtcagtgttagctgaaaaattatctgaatataaaatgcagaaaatagcttctttcatggaagtgatgcatgtatgtcctttttagagccctcatatgttaaatctggacaactatgcatcctaatgtggcaaagaagaacagcaagctatctacacacacacacacacacacacacatacacagatttgaaaatctgactctattatcttatattcacctagta

SEQ ID NO: 50530 - DNA, 601 bp, Human
ttgcctcttagctatgtgatttgggaaaaattactggatcattctgaatattggttttttcatctataagaggccgaggcaggcggatcacgaggtcaggtgatcgtgaccatcctggctaacacagtgaaaccccatctctactaaaaatacaaaaaaattagccaggcgtgatggtggacgcctgcagtcccagcttcttgggaggctgaggcaggagaatggcgtgaacccgggaggcggagcttgcagtgagctgagatcgcgtcactgcactccagcctgggcaacagagtgagaytctgtctcaagaaaaaaaaaaaaaaaaaggattagtttgggaaggaaggatttagcagctgatctataaaccatcttctatcctctaggacagacagacagaaaccagggaaataaatggccgtgtccattctccacataaacttcctaccccaacctcatgatggtatttattagcagaacaataagggagagtccttatattcacaatgtttttagtgggctatacctggtctacttagatggtaaggtttagctatggggctagcttgctggaaaatgtcagtgttagctgaaaaat

SEQ ID NO: 50531 - DNA, 601 bp, Human
ttccactcaatctttagcaaagagctgaggttctaggacaagatggtgaagatttaaatctagcatttgcctcttagctatgtgatttgggaaaaattactggatcattctgaatattggttttttcatctataagaggccgaggcaggcggatcacgaggtcaggtgatcgtgaccatcctggctaacacagtgaaaccccatctctactaaaaatacaaaaaaattagccaggcgtgatggtggacgcctgcagtcccagcttcttgggaggctgaggcaggagaatggcgtgaacccrggaggcggagcttgcagtgagctgagatcgcgtcactgcactccagcctgggcaacagagtgagactctgtctcaagaaaaaaaaaaaaaaaaaggattagtttgggaaggaaggatttagcagctgatctataaaccatcttctatcctctaggacagacagacagaaaccagggaaataaatggccgtgtccattctccacataaacttcctaccccaacctcatgatggtatttattagcagaacaataagggagagtccttatattcacaatgtttttagtgggctatacctggtc

SEQ ID NO: 50532 - DNA, 601 bp, Human
gtaggccatttctccttggaatagtttttaaccttgcaagtaaatttcaaaatgggcataattccactcaatctttagcaaagagctgaggttctaggacaagatggtgaagatttaaatctagcatttgcctcttagctatgtgatttgggaaaaattactggatcattctgaatattggttttttcatctataagaggccgaggcaggcggatcacgaggtcaggtgatcgtgaccatcctggctaacacagtgaaaccccatctctactaaaaatacaaaaaaattagccaggcgtgrtggtggacgcctgcagtcccagcttcttgggaggctgaggcaggagaatggcgtgaacccgggaggcggagcttgcagtgagctgagatcgcgtcactgcactccagcctgggcaacagagtgagactctgtctcaagaaaaaaaaaaaaaaaaaggattagtttgggaaggaaggatttagcagctgatctataaaccatcttctatcctctaggacagacagacagaaaccagggaaataaatggccgtgtccattctccacataaacttcctaccccaacctcatgatggtatttat

SEQ ID NO: 50533 - DNA, 601 bp, Human
ggactgatttatgaggatcaagagtaaccccatcctgggaagataaaagcaggagccccctccccttatcctcaattctctgtgtaggccatttctccttggaatagtttttaaccttgcaagtaaatttcaaaatgggcataattccactcaatctttagcaaagagctgaggttctaggacaagatggtgaagatttaaatctagcatttgcctcttagctatgtgatttgggaaaaattactggatcattctgaatattggttttttcatctataagaggccgaggcaggcggatcaygaggtcaggtgatcgtgaccatcctggctaacacagtgaaaccccatctctactaaaaatacaaaaaaattagccaggcgtgatggtggacgcctgcagtcccagcttcttgggaggctgaggcaggagaatggcgtgaacccgggaggcggagcttgcagtgagctgagatcgcgtcactgcactccagcctgggcaacagagtgagactctgtctcaagaaaaaaaaaaaaaaaaaggattagtttgggaaggaaggatttagcagctgatctataaaccatcttctatcctctagga

SEQ ID NO: 50534 - DNA, 601 bp, Human
ccagggctttaaaagcttcccaggtgactgagcaatgtttgagcaccactgctgtggctctgatggtttatttaaggttcgtttgacatgaacttcttcctatattctggcagtggctgctctcactgcctggaaattcctccttccctacctcaccagctagccctctcccaagttccaaatttcagagctgaggaactatagcaggggttgacacatgtttaaaataaaaagttagaaagaaaatatattaggcttttcaggccacatgtggtccctggcatgcattctttctttcccycttttaaaatgcaaaagccattctttgctggtgggtcacacaaactaggccagggaccaaatctgacctgtggacaattgaattgcctgttttgtgaggcagtgggttccctgtcaatagatgcaatcaagccatggctgaaggaattcctggcagggaaaccatgactaggacttaagcttctgataaatgactgaactagaacatctttacggtcttttccaaacttgggatgccttaattctaattcatctcagcccctggaaggtttcctcatctgccagatgacctccctccagc

SEQ ID NO: 50535 - DNA, 601 bp, Human
agtctcaagatgcagtatgagctgactttttgaagatgagaagccacacctcaaatggatgaataagggtggttgttgcaagaggggaaatagcacatgcaaaggctgagaccatgaagcgtgtgtgtgtgtgtgtatttatgtgtgtatgtgtgtgtgtgtgtgtgtttgtgcgtgtggggcagggggcagctgcctgtggctccagatggctgcagtgcagggagaatgcgggatagagagggagggcaggcagggcaggcagagacgaccacataggttctgtcaaatgctgatacgmccctgcagtctttccagaggggtcctttttccaagcaaggtatgtgctgaggcatcttccatcaggaccgctccatcttctggggtgctcagaccttaattcgcaccttgataatggcagtggccttaccgctccatcttgtttgcatctgtccactccatttaaacacaaactccccatagaggacttaacttggtgccaggcacagagtcagggcttcatgtgatttttaaaactggaattgacacattttggcaacgatcttctttttttaaaaggtgaagctcttttattttgcct

SEQ ID NO: 50536 - DNA, 601 bp, Human
ccactgtcaggctgtgtgtttggatacaggtgatagaaacaaggttcttgtctttgaagcagtccctgatgttaggaggactgaccaaccatggccattgtaatggggtgggggtggggatacactaggagttaatctagggggctgtgggagcccagaggggcgggctgtttctaagaaagtctcaagatgcagtatgagctgactttttgaagatgagaagccacacctcaaatggatgaataagggtggttgttgcaagaggggaaatagcacatgcaaaggctgagaccatgaagcttgtgtgtgtgtgtgtatttatgtgtgtatgtgtgtgtgtgtgtgtgtttgtgcgtgtggggcagggggcagctgcctgtggctccagatggctgcagtgcagggagaatgcgggatagagagggagggcaggcagggcaggcagagacgaccacataggttctgtcaaatgctgatacgaccctgcagtctttccagaggggtcctttttccaagcaaggtatgtgctgaggcatcttccatcaggaccgctccatcttctggggtgctcagaccttaattcgcaccttgataatggcag

SEQ ID NO: 50537 - DNA, 601 bp, Human
gagtggcttttgtcatttataatgaacccctaatgtggtgactcaggtgggtcattagatggtttcaaggcagcgctggccatgcttggagggttggaaccttcagctccatcttccagcctctaaggaagggagaggggctgcaggctgagttcagtcaccagtggccagtgatggaatcaatcatgcctatataatggagcctccatagaaacgtctaaatgatggggttgaggtgtttcccagttggtaaacgcactgaagtgctgggaggctggtgtatccacagagggcatgaaarctccatgccccgtgatgcacccccataccttctgtatgcctctcttccacttggctgtttctgagttgcagcctctataataaagctgtaattgtaagtagggcactttcctgagttctgggagtcatgctagcaaataattatcaaacctgagggtagccttgggaacccctgaatttgtagtcagcagagcagaagtgccggctccctgggactctgtttttggttggtgtctgaagtgagggcagtcttgtgggattgaaccctttaactctttctgacactctggggaggcagtgt

SEQ ID NO: 50538 - DNA, 601 bp, Human
cctgtcccaggctcttctgggtctgctggacacagcctttaccccttctggatctcaccaggctcctgttggggcacacctgctgtgtgcaatcctaagagcctggctgggattctcaacactgtttgcaggagggtttcctcctcggggtcagccggggccagcagccaatgcagttgagagtgccagcccccttcctcctatagaatgtctatagtggtcattctcaactgtgccctgtccctctcctcttcctctgtgggggtagagacactgtcttgctcatccttttatcttcaaytcccagcccagggctggcactgtggcataacacacacacacatatatatatatataaaattgcaatatatatatatttgatttttgtccctagtttttggcccagatttcttaaaagccttgggatttctggagtaacaagagtggcttttgtcatttataatgaacccctaatgtggtgactcaggtgggtcattagatggtttcaaggcagcgctggccatgcttggagggttggaaccttcagctccatcttccagcctctaaggaagggagaggggctgcaggctgagttcagtca

SEQ ID NO: 50539 - DNA, 601 bp, Human
atgatcacaccactgcacttcagcctgggtgacagagcgagaccctatctctaaaacaaacaaacaaacaagcaaacaaacaaataaaaccctcttgactgtatctcctgattccctgattcctgctggacctggatgaaatttcacatttatataatagtttagagttcacagggtagttttagatagctcatcttttaagtcccttccctaaaagcctgtgtggtaatgggtgtggagtctgagtctttgtttctagacagggactagcaccaatgctggagttaattctcaccttctstacgaattcattttagagacattgatgtgtcctgagcaatggctactatttagttttaagtctagatttgtgagacatttccatttaattttcattaaacagtttttcaaaaattatgactatatgccaagttggtgtcattatgtctcttaacttatagctatagttattttaatgtgcatatatttattccttctatgcaatactttctgcttggtccggaggattagaaagcaatttgtcattctgctttgcacacaattccctaacttttgaggggaaaggagacatctgattcga

SEQ ID NO: 50540 - DNA, 601 bp, Human
tttagaaatggccataggttagcgtctgtctaagatgggatgctgtgtctttagaaatggccataggttagcgtctgtctaagatgggatgctgtgtctttagaaatggccataggttagcgtctgtctaagatgggatgctgtgtctttagaaatggccataggttagcgtctgtctaagatgggatgctgtgtctttagaaatggccataggttactctctgtctaagatgggatgctgtgtctttagaaatggccataggttagtgtctgtctaagatgggatgctgtgtctttagawatggccataggttagcatctgtctaagatgggatgctgtgtctttagaaatggccataggttactctctgtctaagatgggatgctgtgtctttagaaatggccataggttactctctgtctaagatgggatgctgtgtctttagaaatggccataggttactctctgtctaagatgggatgctgtgtctttagaaatggccataggttagcgtctgtctcagatgggatgctgtgtctttagaaatgtcttcttgtgcagtgcacaccctgagaacccatacttggtggctctgcttgc

SEQ ID NO: 50541 - DNA, 601 bp, Human
caattctggaggcttccatgctcaggaaagtggcttgggctgggatggctgctgaggaatcattcaggaaatatgtggaaatgctgtccctaggcctcctcagcagaacctggatgaggtccctcctcatccagggacccgggtgggggatgtttccccagggaagggggttctgaagtgcagccatgtagttagagagcccttaatctggttcatcccctcatttcactgatggtgaaactgaggccagagagggacagggacttgtccaacttactgtagattttgggaaagtcacagmaaaattccaagagcatcccagaccatctctcctgtgagttggggcagggtgcagtgggatgtggtacctctgtgtcctggccaggaatgagggctcagaaatgccatgaatgaaagtcacattgtcagctcaaggtcaattcatcaaaaagcaaagactggtaaatgcatttttgaataaaaatatgttaacaaaagaaacccagtctgtgaatgtgcaggaatccctctcactatctgaacctttgctatccagactcctgttttccaaacgcatgaatgaataaattcgataaatgtg

SEQ ID NO: 50542 - DNA, 601 bp, Human
cttggactgcttctgaggggagaggttttctggagggttttggcaaaaaatcataaggaacactgccacgttttcgcattcaagtttcaggcgataagctcactaattaactctgccataggctgcgggaaagtgataagtactaaaaccgaacatgtgaaaatgcaagggagaacggctggaaaaaggagactttggagttgggcaggcatgcgttcaaatcctggctgggccacctaaactatgtgccatgagatgtggcccaagcagggctccctggagctgtggtgtcctcatgggsagaggagggtctccttgcggagactttgtaaggattagggtgagtgtggccaagtatctagcgctgaccaagtgcttaacttaggaagatttttttggggggtgtgtggggtcttgctgtgtcaccccagttgcagtacattggtgtaatcttagctcattgcaaccttcaactcctggactcaagagatcttcctatcttggcctcccaaagcattaggattataagtgcaagccactgtgcctggcttggaagataatattattaattttaaaagttccctggtcttcttgaaaaagc

SEQ ID NO: 50543 - DNA, 601 bp, Human
ccagttttgaggttttctacatttctgttgaaaaccccagcatacgcaccaaaactttgaagggctcaaaatctttctcagagcagcatttgcttggactgcttctgaggggagaggttttctggagggttttggcaaaaaatcataaggaacactgccacgttttcgcattcaagtttcaggcgataagctcactaattaactctgccataggctgcgggaaagtgataagtactaaaaccgaacatgtgaaaatgcaagggagaacggctggaaaaaggagactttggagttgggcagrcatgcgttcaaatcctggctgggccacctaaactatgtgccatgagatgtggcccaagcagggctccctggagctgtggtgtcctcatggggagaggagggtctccttgcggagactttgtaaggattagggtgagtgtggccaagtatctagcgctgaccaagtgcttaacttaggaagatttttttggggggtgtgtggggtcttgctgtgtcaccccagttgcagtacattggtgtaatcttagctcattgcaaccttcaactcctggactcaagagatcttcctatcttggcctcc

SEQ ID NO: 50544 - DNA, 601 bp, Human
cctcgatctctgccttctggcctcagaactgtgggagaacacattgctgtcatttgtggaactttgtcacagcagccacaggaaatggatacagcccaacagaggactgtgttctcaccatctcagcagctgcaaggaataattaagtgacaaattcctcagctggattcccagggattgcccaagtgacagtgaagaggaagacagctgctgacagaaaccacgagaaagacctatgagcctgacaggtgtcactgatttcaaggactgcagagccagttttgaggttttctacatttcygttgaaaaccccagcatacgcaccaaaactttgaagggctcaaaatctttctcagagcagcatttgcttggactgcttctgaggggagaggttttctggagggttttggcaaaaaatcataaggaacactgccacgttttcgcattcaagtttcaggcgataagctcactaattaactctgccataggctgcgggaaagtgataagtactaaaaccgaacatgtgaaaatgcaagggagaacggctggaaaaaggagactttggagttgggcaggcatgcgttcaaatcctggctgggcc

SEQ ID NO: 50545 - DNA, 601 bp, Human
aattattactcttatttgattttacgccaatctttctcccaagggtctggtggctgtcctctgctcatctctgtagcttagacctagcacagtgactggcagacagtaagtaggtgtccaatagactaggatctaacttgaatgaactgtttttggtagaggaggccaaagtgtttatcaaagcatatgagaaaacagatgcttatctctagtccagtgcagtgggctgagtggtggccccacaaatatacatccatgtcctcatcctggagtgtgcaaatattactcaaatggcaaacayatgattaggttaaggatgttgagaggaggacctgggtcctaaatgcaatcacacatgtccttgtaagagtgtggaagatggagttttgggatgcacacataggggaaggcctgtgaaggtggaggcagagactgtgtagtgatgtggccacaagccaaggagcactggcagctgccagaggccaggagaggcgtgtggaagggactcccctcagagcctctgcaggggcactgcatccctactgaagcctcgatctctgccttctggcctcagaactgtgggagaacacattgctgtcat

SEQ ID NO: 50546 - DNA, 601 bp, Human
tctgtctcccttaccagagcgccactcatctctgatggggccatgcccagaggaggggctcaggagtgttctgacctcagagtcgcctggcagtgcagcctggtgccttcactagtccactgtggcagggcaggcagctgttcccataaactcccttgggcaggtggcccatcatgtaattagaagccaggtgacctgataataatcaactcctgcctggctggaaagcccttgactttaaagcatccagctaaccagggcttcttccccagaattgtttactaccctgaaggggaaatgytatccacccatttatttcaattgggtacctgcaccttcataaaatggcataaactaaacaagaaagtccctagagtcctctgcaccccagttgtcacctgttgaggagctcatatataggggatatgagaagtgaattgtctgtggagctgacagccagcttgaagctctccctctgtcaccccaggaacccccatacctgtgggattaactgagcgcttcataagcccagagcagaacttctcccctcagcaattttgtgacgaatgctgaagattttggaacataatgtttatttttt

SEQ ID NO: 50547 - DNA, 601 bp, Human
aatatggggagacgaacagtagtccttcaagaactttttgtcagcgtgaatcttgcctttcctcagtttaacagaaaaacaatgggcagcgtgtgaatgcaatgggcacttttccatcctagcagtttatttttgacacctcacagaagtgaatcattgtcatgtaactacatctcatttgcaaaagtacaaattgaaacagagttaatgccaattccctcagcttccataagagcttggtaattaaagctgctaaagaagaaagaaagtagacgcagtgtttccttcaaggcctggttcygctccccaacccagcctgcactctctgcagccatgtgggtttctcatgtcagctgaggcggctggagtagaatgtctccctttctttctcaactaactcttgagtttcttgtgaaaggagataatgcaggtaaagtacttaattccatgcttggcccataataagtactcaataaatagtattggtgataatgatgataatgatgaagaagatgatgatgattattttgacattaggaatggaagagaaagcggagaagcagggaagatttctgtagagatagacgggcggctattgcta

SEQ ID NO: 50548 - DNA, 601 bp, Human
actcctcctaaggcaggagctgtgaggaaagcagtggcagccagcaccttggacgtactccccatccatgcgtgtgagctgcatctaactcgcttcatgtatgttgtctcctcacagcacctaggacccattttacatgtgggtaaactgatgcatgagggtgggaacaggccagcaccactctactggttgcatggagaattccaaccatggtgggtggactctgagctcacagtcctccccacttcatgttggctgtctgggaaaatcatcttttgttctttacacatccacttttggwgcctagaatctcctgaatgctggtcacactgctcccaatatggggagacgaacagtagtccttcaagaactttttgtcagcgtgaatcttgcctttcctcagtttaacagaaaaacaatgggcagcgtgtgaatgcaatgggcacttttccatcctagcagtttatttttgacacctcacagaagtgaatcattgtcatgtaactacatctcatttgcaaaagtacaaattgaaacagagttaatgccaattccctcagcttccataagagcttggtaattaaagctgctaaagaagaaa

SEQ ID NO: 50549 - DNA, 601 bp, Human
actttgaccctgttgattccattccagtcacacgtgcctccttgttctttctacaactgcccagtattcacgctcatgtcagtgacaacccgagaactggggaaggaagatggggctgagacctgggatcccaggcaaaatggcacatccatggatacggggacgatgctgccattactcctcctaaggcaggagctgtgaggaaagcagtggcagccagcaccttggacgtactccccatccatgcgtgtgagctgcatctaactcgcttcatgtatgttgtctcctcacagcacctagsacccattttacatgtgggtaaactgatgcatgagggtgggaacaggccagcaccactctactggttgcatggagaattccaaccatggtgggtggactctgagctcacagtcctccccacttcatgttggctgtctgggaaaatcatcttttgttctttacacatccacttttggagcctagaatctcctgaatgctggtcacactgctcccaatatggggagacgaacagtagtccttcaagaactttttgtcagcgtgaatcttgcctttcctcagtttaacagaaaaacaatgggca

SEQ ID NO: 50550 - DNA, 601 bp, Human
gcttagcagtctttatatagttcttcttgcataatagctctcaaggtggaggcttagggaggctggtgactttccaaagacatcacacatggctggaggtgtagcctgtgtctgacccaagctcatgtctttctctcgatgccacatggcagggctgggtttcccaccctttccaggacataaaggaagggagtgggcaggagctggttttgttagacggtctttgaagatttgccacaattggattgatgagacagcccaaggtccctgcaggaacactggtttgcaggaatctggcccyggggcccatgatttgccattttggcaaacagagcatttcaaagcatatggctcccagacgcaaggatgtgatacagagaagtgaggcacagccgagcacttcacccaggacccctctgcctccaggtagtggtttcattcctcaagccattcaggagggcaaggagggacttgtggcatgggggaaagggccccagtccttgctttgatactgactgcaatatgcagggcccgttacttattccccagctttctcatctgtaaaatgggtgcactgatccaacagaatggatatgaacat

SEQ ID NO: 50551 - DNA, 601 bp, Human
caccatacatatcgcttagcagtctttatatagttcttcttgcataatagctctcaaggtggaggcttagggaggctggtgactttccaaagacatcacacatggctggaggtgtagcctgtgtctgacccaagctcatgtctttctctcgatgccacatggcagggctgggtttcccaccctttccaggacataaaggaagggagtgggcaggagctggttttgttagacggtctttgaagatttgccacaattggattgatgagacagcccaaggtccctgcaggaacactggtttgcrggaatctggccccggggcccatgatttgccattttggcaaacagagcatttcaaagcatatggctcccagacgcaaggatgtgatacagagaagtgaggcacagccgagcacttcacccaggacccctctgcctccaggtagtggtttcattcctcaagccattcaggagggcaaggagggacttgtggcatgggggaaagggccccagtccttgctttgatactgactgcaatatgcagggcccgttacttattccccagctttctcatctgtaaaatgggtgcactgatccaacagaa

SEQ ID NO: 50552 - DNA, 601 bp, Human
aataaaggcaaggaggcaaagaaggaaattcaaactcactaagcaccttctgtgtaccaggcaccatacatatcgcttagcagtctttatatagttcttcttgcataatagctctcaaggtggaggcttagggaggctggtgactttccaaagacatcacacatggctggaggtgtagcctgtgtctgacccaagctcatgtctttctctcgatgccacatggcagggctgggtttcccaccctttccaggacataaaggaagggagtgggcaggagctggttttgttagacggtctttgaagatttgccacaattggattgatgagacagcccaaggtccctgcaggaacactggtttgcaggaatctggccccggggcccatgatttgccattttggcaaacagagcatttcaaagcatatggctcccagacgcaaggatgtgatacagagaagtgaggcacagccgagcacttcacccaggacccctctgcctccaggtagtggtttcattcctcaagccattcaggagggcaaggagggacttgtggcatgggggaaagggccccagtccttgctttgatactgactgcaatatgca

SEQ ID NO: 50553 - DNA, 601 bp, Human
atttttctctagtaagtcatgtaatggcatcattaaactatcacgtgctcatccttttggtgggtttgtgaacaaaacaaatttgtatgagaccatttatcatttctttctagaactctgaatttataatttatattgttacagagtacatttaaatctgccttaataaaggcaaggaggcaaagaaggaaattcaaactcactaagcaccttctgtgtaccaggcaccatacatatcgcttagcagtctttatatagttcttcttgcataatagctctcaaggtggaggcttagggaggstggtgactttccaaagacatcacacatggctggaggtgtagcctgtgtctgacccaagctcatgtctttctctcgatgccacatggcagggctgggtttcccaccctttccaggacataaaggaagggagtgggcaggagctggttttgttagacggtctttgaagatttgccacaattggattgatgagacagcccaaggtccctgcaggaacactggtttgcaggaatctggccccggggcccatgatttgccattttggcaaacagagcatttcaaagcatatggctcccagacgca

SEQ ID NO: 50554 - DNA, 601 bp, Human
gtgtcatcagtacagagtgtagtacctgatacatagtatgtgttcaaaaattttttttgttttgagacagggccttactctgtcacccgggctggagtgcagtggcatgaacatggctcactctaacctcgatctcctgggctcaagccatcctcccacctcagcctcccaagtagctgggactacaggcatgtgccaccatgcctggctaatttttaaattttttgtagagatgaggtcttgctacattgcctaggttggtcttgaactcatgagctcaagaaatccttctgcttcagcytcccaaagtatcggagccactgtgcccagctaaaatcttttgttgaatgaattaatttggggcatgactgagaatatataaaaggggaaaaatgactgtgaatgatcagcatatatttcagaaaatcctgcattaaagcacatgcattagtttcctcattaagacagcctccccataggccctcttaaggcataattctgacaagcttgattttatattttaatctatattttgtttcaataaagaagttgggcatgcaaagggaagcacctaaggggtgagagaatgcatgtccgctga

SEQ ID NO: 50555 - DNA, 601 bp, Human
caagttgctgtcactagagactcaacgttcttttcctttgtcttgttgcttctttcaacatttactgttctttctcgaagctggaatttaaagccacttctttgagcactactcattccctgggtgtctcccatgtatgtgtgaaatatacatgttaataaacttctgtattttttttcttgtgttagtctgtcttttgttacaggggtctgtttcaactaaggacctatgagggttgaagaaaatatgttttttatcccctatgctaacaacactgcagcctttcctgagccttccaagygagttcctgcctcaggacctttgcacattcttcccctacatcctcacagggtggcttccttctcagacccaagtcctgcctgcagcgctagcttctcacggaggcccttcctgtccatatcacaaaagcagtcctctcctcccatcaccctagccccttaccctgtttattccttcctagcactggtcagtaatcctcaatatttattagcttaccagtaatggctctataaatatacatttgtagtggcctgtgtcattcgctggggtatctcctgtgcctggatcaacataagaagtg

SEQ ID NO: 50556 - DNA, 601 bp, Human
gctaatatggaacatcataatattccaccccaaaacacgaagaactgttgagctgaaggcatttaaaaagaagtagatgcaggaaggctctctgccttccctctatttgcctaaaagcaggacatagatttacaaagacaagagatattctgctcccaccctcttctgccagggagaacaaagggtaaccagtgaagacaactttggatgcttataggtctggagcttacaccagaggaacctacatgaaccagtttccctaacccacctcgatctgctatttatttgttttcccccaagytgctgtcactagagactcaacgttcttttcctttgtcttgttgcttctttcaacatttactgttctttctcgaagctggaatttaaagccacttctttgagcactactcattccctgggtgtctcccatgtatgtgtgaaatatacatgttaataaacttctgtattttttttcttgtgttagtctgtcttttgttacaggggtctgtttcaactaaggacctatgagggttgaagaaaatatgttttttatcccctatgctaacaacactgcagcctttcctgagccttccaagcgagt

SEQ ID NO: 50557 - DNA, 601 bp, Human
ttccctggctaccctaagatagcattttctccatcattctcctcctcattttgcatgacttctcttctgagcacttattgctacacgtattagtctgttctcccattgctataaagaaatacctgagactggtaatttatattaaaaaagaggtttaattggctcacggttccaacaggttgtacaggaagcatgatgctggcatctactcagcttctgcggaggtctcaggaatcttccaatcacggtggaaggcaaaggagaagtgaggtgtctcacatgatggcagcaggaacaaaakagagggtggggaggtaccacacacttttaaacgatgggatctcatcgtttaaaatgatgatagtgagaactcactatcacaaggacagtacaggggggatggtgctaaaccattcatgagaaatccaaccccatgatccaatcacctcccaccatgccccacctccaacactggggattacaattcaacatgagatttggtggggacacaactccaaaccatataattacattatattttcatgtgtttacaataagcctccctcaacagaatgtccattccttgagggcagggattttg

SEQ ID NO: 50558 - DNA, 601 bp, Human
tgacagaacaggtgaagtgaggtctgctttaagcactctgtgcacaagtgacctcatcagcctttgctactgtttctgacttctcttggaagtttcttccagtgaaaagtgagcttatttttcttttccaggtgtcttcctccaacttgcacagcctgcagctcctattgctgtcacatatattaatgctgatatcaaagcccctgctggaagtcagggagcgcctgctctctttgcagaaccggcagccccaggtgtgctatctttccccagttggctgtgacaagcggcctctgcaagrccgaaccatttccagatccaaaagctgaataccccttggctgcactcagcccccagctcctgagggtgtggagagcaaaaaccttcctgctgagccctgacagctgctcagtctgggcccctttccacagcctggcttcttcctgccaggagaaattcatcttttcacagcagagggagtgagaacagcccgcagttcctgttggatggcacctgctatctctctgccccctgggtagtaccaggcgttctctgtgggaaatgcccttcctcctccttctcctccctccctgtctgcctg

SEQ ID NO: 50559 - DNA, 601 bp, Human
ggatggagctggaggccattatcctaagtcaactaatataggaacagaaaaccaaataccacatgttctcaattataagtgggagctaaacattgagcacacatggacacaagggaacaatgacactgtggcctacttgagggtgagggatgggaggagggtgaggactgaaaaaacaggtactatactatgcttattacctgggtgatgaaataatctgtatatcaaactcctgtaacatgcaatttacctatatatcaaacctgcacatgtacccctgaaacgaaaagttaaaaaaagraaaaagcgttctctgtatgggtgctggagttataaggctgcctgaaatagggtaaaaggatccaggggacatagctcagaacctgggttcccactcattcctgtgatttgaggccatcgcaccctcagtctaggtcttggttttcccagctgcagagcatttgtttgttcattcagtgaacaaaaagtactgagttcctgcttggagggggcgcagggttggatactgaagatagagcccggaaggagccacagtccctgggccagacagtgtctcaaatcctgtgcagttctgttgttc

SEQ ID NO: 50560 - DNA, 601 bp, Human
gcagccataaaaaagaaaaagatcacgtcttttgcagcaacatggatggagctggaggccattatcctaagtcaactaatataggaacagaaaaccaaataccacatgttctcaattataagtgggagctaaacattgagcacacatggacacaagggaacaatgacactgtggcctacttgagggtgagggatgggaggagggtgaggactgaaaaaacaggtactatactatgcttattacctgggtgatgaaataatctgtatatcaaactcctgtaacatgcaatttacctatatawcaaacctgcacatgtacccctgaaacgaaaagttaaaaaaagaaaaaagcgttctctgtatgggtgctggagttataaggctgcctgaaatagggtaaaaggatccaggggacatagctcagaacctgggttcccactcattcctgtgatttgaggccatcgcaccctcagtctaggtcttggttttcccagctgcagagcatttgtttgttcattcagtgaacaaaaagtactgagttcctgcttggagggggcgcagggttggatactgaagatagagcccggaaggagccacagtcc

SEQ ID NO: 50561 - DNA, 601 bp, Human
tcgaagaacttaaaacagaaataccatgtgatccagcagtcccattattgggtacacactcaaaggaatataaattgttctaccataaagacagatgcatgtgtatgttcattgcagcaactattcacaatagcaaagacatagagtcaacataaatgcccattaacagtagactggataaagaaaatgtggtacatatacaccatggaatactatgcagccataaaaaagaaaaagatcacgtcttttgcagcaacatggatggagctggaggccattatcctaagtcaactaatatagraacagaaaaccaaataccacatgttctcaattataagtgggagctaaacattgagcacacatggacacaagggaacaatgacactgtggcctacttgagggtgagggatgggaggagggtgaggactgaaaaaacaggtactatactatgcttattacctgggtgatgaaataatctgtatatcaaactcctgtaacatgcaatttacctatatatcaaacctgcacatgtacccctgaaacgaaaagttaaaaaaagaaaaaagcgttctctgtatgggtgctggagttataaggctgc

SEQ ID NO: 50562 - DNA, 601 bp, Human
aatcattagagaaatgcaaatcaaaaccacaatgagatatcatctcacatcagtcagaatggctattcttaaaaagtaaaaaaataacagatgctggcaaggttgcagagaaaagagaaagcttatatactgttggtgggaatgtgttagttcagccactgtggaagcagtttggcaatttctcgaagaacttaaaacagaaataccatgtgatccagcagtcccattattgggtacacactcaaaggaatataaattgttctaccataaagacagatgcatgtgtatgttcattgcagcwactattcacaatagcaaagacatagagtcaacataaatgcccattaacagtagactggataaagaaaatgtggtacatatacaccatggaatactatgcagccataaaaaagaaaaagatcacgtcttttgcagcaacatggatggagctggaggccattatcctaagtcaactaatataggaacagaaaaccaaataccacatgttctcaattataagtgggagctaaacattgagcacacatggacacaagggaacaatgacactgtggcctacttgagggtgagggatgggaggagg

SEQ ID NO: 50563 - DNA, 601 bp, Human
attagaaaaaactattataaaattaatataaaacccaaaaagagcccacatagcccagatcctaagcaaaaagaacaaagcaggagacaacatggtacctgacttcaaactatactacaaggctacagtaaccaaaacagcatggtagtggtacaaaaacagacacatataccaatggaacagaaaagagagtccagaaaaaaggccacctacctacaaccatctgatcttcaacaagctgacaaaaacaagcaatggggaaaggacttcctgtgcaataaatggtgctgggataattggkgaactatatgcagaagactgaaactggacctcttccttacacaacgtacaaaaatcaactcaatatggatcaaagacttaaatgtaaaaacctaaatctataaaaaccctggatgaaaacttaggaaatatccattctggacataggccctggcacagattttatgacaaagacgccaaaagccattgcaacaaaaacaaaaattgactaatggaacctaattaaactaaagagcttctgcacagcaaaagaaactataaacagagtaaacatacaacccagagtatgggagaaaatatt

SEQ ID NO: 50564 - DNA, 601 bp, Human
cgtgatctgataaacaactttaacaaagtttcaagatacaaaattaatgcactaaaaccagtagcatttctgtacaccaacaacatccaagctgagcacaagatcaagaattcagtcccattaacaataaccacacaagcatacaaaataaaattcctaggaatagagctaaccagggaggcgaaagatccctacaatgaaaattacaaaacactgctgaaagaaatcagagatgacacaaacaaatagaaaaacattccatgcttatgataggaaaaatcagtattgttaaaatggtcatagtgcccaaagcaatttacagattcaatgcaattcatgtcaaactatcaatgacatccttcacagaattagaaaaaactattataaaattaatataaaacccaaaaagagcccacatagcccagatcctaagcaaaaagaacaaagcaggagacaacatggtacctgacttcaaactatactacaaggctacagtaaccaaaacagcatggtagtggtacaaaaacagacacatataccaatggaacagaaaagagagtccagaaaaaaggccacctacctacaaccatctgatcttcaa

SEQ ID NO: 50565 - DNA, 601 bp, Human
agtaggctttatccctgggatgtaagattcctttgacatatacaaatcaatagatgtgactcatcacataaacaaaagtaaaaacagaaattacatgatcatgtcaatagatgcagaaacggctctgataaaactaatatcccttcatgttaaaaaccctccacaacttggcattgaaggaacataccccaaaataataacagccatctatgacagacccagagccaacatcatactgagtgggcaaaagctggaaacatcccccttgagaactagaaccagataaggctgcccactcttmccactcctattcaacatagtactggaagtcccaactggaacaatcaggcaagagaaagaaataaaagatgtccaaataggaagagaaaaagtcaaactatctctgtttgcagacaatataattttatacttagaaaaccccatagtctctgccaaaaagcttcgtgatctgataaacaactttaacaaagtttcaagatacaaaattaatgcactaaaaccagtagcatttctgtacaccaacaacatccaagctgagcacaagatcaagaattcagtcccattaacaataaccacacaa

SEQ ID NO: 50566 - DNA, 601 bp, Human
ctattccaaaaaattgagaaggatggaatccccttcaactcatcctatgaggccagcatgatcctgataccaaaacctggcagagacacatacatacacaaaataaaacttcaggccaatatccttgatgaatatagatgcaaaaatcctcaacaaaatcctagcaaaccaaatccagcagcacatccaatagcttatccactatgaggaagtaggctttatccctgggatgtaagattcctttgacatatacaaatcaatagatgtgactcatcacataaacaaaagtaaaaacagaaaytacatgatcatgtcaatagatgcagaaacggctctgataaaactaatatcccttcatgttaaaaaccctccacaacttggcattgaaggaacataccccaaaataataacagccatctatgacagacccagagccaacatcatactgagtgggcaaaagctggaaacatcccccttgagaactagaaccagataaggctgcccactcttaccactcctattcaacatagtactggaagtcccaactggaacaatcaggcaagagaaagaaataaaagatgtccaaataggaagagaaaaa

SEQ ID NO: 50567 - DNA, 601 bp, Human
actattcctaccaaaactattccaaaaaattgagaaggatggaatccccttcaactcatcctatgaggccagcatgatcctgataccaaaacctggcagagacacatacatacacaaaataaaacttcaggccaatatccttgatgaatatagatgcaaaaatcctcaacaaaatcctagcaaaccaaatccagcagcacatccaatagcttatccactatgaggaagtaggctttatccctgggatgtaagattcctttgacatatacaaatcaatagatgtgactcatcacataaacaraagtaaaaacagaaattacatgatcatgtcaatagatgcagaaacggctctgataaaactaatatcccttcatgttaaaaaccctccacaacttggcattgaaggaacataccccaaaataataacagccatctatgacagacccagagccaacatcatactgagtgggcaaaagctggaaacatcccccttgagaactagaaccagataaggctgcccactcttaccactcctattcaacatagtactggaagtcccaactggaacaatcaggcaagagaaagaaataaaagatgtcca

SEQ ID NO: 50568 - DNA, 601 bp, Human
aaatatataacataccagaatctctgggacacagctaaaacagtgttaaaaaaaaaagttcacagtgctaaatgcccacatcaaaaagttagaaagatctcaaattaacaacctaacatcacacctagaggaattagcaaaccaatcccaaagctagcagaagataagaaataaccaaaatcagagctgaactgaaagaaattgagacacacacacaaaaaatacaaaatatcaatgaattcaagagttgatttttttaaagaataaataagactgataggccactatctaaactaattawaaaagagagaaaattcaaatacacaatcagaagtgacaaagagacattatcactgaccccacagaaatacaaaaagccctcagagactattatgaacactgagaagaaactgataaattcctggaaatatacaacctcccaagattgaacaaggaagaaactggaaccctgaacagaccaataacaagttctgaaactgaattggcagttaaaagcctaccaaccaggaaaagctcaggaacagatggattcacaactgaattctaccagatgcataaagaagagctggtactattccta

SEQ ID NO: 50569 - DNA, 601 bp, Human
aaccacacccttggaacacagtgcaataaaaatagaaatctttactaagaagatcactgaaaaccatacaattacatgaaaattaaacaacatgctcctgaatgacttttgggtgaatgatgaaattaaggcaaaaataaagaaattgattgaaattaatgagaacaaatatataacataccagaatctctgggacacagctaaaacagtgttaaaaaaaaaagttcacagtgctaaatgcccacatcaaaaagttagaaagatctcaaattaacaacctaacatcacacctagaggaatyagcaaaccaatcccaaagctagcagaagataagaaataaccaaaatcagagctgaactgaaagaaattgagacacacacacaaaaaatacaaaatatcaatgaattcaagagttgatttttttaaagaataaataagactgataggccactatctaaactaattaaaaaagagagaaaattcaaatacacaatcagaagtgacaaagagacattatcactgaccccacagaaatacaaaaagccctcagagactattatgaacactgagaagaaactgataaattcctggaaatatacaa

SEQ ID NO: 50570 - DNA, 601 bp, Human
atgactcactggtgtctctgaaagcaagggagagaaagcaagcaacttggaaaacatatttgaggatattgtccatgaaaatttccttcaggaaatgcagggaacccctgtgagatactatataagatgaacatccccaagatacatagtccgtcagattctccaaggtcaaaatgaaagaaaaaatgttaaaggcagctagagagaagaggcaggacaccaacaaagtgaaccccgtcaggctaacagtggatgtttcagcagaaaccctataagccagaagatactgggggcctatatmcagtattctttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcatgagccac

SEQ ID NO: 50571 - DNA, 601 bp, Human
tgctttggctggcacacccatcgaagtgttgtggtcattgggctgggaacacctcggcccattcagcgtagcaggttcctaaccttgaggggccagagaacaaatctaggggcccaatgtcagtcccccagagccagagcatgaaacccaggagtgctgagctgagcgttggctccctaaaatcttcctgaaatgaagacagtcaactgaacccacctcatgctgcaatcaaaccctcaagggcatcaaagaagataaaagcaaaaaaccctatctaaaggtcagtagcctcaaagattgyaggatcatcagtcaacacagatgagaaagaaccagtgcaagaactctggcaactcaaaaagccagagtatctttttatctccaaatgaccacactaattccccagcaatggttcttaaccatagtgaaatgactgaaatgacagacatagaattcagaatatggataggaatgaagatcactgagatttgggagagtcaaaacccccaaggaatctaaggaattcaataaaacaatacaggaggtgaaagacgaaatggccattttaagaaaaaaccaaacttatctgatagagctgaaa

SEQ ID NO: 50572 - DNA, 601 bp, Human
atcccactgccgaagtgctttggctggcacacccatcgaagtgttgtggtcattgggctgggaacacctcggcccattcagcgtagcaggttcctaaccttgaggggccagagaacaaatctaggggcccaatgtcagtcccccagagccagagcatgaaacccaggagtgctgagctgagcgttggctccctaaaatcttcctgaaatgaagacagtcaactgaacccacctcatgctgcaatcaaaccctcaagggcatcaaagaagataaaagcaaaaaaccctatctaaaggtcagyagcctcaaagattgtaggatcatcagtcaacacagatgagaaagaaccagtgcaagaactctggcaactcaaaaagccagagtatctttttatctccaaatgaccacactaattccccagcaatggttcttaaccatagtgaaatgactgaaatgacagacatagaattcagaatatggataggaatgaagatcactgagatttgggagagtcaaaacccccaaggaatctaaggaattcaataaaacaatacaggaggtgaaagacgaaatggccattttaagaaaaaaccaaacttat

SEQ ID NO: 50573 - DNA, 601 bp, Human
gctgtgctgctgccattcatcactggtgcagctatatgcaggaacaccaccacccaactcctgctggtgccccaccccaggcaatgcacgtgcaccccactgcactgttgcagctgctggcacacgtgagcgagcatggatcccactgccgaagtgctttggctggcacacccatcgaagtgttgtggtcattgggctgggaacacctcggcccattcagcgtagcaggttcctaaccttgaggggccagagaacaaatctaggggcccaatgtcagtcccccagagccagagcatgaaamccaggagtgctgagctgagcgttggctccctaaaatcttcctgaaatgaagacagtcaactgaacccacctcatgctgcaatcaaaccctcaagggcatcaaagaagataaaagcaaaaaaccctatctaaaggtcagtagcctcaaagattgtaggatcatcagtcaacacagatgagaaagaaccagtgcaagaactctggcaactcaaaaagccagagtatctttttatctccaaatgaccacactaattccccagcaatggttcttaaccatagtgaaatgactgaaatgacagac

SEQ ID NO: 50574 - DNA, 601 bp, Human
cccccaccagtgtcccacccctgctgtgctgctgccattcatcactggtgcagctatatgcaggaacaccaccacccaactcctgctggtgccccaccccaggcaatgcacgtgcaccccactgcactgttgcagctgctggcacacgtgagcgagcatggatcccactgccgaagtgctttggctggcacacccatcgaagtgttgtggtcattgggctgggaacacctcggcccattcagcgtagcaggttcctaaccttgaggggccagagaacaaatctaggggcccaatgtcagtsccccagagccagagcatgaaacccaggagtgctgagctgagcgttggctccctaaaatcttcctgaaatgaagacagtcaactgaacccacctcatgctgcaatcaaaccctcaagggcatcaaagaagataaaagcaaaaaaccctatctaaaggtcagtagcctcaaagattgtaggatcatcagtcaacacagatgagaaagaaccagtgcaagaactctggcaactcaaaaagccagagtatctttttatctccaaatgaccacactaattccccagcaatggttcttaaccatag

SEQ ID NO: 50575 - DNA, 601 bp, Human
gctgtgccccctactgatacatgggtaccctaccatgctgccactgccagcatgaatgcacaaatggacactggcaaccctgcccctgccagtgccccacccccactggtgcaagggctagcacaggtgctggcaaccccacccccaccagtgtcccacccctgctgtgctgctgccattcatcactggtgcagctatatgcaggaacaccaccacccaactcctgctggtgccccaccccaggcaatgcacgtgcaccccactgcactgttgcagctgctggcacacgtgagcgagcatsgatcccactgccgaagtgctttggctggcacacccatcgaagtgttgtggtcattgggctgggaacacctcggcccattcagcgtagcaggttcctaaccttgaggggccagagaacaaatctaggggcccaatgtcagtcccccagagccagagcatgaaacccaggagtgctgagctgagcgttggctccctaaaatcttcctgaaatgaagacagtcaactgaacccacctcatgctgcaatcaaaccctcaagggcatcaaagaagataaaagcaaaaaaccctatctaaaggtca

SEQ ID NO: 50576 - DNA, 601 bp, Human
gtaccctgctgtgccccctactgatacatgggtaccctaccatgctgccactgccagcatgaatgcacaaatggacactggcaaccctgcccctgccagtgccccacccccactggtgcaagggctagcacaggtgctggcaaccccacccccaccagtgtcccacccctgctgtgctgctgccattcatcactggtgcagctatatgcaggaacaccaccacccaactcctgctggtgccccaccccaggcaatgcacgtgcaccccactgcactgttgcagctgctggcacacgtgagygagcatggatcccactgccgaagtgctttggctggcacacccatcgaagtgttgtggtcattgggctgggaacacctcggcccattcagcgtagcaggttcctaaccttgaggggccagagaacaaatctaggggcccaatgtcagtcccccagagccagagcatgaaacccaggagtgctgagctgagcgttggctccctaaaatcttcctgaaatgaagacagtcaactgaacccacctcatgctgcaatcaaaccctcaagggcatcaaagaagataaaagcaaaaaaccctatcta

SEQ ID NO: 50577 - DNA, 601 bp, Human
gtgtgcattcatcacataatgccaccactgctggcatgtgcgtaccctgctgtgccccctactgatacatgggtaccctaccatgctgccactgccagcatgaatgcacaaatggacactggcaaccctgcccctgccagtgccccacccccactggtgcaagggctagcacaggtgctggcaaccccacccccaccagtgtcccacccctgctgtgctgctgccattcatcactggtgcagctatatgcaggaacaccaccacccaactcctgctggtgccccaccccaggcaatgcacrtgcaccccactgcactgttgcagctgctggcacacgtgagcgagcatggatcccactgccgaagtgctttggctggcacacccatcgaagtgttgtggtcattgggctgggaacacctcggcccattcagcgtagcaggttcctaaccttgaggggccagagaacaaatctaggggcccaatgtcagtcccccagagccagagcatgaaacccaggagtgctgagctgagcgttggctccctaaaatcttcctgaaatgaagacagtcaactgaacccacctcatgctgcaatcaaaccc

SEQ ID NO: 50578 - DNA, 601 bp, Human
agaccatgtcagaccatcgaagaactctagcagactggctcccactggtgtgcaccagctcacccacagcctcccctcaccgcagcctcccttcactggtgcacactcattcgtgccccactcccccaccatcccacatcgctttgctggtgcactgtgagtggaccttgcctccctctcttccagcacatgtgtgtgcattcatcacataatgccaccactgctggcatgtgcgtaccctgctgtgccccctactgatacatgggtaccctaccatgctgccactgccagcatgaatgcrcaaatggacactggcaaccctgcccctgccagtgccccacccccactggtgcaagggctagcacaggtgctggcaaccccacccccaccagtgtcccacccctgctgtgctgctgccattcatcactggtgcagctatatgcaggaacaccaccacccaactcctgctggtgccccaccccaggcaatgcacgtgcaccccactgcactgttgcagctgctggcacacgtgagcgagcatggatcccactgccgaagtgctttggctggcacacccatcgaagtgttgtggtcattgggc

SEQ ID NO: 50579 - DNA, 601 bp, Human
cattctgaatgccccccatctgctggactctcttggggccccagcctggttgtgcccagagggcagtatcagatgcccaaccagggtgcttccctgggaccctcttcatggcttctttgccagcagaccatgtcagaccatcgaagaactctagcagactggctcccactggtgtgcaccagctcacccacagcctcccctcaccgcagcctcccttcactggtgcacactcattcgtgccccactcccccaccatcccacatcgctttgctggtgcactgtgagtggaccttgcctcccyctcttccagcacatgtgtgtgcattcatcacataatgccaccactgctggcatgtgcgtaccctgctgtgccccctactgatacatgggtaccctaccatgctgccactgccagcatgaatgcacaaatggacactggcaaccctgcccctgccagtgccccacccccactggtgcaagggctagcacaggtgctggcaaccccacccccaccagtgtcccacccctgctgtgctgctgccattcatcactggtgcagctatatgcaggaacaccaccacccaactcctgctggtgcccc

SEQ ID NO: 50580 - DNA, 601 bp, Human
agtctcaggagcaaatgggccatgaaaggccaaattgactgttaattctaattaaaaagaggaagctgctacagcataatgagtgtggacagttaattagcaggtaagaaaacacaattaaagtctctcagaacaaacctacagtgatgtgttctgtttggtggtgagttaagcacactcagatgacctgtttctaagcttggtgaggagtttctgtttcaatagagacggaggtcagcagtcttgctggtaggttctcatgggcgcattttaacattcttcctttttggatgagcatggkgctgggagggggtgttgaaatagaaaagcaagagtgactagataaaagatggtcgagctaggaggaacatctcccaccgagagaccgggacatcaggaagactggcacactcaagccacatcttcagagagaaggcattgagagtggatagagggaggatacagatgctgggctgaagcagggaagtctgggaaccctgcacggggctgctgagcaatgggacttgtttcctggcccccagcgactcctggggaagggatgagttgaacaggtgaggaatggcccgctctcaccatggac

SEQ ID NO: 50581 - DNA, 601 bp, Human
ttctttttttttttttttttggagaccgagtctcactctgtcacccaggctggagtggagtgcagtggcacgatctcggctcactgcaagctccacctcccagtttcacgccattctcctgcctcagcctcccgagtagctgggactacaggcacccgctaccacgcccggctaattttgtatttttagtaaagccggggtttctgcatgttggtcaggctggtctcaatctcctgaccttgtgatccgcctgcctcggcctcccgaagtgctgggattacaggcgtgagccaccgtgccyggccagaaattctttatgcagttgaggagatggagggctaaccagggtgcacgttcagtgagagcctgggctgcgatggggaggtgggacaggagaggcatcttgtgaggggccagcaggggtggattctagggtgtctaggaggccatgcttggggcaggagtttgcaggcagaagctgtaggcctgttggagggttttaggaggagaaagacaggatcagatttgtgatttgaaaagtgtccccgatgcagagtgggatatgggtcagcagaaggagggtgtggaggcagactgggac

SEQ ID NO: 50582 - DNA, 601 bp, Human
tctttttctccctgttgcttgccccatagccaatcatgtctgtctcttgggtgcttgacagatgtttgctgaatgtgcagatgaagggaaaatgatgacagttaaacagatcttttaaggatgagtggaaattctttttttttttttttttggagaccgagtctcactctgtcacccaggctggagtggagtgcagtggcacgatctcggctcactgcaagctccacctcccagtttcacgccattctcctgcctcagcctcccgagtagctgggactacaggcacccgctaccacgcccrgctaattttgtatttttagtaaagccggggtttctgcatgttggtcaggctggtctcaatctcctgaccttgtgatccgcctgcctcggcctcccgaagtgctgggattacaggcgtgagccaccgtgcctggccagaaattctttatgcagttgaggagatggagggctaaccagggtgcacgttcagtgagagcctgggctgcgatggggaggtgggacaggagaggcatcttgtgaggggccagcaggggtggattctagggtgtctaggaggccatgcttggggcaggagtttgca

SEQ ID NO: 50583 - DNA, 601 bp, Human
gcattttgtctctttttctccctgttgcttgccccatagccaatcatgtctgtctcttgggtgcttgacagatgtttgctgaatgtgcagatgaagggaaaatgatgacagttaaacagatcttttaaggatgagtggaaattctttttttttttttttttggagaccgagtctcactctgtcacccaggctggagtggagtgcagtggcacgatctcggctcactgcaagctccacctcccagtttcacgccattctcctgcctcagcctcccgagtagctgggactacaggcacccgcyaccacgcccggctaattttgtatttttagtaaagccggggtttctgcatgttggtcaggctggtctcaatctcctgaccttgtgatccgcctgcctcggcctcccgaagtgctgggattacaggcgtgagccaccgtgcctggccagaaattctttatgcagttgaggagatggagggctaaccagggtgcacgttcagtgagagcctgggctgcgatggggaggtgggacaggagaggcatcttgtgaggggccagcaggggtggattctagggtgtctaggaggccatgcttggggca

SEQ ID NO: 50584 - DNA, 601 bp, Human
gcatgagacatgagcatgtattaattaggcaaaaggggcaggtccctccaccactaccttattctcgatcacagcctcatgtttatttatttccatggattgcatcatcatctttgcatttatcttttgcttgttcattgtgctcctcgagggcaggcattttgtctctttttctccctgttgcttgccccatagccaatcatgtctgtctcttgggtgcttgacagatgtttgctgaatgtgcagatgaagggaaaatgatgacagttaaacagatcttttaaggatgagtggaaattctttttttttttttttttggagaccgagtctcactctgtcacccaggctggagtggagtgcagtggcacgatctcggctcactgcaagctccacctcccagtttcacgccattctcctgcctcagcctcccgagtagctgggactacaggcacccgctaccacgcccggctaattttgtatttttagtaaagccggggtttctgcatgttggtcaggctggtctcaatctcctgaccttgtgatccgcctgcctcggcctcccgaagtgctgggattacaggcgtgagccaccgtgcctggc

SEQ ID NO: 50585 - DNA, 601 bp, Human
aggtagccagcataagtaactacacaagcctgtggtctcaccacatgggatgtgttttctaaaaaaaaaaaaaaaaaatggaaaggagacttctccaggaatgggcatgagacatgagcatgtattaattaggcaaaaggggcaggtccctccaccactaccttattctcgatcacagcctcatgtttatttatttccatggattgcatcatcatctttgcatttatcttttgcttgttcattgtgctcctcgagggcaggcattttgtctctttttctccctgttgcttgccccatagcmaatcatgtctgtctcttgggtgcttgacagatgtttgctgaatgtgcagatgaagggaaaatgatgacagttaaacagatcttttaaggatgagtggaaattctttttttttttttttttggagaccgagtctcactctgtcacccaggctggagtggagtgcagtggcacgatctcggctcactgcaagctccacctcccagtttcacgccattctcctgcctcagcctcccgagtagctgggactacaggcacccgctaccacgcccggctaattttgtatttttagtaaagccgggg

SEQ ID NO: 50586 - DNA, 601 bp, Human
ggcatcaatggtggcagaaagctgattcaacttctgccttcaaggagccgtcagcatctgaggtccactgagtcaagaaaaccagccctgagcacaagattaacgttctccttcattgggcagtaataataaaaatagttaaaatttattgagcactttctatgtgttcttgaaaggttttccctttgtagggtttctaattattttagaaaaggagtgataaaatgtcatcagatatggcatcagacattgttgatcttgggcaaggaagatcaaattatcaggagtcactggtctgaaytgaaagagcaaaggaattttcctcctgttgtatccagagacactgcaaaagttagaggcagaaaatatcttagggaccccctaggccagccccaacccaatatttcaggtggggaaactgaggctagagaggtggagtgagactcccagtgtttcagaggagtaggatccaggacttccaaactagcctgattgactgctctactgtgtcctccctaggaattcctggtgcccacccatgcttagactgttcccactgctggaaatgcccccgagctttggaaagatttcaaggcacaca

SEQ ID NO: 50587 - DNA, 601 bp, Human
ctctccacttccaagctgtgtaaccacaggtaagtcgtatctctggctctccattttcttgtacataaaatgaggacagaacaggagttcctgcctcttaggtctgtactggggattaaatgagataatgcttagcaacatgtttaatgtgtggctgtattagtccgttttcacactgctgtgaagaactacctgagactgggtaatttatgaagaaaagaggcttaattgacttacagttctgcacggctggagaagcctgaggaaacttatgatcatggtggaaagggaaggggaagcragtatatcttactgtggtggagcaggggagagaaagtgaaggcggagatgtcatacacttttaaaccatcagatctcatgagaactcactcactatcatgagaacagcataaaagaaaccacctccgtgatccaatcacctccaaccaggtccctcccctgacacatgggaattacaatttgacatgagatttgggtgggcacacagagccaaaccatattggcaaaggcccaatcaatatcaatgattacggcgattcctcttctgcctgtcattaatcccctcagtgtttgctgggaa

SEQ ID NO: 50588 - DNA, 601 bp, Human
tagatatattttctcttagtcaccaggtttaacccagtttaaattcccacctctccacttccaagctgtgtaaccacaggtaagtcgtatctctggctctccattttcttgtacataaaatgaggacagaacaggagttcctgcctcttaggtctgtactggggattaaatgagataatgcttagcaacatgtttaatgtgtggctgtattagtccgttttcacactgctgtgaagaactacctgagactgggtaatttatgaagaaaagaggcttaattgacttacagttctgcacggcwggagaagcctgaggaaacttatgatcatggtggaaagggaaggggaagcaagtatatcttactgtggtggagcaggggagagaaagtgaaggcggagatgtcatacacttttaaaccatcagatctcatgagaactcactcactatcatgagaacagcataaaagaaaccacctccgtgatccaatcacctccaaccaggtccctcccctgacacatgggaattacaatttgacatgagatttgggtgggcacacagagccaaaccatattggcaaaggcccaatcaatatcaatgatta

SEQ ID NO: 50589 - DNA, 601 bp, Human
tcttattttacagattaggaaaatgaagctcagagagggaaatgtatttgctcaaggtaatgaaacttggtggaagagccagatttagtaaaaaaaaaaaaaaaaaaaaaaaaaaaaaaagtccttctgactcctttctttacagaataacaagaggtgatatggattgaggtatatgtccctcaccttgaatttattttattcccctctttctttctctccatctctccttcccccactcatttttctcccttcttgccaggaaaatagaaaatacgtgctgattaattgagtattctaygtaaagaattgccaagtaatttaaaaaattctgtagatatcctaaaaatattcctaataattttgagacattatctacttcattagtaatgccattatttttccttcagaaatgttcataagcaaagaaatattcttccccctcattggtaaattcctaatagttatacttagttatgttcaagtgaaaaggaattgaattatgcacgttcttcatatgagacttactttttgaaaactgacttttcctccagatctctgttctctgtgaatctgtgctacagctcagctggtctaacaa

SEQ ID NO: 50590 - DNA, 601 bp, Human
cttctttgctatcttgtttgagtatcctattctggattgccccagaagcagaccctgagaagcagtttatgtgccagttgatcccaggaaatgcagggaagagtgcagggaggtgaaagaggtggataagggctatgttattagcaacaccaccatgggaagtcacatcttaatccaactgggaccctcgggaaactgtggaaaacacatctcagagttacccagtctgaggggtaggagggctggattatttatccaccatgtctcatcagtcactcattgagtgttatactttgagcartgcttttggcctgccacaatgtgggctgagagagctggggaagtcctcaagcaaaaagccacatacgggagcagttgtaggtctgtctgagaatcacaaaggggtgtggacaaagggatttggggaagataacaagaatctttgctatgccatctattccttaagtgtttaacttctcattgactattgcaataatcaggtagccattactaataacaacagtgaagaaaatgtttatatcatatacacctaagtactagtttcaggagttggggtataacactagcattaagaacatgg

SEQ ID NO: 50591 - DNA, 601 bp, Human
atcttgttatcttattagagtcttctttgctatcttgtttgagtatcctattctggattgccccagaagcagaccctgagaagcagtttatgtgccagttgatcccaggaaatgcagggaagagtgcagggaggtgaaagaggtggataagggctatgttattagcaacaccaccatgggaagtcacatcttaatccaactgggaccctcgggaaactgtggaaaacacatctcagagttacccagtctgaggggtaggagggctggattatttatccaccatgtctcatcagtcactcawtgagtgttatactttgagcagtgcttttggcctgccacaatgtgggctgagagagctggggaagtcctcaagcaaaaagccacatacgggagcagttgtaggtctgtctgagaatcacaaaggggtgtggacaaagggatttggggaagataacaagaatctttgctatgccatctattccttaagtgtttaacttctcattgactattgcaataatcaggtagccattactaataacaacagtgaagaaaatgtttatatcatatacacctaagtactagtttcaggagttggggtata

SEQ ID NO: 50592 - DNA, 601 bp, Human
gtcttctgaccatgtccttttgatggcacctctcatttcaaaagaacagaaagatggggaaggtgtcatgtctgtatccaatgtgtcttgcacagggtactcttcatatcacagtactcaatatatgttgcccaacagtccaatatagcttaaactttgaaaattagccccaaataattatgtatgtgggtccactcatcttgttatcttattagagtcttctttgctatcttgtttgagtatcctattctggattgccccagaagcagaccctgagaagcagtttatgtgccagttgatmccaggaaatgcagggaagagtgcagggaggtgaaagaggtggataagggctatgttattagcaacaccaccatgggaagtcacatcttaatccaactgggaccctcgggaaactgtggaaaacacatctcagagttacccagtctgaggggtaggagggctggattatttatccaccatgtctcatcagtcactcattgagtgttatactttgagcagtgcttttggcctgccacaatgtgggctgagagagctggggaagtcctcaagcaaaaagccacatacgggagcagttgtaggt

SEQ ID NO: 50593 - DNA, 601 bp, Human
agaaagcaggggaaacttccactttgaaaccattagatcttgtgagaactccctctctatcacaagaacagcatgggggaactactcccatgattcaatcacctcctacaagtccctcccctgacatgtggggattacaattcgagatgagatttgggtagggacacagaaccaaatcatattctggtgttgattttcctatagcaactttttgtagaacatagcatatccctttgagctgcagatccactcttcatttacttcttatgttatacctttgaaaatgtcttattttctacawgttggattctttgctttagagacacccattatccttgtgttggatcagctttgtttccctttcctattggccatctcgtgagcgactttgttctcttgttttctgcatagatattgtatgctctgggaaatctctctcttccttcttctctccctttctttcctttcttctttgttctagtttcccaggttggctctttccctgtgcattgtcctccatttctcttatccttattgcagtgagctactttgtccagattgccacctgctgtgatatgatggaagaccgatctttgacacc

SEQ ID NO: 50594 - DNA, 601 bp, Human
ttccatttactttacaaagaaacttaggcttgtggaaggtaagtaattttttcaagagcacatcaccagtaagctgcaaactcagtgactctgggtaactccacagcatgagttttaactactcccttgggccccaagcaagtctaagatactaacaaaacttaaaatacttgaaaagaacttagctatcttcatagttttatctgaatgctctcccaaaccctgcaattcatttatctctcttactgaaggccttggtggcctgatttcctaagagtcttttaaggtctctttcttccawtccaaggtaaaatgagaaagaatggggtttgataaagaaacagaatgcatttcaggcaggccttcttttatttttattttgtttttaagaatgaaaatagttttattgtttttttctgactttcatgaataatatttgctcatgtaaaataattttttaaagcatgcaacatgacaaagtataaaaaggaaacaaaaattacctctaagccttccacctagagatgatctccatttgtattttggtatttagctttgatgttaaatgttctgtgaagaagattggggctacttgggatat

SEQ ID NO: 50595 - DNA, 601 bp, Human
gggccaatgaagcagcctcttgtagatcatggagaggggtttgcagttgaagaaaaccactttgggctgctatgcagcagttgaggtgatcaatttgcatttcacagaggtcactgctctttggagaaaagcctggagggtgtaggagaggatgcagcaggctgttggggcagtccagggaggaggcaatggttgtttaggggggctcagatcacggcaggtgagatgaaaggaagggtctgaatttggagacaattgctccattgaggtaaagctttcaaggtaagcattgcacatacamaatcacttagcaagccgacccaaccaagcagcccagggtgacaaagccacaaagccaaggccaactcaagtctgaatctctccagacctttcaccgttatcaccccactatgatgccagcaaggcttgcactccaacaaatcaaaaacaactcggaatggagcgtcccctcacctcccactacactgtgagcccctctgatcaggcactatctccatttgtctggcatttcccacagagtagatactccatcaatatttacttacataagttaaatgctcaaaagttgattttgacaaga

SEQ ID NO: 50596 - DNA, 601 bp, Human
gactaacatggtgaaaccccatctctactaaaaatacaaaaattagctgggcgtggtggtgcatgcttgttatcccggctactcgagaggctgaggcaggagaatcatttgaacctggaaggtggaggttgcagtgagccgagatcaagcatattgcacaccagcctgggcaacaagagtgaaactccctctcaaaaaaaaaaaaaaaaaaaaaaagataaaagaatgatacaacagactttgggaactcgggggaaagggtgggaggggggtgagttataaaacactacaaattgggtgratgtatactgcttgggtgatgggtgcatcaaaatctcggaaatcaccaccaaaaaacttattcatgtaaccaaacaccacctgttccccaaaaaacctatggaaataaaaaaataaaaataaaaaaggggagtgagcaaatgaataaatacatataaatacaaaatgtgataagcattctggaggagatgcactgtctattttggcagtgggtggagaaggatgctctggggaggagatggtggagatgtggattgaagacgggaaggtggctcctgaagatctggggaagatcatgccg

SEQ ID NO: 50597 - DNA, 601 bp, Human
tcgtatgttgtcactcaaaagtgagagctaagctacgaggatgcaaaggcataagaatgatacaactggggccaggcgcggtggctcacacctgtaatcccagcactttgggaggcagaggccagtggattacatgaggtcaggagtttgagaccagcctgactaacatggtgaaaccccatctctactaaaaatacaaaaattagctgggcgtggtggtgcatgcttgttatcccggctactcgagaggctgaggcaggagaatcatttgaacctggaaggtggaggttgcagtgagcckagatcaagcatattgcacaccagcctgggcaacaagagtgaaactccctctcaaaaaaaaaaaaaaaaaaaaaaagataaaagaatgatacaacagactttgggaactcgggggaaagggtgggaggggggtgagttataaaacactacaaattgggtgaatgtatactgcttgggtgatgggtgcatcaaaatctcggaaatcaccaccaaaaaacttattcatgtaaccaaacaccacctgttccccaaaaaacctatggaaataaaaaaataaaaataaaaaaggggagtgagcaaa

SEQ ID NO: 50598 - DNA, 601 bp, Human
gtgggacaagtctttattttgagagactgtcctgtgcaattgcagggcatttattaccctttactttctgatgccaggagagcctccagtcaccaccacaacccaagccaaccctacacatttccaaactcacatgtggtctcaggtctatacccttcctttcctccatatcctgtacagtgagaccagtgatcacgccctgtgcccagaccaggacctagggctcagcatgactgctgggatcccacttgaacctccccatctccagctggagtcaccactctgccaatgagatctacasctgggtgtttctcagacaagacagagtgggtaatggatgggaaatccctcagggacttttactaaactctagagagacagtgaacacaatttggaaattactaggctggaggcattcattgtgtcaacatccaacaattatttatgtgctggggctgttccaacagtgaggtcaaaagcaacatgtccttgctttcatgcggaacccttgtctgctgggatgacttgttcattaaaatgggagtgagtccaggaatggaaaaccaaacatcgtatgttgtcactcaaaagtgagagctaa

SEQ ID NO: 50599 - DNA, 601 bp, Human
ccagcatccatctccatctgccacactttagaacccccccacccctgccccttgactggatgtgtagtgggccccagttcctgagtcgccctggtggcattgcagtgggacaagtctttattttgagagactgtcctgtgcaattgcagggcatttattaccctttactttctgatgccaggagagcctccagtcaccaccacaacccaagccaaccctacacatttccaaactcacatgtggtctcaggtctatacccttcctttcctccatatcctgtacagtgagaccagtgatcacrccctgtgcccagaccaggacctagggctcagcatgactgctgggatcccacttgaacctccccatctccagctggagtcaccactctgccaatgagatctacacctgggtgtttctcagacaagacagagtgggtaatggatgggaaatccctcagggacttttactaaactctagagagacagtgaacacaatttggaaattactaggctggaggcattcattgtgtcaacatccaacaattatttatgtgctggggctgttccaacagtgaggtcaaaagcaacatgtccttgctttc

SEQ ID NO: 50600 - DNA, 601 bp, Human
ctgcaatgatgaaggcagccggccgctgagattgctggaagaactcaccagtcaagatgaacgggatgccacctgcagtgtgtgagccaggacatggaattaatcactctgagaaggtcatgcctccagcatccatctccatctgccacactttagaacccccccacccctgccccttgactggatgtgtagtgggccccagttcctgagtcgccctggtggcattgcagtgggacaagtctttattttgagagactgtcctgtgcaattgcagggcatttattaccctttactttctgawgccaggagagcctccagtcaccaccacaacccaagccaaccctacacatttccaaactcacatgtggtctcaggtctatacccttcctttcctccatatcctgtacagtgagaccagtgatcacgccctgtgcccagaccaggacctagggctcagcatgactgctgggatcccacttgaacctccccatctccagctggagtcaccactctgccaatgagatctacacctgggtgtttctcagacaagacagagtgggtaatggatgggaaatccctcagggacttttactaaactcta

SEQ ID NO: 50601 - DNA, 601 bp, Human
ggaaacacaggctttgttaccactgtatcctcattgcctagaaaagtgcctggcacacagctgggactcaacatatatatgtgttgaattaatgaattcggtttccaatgaacagatcctttccctacccaaaaagacttgtatctgattcttgagtatgtgggcattttcctactgatcactgtcacccttgggacaatgatcccattagctgtggttatgatgatgacaatgaggatgttaaatgggtggtggtttgcagtgtgcactggaactattagatggaatttgtcttacacartgatgagcacattgtaaaaatgataagtaggttgtaggtttgagttgctaacctaggagtccttgcataccgtcagcaatgggtagcccacaccctctgaaagagcccacagcatttagggaagctctaggaaggcacaggaaagagaaagggatgaaaggttttgcccaaagcatagtttcttccttccttaggaaaatagcatgagtttccagttgagaggagagagatcaacttctgctctatgaatcacccctcaagtgctgcagaatcaaagggaaccccatgggcaaaagactc

SEQ ID NO: 50602 - DNA, 601 bp, Human
tgtttccccgttcagctccagaaccaggaaacacaggctttgttaccactgtatcctcattgcctagaaaagtgcctggcacacagctgggactcaacatatatatgtgttgaattaatgaattcggtttccaatgaacagatcctttccctacccaaaaagacttgtatctgattcttgagtatgtgggcattttcctactgatcactgtcacccttgggacaatgatcccattagctgtggttatgatgatgacaatgaggatgttaaatgggtggtggtttgcagtgtgcactggaaytattagatggaatttgtcttacacagtgatgagcacattgtaaaaatgataagtaggttgtaggtttgagttgctaacctaggagtccttgcataccgtcagcaatgggtagcccacaccctctgaaagagcccacagcatttagggaagctctaggaaggcacaggaaagagaaagggatgaaaggttttgcccaaagcatagtttcttccttccttaggaaaatagcatgagtttccagttgagaggagagagatcaacttctgctctatgaatcacccctcaagtgctgcagaatca

SEQ ID NO: 50603 - DNA, 601 bp, Human
gggagggtgcggcacagagcaactgctccgtaactgtgaatgcaggaacagccaccatgctggggtggctggggcttggagtgccgcaaatactgacctttggctcacccaagctggcagcagaatctctgggatgtgttgggcttggcactagtaaattagcaggcggacttagaactgagtgtccagaatagttggtgaggggaggaagacaggaagacaggattgaaatagctcctgagaatgggtggtgatgtatatgacggattctcacctcctccaggtggtaccacccagcacygagggcagcagggagccctggtgggcatttgagcagggaagcttcatcctccttctgcaaatgcttctgggccccttgctctgtgcagaaggcttgcaaagccttttgtgttcctgctcccagataaccctcttatctgatcctctctctcacccatctttcttgctcactctgtttcagtcatataggcctctgggtggtttcttacacaggccaaatattagccctgcctaagggcccttgcacttgctgtttttctagccaggacttcaccattcccagacagctctgctccctcac

SEQ ID NO: 50604 - DNA, 601 bp, Human
tgtgctatttggtcatggcggcccgaggcccgagtagatgaacacagtagctcttgattgtggctgagctggttttcagaagggaggtaggtcagaaatggttcacgtatggcatctagaacacatacacgttgctcccatgggcgggcgtgagtggggctgtggtgggctggggttgggggatgtgactcagaacttgttagccctgtatttctctaatgcattgatcattgctcacagcagccccctgagcccagctctctaacttgctaagctcctctccggaaaggaaattaaccgkgggtgccttcccaggcttgggtcaggaggctgacatttcacaaaatactaaacgtatctacctgcccagtgtctccatctgtatgtccagcctggctgttcctgctccgatgaaggttcatcaatagtcacacctgcaatgtttcccgaatgacccctgaaaacccagacaccctggacatacccagcttctcaggaactgtttccagaggggatttgtttcgaaaatgcccacaggcataagaaaaggctcataaatgacaggcaagagaagcaagaacaaaacaaagaattgattcca

SEQ ID NO: 50605 - DNA, 601 bp, Human
tagggtggggccctaatccaatatcctgctattctcataagagaggagaagaggacacagatcaacacagaagggagaccatgcgaggacacagggagaagacagctgcaaggaacatggttgtgctttggtcaagggtaggctgaggtaaacatccagagtgactcagtgagtttagagggcaggtgtataactctacttgttatcacagccatgtagccataacataggaagggcatcccttggccctacaccactgttgtctgtaaaaggtataactgccctgctgacactgtacatrcactcttgcgctggcgcccagagaaagagagagaaaaccagagctgtccatctgcaaaatggaaagaggggagccaggacatagcttgagttctggtgcccagagaaagagttaagctgctgaccttgaagggcaagctggcagtgcagccatgtgtgggagctgctggactaagcagccaagacagggtggacagtgtgagagaactagtgtgagtgagcttctcatgagagactacattgcacctgcctacggccccctgagtgttcttccagctgtctgctcatccacccactccct

SEQ ID NO: 50606 - DNA, 601 bp, Human
catacatttgcatgcaattttctctgaatcggaaaatattggcactccacactggagagtgtttttcgcaggctttataacaaatggcccaagcaacactgatgctgaccacagcaaatgctgccaacaggatcccagagccagagtgtggaggtgagcatgaagggatgtgggctcctccccacaaccatagttgcctcccttctctgttggtgatgagaaggctaaggattttccctgttttacaggtgaggaaacccaggcttggagaggaaacccatgcttgaggagcatgctcagsgccctccgctaatacatgggcttcaatacaggcgtgattcgtgccgttgtctgtggctctactggctcagacattttattctgaggaagaagcccaggcttcttaggggtctgtttgggggctggaatacatttgccactgatacttattggaataagtgaaacaatcaagttgtgtgagtagtttctcttggtggctgctgtgggctgaactgcgtccctcctgaaattcatacgttgagtcctaagccctagcacctcaggatgtgattaagttgaaatgaggtcattagggtggggc

SEQ ID NO: 50607 - DNA, 601 bp, Human
ggcactcaggatatgacccaatattcttcaggttgaaaagaataatttgctcttttccagaatttattgagctcaaactgcattttataactcgagtagaatcaaagaggcatacatttgcatgcaattttctctgaatcggaaaatattggcactccacactggagagtgtttttcgcaggctttataacaaatggcccaagcaacactgatgctgaccacagcaaatgctgccaacaggatcccagagccagagtgtggaggtgagcatgaagggatgtgggctcctccccacaaccayagttgcctcccttctctgttggtgatgagaaggctaaggattttccctgttttacaggtgaggaaacccaggcttggagaggaaacccatgcttgaggagcatgctcagcgccctccgctaatacatgggcttcaatacaggcgtgattcgtgccgttgtctgtggctctactggctcagacattttattctgaggaagaagcccaggcttcttaggggtctgtttgggggctggaatacatttgccactgatacttattggaataagtgaaacaatcaagttgtgtgagtagtttctct

SEQ ID NO: 50608 - DNA, 601 bp, Human
acccaaaggaatgtaaatcattgtattataaagatacatgcatgtgtatatttattgcagcactattcacaacagcaaagatatggaatcaacccaaatgtgcatcaacgatagactggataaagaaaatgtggcacatatacaccatggaatactatgtagccataaaaaggaatgagatcaagtcctttgcagtgacatggatggagctggaagctgttaccctcagaaaactaacataggaacagaaaaccaaacactgcatgttctcacttataagtgggagctgaacaacgagaayacatggacacattgaggggaacaatactggggcctatcagggggttgtggtggagggagagtgttaggaagaatagctaatggactctgggtttaatattaatacctaggtgattggttgatctgtgtagcaaaccaccacggcatgtgtttacttgtgtaacaaacctgcacatcctgcacatgtaccccaaacttagaataaaagttgaagaaaaacaaaaagctcagaaaaagtttgactagtcctgcccgtctcactctgcttaggcactcaggatatgacccaatattcttcagg

SEQ ID NO: 50609 - DNA, 601 bp, Human
aatgccatttgtctcagcaatcccattactgggtatctacccaaaggaatgtaaatcattgtattataaagatacatgcatgtgtatatttattgcagcactattcacaacagcaaagatatggaatcaacccaaatgtgcatcaacgatagactggataaagaaaatgtggcacatatacaccatggaatactatgtagccataaaaaggaatgagatcaagtcctttgcagtgacatggatggagctggaagctgttaccctcagaaaactaacataggaacagaaaaccaaacactgyatgttctcacttataagtgggagctgaacaacgagaacacatggacacattgaggggaacaatactggggcctatcagggggttgtggtggagggagagtgttaggaagaatagctaatggactctgggtttaatattaatacctaggtgattggttgatctgtgtagcaaaccaccacggcatgtgtttacttgtgtaacaaacctgcacatcctgcacatgtaccccaaacttagaataaaagttgaagaaaaacaaaaagctcagaaaaagtttgactagtcctgcccgtctcactc

SEQ ID NO: 50610 - DNA, 601 bp, Human
ttcctcaaagacctagagacagaaatgccatttgtctcagcaatcccattactgggtatctacccaaaggaatgtaaatcattgtattataaagatacatgcatgtgtatatttattgcagcactattcacaacagcaaagatatggaatcaacccaaatgtgcatcaacgatagactggataaagaaaatgtggcacatatacaccatggaatactatgtagccataaaaaggaatgagatcaagtcctttgcagtgacatggatggagctggaagctgttaccctcagaaaactaacayaggaacagaaaaccaaacactgcatgttctcacttataagtgggagctgaacaacgagaacacatggacacattgaggggaacaatactggggcctatcagggggttgtggtggagggagagtgttaggaagaatagctaatggactctgggtttaatattaatacctaggtgattggttgatctgtgtagcaaaccaccacggcatgtgtttacttgtgtaacaaacctgcacatcctgcacatgtaccccaaacttagaataaaagttgaagaaaaacaaaaagctcagaaaaagttt

SEQ ID NO: 50611 - DNA, 601 bp, Human
acatagtcacgggcaaagatttcatgacaaaaatgtcaaaaaaaaaaaaaaaagaagagcaacaaaagcaaaaattgacgaatgggatctaattaaactaaagagcttctccactgcaaaagaaactatcatcatagtgaacatacaacctacacaatgagagaaagtttttgcaatctatccatctgacagaggtctaatatccagagttcataaggaacttaaacaaatttacaagaaaaaacaacctcattaaaaagtgggcaaaggacacacacagatgcttctcaaaagaagacaytcatatggccaaaaaacatatgaaaaaaagctcaacatcactgatcattagagaaaggcaaatcaaaaccacaatgagataccatctcataccagtcaaaatggcgattattaaaaagtcaagaaacaacagatgctggcgagcttgcggagaaaaaggaatgcttctacattgttggtgggagtttaaattagttcaatcattgtgaaaaacagcatggtgattcctcaaagacctagagacagaaatgccatttgtctcagcaatcccattactgggtatctacccaaaggaatgtaa

SEQ ID NO: 50612 - DNA, 601 bp, Human
ggccaacattgtgaaaccccatctctactaaaattacaaaaattagctaggcgtggtggcagtcgcctgttatcccagctacttgagagactgaggtaaagattaaaactggaccccctccttacaccttatacaaaaattaactcaagatgcttaaagacttaaatgtaaaacccaaaactataaaaaccctagaagaaaatctaggcaataccattcgggacatagtcacgggcaaagatttcatgacaaaaatgtcaaaaaaaaaaaaaaaagaagagcaacaaaagcaaaaattgaygaatgggatctaattaaactaaagagcttctccactgcaaaagaaactatcatcatagtgaacatacaacctacacaatgagagaaagtttttgcaatctatccatctgacagaggtctaatatccagagttcataaggaacttaaacaaatttacaagaaaaaacaacctcattaaaaagtgggcaaaggacacacacagatgcttctcaaaagaagacattcatatggccaaaaaacatatgaaaaaaagctcaacatcactgatcattagagaaaggcaaatcaaaaccacaatgag

SEQ ID NO: 50613 - DNA, 601 bp, Human
tctaacacttatgatgtgccatttaagatagaatttcaatccactgagcatctgtttcctcatttgcaacatggtgatatatacccacacattgttttgaagatgaaatgagatatatcaattttgcattcaacatcctccacacccccatctgcaggcggaatggacatctgacttatcaagtccaaagtggagcctctaaaactgcctgctctagccttcctcatctctgctgatggcacctccatccttctgattgattatgccaacaaaaacacttggaggcaggctgagcttctcyctctctctcccacccacatctgctccatcaggaaatcatgttgctccaccttgaaatgtattccaaatctgagggtttgtcatcacttctattgtaacctaattttggtgcaagccaccatcatgttttgcttggatttttgcaatagcttgtcaactgatttccctgcttttcactttaagcataatcttaagattattcttaacagacaagccagagtgatcctgttaaacaaaggacaaaacttgtcactcctctgctcaaaacccaccatgacttcctaagtcacctgcaggaaag

SEQ ID NO: 50614 - DNA, 601 bp, Human
ggcagagacaaaaaccctcaaatagataatcagtaaacttgctgttaaaccatctctacacagatttttaagatagctccacattcatataccaatactcctagacaaaacaccatgtgtgatgctggctcaataaggcaagtgtaccctacatgaagtgttatcacataaggcttgaataaatcagcttcaaactctgggaaagatgagaaaatggcacttttttgttgttgttgttgcaaatttggcatttaaaaattaatcatcacgaaagcaaaatggaatgcttgctgaatattarcttaagcttatatttacaattaaccacattgtctccttgcttctactatacacatgagacaagaatgacatcaaaagggaagagaaatgccttagttcataggaagaatgtggagcacagaataggccaaggtaatgccagttttttctaatatgcaaatgatctaactcactaattgatactctgaggcggccttgcacaaataagagagatcagaaaaaatagaaatgctcaatgcaatcactccgttttatgtatcctgattagtgtttggactagaataaccctgccaactgcact

SEQ ID NO: 50615 - DNA, 601 bp, Human
attgtagcaaagactaggaaacagtaggtgtccagacttttctgtggaaaggcagagacaaaaaccctcaaatagataatcagtaaacttgctgttaaaccatctctacacagatttttaagatagctccacattcatataccaatactcctagacaaaacaccatgtgtgatgctggctcaataaggcaagtgtaccctacatgaagtgttatcacataaggcttgaataaatcagcttcaaactctgggaaagatgagaaaatggcacttttttgttgttgttgttgcaaatttggcayttaaaaattaatcatcacgaaagcaaaatggaatgcttgctgaatattagcttaagcttatatttacaattaaccacattgtctccttgcttctactatacacatgagacaagaatgacatcaaaagggaagagaaatgccttagttcataggaagaatgtggagcacagaataggccaaggtaatgccagttttttctaatatgcaaatgatctaactcactaattgatactctgaggcggccttgcacaaataagagagatcagaaaaaatagaaatgctcaatgcaatcactccgtt

SEQ ID NO: 50616 - DNA, 601 bp, Human
gagggggggcgttcttcccacgaacggtggctcggaccgcacgctgcgccaagctagggcgagatccccaccctgcgccgcgcccctctgcctcgcaaccacacacggccccagccgggaggcgccgcagccccggaacccacctccgcgctgctggaaggatggatgcggaggaggcgggagagaggcggcggctccggaacgagctgctcccacagcccctccgctcctcgccgtctcgccttcgtccccagcttacccagttctgcgcgttattgctcagcttgactttcttgcacargctcccggggatctccatgaccgcggagcgcgctgagcagccggggttctctgcgccgggagggtagcaagaggagggcaggccagcgagcggggcggggctggagggcggggcctcctcgcgtcggagcgggcgcgcgctgacttgcgcacgcgcccgtgctcgtggcctgggttgcgcggcgcatgcggcgcgcctcggaaatgggtccggggcagaggtctgtggggaagggcgaaacgccgggatagaaccggaggtagaagctgggggcggagcttcaacgctcgcgccggcgcg

SEQ ID NO: 50617 - DNA, 601 bp, Human
ccagggcttccccatctgggtcctaccagggtctacatttcttcagcggaacattcttcctggattaccaattttatcctgtgataggaattttaaaggtatatgggttcttcacacttgtgcctattaagatgatttaaatatgagagaggaagagatgacgggtgttccatgagggagagaaaaatttacaaggatcagaaaatttaaaattctagccccatcaaaaatcccccatagaatcaagtcttctctgcagccaaacacaagagcatcacggagccccagcctccctattgamccttacctccacttcccaacaaaaactctccagggcagtcaaacaagtttcgtcaatgtttctggagtaaaaaaaatagtaatttttattcccaacacttatccatgcagttcccctctgactcagaaatctgaaatcctccataaaccctcccaaaacgcccaggcgaaactaatctctcctctaaattgcaataaaacttctgtcttacgccactcactctggaccacaaagacatattcaccacttggcaaatgtcacaaccccaacacaaaccatgaactaccagaaggcaagcag

SEQ ID NO: 50618 - DNA, 601 bp, Human
atgggtccagcactaacaagctccatgacatctctgtgcctcagttttgtcatctataaaatgcaaatgctaattgtaatagaggatgataacagtaagagctaactctaattgtcacaatatccctgtgaggctatcattctcattttatagataagcacatagaggcatagagaaattaagtgaccaaccaaaagttacatagttaataaatagtggagtccagatttcagcccaggcagtcagctccagggtcctgcttttaaccactgtctctcataatattcaccctcagaaatgyaacaaaaactcaatgggctaatataggtaaaacatttcaaactgttcctggcacacactaaactctcctttgtgtttaactaatatcacccttacccccgtgcccaacctacttcccaatttccacacaggtaacaacctttctccccacttcccagaccaaaacttcaggatcatcttctaacattcctccctttttcatcccctaaatctagtcggtcctctcaactcttccttaaatgtttttaatgcagctactcctctagtcccactgccaccttaccccagcccttcagcccct

SEQ ID NO: 50619 - DNA, 601 bp, Human
agttgggctggagctatggaaattcagggagttgtgaaaggtgaatggaaaagcaaaccagagactgcatatgcttcttaatgtcacgtccagtttcaaacgcttcttttaggacactactccactgtaaggcaggtccaacagggtttcagcccaatatgattctacaaaatgggtgaatgacacctgggcctgaactgagtgtcccaaatttccctcagcccaactaacacatccccaagggcagatgaaaactggtcccattggagaaagattcaattggatagaaaatgatattcattatatctgacgctttatcagactgaagtaagaggcagctccaagagcaagtcaatttcttggtttttctttactattcccacaggtatatggacaactttaacttcctgtaattctaaccatttcccagagctgtaagactacattttcccatctctttgcctattgtctcccacgagtacacttcctttacctaatccttaacaggagctattatccaaagcttagtatttggtctcacatttactttccttatattctttaactcaaatttaactatgaaacctttacttccaacctc

SEQ ID NO: 50620 - DNA, 601 bp, Human
tttccaatagatgttagaagaattatccccctccatacgcaagtagaatagccaaaattgtctccagaattgccaaatgccccctagggctggtaaaatctcacgattgagaaccactggcatagagaactactcctcaaaattcaatgtaacacacccaggctgggaagcatattgacacttcaaatctgaagaagcaactacgctaaggggaggctaatactgctggacatgctaccagaagccagggtgcaaaactgcccaaaactaaaatctcaaagtatccactcactctggaaayttcctgttcttgggaacagagtaaaaatacctgaatacataaacacacagataagtagaaaaaaaaaatagcagccatcacaaagcttcatctagatctgcaatgtccaatagagcttcctgagatgatgaaaatgttctatactgtgctgtccaattcctgtggccactaaccacatacgcagctcttgaaacgtggttactgcaactaacaaatagaattttttactttcttaatgttcattaaatttcagttgccacaagtggatcgtgaaccggacaacacagatctagacctcac

SEQ ID NO: 50621 - DNA, 601 bp, Human
gaaatttaggtttttttaagaaatcttttccaatagatgttagaagaattatccccctccatacgcaagtagaatagccaaaattgtctccagaattgccaaatgccccctagggctggtaaaatctcacgattgagaaccactggcatagagaactactcctcaaaattcaatgtaacacacccaggctgggaagcatattgacacttcaaatctgaagaagcaactacgctaaggggaggctaatactgctggacatgctaccagaagccagggtgcaaaactgcccaaaactaaaatytcaaagtatccactcactctggaaatttcctgttcttgggaacagagtaaaaatacctgaatacataaacacacagataagtagaaaaaaaaaatagcagccatcacaaagcttcatctagatctgcaatgtccaatagagcttcctgagatgatgaaaatgttctatactgtgctgtccaattcctgtggccactaaccacatacgcagctcttgaaacgtggttactgcaactaacaaatagaattttttactttcttaatgttcattaaatttcagttgccacaagtggatcgtgaa

SEQ ID NO: 50622 - DNA, 601 bp, Human
ccctctttcaactgggccctatcctcgggcacgtcttcaagagtccaattttagcagaaatcccccatcctccatagctgaccaaactcttcaagctgcaccatcccccaatgatgtctgatcaccttggcctgcctgccttcagcaagaaccctgttaaatcgttttagtcagaatactccctaattcttaatgtttcctcttagtaattttccatccaccgacccccaccctgctccctcaccataaattcccacttttccttactgtatttggaactgagcccaatctctctcccctwcggcaaaactccactgcagaagtctctatagccactgcaatagtctccctgagaacattctctctactaccgcttaacaccaaaaagaaaaatcactccctccatttgaactaattacttaatctgatttcaaaacaattcaggattggggttttcctgtcttgttattggtatgctatgagtaactgatccatctcagagtaagaaatggcaacttccaggctgatgggggaaaaaaatgccacaacaattggatttttcaactggattttacatttgcatttcagatttaagaatttt

SEQ ID NO: 50623 - DNA, 601 bp, Human
tttaggaaaagatatgtcacagaaacgattaccaccgacaagatttctctccttgatcaaactaggcaggctccttctgaaccctctttcaactgggccctatcctcgggcacgtcttcaagagtccaattttagcagaaatcccccatcctccatagctgaccaaactcttcaagctgcaccatcccccaatgatgtctgatcaccttggcctgcctgccttcagcaagaaccctgttaaatcgttttagtcagaatactccctaattcttaatgtttcctcttagtaattttccatccmccgacccccaccctgctccctcaccataaattcccacttttccttactgtatttggaactgagcccaatctctctcccctacggcaaaactccactgcagaagtctctatagccactgcaatagtctccctgagaacattctctctactaccgcttaacaccaaaaagaaaaatcactccctccatttgaactaattacttaatctgatttcaaaacaattcaggattggggttttcctgtcttgttattggtatgctatgagtaactgatccatctcagagtaagaaatggcaacttcc

SEQ ID NO: 50624 - DNA, 601 bp, Human
aaaaaaaagaaaaaaaaaatatgaaagacaaagacagaggtaaggtatgcaagcaccaaagtaactagagagaagaataagagaaaacagcctgcacaatggctgcattcatccaaagacagatactgaatttctctacataatgtctggtatttccaccatcattattcagttaaaatttaacaactgtgtctttaggaaaagatatgtcacagaaacgattaccaccgacaagatttctctccttgatcaaactaggcaggctccttctgaaccctctttcaactgggccctatcctcrggcacgtcttcaagagtccaattttagcagaaatcccccatcctccatagctgaccaaactcttcaagctgcaccatcccccaatgatgtctgatcaccttggcctgcctgccttcagcaagaaccctgttaaatcgttttagtcagaatactccctaattcttaatgtttcctcttagtaattttccatccaccgacccccaccctgctccctcaccataaattcccacttttccttactgtatttggaactgagcccaatctctctcccctacggcaaaactccactgcagaagtctc

SEQ ID NO: 50625 - DNA, 601 bp, Human
aggccatttaatatttactacatttagaactaaatgactaacaatcctgtcactaggctaatattgcatgtcctctgatatttgtggtatgcattttctgtacatactacaaacttccatcctcatcaatgacacaagtggccctttttgacccatcttaatttccacatggccgttttgttattttatccacttgcctgtaaggaaaatcaacttctctgtgatgctacttagagaatttcatattttgtgaatttttcatcattttataaagaattgtgcatttttaagtgaaatgtawaaagacacaaagcatataccaaatactaagcataattgtggacttcaacatctttcatccatcctatcacccaccctaaactgataaacagtgtattcctccaatgagaaatccctgaaatggtaacaggcacatttcttttatgtccctagacacaatatggatgaaactgtagagatcgtaacaatatggataaatgagagactgtagaatacaatgaaaagaaatctttagttcacagagttcttgataattaaaacctttagttcacagagttaactaataactgaaattaatatt

SEQ ID NO: 50626 - DNA, 601 bp, Human
taacaagtggagttatatacctgcgctgtaaactcgctgagtcattctggacgtttgcctcgacctatccttgaccaaagcacagccatgttctttacaatgagttacaattatccatattttccacaatgcccaacctcctttgttactagtcagtactcataaaagttagatacaagacatttattttaaagtatggtttgttttctctgtgtaacttgcaaatgaaatgatgactgatatttggaaatcttaaatctagcagaaatggaataattcattgcaaggccatttaatattyactacatttagaactaaatgactaacaatcctgtcactaggctaatattgcatgtcctctgatatttgtggtatgcattttctgtacatactacaaacttccatcctcatcaatgacacaagtggccctttttgacccatcttaatttccacatggccgttttgttattttatccacttgcctgtaaggaaaatcaacttctctgtgatgctacttagagaatttcatattttgtgaatttttcatcattttataaagaattgtgcatttttaagtgaaatgtataaagacacaaagcat

SEQ ID NO: 50627 - DNA, 601 bp, Human
ggtcaacagcttaaatctctctctctctctctgggtgtgagcaagacgagctgtgtcctggctcgctcctgtccatctgcaaagatggacagctctggctctctctctccttctctgggtgcaagcgcacccatacaatgtcagcagggcaattatatcttttacagacaatagtggcttacagccaaatgatgaaccttctcatgttatggctacatggctgtgataacaagtggagttatatacctgcgctgtaaactcgctgagtcattctggacgtttgcctcgacctatccttgaycaaagcacagccatgttctttacaatgagttacaattatccatattttccacaatgcccaacctcctttgttactagtcagtactcataaaagttagatacaagacatttattttaaagtatggtttgttttctctgtgtaacttgcaaatgaaatgatgactgatatttggaaatcttaaatctagcagaaatggaataattcattgcaaggccatttaatatttactacatttagaactaaatgactaacaatcctgtcactaggctaatattgcatgtcctctgatatttgtggtat

SEQ ID NO: 50628 - DNA, 601 bp, Human
tgttgagtttgtattctgcaactttactaaatttatttattctaacagtcttctggtgaaatctttagggttttccatattatttaaaaccacgtcatctgcaaacaggaacaatttaacttctacttttccaatttggatgccttttatttatttctcgtctaagtgctctgtctaggacctccagtactatgctgaatagaagtggtaagagtgggcacccttgttgtgctcctgatcttagagggaaagctttcaacttttcctgttttaccattgagtatgatgtcagttgtgggcytgaactatgtagcccttattacgttgaagtacattccttcttttcctaatttgttgagagtttttatcataaaaggttaatgaactctttcaaataatttttctgcatctattgagatgatcataggttttttgccctacattctgttagggtggtgcatcacctttattaatttgcatatgttagctgggcatggtggctcacaccactaatcccagcacttcagaggccgaggcaggcggatcacctgaggtcaggggtttgagaccagccaggccaatgtggagaaaccccgtctct

SEQ ID NO: 50629 - DNA, 601 bp, Human
agcagttttagactttctgatcttacatgtaaatttttaattcactttgagttttttttatatgaggtgagataagggtctaacttcattcttcttcacgcagatatccagttttcccaacaccattttttgaagactgtcctctccccatcatgtattattggcacctttgtcaaaaatcaattaaatataaatgcatgtatttatatctgggctttctgctctgttgtatggtttatatgtttgtttctgtatcatgctgttttgattactatagcttcagagtgtgttttaaagttamgtaatgttaatacctcccgctttgttatctttgctcaagattgctttggttatctggggtcttttgtggttccatacaaattttagaactgctttttctatttctgtgaagaatccttggaatttttatagggattgcattgaatctgtagatcactttaagtagtatggacattttaacaatattaattctttcaatccatgaatacatacaatgtttccttttatttctgtcttcaatttttttcatcaatgtttcacagttttcagtatacaggtctcttacttccttggttaaatg

SEQ ID NO: 50630 - DNA, 601 bp, Human
aaaacttttttcctactttcctctagcagttttagactttctgatcttacatgtaaatttttaattcactttgagttttttttatatgaggtgagataagggtctaacttcattcttcttcacgcagatatccagttttcccaacaccattttttgaagactgtcctctccccatcatgtattattggcacctttgtcaaaaatcaattaaatataaatgcatgtatttatatctgggctttctgctctgttgtatggtttatatgtttgtttctgtatcatgctgttttgattactatarcttcagagtgtgttttaaagttaagtaatgttaatacctcccgctttgttatctttgctcaagattgctttggttatctggggtcttttgtggttccatacaaattttagaactgctttttctatttctgtgaagaatccttggaatttttatagggattgcattgaatctgtagatcactttaagtagtatggacattttaacaatattaattctttcaatccatgaatacatacaatgtttccttttatttctgtcttcaatttttttcatcaatgtttcacagttttcagtatacag

SEQ ID NO: 50631 - DNA, 601 bp, Human
agaagttgagccttttttcatatacctgttggctatttgtctatcttccttttaggaatgtctattcagatcctttgcctattttttaattgcactgttttcttgccactgagttgtttggcttcctattttggatattaaccccttatcagatgtatggtttgcaaatatattctcccattctgtaggttgtctcttcactctgttgattgcaccctttgctgtggagacaatttttatctgatgtactcccatttgtctattttcatgtttgttgcttgtacttttggagtcatatccaaaaaaaaaaaaaaatcactgcctaaactagtgtcataaaacttttttcctactttcctctagcagttttagactttctgatcttacatgtaaatttttaattcactttgagttttttttatatgaggtgagataagggtctaacttcattcttcttcacgcagatatccagttttcccaacaccattttttgaagactgtcctctccccatcatgtattattggcacctttgtcaaaaatcaattaaatataaatgcatgtatttatatctgggctttctgctctgttgtatggtttata

SEQ ID NO: 50632 - DNA, 601 bp, Human
agctcactgtggttttaattgcatttccctgatgagtagagaagttgagccgatgattagagaagttgagccttttttcatatacctgttggctatttgtctatcttccttttaggaatgtctattcagatcctttgcctattttttaattgcactgttttcttgccactgagttgtttggcttcctattttggatattaaccccttatcagatgtatggtttgcaaatatattctcccattctgtaggttgtctcttcactctgttgattgcaccctttgctgtggagacaatttttatytgatgtactcccatttgtctattttcatgtttgttgcttgtacttttggagtcatatccaaaaaaaaaaaaaaatcactgcctaaactagtgtcataaaacttttttcctactttcctctagcagttttagactttctgatcttacatgtaaatttttaattcactttgagttttttttatatgaggtgagataagggtctaacttcattcttcttcacgcagatatccagttttcccaacaccattttttgaagactgtcctctccccatcatgtattattggcacctttgtcaaaaat

SEQ ID NO: 50633 - DNA, 601 bp, Human
aatattggaatcctcatatatttgttgttgcgaaaatagtagtcattttggaaaacagcagcccctcaaaatgttcaatacagagttatcatatgaccaaacaatcccatgcctacattatactcacaagaaatgaaaacatatgatcacataaaacttgtacatacatatgtccacagcagcattttcagaaatacattgttattatcatcaccatgttatacatcttttgaacttaatccttgtatctaaataaaattttgtaccctctgaccaacatctcctccaaccatcctcctcracccccactcgaccccaaacctcgcagtccctgataaacaccattcactctctacttctacaggtgcaacttttttagattccacatgtaagtgagatcatatggtatttccctttctgtgcctggcttatttcacttaacattttatcatccatgtggtaacaaacaaaaggatttgtataatttttaagactcaatagtattccactgtgtaaatatactacttttttttaatccatttatcaactggtcaacacttaagctgattccatatcttgactatggtaaatagtgctgcaa

SEQ ID NO: 50634 - DNA, 601 bp, Human
agataataacaagtactggggaggatatggaaatattggaatcctcatatatttgttgttgcgaaaatagtagtcattttggaaaacagcagcccctcaaaatgttcaatacagagttatcatatgaccaaacaatcccatgcctacattatactcacaagaaatgaaaacatatgatcacataaaacttgtacatacatatgtccacagcagcattttcagaaatacattgttattatcatcaccatgttatacatcttttgaacttaatccttgtatctaaataaaattttgtaccctytgaccaacatctcctccaaccatcctcctcgacccccactcgaccccaaacctcgcagtccctgataaacaccattcactctctacttctacaggtgcaacttttttagattccacatgtaagtgagatcatatggtatttccctttctgtgcctggcttatttcacttaacattttatcatccatgtggtaacaaacaaaaggatttgtataatttttaagactcaatagtattccactgtgtaaatatactacttttttttaatccatttatcaactggtcaacacttaagctgattc

SEQ ID NO: 50635 - DNA, 601 bp, Human
caagaaatattattaagcaactatgtcagttatatgtcgtgatgctccaaatacaagaacagagctcaaaatttaaatatgcttacgcctagtccaaggttacctatatgcactgcttttaaaataaactgctttctctctcttgaccatacctgttagccaaactgtgcaaccacgaaagccacctctggtccccaccacctgacctctcttgttcctgctgacatgatgggcttggtaggtgacattggttgctctctgcattccctagaaaaaaaagaaaaaaaaaattctagtttayatgagtcctttaaaaggcaaacacatattccttgcaaacacacaaaagtctatgtaacatgccaaaagcaaagaaaaagataaaacagtttttttttttccttagagtactggcatggtgtttactgctttccacatgccaactgatttaatcctcacagcaatccaatgacataggtactcttactactaaggttttacagatgaagattttaaatctgaaaaatggtaaataacttgccggagatcccaaaactagtgagtggcagactccagagcctagtcctttcacacattcatt

SEQ ID NO: 50636 - DNA, 601 bp, Human
ataaatttctattcatataaattacccagtctctggtattctgttataacagcataaaatagactaagacgtatggttttcactgttagcttctcagagcagaatccagatcttatttgcactcagaagtgtgtagaatttaatgtgctatctatgaaaaagtagttttaaggttcattgtggtttttacctttatttaacagcaatcctataaaagaacaaaaaaaaaaataacaagaaatattattaagcaactatgtcagttatatgtcgtgatgctccaaatacaagaacagagctyaaaatttaaatatgcttacgcctagtccaaggttacctatatgcactgcttttaaaataaactgctttctctctcttgaccatacctgttagccaaactgtgcaaccacgaaagccacctctggtccccaccacctgacctctcttgttcctgctgacatgatgggcttggtaggtgacattggttgctctctgcattccctagaaaaaaaagaaaaaaaaaattctagtttacatgagtcctttaaaaggcaaacacatattccttgcaaacacacaaaagtctatgtaacatgccaaa

SEQ ID NO: 50637 - DNA, 601 bp, Human
tgtattacaaacatagcaagaagatgctagtccctcaatcttggacttcccagcctccagaactatgagaaataaatttctattcatataaattacccagtctctggtattctgttataacagcataaaatagactaagacgtatggttttcactgttagcttctcagagcagaatccagatcttatttgcactcagaagtgtgtagaatttaatgtgctatctatgaaaaagtagttttaaggttcattgtggtttttacctttatttaacagcaatcctataaaagaacaaaaaaaaatataacaagaaatattattaagcaactatgtcagttatatgtcgtgatgctccaaatacaagaacagagctcaaaatttaaatatgcttacgcctagtccaaggttacctatatgcactgcttttaaaataaactgctttctctctcttgaccatacctgttagccaaactgtgcaaccacgaaagccacctctggtccccaccacctgacctctcttgttcctgctgacatgatgggcttggtaggtgacattggttgctctctgcattccctagaaaaaaaagaaaaaaaaaattctag

SEQ ID NO: 50638 - DNA, 601 bp, Human
aaaaggaacgctcctaaaaagaaaaagctgattaggctcacacttattcaaaacatttaatgccagaagacaatagagtactgtttttaaaattccaagaccaagaaagtatgaaccaaatatatattttacccagccaagttggcataaaaggtagtcattctcaaacataaaacctccaggagttcagaacctaatggaaggccatcttgcaaaaattatttaacaatgaaatacagacaattaaagaccattcaaataaagagctcatgagtgaacatgtcatagtaaaataactgaygggaagctaccaactattgacccattaagtgctataaacctgggcaataaaaatgtaacaatttaactgtctggaattaagaatgaggaaatgggaagaatgtgagagtgtatcttctttcatacaaaaacaaacagacctgtctaaaaatgaaacatgattaaaaaaacaaaagagtaacttttttgccaatcagcacaaatttttaagaactggtaacaaccactgttgacaaagacactgggaaataaacaccctcccatactgctggtaggagagtaaactgggataaaattttag

SEQ ID NO: 50639 - DNA, 601 bp, Human
cattttcctagatcatcagcactcacaaaccaccttgatacaattatctgggagtccaatttataatataattaattttaatagaacaccctcatttcaactcaccttcctataccaacagtatttactcagtaaacaaagagaaggaaagagtacatttatgcactattacttgccaacttggcgagtgtcataaccaagatagttctaaaacaagagataaaatactaaagtctaatgtaccaatgctcttgaaagaattcatggtagtacagaaggctaactggaataaaaaaaaaayagaagagagggcttttttttggttccatatgaaatttaaagtagtttttttctaattctgtaagaatatcaaatggtagtctgatgggaatagcattgaatacatagattactttgggcagtatggccattttcacgatactgattcttcctatccatgaggctggaatgtttttccatttgtttgtgtcctctattatttccttcagcagtggtttgtagttctccttgaagaggtccttcacgtcccttgcaagttgtattcccaggtattttactctctttgtagcaattgtgaatg

SEQ ID NO: 50640 - DNA, 601 bp, Human
tccggagtttgacatctgtcaagtattcactataggtttattaagttgaaaagttgagcctgaaataatttggccattggcttaaattcaatgactgtgttatacttcacggcttttttaaaagcaggttttatcaaaaccagatttacttagaaagtcacagcatagaaatgttttaggttattttaatcctatgttacaggaacaaagagatggtagctggggaggagtagagttagcctcaaagcacatatcaatgtttaaagtatgtgctttgcctgataccatattctcaataaaygtaagcagaaaggcaatggcacaaaaaccacatacctgagtgtaaggtgatatgaaacttgtgatgcacactaagccagcatctgcaaacagtttagcaacttctgcgatgcgtcgaacattctcttctctgtcttcaggactaaagccaagatttttattgagaccttgacgaatattgtcaccatccagagtgtagcatggaataccatgacaaaccaggtactcctccaaggccatgctcacagtagtctttcccgctccagacaagcctaaaattaaacagtccaaacagattcca

SEQ ID NO: 50641 - DNA, 601 bp, Human
tgtgtgaccttgggcaatgcacacctttgtttccttgtgtccccactaggagacaagaattacttgagttaattcacataaaagcactctagcagttaccagaacacagttaagtgttcaataaatgttaatattattaccactacagctactatcaatatcaacagtcaatgaattgggtttttaaaaataacatatgcatacctgcaaccatcttatctttgacaaacctgacaaaaacaagcagtgggaaaggattctctatttaataaatggtgctagaactggcttgccatatgcrgaagattgaaactggaccccttccttacaccataggcaaaaattaactcaagatggattaaaggcttaaatgtgaaactcaaaactataaaaaccctagacgaaaatctaggtaataccattcaggacacaggcacaggcaaaagatttcatgacaaaaacatcaaaagtaattgcaataaaagcaaaacttgacaaatgggatctaattaaactaaagagcttccgcacagaaaaagaaactatcatcacagtgaacagacaacctacagaatgggatcaacaaggaacttaagcaaat

SEQ ID NO: 50642 - DNA, 601 bp, Human
gtgctcttctacaagtatagtgtgtgaccttgggcaatgcacacctttgtttccttgtgtccccactaggagacaagaattacttgagttaattcacataaaagcactctagcagttaccagaacacagttaagtgttcaataaatgttaatattattaccactacagctactatcaatatcaacagtcaatgaattgggtttttaaaaataacatatgcatacctgcaaccatcttatctttgacaaacctgacaaaaacaagcagtgggaaaggattctctatttaataaatggtgctggaactggcttgccatatgcagaagattgaaactggaccccttccttacaccataggcaaaaattaactcaagatggattaaaggcttaaatgtgaaactcaaaactataaaaaccctagacgaaaatctaggtaataccattcaggacacaggcacaggcaaaagatttcatgacaaaaacatcaaaagtaattgcaataaaagcaaaacttgacaaatgggatctaattaaactaaagagcttccgcacagaaaaagaaactatcatcacagtgaacagacaacctacagaatgggatc

SEQ ID NO: 50643 - DNA, 601 bp, Human
acaaaggcaaataagacacggtcccagctgtcaaggagccagtggggtttggaggcagcatagcatctaagcccaggagacgcactgtctggatgcaaacctgtgctcttctacaagtatagtgtgtgaccttgggcaatgcacacctttgtttccttgtgtccccactaggagacaagaattacttgagttaattcacataaaagcactctagcagttaccagaacacagttaagtgttcaataaatgttaatattattaccactacagctactatcaatatcaacagtcaatgaattgrgtttttaaaaataacatatgcatacctgcaaccatcttatctttgacaaacctgacaaaaacaagcagtgggaaaggattctctatttaataaatggtgctagaactggcttgccatatgcagaagattgaaactggaccccttccttacaccataggcaaaaattaactcaagatggattaaaggcttaaatgtgaaactcaaaactataaaaaccctagacgaaaatctaggtaataccattcaggacacaggcacaggcaaaagatttcatgacaaaaacatcaaaagtaattgcaa

SEQ ID NO: 50644 - DNA, 601 bp, Human
tactggggtaaaatccgagtttcttaatgtgaggcatcagccctatacctggccccaccattctcagtcttgcacttgatgctctattgataatacctgcctggtcaggctgtttctaccttaggcctccccacgccacaacccaacccctaccagcaacactcaacccctctcttctggacaaaccaatgtgcttcctcacagcacatctccatggtgacctcctccaggaagccttccctgcatgctcaggctgatgaggccccttgctttctcagggttctcagaatactcactacawatgatcatagatctttttccagtatattaaaatcatctcatcagctttacaagtttagtgtctggaatagcaattaagctatgatcttactattctaactatccttttaaaggaaagtgtcaatgagtttctatccctgtctctcatcttattactcttctgtatctaatcgtcctcatctaggtttcaactaataaagttaatgattcctaaatctagatctcaatcccatacaactttcctaaactctaaaaccaatttcctagatggcccagtggtaatctccacttagactaactc

SEQ ID NO: 50645 - DNA, 601 bp, Human
tatttcacccatcccttaacactggagttgcccacactcccatcacagcccactgctcaccttacacagttcttaagcgtttctctcaagtgccttcacagtataaactacaacacatacatcaacactgaagcttgaaccctgacctctgtcctgaaattaaacacacatgtccaaattcttcctatgtccacctggatatatcacaggtgccaaaaactaagcatgtccaaaactaaatccagtcccttttctctcaagtttacattctctcatatgcttcccaaatcaaggaagaccwcactacacacccacaatcctaagagtggttccttccctttcccatacattaattcagtcacaaagtccttcagatgttacttctaaatattacaccaacccagtttgcaatctttccctattccctagttcaacctcacttctcttgtctgaacggcctcaacatattacaggtcttctggcttctaactcggatctgctcaaagccataatctacactgtggcaaaggatgcaaatctgaccatcctactgaactcttcagagactctctgccactactggggtaaaatccgagtttct

SEQ ID NO: 50646 - DNA, 601 bp, Human
tgctgctttcccactgctatgcctatggatgcctataatgttattccctgatctttcctaggcagactcctcctgggctcctcctatttcacccatcccttaacactggagttgcccacactcccatcacagcccactgctcaccttacacagttcttaagcgtttctctcaagtgccttcacagtataaactacaacacatacatcaacactgaagcttgaaccctgacctctgtcctgaaattaaacacacatgtccaaattcttcctatgtccacctggatatatcacaggtgccaaraactaagcatgtccaaaactaaatccagtcccttttctctcaagtttacattctctcatatgcttcccaaatcaaggaagacctcactacacacccacaatcctaagagtggttccttccctttcccatacattaattcagtcacaaagtccttcagatgttacttctaaatattacaccaacccagtttgcaatctttccctattccctagttcaacctcacttctcttgtctgaacggcctcaacatattacaggtcttctggcttctaactcggatctgctcaaagccataatctac

SEQ ID NO: 50647 - DNA, 601 bp, Human
ccacccttgcagctccctctaagccctctccactctgtcctttggaacaatgtttcctttgtaaatcaaccttttcttctttctggtcttcaaaacctgattctccctttgctccacatttatactccattaatcaaagtgcagttgccaatattttcaaagctggtccctgcaatttctaccatcctttttccacacagctcattttagcatttgccatcttccttatggtccctctgacaatcctcacctacttccactctcaccagattaccatacttcatgtttcaaaaaaaaaaamaaaacaaatctccaagaataagctctcaatctcttctctttcaagcaaaatctcttctctgtcatacaaatttatctacatactaatgatccttttctccctgccactcctaccttcacatactaggaattccctcccctttcatgaactcctacaggacctgttcaacccattctctctactccacctgaaatcttcagcattccccctttgctgggttccctgctccccagcaacaaacaagtacaagtccatttaaaacaaatgaactgctaagggaagttcacccatttaaaacaa

SEQ ID NO: 50648 - DNA, 601 bp, Human
ctactaacccaggatattggggaggtacagaaggaaaacaatgaatgtaccacaaactttttcactcaaattctacgtggatcctgagccaaagcccagcctgaatgctggtgtcatcaggcttctctctaatatcacattcaaacccagcctgagctggcatgaaagcaatttcacaaaaaagatccattcagaatcctgaggctagtttacttctttgccaaatgcaagccccctgcagccacttctcctctctaacactccccaaacttaacttttctgctcctaactcccaactctstagtaaccacccttgcagctccctctaagccctctccactctgtcctttggaacaatgtttcctttgtaaatcaaccttttcttctttctggtcttcaaaacctgattctccctttgctccacatttatactccattaatcaaagtgcagttgccaatattttcaaagctggtccctgcaatttctaccatcctttttccacacagctcattttagcatttgccatcttccttatggtccctctgacaatcctcacctacttccactctcaccagattaccatacttcatgtttcaaaaa

SEQ ID NO: 50649 - DNA, 601 bp, Human
cttgggcacatgttctcaggacctcctgagggctgtgtcacgggccatggtcaatcgtatttggttcagagtaaatctcttcaaaaatttttttttttttagatggagtctcgctctgtcgcccaggctagagtgcagtggcacaatttcggctcactgcaagctctgcctcctgtgttcacgccattctcctgcctcagcctcctgagtagctgggactacaggcgcccgccaccatgctgactaattttttgtatttttagtagagacggggtttcaccgtgttagcgaggatggtctsgaatctcttcaaatattttacaagagttcaactctttttgtcgccaaagcattggcaaatgtgtgttcaacattccactcccactccaccttctcatccatccaacaagcattaactatgtgtgtgacaggtgtatgctttgggcaatgtactgtgctaaattctaaacacacacaagtgttcactatgatctccctgctcacaagtagcctactccagccaggatgacaaaccttcctccctcaccaatccattctttcaaaaacaacaaaatcaactaaaattaaagtaagtaaaagg

SEQ ID NO: 50650 - DNA, 601 bp, Human
ttgcaagacaagaagaaaatcaaaatattttcatcaaaacatgtttctttgccatattttgaaatggccctgcaaagctgttctttgtgggggaaaatttgcacctttaaagaatctttattaacaaaactatatttttttcttccagaccctcccaatcctaaagagattaagatctgaatggggacatttgtcatctattgtctctaagggtagccactgtaagacctcaaaagaactttggtctccacaatctttatcttaacctgaacaattccctttctatcaatcccagttcttyagacaaactcaaccaattgtcaaccagaaaacatttaaactcacctatagcctagaagctccccgcaccacctggctttgagttgtcccacctttctggaccaaaccaatgtatttgattgatgtctcatgcctctctaaaatgtataaaaccaagctgtgcctcaacgaccttgggcacatgttctcaggacctcctgagggctgtgtcacgggccatggtcaatcgtatttggttcagagtaaatctcttcaaaaatttttttttttttagatggagtctcgctctgtcgcccaggct

SEQ ID NO: 50651 - DNA, 601 bp, Human
tgtcatgtaaaggtctataaaagcctgaggccccctgaatatacacaatcttgtctgtgctggaatatataccattacagctttgaaatagagttgatagggaacttgctaagcatcatttacaagtaaaagctttttaaaaaaataagcaactctataatcaggaactccagcaccatggcaaacctaagtatcagtgtatgcatacagacacacacacacacacacattaacctaaggaacattttatcaacctctactcaggggaatgtagtcaacaacaggggaatgtagtcaacarttgagaaagtaaacaagaaactggactaatacaaacacactcccagttatagagtacaaactgtaagagacccaagagcattgtggacaaggtcttattcatctttgaatacttggcaccaaatacataccttgcaaatagaaagctgaggactaaactctgattttttatcttgcccaaattcctatctaaggggcctggggagtcatgccctacaaaccacaaattttcatcagataggttttatttaaccctatatatcatgacttcttttccaacctgactctggcataacattgc

SEQ ID NO: 50652 - DNA, 601 bp, Human
aagcagtcatcatgaaaataattgagattatcagaatggttaatacaaggatatactgactgtccgataaatgtcatgtaaaggtctataaaagcctgaggccccctgaatatacacaatcttgtctgtgctggaatatataccattacagctttgaaatagagttgatagggaacttgctaagcatcatttacaagtaaaagctttttaaaaaaataagcaactctataatcaggaactccagcaccatggcaaacctaagtatcagtgtatgcatacagacacacacacacacacacaktaacctaaggaacattttatcaacctctactcaggggaatgtagtcaacaacaggggaatgtagtcaacagttgagaaagtaaacaagaaactggactaatacaaacacactcccagttatagagtacaaactgtaagagacccaagagcattgtggacaaggtcttattcatctttgaatacttggcaccaaatacataccttgcaaatagaaagctgaggactaaactctgattttttatcttgcccaaattcctatctaaggggcctggggagtcatgccctacaaaccacaaattt

SEQ ID NO: 50653 - DNA, 601 bp, Human
aatccctcaaggatggaggcacagctgataaatctttgcattactagagcctaggactataactacagtggtgggcttttaatcaatgtgtggttgatgatggaagatgaaagaatggatgctgggacagctttggagagataaggaggaagctacaagtagaacaataggattagaataagagtgcagaagtcagttaaaaagaaacctagaaggcagagatgatgaagcataaaacctcctgggatgtctcagtggcctgcaaataatgatatctgatcagtaaatacaaagaaaaacrtcagagcagtatcgatttacattatttctatatattcagctacaatgtttggataaaataaataaattaggaaggaaagtcccaagttacctacctggtagatattttataatgtggaaaaactcaaaggctaaacatttataatatattcagacaaagaaatttttttaaagttgtatgtctaatatatccagtaagatacactagatgaaagaggtttataagatacactagatgaaagaggtttattacaggattttgcagattaagagggggttcaaactccaaaacccacagtta

SEQ ID NO: 50654 - DNA, 601 bp, Human
gcactcctcaagataggactttttaactgggattaagttaaaggatctaatgaaaaagtggacagcatgcatggagagatggagaatttcaacagaaaaatgaatactatcaaaaaaaagtcaaataatgacagaattgttttttaatgattatcagagtttaaaaattctttctatgagcctatcaatatattggatacagctaaggaatcagcaaacataaaaatcagaaattatcaaagctaaaatgttaacagaaaagggatgaaagaaacagagcatctaaaaactgtgggacaayatattattcaacatatgtgtaactagagtcccagaagaagagtgaaaaaggcaaaagaaatatttcacatgataatggccaagaattttcaaaaactaatgaaaaaaatatatatctacccaagcaggttggggaattctaaacagtaagaaaaaagacctaaatctactacaagacctagacacatgatattaaacccactaaaatccaaggagtaccacaaaatcttaaattcagacatgaaaaaaaaatcacatagaggaacaaagaaaagaattacattagacttctcatcagaaa

SEQ ID NO: 50655 - DNA, 601 bp, Human
ccctcagtatctgagaggaattggttccaggactccttgaggacaccaaaatccacagacgctcaagtgatataaaatggcatagcatttgcatacaatctacacacatcttcccatacacttcatatcatctctggattacatataatacctaatacaatgtaaatgttatataagtatataattgtattctttttaaaattgtattctttttcattgttgtattaattttcctgaatattctcaatccatggttgtttgtatccacaaatgtggaacccacagatatagaactccagayacagagggccaactttctaacgctgatatggcaaatttcaagttaaaaaaaagatagattcagtatacaaaaaactcaaacaaaactacaatcaaaacgaaaaggaaaaatactagaactatagttccaataaaaatgagatggaggtgggtggtgccaagatggccgaataggaacagctccagtctacagctcccagtgtgagcgacgcagaagacgggtgatttctgcatttccaactgaggcaccgggcgcatctcactggggagtgtcagaaagtgggtgcaggacagtgggtgc

SEQ ID NO: 50656 - DNA, 601 bp, Human
aaaacaaataataaaactgtacagtcatccctcagtatctgagaggaattggttccaggactccttgaggacaccaaaatccacagacgctcaagtgatataaaatggcatagcatttgcatacaatctacacacatcttcccatacacttcatatcatctctggattacatataatacctaatacaatgtaaatgttatataagtatataattgtattctttttaaaattgtattctttttcattgttgtattaattttcctgaatattctcaatccatggttgtttgtatccacaaatrtggaacccacagatatagaactccagatacagagggccaactttctaacgctgatatggcaaatttcaagttaaaaaaaagatagattcagtatacaaaaaactcaaacaaaactacaatcaaaacgaaaaggaaaaatactagaactatagttccaataaaaatgagatggaggtgggtggtgccaagatggccgaataggaacagctccagtctacagctcccagtgtgagcgacgcagaagacgggtgatttctgcatttccaactgaggcaccgggcgcatctcactggggagtgt

SEQ ID NO: 50657 - DNA, 601 bp, Human
aaagtcttcaaaagtattacaaaactaagcttgaagaggggataaaatttacttagtttattttagaaataaagttgtcattatatatagtataaccttttaccactccaattcaggttttaggacttacataaatcataattcattaggcaaaatgtgcctctttccaaggtaaattagataacctacaaacactattcttattgcacttacatagaacaagcatttcacactagctggacacaggtatgagcagtttatttctttaataaacattctttccaacccagatagtgttgtstttgatctgctcaagtattttaaaagtattcaagaaataataaatctttctaaggtcaatgaaatgcccatgcctctcccatttcttaatcccaactacagttagggaacaactgatcaaggaatgtgaaagagagtcagagaaaagattcatatttcagaaataaactagaaatggaaagaatctaaatactagtaaaggcagagtagtagaaacattgagtgtgtaggctgcagaatcaatcagaactgtgtgcaaacctctccctaactgaactatctgggacaaataacttcacct

SEQ ID NO: 50658 - DNA, 601 bp, Human
atacgatgtgcattaagtgaactacacatacattttgtatgttcaattagcttcttcgatatgtaaagcctccaaagatgccttgaggcatacagattctttgcagctacaaagtaaagaattgaaatcttctatgctagggggagaaaacactaaacataacaagttacacaaaaagtcaggcactcattaggacttctgtgaggaagagtatgatacactttcacgagacacttaaaattaaatatttacataatcacaaagctttaggggcataacatcttcaaaaccaacgagatayaaaaagcaacaggagtctataggtcagttatttccaatgttcttatcactaagaatatgaagtaaaaaaagagggcaaaggctttttatatttaagatctgagttccaattctaacagtgcaatcttgagcatcttacaacgtgtctccccagttgtttaaaaaaaagtacaaaaaagatacacacatatatgttacagggctgttttgacaaactagtgacttaaagtacctgaagagtggaggataatattagtgagaactgactataacaccactcattgttctaagagcttcatgt

SEQ ID NO: 50659 - DNA, 601 bp, Human
tgctaaaatgagactgcttcatctgcagagtttcaaattcagtcagtttgctgtggggcccatgaatctgtatttctaaaatgttcccagaaaatgataacagtgatgatctaatactttgataaccactctccttaaccaagagaaactttacggccagaggaggtggctcacgcctgaaattccagcactttggaggccaaaacaaagcaggcagatcacctgacctcaggagctcaagaccagcctggccaacatggtgaaacccagtctctactaaaaatacaaaaaattagccagrtgtggtggcgcattcctgtagtcccagctacaggaggctgaggcatgaggattgcttgggccaggaatcgcttgagcccaggaggcagaggttgcagtgaactgagatcatgccactgcactccagcctggcagcctgggcagtagagtgagaccatgtctcaaaaaaaaaaaaagaagtcattgggagacaaggaaactcaaatgaccaataaatgtattgaaaaaatggttattctcataaatcatcagggaaatgtaaaatgatggcataatcatttcatagagaagacttcacctt

SEQ ID NO: 50660 - DNA, 601 bp, Human
aggaatttaattttgaaagcaatggaaacaaacagtgtaaggatgagtatagattataccaaactaacaaagaataagggcactaggaaaatatttccttctcctattaaatttaaataacattaggcctccaagtatttctaataaagacagcctctcctaaactagtggttctcaaactttacctcaaacccctggaaagcttgctaaaatgagactgcttcatctgcagagtttcaaattcagtcagtttgctgtggggcccatgaatctgtatttctaaaatgttcccagaaaatgrtaacagtgatgatctaatactttgataaccactctccttaaccaagagaaactttacggccagaggaggtggctcacgcctgaaattccagcactttggaggccaaaacaaagcaggcagatcacctgacctcaggagctcaagaccagcctggccaacatggtgaaacccagtctctactaaaaatacaaaaaattagccagatgtggtggcgcattcctgtagtcccagctacaggaggctgaggcatgaggattgcttgggccaggaatcgcttgagcccaggaggcagaggttgca

SEQ ID NO: 50661 - DNA, 601 bp, Human
atacatcagagcaaatgctgtacagccgtccagcctctctttatcttcatgagtcgcagtcagaactataggtactgacaagttaatgacacctcctgcagagcacaaaagaacatgaagcacacagcttgaattactcaacacgctttacttaacacccacctttcacttcaggggacacttttcaaataataaaaggctgtagatccagtgacagtattcaactggtacctggcacagaaaaacgaaagacagaacaagctataaggtcagggagaatgagcaacgatctcccaagttaaaaaaaaaaaaaaaaaaggaaaaattaaaagaatcaaactgtttttgggtacaacattttggtatagaattacataagtaaaacaaactgtttaacaagaaagaatcagctggttaagcctaacatcaccaaatacatactgtgcacttccaatatatgaaagagacaaagaactacgtttctgggccttttcaggaaaaacttaaatccttgttgataacaggatgacataataactacaatttatgtggcaagttgattaagtatacttgagtatccttgagataggaagacagaact

SEQ ID NO: 50662 - DNA, 601 bp, Human
cccaatgccactagtccctggaacctcagcaaatccttgtaggttcccttaactctgaccacctttctttaaatactcgcttcactgaattatgctcaaagcctcatctgagtgtgccttctgcttcctgctgggagctgactgacacaggttccctcacccaatctcagctctctggcttgctgtcacttatcatcgagatccactatccacttcagagccaaacatagatctgcttctgcctcagctttctcatgtaccatcctcaactttacttaaaacattcttctgatgtctccayttacacacttaaaatgtagtttgtaattcagcaacgctataaagctttctcagatttattaacactgtactaccacacactattctgaaagaaattatgtcaactcttccctttgcaatcagcaggacaccaatattctatgtttaataaacactaacaggctcttacttggcttaagtgaaatgcattcttcccctccaggatactggtcaatcatcggtaattcaaagaacttgccatctggaaatgtatcaccttgcaatcaccgatgtgtgtattaaagatttctcaatccttccc

SEQ ID NO: 50663 - DNA, 601 bp, Human
tgttccaatgggaaaaattcatttacttgcatctatgaaagatgcactttttcttttaatgcttctgtaactcaaataatatgtactttttcatatatactttctcatatatatattatatttcaatgtgaagttaaaagaaaataagacaaattaggaaacgatcagaatgggacagaatcttgaagaacacttagtcctacctacaccacctactgtgcactcaaacatagtatagagaggtctcaagaagtctaatgtgagatggcaaaccagctggtggcaacccagaacccaaacygtgcctggactcctcgacaaccgtcttgtattatttccactagaccatgctctttcgggtagtgaggagagttgaatctgaggccagggaaggacttgctgcagctagcatattgacacggttcaggacacactactccaaaatatggcaccttggcatttgagaaaacagcagaagaaagcaagccactctcaccttcccctaaggcagtcataaaacctagcagatcttcccctgaagtaggtcaaaagactctcattccagaggtgccctccctatacctagaggaaaggaacgtgc

SEQ ID NO: 50664 - DNA, 601 bp, Human
tgacacatgcataggcactcataaaataggtactttcaatttctttatattagctttatattatattaaacaccaaaggatatcccaaatcagggctaggacacacgctctgacatgaagcctgttaggcagtaggtcataccaggctccctgccataatcaaactctaggacttcatagacttatgaagcagcctagagatatagacagttccttggatgtggggctagaatcctagaaatgcagagaatttgcagcaaagtagttttttaaaggacaccaattatattaattaccacaycttgtcatgagccaggcaatgtgttaaatgatttacattgatcctattttctcctctcaacaatagaaacatagacagatattaccaatatcatgagtcaggtattgtaagaatacaaagattaagaatacatattatacaaagaatatcacaacccacaactctaggctctgataaaaaaataagtttatttggagattccacctctaacgaatgttgccagggccatcctaactcactattttggaactcttataggatattataagaatttatttctagtattttaaaaaagatgtg

SEQ ID NO: 50665 - DNA, 601 bp, Human
aagagctgcatttttttcagaacaaccagcaaccaaactaattttattcttggaagtgaccttgccctggctgaccccagacccctagtcaggtgagaacagtatcagccctcccagagtgggggctcagagtggagacaacaagcctggaaatgctcagcctccacctcctcttcctgcctcccaaacccagggaccctcaagaggctctctgccctcccactgattattattctaagaaaacagaggaaggcaaccatggtgataaagcactggaaagtatttcatgaggtccttcaayagggtgagaagaagaaattaaaataggtaacacttaccaagctcttcctaatataccagtcactgtacaaaatgttttataaatattatttaatgtttacagcaaatcaataagatagttattattcctgttttacaaataagaaaacagggacttggagaattcaaataacatatcctagctgcaaaatgaactagtgaaggatcaagtctttggacctgggtctgtgtgaccccaaaacccacacattcctattcatactgagctactgacgctgtgtcaaggacatttagggaggaa

SEQ ID NO: 50666 - DNA, 601 bp, Human
agataagggaaaaaatacaaaattcaggacagagattatctggggtggggggtggtggatgatggaaatggcagcgtaaaaagaatgggattggtggctgggcacagtggctcatgcctgtaatcccagcactttgggaggctgaggcgggcagatcacgaggtcaggagattgagaccatcctggctaacacggtgaaaccccatctctactaaaaatacaaaaaattagccgggtgtggtggcgggtgtctgtagtcacagctactcgggaggctgaggcaggagaatggcgtgaaccygggaggcggagcttgcagtgagctgagatagcaccactgcagtccggcctgggcgaaagaacgagactccgtctcaaaaaaaaaaaaaaaaaaagaatgggattggtagcagtacctgctagattataagtcatacttatcaaattagcagcaattctatgttgttcattaaatagtctgtttattggttttgagacagggtcttactctgtcactcaggctggagtgcagtggtgcaaaaatggtttactgcaggttcagcctcccgggctcaggcaatcctcccatctcagcctccca

SEQ ID NO: 50667 - DNA, 601 bp, Human
ttaaaaaacaaaaattagtctaatacctagaataatgaaactttagaatttaaagtgacagtaaaagatcatctctagttcaacattctccataaaatttgaagaaagtgaagcccccgaaaggttaaatgactggccaataaagtttaggataaactcaggcctagaaatttggttttagcttcctttcagtgtaagtctccattatttaataatttataaaaccatcactgttccatattaaaataaggtataaatgataaccactacacataaataaccaaatcatcttttattgttytgttttcattttctctctcctggtaatctcctgcataccaggtacttatctatttaccaacatagtttagaaagtgcaatagtaagagtgcaattccatacctcacacttgaattgttcaccctgaggggtttcaactttttaagttgtttctactgatgtttgcctgcatgttttcaaacagcatgcttacactttgttatgactgtttaattttacatagtatataacatagaccttatttccacatcacttagacttcctaccatattcgagtatttaatgaggttcttattcccca

SEQ ID NO: 50668 - DNA, 601 bp, Human
aatctgaaggaatccaaaatcaaaaacacttctggccccaagcatttcatacaagggatacacaacctataaataatttaatacttgtaaataattaggacattgcctgtcacatagtgattgcacaaatattagctaaattctctctccatacatagactccctgggcttaccagagtaaacatcactaagtcctcaaactagttatgctcagtaagctatagcagacacagtaggcagagaaataacaatattgtccttacagacttcaaaacaaaattcctgaaaccatgaaactagwttcaagttttatttctacttctaatttccagaatgttgggaaattacttttctgggtttacctttctctgacatgagtaccacaaaacctgtcatcagtaaagattagacaataagctaaatccctgggagcagctagaccacgaagtacttcaaagatttgtacagagaatgtaagacttactgttcagagtcatagtagtccatacgcttctttttcttgttgtaagctgcaactcgaaagggaactatttccaaagtgattaaaccaggggccatcgtcagcactttggcaccatga

SEQ ID NO: 50669 - DNA, 601 bp, Human
acagactctaaaaccagactgcctgggttcatctgctgagctgccatttactagtcctgtgaccttatacaagctacttagcctttgtatgcctctagatactcacctacaaaatggaggtaacagcacctactttagagattgttgtggaaaatacaagttgagcaccccaatccacaatccaaaatactccaaaatctgaaaatttttgagcaccaacatgacaaaagtggaaaattccatctctgacacctttgctttctgatggctcaatgtacacaaattgtttcatgcacaaaattatgtaaaatattgtatacagttacctccaggctatacatataaggtatatttgaaacataaatgaatttcatgtttagaattgagtcccatccccaaggtacctcattcaaatattcaaatattccaaaatctgaaggaatccaaaatcaaaaacacttctggccccaagcatttcatacaagggatacacaacctataaataatttaatacttgtaaataattaggacattgcctgtcacatagtgattgcacaaatattagctaaattctctctccatacatagactccctgggctt

SEQ ID NO: 50670 - DNA, 601 bp, Human
taagatctttgaagacagaagttgtgctgttaatgattaagaccacagactctaaaaccagactgcctgggttcatctgctgagctgccatttactagtcctgtgaccttatacaagctacttagcctttgtatgcctctagatactcacctacaaaatggaggtaacagcacctactttagagattgttgtggaaaatacaagttgagcaccccaatccacaatccaaaatactccaaaatctgaaaatttttgagcaccaacatgacaaaagtggaaaattccatctctgacacctttrctttctgatggctcaatgtacacaaattgtttcatgcacaaaattatgtaaaatattgtatacagttacctccaggctatacatataaggtatatttgaaacataaatgaatttcatgtttagaattgagtcccatccccaaggtacctcattcaaatattcaaatattccaaaatctgaaggaatccaaaatcaaaaacacttctggccccaagcatttcatacaagggatacacaacctataaataatttaatacttgtaaataattaggacattgcctgtcacatagtgattgcaca

SEQ ID NO: 50671 - DNA, 601 bp, Human
taatcttaaaaaatctttaaggggcacccatttttcttcagtcaaaaaagactacattgacatggttaaattcccaggacccttggttcttttttatccctagtctccagatctccagataccctcatccttcaggaatggattaaatgactggtatcatcactcacaaaagtgtcctgatcttgatggagcttatgttaagaaataaagtttacattttttatttttatgttttaattccattttccacaaactttttgaagtcccctcacgtatgtttgatatagtttggctctgtgtycccacacaaattccatcttgaattataatccccacatgtcaggggaggaacctggtggaaggtgattagatcatgggtgcagtttcccccatgctgtttacaagatagtgagttctcatagatctgacggtttaaaagtgtggcacttccccactttgttctctttcctgtggccatgtaaatcgtgctttgcttctccttcactccccagccatgcagaaccgtgagtcaattaaacctcttttgtttacaaattatccagtctcatgtcgttttttatagcactgtgaaaacggataa

SEQ ID NO: 50672 - DNA, 601 bp, Human
cttctgacctaaagaaccatgcatgaggtaataaatgggtgttactttaagtggtgctttgttacgcaacaacgaaaaactaatacaactgggaaacactgatgtacaggtttaaaaatcacccccacagaaaccacaggaacggatgacctctcccatggaaagtatatctgaaaaagccttgaaggatgcctacagttagagtgttttttaaaaatgacactaacagtacattatttaaagtatactctgggccgggcgcggtggctcatgcctgtaatcccagcactttgggaggccraggcaggtggatcacaaggtcagatcgagaccatcctggctaacacagtgaaaccccatctctactaaaaataaaaaaaaatagccgggcgcggtggcaggcgctgggagtcccagctactcgagaggctgaggcaggagaatggcgtgaaacagggaggcagagcttgcagtgagccgagatagcaccactgcactccagcctgggcaaaagagtgagactctgtctcaaaaaaaaaaaaaaaaagtatactctggcatcaaaaacatgaaagaaatactctactgaaaatgtggaaat

SEQ ID NO: 50673 - DNA, 601 bp, Human
aacccaacctggccagagaaccctgtcaagcacacccagtcttctgacctaaagaaccatgcatgaggtaataaatgggtgttactttaagtggtgctttgttacgcaacaacgaaaaactaatacaactgggaaacactgatgtacaggtttaaaaatcacccccacagaaaccacaggaacggatgacctctcccatggaaagtatatctgaaaaagccttgaaggatgcctacagttagagtgttttttaaaaatgacactaacagtacattatttaaagtatactctgggccgggcrcggtggctcatgcctgtaatcccagcactttgggaggccgaggcaggtggatcacaaggtcagatcgagaccatcctggctaacacagtgaaaccccatctctactaaaaataaaaaaaaatagccgggcgcggtggcaggcgctgggagtcccagctactcgagaggctgaggcaggagaatggcgtgaaacagggaggcagagcttgcagtgagccgagatagcaccactgcactccagcctgggcaaaagagtgagactctgtctcaaaaaaaaaaaaaaaaagtatactctggcat

SEQ ID NO: 50674 - DNA, 601 bp, Human
cttgagggttttttgtttgtttgttttaatatcacccaggtaatgtaagtctggcccatttgagcagagctttcagctttcgagcttaaagtagaatgtcctgctcacagtctcctagaacaggagaaggaactgggttcatttcaggttctcccttacacttaattaaggcagcagggagtctcaactgaatgggagtgtctcctgttgggctctccaccttgatcatgggcagagttgtattttctatccccatctacactatgaggcattgaaaatcaatactctcaagtttgttagktttaccagggcaaaagcagcttcaacgctcagcttatgtgaattttcagcattcgcttactggttttggcctcacagttcttatcatcatcttgtcagatccacaatacttttatgaaaatgtttcatttaatccagcatttttaatttcttcagaaaggcaatctgttaaatctaacctacctctttaccagaaacccaaattttttataaccaatccatacagtcacaccaccatcttttaaaaattcttatcaactccagctcctacctttcaagaactgccttatctggctcctga

SEQ ID NO: 50675 - DNA, 601 bp, Human
ctctactccccagctcctggcaaccactaatctaaaactagatttttttttttcaagaaaacactaaatctaatttaactagcataaattgaaaacttttaaagaagtttcaatctgaaaggctaaattaatactggaatattaagagtaaaattgaattttttttcttctggaacagcaagtagcaataatcaatactacttaattgacaagacacaacagaggtagtgttgatagtttttctcatcttcacacatacaaaaacacacaaaagccctcaaaccagtaagcacagagcacrtatagctatggcatatattgcttaccttaaattcatccatcctcgtctctcaaacatgggaaccaacctagatggccaactaggactcagcaagcattcagagtcgctcaggtcaccagatcacgagcctgtttacttctagttggcagttctatgttccttcctctcttcattatttatagacttaacctgaaaacctggtgcaatcataaactaccaagtggccctggcttctggaggtatgccaagtatgttttaactaataatcacacttctacaaacctagaaggaaataattag

SEQ ID NO: 50676 - DNA, 601 bp, Human
ctttctccaaggatttgtagtattctgtcagcacggtccaagccttgggagccatgaaaccttcaggtggtttctggccttctcgagcaagtttgcgcattcgtgttcctgaaataaattcaaagtcttcatggctaaaggagaggaaaaaaagaaaattatttcataattttagaaacttagatttttaaaaagcatttgttccttctgttcatattagacaaacttaatgaaaaaaaaatactgaacatagtacttgtgaatataaatctcatttcaaatttgtcactgaacaaaaaaccactattgaatattaccaatttttagaaccagaaaaaaattagttttgaaatttttattgagaccattgtagagtcacatgaaattgtaagaaataatatagccagtcaccattgtaccctttatccagtttcctcccaaaggtaacatcttgcaaaattatagcatatcacagccaggattatcagtgtggaaacaatctaccaatcttactcagactttcctaatttacttgtactaatttctcttatgcacttaatactatactactttatcacatgtgtaggttcatgtagctgtc

SEQ ID NO: 50677 - DNA, 601 bp, Human
agactatgtggtcccctcttgttactagtaatgtgtcaaaggtggagtgactgggttaacagcctaagctttctccaaggatttgtagtattctgtcagcacggtccaagccttgggagccatgaaaccttcaggtggtttctggccttctcgagcaagtttgcgcattcgtgttcctgaaataaattcaaagtcttcatggctaaaggagaggaaaaaaagaaaattatttcataattttagaaacttagatttttaaaaagcatttgttccttctgttcatattagacaaacttaatgaaaaaaaaatactgaacatagtacttgtgaatataaatctcatttcaaatttgtcactgaacaaaaaaccactattgaatattaccaatttttagaaccagaaaaaaattagttttgaaatttttattgagaccattgtagagtcacatgaaattgtaagaaataatatagccagtcaccattgtaccctttatccagtttcctcccaaaggtaacatcttgcaaaattatagcatatcacagccaggattatcagtgtggaaacaatctaccaatcttactcagactttcctaatttact

SEQ ID NO: 50678 - DNA, 601 bp, Human; identical to SEQ ID NO: 32761

SEQ ID NO: 50679 - DNA, 601 bp, Human; identical to SEQ ID NO: 32762

SEQ ID NO: 50680 - DNA, 601 bp, Human; identical to SEQ ID NO: 32763

SEQ ID NO: 50681 - DNA, 601 bp, Human; identical to SEQ ID NO: 32764

SEQ ID NO: 50682 - DNA, 601 bp, Human; identical to SEQ ID NO: 32765

SEQ ID NO: 50683 - DNA, 601 bp, Human; identical to SEQ ID NO: 32766

SEQ ID NO: 50684 - DNA, 601 bp, Human; identical to SEQ ID NO: 32767

SEQ ID NO: 50685 - DNA, 601 bp, Human; identical to SEQ ID NO: 32768

SEQ ID NO: 50686 - DNA, 601 bp, Human; identical to SEQ ID NO: 32769

SEQ ID NO: 50687 - DNA, 601 bp, Human; identical to SEQ ID NO: 32770

SEQ ID NO: 50688 - DNA, 601 bp, Human; identical to SEQ ID NO: 32771

SEQ ID NO: 50689 - DNA, 601 bp, Human; identical to SEQ ID NO: 32772

SEQ ID NO: 50690 - DNA, 601 bp, Human; identical to SEQ ID NO: 32773

SEQ ID NO: 50691 - DNA, 601 bp, Human; identical to SEQ ID NO: 32774

SEQ ID NO: 50692 - DNA, 601 bp, Human; identical to SEQ ID NO: 32775

SEQ ID NO: 50693 - DNA, 601 bp, Human; identical to SEQ ID NO: 32776

SEQ ID NO: 50694 - DNA, 601 bp, Human; identical to SEQ ID NO: 32777

SEQ ID NO: 50695 - DNA, 601 bp, Human; identical to SEQ ID NO: 32778

SEQ ID NO: 50696 - DNA, 601 bp, Human; identical to SEQ ID NO: 32779

SEQ ID NO: 50697 - DNA, 601 bp, Human; identical to SEQ ID NO: 32780

SEQ ID NO: 50698 - DNA, 601 bp, Human; identical to SEQ ID NO: 32781

SEQ ID NO: 50699 - DNA, 601 bp, Human; identical to SEQ ID NO: 32782

SEQ ID NO: 50700 - DNA, 601 bp, Human; identical to SEQ ID NO: 32783

SEQ ID NO: 50701 - DNA, 601 bp, Human; identical to SEQ ID NO: 32784

SEQ ID NO: 50702 - DNA, 601 bp, Human; identical to SEQ ID NO: 32785

SEQ ID NO: 50703 - DNA, 601 bp, Human; identical to SEQ ID NO: 32786

SEQ ID NO: 50704 - DNA, 601 bp, Human; identical to SEQ ID NO: 32787

SEQ ID NO: 50705 - DNA, 601 bp, Human; identical to SEQ ID NO: 32788

SEQ ID NO: 50706 - DNA, 601 bp, Human; identical to SEQ ID NO: 32789

SEQ ID NO: 50707 - DNA, 601 bp, Human; identical to SEQ ID NO: 32790

SEQ ID NO: 50708 - DNA, 601 bp, Human; identical to SEQ ID NO: 32791

SEQ ID NO: 50709 - DNA, 601 bp, Human; identical to SEQ ID NO: 32792

SEQ ID NO: 50710 - DNA, 601 bp, Human; identical to SEQ ID NO: 32793

SEQ ID NO: 50711 - DNA, 601 bp, Human; identical to SEQ ID NO: 32794

SEQ ID NO: 50712 - DNA, 601 bp, Human; identical to SEQ ID NO: 32795

SEQ ID NO: 50713 - DNA, 601 bp, Human; identical to SEQ ID NO: 32796

SEQ ID NO: 50714 - DNA, 601 bp, Human; identical to SEQ ID NO: 32797

SEQ ID NO: 50715 - DNA, 601 bp, Human; identical to SEQ ID NO: 32798

SEQ ID NO: 50716 - DNA, 601 bp, Human; identical to SEQ ID NO: 32799

SEQ ID NO: 50717 - DNA, 601 bp, Human; identical to SEQ ID NO: 32800

SEQ ID NO: 50718 - DNA, 601 bp, Human; identical to SEQ ID NO: 32801

SEQ ID NO: 50719 - DNA, 601 bp, Human; identical to SEQ ID NO: 32802

SEQ ID NO: 50720 - DNA, 601 bp, Human; identical to SEQ ID NO: 32803

SEQ ID NO: 50721 - DNA, 601 bp, Human; identical to SEQ ID NO: 32804

SEQ ID NO: 50722 - DNA, 601 bp, Human; identical to SEQ ID NO: 32805

SEQ ID NO: 50723 - DNA, 601 bp, Human; identical to SEQ ID NO: 32806

SEQ ID NO: 50724 - DNA, 601 bp, Human; identical to SEQ ID NO: 32807

SEQ ID NO: 50725 - DNA, 601 bp, Human; identical to SEQ ID NO: 32808

SEQ ID NO: 50726 - DNA, 601 bp, Human; identical to SEQ ID NO: 32809

SEQ ID NO: 50727 - DNA, 601 bp, Human; identical to SEQ ID NO: 32810

SEQ ID NO: 50728 - DNA, 601 bp, Human; identical to SEQ ID NO: 32811

SEQ ID NO: 50729 - DNA, 601 bp, Human; identical to SEQ ID NO: 32812

SEQ ID NO: 50730 - DNA, 601 bp, Human; identical to SEQ ID NO: 32813

SEQ ID NO: 50731 - DNA, 601 bp, Human; identical to SEQ ID NO: 32814

SEQ ID NO: 50732 - DNA, 601 bp, Human; identical to SEQ ID NO: 32815

SEQ ID NO: 50733 - DNA, 601 bp, Human; identical to SEQ ID NO: 32816

SEQ ID NO: 50734 - DNA, 601 bp, Human; identical to SEQ ID NO: 32817

SEQ ID NO: 50735 - DNA, 601 bp, Human; identical to SEQ ID NO: 32818

SEQ ID NO: 50736 - DNA, 601 bp, Human; identical to SEQ ID NO: 32819

SEQ ID NO: 50737 - DNA, 601 bp, Human; identical to SEQ ID NO: 32761

SEQ ID NO: 50738 - DNA, 601 bp, Human; identical to SEQ ID NO: 32762

SEQ ID NO: 50739 - DNA, 601 bp, Human; identical to SEQ ID NO: 32763

SEQ ID NO: 50740 - DNA, 601 bp, Human; identical to SEQ ID NO: 32764

SEQ ID NO: 50741 - DNA, 601 bp, Human; identical to SEQ ID NO: 32765

SEQ ID NO: 50742 - DNA, 601 bp, Human; identical to SEQ ID NO: 32766

SEQ ID NO: 50743 - DNA, 601 bp, Human; identical to SEQ ID NO: 32767

SEQ ID NO: 50744 - DNA, 601 bp, Human; identical to SEQ ID NO: 32768

SEQ ID NO: 50745 - DNA, 601 bp, Human; identical to SEQ ID NO: 32769

SEQ ID NO: 50746 - DNA, 601 bp, Human; identical to SEQ ID NO: 32770

SEQ ID NO: 50747 - DNA, 601 bp, Human; identical to SEQ ID NO: 32771

SEQ ID NO: 50748 - DNA, 601 bp, Human; identical to SEQ ID NO: 32772

SEQ ID NO: 50749 - DNA, 601 bp, Human; identical to SEQ ID NO: 32773

SEQ ID NO: 50750 - DNA, 601 bp, Human; identical to SEQ ID NO: 32774

SEQ ID NO: 50751 - DNA, 601 bp, Human; identical to SEQ ID NO: 32775

SEQ ID NO: 50752 - DNA, 601 bp, Human; identical to SEQ ID NO: 32776

SEQ ID NO: 50753 - DNA, 601 bp, Human; identical to SEQ ID NO: 32777

SEQ ID NO: 50754 - DNA, 601 bp, Human; identical to SEQ ID NO: 32778

SEQ ID NO: 50755 - DNA, 601 bp, Human; identical to SEQ ID NO: 32779

SEQ ID NO: 50756 - DNA, 601 bp, Human; identical to SEQ ID NO: 32780

SEQ ID NO: 50757 - DNA, 601 bp, Human; identical to SEQ ID NO: 32781

SEQ ID NO: 50758 - DNA, 601 bp, Human; identical to SEQ ID NO: 32782

SEQ ID NO: 50759 - DNA, 601 bp, Human; identical to SEQ ID NO: 32783

SEQ ID NO: 50760 - DNA, 601 bp, Human; identical to SEQ ID NO: 32784

SEQ ID NO: 50761 - DNA, 601 bp, Human; identical to SEQ ID NO: 32785

SEQ ID NO: 50762 - DNA, 601 bp, Human; identical to SEQ ID NO: 32786

SEQ ID NO: 50763 - DNA, 601 bp, Human; identical to SEQ ID NO: 32787

SEQ ID NO: 50764 - DNA, 601 bp, Human; identical to SEQ ID NO: 32788

SEQ ID NO: 50765 - DNA, 601 bp, Human; identical to SEQ ID NO: 32789

SEQ ID NO: 50766 - DNA, 601 bp, Human; identical to SEQ ID NO: 32790

SEQ ID NO: 50767 - DNA, 601 bp, Human; identical to SEQ ID NO: 32791

SEQ ID NO: 50768 - DNA, 601 bp, Human; identical to SEQ ID NO: 32792

SEQ ID NO: 50769 - DNA, 601 bp, Human; identical to SEQ ID NO: 32793

SEQ ID NO: 50770 - DNA, 601 bp, Human; identical to SEQ ID NO: 32794

SEQ ID NO: 50771 - DNA, 601 bp, Human; identical to SEQ ID NO: 32795

SEQ ID NO: 50772 - DNA, 601 bp, Human; identical to SEQ ID NO: 32796

SEQ ID NO: 50773 - DNA, 601 bp, Human; identical to SEQ ID NO: 32797

SEQ ID NO: 50774 - DNA, 601 bp, Human; identical to SEQ ID NO: 32798

SEQ ID NO: 50775 - DNA, 601 bp, Human; identical to SEQ ID NO: 32799

SEQ ID NO: 50776 - DNA, 601 bp, Human; identical to SEQ ID NO: 32800

SEQ ID NO: 50777 - DNA, 601 bp, Human; identical to SEQ ID NO: 32801

SEQ ID NO: 50778 - DNA, 601 bp, Human; identical to SEQ ID NO: 32802

SEQ ID NO: 50779 - DNA, 601 bp, Human; identical to SEQ ID NO: 32803

SEQ ID NO: 50780 - DNA, 601 bp, Human; identical to SEQ ID NO: 32804

SEQ ID NO: 50781 - DNA, 601 bp, Human; identical to SEQ ID NO: 32805

SEQ ID NO: 50782 - DNA, 601 bp, Human; identical to SEQ ID NO: 32806

SEQ ID NO: 50783 - DNA, 601 bp, Human; identical to SEQ ID NO: 32807

SEQ ID NO: 50784 - DNA, 601 bp, Human; identical to SEQ ID NO: 32808

SEQ ID NO: 50785 - DNA, 601 bp, Human; identical to SEQ ID NO: 32809

SEQ ID NO: 50786 - DNA, 601 bp, Human; identical to SEQ ID NO: 32810

SEQ ID NO: 50787 - DNA, 601 bp, Human; identical to SEQ ID NO: 32811

SEQ ID NO: 50788 - DNA, 601 bp, Human; identical to SEQ ID NO: 32812

SEQ ID NO: 50789 - DNA, 601 bp, Human; identical to SEQ ID NO: 32813

SEQ ID NO: 50790 - DNA, 601 bp, Human; identical to SEQ ID NO: 32814

SEQ ID NO: 50791 - DNA, 601 bp, Human; identical to SEQ ID NO: 32815

SEQ ID NO: 50792 - DNA, 601 bp, Human; identical to SEQ ID NO: 32816

SEQ ID NO: 50793 - DNA, 601 bp, Human; identical to SEQ ID NO: 32817

SEQ ID NO: 50794 - DNA, 601 bp, Human; identical to SEQ ID NO: 32818

SEQ ID NO: 50795 - DNA, 601 bp, Human; identical to SEQ ID NO: 32819

SEQ ID NO: 50796 - DNA, 601 bp, Human
aagactcttcttaaaatgcagtggctcacgcctgtaatcccagcactttgggaggctgaggcgggcggatcacaaggtcaggagttcgagaccagcctgaccaacatgttgaaaccccgtctctactaaaaatacaaaaattagctgggcatggtggtacgcacctgtaatcccagctactcgggaggctggggcaggagaatcacttgaccctgggagccagaggttgcagtgagctgagattgtgccattgcactccagcctgggtgacagagcaagactctatctcaaaaaaaaaaaagaaaaaaaatgcatgtttgactatgcccctccctcaggcagaagatgttttaatgattcttccctctcccccaggaggggcctttggtgctatggtctattctcatcttccacactagagcttcatctctcaccacctgtcctaagcccaccactaactttttcctccagctttcccaagctgcctgcaagttgtcaaacacaccactcgttcagcaaatatttattgaacgtgtgtgctaggccctaaggtgacacagttgaaacagacagggttcccgctattgctggactgagggcc

SEQ ID NO: 50797 - DNA, 601 bp, Human
cttaaaatgcagtggctcacgcctgtaatcccagcactttgggaggctgaggcgggcggatcacaaggtcaggagttcgagaccagcctgaccaacatgttgaaaccccgtctctactaaaaatacaaaaattagctgggcatggtggtacgcacctgtaatcccagctactcgggaggctggggcaggagaatcacttgaccctgggagccagaggttgcagtgagctgagattgtgccattgcactccagcctgggtgacagagcaagactctatctcaaaaaaaaaaaagaaaaaaaatgcatgtttgactatgcccctccctcaggcagaagatgttttaatgattcttccctctcccccaggaggggcctttggtgctatggtctattctcatcttccacactagagcttcatctctcaccacctgtcctaagcccaccactaactttttcctccagctttcccaagctgcctgcaagttgtcaaacacaccactcgttcagcaaatatttattgaacgtgtgtgctaggccctaaggtgacacagttgaaacagacagggttcccgctattgctggactgagggcctttgaacat

SEQ ID NO: 50798 - DNA, 601 bp, Human
gtggtgcactacacaggtaagtctcaccccctcagcccccacccagtccttcccctcccaaggcagggctgtcctctgagcttctctccagaggtgcctgcctctggatcagggctaaagcccaaggcagcagggtctccctgtgaccagccatcctctactcctcccagccagtctagtgggaatgataaaggaggcttggaaggccaactctttccctcttctaccagcaagggccatccatggtgccagcttctaggtgagtcaaacaccttcagtccccttccttctgttgcaggtrtggtggagcccctgtccctgctgggtctgtctgatatttggaaatccctcctagagctccccgcagactttctctccatcctgcagtatcattagagaagaagaggaggggagaggacagacaagtcacccagaggctccgatgccatttgaggggtggggtgatggcagtgcttttctctgggtactgagggagcccagagcgggactgatcccagttggatgctctttatctgcaggcgaggtagagtgagttcttcaggactgctggcaggaagatcatgagcaggtgtttgttcca

SEQ ID NO: 50799 - DNA, 601 bp, Human
tacatacatagggcagcagctcctgtcttgggagagactatgtcttatcaaacatagcgggagactatgggacttttggtaaactttaaagttaaatataaatatagtagagaacataatgtaagatgtctaggtcaatgaattttttcaaagtgatcacatttatgtgactaccacctagagaagcatagaacatacaagcatagaaccagcatccccaaaagtccccctgatgccttctcccagtcatttcacctccctagaggtagctatcattgtttttctttttttttttttttttgtcattgttgttgttgttttgagacagggtctcactctgtgactcaggctgagtgcagtggtgatcacagctcattgcagcctcgacctctcgggctcaagtgaccctcctgcttcagtgtcctgactagctgggaccacagacatgagccaccatgcctggctaattttaattttttgtagagatgagggtctcactatgttgcccgggctggtctcgaacgcctgtatgcaagtgatccttccaccttggcctcctagtgctgggattacaggtgtgagccactgtgcctggctggca

SEQ ID NO: 50800 - DNA, 601 bp, Human
cagtgtcctgactagctgggaccacagacatgagccaccatgcctggctaattttaattttttgtagagatgagggtctcactatgttgcccgggctggtctcgaacgcctgtatgcaagtgatccttccaccttggcctcctagtgctgggattacaggtgtgagccactgtgcctggctggcaactattactctgacttttgtctccatggattggttttgcctatttttgaacttcatcttaatggaaccacagcgtaggtactcttttgtgtttggcttatttcactcactattatrtctgcgagatatatccagaatggtttattcctctacagtattttaacgtacaagtatgttgcaatttatgtatcctctctaccgttgatgaacatttgggttgttcatagtttttgtttattacaaacagtgtcactttgatcagtcttgcaggcatctcttagtgtacatgtgtacagacatatgtgcatgtttctgttgggtatatacctggaagtggggtacctcctgggctcagcgttagcagtactgtctgacagctttccaaagtcgttgtgccagtttccactctaggcagct

SEQ ID NO: 50801 - DNA, 601 bp, Human
taacgtacaagtatgttgcaatttatgtatcctctctaccgttgatgaacatttgggttgttcatagtttttgtttattacaaacagtgtcactttgatcagtcttgcaggcatctcttagtgtacatgtgtacagacatatgtgcatgtttctgttgggtatatacctggaagtggggtacctcctgggctcagcgttagcagtactgtctgacagctttccaaagtcgttgtgccagtttccactctaggcagctgtgtaggagactgccagttaccctgtgtcctccccaacacttgktattgtcaggttttggttttgttttgttttttctttttttgagacagagtctatgttgcccaggctggagagaaatggcatgatcttggctcactgcaacctctgcctcctgggttcaagcgattctcctgccttagcctcccgagtagctgggattacaggcgcccgccaccatgcctggctaatttttgtgtttctagtagagacggtgtttcaccatattggccaggctgatctcaaactcctgacctcaggtgatctgcctgcctcggcctctcaaagtgctgggattacaggaat

SEQ ID NO: 50802 - DNA, 601 bp, Human
ttgtcaggttttggttttgttttgttttttctttttttgagacagagtctatgttgcccaggctggagagaaatggcatgatcttggctcactgcaacctctgcctcctgggttcaagcgattctcctgccttagcctcccgagtagctgggattacaggcgcccgccaccatgcctggctaatttttgtgtttctagtagagacggtgtttcaccatattggccaggctgatctcaaactcctgacctcaggtgatctgcctgcctcggcctctcaaagtgctgggattacaggaatgasccaccacaccaggctttgttttggttttggcctactctggtgagcgttcagtaccatttcattgtgggtttttttgttttttttttttgagacaaggtctcactctgttgccaaggctggagtgcagtggtgcgatcttggctcactgcaaccccgcctcctgggttcaagcgattcttgtgcctcaacctcccaagtagctgggattacaggtgcgcaccaccacacccagctaatttttgtattttttgtagagatgggatttcaccatgttggccaggctggtcactgtggttttga

SEQ ID NO: 50803 - DNA, 601 bp, Human
atcttctcccacactatggcttgcctttttactctcttaatagtatattttgaacagaagttctttttttatagtttatattttcttcttttctttctttttaaaatttttttctttcttttttatttttgagataggatctcactctgttacccaggctggagttcagtggctctagtcttcagggatcatggctcactgcagccttgacctcctgggttcaaggactcctcccatgtcagcctcccaagtagctgggagtacaggaacatgctaccatgcctggctaatttttttttgktttttttttgtgtgtgtgtgatggagttttgctatcgttgcccaggctggagtgcaatggcacgatttcagctcaccacaacctctgcctcccaggttcaagcaattctcctgcctcagtcttccgagtagctgggatttcaggcatgcgccaccacgcctggacaattttgtatttttagtagagactgggtttctccatgttggtcaggctggtctcgaactccctacctcaggtgatctgctcgcctcggcctcccaaagtgctgggattacaggcgtgagccaccgggcccggcca

SEQ ID NO: 50804 - DNA, 601 bp, Human
ccacactatggcttgcctttttactctcttaatagtatattttgaacagaagttctttttttatagtttatattttcttcttttctttctttttaaaatttttttctttcttttttatttttgagataggatctcactctgttacccaggctggagttcagtggctctagtcttcagggatcatggctcactgcagccttgacctcctgggttcaaggactcctcccatgtcagcctcccaagtagctgggagtacaggaacatgctaccatgcctggctaatttttttttggtttttttgtgtgtgtgtgtgatggagttttgctatcgttgcccaggctggagtgcaatggcacgatttcagctcaccacaacctctgcctcccaggttcaagcaattctcctgcctcagtcttccgagtagctgggatttcaggcatgcgccaccacgcctggacaattttgtatttttagtagagactgggtttctccatgttggtcaggctggtctcgaactccctacctcaggtgatctgctcgcctcggcctcccaaagtgctgggattacaggcgtgagccaccgggcccggccacctggcta

SEQ ID NO: 50805 - DNA, 601 bp, Human
ttgatttttttgtgtgtggatttggtaggggttaaagttcattttttccccatatgaatatactgttgactcaacaaccttaatgcaagaaaaaaaaacctttatttgctgcattgcagtggtatctttgtccaatcaaatcaccatgtaagtgggtctgtttctagactgcatggttttggcttaacttgtagcaatagataaatgaagttatttatccaaagtagattaagtcacatgaaacctgaagaaactaaggaatgagaaaggaaagtcggtatataaatggagtgtgtgaatrtgtgcatgtgtgtttgcatatctgtgtgcatatttgtacaagtatgtatctgtgtgaatgtatgtagatctgtgtatgtaaatattttcttagcatctatttggccaccagggcttttctcctgagtgtgagtgcataagtgcatgtgagcatgcacaagtatctttgtgtatttgaatatcttagcaaccttagcaaatgcatgcgattgtatttgatcttgttagcatccatctgcatgtacctctgtgtagccagaagggttttcttctttgcctcagttagtacccagggcaaaag

SEQ ID NO: 50806 - DNA, 601 bp, Human
agtgaaccgagatcacaccactgcactccagcctgggcaacagagggagactccgactcaaaaaaaaaaaaaaaaaaaaaaaagttgaaaagtgcagaggaatttgagaaaggtatgacctgaaaaggacacagagggaagggaaggaaggggagaacagagagggttataagcaggccagagccggattgtgaagtgcctgtatgcaaggtaggcatttggattctgctctggggagctattgaagtattttgagcaggggagtaatagaatcagatttgtgtttaaagaaaaaaaaaaatcagtctggatgccaagtggacaatgaaatggaggcgagtaaaagaggatcaaaaagaccagttaggaggttgttcctgtgtacaggtgagataagctggtgacttggtcgtggtaatagaaacaaagaaaaggccaggcacagtggctcacgcttgtaatcccagcactttgggaggccaaggtgggtggatcacctgcagttcaggagttcaagaccagcctagccaatatggcaaaaccctgtttctactaaaaatacaaaaatcagctgagtgtggtggtgggcgcctgtaatgcc

SEQ ID NO: 50807 - DNA, 601 bp, Human
ggccaaggtgggtggatcacctgcagttcaggagttcaagaccagcctagccaatatggcaaaaccctgtttctactaaaaatacaaaaatcagctgagtgtggtggtgggcgcctgtaatgccagctacctgggaggctgaggcagaagaatcgattgaacccaggagatggaggttgcagtgagccgagattgtgccactgcactccagcctgggtgacaaattgagattctgtctcaaataaataaataaataaataaaaatagaaatgaagaaaataggtggattccaaagatatgkaggacttagtgataggcagtatgtgggggtgaggcagaaggaagtgtccagatttcctgcttgggcaacaggatggatggggaggatcggaagaggagcaggtgtgtgcagaaaaggcattccattttagacatgtggaatctgaattgggagtttactcatgaccacagctctattgcacccgattcttgctttgacaggaatgctccaaaatgggaagaagtttgattcatccagagacagaaacaaacctttcaagttcagaattggcaaacaggaagtcatcaaaggttttgaaga

SEQ ID NO: 50808 - DNA, 601 bp, Human
aggatggatggggaggatcggaagaggagcaggtgtgtgcagaaaaggcattccattttagacatgtggaatctgaattgggagtttactcatgaccacagctctattgcacccgattcttgctttgacaggaatgctccaaaatgggaagaagtttgattcatccagagacagaaacaaacctttcaagttcagaattggcaaacaggaagtcatcaaaggttttgaagagggtgcagcccaggtaggatgaggattcgcattaaaggggatctggggagttggggatctgggatcagcwctctgccctccacctccaccttcacccactcacagaccactactgctttgactctacagccagggcatggcaacgccatctggtgtcccctcctggctttgcgtccccacccctctccttgccagcatacctcttttgtgtccctgggggctctcatcccaagcacatccccctaggcttgctcagaactagctgagagagccaggcacggtggctcacacctgtaatcccagcactttgggaggccgaatggggtggatcagttgaggccaggagttcaagactagcctcaccaacatg

SEQ ID NO: 50809 - DNA, 601 bp, Human
ggagtgagactgtctcaaaaaaacaaaacaaaaaaataaactagctgaggtctaccagttgcctgggactgaggtagtggaagagttggggtggagtaggccaagaaaatttttcgttttttcgcttttttgaaaagaatttcagaattacaaaaatattaaagaaatagtacagagttcttctatattctatccagcttccccttcttgcataaccatagtacaattatcaaaaccaggacattcacactgatacaaattacttacttattcaaatttttgattattcaaaattcaaaastagatttaaatttcaccaattgtcccactaatgctgagtgggttctcaacaactgctgtgatgagccctggttcaagctgttctttcttggtctgtctgtgaagtcctatgatgctcccttacgataggtcttgtttttggtgtttttttttagaaagagtatcactctgtcaccaaggctggactgcagtggcgcaatcttggctcactgcaagctccgcgtcctgggttcacgccattcttctgcctcagcctccctagtagctgggactacaggcgcccgccaccacggccggctaa

SEQ ID NO: 50810 - DNA, 601 bp, Human
aaaatattaaagaaatagtacagagttcttctatattctatccagcttccccttcttgcataaccatagtacaattatcaaaaccaggacattcacactgatacaaattacttacttattcaaatttttgattattcaaaattcaaaagtagatttaaatttcaccaattgtcccactaatgctgagtgggttctcaacaactgctgtgatgagccctggttcaagctgttctttcttggtctgtctgtgaagtcctatgatgctcccttacgataggtcttgtttttggtgtttttttttagaaagagtatcactctgtcaccaaggctggactgcagtggcgcaatcttggctcactgcaagctccgcgtcctgggttcacgccattcttctgcctcagcctccctagtagctgggactacaggcgcccgccaccacggccggctaatttttttgtatttttagtagagacggggtttcaccgttgttagccaagatggtctcggtctcctgacctcgtgatctgcccgcctcagcctcccaaagtggtgcgagccaccgtgcccggcctgttttttgttttttatttatttatttatt

SEQ ID NO: 50811 - DNA, 601 bp, Human
ttcaaaattcaaaagtagatttaaatttcaccaattgtcccactaatgctgagtgggttctcaacaactgctgtgatgagccctggttcaagctgttctttcttggtctgtctgtgaagtcctatgatgctcccttacgataggtcttgtttttggtgtttttttttagaaagagtatcactctgtcaccaaggctggactgcagtggcgcaatcttggctcactgcaagctccgcgtcctgggttcacgccattcttctgcctcagcctccctagtagctgggactacaggcgcccgccaccacggccggctaatttttttgtatttttagtagagacggggtttcaccgttgttagccaagatggtctcggtctcctgacctcgtgatctgcccgcctcagcctcccaaagtggtgcgagccaccgtgcccggcctgttttttgttttttatttatttatttattttgagacgtagtctcactctgttgcccaggctagagtgcagtggcacaatctcagctcactgcaacctcctcctcccaggttcaagcaattttcctgccccagcctcccgagtagctgagattacaggtgtgca

SEQ ID NO: 50812 - DNA, 601 bp, Human
acggctcctgcttttggggctcttgatcagtgtgctaacctcactgcctcatggcatcatccattctctctgcccaagttgctctgtatgtgttcgtcagtgttcatgcgaattcttgcttgaggaaacttcggttgcagattgaagcatttcaggttgtgcattttgtgtgatgcatgtagtagcctttcctgatgacagaacacagatctcttgttcgcacaatctacactgccttaccttcacttaaaccacacacacaaggtgctcagacatgaaatgtacatggcgtaccgtacatagagggacttgagccagttacctttgctgtcactttctctcttataaattctgttagctgctcacttaaacaatgtcctctttgagaaaatgtaaaataaaggctctgtgcttgacaaactcctgtccatccttattttaggtaggaagtgctctaaggaccacacaagccaggtgcccttgggaaagagtggaaagaaaggagggttccaagtggctaggtgagtgataaatataatagctacaatgtgagcattttacatgctgggccttgttctacatacttttttattttatttat

SEQ ID NO: 50813 - DNA, 601 bp, Human
gtgccgtgttgcacatccagaactccactcccacccgcgcctttggtataatgcctgctgcccaaactcaggatttgctgtgggtctggggatcaataaagtgacaggggatccgtaagtggagaggcccctcctcaggaaatgcgcccgtggaatgctctaccctcttccgcagccagtcgcccctggccttcccaacctcgcggctgcccgaaggacctgttgtgccgggtccggaaagcgtgtttcgctccctttcccttgagggagtggggagggaatgtgactcttttcgcccagsgccgtggactcgcggcttgtggctcccaagttagggagtgagaggatcgcccgccgagggggtggctccgcagcccggctgcgcgagacgcttcccgctcggggacccgccttccgaggccaggtgaacgttaccggccccctgacctccagcagatccacacgtgagtcccggtttccgcgatcggggagcgacctctgcctcccgtggcgcgcggggcccccggccgcccagctccctgctcccggggctgcctgctggaggagcctgcggtggcttcaggaagggcggcctcatatc

SEQ ID NO: 50814 - DNA, 601 bp, Human
tggtataatgcctgctgcccaaactcaggatttgctgtgggtctggggatcaataaagtgacaggggatccgtaagtggagaggcccctcctcaggaaatgcgcccgtggaatgctctaccctcttccgcagccagtcgcccctggccttcccaacctcgcggctgcccgaaggacctgttgtgccgggtccggaaagcgtgtttcgctccctttcccttgagggagtggggagggaatgtgactcttttcgcccagcgccgtggactcgcggcttgtggctcccaagttagggagtgagrggatcgcccgccgagggggtggctccgcagcccggctgcgcgagacgcttcccgctcggggacccgccttccgaggccaggtgaacgttaccggccccctgacctccagcagatccacacgtgagtcccggtttccgcgatcggggagcgacctctgcctcccgtggcgcgcggggcccccggccgcccagctccctgctcccggggctgcctgctggaggagcctgcggtggcttcaggaagggcggcctcatatcttggggtcacacttggaacagggttggggaattccgatggaat

SEQ ID NO: 50815 - DNA, 601 bp, Human
ctcctcaggaaatgcgcccgtggaatgctctaccctcttccgcagccagtcgcccctggccttcccaacctcgcggctgcccgaaggacctgttgtgccgggtccggaaagcgtgtttcgctccctttcccttgagggagtggggagggaatgtgactcttttcgcccagcgccgtggactcgcggcttgtggctcccaagttagggagtgagaggatcgcccgccgagggggtggctccgcagcccggctgcgcgagacgcttcccgctcggggacccgccttccgaggccaggtgaackttaccggccccctgacctccagcagatccacacgtgagtcccggtttccgcgatcggggagcgacctctgcctcccgtggcgcgcggggcccccggccgcccagctccctgctcccggggctgcctgctggaggagcctgcggtggcttcaggaagggcggcctcatatcttggggtcacacttggaacagggttggggaattccgatggaatcgttcaagaatgggggtaaacggaccgtggaaaggggcagaggtgggcggatgtggagcgagagacaagtgggaaggaaacggactc

SEQ ID NO: 50816 - DNA, 601 bp, Human
tgggtatatttgaaagcttatattagtgaggatggagaagaactatagcagataggaaacattcatacaacttctgaagacatccgaaactacagactggtaaccactggtgtcactggtttgctttattgctttgctttacttccaagatttacttaacaaatatttcagtgctttcctttgccaagcactgtgctaagaagagcaaagacagacttggtatctgcttcataaaatttacagtagaggaagagacaaatattaatttgatagctatttgaaaaataacatgtaaaatcaytgccatgctgatgctaagaaagggcctcatagtgcagcgagagcctgaaaaactataaccctagtatgcaataatcagaagagcagattgtttattgtgtccctgtctctgttcttcgtgctttgcatgtattgatggactcatttcctgtgcgcagcagtcccatgaggtagttcatattctcattcccattctacagagaggaaacaagcatggaaggtattaggttggtgcaaaagtaattgcaatttttgccatgactttttaataagttccttgtttacagccagataggtaaaa

SEQ ID NO: 50817 - DNA, 601 bp, Human
aaatattaatttgatagctatttgaaaaataacatgtaaaatcactgccatgctgatgctaagaaagggcctcatagtgcagcgagagcctgaaaaactataaccctagtatgcaataatcagaagagcagattgtttattgtgtccctgtctctgttcttcgtgctttgcatgtattgatggactcatttcctgtgcgcagcagtcccatgaggtagttcatattctcattcccattctacagagaggaaacaagcatggaaggtattaggttggtgcaaaagtaattgcaatttttgcmatgactttttaataagttccttgtttacagccagataggtaaaaagtagcaaagtggatgctgtgagggacccattctcactcaaagcctatgacttttggaggaaaggtaaaacttcagtccccacctgaatctccagctgtcctgtggtgctcttcctttcccctcatgactggatggaaactttaggtgtaaagaggactagtaaaaaggcaaatggatatgagaaaagtgaacagatttaataaatacttaagaggccaggtgcagtggcttacacttgtaatcccagcacttcgg

SEQ ID NO: 50818 - DNA, 601 bp, Human
tattaatttgatagctatttgaaaaataacatgtaaaatcactgccatgctgatgctaagaaagggcctcatagtgcagcgagagcctgaaaaactataaccctagtatgcaataatcagaagagcagattgtttattgtgtccctgtctctgttcttcgtgctttgcatgtattgatggactcatttcctgtgcgcagcagtcccatgaggtagttcatattctcattcccattctacagagaggaaacaagcatggaaggtattaggttggtgcaaaagtaattgcaatttttgccatkactttttaataagttccttgtttacagccagataggtaaaaagtagcaaagtggatgctgtgagggacccattctcactcaaagcctatgacttttggaggaaaggtaaaacttcagtccccacctgaatctccagctgtcctgtggtgctcttcctttcccctcatgactggatggaaactttaggtgtaaagaggactagtaaaaaggcaaatggatatgagaaaagtgaacagatttaataaatacttaagaggccaggtgcagtggcttacacttgtaatcccagcacttcgggag

SEQ ID NO: 50819 - DNA, 601 bp, Human
cctgtaggcctagctacttggaaggctggagtgggaggattgcttgaggtcagaagtttgtggctacagtgagccaaaatcccagcattgcactctagtctggacaagagtgagaccttgtctcaaaaaaaaaaaaaaaaaagagagatacaaaaaaggccagccacacctgtaattccagcactttgggaggctggaggagacagattttttgagcccaggagtttgagatcagcctgggcaacatggtgaaacgctgtctccacaaaaaatacaaaaattagctgggtgtggtggtgcktgcctgtatcccagctatttgggaggttgaggtgggaggatcacctgagcccagcaggtggaggcagccgtgagctgtgattacatcactgcaccccagcttgggcgagagggcaagactctgtctcaaaaacagataaacaaaaagagaataacaacaaaaaaacttaagaaaagtcaaaattggattgaatgtgaaggagggcagtgtcaaggatgaccagcttcctacttgtacaatcaaatggaggataattacctcttaaatctttatttgcctagcattttaagattttcattt

SEQ ID NO: 50820 - DNA, 601 bp, Human
tcaaacctccctctgcctctctcttataaggacacttgtgatttcatttagcacctacctagataatccaggataatctctctctctctcaagacctttaacttaatcacacctgcaaaaggtaacatttccaggttccaggaattaggatatatttaggggccatcattcagtttactataataactattttttatatccactcaagaagagtctcagatgtccatgaatgaaataaagcaataaatatcagattaaccctactgtttgcaaagtcctttaaatgaaaatgtcattataytttacattatactttatacttacattataagtatacattctacattatacattatactttacattatactttataccttacattatactttgctcacagaacatttatataattttatcttgtttcaggaagtacataaggcagtttatatggatacttgaaatgcaacaagataatgtaaattaaaaatagatgaaagaaaataaatgaggataagaagagaaaaggaagcaagggatgaagctctagaaaaatgaatataatcacattacttttattgatattgcatggaagataaat

SEQ ID NO: 50821 - DNA, 601 bp, Human
ccaaaaaagaaagcattttattgcctcatgaacattataattacttgtttacacgaatatgttttattcatttaaccatctcccaaccatactagcagaataactactttaagaaaatacctagtaaaactgttgaaaaaaatgagccatcaatggatttgtccttaagcgactctagccatctctgtgttgaattttcacggtttgaagcagcaactgcagaaaagagggcatctgcctcagtcattgatcagctggcatgctctccatgcaggcagaggttcaccattacttctgttgygaaatgtccccaacaacaccgtaaagccagtcacttcttcaatttactgagttaagctgatcatggtggtgagtgcttatagtcccagctaatcaaggtgctgaggcagtgggaccacttgagctccagagttcaaacccaggctaagcaaaacccctgtctcttaaaaaaaagatatatatatatattttaactgtatatatatagttttgtatacatatataaaactaaaagaaaaaagtaaaacaagaaaaaatttactgagttactacacagttaagaacacataaaaggtgacct

SEQ ID NO: 50822 - DNA, 601 bp, Human
ttcctgaagggttaggtcagccctgggaagaagtatagaccttggctcctgttattcctctttagatatcccagggttccaacaggaagttacaagatacctgcactacctgtaaagtttatttaaaatgattggaaggctctcataagcattggaggggaagaaaaactttttttctaccctcttaggtgaagtgcctaggagcctgtgaattaaacttacagcagacagactagcaggagaaaaagcttacaaagttatttattttaaattttgcttgcacaagggtgtcatagaaagraatgaataccccaaggagtgatgagatttgattttctgtatcattttactacaggaaagggaggtggagaaaaggcaatattgagagagcaaatgacttctttaaaaaaaaaaaaaaaagataaatgggtccttaggagaatagatgggagatatgacagtttgtgacaatgtctagaagagaagaaagagttgctcccagtgggaggaatttgtgacagctgagttcttttgggaacctctgcttttagtcagataaaggatttcgggaactcaaatgccttcagctcaaaataactct

SEQ ID NO: 50823 - DNA, 601 bp, Human
tcttcagaccactcagtcttaacagacatatctggctgaattctgggcatccctcttggttttgtcctgaaatgtggacacaattttcccagtcactttcctgattaattttagctctccaagaggatggagaacttcaagaggacaaatactattatgtcttagctctgttttgtttctcatttattactgtgtcctgcagaacacaatgggtttacccaagtagtccctcaatacatgttgtttaaagcagaatagtgcagctcaatgacatagggtcatgtcccactcagcctcttgrttgcaggcaactgctcaaaaactggacttcctcaagtgtgaaaaggaattataagaatccctatgtgtcccaaagcactgtctaaactaagaaccactctatgaatgctagttttccttactattaatggtttaatgcttattttaaaaatccctcaaagcatttcacaagcagatagtccctttccctttgtatttaggcttcaggataatatgagcggtaccactgttttatttttacaatactgatcattttatcatgcctgttgtatattcaggtgtaagttctttttcacaggat

SEQ ID NO: 50824 - DNA, 601 bp, Human
ccattatttgggcattctaaggaaaattcaggagtggttttttaagagggctgtgttgctctggggagcatcatcttgacaatcttgttaagggagggtgtttgaaagccacttcaactagaaaacttactttctacctggagtctgagtgcacctgtatccatcactggacggaactctgatgctgtcctgacaatgccctttcatgaccttaacctgtggctctggtcatcactgttcctcagttctcactctatcacatgggtaactgttgtactcagaggctttgggagtcctcaartgtctcactttccctctgtcattttaaaaactgctgcacagcccttgtttatttctatgtaattattacttcatcatatatgatgttataagccaatttgattcttttttggggagaaggtggaagcgaaggaagataggaaaagaaagtcaggctcgtactattacattttcacagatttatttgaaattgagtctttcccagaattatctaccacctcttatggtcagtttgacacagttaatgccaagcacagtttataactttttaaaattgatcaaaaattaccctaactttgaa

SEQ ID NO: 50825 - DNA, 601 bp, Human
tactttctacctggagtctgagtgcacctgtatccatcactggacggaactctgatgctgtcctgacaatgccctttcatgaccttaacctgtggctctggtcatcactgttcctcagttctcactctatcacatgggtaactgttgtactcagaggctttgggagtcctcaaatgtctcactttccctctgtcattttaaaaactgctgcacagcccttgtttatttctatgtaattattacttcatcatatatgatgttataagccaatttgattcttttttggggagaaggtggaagsgaaggaagataggaaaagaaagtcaggctcgtactattacattttcacagatttatttgaaattgagtctttcccagaattatctaccacctcttatggtcagtttgacacagttaatgccaagcacagtttataactttttaaaattgatcaaaaattaccctaactttgaaggtcctgaaattactgacacatataagaatttgcaaattaaatgtggcacacagtttttaaatatacatttaccatacacacacacacatatattatatatacacacacacacacacacacacacac

SEQ ID NO: 50826 - DNA, 601 bp, Human
agctagaaccagaggaaggggaagaaatgatggcttaaggcattcttagaagttgggttcgagcctacagtttgtttttctctttaagatctggaaaggtgaagaatctgatggcagtgaacccagtaatgaatacgatgttaatattataatgttatttattttatttacttatatactatagtaattaatttgtagtaattaagtagtaaacctgataatatctgatctaaatgattagcataaagaactatgtcaagatcaaaattcaggatgactaagaggtcagaacataagatastcacgcagaaggatgtaggaataaccaagagaactgaatgacctctctaagagcaccaagaaacatttacgccaggatacacaaagaactaagacatttgaggggtttggcgatggtgtcaagaggtgctcgctgttttacattattatgtatatgctgtccattttctagagagcatagagatagaggaaacaaaactgagacttaatcaacatcatgggatttaaatatcaaactatgaacagataaagaatgcatgtgttttacacgagtactgaggaaagacctaaattgaagcat

SEQ ID NO: 50827 - DNA, 601 bp, Human
aaatctggagattctatggggagatagggagagcatctatcaatcagggtccagttgcagaggatggaatccacccgtctattttaaacaagaaggaatttgttacagagccatggtaagtgggcctcagaaccattgcacagctgaagtagtagactctaaactgagctttcatgaacaactctcaaactcaaagctgctcccagaactggggccccacattgatgctaccatagcaacttattaagaagctattaggatcaggaaggcactgccatcaggacctgcctcggcaccaagsagtggatcctttcatcggctccataactgctcctgtctgcactagcaaaatggatgggatttttttgacaccacatagttaggggcagaaaactgggacctcagccacagaaaactgatgcctccaagactgtgcttgactgtaggaacagcagaagtggctgctctctcacaaatctcttaggaaggcatttcactgaccaagccaaagttaccttttggtctgtggctccaaagaggccagcttccagcactttgcagcaaaggcaggtatgtccacacagagagggagaagcaatgt

SEQ ID NO: 50828 - DNA, 601 bp, Human
ctctgcctgtggcctcttttacaatatacctaatttaagatgtgtataagacacatttttagatattcactaggaaaacaaaggcttttctatcctgtcatttacttaatttttttaacctaacttatttttctgaatgattaacattgatgcctttgattgtgtgggtgttgtcaaaagagagttcatcacatggggaaaggttggcaacctctctctgcttggtacttttccatgagcctcctttcactattctcattgttatttccttttcactctgaagtagttccaaatctgataytgaaggaactcgattttattttacatgaatatttgaagtaaattgagccacttgtgttttaaggtttgtttagtatgcactacacagagaagaatataaagtaaaagcaatagcaataataacttaggtttgacaaaacacataacaaaaaagggtactttgagacacagaaagtcaaattataggtaaccctaaaactcacctttccactttcctttctttactagaattctctaccaacattggggtgtcggtggtggttaggacagaaggaagtatagatatagctatctgcttcta

SEQ ID NO: 50829 - DNA, 601 bp, Human
tgccaggggggaagaaagccacgttctttcctcactgttcccttagggcctttgttgtaggagaatagtgggaggggctgaggttggctttgactacaagtggaaatttttgttttcctgatgagcctggcactcaggacactagacatttaactgtaggtttatgattgtcacccactctgcttttaatgccaagagtttcagaacccggctgacctgagcagaataaagttctttgggttcaatctgcagcaatcagaattttgagaacaacaacaaaaaaaatcttttttttttttttatctggtgttgcctcagcaggatccccgaatgtacttgctggtagcttagagcatagtctatgcaggggaggagaaacagagttgcagctgtgatgtgactcattcatactatgttcttttaatggagaaaaacctgcagtgacatcatctggccaccaggggttgtgctgttgccagagagcccttgattttatctgcccgcaagtcctgaggcaggaagtagcaccttaacagagagccccatcttcattcctaagaaaaccagcatcagttttttgttccctttgttgactttccaa

SEQ ID NO: 50830 - DNA, 601 bp, Human
gaggttggctttgactacaagtggaaatttttgttttcctgatgagcctggcactcaggacactagacatttaactgtaggtttatgattgtcacccactctgcttttaatgccaagagtttcagaacccggctgacctgagcagaataaagttctttgggttcaatctgcagcaatcagaattttgagaacaacaacaaaaaaaatcttttttttttttttatctggtgttgcctcagcaggatccccgaatgtacttgctggtagcttagagcatagtctatgcaggggaggagaaacmgagttgcagctgtgatgtgactcattcatactatgttcttttaatggagaaaaacctgcagtgacatcatctggccaccaggggttgtgctgttgccagagagcccttgattttatctgcccgcaagtcctgaggcaggaagtagcaccttaacagagagccccatcttcattcctaagaaaaccagcatcagttttttgttccctttgttgactttccaactagggctgagcccgcttttctgaattaataagaaccaagaaagaaaagggaacattagtcgtggttccaaataccaac

SEQ ID NO: 50831 - DNA, 601 bp, Human
acatggactacattaaaaagttattgaattatgttttctgttagcttatataaagcacatgacatttaataacttgcaaagaaatgcttattttatctgtaatatatactttggtgtttatcagattctgttcaaactgtgtagcaaatttccttgaaaatagaactttcttttttcctcacatccctgtatttgatatcagactattcttagactctccacctcactcatcaccatggtgtctacggacttataagtatgacatgctgtcacccttatttatacatgaggtatggaggtragcgtgaataagaatcttgctcagagccaattagttgcagatccagcattggaattcctctcccatagtatcaaaagtgtagtcatattcctagatcattaggcaggaagaaaaagaaaataaaagaaaaactactcagagacatctggccggatctgtgcctttcatcagaataatcatgtcctgaatctcccactggggttgtcagaaaagatttttcccaagcttttctataccacggagagctacatttaatttataacctgaaagtatcccctaaaacagactcataatcatgct

SEQ ID NO: 50832 - DNA, 601 bp, Human
ttataaaataacagcccactaagcgtcagaggtgaggggttgccccatccaattttcagagtctaaaagaggcatctgggtgtccattacctgaaacagcacaggcgctagtgtctccagagaaaaggaaatggaagagggaggcaggggatgttacaacagggtgtgattaatagcagctcactgctggagttcactcaggaaaggctgggtaaatgctgcagctcaaggtcagtgtgaggcaggccaagggatcggttagccctggaacttctgagtgagtccttggctccagttaaayaagaagcagccaagatctgggaaggtcaacacagtcaaagccctaccaggaactaggattataccctgggcttcaagccaagaccagggcactctggctgatctgagtgtgatcttgaactctgctttgccctctgagagaaggagccgaagctctgtctaccttcagggacagaggtctggagttagtttcctgattacagcaggaacaacccaagaggccatcagatactgggaggttcttacagtgctctaaaccctttcaggcaatttgagtcttctgtgtctattgtcttcacag

SEQ ID NO: 50833 - DNA, 601 bp, Human
ccaaaattatgagcatgcagctgtctctgtgtctgttgagcagagcttcctcaatgtgttgtcaatggctcaattttggaaacgggcaatgtctcgagacagtgctgattgccacaacttacgggatgagtactactcgtatctagttggcagaggccagatatactgctgagcatcctgcagtgaacacacagttccctacaatcacaacaatgagttcccctacctgaaattccatagtgctgaggctgagaaatccggcgaaatggtcatagcaagatgagatgagtttagctgattkccttcatccttaggaataagaacatgttaacatattaacattattgacctctaccagcacttaaaggacaaaaagcctatcaaatctaaaccttgctatgaaacaaaatctgattcttgtgagagaaaagtcttccttgattctcaagagaaagtaaaaggtttttgtggttttgacttaaataattctaatgactcgatttgtttattggacaatagattgaaggagctaagctggattttgttgattttaatttttaccagtaatgtagtataaaaaatgttttgctagacttgtatg

SEQ ID NO: 50834 - DNA, 601 bp, Human
tttaaaaaaattaacagttatatacgtgcttattgtaaacagtcaagtaatacagaggaatataaaacagagtgaatcatcttctccctgtccaacctcacccttttgcagcagccaacattaacaatttggtacatatcctttctcaactttctcaatgctcatacaaatgcatggatgttcatgttcacataaaaatggtgttttattcctcccccaaatggtgcagatgcaaatatgatgcagtaacttgatttttgcattcaacaatatacaatgaaaattcctcctagtcaatacrtgtcaatccaattcattattttgtcaacctaaggtagtcataagggtcagaatccaatttaaggagaggttatttaagtgcatattgtgagggtggccaactcaaacatgccaactccaaaggaatggagtcagcgttctaaagtagggaaattaaggtttcatttatgtagtcagggacagggaagtttttagcatatttcatttttcagacagggttggcacattgttacagcaatttgattggtttataggcagcgtttctttttggaaaagttacatttaacattcattacagagg

SEQ ID NO: 50835 - DNA, 601 bp, Human
gaatccaatttaaggagaggttatttaagtgcatattgtgagggtggccaactcaaacatgccaactccaaaggaatggagtcagcgttctaaagtagggaaattaaggtttcatttatgtagtcagggacagggaagtttttagcatatttcatttttcagacagggttggcacattgttacagcaatttgattggtttataggcagcgtttctttttggaaaagttacatttaacattcattacagagggcatagtagtcatgggttttctgtcatgtggtcttagcaaagcaaggtamcaaagaggaagtcaatctatagcaagggtcattaagaaggcaggagatttttgtcctggacatttaattatctctagccattgtagagaacgagaaaaataagaaagtgagttaatgtataatctgagaaacagaaattataaccatatgtgactcagatcacagtcacatctttctcaagacttaaagtgctttgggggtcgcaacaacttttgcattatatttattttcacaaattttaataactgaaaaatagtatacagtgtgggtatattatacttgaatactggtgccctactg

SEQ ID NO: 50836 - DNA, 601 bp, Human
catcaggaacattaactatatttttgtttgtttttttgcataactatttgtttagtttttccttcccaaatttgtggctgctgtgttcttgtgactttttgtcgggggtgtttttttcttgcttgcagtgttacccacaatgcatctattttgtgtgtattaaacagtccctttcaagagtacaaataatggtttgaaataggaagagtatcccaaatgctttaatcttatatttgaaatgtaggaaattggaggagctgaggatatttgtgacacatattttacatcttctcattgaaartagagctgttgtttgtctgcatggttttgagtttggtcactgaaatgctaatgacacagcagaaacccttggtgtgtgcataaggccacatgacctcaggtcaggaataaaagcttagggctgagcagctcactctttggttgagaatccagttggctcccctggagtgaagttctacacagaccctggaggaaccaccccatctgtaaggaacctaagtttctgtatttctggctttcattgtagaaaacctgatgtcttctatacttgttcccttgacctacttctaaaacagtttat

SEQ ID NO: 50837 - DNA, 601 bp, Human
ggccggctgatcttatgtggtaatgaaagctgggtcttaatgcagggacattttctgtagttagcccagtgaaatgatgtcccaagccagccactcccacgcttctgagcagtgtcaccttagatggtccttcccatcactccaaatttccacagcttccagtgccttcaagagcatactgtataggcacaagctagggatgggaccagggaggccttgggtaaaagcagccagttcaggctctctgagattcttgtctctggaggtgaataggagtccttgcttaggtcttggccacagrgataataatttaggcttatgtatattcctgaaacctttaattggtttgagctcctggaagattctccaccctttaggaccatgtggtacttggttaactgttgggtaccatatactttctgctatctttagtattacattgaattttggtgacttaataatacatggttaacctgagattattgtatcaatggtatatttttcctggcagtcagaagatggccaccttgtacatatggaagaatgagaaagggaaggaaagagttccatgtatttgttgacctctatatgtaatagcacg

SEQ ID NO: 50838 - DNA, 601 bp, Human
cacttacagccagctatggaggactttgaatgattatataagaattttcaaatctacgccagaagcaatggagaatccatccattgaatgttttttgaacagggttttggcatgttgaaagcaatgtgttcaaaatattcagtgttgtgtagattgggtggtggagaaagagaatacaagcaggaagatgaaatttggctaagacttcagtagtgtgagtatgtagtgatgaaacccctaaatcactgtcatatagcgatgaaaattaaagggttatttatttttcctcatgcagtctggkagtttgctcagtgaaggaagttcctggagtcaatgcatcaagaacattaactattttttgctattgacaaacaaacatcacagatattatgaaaagagcatcaagaagacttgattgtttttgtcttaggggattaattcaacaaacattggttgatcaagtcctatcagaaagagtttgggagacataagccaccctggacctttcctagtggtcgatgtggggaaactgcagctattaaagctcaggcttaggcattcagtaagcccagatggagtcttgagtgggattgggagattt

SEQ ID NO: 50839 - DNA, 601 bp, Human
aaagagaatacaagcaggaagatgaaatttggctaagacttcagtagtgtgagtatgtagtgatgaaacccctaaatcactgtcatatagcgatgaaaattaaagggttatttatttttcctcatgcagtctggtagtttgctcagtgaaggaagttcctggagtcaatgcatcaagaacattaactattttttgctattgacaaacaaacatcacagatattatgaaaagagcatcaagaagacttgattgtttttgtcttaggggattaattcaacaaacattggttgatcaagtcctrtcagaaagagtttgggagacataagccaccctggacctttcctagtggtcgatgtggggaaactgcagctattaaagctcaggcttaggcattcagtaagcccagatggagtcttgagtgggattgggagatttcagttcctgtcaaatttctgcatgaggtgttgtggtaaagtcaaaatagcatgaattctgtaacctaacagatttgcattaaaatctcaagttcaccactcatcagttatgtgagtttgggcaatttatttaactttctgaaccatcatttcctttttggaaaatg

SEQ ID NO: 50840 - DNA, 601 bp, Human
acaaacatcacagatattatgaaaagagcatcaagaagacttgattgtttttgtcttaggggattaattcaacaaacattggttgatcaagtcctatcagaaagagtttgggagacataagccaccctggacctttcctagtggtcgatgtggggaaactgcagctattaaagctcaggcttaggcattcagtaagcccagatggagtcttgagtgggattgggagatttcagttcctgtcaaatttctgcatgaggtgttgtggtaaagtcaaaatagcatgaattctgtaacctaacakatttgcattaaaatctcaagttcaccactcatcagttatgtgagtttgggcaatttatttaactttctgaaccatcatttcctttttggaaaatgaggaaatgccacctatggaagacgattctccatagatctcttctgtttctacacattttgtaagcagagacactgatggtcttttttctggactatccattcaaatttcttaatagtgaaaaacgttggaagacagagacagtgtctctttctagagcagaagtcagttttgcttcttcctccagagcaaaggtttgcttactgc

SEQ ID NO: 50841 - DNA, 601 bp, Human
aagccaccctggacctttcctagtggtcgatgtggggaaactgcagctattaaagctcaggcttaggcattcagtaagcccagatggagtcttgagtgggattgggagatttcagttcctgtcaaatttctgcatgaggtgttgtggtaaagtcaaaatagcatgaattctgtaacctaacagatttgcattaaaatctcaagttcaccactcatcagttatgtgagtttgggcaatttatttaactttctgaaccatcatttcctttttggaaaatgaggaaatgccacctatggaagaygattctccatagatctcttctgtttctacacattttgtaagcagagacactgatggtcttttttctggactatccattcaaatttcttaatagtgaaaaacgttggaagacagagacagtgtctctttctagagcagaagtcagttttgcttcttcctccagagcaaaggtttgcttactgcctattagaaaagattcagattccctgagctcaagtttcttcagctgagatgcaaacccattgcttgtgcagtatccacctaggtccctccatttcaccctccatgggacttggtagca

SEQ ID NO: 50842 - DNA, 601 bp, Human
aggccaagatatcattagagagcaacaaagagtagcctgatagcaattctttatccatgttactaggattcagctggggataaggaggaataaacacagtcatctaagatagtttcctaggacagaggaaaaaggattagggcctggggaagaggagtaaaactgctatctgtcagaggacatcaatctgaaagagaaggtgcaagcaactcttcctataagaaggatggatagttcccagaagggattggtggaggagggagcatcacccttgcagtctcgtgacatttgttatcaactratgccttttttttttggcacactttagtatgacagtcaggtggctgatcctgggttactgtttttagagacattttcttattggtggctccaggcacagtaagtacgtttgcctttagctgtggtctgcccttacaccctcatgctaggacatgtggaggtttcaaggtgaacaaaactgattttctatcattcagttgctaacattgtagtaagggaggtaagacacgtaatcaaatagacataacccgggagaaaaagtagcaaatgcctgagagtgggccaggtgctgagagagtgc

SEQ ID NO: 50843 - DNA, 601 bp, Human
tgtacagaagacaaagtgacctctgcaggcttagaggaagccagattggggcaacaaataatttattgaatttttaattaatttaatttggggtcatggcaagtcattgaagacatagagatgaaacttgatagagagttcataatgatctctcttttgcctgaattctatgatattattagtctctgtttaactcagagctcttctttgaaaaaaagaacatgacattcagactagtgccaatgaaaaatgaggcttatttttaggataaagagaaagcttatggacgttcaggagaagycaaataatcaggcctcaggccaggccgaattataaattccaatgagctcagagacctgtatagcacttactagattcttaataagtgttcgttaaaagaatgaatgaatgaatgaatgaacaaatgaactcacaaatgacctaagggagctcagaggaatactgaggactacactactgtcctaccaataactgacttaatcttactgcacttaactctcctgtgtctcttggcccaaaatcccaacagaggaatccagagaatacccctgggtcagatgcccatctcagtccattaagc

SEQ ID NO: 50844 - DNA, 601 bp, Human
ggaagccagattggggcaacaaataatttattgaatttttaattaatttaatttggggtcatggcaagtcattgaagacatagagatgaaacttgatagagagttcataatgatctctcttttgcctgaattctatgatattattagtctctgtttaactcagagctcttctttgaaaaaaagaacatgacattcagactagtgccaatgaaaaatgaggcttatttttaggataaagagaaagcttatggacgttcaggagaagtcaaataatcaggcctcaggccaggccgaattatarattccaatgagctcagagacctgtatagcacttactagattcttaataagtgttcgttaaaagaatgaatgaatgaatgaatgaacaaatgaactcacaaatgacctaagggagctcagaggaatactgaggactacactactgtcctaccaataactgacttaatcttactgcacttaactctcctgtgtctcttggcccaaaatcccaacagaggaatccagagaatacccctgggtcagatgcccatctcagtccattaagcaatagccagagaaggtaatgccaaatgaccatagg

SEQ ID NO: 50845 - DNA, 601 bp, Human
aggaatactgaggactacactactgtcctaccaataactgacttaatcttactgcacttaactctcctgtgtctcttggcccaaaatcccaacagaggaatccagagaatacccctgggtcagatgcccatctcagtccattaagcaatagccagagaaggtaatgccaaatgaccatagggctcccttctaaggatcagacagattaagccagaataagaaactgaacatggcctgtgggtttgtatttctccagggcattcattttgtatgtaattacagactgccatgtactggtgtatatgcatgtaaggtatatatgcgggtggcaccacagtgaaatatttttgcttcttgaggacagaataatagcttctgttctttcttctatagggcttcaattttataaataattctgatcaaggaagaatgttcaagtatgaccagattgggagctaatgtgctaactgattattatatgccagacactgtgttaggcattttacaaaactgtaatctctcacaatttattcttgtgggtaggcattattatccccattttacagatgaaaagactgagatttcaactatcacagttaca

SEQ ID NO: 50846 - DNA, 601 bp, Human
actgaggactacactactgtcctaccaataactgacttaatcttactgcacttaactctcctgtgtctcttggcccaaaatcccaacagaggaatccagagaatacccctgggtcagatgcccatctcagtccattaagcaatagccagagaaggtaatgccaaatgaccatagggctcccttctaaggatcagacagattaagccagaataagaaactgaacatggcctgtgggtttgtatttctccagggcattcattttgtatgtaattacagactgccatgtactggtgtatatgcatgtaaggtatatatgcgggtggcaccacagtgaaatatttttgcttcttgaggacagaataatagcttctgttctttcttctatagggcttcaattttataaataattctgatcaaggaagaatgttcaagtatgaccagattgggagctaatgtgctaactgattattatatgccagacactgtgttaggcattttacaaaactgtaatctctcacaatttattcttgtgggtaggcattattatccccattttacagatgaaaagactgagatttcaactatcacagttacaaagttg

SEQ ID NO: 50847 - DNA, 601 bp, Human
tgaggactacactactgtcctaccaataactgacttaatcttactgcacttaactctcctgtgtctcttggcccaaaatcccaacagaggaatccagagaatacccctgggtcagatgcccatctcagtccattaagcaatagccagagaaggtaatgccaaatgaccatagggctcccttctaaggatcagacagattaagccagaataagaaactgaacatggcctgtgggtttgtatttctccagggcattcattttgtatgtaattacagactgccatgtactggtgtatatgcatgtaaggtatatatgcgggtggcaccacagtgaaatatttttgcttcttgaggacagaataatagcttctgttctttcttctatagggcttcaattttataaataattctgatcaaggaagaatgttcaagtatgaccagattgggagctaatgtgctaactgattattatatgccagacactgtgttaggcattttacaaaactgtaatctctcacaatttattcttgtgggtaggcattattatccccattttacagatgaaaagactgagatttcaactatcacagttacaaagttgaa

SEQ ID NO: 50848 - DNA, 601 bp, Human
tcttctatagggcttcaattttataaataattctgatcaaggaagaatgttcaagtatgaccagattgggagctaatgtgctaactgattattatatgccagacactgtgttaggcattttacaaaactgtaatctctcacaatttattcttgtgggtaggcattattatccccattttacagatgaaaagactgagatttcaactatcacagttacaaagttgaaaaggggtggagctggaattcttcctgagattggtttgttccccaaagttataccctttccaatatcactatactmtcttgcaatcgacggatcattaagcaaaatatcgggatgaattctgcaggacagagccaggactcttccatgagtcattagtcaggtaaagacacttaaggcacataattaggcaagtatgtagttttttatttaatattggtttgaggaaactagctctaaataaattaggggaccaattgggaacctttgatatggtcaggttttagaggagatgagaaggataaaaggagaaagttgtttgaaaaaaatcaagttacaaaatactgcgatttcatttttagatatatggatctgtct

SEQ ID NO: 50849 - DNA, 601 bp, Human
gaagcaccttggaacagccgcagtaggaagtcaatacagtccttaggccagaggagagttcttggaaccagacgatggctgagctgtagaagggagctacctaatgggagctttggcctgtggtagttgaaagctgaaactgcaagatgcagcctggcagggagggagacaggcaggactagacatttgctaaccactcgcttctgccctccagtgtcctgcaggggcttcccattggccaagggcatgggaatcatattgatataatccttaggtcatctcctgggcacagagaagggtrgaggagggtagagagtgggtctgaaggagtgaacagaatctccagcagattcttctctaagtgtaacccatttcatactttctgggccaatgcccagagagaaaggtgggacatacacatctcagggcttagctctcctcattctctcctcctttcctcttcccacaatctaccagggatagagccagaggcacatacctcctcggtaagtcctagatatctaaggggtatctaaggggaactgcttgggctggatgtcctgggcttggcttttgctatgccaagagagaaataatgata

SEQ ID NO: 50850 - DNA, 601 bp, Human
ttctttgtgtttctttaacttctctgtcctgccactggcagatggatgccttagaccagctaggaaaatattacattttgggagaggcaaagagaatacttttaaaaactattactccccaatttcatgctgctgtagtttgtttggaaattttaaaattttatagcattttcaagtatattatctgatttaacatcatttaaccttagcaacaatcctacaaggtatccattttacagatgagataattgaggtcaaacgtactctgctagttaatagcaaacccacaactagaattccrgatctcctgactcccattagagtgctccttcttctgtgccagacagggggccacagtttgcacatttggaaaagagaaccaagttcatgaaattggttcataatatactggtacttgctaaaagtggtgacttgagcatttgcccagtgataattgctttcactgaaaaattttttttaactttttctaatatctgcttccatggtaactaggtaattttatacttattttattgcccttcttgcattatcatctgtcatttggtatctttcaccatttgcttttttcattcctggtttt

SEQ ID NO: 50851 - DNA, 601 bp, Human
atatgtgcctaggtagagaaaggatgaggagagcttaaacctagactaactagcaacctggtctctgggcagatttcttgaatgggtggtttctggcagtgagactttgaaagattcgtgatgtctctgaggagtgggatgtttggcccatcagagctgaaggccagttcagagtttctcactttgtaaggtttatgcgctccccctctgaaaagtggaagctaccggctgggtactgggtctgtctttccctagattcactcgaagtttcccaattcatgtattaccagttaaacagggttttgaactttcttttcttactagaatatagaaggtactaaagatgtttgatgtcttgaaaagtctaaggacctggaactgttgtttattccctggagcatgtcttctcacgttatgaagatagggaagactgagaatttgggttccagctaagtttgagcagtatctgtaagtccttgggccaggctgagtggggagaagtccacagtgtgttgcagtacccccaggactgtctgctgacccccactgcaggggtggggtggagcttactttctgggtctatctctcatagctgtgcttg

SEQ ID NO: 50852 - DNA, 601 bp, Human
actggtttcgtggaagataatttttccacagacaaagggtggcggtgatgtttttgggatgattcaagcacattactttcattgtgtattttatttctattattattacattgtaatatataatgaaataattatacaactcaccataatgtaaaatcagtgggagccctgagcttgttttcttacaactagacggtcccatctgggggaaacgggagacagtgacagatcatcaggcactagattctcataaggagcacgcaagctagatccctcgcatgtgcagttcacaatagggttygcggtcctatgagaatctaatgttgctactgatctgatgggaggcagagctcaggtggtaatgcaagcagtggggagtggccataaatagagatgaagctttgccagctcgcacacctctcacctcccgtggtgtgatctggttcctaacaggtaacagaccggtactggtccatggcgcgggagttggggacctctgccctatgggatcctccattcctttctcctttcctctctggcttgagaaaaccacagtcctaaattttttattattgctttgcttttctttataatttaattc

SEQ ID NO: 50853 - DNA, 601 bp, Human
aaagggtggcggtgatgtttttgggatgattcaagcacattactttcattgtgtattttatttctattattattacattgtaatatataatgaaataattatacaactcaccataatgtaaaatcagtgggagccctgagcttgttttcttacaactagacggtcccatctgggggaaacgggagacagtgacagatcatcaggcactagattctcataaggagcacgcaagctagatccctcgcatgtgcagttcacaatagggtttgcggtcctatgagaatctaatgttgctactgayctgatgggaggcagagctcaggtggtaatgcaagcagtggggagtggccataaatagagatgaagctttgccagctcgcacacctctcacctcccgtggtgtgatctggttcctaacaggtaacagaccggtactggtccatggcgcgggagttggggacctctgccctatgggatcctccattcctttctcctttcctctctggcttgagaaaaccacagtcctaaattttttattattgctttgcttttctttataatttaattcctaagtgatattttagttttgtgtgcttttgta

SEQ ID NO: 50854 - DNA, 601 bp, Human
catctgggggaaacgggagacagtgacagatcatcaggcactagattctcataaggagcacgcaagctagatccctcgcatgtgcagttcacaatagggtttgcggtcctatgagaatctaatgttgctactgatctgatgggaggcagagctcaggtggtaatgcaagcagtggggagtggccataaatagagatgaagctttgccagctcgcacacctctcacctcccgtggtgtgatctggttcctaacaggtaacagaccggtactggtccatggcgcgggagttggggacctctgycctatgggatcctccattcctttctcctttcctctctggcttgagaaaaccacagtcctaaattttttattattgctttgcttttctttataatttaattcctaagtgatattttagttttgtgtgcttttgtacttcattaagtagaattatacttattcttctgcaacttgcatttttcactcgatatcttatttccaagttttatccatgtggtgtgtatagtgatagttcattcattttgctattgtccagtctttatcatggaaatgcaccacagtatgcttatgtattgtcctg

SEQ ID NO: 50855 - DNA, 601 bp, Human
tgtggacgacccaggtggtgtgcattcaagttgcaagctgctttcccatgcagtcccactcagggtcacgagttctcaggggaggatttttttctctgtccattcagtcctgagtttcaagatgggcaacttgcctttcagatccctgtgtaaagaatgaaggtatttatttctagttcacctgactctcagggtgcagcccttggggcctacaatttacacaggaatctcacattaaacccctctccatgggcgggccttgggctttgtcctctgcccttacgcctcatgagacagtgargagctaagctggaattcaccaaggtggtaaatgtagacctccctgaaagcttgtcctgtttacatctctgccttctcattttctcttaatttttttctttttttggcttcttggtattctttgctttcttggagctcgtcacacatttaggaggatttttgtcttttctggaatttttagttgttttttggtgggagggtctgtcagtgcatctagtcctccacactatggaagcagaagttggtttaaattcactttaaaaattgccttctgttttatcaattctgcctaaaggtttgt

SEQ ID NO: 50856 - DNA, 601 bp, Human
tcattgtgctgcttaagcaacaataataaccagttttaaatatacacttcttattctttttactgtcagaatactatgggaataataaattacttacaaacctgatagaattcattccagaccatgttataggtgcaagatccttttgaagatgggttctggttttaggtcagcaacttagctcaacaattactttgaaatgatttttttaaatgaaaaagtcaatcatagaagcaactgaatttataagttgtgtactttttggcagaaaaataaagctctaggggtagagaggaaagcratgcttcatcgaggcctaattagatcttgtggagctgctgtggggatccggacctagggaggaggaggatgtcaggctcattatgaatacacatctttgttcaagtcttttgcttgcaatacccactttagacactttgctgacaagcctttactttctaggaggagagtgttgtaaaaagggctccttgagtaggaggaagcagcagagccagaggagctgaggccaacattccctctgcattctgtgtcctggctcataggccaggaagatcctgttcccacagaagcaaggcttggc

SEQ ID NO: 50857 - DNA, 601 bp, Human
ttacaaacctgatagaattcattccagaccatgttataggtgcaagatccttttgaagatgggttctggttttaggtcagcaacttagctcaacaattactttgaaatgatttttttaaatgaaaaagtcaatcatagaagcaactgaatttataagttgtgtactttttggcagaaaaataaagctctaggggtagagaggaaagcaatgcttcatcgaggcctaattagatcttgtggagctgctgtggggatccggacctagggaggaggaggatgtcaggctcattatgaatacacrtctttgttcaagtcttttgcttgcaatacccactttagacactttgctgacaagcctttactttctaggaggagagtgttgtaaaaagggctccttgagtaggaggaagcagcagagccagaggagctgaggccaacattccctctgcattctgtgtcctggctcataggccaggaagatcctgttcccacagaagcaaggcttggccttcctgctttggcctctccacaggctgaggacacagctctgagctccaccttaccctctccccactttgtccactctgaactctgagttcta

SEQ ID NO: 50858 - DNA, 601 bp, Human
gcttggccttcctgctttggcctctccacaggctgaggacacagctctgagctccaccttaccctctccccactttgtccactctgaactctgagttctagcctcctgatagtgtttgtctatgacagctcagaataatattaaagattttcaggtgcttttacaagacacacctccaagttaatttcatttcaaaatgaaagagcagcacgttcctctggtataaccaaaaatgatttcagtaagcacagtgcctcaaatctttagctgggtctgtctgtggccactgagtggctgcacrtaccagagtgcacagaccaaagttagcattaacagataatggactgactccacatattcttatggcctgaaattctggctcatgactagttcatgtcaactgcagggtccaaatgtcatgttctgcagagtggggtaagccaactgagtctaagctaaaacttcactccatcatggtgataatgctagtttaagtttaggcacaatgtctgtaactgaccaatttctataaaatgcctcgatttttatttttctgggctgtaggattactggggtatacatacatacatatactaataca

SEQ ID NO: 50859 - DNA, 601 bp, Human
agcctccatgcttcctggctcttatttctgggttcttcggagatgaagaagtaccgcatgctgccaaaggtagcgtcgtgacttccaggggcacatgagcacagctctctgccccaggcctggtgaaaagcagagaaagtgtatctttgcgatttttcttcttcacatttctctttctcctcctccacgtcaggccacctctgctttatgctcattctgtttttaaaacagctttccttactcttttacaagtgtgcatgcggatgtgtggacacaggaactcaagttccctgatagcacrtatgcattcggattttaccttcaatgctaggattcaattttaacaaggacacatagaaagccatctctgcagtctcactgctggccttatgaagaactgaggcctcctatagagtcagcccctctgccccaattctccacagagattctttatgggcccctggtcacagacaactcctctttctgtctgaggagagatcctactgggtctgttagctccttgggtaccaaagatacctcagagaccagcctattagatgacggccttggagtcaggcactcagttgtggtcatgatccaa

SEQ ID NO: 50860 - DNA, 601 bp, Human
aggttcatccatgttgtagcatgttttagtacttcattgtttttatggctgaataatattccattttatttatctactacaatttgtttatccattcatctcttgatggacatttgggctgtagtcacctttggtctactgtgaatagtgctgctatgaacatgtgtgtccatgtatttgtttgagtaccagttctcaattctttggggtatatacctaacagtggaattgctgagtcctggggaaattaattctgtgtttaactttctgagaaactgtacgactgttttccacagtggcrgaactattttacattcctgccagtaatgtacaaaggttccaacgcctccacatctttgtcaacacttgttattttcctgttaattcatatttaaataatcaagtttaaatatctaatattgggcataaatattcatcctacaaggagatcttctagggagtcaagaaaccaaagaactagaccattaatttgcaatgcagaaataattaaaattaaaaggaaaagatatattaaatactttaattcattaacatgatttacttgcacttcatctcattccaaattggatgtggcttacag

SEQ ID NO: 50861 - DNA, 601 bp, Human
tgcatgttttgcttttgcaaaggcagatgcccttcttgagctgctttcccaggagctgtgactctggtgatccaaggaacgcatttgcaagatgactgacagcctgacagggttggtgtgatgcagcttgtggtccgaagtagagtgacactttacagtaaatgagccacagttgctcctttttaaaaaaaatttagtaagaaatccactaaagtgacagagttttattacctccatgcatgtgggatactaaggtagttctaatgattcttttccggcttaacaaggaaaagtcacaaartttgttttccatatttcagaaaacaaagatgtaaatgtaagcactgataccagagcaatatgttatagagtatgacaactaattaaaatcaaagactttgtgatttattcagatttattttcacaggatagaacagcactttccaaaatctgagtactttacagagctcttttgttagaaattgcatttgcaagagcaattttatagtgctgaagagatctgcttttctgtagcacaggggaaagaggaaatatgtccatacgaagccttgtacatgaatgttcatagcagctttatttg

SEQ ID NO: 50862 - DNA, 601 bp, Human
gagctcttttgttagaaattgcatttgcaagagcaattttatagtgctgaagagatctgcttttctgtagcacaggggaaagaggaaatatgtccatacgaagccttgtacatgaatgttcatagcagctttatttgcattagcctaacctaaatgcccttcaacaggcaaataaacaacacactttggcatattcattcaatagaatactactctgcaaaaaaaggggaagaaccattgataatgcagcaacatagatgaatataaaataactatctgcaaagccaagcaaaaatgagtrtatactctatgattcaatttgtataaaattctagtaaatatctgcaaactaaaccctagggaaagaaagtcagtcagtggctgtctggtgagagtggattgggggaaaggaaagaagagggagggaggaagaagaagaagcaagtaaaaggtgatgaatatgttcacttccttgattgtgataatggcttcacgggtagatacatatgttaaaacttacaaattatacatatacactttaaatgtctgcagcttattgtatgacagttacaggtcaatgaaactgttaaaaagaaaaatc

SEQ ID NO: 50863 - DNA, 601 bp, Human
tgtctcaaaaaaaagaaaggaagaaatggtttttgctttgccattatcgtcctgtcttgtgctaggtaaggtacagaataatctcagttattctacaatcacactttttttattagattattcttaagttgcatgaaatatttaatgatgatggtacttttctaatgttgcaaagtattttacctgctgggggtcttgtaccaaaggggagtactccacatatgtgatgtgatttttcttctttttgtgtattgggggttaggggctgatgaggaaatcacagaggctttatccctagccstaactttagtcccaaatttcaccattaagaaattgtctttgggttatgcattttcttctctactatcacactttggaaggtaaagatattgcattcctaatacctaagtgggagtcaatttttctttctcctaggcatagaaaggcctgatggtaggaagaggtaccaataattgacagcaattatttcagttttgccagcagccaaatttgcctgctggttcctaagaactaagatgtaagcctttttgctcctatgagaagatgtcctttgtatgaggaattgggtctaaaacgagca

SEQ ID NO: 50864 - DNA, 601 bp, Human
cactttggaaggtaaagatattgcattcctaatacctaagtgggagtcaatttttctttctcctaggcatagaaaggcctgatggtaggaagaggtaccaataattgacagcaattatttcagttttgccagcagccaaatttgcctgctggttcctaagaactaagatgtaagcctttttgctcctatgagaagatgtcctttgtatgaggaattgggtctaaaacgagcatgacatctccccaacttccttagtttccataagaatgagaatgtttttctccctctaaatatggcctarcagtcctattgggctctatgcttgtgcaccctaaggactcaatcagataggttcagggcacagcccagagtcaggcagaatgtagccagggagcttgtcagtttatctccagaagttaaccaacattccccaacctaatgatgacaattacgggaaaaaataagaaaccacacattgatgtgcagcaatttaaaagataagttgcaacaccatatgaacaatctcctgaaaggataactggattttaggcattaaattaaatgagcttatctgtcagtagttttggcctctgtctttcca

SEQ ID NO: 50865 - DNA, 601 bp, Human
ctccagaagttaaccaacattccccaacctaatgatgacaattacgggaaaaaataagaaaccacacattgatgtgcagcaatttaaaagataagttgcaacaccatatgaacaatctcctgaaaggataactggattttaggcattaaattaaatgagcttatctgtcagtagttttggcctctgtctttccactttcgtggccaataccaattaatggccctgacagtgtaaagttgaacaagctctaattctctgggtttggtcacctctgtatttaatccaggcctgagggtttcgyataacactggtctgaacttccctgtggggtataagtaccaggaagaccttcctgcatggccttcctaatcacattgcataggtaaactaaccaaatggaaggtggggcaatgctggcagttttgttgctgaaggagagaggtgcctggcagggaggtgggaatgtctgagcagagggagtgtcaagtttgtgcaaggtctgccaggggaagggaggggagagactcatattcctcctgggactggaaatagagctggcaagttcaaggaaggcttctagcctcttcccacaggggataat

SEQ ID NO: 50866 - DNA, 601 bp, Human
aatgccgatcccataggtagtgaagattcagtaagttaatgttcgtaaagcctgcaggacagcatctgacactttgtaggcatgaaatgattatttgctgctgtgagaaagactgagaaacaagtctggaggagaggcacaataattcgttttggctccgtaaagtctgaaatgcccaatagataaacagatttataggctgagaggacaactcagtgtaaaagtttaaggcagagatggacatttgggattcaactgcatatagataacatcgaaaactagatgactagatgagatttcyctggggattacttaataaatacaaatggtcatgaactcactaacctttaggaatgaagtgaactttcctttgtagggaagaaccagtccctctctttaggaggaggcataagtctatcaaccatataatttggggaaagggtctgtccccaaccctttcttcttggttgttgagggaaggcagcggatcttaatcatatgtttggaggagcgataaaatctgtatccctctgaattaattaaacccctgctcttagtgctgtttatgatacccattccaggacaaaatctgcacctcatc

SEQ ID NO: 50867 - DNA, 601 bp, Human
gcacctcatctgatgaaaaatttgatgtgaagaaatgatgagctatgatcaggttaggttaggtagaattagatttcaaagcactaaaaaaaatttttagctgtcagaggatgtgtgtgattcccagaggcaatactttgcatactgattaagcaatcatgacctatttagtttgatttataatgaaaagaaaatctatggtatgttaatgaaagatcttggcatatttcagtctgcagtaggattcaaattgaaataggccttgataagtaggaataattacacagcagactgaaattayctcctttacagaaagattccaggaatacaggaaaaggtcaagggatcatcggtatccagggtttcttgttgctgttgttcttgtcatagttttttacttgcctagatttgtatctaagaacatacaaaaaagtcctctccattttttggttttctgctgcctttttatgttgtctttagacttcaaggagacatgggagaggtgggtgactttggggtaaaggaggagaaattgaatctcttctgtaggcagaagtagaatcaggaaatacaactttatggtgggctattcaaagcagtg

SEQ ID NO: 50868 - DNA, 601 bp, Human
aggtggttgctcaatagactttcttcctttcctccacccttccctggtttcctttttacccttatcactcccttctccctagggctcagtccattctgcaggcaccccaagtggccaaggccccagggacctctggccttgactagacagaaagaggttgcttttacagtcttctcaagggtgcaggcttaagtctttttaattcttcaaaatgggacatttaaaatacagcacaacccttttcgtgccatatttgatagcatcacaaagcagaacagctagagcagagaccctaaggtargagggggcctggtatgttccagggacagtgaggaggctggaaggtctggagcagagtaagaagaaatgagaggggaccagactgtgtagggccatcagaaggcccaccaggtggactttggcttttcaccgtgagtattatgaggagatagtgcaaggttttgagcagagacctgctccaatttaatgctttaatgggtccctctggctgcggtgttgaaaagggactgtagaaggataaggtggaagtatggagtttagttaggtgattgcaagagccccggtgagtgatgatggcggc

SEQ ID NO: 50869 - DNA, 601 bp, Human
cttcctaaaagctgttcatttctttcatcttgtctcatttgctgtttgacccagtgccatctggcatccacattccttgttctcctcacacagtcctctccagagacacaaattaccccctagtcaccagattcttccttgacccttattctgcttggtcttttcatttttgataggaaatgtctgttcagtaaatgaacatttggttttatgatctagttaatgtatgtttttatacttcctaaaaaaacattgtgttaataaataacatataatgctaacaatattatagacagattcyattctgctcacaaaaagaataccacattaataaagttatttctgtcctagggaagaccaaggcacatatttgaaaatattcactagagcctgagatcatacttaggactggatgacttgtgggagatggaaggggtagaggaaaaagggcagttcctacatagctgatttcatagggtataatgttttcttacagataccatatgcatgcaagtataacagggttttgggagaacttacctgggagcagcataaatcagaagaagacagcatatgcattttaagatttgagggttttttt

SEQ ID NO: 50870 - DNA, 601 bp, Human
agcccttggctttccgattgaagggagcactagctattagctgctcatctcaacatatgtatttttttattttaatggataaaaatgttatatggctgatatgattgatgactaagataaattttcacactgggacattttctgcctgaaggtcaggcttaggtggcctggtcccagagttgctgtttctactaggacccgacctggtaaaaatagaagatacagggtagtgaggcagatttgaaaagaatgcagcatgtgcaaattcttactagctgtaatataaatgataaattaaaayatgcatttagtggaatgcactcccataaactattctagattgcatatttgtatacatccatctagtatattttttctgtgttaaataggtacatatttatccttttattccataaaggtaccacacatatacacttctggtagttttctttcttcattttctaactattttgtgagtatgttaaatatttattgcaccttcatttttaatgaatttatctcccagtgcgtagctatagcaatgcttttagataagtaaccttgcacattttcattattttcaatatttcactgttacata

SEQ ID NO: 50871 - DNA, 601 bp, Human
ccactggggacaaaatgtttggagaaggcatgtcattttattacagtccaatcattgttatatacttataggaataacagaagcaaaacttgagttggtaaaatgatttgtcagagacattaaaaagtcagtgtaatcaagagtggtaaatgaagctaccctgtctgtgctctggggcccttgaaaggggaccaccaagggcagtgcagtgtttctctgcctcctgtttgctaactctgctcctgctcttctctcctgtgcttccgggctgcaggtctcactccatcgggtaagcgccacrgggctgcgtgtggggctttccccactcccttgctgcccctttgctttccagggctccctgtttctttcacactgtgcctgaaccaacaaaactacactctgttttccagacagttcccgtgaccaggaagatagtttatagggcacttaatacatttgaacttattgaagtacatctctatctcatttctgaatcatttacaccatttcacttgctgagctctctctcaggagtctctttctctgcaccatttcttccggtgttgacagagcttcttagaattgaaaagaagaagaaaaa

SEQ ID NO: 50872 - DNA, 601 bp, Human
attaaaaagtcagtgtaatcaagagtggtaaatgaagctaccctgtctgtgctctggggcccttgaaaggggaccaccaagggcagtgcagtgtttctctgcctcctgtttgctaactctgctcctgctcttctctcctgtgcttccgggctgcaggtctcactccatcgggtaagcgccacggggctgcgtgtggggctttccccactcccttgctgcccctttgctttccagggctccctgtttctttcacactgtgcctgaaccaacaaaactacactctgttttccagacagttccmgtgaccaggaagatagtttatagggcacttaatacatttgaacttattgaagtacatctctatctcatttctgaatcatttacaccatttcacttgctgagctctctctcaggagtctctttctctgcaccatttcttccggtgttgacagagcttcttagaattgaaaagaagaagaaaaaaaaacaaagtggagattgaaagttatatatgttttctgaaacttctagaaagtaaagttgagaaacaaaaacagattttctctagattgtcatgtttctctgaatttcttgtacccat

SEQ ID NO: 50873 - DNA, 601 bp, Human
gaaagtcttatgttaacttcttgctttcctctggccagtttctctaccatggaatgattagcttctacctgcctggctctatttcctggatactgccttttgctccttactgttttcctgagcagaagggagtagagacctaagttgggcctggagaagatgcccatgggctactgggctcacctgggagaaaccagacattctcagatttcctggcaaaaggaggctgcagaaagtaaaataatatgcaaccacggatccaccatctacttttcatttatacccttgaaagctgactatrcccattatacccaacaaaaacaaatgtcatcttggttagatgggcagggaatatttcagatatttggaattgctgttttagaactacgaatagggagtttttcatgtacttatgtgtgctctcttcttttttcttttttcccctttaatctgcttttgctctgaagttactccattcgccattccataagtatgcctgctatgaggtaatgtgtgtaaaatattttatgtaatattaatatgaaatgtgtttaaggtgttattttatttatatttacttatggggttcctctgctttatg

SEQ ID NO: 50874 - DNA, 601 bp, Human
atgaaatgtgtttaaggtgttattttatttatatttacttatggggttcctctgctttatgtgaaaggaaattgctgatggtcttcaaaagaaaaggctgacaattctgtggaagaattgcgtagcttgggcttttgaccagacatcctggcttaaatctagtctttcctgtgtgatccaagacaagtgacttaacctcaattcttttatccatatattgcaagaaataagacctacttcatatggtgtttgtgaggcataaacaaaggaacctacataaagcatttagcacagtgtctgracatgccaagcaatcttgcaaaggtaaacttgggtttcttatttccgcagaattaaatgctagcctgggggcaagtttaaatgcaaggctaaagttctagagaggatatcattaggatttttaaggtggatattaaggtgagatgtttgttaaataataaaatgtcagtataattactgaccagataaaaactggtgagaaagacattcttaacttcaagtttgcatggcatagtgatgcaatcagataaaattaaactaatagcaagacaggaatgagtgttaaattgaaaatcagaaa

SEQ ID NO: 50875 - DNA, 601 bp, Human
acattcttaacttcaagtttgcatggcatagtgatgcaatcagataaaattaaactaatagcaagacaggaatgagtgttaaattgaaaatcagaaaatgcaggctctagcccagctctgccaaggattaactttgcactcttgggaaaatcacctcaatggtatcagcttcatcatatttaaaataagaggctagaaccagattagctgcttgtcaaagatgcccctccacccaccgagccctaaggctgcctagagatgaagcctttgggatcttcccccacttcagtcagagctatgmctcttctacctgctttatattgatgttgttgtttgaaggcattatagaaggagtttagttactttcaatagtttgagaccgccgaagccaaattcttcatatatataatcttttcctctgttttttaactgtcatgaagagaaattcttcctagggtcatttgcagtgctaaaaaagtttgtacatctgattaaatcttattaaagttgtacatctgattaaatctgattaaagagcttctccctgttctccagcatgtattctagtataatttaattagataaatgtctgttctattat

SEQ ID NO: 50876 - DNA, 601 bp, Human
aattcactcataaacatctatgttcattgccttttagtagtataaaagtgatacttcattctgcaccacataatgaaacctatattctatagctgttctcctttataaagtttttctaggccattcctcttattttacttttttttttttgcactcaagagagaataacaagtgccttattaattcaacatttagttgaattatttgatctgaaaatgatggcagttgttgctgctgaaagctgacatggatacaagatttaaaatacacttagttcagttcctgtttctttagtaggagytggtggtatttttaatggtggtgatgtcattaaattataatatcatggggccaaatccaatacagaaaaccagaaagcaccaaatgaagtttttagtgcttaaagcaacaaaattatgtatagattatttaatacaatgaatgagtcacaaataaaatgccattaggggccaggcacggtggctcacgcctgtaatcccagcacttttggaggccgaggcaggtggaccacctgaggtcagaattcgagaccagcctggccaacatggtgaaaccccatctctactaaaaattcaaaaaa

SEQ ID NO: 50877 - DNA, 601 bp, Human
gaaaaccagaaagcaccaaatgaagtttttagtgcttaaagcaacaaaattatgtatagattatttaatacaatgaatgagtcacaaataaaatgccattaggggccaggcacggtggctcacgcctgtaatcccagcacttttggaggccgaggcaggtggaccacctgaggtcagaattcgagaccagcctggccaacatggtgaaaccccatctctactaaaaattcaaaaaaaatagctggatgtggtggtgggcacctgcagtcccagctactcaggaggctgaggcaggagaatygcttgaacctgggaggcagaggttgcagtgagtcaagatcagttcactgtattccagcctgggtgacagaacgagactatcaaaaaaaagaaaaaaaaagccattaggctgcaaaggttctatttggtaagagaacaagtaggtatatctatttgagaggaaaaataacgcatgctaataacctccattttgattgggcattaggtaggtaatgggtatgtttcatcttaaaataatgaaagcattaactttccaaaacaccacttcatgtaagttgtcaaaatgattatttttttaagg

SEQ ID NO: 50878 - DNA, 601 bp, Human
ttcacatataaatctatgaataaaaccactattgaatagtgttactatatccttagagttgtttgtataaaccattcaggggtgaattgttcattaaagtgaattggggtatgcgtttaccacttaatctcttaatgctatccctccaaaagtagatatgtgagagatgactgtggataggataaaggctatatgaattctgaatttagagtgtgagtgaaagttcaataacagctcagagctgctctggtttggacatggaccagcaaaaacaaactggggactacgtatccactacccrtcagctacctagacttgtttataaattcaggtactgagcacagcacagtatggctatcatagagggaaaattaaactgagtcacaaaatgcattttataataacacagtaatgcatttcatccctgggtataaattgaaaatgtgcctattacagagtgttttaaaaattcactggaattattgttctagcataggtaagtttgaataaaaagagtaaaatgaaatcagtctagtcttaaaattgaacttttaaaacaagaaaaatcattacaactactaagattatttttaaaggtatc

SEQ ID NO: 50879 - DNA, 601 bp, Human
aaattctgtagtttgtttttccatgaaacacttttccaatcctataaaatttagttctgcctacgcccttacaatgtattacttgacactgcagctgatgtcacctgtacagtcactgagcatgcttcctatttcatccaaaacaaacaagtaaatgcagaacgaactcctgtgaagccacttttggtatcttctgccatctcccaatgagtcatgagtaactacatctcttccaaccattttgcatccatgtcaagcagaccatatttttagtgcacctactttttgataaatacattayatggcctggaccaaaaccttaaaaagaaaaggggggcaagttgcattacatgttttgtttctttttgtattatgagagattaggaagcccaactcagcgattcaaatgaaattctatgcaaagaacgattataatttgggggacaaagtgacaaatacttggatgaaaaacaattatgtagagaagggtccaggagaattttatcattcacatctttgcttaaggaggtccttacctaagatattgcagtaggcagtcattaaacctacgtggttaggaatatctttgattccatacctt

SEQ ID NO: 50880 - DNA, 601 bp, Human
aaagaaaaggggggcaagttgcattacatgttttgtttctttttgtattatgagagattaggaagcccaactcagcgattcaaatgaaattctatgcaaagaacgattataatttgggggacaaagtgacaaatacttggatgaaaaacaattatgtagagaagggtccaggagaattttatcattcacatctttgcttaaggaggtccttacctaagatattgcagtaggcagtcattaaacctacgtggttaggaatatctttgattccataccttctttgccaaattgatttcttacraagccattccttctttattttactactctgtttagaggaaatcaagaaacaggagagaataatgaaacaaagcacagaagaaaacgtcagtgatttgtattcactgaattcaatattgtgtgttacttctattgcaaaagagaatgtgaatggaagaaaaaagaggagagagggaactattaatagagtagattacattgaattaatcttatttgtttctctcagggaagaaataagcatagtgaaaaatcacacaatggaaaccatcccttcccctgacctgttcccagtgttaagata

SEQ ID NO: 50881 - DNA, 601 bp, Human
agaaagaaagaaagaaagaaagaaagaaagaaagaaaagaaaagaaagaaagaaagaaagaaagaaaaggggaaggggaaggggaagggaagccacgctcattcacttaggtattcgctgtggctacttcctacaagaactgatttgagtatctgtgagagcaacaatgtggttcccaagcctaaagtatttactgtctggccctttacaggtagagttttctgacaccaagcagagtacaaaaattcaatttaataaataaatttaagaggcagagagagattttagtgacaattagagygaagtgtgttttgtaatgatggaactgcttttgaaccctggttacatttttaaaaggtcaggccaggcagcacagacacaatccccagtgttgctgatgtctgtgagtgatcactttggtgacagtgaggcatcaacaatcagtttggcaatagcaacattatttattctatatcttctttttccttcaaagtgttttttctacattatgaaaaacaatgggagggaaggccagtgtgactattaataagacttgcactaagcattttgcatcttgtcaagcagaccatatttttagtgc

SEQ ID NO: 50882 - DNA, 601 bp, Human
ggttcccaagcctaaagtatttactgtctggccctttacaggtagagttttctgacaccaagcagagtacaaaaattcaatttaataaataaatttaagaggcagagagagattttagtgacaattagagcgaagtgtgttttgtaatgatggaactgcttttgaaccctggttacatttttaaaaggtcaggccaggcagcacagacacaatccccagtgttgctgatgtctgtgagtgatcactttggtgacagtgaggcatcaacaatcagtttggcaatagcaacattatttattcyatatcttctttttccttcaaagtgttttttctacattatgaaaaacaatgggagggaaggccagtgtgactattaataagacttgcactaagcattttgcatcttgtcaagcagaccatatttttagtgcatctactttttgataaatacattacatggcctggaccaaaaccttaaaaaaaaaaaaaaagggcaagttgcattacatgttttttttcctttttgtattatgagagattaggaagccagttttaataagggatttttagcagttttaataaggaatttttcaaaatactt

SEQ ID NO: 50883 - DNA, 601 bp, Human
aacaatgggagggaaggccagtgtgactattaataagacttgcactaagcattttgcatcttgtcaagcagaccatatttttagtgcatctactttttgataaatacattacatggcctggaccaaaaccttaaaaaaaaaaaaaaagggcaagttgcattacatgttttttttcctttttgtattatgagagattaggaagccagttttaataagggatttttagcagttttaataaggaatttttcaaaatacttagccttatttttaaattgtaagttaattccttcatgtttctatkcttagtcaataacaaatacacaagaaaaaagcctcataaaccatcataactgcattgtaaggaatattcatactgtaagggtgtattaattccatttcacgctgctgtgaagaaatacctgagactgggtaatttataaaggaaagagatttaattgactcacagttccacagggctgagggggcctcaggaaacttacaatcatggcagaaggggaagtaaatatgtccttcttcacatggtggcaggaaggagaagtgctgaacaaaaggaggaaagccccttgtagaagcatcagat

SEQ ID NO: 50884 - DNA, 601 bp, Human
gatttgggtgaggacacagccaaaccatatcaaaaggcagttgcctaagatgatgtgaaatcaccagtgattaagacttgatccatcttcaattttcaaagcagaaaccagaaatcattttccattgagccactctgacttttcaaaagacatttgtcagaaatccagtttgccctgctaactcccaagtagaaaaatctaagtttaggtcatgtaaggatgtttatacatttgtacaattggaggaattaataaaaaatctaattccattttgattagatcagttctctgggtgagtggrgatagctgttccaagtccatggatccgattatgctcctgaagggattaaaatcttagatacaggagagataaagagagggttgctaaaagtgtgcaaaattaaagtttggaatcctatccgagaacccaagtatgaataatattctagcactctactaaaggaaacaaacttctgtgcattcttttgtctctaaagatagaaagtatttctgaatttgaaagtaatccagcttttggtattcttataaaaacattacaaaaatgatagtaacaactaactgcatttttgtggatctgctc

SEQ ID NO: 50885 - DNA, 601 bp, Human
cccaggtcaccgtcactgctgcaggtgggacgggacaggcccctgtggaatcgggtctgggaggttccctgggaggcctcctctcccaggaggtcacagctgggggtcagagctgaaaggaactttcccacccacaggcctctctcctttacacttggagaaactgaggcccaggcaggggaggggcctgtccacatcaccacctccagaggagcctgaacctaggacagaacccacccctgcctcccctggaccccgcccatctcccactcagagcccctcactcaccattctgagggcstgaccctggggggttaaggggctggtcctcaggacctcctgggtcaggacagggaggtgaaggctggggctgtcttgccccccacatcagcccggctcctcctcctggctgggccccaacatctccctctgcctcgaccccccactcttcaccagcccagcctcagagcccctgggacacaagcccgtccttgaggggaggggagtgggatcctttgggagactcagactgccctgggggaggcggcgctccccacgaggcctcagtgactcaccaggtgtggagggcggccctgtgggt

SEQ ID NO: 50886 - DNA, 601 bp, Human
cccctcccctgccccaggtcaccgtcactgctgcaggtgggacgggacaggcccctgtggaatcgggtctgggaggttccctgggaggcctcctctcccaggaggtcacagctgggggtcagagctgaaaggaactttcccacccacaggcctctctcctttacacttggagaaactgaggcccaggcaggggaggggcctgtccacatcaccacctccagaggagcctgaacctaggacagaacccacccctgcctcccctggaccccgcccatctcccactcagagcccctcactcacsattctgagggcctgaccctggggggttaaggggctggtcctcaggacctcctgggtcaggacagggaggtgaaggctggggctgtcttgccccccacatcagcccggctcctcctcctggctgggccccaacatctccctctgcctcgaccccccactcttcaccagcccagcctcagagcccctgggacacaagcccgtccttgaggggaggggagtgggatcctttgggagactcagactgccctgggggaggcggcgctccccacgaggcctcagtgactcaccaggtgtggagggc

SEQ ID NO: 50887 - DNA, 601 bp, Human
agagcagcaggacgaaggccaccgagaccccaatcaaaacctccaggtatcttcccagaccttgacatgaggacgtcaggagtgggaatgatgtcattgatgtgagcacctactgtgtgcaggcgcgagccaggtctttccttcgtgacctccaaccctcacaagcagtcgtgcaacatggaattgccacccgtacaacccatttcacagatgcacaaactgaggctcagagcagggagtcgcctgccccaggcctccagcgaggaagcggcagagctgggaagggagcccgggagtctgrcctgcagcccttgttcctgcaccagagccgagacccggagctgcagggaaagagcctgaccgtcctgaaccacggccctgctcccctcccctgccccaggtcaccgtcactgctgcaggtgggacgggacaggcccctgtggaatcgggtctgggaggttccctgggaggcctcctctcccaggaggtcacagctgggggtcagagctgaaaggaactttcccacccacaggcctctctcctttacacttggagaaactgaggcccaggcaggggaggggcctgtccacatcaccacctc

SEQ ID NO: 50888 - DNA, 601 bp, Human
ggacctggaggaggacatgggagtgtgaggggcagtgtatgggctgtggtgggtgggagtctgtggtctttggggcagaattacctcctcagcaggcccctgtccttgggctctgtctccgcagcccctgcaggacgctggaaatcagtctttctctggtctgggtgaagatggacagagtctcagccctgggaacattagaactcccattctacacatgcaacttgagggaaagaaggaaaactaaaaatattcctgcatggatgttccaaatattttatgagatagaaaaaaactcccrtgaatactgaagtttgtaaatgcgtattgaaattacgtgcccctggaaccggttttctaaactgacacccctgtgtgtttgggttccctctggctggtgccctgagcccaccctcggtcgacccatgggtcccccgcttccctactcaccagatgtcctgtgtttgctgtgacgctgacgtcggaggaggaggaagaggaggaggaagagcagcaggacgaaggccaccgagaccccaatcaaaacctccaggtatcttcccagaccttgacatgaggacgtcaggagtgggaatgatgt

SEQ ID NO: 50889 - DNA, 601 bp, Human
tacaaaaattggccggatgttgtggcacatgcctgtaatctcagctactcaagagtttgaggtcgggagttccagaccagcccggccaacatgatgagacctcatctctactaaaaaaaaaaaaaaaaaaagaaaaatacaaaaattagctgggtatggtggcgcatgcctgtaatcccagtttctcaggaggctgaggcaggagaatcgcttgaacccaggagctggaggttgcagtgagccgagatcacaccactgccctccagcctgggtgacagagtaagactctgtctcaaaagaaaaaaaaaaaaaaaagtgccaggcacggtggctcacgcttgtaatcccagcactttcagaggccaaggcgagcggatcacctgaggtcaggagtttgagaccagcctaacgtggtgaaaccctgtctctactaaaaatacaaaattagccaggtgtagtggcgcatgcctgtaatcccagctactcgggaggctgaggcaggagaatcgcttgaacccaggaggcggaggttgcagtgagctgagattgcagcattgcactccagcctggacaacaagagcgaaaatccatctaaaaaaaa

SEQ ID NO: 50890 - DNA, 601 bp, Human
ctgaggactccagcctagacatggagggagagatgtgactcagccaaacagggacccaaagacagtggctgaagcaggtgctgctcctgggtcagaaagacctgagttctgggcggggcacagtggctcacgcctgtaatcccagcactttgggaggccggggcgggcagatcacttgaggtcaggagttcaagaccagcctggccaacatggtgaaaccccgtctctactaaagatacaaaaattggccggatgttgtggcacatgcctgtaatctcagctactcaagagtttgaggtcrggagttccagaccagcccggccaacatgatgagacctcatctctactaaaaaaaaaaaaaaaaaaagaaaaatacaaaaattagctgggtatggtggcgcatgcctgtaatcccagtttctcaggaggctgaggcaggagaatcgcttgaacccaggagctggaggttgcagtgagccgagatcacaccactgccctccagcctgggtgacagagtaagactctgtctcaaaagaaaaaaaaaaaaaaaagtgccaggcacggtggctcacgcttgtaatcccagcactttcagaggcca

SEQ ID NO: 50891 - DNA, 601 bp, Human
tcagtcccagtgctcagccctctccacccggccctccctcagtcccagtgctcagccctcttccacccggccctccctcagtcccagtgctcagccctctccacccggccctccctcagtcccagtgctcagccctctcctccaacaccgaatcccactcttcctccttgtttgcctcagcccccggccctcatctccggcttctccttgtggcttgtgagggttgggtggatgtggaagtgggagagacagaggggctgggagcatttgggagctgaggctcacaggcccagaggggacrgagaaggggttacctccgttcctgctgcagcctccgagttatcctctgcacctgatggagcctgttcaggacccgctcgttcacctatggggtgggaaacgcccatcagctggatcccacggctcccgttcatttgtttaacggatgtttaatggggcacgcactaaactctggagactggccaaagaccatcccgtggcctgaggtccttccaccttcccatccctccggctcccctctcaccatgccacagtcctgagtgccctccagtgggggccttccgcgtgctgttcctctacc

SEQ ID NO: 50892 - DNA, 601 bp, Human
gcctttggctcttcctccccactcgcccgctccccctggcggagccggcgcgcccggggtgccgctccctgcctggcgcgctccgcacctggaggtgccttgcccctctcctgcccacctcggaatttccctgtggctcctttgatccttcgagtctccagctcctctcccttccacctgtttcccccaagaaaggcaggatcctggtccctgctacgtttctggggccatggctggtctgggccccggcgtaggcgattcagaggggggaccccggcccctgttttgcagaaagggggcyctgaggcagaaggtggtccacgaagtcaagagccacaagttcaccgctcgcttcttcaagcagcccaccttctgcagccactgcaccgacttcatctggtgagggaagggggctgggggactgggggacgaggggactaggggtgcagactcctatcacgccgacccctgtggaaggaagaaggagggggctgtagtcccgactcccaggttctaggatggccagggaacgctgggagcttcgactcctgggtttcagtgaggaggaggctggttcctggagtgctgggtccgagggagg

SEQ ID NO: 50893 - DNA, 601 bp, Human
tgaagtcaggtgggttcagagtttcgcccagggtttgacacaagatcggagacagttttatgatgtacagatggagagagaggcagagagagagagatccacagaagtccatgaggcgttttaccaccctctcagctgaaaataacagaagtctacatagaagatgtgacttcatagaacatatattgagcaccactgtctaccagcacgtgtatgtgattgatgacccccctcgtccactcacctccgccaccaacaccagataagtctgatgcatccagtgctcattgggtacactcaycaagatttttttttttgttttttgcctgtaatcccagctactcgggaggctgaggcagaattgcttgaacctgagcggcagaggttgcagtgagccaagatcacgccactgcactccagcctgggtgacagagcaagactttgtcttggaaaaaaaaaaaaagatttttttttgtttttgttgttttgtttgattttggggtattttttagatggagtttcactctgtcacccaggctggagtgcactggtgcaatcttggttcactgcaacctctacctcccaggttcaagcgattctc

SEQ ID NO: 50894 - DNA, 601 bp, Human
agcctctgtctgtggatggtttgtgtgtcaggcagcctgctgagaaccttcacacacagcatcttatttagtgcggcaggaaccctttgagttagggtcagcggagatatttagaagcccagcacattgaaaaggatcctggaaactgccaacaccctcctctacccaaatatatattcaaactagaaaccccactaacatagatgaaaatccaagaatggcctaaatgttcaccctgtgataatccttttaatggattcttagaatcaagttatttaacaagcagatattgtcccggggrtagtgggtggcaggggagaaggagaagcttcactgatgacctgcattcttgcttaatggactctggaaatttagcattgcttcaaaatatagattatttatttccacttgacagaggaggatgctgaggctcaaaactgggaatgaacttgccccaaatcacacagctgagaagcggcctagctcttacttacattcagggctatgtagggacttcaataaaatccctaacaataaccacagtaatagtattgggagcatctaacgtggtaggcacagctatgttttgtacaccaattat

SEQ ID NO: 50895 - DNA, 601 bp, Human
tctgtctgtggatggtttgtgtgtcaggcagcctgctgagaaccttcacacacagcatcttatttagtgcggcaggaaccctttgagttagggtcagcggagatatttagaagcccagcacattgaaaaggatcctggaaactgccaacaccctcctctacccaaatatatattcaaactagaaaccccactaacatagatgaaaatccaagaatggcctaaatgttcaccctgtgataatccttttaatggattcttagaatcaagttatttaacaagcagatattgtcccgggggtagygggtggcaggggagaaggagaagcttcactgatgacctgcattcttgcttaatggactctggaaatttagcattgcttcaaaatatagattatttatttccacttgacagaggaggatgctgaggctcaaaactgggaatgaacttgccccaaatcacacagctgagaagcggcctagctcttacttacattcagggctatgtagggacttcaataaaatccctaacaataaccacagtaatagtattgggagcatctaacgtggtaggcacagctatgttttgtacaccaattatttta

SEQ ID NO: 50896 - DNA, 601 bp, Human
tcacacacagcatcttatttagtgcggcaggaaccctttgagttagggtcagcggagatatttagaagcccagcacattgaaaaggatcctggaaactgccaacaccctcctctacccaaatatatattcaaactagaaaccccactaacatagatgaaaatccaagaatggcctaaatgttcaccctgtgataatccttttaatggattcttagaatcaagttatttaacaagcagatattgtcccgggggtagtgggtggcaggggagaaggagaagcttcactgatgacctgcattcwtgcttaatggactctggaaatttagcattgcttcaaaatatagattatttatttccacttgacagaggaggatgctgaggctcaaaactgggaatgaacttgccccaaatcacacagctgagaagcggcctagctcttacttacattcagggctatgtagggacttcaataaaatccctaacaataaccacagtaatagtattgggagcatctaacgtggtaggcacagctatgttttgtacaccaattattttatttaggcctcctgggttcctattataactgagaggtcatgttctc

SEQ ID NO: 50897 - DNA, 601 bp, Human
actgcaacctcggcctcctggattcaagcaattctcatgcctcagcctcctgagtagctgggattacaggcatgcaccaccatgtccggctaatttttgtatttttagtagagacagagttttgccatgttgcctagcctggtccggaactcctgagctcaaggcaatccgcccacctcggcctcccaaagtgctgggattacaggcatgagccaccgcacccagccaggaccaccgtatttaaaatttcaatcccccaacttctggtggtccccatccctgcctcattttttctccagarcacccattaccaaccatcaaactatatgttttatttatttaccatgtttacattctgtatccctccattaggaagtaaactccatgtgacaaagaggtttttttttttcatttgtttaatgctgggtccccacaccaagaacagtccctggcacacagcaggtgctcaatgattattggtacatagagtgaaagagatggagcctcaggctgacctagagagcaaggcaggaggaaaagataaaagggcccctcccctggggttttaggaccctcccaacgccccctaagccagtcttct

SEQ ID NO: 50898 - DNA, 601 bp, Human
gtatttttagtagagacagagttttgccatgttgcctagcctggtccggaactcctgagctcaaggcaatccgcccacctcggcctcccaaagtgctgggattacaggcatgagccaccgcacccagccaggaccaccgtatttaaaatttcaatcccccaacttctggtggtccccatccctgcctcattttttctccagagcacccattaccaaccatcaaactatatgttttatttatttaccatgtttacattctgtatccctccattaggaagtaaactccatgtgacaaagaggtttttttttttcatttgtttaatgctgggtccccacaccaagaacagtccctggcacacagcaggtgctcaatgattattggtacatagagtgaaagagatggagcctcaggctgacctagagagcaaggcaggaggaaaagataaaagggcccctcccctggggttttaggaccctcccaacgccccctaagccagtcttctctgcccccaggacccccggaacaaacacaagttccgcctgcatagctacagcagccccaccttctgcgaccactgtggctccctcctctacgggcttg

SEQ ID NO: 50899 - DNA, 601 bp, Human
tccgcccacctcggcctcccaaagtgctgggattacaggcatgagccaccgcacccagccaggaccaccgtatttaaaatttcaatcccccaacttctggtggtccccatccctgcctcattttttctccagagcacccattaccaaccatcaaactatatgttttatttatttaccatgtttacattctgtatccctccattaggaagtaaactccatgtgacaaagaggtttttttttttcatttgtttaatgctgggtccccacaccaagaacagtccctggcacacagcaggtgctsaatgattattggtacatagagtgaaagagatggagcctcaggctgacctagagagcaaggcaggaggaaaagataaaagggcccctcccctggggttttaggaccctcccaacgccccctaagccagtcttctctgcccccaggacccccggaacaaacacaagttccgcctgcatagctacagcagccccaccttctgcgaccactgtggctccctcctctacgggcttgtgcaccagggcatgaaatgctcctgtgagtgacctgggccttgccagggcccttccaaagcgcccggtc

SEQ ID NO: 50900 - DNA, 601 bp, Human
atttcaatcccccaacttctggtggtccccatccctgcctcattttttctccagagcacccattaccaaccatcaaactatatgttttatttatttaccatgtttacattctgtatccctccattaggaagtaaactccatgtgacaaagaggtttttttttttcatttgtttaatgctgggtccccacaccaagaacagtccctggcacacagcaggtgctcaatgattattggtacatagagtgaaagagatggagcctcaggctgacctagagagcaaggcaggaggaaaagataaamgggcccctcccctggggttttaggaccctcccaacgccccctaagccagtcttctctgcccccaggacccccggaacaaacacaagttccgcctgcatagctacagcagccccaccttctgcgaccactgtggctccctcctctacgggcttgtgcaccagggcatgaaatgctcctgtgagtgacctgggccttgccagggcccttccaaagcgcccggtctgggttccgggaaatgcccgggatggggtggggggtggagtcttggcttgggggcggggcctgaggtgctacccgcag

SEQ ID NO: 50901 - DNA, 601 bp, Human
ccttttggctcgaagccccgcctccaacctggcttcttgcaactttctgcacctgttaatgactttgactttctttttttttttgggacggagtttcgctcttgttgctcaagctggagtgcaatggcgcgatctcggctcactgcaacttccgcctcccgggttcaagtgattctcctgcctcagcctcccgagtagctgggattacaggcgcgtgtcaccaagcccggctaattttttgtatttttagtacaaacggggtttcaccatgttagccaggctggtctcgaactcctgaccycaggtgatcccctcgactcggcctcccaaagtgctgggattaacaggcgtgagccaccgcgcctggccaatggctttcttttttgtttttattttatgtttatttttttgagatggagtcttgctctgtcacccaggctggagtgcagtggtgcaatcttggctcactgcaatctctgcctccggggttcaagggattctcctgcctcagcctcccgagtagctggaattacaggcgcctgccaccacatccggctaatttttttttttttttttttttgagacaagatctcgctctgtt

SEQ ID NO: 50902 - DNA, 601 bp, Human
agtttcgctcttgttgctcaagctggagtgcaatggcgcgatctcggctcactgcaacttccgcctcccgggttcaagtgattctcctgcctcagcctcccgagtagctgggattacaggcgcgtgtcaccaagcccggctaattttttgtatttttagtacaaacggggtttcaccatgttagccaggctggtctcgaactcctgaccccaggtgatcccctcgactcggcctcccaaagtgctgggattaacaggcgtgagccaccgcgcctggccaatggctttcttttttgtttttrttttatgtttatttttttgagatggagtcttgctctgtcacccaggctggagtgcagtggtgcaatcttggctcactgcaatctctgcctccggggttcaagggattctcctgcctcagcctcccgagtagctggaattacaggcgcctgccaccacatccggctaatttttttttttttttttttttgagacaagatctcgctctgttgcccaggctggagtgcagtagcatgatctcagctcactgcaacctccgcctctcaggttcaagcgattctcctgcttcagcctcctgagta

SEQ ID NO: 50903 - DNA, 601 bp, Human
aatttttttttttttttttttttgagacaagatctcgctctgttgcccaggctggagtgcagtagcatgatctcagctcactgcaacctccgcctctcaggttcaagcgattctcctgcttcagcctcctgagtagctgggactacaggtgcatgacactgcacccagctcatttttgtatttttagtagagacagggtttcaccatgctagccaggctggtctggaactcctgacctcaggtgatccgcccgcctccgcctcccaaagtgctgggattacaggggtgaggaccgtgcccrgcaatggctttctgggtataaggatcttgagaagggagagtacctggttctgagggaggctgtggttcagtactggtgacatggccagggtccaaactctggttcctaatggagagaagggctctggatctgatttcagggtcactggttgcggaaagggctctatgccctgtcttctgggttctggagaggtaagaagtcatgagaaacgagactgagagcttggaattcttttttttttttttttgagacggagtctcgctgtgacgcccaggctggagtgcagtggcgtaatctcgg

SEQ ID NO: 50904 - DNA, 601 bp, Human
gtgacgcccaggctggagtgcagtggtgcgatctcggctcactgcaagctccgcctcctgggttcacgccattctcctgcatcagcctcctgagtagctgggactacaggcgcccaccaccatgcccggctaattttttgtatttttagtagagatggggtttcaccgtgttagccaggatggtctcgatctcctgacctggtgatccacccgcctcagcctcccaaagtgctgggattacaggcgtgagccaccacacccagccgattcttgagttttaaaaaatctatcaagcatgatsatcttaatctctccattcattcattcactcactgaatatccttctttttctttctttctttctttctttttttttttgagacagaatctccttttgtcacccaggttggagtgcagtgatgcagtctcagctcactgcaacctctgcctcccagattcaagtgattctcctgcctcagcctcctgagtagttgggattacaggagcgcaccaccacacctggctaatttttgtatttttagtagagatggggtttcgacatgttggccaggctggtctcgaactcctgacctcaagtgat

SEQ ID NO: 50905 - DNA, 601 bp, Human
tcaagatcttgaaaaaggacgtgatcgtccaggacgacgatgtggactgcacgctggtggagaaacgtgtgctggcgctggggggccggggtcctggcggccggccccacttcctcacccagctccactccaccttccagaccccggtaaggatggagggggcggaggctgtcctccgggccctgccttatccagttctggacatctgcgttgggattctgagtttagggcgaggcaagagaactttgtgctctctgagtgggcgaggccaggcggattgtctcctcagggggcgtggccggggggggggtccttggggggcgtggccaggcgaagggactcatcggggggcgtggccaggcggaggggctcaacggaggcgaggccgggtggaggggctcctcgggggcgtggccaggtggagggactcatcgggggcgtggccaggcagaggggctcttcgcggggcgtggtcaggcggatgaaatctttgggggggtggtttagaggggcgggctttgtcaggcgatgggatcattaataggcgtggccaggcagattggctccttgggggcgaggccaggcagacgagattatgaat

SEQ ID NO: 50906 - DNA, 601 bp, Human
cctggattaaaatatatgtatgagcaactttgattcctttttttttttttgagaaggagttagctcttgtcccccaggctggagtgcaatggcgcgatctcggctcactgcaacctccgcctcccgggtttaagcaattctcccgtctcagcctcctgagtagctgggattacaggctcccgccaccacactcagctgatttttgtatttttagtagagaccgggtttcgccacgttggccaggctggtctggaactcctgacctcaggtgatccacccgcttcggcctcccaaagtgctrggattacaggcgtgagccaccacgcccagctgcaactttgattcttagtaggaagccagaattgcatctgtgtgtgagtggctgtggaaagagattttggtgttcccggatttcgagcgaatggtgggcttcagtcttcaattctgagaaggcggggccagaacacgtggtctgatagttggcggtggtctggcgggtggagattctgaggtagcaggattagcaccttagggccctcccagggatgtggctaggtgctctgaatttctggttgggtgcatctggaaccttccacgtctg

SEQ ID NO: 50907 - DNA, 601 bp, Human
gcctgccaggtgggcccagctgggtctctaaataggtaaggtgggcagcacctgtgggtgaatgttccaggagagtgggaccagctcgtaggaattccaagtaggacctgaccctggatccttctgagaaggggcagacgatttctagtgtactctgagtgggtgtggcctgtcccctgccaacactgaacatgtccggactatcttctgaatactttaaactgggcagggctctccctggagtattcagttggatggaagcttatttcctgtgttgtacgtgtttctctgatgtaagtgkactggacttctgtgctgcatttttcaagagggcaggatcagctgggcgcggtggctcacacctgtaatcccagcactttgggaggctgaggcaggtggatcacttgaggtcaggagtttgagaccagcctggccaacatggtgaaacctcatctctaacaaaattacacaaattagccgggcgtggtggcatgcgcctgtaatcccagctattcgggaggctgaggcaggagaatcgcttgaaccggggaggcggaggttgcagtgagctgagatcacaccactgcactccagcctgggt

SEQ ID NO: 50908 - DNA, 601 bp, Human
tgggcgtggtggctcactcctataatcccagcactttgggaggcggaggcaggccaattgcttgagtccgggagtttgagaccagcctgggcaacatagtgaggacctatcttcactaaaagtgcaaaaattagccaggtgtggtggtgcacacctgtagcccacctacttgggaggctgaggtagaagaattacctgagcctgggaagttgaggctgagtgagccgtgatcacactactgtgctccagcctgggcaacagagtgagaccctgtcaaaaaaaaaaaaaaaaaaaaaaaaamcgaaacaaaaaatcacctgatgaaataaatattcagagtgggaagagcttgtgctgaaagcacttaacgtgggtagcgctcccagggggtgaggccagaggggtcctaggcttcctaaagaacgcatcatgattccctgccttccacctcccctagatcattgcctaccagccctatgggaagtctgtcgattggtggtcctttggagttctgctgtatgagatgttggcaggacaggtaagggaaggtggggagaagctggcttggctaaaagagacagagaggggcacctggatctca

SEQ ID NO: 50909 - DNA, 601 bp, Human
gctggattgactgggagcggctggaacgattggagatcccgcctcctttcagaccccgcccggtcagtcaccctccaggcaacaaaaacctggtccctgaaggggtggggttcccctgggcctcaatatacctgtatgtgggggtggggttccctctgcagagccccccgcccccaacaaaaggaggtgcagacaccatgaagcatgaatagagattctgcaggagacaggagatgagactggggtacacagagggacacccgaggagccctcggagctgcttaactttccctcccccacrtctcccacagtgtggccgcagcggcgagaactttgacaagttcttcacgcgggcggcgccagcgctgacccctccagaccgcctagtcctggccagcatcgaccaggccgatttccagggcttcacctacgtgaaccccgacttcgtgcacccggatgcccgcagccccaccagcccagtgcctgtgcccgtcatgtaatctcacccgccgccactaggtgtccccaacgtcccctccgccgtgccggcggcagccccacttcacccccaacttcaccaccccctgtcccattctagatc

SEQ ID NO: 50910 - DNA, 601 bp, Human
cgacgcagcctccgtagcggcgcgcactctccagaggccagcaggactgcgctctctaccgcagaacctgctccagctaggtgttctctccccatctcgccgtcgctctgccccctcactctctctggacctcagagccggttctctccttcctcctcccgcgctttccgtccggggatcgcaacctccagcccgtgggcaacgcgttcagcccaagaccccacagtttttcccaacgacccccctaccaagggcttctcttgtttctgctctcctgccccgcacttcccaaaggtgagamtctcccagggactgctggacagagaaggcctgggcaggggcagtagccgatatttaaaggtctttcagcgccagcatccccacctccagcaccactattggaaaataattaggccaccttttgcctcggtcacagcctgtgaccagcttcttccccccaaggaggctcctagaccccctctgcctgtctcccctcaccaggtagccttgctcaccataggtccctgcagtagcgggctcgccagcagcagctcctggggacctctgaacggttgcagtgaacctgggcgagggccgggga

SEQ ID NO: 50911 - DNA, 601 bp, Human
cccgtcggttccgggcctggagggccaggaagagccgcgcgtccgcctttcgtcccgccaggaactccccataggacacgacaccgcaggaacaagcgtcctgggagcccctgggatcttggctgtcgtctctagggaccctacaccgtgaaatgatagaggcgaggttccttgggttccgcaagtcgacgaaaatagctcgtggagaaggcgcgtcctgcaactgcagttcgcaagctctcagggcgccccgccagctgggggccagattgggtgacactcccctcgacgcagcctccgkagcggcgcgcactctccagaggccagcaggactgcgctctctaccgcagaacctgctccagctaggtgttctctccccatctcgccgtcgctctgccccctcactctctctggacctcagagccggttctctccttcctcctcccgcgctttccgtccggggatcgcaacctccagcccgtgggcaacgcgttcagcccaagaccccacagtttttcccaacgacccccctaccaagggcttctcttgtttctgctctcctgccccgcacttcccaaaggtgagaatctcccagggactg

SEQ ID NO: 50912 - DNA, 601 bp, Human
cacgcacatacttggttttcttcttaggggcattggcaggtagactttgaggaagaaaagtaaaggatcgaacagctcagccctccctcccgaccgtggatgcccggagtcgaccaacacctcaggtccgggtgcggaggccgcgggcgcccctgcgcgaccgtccgcgcccggcaagagccgcgcggctttcgcctttgctggtcccgcgccaccgctggggcgggctgcgaaagggttgggaagagcaaagggtttttttgttttgttttgagacgcagaagccctttaaaaagcccgscgaggagaggtccagaagtagagaaagcagacggaggcaagctgtgcccgcggggcaaagggacagtagaaggggcgggcgcccgggttccccggaaaaccctcggccccaaggaatctcctggggcgggagagcgcggttctaaaaccgagaggataggaaggggaagggggagttgtgtttcaatttcggattcaccaggattcatctctagtcacatttttcttctcaaatttttaaatcgaaaagataaaagccaaaagaactttcatccccagagctttttattgggggaaagga

SEQ ID NO: 50913 - DNA, 601 bp, Human
gaacgcctgctaaggctccgaagagccgggccaccgatctagctcccggctgaaagcagccgaccttgtcacgcgcggggccgggaatgggagggagggtgttagagggtgatcgctgtgggaaagtgagagggagcggctgttagtcattgctccgggtccattaccgagaatccccaaacctagtccgccgctgcgtggcccctctccccatgcaaagcagacccccgaagaagccatgccaggctgagggacagacgccggggctcgaagctccgggcagattcagaaagaggcgtckctgcagaaaggacgcatcacagttttcagatcttaatgtggccgaggttttacaactcccgacccggcgcagaaaggaaatcccaccatgttccccggagtcgagaaaacggtgaacagctttcggcctgcgctcgacctctgcgtctgcgtctctctcgcctcggcttcccttattttttaaaccaccaccacactccttcccccgccacttccttcccccacccccttcctccgttgcaccagcagcagagtcgcacgcagcaaatactccttcaagaattttacctacctacagttc

SEQ ID NO: 50914 - DNA, 601 bp, Human
cggagacactgggggctctcccagacaagttggataggggaagggagtggttagccctcaaggtacaaccccgggctttcatctctttagctccctcgcgctcccctttcttgcaacgctgagagggcgagtgcgcgctagcagcactttaaaaggaacccgtacgcttccagcgccccggctgccgggccaagaagggagcgacagtgctgccagggagcagagtgtggatattgtaaaggaggtccgacggaagggacagccggcgagcaggggtggtgagggcagagtgaattccggrgagggggaaggaagaggtgtctactcactgacagaaaacaaggcatataataacagtccatgattcttgacagccaatcttgaacaaacttgctggaaaggctcagggaagctgcagcagtgcgttgctcgggatggcactacggaatggctcctaaaaggaatatttgaatataatgagactccaccgcagacaggctctgtttttcttccagcccctcggagtcacgtgagcgccgaggcccctcccgcggcaggcggcgaaagggcctgcgcgccctcccctcctccacagcccccc

SEQ ID NO: 50915 - DNA, 601 bp, Human
aggggaaaataaattccaacacagtaatgatgctggtggattaataactcagatttactttggaaaagaaacatccgctaggaaacattcagatcggattacaaggcccctattgaataaacccgacaaacacacagctgtaatattaaattcagtaggtgctttgaaaaaaacgggcagaaaacctagcagaaaaggctttgatatagcaaaaacacaccgctggggctagcccacgtctgagtgctgtcattccccttcccctgaacacctccccctctgtctccaaaaaataagttcrgcggcagctctgcaaattcttggaggtaagcagctctgttcctcagcctcctggactggggctttgatgtaacccgaactcttcttccccagggctttcactgcccctctagccagtcccaccagccctcccccacgcagactgggggaagagactgaccttcgtggtggaagctcctcacggtgttggcccggctggccgggcgctcaggatactcaagaccagtgctgtggatctgctcttcctcctcctccccagactgaagccggtaaagatcccgcatgtagtccggaatgacgg

SEQ ID NO: 50916 - DNA, 601 bp, Human
tcagtaccaccttatcatactcatccaggtacagcatggagatggcactcagttcagtgggcacacaacaggctttggggatactggaattgacagaattgaccagggtctgcacaatggcatggttggttgagttgaggtggtcagccagtggaaaggggcagtccccatggcagtagaaggcctggtagcctggtggggccacaatccagtcattccagcccacatcgctgaagtccacatagagcgagtggcgccggcagttcttattcttcttcctggcccgctgtgagtgatgcttagggctacgcttggccctccggcgtcgggtcaaggcatggccccggccatcatggccaaaggtgaccaggaggggccggagctgggcccaattcccactcccttgaggtaacgatcggctaatcctgacatgctggccctggtgggtccgagtctgatggaggtgagtcacctcaatggctagcccatagtttggctgcttctcccgggtccagcgaaggaccgcagggctcacatcaaaagtttcccaccgtgtcacattgtggtggaccagtctcgtgtccagtagtcgtgtgatgag

SEQ ID NO: 50917 - DNA, 601 bp, Human
caacttaaccacctccaggtaccaccttttgacttccatccagcctccaactcacctgaacagaaaaaagcctcattcaaaagagatgagcccgaaggaaaagagaaaggattaaggagaaaaaaaaatcatgatttacctttaaaataatgactcattttatttttttcttttaatacgtagttataaatatattttgtcaaaatatatgatcaatatggtcaaaacatttgcacgtaaagtcataaataaggtcaaggtgaatgtttagggattttttccattttttttttttttttttaaataaaagtccagctataaggaagcagtctgtgtagtgtgtgggtgagtggatgggaacgtgtgtgtgtggtgtatgtggtgtgtgtgtgtggtgtgtatatctgtctatcctcaaggactgcctgatctcagcggcacccacatccctctactaccatctcctgataatttttcagtaccaccttatcatactcatccaggtacagcatggagatggcactcagttcagtgggcacacaacaggctttggggatactggaattgacagaattgaccagggtctgcacaatggcatggt

SEQ ID NO: 50918 - DNA, 601 bp, Human
gtttacttcctgtccctacaacttaaccacctccaggtaccaccttttgacttccatccagcctccaactcacctgaacagaaaaaagcctcattcaaaagagatgagcccgaaggaaaagagaaaggattaaggagaaaaaaaaatcatgatttacctttaaaataatgactcattttatttttttcttttaatacgtagttataaatatattttgtcaaaatatatgatcaatatggtcaaaacatttgcacgtaaagtcataaataaggtcaaggtgaatgtttagggattttttccattttttttttttttttttaaataaaagtccagctataaggaagcagtctgtgtagtgtgtgggtgagtggatgggaacgtgtgtgtgtggtgtatgtggtgtgtgtgtgtggtgtgtatatctgtctatcctcaaggactgcctgatctcagcggcacccacatccctctactaccatctcctgataatttttcagtaccaccttatcatactcatccaggtacagcatggagatggcactcagttcagtgggcacacaacaggctttggggatactggaattgacagaattgaccaggg

SEQ ID NO: 50919 - DNA, 563 bp, Human
ttacagccataaaagaatgatcaattatgatacctatgagttgactagcttttacaataacctaaggaagtatcaaggtgcaggagacaggaccaaagtggttgtttcagagcctacaattggaaacaaactttggttgggggtggggagggcaggcggtgggttgggaagaataacagaaattctttcctgaatgagtgtttacatgataccattaagtcttttaaaattggctatgagcaagacactgttcaaataaccargcggatctgggagatgaattaatttagaaatataacacaaacaaaagtattaaaggaaaaaagtttaaatcatattatcttgtcatgcactggaattagcaacatgattatcatttggactaacagcattagcctcgctaaacctcagtcttctaaaagtgaagataaaagtatttcctagagttgtcagaattaaataaagactagaaagctgctaaagacagtgtttggcacgtagtgtaccccacagacattcgatctcatcctccctcctttgaagagaagccgcacatcatctgc

SEQ ID NO: 50920 - DNA, 601 bp, Human
ataaatcataagtgcaagaaatataatagctagaaatttaactcaccctctaaataattattttagttaccctatcaattgattataaatttcttatttaacatttaaacaggaagtcgataacaaattttaaaagaaactgtacagattttagacaaggtgtatttttatagtaaaagtcttttcaaggactcattcttttgaagactatttctaataaaaatagcatggtacgcctttttagactttctcattgaaccgtaacacaagattgtaaattttcctataaagacacaagtarcctagaacaccatattaatgaaatgtccactttctaacttgcttcaacttgagaatttggttctaattgtggcttgcttaccatcatgaggctgtataacataatgacttcctccaatatagtctgcagagattcctagttgagaagcatctgttgtagaactgtcaccatccatctatgaggagaaaaacagtttttcaatacttttcaaagtactaacaaacgtaacagattcaacacttataaactgtcacaggatgatgcatcaattatacttttcatagccttaagcttactaaa

SEQ ID NO: 50921 - DNA, 601 bp, Human
cctgacatagttcaaagttaatattgaatgaaaaccaaaaataaatcataagtgcaagaaatataatagctagaaatttaactcaccctctaaataattattttagttaccctatcaattgattataaatttcttatttaacatttaaacaggaagtcgataacaaattttaaaagaaactgtacagattttagacaaggtgtatttttatagtaaaagtcttttcaaggactcattcttttgaagactatttctaataaaaatagcatggtacgcctttttagactttctcattgaaccrtaacacaagattgtaaattttcctataaagacacaagtagcctagaacaccatattaatgaaatgtccactttctaacttgcttcaacttgagaatttggttctaattgtggcttgcttaccatcatgaggctgtataacataatgacttcctccaatatagtctgcagagattcctagttgagaagcatctgttgtagaactgtcaccatccatctatgaggagaaaaacagtttttcaatacttttcaaagtactaacaaacgtaacagattcaacacttataaactgtcacaggatg

SEQ ID NO: 50922 - DNA, 601 bp, Human
gaggttgcaatgagccgagatcacgccactgcactccagcctgggcaacaagagcgaaactccgtctcaaaaaaaaaaaaaaaagttacagcttcatacacccaaacctgatagttctgacaacgtacctattttttaaaacagtcgggccaggcacagtggctcatgtctataatcccagcactttggtaggccaaggcggatggatcacctgaggtcgagagttcaagaccagcctgaccaacatggagaaaccccatttctaccaaaaatacaaaattagctgggcatggtggtgcaygcctgtaatcccagctactcgggaggctgaggcaggagaattgcttgaacctgggaggcggaggttgcagtgagcggagattgtaccattgcactccagcctggccaataagagtgaaactctgtccccaaaaaaaaaaaaaaaaaaaaaaaacagtctaaattctattttatctgcctccaataagtgggagagaggagaacatttagggacatgacagaattgaaaatgggacactgttcagtaactgtgtatgtagacatgaaagaaatatttgatttgctgaaagcctgaatgatt

SEQ ID NO: 50923 - DNA, 601 bp, Human
aagaactgcataaatgcagtcaagcaagataatataatgtgagccacatatgtcagtttagattctctagtagccatataaaataaaataaaattaattttaatatatttaatttaacccaatatagccaaattcttaccatttaaacatagaatcaatttttaaatgagaaattttaattcttttcttcatactaagtcttcaaaatctggtgtttcaaatttacaacacatctccattcagaccagccacatttcaggtgctcctgagcacatggcttgtggctatggtactgaccagyggcatagctggtcatacatagcctatgtaagcaataatcagcatttgtgcttttttttccttaaaacataaggacaaaattctcaaactgtaagttctaagcttagtgatgtattttaatagcatatttatttgtaagctttattacttccataagtctttttaaactataaaatgacagaaaaattaccaatagaaaatgatataaaacgtgtgaattttaattcagaccaagtgatgagcaatgacaatgagttttaaaagttctaagaagacaaaactacttaagaaaaaaaaatat

SEQ ID NO: 50924 - DNA, 601 bp, Human
tgtagaagcgagtctgctcaacagcttgttatttggtggattgtggcagtaaatcggggcgagtggggaacccggcgcaggaactgcagccgcggctgggagtggtgctgcccggacgggggcccacggaggtcagaggggaggaggactctggagctgacagcgcgcacttcacccgcagttggtaggtggggagaggggaatccggggatactgaatggacgaagtggcagtagcagcagctgctgctgcccgaggtcccggtgcagttggaagctttggaggtggggagagggatgcyaggcaagtggcacggcgagcgcaagggaaggggccagccattgaccagcggcagcaactgcaggaaccgccgccgcagttgcagccgcctcctcgtccgcttcctcgggttcccgggaaaatggctgtggggctggccgcgccgctaagtttgcttccgcgcggtgaagagcgggctgcttgggggagccgtcccccaactccgcggcgcgtccacctctgcggagtccgtggcaggactcgaggggctacgagctgatacctctctgggctgtacaaaaagttgaggcgggcgctggga

SEQ ID NO: 50925 - DNA, 601 bp, Human
tttgtattttttgtaaatgcacttactttaaaaggtacccaattcctgtcttatttactgtttcagcatattaagctctgaaatatagcattttcccaaactttctcgtggttttctattttctcgaagtaaatgacatatttaaccttctttaatattacttgggaaaacttattagaaaacaaaaaatcattttctacttcaaaacgtatctccaaagtgtacactgttaactttgcacttaacaatgttaagttgaacttgtatggatacactttaacttccggaaaaaaaaaaaaaaggtaaaatgacagattgagatagcaatcatcctgttactgtaaaaattaaaatgagtggtagagtgacatttcttacatctttctatgtatcattctggtcgtgtccatttgctgaaagtagatgtttcttagtaacgcttatttttttatactaagaagattagtgtggtaaactaggtatacctacaagtctggagccatcagttcatatctgcattcatcggctgaattcagacttaaaacctttcaagtgcagcttttagcaaatgaattttccaaatgatactttccttatgaaa

SEQ ID NO: 50926 - DNA, 601 bp, Human
acctacaagtctggagccatcagttcatatctgcattcatcggctgaattcagacttaaaacctttcaagtgcagcttttagcaaatgaattttccaaatgatactttccttatgaaaagatgttacctttatgtggctatgtcaataaacaattatgtattgttagtgttaatattagtagcaatatttcttttaatttgaaaaatttcaggaagctataaatgaataacttagttttatgatatgtgtaatatgaaatattttttctgtttttttcttatctttctgcttatataatagaatttttgaaaaattttgtatcgagacaaaacattattaatcactgataattttgaattacaactttaaaacattttatcatatcaggacatcagtctataaaatgaaaggttgctaatcaagtatttagggtatttttcaaattttcaatgatattaataagcaagtcattttaatattcttaatgcttcaaacacaaccttttaatgagacttgaggttggagtagggaggcatagtaatgacattcacagttttatgttcctttcaccaggcggcagatgagcctgcctacctgaca

SEQ ID NO: 50927 - DNA, 601 bp, Human
atatgaaaaccctttatataccaaacttaaaggaaaagcacatcaaaaataaagaaataaaaaactcaaaaggagaaattattccaaaatgctaccatcaaaataccatgctcatgatatttcctgtcatttggctcttaactatttgtggtagcatacttggactgtaatctattttctcccctcatttaatgttcaggtagagacaattttagtgtttaggacaatacaaatacaacaggaattatgttttcaagacagtgtaaaaaagcatttaaaaagtttattttgtgactgggcrtagtgtctcatgcctgtaatccaagcactttgggaggccgaagtgggcagatcacttgaggccaggagttcaagagcagcctggccaacgtggcgaaaccctgtctctactaaaattgcaaaaattagacccggcgcggtgactcacgcctgtaatcccagcactttgggaggctgaggtgggtggatcacctgaggtcaggagttcgagaccagcctgaccaacatggtgaaatcctgtctctactaaaaatacaaaaattagctgggtgtggtggcaggcacctgtaatcccagctgc

SEQ ID NO: 50928 - DNA, 601 bp, Human
aacttaaaggaaaagcacatcaaaaataaagaaataaaaaactcaaaaggagaaattattccaaaatgctaccatcaaaataccatgctcatgatatttcctgtcatttggctcttaactatttgtggtagcatacttggactgtaatctattttctcccctcatttaatgttcaggtagagacaattttagtgtttaggacaatacaaatacaacaggaattatgttttcaagacagtgtaaaaaagcatttaaaaagtttattttgtgactgggcgtagtgtctcatgcctgtaatccmagcactttgggaggccgaagtgggcagatcacttgaggccaggagttcaagagcagcctggccaacgtggcgaaaccctgtctctactaaaattgcaaaaattagacccggcgcggtgactcacgcctgtaatcccagcactttgggaggctgaggtgggtggatcacctgaggtcaggagttcgagaccagcctgaccaacatggtgaaatcctgtctctactaaaaatacaaaaattagctgggtgtggtggcaggcacctgtaatcccagctgctcaggaggctgaggcaggagaat

SEQ ID NO: 50929 - DNA, 601 bp, Human
cttaactatttgtggtagcatacttggactgtaatctattttctcccctcatttaatgttcaggtagagacaattttagtgtttaggacaatacaaatacaacaggaattatgttttcaagacagtgtaaaaaagcatttaaaaagtttattttgtgactgggcgtagtgtctcatgcctgtaatccaagcactttgggaggccgaagtgggcagatcacttgaggccaggagttcaagagcagcctggccaacgtggcgaaaccctgtctctactaaaattgcaaaaattagacccggcrcggtgactcacgcctgtaatcccagcactttgggaggctgaggtgggtggatcacctgaggtcaggagttcgagaccagcctgaccaacatggtgaaatcctgtctctactaaaaatacaaaaattagctgggtgtggtggcaggcacctgtaatcccagctgctcaggaggctgaggcaggagaattgcttgaacccgggaggcggaggttgcagtgagccaagatcatgccgttgcactccagcctgggtaacagagctagactccatctccaaaaaataaaaaaattaacctggcat

SEQ ID NO: 50930 - DNA, 601 bp, Human
aactatttgtggtagcatacttggactgtaatctattttctcccctcatttaatgttcaggtagagacaattttagtgtttaggacaatacaaatacaacaggaattatgttttcaagacagtgtaaaaaagcatttaaaaagtttattttgtgactgggcgtagtgtctcatgcctgtaatccaagcactttgggaggccgaagtgggcagatcacttgaggccaggagttcaagagcagcctggccaacgtggcgaaaccctgtctctactaaaattgcaaaaattagacccggcgcgrtgactcacgcctgtaatcccagcactttgggaggctgaggtgggtggatcacctgaggtcaggagttcgagaccagcctgaccaacatggtgaaatcctgtctctactaaaaatacaaaaattagctgggtgtggtggcaggcacctgtaatcccagctgctcaggaggctgaggcaggagaattgcttgaacccgggaggcggaggttgcagtgagccaagatcatgccgttgcactccagcctgggtaacagagctagactccatctccaaaaaataaaaaaattaacctggcatggt

SEQ ID NO: 50931 - DNA, 601 bp, Human
gtggtcccagctactctggaggcagaggtgggagaattgcttgagcctgggaggtcaaggctgcagtgagctgtgattgtgccactgcactccaggccggatgacagggcaagaccctgtctcaaaaaaaaaatttttttttaagatgcttttactctgaaataacttttttttttggtggttcctgccagtaattttcttatatgaatatatttttaatagtcttcgttactttatacttagatacctcctatgcttattataaacatttttaacattatagaggtatatcatatagttmatgaagtcctccttaaaaaattttatttaagttgatgaataataattttacatattcatgggctacatagtcatgttttgatacatataatgtatggtgattaaatcaagataatttgcatatctatcatctcaaacatttttcatttctttgtgttgggaatattcagtatcctcctcttagccatttgaaacaatgtgatatagcattgttaactacagtcatcctgctgcggtatagaacactgtgaaagtcctccttgatacgactccaaagagatttgatgtggtcttccagatt

SEQ ID NO: 50932 - DNA, 601 bp, Human
ttttttttggtggttcctgccagtaattttcttatatgaatatatttttaatagtcttcgttactttatacttagatacctcctatgcttattataaacatttttaacattatagaggtatatcatatagttaatgaagtcctccttaaaaaattttatttaagttgatgaataataattttacatattcatgggctacatagtcatgttttgatacatataatgtatggtgattaaatcaagataatttgcatatctatcatctcaaacatttttcatttctttgtgttgggaatattcrgtatcctcctcttagccatttgaaacaatgtgatatagcattgttaactacagtcatcctgctgcggtatagaacactgtgaaagtcctccttgatacgactccaaagagatttgatgtggtcttccagattttttttactgtgccagtcataaaattattgtcattggtattggatcatgctgtattgcagtttgctttattcacttatatatctgatgttttcctaccagaattaagcaccataaaaggaggaaacgtctgacttgttctatgcccaacacatagagtagtgcctgat

SEQ ID NO: 50933 - DNA, 601 bp, Human
tatatgaatatatttttaatagtcttcgttactttatacttagatacctcctatgcttattataaacatttttaacattatagaggtatatcatatagttaatgaagtcctccttaaaaaattttatttaagttgatgaataataattttacatattcatgggctacatagtcatgttttgatacatataatgtatggtgattaaatcaagataatttgcatatctatcatctcaaacatttttcatttctttgtgttgggaatattcagtatcctcctcttagccatttgaaacaatgtratatagcattgttaactacagtcatcctgctgcggtatagaacactgtgaaagtcctccttgatacgactccaaagagatttgatgtggtcttccagattttttttactgtgccagtcataaaattattgtcattggtattggatcatgctgtattgcagtttgctttattcacttatatatctgatgttttcctaccagaattaagcaccataaaaggaggaaacgtctgacttgttctatgcccaacacatagagtagtgcctgatacatagtggaccctcaaaatttgttgaatgaa

SEQ ID NO: 50934 - DNA, 601 bp, Human
ggtatagaacactgtgaaagtcctccttgatacgactccaaagagatttgatgtggtcttccagattttttttactgtgccagtcataaaattattgtcattggtattggatcatgctgtattgcagtttgctttattcacttatatatctgatgttttcctaccagaattaagcaccataaaaggaggaaacgtctgacttgttctatgcccaacacatagagtagtgcctgatacatagtggaccctcaaaatttgttgaatgaatcagtgaactagagcagtgattcctaaagggtcsctccagaccagcagcatcagccttacttgggaacttgttccaaatgcaaattttccccaccccagatctacttcatcagaaactctgggggtaagatccagtaattgtgttttaataagccctttaaatatttctgatgcatgttaaaagtttaagaatcaggttgggcacggtgggtcattaatcccagcactttgggaagccagagtgggcagataacttgaggctagaagtttgagacccacctggccaaaatgttgaaaccctgtctctagtaaaaatacaaaaaattagccagac

SEQ ID NO: 50935 - DNA, 601 bp, Human
cagcatcagccttacttgggaacttgttccaaatgcaaattttccccaccccagatctacttcatcagaaactctgggggtaagatccagtaattgtgttttaataagccctttaaatatttctgatgcatgttaaaagtttaagaatcaggttgggcacggtgggtcattaatcccagcactttgggaagccagagtgggcagataacttgaggctagaagtttgagacccacctggccaaaatgttgaaaccctgtctctagtaaaaatacaaaaaattagccagacatggtggtgcamacctgtaatcccagctacttgggaggctgaggcacgagaattgcttgagctggggaagcgaaggttgagaccctgcctaaaaaaaaaaaaaagtttgagaaacattgactagaggagtgtgatttgtaggttaaatagatgtatctatgattattataaaatttatgtttcagttttcttgatgaaccttcaagtattaggataggatgtcaattgacattcatttctttttgtttcatacagtgtttttatcatgtcagctatataggatttgattactctatatttatttgggattct

SEQ ID NO: 50936 - DNA, 601 bp, Human
agaaccttttgtgacttgataaaaagcaataaaggcagtttttttttacagtaatcattaaagattattatatagttcatttagtaaacagttattaagtgctgataatatgcattgacacttgctaactgttggggatatagcaatgaagggaagactcagccctcaaggagctcacagttaataagagaatgtaataagtattacattagcaggggtcaccacatggtgctaagaaagcataaattaaagacattattgttatagtgttactataaatgtatttgttttaaaagtaatrtgcaaattattgtgcaaaatgtttttcaggtactcctgaaacaggataataccacacaattggtacaagatgaccaagtaaagggtcctttaagagtatgtatgttgtacggtttaaaatctgaaataatcatagatttataccatatttactgaatttacatttctacatagacttaacattttatgagaacgttaatcagaaaacaatacatatgaagggtttaaatataattagtataaattgtgatattgcaatggctgtattctgttttagatactaaacatcttctagaagggt

SEQ ID NO: 50937 - DNA, 601 bp, Human
tcctttaagagtatgtatgttgtacggtttaaaatctgaaataatcatagatttataccatatttactgaatttacatttctacatagacttaacattttatgagaacgttaatcagaaaacaatacatatgaagggtttaaatataattagtataaattgtgatattgcaatggctgtattctgttttagatactaaacatcttctagaagggtaatttaatatatataaacatgttaagtttttcacctacctttctgttttgaattcttgaactggatacctggctttgtttttcacrttgttgctgtatctgaggtgatgtttagccttctaagttgagtatcataaccatcaatctttggttgttctaatttaccaagtaaactatgttcacttcctaattcaatttaatgaatacctagattatgttttccatgcatttctggccatttgtttatgtaataaatctgttatatcagagtaccactttggttaatatctgatatacaaaggtctggaaactgaaagaaggtcaactggtccatccctatctctccaggtgaacctttatctaaaaggtaccttaaatacaaatgct

SEQ ID NO: 50938 - DNA, 601 bp, Human
gaagaactatgctttggttaaaaatttctctgtcttaccctgtaccttctattagtagtaccaatttgctgtgtgtaagtacttttttcaaacctctttgatgcttcttggacttactagaatttagtgttggttcacagtggtgctattattctgaactacatatttttaggaagcttagttgtggctactgatagttgttaaattttaaaaactaagtggccagatgcagtggctctaacctgtaatcccagcactttaggggggcgaggtgggcggatcacctgaggtcaagagttcragaccagcctggccaacatggcgaaaccttgtctctactaaaaatacaaaaattagctgggtgtggtggtgggcgtctgtaatcccagctactcagtaggctgaggcaggagaatcgcttgaatctgggaggcggaggttgcagtaagcctagattgtgccattgcactccagcctgggcaacaagagcaaaactgcgtctcaaaacaaataaaaactaagcttaatgttaactcttagagattaagtaaatacatctttgctttatcaaactaagacctgataaaaattacaggtgtgt

SEQ ID NO: 50939 - DNA, 601 bp, Human
tgtttgtttgttcgttttagagacaggatcttgctctgttgcccaggcttttgttcagtagcactattgtagcttcctgcagccctgaattcctgggctcaagcagtcttaccgccttagcctcccaaagtgttgggattacaggcatgagccactgctctcagcttcccctttaatgttgaatagtaaacagcaccaactcaaggggatttttttgtttctgttttttgagcaatagaaatatttcctcttcctaccattcctaccatagtttactcattgatagttgttatccttgccrttaaagataaggaatctgtaatatgtggaagtgtgttatctgttcagtcattcaaaaggtgttaaaattgggattagaattcatacctctatccagcccaaatctctagttatgttttttaaaaaaggaattaatatgtccagttaaatgttaccactaactcctggtaaatacaactgtcagtaagacattttgaaggtactctctgttttgcctttttgtaatataaaaacatatacttgaaaagtaaggaaaagttaaaggatagaaatttcagtaattctagtaattaactttgaa

SEQ ID NO: 50940 - DNA, 601 bp, Human
ccctattactcaagtgcagatcagtgatgtaatcattggaggatgttgtgttttaacctgtcattgtgcctgcagctagtcattaatttctggatcattgactgtgtatagcacagctgcttttttagaatcatggttctttgagtatgtgcttcgggagtttttaattttttccacattgtctcctgcatgtaaaagaatctaagctaggtatctgtagtctaagagggagaactgattgaagtaaataaatatttaacatgttgaaagcttttatataattttctttcaaaaaacttaytcattaaaggtaagcgtaggatttgaaggcaaagtgtttgctaataaaacaaccttttcagaaaataattcaggattataatttcataggtaaccaattaaaaaattctaagatatcaaatgaatgtaatgtagaatttctttttgttaacactgacttattctgttagaatggaaaaaagtatctagaattgtgaaaattagtactaaatcttgataattgtttttgggtacatatgtatgctttcttgttaagtgaatatggatgttaagtgtctgaagtaaagattatatcttattt

SEQ ID NO: 50941 - DNA, 601 bp, Human
tcctgcctcagcctcctgagtagttgggattacagacacaccatcacgcctggctagtttttgtattcttaatagagatgaggtttcgctttgttggccaaatgggtttcgaactcctgacgtcaagtgatttgcccgccttggcctctcaaagtgctgactgggattatagatatgagccactgcacctggcctaatgtctatatactctttatctagatttaccagttcttaacatttttcacacatttgctttacgattccctctctatatatatactaatttttttcttttcttttytttttttttttttgagacggagtatcactctgtcgccaggctggagtgcagtggtgcaatctcagcttattgcagcctctgcctcccaggttcaaacgattctcctgcctcagcctcccgagtagtcagaactacaggcgcgtgccaccacgcccagctaatttttctatttttagtagagacagggtttcaccatgttggccaggatgatctcgatctcttgacctcatgatccacctgcctcagcctcccaaagtgttgggattacaggcgtgagccaccacacccggcctatactaa

SEQ ID NO: 50942 - DNA, 601 bp, Human
tttttagtagagacagggtttcaccatgttggccaggatgatctcgatctcttgacctcatgatccacctgcctcagcctcccaaagtgttgggattacaggcgtgagccaccacacccggcctatactaattatttttatattttgtaataattttatttttctgaactatttgagaggaagtggcaagcatcatgatcctttatcattaaatatttaggaacaaggagatgttcttacataaccaaagtatgaataccaaatttagaaaatttaacgctgatagactactatcataatrtatggttaatatttcaaactttgtcagttgttccaataatagcctttatagcgtcccccagttcccctgattacaggatccaattcaggatcatgcattgcatatagtttatatggttcttgagtctcctttaatctaaaaaaattctgtagccttttttcttccatgacattgactttttttttttttttttttttcccctgagacggagtctcgctctgtcacccaggctggagtgcagtggctggatctcggctcactgcaagctccacctcctgggttcttgccattctcctgcct

SEQ ID NO: 50943 - DNA, 601 bp, Human
tgtacattaaatcttcacaaaaacctgcaagatattattattctcaatttatagctgaggaaaatgggaacagtaatgtcttgctggtttttgtattagataatgtatagaattttcttttttgttgttgttgttgttttttttggttttttgtttgtttgtttttttgagatggagtctcactctgtcacccagactgtagtgtagtggtgcgatcttggctcactgcaacctctgcctcccaggttcaagtgattctcgtgcctcagcctctcgagtagccaggactacaggtgtgtgrtaccacacctggctaatttttgtgttttagtagagatggggttttgtcatacttgccaggctggtctccaactcctgacctcaagggatccacccgcctcggcctcccaaagtgctcagattacaggtgtgaaccactgcacccagccgataatgtatataaatttattagtgtgtaataagtactcaggacatgatatatatttaataattcaatacccagtattttatttctaagctaactccatagacttctactgaaaactccttcatacttattttataattttaacaagttgag

SEQ ID NO: 50944 - DNA, 601 bp, Human
tgttgttgttttttttggttttttgtttgtttgtttttttgagatggagtctcactctgtcacccagactgtagtgtagtggtgcgatcttggctcactgcaacctctgcctcccaggttcaagtgattctcgtgcctcagcctctcgagtagccaggactacaggtgtgtgataccacacctggctaatttttgtgttttagtagagatggggttttgtcatacttgccaggctggtctccaactcctgacctcaagggatccacccgcctcggcctcccaaagtgctcagattacaggygtgaaccactgcacccagccgataatgtatataaatttattagtgtgtaataagtactcaggacatgatatatatttaataattcaatacccagtattttatttctaagctaactccatagacttctactgaaaactccttcatacttattttataattttaacaagttgagttatctggtttctcagagtgcagcagattggaagatgtgtcaaaaggaaatacaggaaagatcagtagatgcagtcaataaagaaaactgtggagtctcacagctgagaagtctatgacaagaaaaaa

SEQ ID NO: 50945 - DNA, 601 bp, Human
actgcgcctggccctaaatattcttaacataagtatgcccctttgatttttggtatcacttatctctaataataattgtggcacaaaatgtatcccaaattagactataatcctgtaaagagctgaaagtatatttttaggtttctatgtgcatgtaaatatattactcagttcctagataatagatttaatttgtatggggaaattctgaaagtcccttgaacctttcagttgtatagaaaaataagtaatttggattcagaatattcagattgtaggtttgccaagagtttttttttttaataacaaattcttttatttactcagatttatcatttaccaggggatattgaaaataaaaaataagtaagacactattcttacatttgacgattttatgtataatgtacagaataattcaagtaacagtaatataaaatagtatatgttcaatattaggactccctggcctgagagattacatttatttgaggaaaatacagaaagccttcacaaagcaggtgcttttgaggtgagctttgaaggatttaaagatagtaggcaaagcttcactagaggaaacaaaaaaataggttaaaaa

SEQ ID NO: 50946 - DNA, 601 bp, Human
ataattactggcaccaagcaaacaaacaaatacttccatctggtgttaagacagctgatgtgactgccaagaatattcaattatctggatatacactattcagtatgataaccatgaaccatatgtggccatttaagtttaaatgtaacttaattaaaataaaatagaattaaaaattcagtctctcagttgcaccagccacatttcaagtgtttagcaccatgtgactcactgctactgtatagggcagtgcagatatagaacgtttccatcagtgcacaaaggtctgtgaatggtgctrgaatgtagcagagagaggctagtgttagggagagcatgaacagatatatttaatcagcttttaaaaaatataaagttctataaaggatacagagagtatttaccaattatattgttaagatactattttcagaagttaagaaattaaaaagttctttgttcatgttttaacttgttttaattactaaggattgtacatatcttggttaaaaaaggtaacatagattttttttttttaatgaccagatttcaaaaaagatccttattcaagtatatttttaaaaattatatgccaaatttt

SEQ ID NO: 50947 - DNA, 601 bp, Human
agcaattattttgacttttttcatgattacaatccagacttttgggccgggcgcagttgctgacgcctgtaatcccagcactttgggaggctgaggtgggcagatcatgagctcaggagatcgagaccattctggccaacatggtgaaaccctctctctactaaaatataaaaaattagccgggtgtggtggtgcatgcctgtagtcctagcttctcgggaggctgaggcaaaggaattgcttgaacccgggaggcagaggctgcagtgagccgagatcgcgccactgcactccagcctgrcgacagagtgagactctgtctcaaaaaaaaaaaaatccagacttacagaaactttttcctaacctcatctctgctttgtgatcaaaacagtgaaattaaaaaagttttttgagttatagttctctgtgaaaaatttaatgccataatatattttatagtgataaaaatatttcaatattactgtctagtaaatgtgcttttttactaaaatgaaaaataaatttcacaaataataaaatagacattgttgtctacaagtgttgaaaacatcatgctgatatgaattaccccgtactatct

SEQ ID NO: 50948 - DNA, 601 bp, Human
agacttttgggccgggcgcagttgctgacgcctgtaatcccagcactttgggaggctgaggtgggcagatcatgagctcaggagatcgagaccattctggccaacatggtgaaaccctctctctactaaaatataaaaaattagccgggtgtggtggtgcatgcctgtagtcctagcttctcgggaggctgaggcaaaggaattgcttgaacccgggaggcagaggctgcagtgagccgagatcgcgccactgcactccagcctgacgacagagtgagactctgtctcaaaaaaaaaaaaatccagacttacagaaactttttcctaacctcatctctgctttgtgatcaaaacagtgaaattaaaaaagttttttgagttatagttctctgtgaaaaatttaatgccataatatattttatagtgataaaaatatttcaatattactgtctagtaaatgtgcttttttactaaaatgaaaaataaatttcacaaataataaaatagacattgttgtctacaagtgttgaaaacatcatgctgatatgaattaccccgtactatctgtaggaggattgtatagattgaaatattgtgaatg

SEQ ID NO: 50949 - DNA, 601 bp, Human
gtctggcctgtctcaactttaaaacctctttcagacatttcacaatatttcaaggataattaaggttaaaaaaaatcctatccaaaccccaaagaaaatttcatttggcaatttgataaatcatagaaaatatttagattatatgttctaagtgctaatggttttctttataatattgccatgtcatttataatatgcatataattgtaggaaatcatccatggagtacttcatgattgcttatatgaatactgttgtttattctgcagtgttgtatcaaatgggataaactgtctagtayatttttggttgttacggggtaaaagggtttaggggcaagacaaagacaatgaatttactgaaaagggggacctatttgagcatgaaaaatattggcctggaaaaatgtgggattcttgtttctgttttaaatacacaaatatgaatttatgaaatgaaacgagtatagtcatatgtaatgaagggcatacgctatttctttccttttacttcccctgcagtatttggtttttttacactctgaaatcagaatggcggttcatacttacaggctgcctacagagttgccatagtaacgtgc

SEQ ID NO: 50950 - DNA, 601 bp, Human
ctgtctcaactttaaaacctctttcagacatttcacaatatttcaaggataattaaggttaaaaaaaatcctatccaaaccccaaagaaaatttcatttggcaatttgataaatcatagaaaatatttagattatatgttctaagtgctaatggttttctttataatattgccatgtcatttataatatgcatataattgtaggaaatcatccatggagtacttcatgattgcttatatgaatactgttgtttattctgcagtgttgtatcaaatgggataaactgtctagtacatttttrgttgttacggggtaaaagggtttaggggcaagacaaagacaatgaatttactgaaaagggggacctatttgagcatgaaaaatattggcctggaaaaatgtgggattcttgtttctgttttaaatacacaaatatgaatttatgaaatgaaacgagtatagtcatatgtaatgaagggcatacgctatttctttccttttacttcccctgcagtatttggtttttttacactctgaaatcagaatggcggttcatacttacaggctgcctacagagttgccatagtaacgtgctgttggt

SEQ ID NO: 50951 - DNA, 601 bp, Human
tacggggtaaaagggtttaggggcaagacaaagacaatgaatttactgaaaagggggacctatttgagcatgaaaaatattggcctggaaaaatgtgggattcttgtttctgttttaaatacacaaatatgaatttatgaaatgaaacgagtatagtcatatgtaatgaagggcatacgctatttctttccttttacttcccctgcagtatttggtttttttacactctgaaatcagaatggcggttcatacttacaggctgcctacagagttgccatagtaacgtgctgttggttttaartgagcatgctcggaaagacaggaaggtttagcagaggcttggcagtttgccaatggaggtttgccagatgctttgaaatgggctgtctttcttttcctttcatgtaatgtctgatttttatgtggaagagaatgtaagtagtgctgtataaccctgcggatgctatgccctaagagggaaagcaaatatttgcaagtcagactgaaaaatgtccagaccctgtactgattaagtagaaggggaatctaaccactttgcatttgaaagaaaatgcagcatataggtaagatttttttgtgt

SEQ ID NO: 50952 - DNA, 601 bp, Human
ctcttattacaatgattaatttcataaatattgtaatgttttattcaagctgtgagtatacgttagtataaaagaatgaagagcagaggcaaagctctgttacctattgtttgcaggtaatagtaaataaatttttaaagataaggaagcttacaaggatagtatcttaaaatgtgtcacctaaattatgagcctgttaaaattaagtgaatcaggatgcttttcatctactggaaaataacagcaaaattacagaatttaggcactgattcatatgattatttatttttcggatggtcartttcatagcatatgttttattgaattattaaactaattctttttctctggccatacaggaagattttcttgagtgaaattttgttgctttagaaaaaaatcagctgcatttcttgctcttgggtttaagatttagttgctgaatcattgtaacttctcttgaacagttattttttaaaagtgtaatatactgataaactgaaaagcactttatatacaacaaagaggaggggaatgactatggtgtaaaatgaataaaaatctgataagccatggcctacctggcttagtcattatgggc

SEQ ID NO: 50953 - DNA, 601 bp, Human
gcaaaattacagaatttaggcactgattcatatgattatttatttttcggatggtcagtttcatagcatatgttttattgaattattaaactaattctttttctctggccatacaggaagattttcttgagtgaaattttgttgctttagaaaaaaatcagctgcatttcttgctcttgggtttaagatttagttgctgaatcattgtaacttctcttgaacagttattttttaaaagtgtaatatactgataaactgaaaagcactttatatacaacaaagaggaggggaatgactatgrtgtaaaatgaataaaaatctgataagccatggcctacctggcttagtcattatgggcctttatcaccatgtaggtgaggctacgctgttttattacattacagatcagagtcttcccaaaatgtaacgatgctatgcttttcgtgaagattcaatgttgcattacaataatcaaaaagatcttttgtaaggttctctaaaccactataacaatactctagtctgttatttgttgtttttagtatagcaagcaaattttatgcagtagaatcatacaagtgttagatacttctgcagtgtt

SEQ ID NO: 50954 - DNA, 601 bp, Human
tttcttctttctgccaatcttactccaagccactgttctctttacctagcctaatgcaataacaataacaacttaattgttctttcaacatccatgcttgccctcctccaatctgttctctgtactggatctacagtagttgtttgtttttttttttctaactgaaaatatatatgtgattcctttaggaataaaataattttagggaacaaaagaggttgtggtttttattcttttggattaaaatatttctaaagcatatcgcgtaatactacctttttctaaaagcagtataatgtayattatttaatgtaatatttactcaagatttaattattgcattcttataatacacatactgtcttggctcttagtccttacactaaatgacatatgtctgtaaagattgtgaatttttctccaagttttctttcttctaagctatatattgtcaattgtcagtttttacatatgataactttctggacagttcttcagaattccacttgggatggggcttattgataacctatgtagtcattttgacctatggctcacctgagttgccagacttactatttgttttgtttgcttttcactt

SEQ ID NO: 50955 - DNA, 601 bp, Human
aaagattgtgaatttttctccaagttttctttcttctaagctatatattgtcaattgtcagtttttacatatgataactttctggacagttcttcagaattccacttgggatggggcttattgataacctatgtagtcattttgacctatggctcacctgagttgccagacttactatttgttttgtttgcttttcactttaagttaaacgtgaagtttaactgaagtttaaaattttaagctttctttttaaatttgtctttatttgctgtttccctaaggtgttgtgacaacaaaatayatctgttgtacgagaacatacatcaagatgtacctttcattataccactattaaaacgtttaccttttgtaggagatacaaacaagtaaagataaccacgccaaataatgttcttagtttattcatggagacttggtggtttttaaagtaagactgtttgtttagtccttacaacagtctatgaaaatatgtatataaataaatatatacatatgaaatcgcctcagagtgcattgcctgagaaaagagagattatgaagggaggttagataccttatcccatagtttctcccaaagtgg

SEQ ID NO: 50956 - DNA, 601 bp, Human
tcagaaaatgagtaaatgataaacaacagctgagattttaaaaattcaacagatgtctgtaggaacaaagagggctctacttgaattaaagtgggtgagtacagcttacaaatgttctatgcatttaccttagttttagtatttcacatttttaaaaaatcacactatttaatatattataaatttaaaattttatacaaaaaatgtaagcagctattggattcgctgcttccttcccgtgagtcctccagtccagacatgtcctcagagctgccacttctgatgtactccttgcagtgcktagctccccacagtggagcttggagggtgctgtcttaacatctctccttccatgatagggatctgcccatttcaggggattcttcctgctgccttcaaactgagcctcatttttggaggtggtagggatgaaggagaggggatggaggggttgtaagagctgaggagtgtgaggacttgtgatggagtttcagagttggggtgagaagggtagcccatgaagagggccagaagagggactatagacagcatcataaagaaatttaaatttctttatatttggtaaaagtatttagtgtta

SEQ ID NO: 50957 - DNA, 601 bp, Human
attattgcacaaaaaaaagtcctttggtattgaaaaaaatgagtggtatactggagtacaccgccccaccccccacccccaatacacacaaaaggtaggggtgttatataattattaaaactttttttttttttttttttggagacacagtcttactctgcctctcaggctggagtgcagtggtgattatagctcactgcagcctcaactttccaggctcaagccatcctcccaccttagcctcctgagtagctgggactaggattataggcatgcaccaccatgcccggctaatttattmttattttttttttatagagacaaagtttcgctatgttgcccagtctggtctaaaacccctgggctcaagtgatcctcctgcctggccctcccaaagtgctaggattacaggcaggagccactgagcctgaccaaaaattttaagggattcccatagaggttcttgaaacctgagaatacccatcaacaatatgttctgttacatacaatacacagtatagggaaaccacaaagatcaagtttagttatacctttcctcactttaaaaatgtcaatttttgtggctccgatatgttatacg

SEQ ID NO: 50958 - DNA, 601 bp, Human
gcacaaaaaaaagtcctttggtattgaaaaaaatgagtggtatactggagtacaccgccccaccccccacccccaatacacacaaaaggtaggggtgttatataattattaaaactttttttttttttttttttggagacacagtcttactctgcctctcaggctggagtgcagtggtgattatagctcactgcagcctcaactttccaggctcaagccatcctcccaccttagcctcctgagtagctgggactaggattataggcatgcaccaccatgcccggctaatttattattattwtttttttatagagacaaagtttcgctatgttgcccagtctggtctaaaacccctgggctcaagtgatcctcctgcctggccctcccaaagtgctaggattacaggcaggagccactgagcctgaccaaaaattttaagggattcccatagaggttcttgaaacctgagaatacccatcaacaatatgttctgttacatacaatacacagtatagggaaaccacaaagatcaagtttagttatacctttcctcactttaaaaatgtcaatttttgtggctccgatatgttatacgctagga

SEQ ID NO: 50959 - DNA, 601 bp, Human
ccttccctaagaattacttctggaattattttgttatcttatttttaggtgttgcaaagtcaagtacaggggccatactagaaaggcaaaagagaaaaccaggttattgtgagatgagggggtgatgaggtctggggtaaaatagaatgtatatgactcacttaaatgtatttaaatatctttaaaacattgtgccatctaaacagaaatcctttgccactgtgactttgcaatccctggtttatattcatctggcaataacaaaaactatgtttatatgaaaattatttttatatataartatatgatataatgaacatgtgtcattattgtgctcatctgccagtatatttgtgtgggccacatagtatttaaatgggctttaaaaaaaatatatcaggtgaggtgaaaacgtaacactcccattttattcctgaatgttttcctcttggctaatcttagtccttacagtgatactgaaaagtagagttagagtggtaaatggagtgaagggtagacattgtatatcttcataaatatgacttaaaatctgtcattgtaggatattgagaaaattcagatttttcagctttattaaaat

SEQ ID NO: 50960 - DNA, 601 bp, Human
gcctttaacagaagtgaagagtgaacctgaggaaaatatcgattcaaacagtgaaagtgaaagagaagagatagaattaaaatctccgagggtgagttcttaatactagttttatctggtttaagtattatttaaaattttttattatagccattttcatatatacacaaaagtactacagtgaacctagtttattttccagtatttaatgctgcttagctagctacttttttcgaaatatattgtatattatttcctctacctgaaaacccttccttctgttttctgtttatattcgatyaagtcattcttgtctgggatgaatcccagatattccttttccagtcttctgctaaagtatcacctcattgaaggctgtcttggtcaccttatctgaaattgtaacctgcctcctctctttggaactctcagtccctctgatgttgttctttctgtaatttacttatttattctgtttattgtgattatctattttgccccactctacactagaatcacactccacgaggtcagggattagtgtttatttcgtttattgacagatgccaggcatttagaatagtgcctggcacataataaa

SEQ ID NO: 50961 - DNA, 601 bp, Human
cccttccttctgttttctgtttatattcgattaagtcattcttgtctgggatgaatcccagatattccttttccagtcttctgctaaagtatcacctcattgaaggctgtcttggtcaccttatctgaaattgtaacctgcctcctctctttggaactctcagtccctctgatgttgttctttctgtaatttacttatttattctgtttattgtgattatctattttgccccactctacactagaatcacactccacgaggtcagggattagtgtttatttcgtttattgacagatgccasgcatttagaatagtgcctggcacataataaaggcttattaaatagatgttgaataaatgaatcacctctttatagtgcctgtgccctaaactagatgatatcttgtctttgtaactttatagcacactgtgtagctctagtgatgcgtacatgtatgctggttgtatcttccaactttgctccttctttcctttaatatataaggtctatttaggaattgtcatctagcatttggatcagtgtccagtgatgttacatagtaggatttatcaaattttagaaagagaaaggaatttacca

SEQ ID NO: 50962 - DNA, 601 bp, Human
tgtttttttttaattttttttaaaattgtggtaagtacatataacataaaatttgccaccttaactctttttaagtgtacacttcattggcattaagtacattctcaccgttgcataagtgtcaccaccgtccagttccagaatatttttaccttgcaaacctgaaattctgtacccattaaacagtaactcctcattcctccccaacccttagcaatcaaagttttactttctgtacctatgaatttgatattctaggtacttttatataagtgaaatcatacagtgtttgtcctttttyactggcttattcactcaccataatgtctgtaagacattatgttgtagcacatatcagaatttccttcctttttaaaggtgaataatattttattgtatgtattgtggacatactttcttttcattacctaaaaaccttcctcatcctacataaaatatctgcagtgtgctgtctagtatggatgaaccataaatctaccttctccaagattttctcccagttttttactattttaaaaagtgctgccgggcgcggtggctcatgcctgtaatcccagcactttgggaggccaaggcaggt

SEQ ID NO: 50963 - DNA, 601 bp, Human
ggtaagtacatataacataaaatttgccaccttaactctttttaagtgtacacttcattggcattaagtacattctcaccgttgcataagtgtcaccaccgtccagttccagaatatttttaccttgcaaacctgaaattctgtacccattaaacagtaactcctcattcctccccaacccttagcaatcaaagttttactttctgtacctatgaatttgatattctaggtacttttatataagtgaaatcatacagtgtttgtcctttttcactggcttattcactcaccataatgtctrtaagacattatgttgtagcacatatcagaatttccttcctttttaaaggtgaataatattttattgtatgtattgtggacatactttcttttcattacctaaaaaccttcctcatcctacataaaatatctgcagtgtgctgtctagtatggatgaaccataaatctaccttctccaagattttctcccagttttttactattttaaaaagtgctgccgggcgcggtggctcatgcctgtaatcccagcactttgggaggccaaggcaggtggatctcgagatcaggagatcgagaccag

SEQ ID NO: 50964 - DNA, 601 bp, Human
cctttttaaaggtgaataatattttattgtatgtattgtggacatactttcttttcattacctaaaaaccttcctcatcctacataaaatatctgcagtgtgctgtctagtatggatgaaccataaatctaccttctccaagattttctcccagttttttactattttaaaaagtgctgccgggcgcggtggctcatgcctgtaatcccagcactttgggaggccaaggcaggtggatctcgagatcaggagatcgagaccagcctcgccaatatggtgaaaccccatctctactaaaaayacaaaaaaaaaaaaaagtgctataatacatttgcttgtaaaaatatcctcatcacttatccacatatataagccaggcttctaaaaatggcatttctcacctgtagtcccagctactcaggacgctgaggcaggagaagtgcttgaacccaggaggcagaggttgcagcaagctgagatcgcaccactgcactctagcctggtcgatagagcgagactccatctcaaaaaaatgaataaataaataaaaacagtatttctgggacaaaggtatacagacccaaattttatagcagttgtt

SEQ ID NO: 50965 - DNA, 601 bp, Human
tttaaaggtgaataatattttattgtatgtattgtggacatactttcttttcattacctaaaaaccttcctcatcctacataaaatatctgcagtgtgctgtctagtatggatgaaccataaatctaccttctccaagattttctcccagttttttactattttaaaaagtgctgccgggcgcggtggctcatgcctgtaatcccagcactttgggaggccaaggcaggtggatctcgagatcaggagatcgagaccagcctcgccaatatggtgaaaccccatctctactaaaaatacamaaaaaaaaaaaagtgctataatacatttgcttgtaaaaatatcctcatcacttatccacatatataagccaggcttctaaaaatggcatttctcacctgtagtcccagctactcaggacgctgaggcaggagaagtgcttgaacccaggaggcagaggttgcagcaagctgagatcgcaccactgcactctagcctggtcgatagagcgagactccatctcaaaaaaatgaataaataaataaaaacagtatttctgggacaaaggtatacagacccaaattttatagcagttgttttca

SEQ ID NO: 50966 - DNA, 601 bp, Human
taaaggtgaataatattttattgtatgtattgtggacatactttcttttcattacctaaaaaccttcctcatcctacataaaatatctgcagtgtgctgtctagtatggatgaaccataaatctaccttctccaagattttctcccagttttttactattttaaaaagtgctgccgggcgcggtggctcatgcctgtaatcccagcactttgggaggccaaggcaggtggatctcgagatcaggagatcgagaccagcctcgccaatatggtgaaaccccatctctactaaaaatacaaamaaaaaaaaaagtgctataatacatttgcttgtaaaaatatcctcatcacttatccacatatataagccaggcttctaaaaatggcatttctcacctgtagtcccagctactcaggacgctgaggcaggagaagtgcttgaacccaggaggcagaggttgcagcaagctgagatcgcaccactgcactctagcctggtcgatagagcgagactccatctcaaaaaaatgaataaataaataaaaacagtatttctgggacaaaggtatacagacccaaattttatagcagttgttttcatt

SEQ ID NO: 50967 - DNA, 601 bp, Human
tggaaaaataggatgattggtgaatgggagaggtaatttgattaaatacaaataggcacaggagctatcacaattacatatgacctaggttagtgagtaaaaaaaagttctgtaatgaaatataattaggattaggaaaagtaggaggaactaattggagttgagtatagtgagtatagaattttaaatatttggacaaaaaatttaagcaaaggtgaaaaacatcaaaatatgtatattgtaatatgtatataaaacatataatacatctatgtaaaatgtgatttaaaaagactgtaaytcttttgtaaatggacaaagatttattttagagaaaatttcacagacttgaatgtaagaacaatattatctttaagtagtttttctcatagagttttgaatttaccttatcactctattattggaaggtgccttccaagagaaaacattctcactacaaatgggctgtcaaagcttcatgtcaggacccccagggatcaccaaaataatgccctatatttattacagagcccagtagtacttgttgagcttttaatgcttgtgacactagaatgatctttgatgcagttctcctataagt

SEQ ID NO: 50968 - DNA, 601 bp, Human
attgtaatatgtatataaaacatataatacatctatgtaaaatgtgatttaaaaagactgtaactcttttgtaaatggacaaagatttattttagagaaaatttcacagacttgaatgtaagaacaatattatctttaagtagtttttctcatagagttttgaatttaccttatcactctattattggaaggtgccttccaagagaaaacattctcactacaaatgggctgtcaaagcttcatgtcaggacccccagggatcaccaaaataatgccctatatttattacagagcccagtastacttgttgagcttttaatgcttgtgacactagaatgatctttgatgcagttctcctataagtctttacaggattgatacacaatattttattataaaaatattaaaagtatttttagctctccctgtgttaatcttccttatacctgattatcaatacaaagaaaagccgatggaagatgagtaaacaaatagaattcaacacaaatgtaaagctttgttcttgtggtggtatcctacagtgtcaacaaatgacctaatactcaaatttcttttctttgttagggctgggaaaccttta

SEQ ID NO: 50969 - DNA, 601 bp, Human
tccaagactttgacattcctgctgttatactagcagtgtcaatgcttctagccagagactaccaggatcacacctgtagttagaacaagttacatttattactcatttatagtgagggagaacacacagcaaggggaaccatagggcatcttagtaatatggtgttaaatgaatcaacagaggctcaaggcaccatctttgggaaaacaataattcataattctgtggagacatattactgactatgagcagggagccaggcctgcaacttccaaccgtgcaagtgtttgtttcattaatsagaaatcaagcctatgtcaagcactgtaataattctaagtcgactaattaataaaaaagaacgttagaacttacatttgatcttccgttagatgattttggggagggtttaagaaaggcagggcatgggggctcttgcatgtaatcccagcactttgggaggtggaggcggaaggactgcttgaggccaggagttcaagaccagacctggcaacatagttagacccccatctctacaaaaaattaaaaattagcctggcatggtggcacgcacctgtagtcccagttacccagaaggctg

SEQ ID NO: 50970 - DNA, 601 bp, Human
tgttcagacacgattaggacatggtcttgtttctgttttgatacatcatggtcacagaatggacttgtctgatgttgatgctctttgaaattgttcatgtttcaacagcaggacagtgtggcctagctatgagtgccagactagctctaagcaacaccaaggcccagctgatagtgccaggcaagttcctaaatgtcaggggctgcctttcttgttctcttttacaaaatctggcatatttaatatctctggttgccctgtatttatttggagccagactgctcctgggtttctctatacrctagatgtgtgctctgttataactcaagtccctcatctctacactgggaaaaatacagttcctattttgtagaggtgttgtataatgcagtagttccctctcatctgctggaaatgtgttccaggacccccagtggatgcctgaaacctcacatagtactgaatcttatatatcctatgatttttcctatacatacatacctacaataaagtttaatgtataaattaagcacagtaagagattaacaacaataataaaatagagcaattataactgtattgtaataaaagttatatgaat

SEQ ID NO: 50971 - DNA, 601 bp, Human
tatacgctcaggttttggattagtcatctctctaattaattacctaactagtactctcctggttcatggtttttcgttgttcttctctactcctaaaagctggtataattctggcctgttcagttgagatgaagccaccatggttcctaacgaatttagccagactcctgaaagggagtatctgcaagtgtaagaagtgtgagaagagtcctggtctctcattgagaaatcctgggactatcctttgttagcaatattagtgctagaagtacctacatgatatattgctttgtccagtgtygccaggaccaagtacactaaaaatcaggcctgtgcttcttggttgtctgatacctcctatggaattggatagagttatccctttgttagccctggatcaggtacatattgcacttaccagactatacttgattttactatatgtctatcttttataacagattatgggttgcatgagagcattggccatgtttattctctacatacttcctgatacagtgcatactagtaggccctcagtaaatgttcaaatgaataaacatttccatataagttaataaagtacagatgtttaaaagcc

SEQ ID NO: 50972 - DNA, 601 bp, Human
ggtataattctggcctgttcagttgagatgaagccaccatggttcctaacgaatttagccagactcctgaaagggagtatctgcaagtgtaagaagtgtgagaagagtcctggtctctcattgagaaatcctgggactatcctttgttagcaatattagtgctagaagtacctacatgatatattgctttgtccagtgtcgccaggaccaagtacactaaaaatcaggcctgtgcttcttggttgtctgatacctcctatggaattggatagagttatccctttgttagccctggatcagrtacatattgcacttaccagactatacttgattttactatatgtctatcttttataacagattatgggttgcatgagagcattggccatgtttattctctacatacttcctgatacagtgcatactagtaggccctcagtaaatgttcaaatgaataaacatttccatataagttaataaagtacagatgtttaaaagcctaatatgatgctcatagccagtctcgttttagaaactagatactgggttaatgagtgagagatagttttcaaatcatagtacaggcagttcctaacttata

SEQ ID NO: 50973 - DNA, 601 bp, Human
tcataagtatcttgaaaataatatattttaatagaaggtgaattgacaatccatgcatcctaatgtgtgctacactttccctcaaagcctgtaccagtgtatcctataaattcaatgctgttcatctgggatctttcagcaaagctgagaccatgtggttctaagagaacacagactactgtggtgcaggcatgttttataatgagtataggtgaacatattttattctgcttgtactcgtttcccccacttttctacctctgtatacttttaaatgtaattaagaaattttaggctgagygcagtggttcatgcctgtaatcccagcaccttgggaggctgaggcaaaaggatcacttgagcccaggagttccagaccagccagggcaacatagtgagaccccatctttacaaaaaaatttaaaaattagccaggcatggtggtgtgcacctgtggtcccagctactcaggaggctgaggtgggaggattgcttgagtctgggaggtcaaggctgcagcaagtgtaatcacatcactgcactccagcctgggtagcagagcaagaccccacctcactctgttgcccaggctggagtatag

SEQ ID NO: 50974 - DNA, 601 bp, Human
tggcctgcgcctatcccagctcctcaggaggctgaggcaggagaaatgcttgaatccaggaggcggagcttgcagtgagctgagatcacgccactgcactctagcctgggcaaccaagtgagactatgtctcaaaaaaaaaagaaaagaaaagaaaaaaccttttctttccacagttattttaagtagaatgtcatattcctttcttagggtacaaaatgcccatcatctgtccttcctagatactatctcaaaccacttaacaaattaacttcatgtctaggatgtctaggtactaatcytttgatcttttttaaggactattgtacctaaatatgatactggggaatgttgcaaaatagcttttcatatagatttgagttagtaatatgcaacgtaatatatttttgcttggagcttagtttcccctccccctcaaattcttggcacaaatgttatgatttgttttatttcagaaatttctacagggaggtattcagaggtacatgattaaagatttttattgttatttttggtaagatttttattgtaaaattacattggtaatataaaaacctgtataatataataatatttcctct

SEQ ID NO: 50975 - DNA, 601 bp, Human
tggtaatataaaaacctgtataatataataatatttcctcttacagactcttgttcatctgatagtgaaacagaagatgctttagaaaagaatttaataaatgaagaactttctcttaaagatgaactagaaaaaaatgaaaatttgaatgatgataagctagatgaagaaaatccaaagatttctgcacatatattaaaagaaaatgataggactcaaatgcagcctttagaaaccctgaagttagaagttggagagaatgaacaaatagtacagatttttgggaacaaaatggaaaaarcagaagaagttaagaaagaagccgaaaaatctccaaaaggaaagggaagacgaagcaagacaaaagatctttctttagaaattataaagatttcatcatttggccagaatgaagcaggaagtgaacctcatatagaagctcatagtcttgaattgtcttcattagacaataaaaacttttcttctgctacagaagatgaaattgaccaatgtgtgaaagaaaagaagttgaaacggaaaatactaggacaatcatcgccagagaaaaaaataagaattgagaatggaatggaaatgacaa

SEQ ID NO: 50976 - DNA, 601 bp, Human
tgaagaatctcaagaaggtctctgtgagagggaatcggcaaatggatttgaaactaatgttgcctctggtacctgtagtataattgtacaagagagagagagcagagagaagggtaaggactttctagggaaaagtaagtgtttatatgaaaccaaaaatcaaaactgttgagtttcaggtactgttgatctgtaaagtactttctttttcttttctctcttcttttcttattaaaaagaaagaaatgtcagtgtagtctgttgaataatatacttgctcttttttttttttttttttttttcaacattctctctttccccttatttcaggtcagaagaggccaagtgatggaaatagtggattaatggcaaaaaagcaaaagcgtaccccaaagcgaacaagtgctgcagccaaaaatgaaaagaatggaacaggttggtgtctttcaatgctagcttttgtatagtgttagtatttttagcagtttgttggcttgttttaaacataaatggagcaatactatattgttttataactgcattttcatttaacagtattatactagatattttgccatttttattcttaggaactctagct

SEQ ID NO: 50977 - DNA, 601 bp, Human
agatagggtttcaccatgttgaccaggctggtctccaactcctgatcccaagtaatctgcccacctcgtcctcccaaagtgctggaattacaggcatgagccacagcgcccagccaaaaagatttttttattaccgtcttttttgttgttggggggtacaggctctggcacccagactggagtgcagtggcatgatcacggcttactgcagcctcagactcttgggctcaagcgactcccacctcagcctcccgagtagctggtaccacagtgcctgccaccacacccagctaatttttttagttttttttgtagaggcatattctcactatgtggctcaggctggtctggaacccctgttctaaagcaatccttttgctttggcctcccaaagtgctgagattataggcatgagccaacatgcccagcttattatagtcttttccccatttttatttgcttatgtttttataatgagttattaaattgagatttgagtgatttgtagcatacatgtaagaatttgttgcctgggcatggggctcacgcttataattccagcactttgggaggctggagcaggaagatcacttgagtccag

SEQ ID NO: 50978 - DNA, 601 bp, Human; identical to SEQ ID NO: 50924

SEQ ID NO: 50979 - DNA, 601 bp, Human; identical to SEQ ID NO: 50925

SEQ ID NO: 50980 - DNA, 601 bp, Human; identical to SEQ ID NO: 50926

SEQ ID NO: 50981 - DNA, 601 bp, Human; identical to SEQ ID NO: 50927

SEQ ID NO: 50982 - DNA, 601 bp, Human; identical to SEQ ID NO: 50928

SEQ ID NO: 50983 - DNA, 601 bp, Human; identical to SEQ ID NO: 50929

SEQ ID NO: 50984 - DNA, 601 bp, Human; identical to SEQ ID NO: 50930

SEQ ID NO: 50985 - DNA, 601 bp, Human; identical to SEQ ID NO: 50931

SEQ ID NO: 50986 - DNA, 601 bp, Human; identical to SEQ ID NO: 50932

SEQ ID NO: 50987 - DNA, 601 bp, Human; identical to SEQ ID NO: 50933

SEQ ID NO: 50988 - DNA, 601 bp, Human; identical to SEQ ID NO: 50934

SEQ ID NO: 50989 - DNA, 601 bp, Human; identical to SEQ ID NO: 50935

SEQ ID NO: 50990 - DNA, 601 bp, Human; identical to SEQ ID NO: 50936

SEQ ID NO: 50991 - DNA, 601 bp, Human; identical to SEQ ID NO: 50937

SEQ ID NO: 50992 - DNA, 601 bp, Human; identical to SEQ ID NO: 50938

SEQ ID NO: 50993 - DNA, 601 bp, Human; identical to SEQ ID NO: 50939

SEQ ID NO: 50994 - DNA, 601 bp, Human; identical to SEQ ID NO: 50940

SEQ ID NO: 50995 - DNA, 601 bp, Human; identical to SEQ ID NO: 50941

SEQ ID NO: 50996 - DNA, 601 bp, Human; identical to SEQ ID NO: 50942

SEQ ID NO: 50997 - DNA, 601 bp, Human; identical to SEQ ID NO: 50943

SEQ ID NO: 50998 - DNA, 601 bp, Human; identical to SEQ ID NO: 50944

SEQ ID NO: 50999 - DNA, 601 bp, Human; identical to SEQ ID NO: 50945

SEQ ID NO: 51000 - DNA, 601 bp, Human; identical to SEQ ID NO: 50946

SEQ ID NO: 51001 - DNA, 601 bp, Human; identical to SEQ ID NO: 50947

SEQ ID NO: 51002 - DNA, 601 bp, Human; identical to SEQ ID NO: 50948

SEQ ID NO: 51003 - DNA, 601 bp, Human; identical to SEQ ID NO: 50949

SEQ ID NO: 51004 - DNA, 601 bp, Human; identical to SEQ ID NO: 50950

SEQ ID NO: 51005 - DNA, 601 bp, Human; identical to SEQ ID NO: 50951

SEQ ID NO: 51006 - DNA, 601 bp, Human; identical to SEQ ID NO: 50952

SEQ ID NO: 51007 - DNA, 601 bp, Human; identical to SEQ ID NO: 50953

SEQ ID NO: 51008 - DNA, 601 bp, Human; identical to SEQ ID NO: 50954

SEQ ID NO: 51009 - DNA, 601 bp, Human; identical to SEQ ID NO: 50955

SEQ ID NO: 51010 - DNA, 601 bp, Human; identical to SEQ ID NO: 50956

SEQ ID NO: 51011 - DNA, 601 bp, Human; identical to SEQ ID NO: 50957

SEQ ID NO: 51012 - DNA, 601 bp, Human; identical to SEQ ID NO: 50958

SEQ ID NO: 51013 - DNA, 601 bp, Human; identical to SEQ ID NO: 50959

SEQ ID NO: 51014 - DNA, 601 bp, Human; identical to SEQ ID NO: 50960

SEQ ID NO: 51015 - DNA, 601 bp, Human; identical to SEQ ID NO: 50961

SEQ ID NO: 51016 - DNA, 601 bp, Human; identical to SEQ ID NO: 50962

SEQ ID NO: 51017 - DNA, 601 bp, Human; identical to SEQ ID NO: 50963

SEQ ID NO: 51018 - DNA, 601 bp, Human; identical to SEQ ID NO: 50964

SEQ ID NO: 51019 - DNA, 601 bp, Human; identical to SEQ ID NO: 50965

SEQ ID NO: 51020 - DNA, 601 bp, Human; identical to SEQ ID NO: 50966

SEQ ID NO: 51021 - DNA, 601 bp, Human; identical to SEQ ID NO: 50967

SEQ ID NO: 51022 - DNA, 601 bp, Human; identical to SEQ ID NO: 50968

SEQ ID NO: 51023 - DNA, 601 bp, Human; identical to SEQ ID NO: 50969

SEQ ID NO: 51024 - DNA, 601 bp, Human; identical to SEQ ID NO: 50970

SEQ ID NO: 51025 - DNA, 601 bp, Human; identical to SEQ ID NO: 50971

SEQ ID NO: 51026 - DNA, 601 bp, Human; identical to SEQ ID NO: 50972

SEQ ID NO: 51027 - DNA, 601 bp, Human; identical to SEQ ID NO: 50973

SEQ ID NO: 51028 - DNA, 601 bp, Human; identical to SEQ ID NO: 50974

SEQ ID NO: 51029 - DNA, 601 bp, Human; identical to SEQ ID NO: 50975

SEQ ID NO: 51030 - DNA, 601 bp, Human; identical to SEQ ID NO: 50976

SEQ ID NO: 51031 - DNA, 601 bp, Human; identical to SEQ ID NO: 50977

SEQ ID NO: 51032 - DNA, 601 bp, Human
gcccggcccgccccaaccgacggcgccctcctgacccaggcagcctagcgctggggcccaagaggcccatccgcggggaactgccagcgcctgccccaggccgtaccgtcgagggggctgtactggagcgctcacagccccaaccctggctgccctccctcagtctcagttccctctttcgaaccaaaagacgcagtgggggaaaggccgcttctgctcctttcgtgcccagcccgggtcagagcattaggattagctggccacaggcggcgaactgggctcaggccgggagctggggtcmtacggtagaccccagtttggagaggttaggagagggggtgttgacttccaaaagctggagcccccagacgctttgcctcttggcttctctcctgtcaggccccagtgagggcacctgctcggacccttagagtcccctctggaactgcgagtcctcccacctgcccagactccgctggagagagggccgggccgggcgctcgagtgcctcccaacagggcagcctccctcctggcccggtctagcctctccgcgctctgctcgcccctgctccttgagctcggggtcgcttcccttggct

SEQ ID NO: 51033 - DNA, 601 bp, Human
cagcagaaatgggggctcacagggggatctcaatttcttaagataacttcaagcttgtgcccaccgactgccttttgtctgggaaggcaaagacagacaggcagttctggaccaaaacacagtttcctggtgcaaatgggactcaatctaattcttgggggtggtagaggaggagacatagtgaaaaaaaaaaaaaaaaaaaaggctgacagagtttaaaagaaaacttttcctgcctagggatcctaccatcagagcaaatgtcagttgggaaagtattggagaatggaaaggagcaacwtttcctttcagatattattgtgattttggatgccagctttaaacaacccagtttgtgacacatttgtgattataaaaatgatcatttctacaaaaatgctcactcttttaaagcactgtgttagatggaagtgtttaaaatcaagttacaatggctttgccaaaccactcctccacccataggacccaaagacaaacatacattgtttgtagccttcacatatctctttgaaactatacctggtcactgaaaaatgccaataattcaatattctcaaccccaggtattatagtaattact

SEQ ID NO: 51034 - DNA, 601 bp, Human
tggaagtgtttaaaatcaagttacaatggctttgccaaaccactcctccacccataggacccaaagacaaacatacattgtttgtagccttcacatatctctttgaaactatacctggtcactgaaaaatgccaataattcaatattctcaaccccaggtattatagtaattactttacaccatacaattttctttgcatctccaccaagaacagaaagaataactgatggcattacaccttaacacttaattttactttcattttcttaacctatttcattttctctttcttgtatatayattttttaaactctttcaggaaaaccctgccactaacacccatggcatgtatagtggtaattgcaagatttatttttaagtcatatgcacatatcacatatgtaatgtgtagaggtagtgtatcaaggggagccctatgcacacacaaagcagaaatctgtgcatgtatattttgcactgtatcgtgggaataatttagttatttgtttgcaaaggacagtgcaggtctttttgttctctattgacataagtaccagatccccacagtgcagtgagcaccagtgcaggcacccttaggtc

SEQ ID NO: 51035 - DNA, 601 bp, Human
aggaggcgagggtcaggccaggtgggccgcgtggcggcggggatttaggcgatggaacactttgtgatgggtccctttctgagcttcccgcgagagaagcccaggctggcgtccctttgctgctacgagccagatccttcgtggactggggcgaagcagaggcctgagccttggaaggcggagctggggcctcgacccccgccaggggccgggagcgctcgtcagggcgctgggggtctggggcggcagctccccggggcgaggctctgggaagcgcctccaggcctgtcggcctccgggrgcttggggaggcggctcccgaagccctttcggcggctctcgttgggggtagagttaaccaaagaaggcgcttctgaagggccgggcggagcagccctggggcctcagagccgcgccttcacgcccgcgaaacgcgcgccccgggtctcggccccacggtgcgactgcggctgcggggtcctcacgttcggactttctctccggtggctctcggacaaacacgcttggccaatcctgcggagaggggcacccagataaacgtaacaaagctaccattttctcgactaaaggtcacattgta

SEQ ID NO: 51036 - DNA, 601 bp, Human
gcgccccgggtctcggccccacggtgcgactgcggctgcggggtcctcacgttcggactttctctccggtggctctcggacaaacacgcttggccaatcctgcggagaggggcacccagataaacgtaacaaagctaccattttctcgactaaaggtcacattgtaatctcccaaggaagttagtgagaaaacctcaaattatacggactggctgtggaccgtttaatttttctttccctccgtccctccctcatgtctccaaaggaaaatttaaaacactcgtgtttttattttcccccmgagaaaagctaaacaaccaccacaacaaaagccccagatttaagtctaaattcatcaccgtcctggagtcaagagttcaaaactctcaaaaaaccggaccttaaggcaatgtaaggtttccccagcagaccccagtaggtttgcaaatctcttaatcccaaactcaattccaaagcctcaagctattcagttttccttttattattttgaagacttaaaatttttaatgcttttttgtctgtcaaaatcagcttttaaaattaagtggaatttgttcctcttattcacttgaaaaaacat

SEQ ID NO: 51037 - DNA, 601 bp, Human
attattttgaagacttaaaatttttaatgcttttttgtctgtcaaaatcagcttttaaaattaagtggaatttgttcctcttattcacttgaaaaaacatcttagtcattattttctgtaacaaatcccatttccacttcctcttccctctcttattttgttgaaatagaatcagaatacatattagtggctctccaatggcaaataacacagaaaatagcaaggaaagagagcccttttccttagtctgtttctactgtgaagaatgtcaatgagaaatgataaggaagtttgtcatttycttttactaaacgacccacccttaattcgtaatttgcaaagaaaaggcagaatagtacaatggttaggagctccgatctctggctgtacgacttcttaggaaaatatttaatttttagtctctatttcttcatctttaaaacagggaaatgatattcccaacccagagatgttatgagtattcaatgagataatgcaaccatatggcacatagtaagcatttattaagtattgtctgtggttctaagtggcagttaaaaagacacgtgtaaaagtaagtaatatttatcagagtatactt

SEQ ID NO: 51038 - DNA, 601 bp, Human
ggaataacattgtgaagtatagagttgaaaaagtttctaattcccacatgtcattgatgaacccagtttatatatcaagcagtcataatcccaaaaaaaccctttatacttattatttatttatttattttgagacggagtctagctctgtcgccaggttggagtgcagtggcgcgatctctacttattgcagcctctgcctcccgggttcaagcggttctcctgcctcagcctcctgagtagctgggattacaggcacgcgccgccacacccacctaatttttgtgtttttagtagagasagggtttcaccatgttggcctggctggtcttgatctcctgacctcgtgatccacccacctcggcctcccaaagtgctgggattacaggcgtgagccaccgtgccggccagtaatttttattttctcttccttgaattatagatctaacattgaaatttgtttggaaatgcttaatttataatacacttcaaaactaaactgacaaattatttaaaataaaaaatttgaagttttaaataattgatattctgattattaaaaatagattacattttatatactaaattttaaatcactaaa

SEQ ID NO: 51039 - DNA, 601 bp, Human
atgataattatcaaaatagtgcttaatgttgaagatgtgccaagttcagccgtgccatttttctgagcagttttgaactttagacattgatttcatgtaaggttaaattgcacattaatacttgtttataaacatacaaaggtaaagtgttgcccatatatgtgcatttctcttaccaatattcaaagggcagatttatttttaaaagttatttttcaaaatggaatcagcatatttcaaccaaaatgtaaactctggtaacacgtatttttccctctgcttatattatggacaataactygaatgtctttggccaaaaaaaaagctttaaaatttttcccactttcagggcatttgtgattgttattaaatagtgcaaaattatatgatactagtttaattttattatacaaagaaggaaattgagaattcagaatcatagagcttaaagcatatttttcttgaggacatctgtagaattaccaaagggctaaactatgcaactgagtatagatactattgattaccataatctagagtttctattttcagcttaaactgtaaagacagatgtcctgattcctagtaattaaaactgtat

SEQ ID NO: 51040 - DNA, 601 bp, Human
taatgttgaagatgtgccaagttcagccgtgccatttttctgagcagttttgaactttagacattgatttcatgtaaggttaaattgcacattaatacttgtttataaacatacaaaggtaaagtgttgcccatatatgtgcatttctcttaccaatattcaaagggcagatttatttttaaaagttatttttcaaaatggaatcagcatatttcaaccaaaatgtaaactctggtaacacgtatttttccctctgcttatattatggacaataactcgaatgtctttggccaaaaaaaaagctttaaaatttttcccactttcagggcatttgtgattgttattaaatagtgcaaaattatatgatactagtttaattttattatacaaagaaggaaattgagaattcagaatcatagagcttaaagcatatttttcttgaggacatctgtagaattaccaaagggctaaactatgcaactgagtatagatactattgattaccataatctagagtttctattttcagcttaaactgtaaagacagatgtcctgattcctagtaattaaaactgtatgcacatttcagctatgcatatac

SEQ ID NO: 51041 - DNA, 601 bp, Human
taacactagctacagactgagatgtcagaaatagagaatagtctataaatacttgaactttttaaaagttcagaattaagttgtgaaaatagttgaatttaaagatataatctgaaattcttatgaagcatttacttgcacatgcatttgaagtgaagatagtcttctagaatcctgaatgtgattttctagtgtattattttaaaaactggctgtccttgtggatgtactattctcaggaagatataaatgatattgcactaaatttgtcttcatattaaagttaatttttgtaaataakttatgatttatagacaatgaaatcttaggcaaatgccagcagagtgtctttgaaattcataatgttatctgttatgaaaaacattctttgacctggttacattttaaccagtagtatttcaaaataaaattaatgatcatgtatcagtaaaatgtattgtataaaatagcagggaaaggtaattgcaaatttttcaaggctatgtcaattttaataatattttggaaaattataaaatttagaaaagcttttaaatagcggctttccatttcttagagacatttacatctacaatatgat

SEQ ID NO: 51042 - DNA, 601 bp, Human
tgacagaaaaatgagttcaccaaaaaagagaaaatcttgtttattttcagatccaaaactttttcttgcttatgatatcgaggttgaaattctaggtgaagcacatctctatttgtggctaaatctactttattataaagccaaggtaaattcattttatcataagaggaccaggttgaactgataagtgaaagcagattgtgggtagaggacctggcactgttatttgcatttatcttcacgataaataatgttgagtagacaattcccagaatttgaataatggtctataacctctaaytgccagacatttgccataccagttttatggtggtcacaagtgttttgatactaacgtattttcctttacttggaggagggaggataaatggaataaccataaatcaagtaataaatggctaggttagaacttctgtttacttttttcaacagctttattcattttgcttgcttaaagtgtaatgcttgttttgtgataaacggtgcctacatttttgctttgttttttaagctacagtgtcacatcttttgctttcacaaacctatactaacttaagtatacatatggttgtggaatgct

SEQ ID NO: 51043 - DNA, 601 bp, Human
gaataatggtctataacctctaactgccagacatttgccataccagttttatggtggtcacaagtgttttgatactaacgtattttcctttacttggaggagggaggataaatggaataaccataaatcaagtaataaatggctaggttagaacttctgtttacttttttcaacagctttattcattttgcttgcttaaagtgtaatgcttgttttgtgataaacggtgcctacatttttgctttgttttttaagctacagtgtcacatcttttgctttcacaaacctatactaacttaartatacatatggttgtggaatgcttatgatgtatcctgttttgtggggatacaagatgattaaggcaagtccctgtcctcagacagtttacaatctagccctctgccaatacagttcctcaacatattcaccaaagttacttttaaaaaattggtaaatctgtattttgaacatttggaacaaacgaaattaaaacttgtactttcattcttcttgtgataaccttaactagaagaactacattgcatcttatatatttttttctagactatttccgttaatgtcagtgtgatgaagttgg

SEQ ID NO: 51044 - DNA, 601 bp, Human
agagacggggtttcactatgttggccaggctggtcttgaactcctgacctcaggcaatccgcccgcctcagcctgccaaagtgctgggattacaggcgtgagccaccgtgcccggccgcctttttctatgagatgaaatcaaccatctccgagcttctcttcctaccctgtctttctgcagtacaaagggattgcatcactaaaatgatactaaataaatattgtggatttaagagaactttgaaatatttagtactaagaataatgacataaagcaagtttgtgcattaagtatgagaarttggacaaacatggaaaaatttgctcatttttttacacttgataaatgaatgtaatcatggaataaataaggcactagaagttaatacaggcctaaatccaatgtcctgcctgcccctaaattccaggaacattatctaagataaaagttcaatgcagcatgtctctgagggccatcttccagggggaacatctctgggcaaaaagaagtgggtccatgtaaggggaccatagacattgcaacaaaacaactgaagagtccaagtaaatggggcagatcaatgagcaagagttccaaggg

SEQ ID NO: 51045 - DNA, 601 bp, Human
agataaaagttcaatgcagcatgtctctgagggccatcttccagggggaacatctctgggcaaaaagaagtgggtccatgtaaggggaccatagacattgcaacaaaacaactgaagagtccaagtaaatggggcagatcaatgagcaagagttccaagggcaaaggtgtaagaaaagggaagatgactaagcaaggatttcagagagaactgtaattttgaatgatagataaaatacaaagaaaaaagaatgggtaggaaaaatttagctgtgatgaaaaatagaactcgccaacagttmtgttctgctaactagaacattgtttctgccatgtataatattaaattttttaactttatgtccctatatgatgttggccaaagatttttattattttagaagtaattttaatgttagcattcttatttcattattcttagttcacattggcatcagtagtataaaacattagtcaatgctggaaatgaaaatattagttaacaccacatacagatgtgaacacctttccataactgaattggatttatttctttccaaactcatttatcatagattattgggacaattctaaataaaaat

SEQ ID NO: 51046 - DNA, 601 bp, Human
tgtaagaaaagggaagatgactaagcaaggatttcagagagaactgtaattttgaatgatagataaaatacaaagaaaaaagaatgggtaggaaaaatttagctgtgatgaaaaatagaactcgccaacagttctgttctgctaactagaacattgtttctgccatgtataatattaaattttttaactttatgtccctatatgatgttggccaaagatttttattattttagaagtaattttaatgttagcattcttatttcattattcttagttcacattggcatcagtagtataaaayattagtcaatgctggaaatgaaaatattagttaacaccacatacagatgtgaacacctttccataactgaattggatttatttctttccaaactcatttatcatagattattgggacaattctaaataaaaatgattaaaactataatctctatgcaaaactagattttttcccctgtaatttgatagttctctatcttgatacccatctcctgagagccttaaagtgtgtctcctttgagacataatcagccattctcaaaaagtggaagaaactattctttttttagaagggatctga

SEQ ID NO: 51047 - DNA, 601 bp, Human
agggaagatgactaagcaaggatttcagagagaactgtaattttgaatgatagataaaatacaaagaaaaaagaatgggtaggaaaaatttagctgtgatgaaaaatagaactcgccaacagttctgttctgctaactagaacattgtttctgccatgtataatattaaattttttaactttatgtccctatatgatgttggccaaagatttttattattttagaagtaattttaatgttagcattcttatttcattattcttagttcacattggcatcagtagtataaaacattagtcartgctggaaatgaaaatattagttaacaccacatacagatgtgaacacctttccataactgaattggatttatttctttccaaactcatttatcatagattattgggacaattctaaataaaaatgattaaaactataatctctatgcaaaactagattttttcccctgtaatttgatagttctctatcttgatacccatctcctgagagccttaaagtgtgtctcctttgagacataatcagccattctcaaaaagtggaagaaactattctttttttagaagggatctgacaatgagaa

SEQ ID NO: 51048 - DNA, 601 bp, Human
gctgtgatgaaaaatagaactcgccaacagttctgttctgctaactagaacattgtttctgccatgtataatattaaattttttaactttatgtccctatatgatgttggccaaagatttttattattttagaagtaattttaatgttagcattcttatttcattattcttagttcacattggcatcagtagtataaaacattagtcaatgctggaaatgaaaatattagttaacaccacatacagatgtgaacacctttccataactgaattggatttatttctttccaaactcatttawcatagattattgggacaattctaaataaaaatgattaaaactataatctctatgcaaaactagattttttcccctgtaatttgatagttctctatcttgatacccatctcctgagagccttaaagtgtgtctcctttgagacataatcagccattctcaaaaagtggaagaaactattctttttttagaagggatctgacaatgagaatcatgttctaggagagaaaagaatttgttaccagatgttatctcaaaagatgcactagttttaaattaaattgcatctatcttttaagtgtt

SEQ ID NO: 51049 - DNA, 601 bp, Human
tttaacgaaggtcgtgtttgttgtgcgtttctaacatgacaggctgcagtctgtgcccttctttactgaaaatgaaagttataccaaccaggcctgtcacaagtgcctcaacaaaagagccaaacaaaacccaagtcccaggaaggttgacaaaggcaatgaggacagccgaacagattctaagagtatttaattgccattaattcttttctcaccctgcacctccttcctgtacttccaagtggcacaagcaaatactacgaattttctggttgcagctttctctaaatgtttgtggaaagaataatatcttgtcattatgtttgtttaagtggcaagactgtgaatgtctttagaatataataaagctcaaatttttttaaaaagttggagagtagagtcagagcattgctggcttactcagacttaagttctgcttctttctaagaacgtgtgaaatgttcactcctataatgtgattatttttcacttcttttctactcctctcaggcaccaaatggtctcccagctgtgggcagttttgtgtcagcatccagcatggctccttaccctaccccagcccaagtgtcgccttacatga

SEQ ID NO: 51050 - DNA, 601 bp, Human
tttgagtgatcctttgtttaagacatgacctattttgttgaaaaatatatgtagaacccaagcaatatctgaatctagctctccctggtgttttgacttggttccaaatacaataatgtttatattttctattagtttgtaaatacggactctggatggtgcatttgtgtcttcattccataagatattcccctcccctcagccccaccccctctctatttttttctttcttttttgcaaaggtgactttctggcaacgtctttgtctctgtttggtggtgggctgctcgggctcctggayctggacttgcccccaaattttgtgtatgcagtgaaggcttcaacatctcatgaaggacactttatttctacagcagaggacacgaaaaacagataaaacaagccagtctcccattttgtacctaatcaaacaacacacatgctaagcatataaagacaagagggtggaaaatatctgaacaagaaggctctaaaggaagtcacttagaaacttaagtttaatgtgaaatgttttgcaaagatgcttaaaatgaactttgtgttaagaaaaccactgtgaaactaaattgtcctattattg

SEQ ID NO: 51051 - DNA, 601 bp, Human
gttttgttttgagacagggtctctgttgcccaggctggagtgcagaagagccatcacagctcactgcagcctcaacctccgaggcttaagttacttttccacctcagcctcttgagtagctgggactacaggcgcctgccaccgtgcccggctaatttttttattttttgtagagacaggatttcactatgctgcccaggctggcctcaaactcctgggctcaagctgtcctctctcaccgagctcccaaagtgctgggattacaggcgtgagcccctgaacctggcccttaggttttttkttttttttttttttaattgtagttttaatgctacaaaaataacatgctagaggaatttagattagacatctttcttaaaccacatacgtcctttacgataggttatacagtagaccaattttagaaatgattaaggaacttcagttggcagttacctgttcatttgtggacatcaaggcccagaggggttaggacttagagtctcactataattctcatatttttaaataatgttgactcattgatcaatattatataagtgactgaagatggtgaagtgttaaataaaaaacattggta

SEQ ID NO: 51052 - DNA, 601 bp, Human
tttgagacagggtctctgttgcccaggctggagtgcagaagagccatcacagctcactgcagcctcaacctccgaggcttaagttacttttccacctcagcctcttgagtagctgggactacaggcgcctgccaccgtgcccggctaatttttttattttttgtagagacaggatttcactatgctgcccaggctggcctcaaactcctgggctcaagctgtcctctctcaccgagctcccaaagtgctgggattacaggcgtgagcccctgaacctggcccttaggttttttgttttttktttttttaattgtagttttaatgctacaaaaataacatgctagaggaatttagattagacatctttcttaaaccacatacgtcctttacgataggttatacagtagaccaattttagaaatgattaaggaacttcagttggcagttacctgttcatttgtggacatcaaggcccagaggggttaggacttagagtctcactataattctcatatttttaaataatgttgactcattgatcaatattatataagtgactgaagatggtgaagtgttaaataaaaaacattggtattttcat

SEQ ID NO: 51053 - DNA, 601 bp, Human
cctcaacctccgaggcttaagttacttttccacctcagcctcttgagtagctgggactacaggcgcctgccaccgtgcccggctaatttttttattttttgtagagacaggatttcactatgctgcccaggctggcctcaaactcctgggctcaagctgtcctctctcaccgagctcccaaagtgctgggattacaggcgtgagcccctgaacctggcccttaggttttttgttttttttttttttaattgtagttttaatgctacaaaaataacatgctagaggaatttagattagacayctttcttaaaccacatacgtcctttacgataggttatacagtagaccaattttagaaatgattaaggaacttcagttggcagttacctgttcatttgtggacatcaaggcccagaggggttaggacttagagtctcactataattctcatatttttaaataatgttgactcattgatcaatattatataagtgactgaagatggtgaagtgttaaataaaaaacattggtattttcattacaggcatttggggagaaagtcattttacttatcccaaaattgagtatgaaggtggaagat

SEQ ID NO: 51054 - DNA, 601 bp, Human
agtagagacgttaagatacagaaaggtacattcgtcttctgaatcctgaagtgttatgctagaggtatctatagctgtggaaaactgaaaagatattatggtatgtacccagcttaaagggggtacagtccgtaaaagtcagaatattagcagccttccaatatgtctgtcggtaggtgaaaaaaaaagtttctctctttcaggagctgtgtacaaaaggatccaaactatactttgtacatttgttattgttttaaaagtggctgtgagtttttagaggtcagctaactttaaacttgcsgtttggtttgtgactttagaaggtagagttaactatatttagcaatatgcttaagcgtgtgcatatcacctcatgaaacgtgtgtgtgcatgagaaaagctgcctccagtacacatacatatgtatatacacacatacacacaagcacatatatgtatgtatttcttataggaccaatctcattgtacataatttcaaagcacaggttcctatctccagggatgcataaaaagactcactgaagtatagggagaaaattttaggtctactattatgtttgttgatctcatcactttaaaa

SEQ ID NO: 51055 - DNA, 601 bp, Human
tccacatgtcaccctctcagatggtacagaattcagaaagatttctcagtttcttccattcatgtttttctcgtttttattactctctatgtgggataagtgggaggaacctcatgtctttcaatttggctctgtgttcttcttctggaatatattgatttttaaatactaaaatctgttattggcctatttcttccccttttaaaagcagatacagaaaataatgatggtagaacagacttgggatgaatccaagtttattataatttttaggagacatttatgatatacctctataggyatcagaatcttttctactattaaggtgaaaagatttgagattttgtgaaatcttttgtgtattctttttatttgagttggcttttaggtggcttatttttcaactctgaaatgaacataacatgttacatatgttacatatgttacaatttttttctaaagtgtagttgtttaatttctacaaagatagtccatataaagtttctaaagattgtaaatttaaaaggaaatgccaaatgaattatttgtaaaattgtttaaaaaaattaataaataatgagtgtgtatttaaaagtttgaa

SEQ ID NO: 51056 - DNA, 601 bp, Human
ataaaatatttaaggttttgctgcttttattactttatgaacacatttgtcaggaatctgattgttagaaagcacattaaatagaattctacttggatgtggaatctataaagagtataataaggttttgatattgaggatgtcagtgtatgaacagctataacaatccacattaatctattttctgtagttgtgttacttctaactttcagactttatcctttctttcatatcttgtgtcttccctaaagtggatccagtcagttttctggttataattacaattgaaaaaaaaaaaaaattcaaccatagttacttctttattcaattacgttgttattgagcgcttcctgtaacatttggtaatgatcataacaagtaacacccaggtacttacaattggccagacattgttttaaatgttttatgtgtatcaacttatttaaacttcacaaaacccctacaaggtaaatactgctgtccccattttaaagatgaggaaactgagacagattaatttgccagtgtaactctgcactacacaatgttgtacaacggtagatgccacaaatatctgctgtcatgaagctcagtgttttat

SEQ ID NO: 51057 - DNA, 601 bp, Human
ttatgaacacatttgtcaggaatctgattgttagaaagcacattaaatagaattctacttggatgtggaatctataaagagtataataaggttttgatattgaggatgtcagtgtatgaacagctataacaatccacattaatctattttctgtagttgtgttacttctaactttcagactttatcctttctttcatatcttgtgtcttccctaaagtggatccagtcagttttctggttataattacaattgaaaaaaaaaaaaaattcaaccatagttacttctttattcaattacgtygttattgagcgcttcctgtaacatttggtaatgatcataacaagtaacacccaggtacttacaattggccagacattgttttaaatgttttatgtgtatcaacttatttaaacttcacaaaacccctacaaggtaaatactgctgtccccattttaaagatgaggaaactgagacagattaatttgccagtgtaactctgcactacacaatgttgtacaacggtagatgccacaaatatctgctgtcatgaagctcagtgttttattttttgatacctcagagtatctccagttgttttt

SEQ ID NO: 51058 - DNA, 601 bp, Human
aaagtggatccagtcagttttctggttataattacaattgaaaaaaaaaaaaaattcaaccatagttacttctttattcaattacgttgttattgagcgcttcctgtaacatttggtaatgatcataacaagtaacacccaggtacttacaattggccagacattgttttaaatgttttatgtgtatcaacttatttaaacttcacaaaacccctacaaggtaaatactgctgtccccattttaaagatgaggaaactgagacagattaatttgccagtgtaactctgcactacacaatgytgtacaacggtagatgccacaaatatctgctgtcatgaagctcagtgttttattttttgatacctcagagtatctccagttgtttttatcgttagtttcttcatttattcaatataaagacattgcgctagatacagaaaacatggagaaacttctagaagatgacaatttataaggcaagtcaaccatgtacatcattagtagatgtataagagctacatatgccccaaacaggaaaccttttaaatgaagattattatatatgttttaacatactgtgtgtatgtacgtacacacaca

SEQ ID NO: 51059 - DNA, 601 bp, Human
tcgttagtttcttcatttattcaatataaagacattgcgctagatacagaaaacatggagaaacttctagaagatgacaatttataaggcaagtcaaccatgtacatcattagtagatgtataagagctacatatgccccaaacaggaaaccttttaaatgaagattattatatatgttttaacatactgtgtgtatgtacgtacacacacacacacacacacacacacacacacacacacacacggctatatgtgaatcacctggctttagtctttctttcctccccagttcttgccatrattcgagggcttcaagagttcatgcagatgatacttctcacaccttggtctggcagttttctttctttctttttttttttatttaatgaaatttcagtttattcagataaagactaatgtatgcctcataacctagtgataatctataagtttgggagttcacaacatttttacaaagcacataatattaacattcaagtgaggcattatagaaagttttataaagaatgaagtaggccaggtatggtgcctcatgactgtaatcccaccactttgggaggcagaggtgggtggattgct

SEQ ID NO: 51060 - DNA, 601 bp, Human
acatggagaaacttctagaagatgacaatttataaggcaagtcaaccatgtacatcattagtagatgtataagagctacatatgccccaaacaggaaaccttttaaatgaagattattatatatgttttaacatactgtgtgtatgtacgtacacacacacacacacacacacacacacacacacacacacacggctatatgtgaatcacctggctttagtctttctttcctccccagttcttgccatgattcgagggcttcaagagttcatgcagatgatacttctcacaccttggtctrgcagttttctttctttctttttttttttatttaatgaaatttcagtttattcagataaagactaatgtatgcctcataacctagtgataatctataagtttgggagttcacaacatttttacaaagcacataatattaacattcaagtgaggcattatagaaagttttataaagaatgaagtaggccaggtatggtgcctcatgactgtaatcccaccactttgggaggcagaggtgggtggattgctggaggtcaggagtttgagaccagcctggccaacatagcaaaaccctgtctct

SEQ ID NO: 51061 - DNA, 601 bp, Human
tttataaggcaagtcaaccatgtacatcattagtagatgtataagagctacatatgccccaaacaggaaaccttttaaatgaagattattatatatgttttaacatactgtgtgtatgtacgtacacacacacacacacacacacacacacacacacacacacacggctatatgtgaatcacctggctttagtctttctttcctccccagttcttgccatgattcgagggcttcaagagttcatgcagatgatacttctcacaccttggtctggcagttttctttctttctttttttttttatttaatgaaatttcagtttattcagataaagactaatgtatgcctcataacctagtgataatctataagtttgggagttcacaacatttttacaaagcacataatattaacattcaagtgaggcattatagaaagttttataaagaatgaagtaggccaggtatggtgcctcatgactgtaatcccaccactttgggaggcagaggtgggtggattgctggaggtcaggagtttgagaccagcctggccaacatagcaaaaccctgtctctactaaaatacaaaaattagccagccgtg

SEQ ID NO: 51062 - DNA, 601 bp, Human
agtgttagtggagttaatgccctttgaggcgactttttacctatgcaactggagttgatccatttccccgttgactttcactggacagactttctacgtacttctcaaaagttttccacaagatcaagcccccaggtactcagtatggtaaagatagtatctttgtattggctttttctctttttcttggttcactgtcttcaaagtgtctctctcttttcctggggtcaccttccaataaactgcctgcacaccagttctgttcccaggctctgctttggacagaaccctagctaaaacratgacctggtactgtatttttaatacaggccttttcccccaagactgcctgtctctgaaattgtaaattcttaactgtcgtaggttccagctcttttcacttccttgtttccgtggtcccctctcctctcacctccctgttgtgatgtctggtcttttgactttttcctcttgttaactttttggtagcactgcaccttctttgccccccacccccacctttcctcttgcacctgccctgcacaccagggaatagatttagtgattccaaattggagtctgagggaccatgggaggtatt

SEQ ID NO: 51063 - DNA, 601 bp, Human
ccattgcccagcctggaatgcagtggtgtgatcatagcttactgcagcttccaactcctggactcatggccccttcccctggcccccacttccaccaagttttgctatgttgcccaggctaatttattttcttgtagagccaggatctctaggtgggcatgatggctcatacctgtagtcccagttacttgggaggctgagatgggaggattgcctgagcccaggaggttgaggctgcagtgagatgtgatcacaccactgcattccagcctaggcgacagagcaagaccctgtctccccmaaaaaaaaaaaaaaagagagagagagagacagggtcgaggctagtcttgaactctttgcctcaggcagtcctcttacctcagcccctcaaagtgctaagattgcaggcatgagcctaacagcaaagagttttgagcatggactttgtgccaagtatttctaggtgcaatagctataaataagatacacccaggccctattttcttggagcctagaatccatcagggaagacatgttaacaaatagttagaagtgaaatgagtgttacaaatatgcctgtataaattagggtgtccaatac

SEQ ID NO: 51064 - DNA, 601 bp, Human
tggaatgcagtggtgtgatcatagcttactgcagcttccaactcctggactcatggccccttcccctggcccccacttccaccaagttttgctatgttgcccaggctaatttattttcttgtagagccaggatctctaggtgggcatgatggctcatacctgtagtcccagttacttgggaggctgagatgggaggattgcctgagcccaggaggttgaggctgcagtgagatgtgatcacaccactgcattccagcctaggcgacagagcaagaccctgtctccccaaaaaaaaaaaaaaaagagagagagagagacagggtcgaggctagtcttgaactctttgcctcaggcagtcctcttacctcagcccctcaaagtgctaagattgcaggcatgagcctaacagcaaagagttttgagcatggactttgtgccaagtatttctaggtgcaatagctataaataagatacacccaggccctattttcttggagcctagaatccatcagggaagacatgttaacaaatagttagaagtgaaatgagtgttacaaatatgcctgtataaattagggtgtccaatacctggtgggctctc

SEQ ID NO: 51065 - DNA, 601 bp, Human
ggaatgcagtggtgtgatcatagcttactgcagcttccaactcctggactcatggccccttcccctggcccccacttccaccaagttttgctatgttgcccaggctaatttattttcttgtagagccaggatctctaggtgggcatgatggctcatacctgtagtcccagttacttgggaggctgagatgggaggattgcctgagcccaggaggttgaggctgcagtgagatgtgatcacaccactgcattccagcctaggcgacagagcaagaccctgtctccccaaaaaaaaaaaaaaragagagagagagagacagggtcgaggctagtcttgaactctttgcctcaggcagtcctcttacctcagcccctcaaagtgctaagattgcaggcatgagcctaacagcaaagagttttgagcatggactttgtgccaagtatttctaggtgcaatagctataaataagatacacccaggccctattttcttggagcctagaatccatcagggaagacatgttaacaaatagttagaagtgaaatgagtgttacaaatatgcctgtataaattagggtgtccaatacctggtgggctctca

SEQ ID NO: 51066 - DNA, 601 bp, Human
gaatatcttctctccacttttctccacacccatctcctatgtgccttcaggtctaactgaaacactgccatgtgcctgatgcctctgaacttgtccaggcagatttcagtgtcctcagtgcactgtgtccttgtttattactgaaaccatcatatcataataatttgtatttttgtccttgaactgaaagttccctgaagcagtgacccttgtatttcctgatatggctcaaaacctgacagagttgtctgaagaggaacctccagaaaggcagggggaaaccagtagagttcaagggagyagagtgtgttaaagaatggtgaatagtcttacatgttgctttgtgtaaattctttggtagtaaaccgatgtacttcttcaagtgcatattgtagtgagtcaaaaaatttgtgaatgaatgagtgatgaacgaatgaatgcagagagtaaggtaaggcctagaaagggttcttttgcaagagtaatttcacatatatggttgggcatggacatcagttacacagttatgtgccacataatgacttttcggtcagtgatggaccacatacacgacagtggtcccataagattataacggagc

SEQ ID NO: 51067 - DNA, 601 bp, Human
gggagtagagtgtgttaaagaatggtgaatagtcttacatgttgctttgtgtaaattctttggtagtaaaccgatgtacttcttcaagtgcatattgtagtgagtcaaaaaatttgtgaatgaatgagtgatgaacgaatgaatgcagagagtaaggtaaggcctagaaagggttcttttgcaagagtaatttcacatatatggttgggcatggacatcagttacacagttatgtgccacataatgacttttcggtcagtgatggaccacatacacgacagtggtcccataagattataayggagctgaaaaacacctgttgcctagtaatgtagtgtcatagtgcaacacattactcacatgtttgtggtgatgctggtgtaaacaaatcgaccatgctgccagtcttataaacgcatagcatctaaattacagtgcataatacttgataataaacaactatgttactgctttatatatttactgcactatattgttaatttttttttttttttttgagatggagtctagctctgtcgccaggctggagtgcagtggcgcaattttggcgcactgtaacctccatctcctgggttcaagt

SEQ ID NO: 51068 - DNA, 601 bp, Human
atcagttacacagttatgtgccacataatgacttttcggtcagtgatggaccacatacacgacagtggtcccataagattataacggagctgaaaaacacctgttgcctagtaatgtagtgtcatagtgcaacacattactcacatgtttgtggtgatgctggtgtaaacaaatcgaccatgctgccagtcttataaacgcatagcatctaaattacagtgcataatacttgataataaacaactatgttactgctttatatatttactgcactatattgttaatttttttttttttttttgagatggagtctagctctgtcgccaggctggagtgcagtggcgcaattttggcgcactgtaacctccatctcctgggttcaagtgattctcctgcctcagcctccagagtagctgggactacagatgcgcaccaccacgccaagctaatttttgtatttttttgtagagacggggtttcaccatgttggccaggatggtctccattacttgaccttgtgatctgcccatcttggcctcccaaagcgctgggattacaggcgtgagccaccgcccccagcctgttgttatttgagagagta

SEQ ID NO: 51069 - DNA, 601 bp, Human
ggagtccaggccccatgctcagggattgtggattttaagcctagggcatccaggtaaacccaatgcagttgttctctaggcccacttagagaagtgctgtcctgggagctttgtggcgtaggacttgggcacctgttccttccccttccatgcgcatgtgcagggggcacccagtaccggtagaagggaaggccagcagcattgaaagcgaggctccctggccctctgcctctcctttcctgtccgggtctctgtggcttgcttccctcaggccacttctaactgtggtctcctctccgcmccctggtcctgtagctcttctgtgttcttaattggagtcatcctctagcctttccctttccctgagagaaagcctcgccttttacagatatcactagccaatggcagtgcctctctgtttcttgccagtgccccgccagtcgccagtcgcaggatcgttgacatctgtcattaaactgtttccagctgctggccttgttctctcagctgttcttcaacactgaagccttgtttcgcctgcttccgggtttggagctcttccggaggcacaagggtttcagaaggttgactttttgccttg

SEQ ID NO: 51070 - DNA, 601 bp, Human
acttctaactgtggtctcctctccgccccctggtcctgtagctcttctgtgttcttaattggagtcatcctctagcctttccctttccctgagagaaagcctcgccttttacagatatcactagccaatggcagtgcctctctgtttcttgccagtgccccgccagtcgccagtcgcaggatcgttgacatctgtcattaaactgtttccagctgctggccttgttctctcagctgttcttcaacactgaagccttgtttcgcctgcttccgggtttggagctcttccggaggcacaaggstttcagaaggttgactttttgccttgtcaaggtttatagaaggaaaggacagtgacatttaaagtagtgtggctccgaatgttaggaatcattttctgttacctaataacttcatcttagtggtgattgtctgaattgtatgatatgttgacagatttctcaaagcagtctctagtgatcattaaacagcctgagttgtatcctgaagaaacatgtatctgtccatatatggaacaaatatttgttccattccctttgtgtggaaactgcctgcatgcttcattcatcacagtaatgcat

SEQ ID NO: 51071 - DNA, 601 bp, Human
tgtagctcttctgtgttcttaattggagtcatcctctagcctttccctttccctgagagaaagcctcgccttttacagatatcactagccaatggcagtgcctctctgtttcttgccagtgccccgccagtcgccagtcgcaggatcgttgacatctgtcattaaactgtttccagctgctggccttgttctctcagctgttcttcaacactgaagccttgtttcgcctgcttccgggtttggagctcttccggaggcacaagggtttcagaaggttgactttttgccttgtcaaggtttrtagaaggaaaggacagtgacatttaaagtagtgtggctccgaatgttaggaatcattttctgttacctaataacttcatcttagtggtgattgtctgaattgtatgatatgttgacagatttctcaaagcagtctctagtgatcattaaacagcctgagttgtatcctgaagaaacatgtatctgtccatatatggaacaaatatttgttccattccctttgtgtggaaactgcctgcatgcttcattcatcacagtaatgcatttcctcaggaacttttaatgtttcaggtgtctgttg

SEQ ID NO: 51072 - DNA, 601 bp, Human
ggaatcattttctgttacctaataacttcatcttagtggtgattgtctgaattgtatgatatgttgacagatttctcaaagcagtctctagtgatcattaaacagcctgagttgtatcctgaagaaacatgtatctgtccatatatggaacaaatatttgttccattccctttgtgtggaaactgcctgcatgcttcattcatcacagtaatgcatttcctcaggaacttttaatgtttcaggtgtctgttgtcatagctttggaatcgtgataacattatttgacttgcttagaattatrgtctaatggatttactacacactaaaccttttagacaggccttgaaaggtgaatttggtaggcatttcacacttctgtgacactcagattttgctggtctcttggatacagtcacaagtgatatgtaagcaaaactgcaagctcaggcataacagcctgctgggctgagcacgattgcagaagtgaatgacttttcacgttacgcttaactcttttctctcgggtgctcagagcacaacttaaagcattctctctgagccaggggaatagcatcctggaatgtaagcccttgaagatgga

SEQ ID NO: 51073 - DNA, 601 bp, Human
ttgattttcttaaaaaagagagataataggaaaacaagctcaaaaatctatttggggccttatgcaggatgttggccttagcctgaagaaataaaaactgatgaagcgcattgttagcagagggatgacttgatcaggtttttgaaaacgaatgttcagcattgaggtaactgaggcatctggatatgccggtctgggcccctgggagccgcaggagataatggagatagagattctatgggctgagaccattggtaggttttatggtgttgaggaatacttaacactgattttttttttkagcgctgttaattaaatgttaaaatataatcggtttgctttagagaaaggcacgaatggattctggggctctggtatggaagttattttcgcagtgtaggtgcaaggtgagggaaccagctagggaggggagatgggcgagggtctgtggagaggggctggagtgaaatggtttgagagccatcatgtttataaaagcaatagaaggtacggtggggtaatactttctatttaatgcatttttcattttatttctttataactaatataaggcacattttacatttcagatgaatttaca

SEQ ID NO: 51074 - DNA, 601 bp, Human; identical to SEQ ID NO: 24496

SEQ ID NO: 51075 - DNA, 601 bp, Human; identical to SEQ ID NO: 24497

SEQ ID NO: 51076 - DNA, 601 bp, Human; identical to SEQ ID NO: 24498

SEQ ID NO: 51077 - DNA, 601 bp, Human; identical to SEQ ID NO: 24499

SEQ ID NO: 51078 - DNA, 601 bp, Human; identical to SEQ ID NO: 24500

SEQ ID NO: 51079 - DNA, 601 bp, Human; identical to SEQ ID NO: 24501

SEQ ID NO: 51080 - DNA, 601 bp, Human; identical to SEQ ID NO: 24502

SEQ ID NO: 51081 - DNA, 601 bp, Human; identical to SEQ ID NO: 24503

SEQ ID NO: 51082 - DNA, 601 bp, Human; identical to SEQ ID NO: 24504

SEQ ID NO: 51083 - DNA, 601 bp, Human; identical to SEQ ID NO: 24505

SEQ ID NO: 51084 - DNA, 601 bp, Human; identical to SEQ ID NO: 24506

SEQ ID NO: 51085 - DNA, 601 bp, Human; identical to SEQ ID NO: 24507

SEQ ID NO: 51086 - DNA, 601 bp, Human; identical to SEQ ID NO: 24508

SEQ ID NO: 51087 - DNA, 601 bp, Human; identical to SEQ ID NO: 24509

SEQ ID NO: 51088 - DNA, 601 bp, Human; identical to SEQ ID NO: 24510

SEQ ID NO: 51089 - DNA, 601 bp, Human; identical to SEQ ID NO: 24511

SEQ ID NO: 51090 - DNA, 601 bp, Human; identical to SEQ ID NO: 24512

SEQ ID NO: 51091 - DNA, 601 bp, Human; identical to SEQ ID NO: 24513

SEQ ID NO: 51092 - DNA, 601 bp, Human; identical to SEQ ID NO: 24514

SEQ ID NO: 51093 - DNA, 601 bp, Human; identical to SEQ ID NO: 24515

SEQ ID NO: 51094 - DNA, 601 bp, Human; identical to SEQ ID NO: 24516

SEQ ID NO: 51095 - DNA, 601 bp, Human; identical to SEQ ID NO: 24517

SEQ ID NO: 51096 - DNA, 601 bp, Human; identical to SEQ ID NO: 24518

SEQ ID NO: 51097 - DNA, 601 bp, Human; identical to SEQ ID NO: 24519

SEQ ID NO: 51098 - DNA, 601 bp, Human; identical to SEQ ID NO: 24520

SEQ ID NO: 51099 - DNA, 601 bp, Human; identical to SEQ ID NO: 24521

SEQ ID NO: 51100 - DNA, 601 bp, Human; identical to SEQ ID NO: 24522

SEQ ID NO: 51101 - DNA, 601 bp, Human; identical to SEQ ID NO: 24523

SEQ ID NO: 51102 - DNA, 601 bp, Human; identical to SEQ ID NO: 24524

SEQ ID NO: 51103 - DNA, 601 bp, Human; identical to SEQ ID NO: 24525

SEQ ID NO: 51104 - DNA, 601 bp, Human; identical to SEQ ID NO: 24526

SEQ ID NO: 51105 - DNA, 601 bp, Human; identical to SEQ ID NO: 24527

SEQ ID NO: 51106 - DNA, 601 bp, Human; identical to SEQ ID NO: 24528

SEQ ID NO: 51107 - DNA, 601 bp, Human; identical to SEQ ID NO: 24529

SEQ ID NO: 51108 - DNA, 601 bp, Human; identical to SEQ ID NO: 24530

SEQ ID NO: 51109 - DNA, 601 bp, Human; identical to SEQ ID NO: 24531

SEQ ID NO: 51110 - DNA, 601 bp, Human; identical to SEQ ID NO: 24532

SEQ ID NO: 51111 - DNA, 601 bp, Human
ctgggtgctttaaaaataaaaagtggaaaatattttccttgggttgttagggtctttgcaaatgtgcatttgaacagtttttccagttgctatgcacaatgaaaatgtttcctgataggtgtatttgagttatgtcctgggacatactgctcttggaacttaaaacctctgcttagcttttaaactaatgccttatcaatggatgtcatctttgagggttttgtgtattgaaatgatggtgctctgtgcttgttgcacagaaattgagataacctgaattttttttttttttttttttgaracggagtctcgctttgtcgcccaggctggagtgcagtggcgcgatctcggctcactgcaatctccgcctcccggattcacgccattcttctgcctcagcctccagagtagctgggactacaggcacccgccaccacgcccggctaattttttttttttttttttgtatttttagtagagacaaggtttcaccatgttaaccaggatggtctcgatctcctgacctcgtgatccgcccacctcggcctcccaaagcgctgggattacaggcgtgagccaccgcgcccggcgataacctgaa

SEQ ID NO: 51112 - DNA, 601 bp, Human
ttttttttttttttttttgagacggagtctcgctttgtcgcccaggctggagtgcagtggcgcgatctcggctcactgcaatctccgcctcccggattcacgccattcttctgcctcagcctccagagtagctgggactacaggcacccgccaccacgcccggctaattttttttttttttttttgtatttttagtagagacaaggtttcaccatgttaaccaggatggtctcgatctcctgacctcgtgatccgcccacctcggcctcccaaagcgctgggattacaggcgtgagccacygcgcccggcgataacctgaattttttcatccacactggcctttcaaactttgagtagttgttttgcttaagtctcacaacttttaccagcattctaaagtctgaccaaaagttctcatcaattaaatatgcatttgcaaagttaagttgatttattagacattggaaagtggttggtgttgttagaactactgaaaaatacagactcaaatggttttttccactgcatgtctttgtttgaaggcagtctactgtagaatatattcggacttcctgacatatccatccatctctttgcata

SEQ ID NO: 51113 - DNA, 601 bp, Human
accaaatggcccagaaagctgaaaatatttaccatctggttctttgcagaaaaaatttgctgctctaggttgatagtcaacaaacacgaggagtaatcacagaataatcagagactgagaccttcctttatctgaaaatgtcagcgtctccctagaaaaagaaatctacagaactcttatatttctatgtacaggtgctgttatgatcatcacatcattacatagctctgcatagttttacgtcaaaataacctttgtattattttggaggagtaagagtcaaggagttgctggacacttyacattttgtcattataaaaaatatttcatagtccaaaattttttagttctttgggggagagaaactcattaaaatttttttttctgattttcttctgagctttaacatttctgtattccaggacacattacctttcatgcaagattgaactgtgtcctggttagagtgttgcgttttattttgtgcaagattggaaccatctagattactccttaaatggttgttataatgtcccaggtagcccatggttaactttgtatatctacctattcagtcatctctctgtgtttacttaattta

SEQ ID NO: 51114 - DNA, 601 bp, Human
acccttgggggaaaggtaaagaaataaatacatttatatatatatatcagacagatcgacctcattcttgccctttccccactaaacctctagatatttcttggtctgctcttcccttcatgtgtgagccattagcaagtgtgagctgggcttaggctattttgggatattcctctcaatgaacatggcccctgtttatttctcttttcattcatgttgaccagagtaagccatctttttaggtaaaacttttcttttttttcttttcttttttcttttcttttctcttctcttctcttctcttcccttttttggaaaagctttcccctctaggttttttttgttgtgtttttgtttttgagacagagtctcgctctgtcgcccaggctggagtgcagtggtgcaatctcggctcactgcagccgccacctcaggggttcaggtggttctcgtgtctcagcctccctagtagctgggattacaggcgtgccccaccacacccaggtactttttgtatttttaatagagacgggtttgctcttttggccaggctagtctcgaactcctggcctcaagtgatctccacaacttggcctcccaa

SEQ ID NO: 51115 - DNA, 601 bp, Human
taccttcagaataaaatatggggagaattctttatagagagcctaaaaatctgaaactggaatattttcatctgcttacacatattttttccataccaagcatgtgcacacccagtattttttatttcttaagaaaacaactttgtcttagtggttttgacatagaggaactaacatcagatagacaaaagcttctcatttaattgaaagataatattacttacagtatgagctagctgtatggtgaaataaactttctccatgtttggatccgcaggcctacaagactatgaaagaggaygaaaaaagatacaatgaaagaatttcagggttagggctgacaccagaacagaaacagaaaaaggccgcgttatctggtgagtattcccttaagtcttgctatgatttgagactcacaaagggaaagttataaacagtttgggtgctgtgatttatggatgtcttgtagaagcaatggtggtatgagattgcaagcatctagaaagtatggtattaccctagaactgggagtgatttaaagcatttggctgaaatttgggtttgagaataaagctagtgataattatgattggttgtttat

SEQ ID NO: 51116 - DNA, 601 bp, Human
atttgcctaaactcacatagctagtaagtggtagagagagaatttgagcccgggtctgtctgagccacagaattggaacccagatattctgattccagagcctaagctattaataacatcagtgtacagtgtacagtactttttttttttgagacagattctcactctgtcgcccaggctggagtacggtggcatgatctcagctcgctgcaacctctgcctcccaggttcaagcgattctcctgcctcagcctcccaagtagctgcatgcgccaccatgcctggctatttttttttttttgtctttttagtagagatggggttttaccatgtaggccaggttggtctcgaactcctgacctcaggtgatccacccacctcggcttcccaaagtgctgagattacaggcatgagccatcgtgtccagccagtattacttcttgatagaaaggtgatgagaagtagggaacacacttgaggcatgcttaggagtcatgcttgatgaggcttggtggttggttaaaggtagaagatgaaggagatggaggaggcaaagatgattttctaatttctagcctgcatgtctgagtggatggcagtg

SEQ ID NO: 51117 - DNA, 601 bp, Human
tagggaacacacttgaggcatgcttaggagtcatgcttgatgaggcttggtggttggttaaaggtagaagatgaaggagatggaggaggcaaagatgattttctaatttctagcctgcatgtctgagtggatggcagtgtacccacagctgagaaagacattacaagaggaagagctagtttaagggggaagataaaattcagttttggaccattaagtatgaagtggaatatctgcgtgaaggtgtcttctgggcagttggacatatgactgccacgcccaggggacttgggctcagatrgagagctgagaatcatctgcatatgtgtagaagttgaaaccatgagagtaggtgaagcctcccagggagaactgatctggtgagaagaggaggaaggcaaggatagagccctggggcaccccaatttttaggaagcaggcttaagaagaacccacaaaggagactaggaaagaacttaaagagcagtatgaggaaacctgaggacaggagccaaggttgtagggagtttcaagaaaaagaatgtgatccacagtgttaccgtggcagaggaatctgggaagaaaagaaccgtaaaatgca

SEQ ID NO: 51118 - DNA, 601 bp, Human
catgtctgagtggatggcagtgtacccacagctgagaaagacattacaagaggaagagctagtttaagggggaagataaaattcagttttggaccattaagtatgaagtggaatatctgcgtgaaggtgtcttctgggcagttggacatatgactgccacgcccaggggacttgggctcagatagagagctgagaatcatctgcatatgtgtagaagttgaaaccatgagagtaggtgaagcctcccagggagaactgatctggtgagaagaggaggaaggcaaggatagagccctggggmaccccaatttttaggaagcaggcttaagaagaacccacaaaggagactaggaaagaacttaaagagcagtatgaggaaacctgaggacaggagccaaggttgtagggagtttcaagaaaaagaatgtgatccacagtgttaccgtggcagaggaatctgggaagaaaagaaccgtaaaatgcactgtgagatttggcggttcagatacctttgggaggctgaggcaggtggatcacttgaggtctggagttagagaccagcctggccaacatggtgaaaacacatctctactaaaaatac

SEQ ID NO: 51119 - DNA, 601 bp, Human
tgggtaccagaaactgtggttcccatgattacttggatatggtttcttaaggatcgctttaggtcaagaactcattcttcttattgggctgacaactttttttgtttttgtttttgtttgtttttgttgttgtggttttggggtttttttgttttgttttgtttttgagacagaatcttgctctgttgcccaggctggagtgcagtggcatgatctcggctcactgcaacctctgcctcccaggttcaagcgattctcctgcctcagcctccccagtagctgggaccacaggcatatgccrccacacctggccaatttttgtatttttagtagagacggggtttcgccatgttggccaggctggtctcaaactcgtggcctcagtgatctgcctgcctcagcctcccaaagtgttgggattacaggcatgagtcactgtgcctgtcctgggctgacaacttcttattgacctggagttttggggtggtgatggaaatgttctgaaatcagatagtggtgatggtggcacaaccttgtgaatatactgaaatccacagaattccacactttaaaatggtgaatttgatgtgaattatatctc

SEQ ID NO: 51120 - DNA, 601 bp, Human
tgccagatgtcctcctggggaagatagggacaaaactgccaccaattgagaaccactgtttatagaaggaattttaccatgaagaaataaatttgcattaataacatagaagttataattgagtcactttatacaaggagaaaatttacttttgccaaagatttagaagaaactactttctagtattattatcctatgccccttttggaaattaatggactaaactgatgtgatcctgcagattggagactttagaagcttggagaagatttcacgggaagtcaaatcaattacgattatyggtgggggcttccttggtagcgaactggcctgtgctcttggcagaaagggtgagtattgaggagtgaccttgattttctttctctagtcttatatagcttttctgtgaatcccagagatgtgtttggcaggatcagtaggaagagtttaattaaggtttatttatttatttttttttgagatggagtctcgctctgtcacccaggctggagtgcagtggcgcgatctcggctcactgcaagctccgcttcccgggttcaggccattctcctgcctcagcctcccgagtagctgggactac

SEQ ID NO: 51121 - DNA, 601 bp, Human
ttaataacatagaagttataattgagtcactttatacaaggagaaaatttacttttgccaaagatttagaagaaactactttctagtattattatcctatgccccttttggaaattaatggactaaactgatgtgatcctgcagattggagactttagaagcttggagaagatttcacgggaagtcaaatcaattacgattatcggtgggggcttccttggtagcgaactggcctgtgctcttggcagaaagggtgagtattgaggagtgaccttgattttctttctctagtcttatatarcttttctgtgaatcccagagatgtgtttggcaggatcagtaggaagagtttaattaaggtttatttatttatttttttttgagatggagtctcgctctgtcacccaggctggagtgcagtggcgcgatctcggctcactgcaagctccgcttcccgggttcaggccattctcctgcctcagcctcccgagtagctgggactacaggcgcctgtaaccacgcctggctaattttttgtatttttagtagagatggggtttcaccgtgttagccaggactgtctcgatctcctgacctggtg

SEQ ID NO: 51122 - DNA, 601 bp, Human
tttctagtattattatcctatgccccttttggaaattaatggactaaactgatgtgatcctgcagattggagactttagaagcttggagaagatttcacgggaagtcaaatcaattacgattatcggtgggggcttccttggtagcgaactggcctgtgctcttggcagaaagggtgagtattgaggagtgaccttgattttctttctctagtcttatatagcttttctgtgaatcccagagatgtgtttggcaggatcagtaggaagagtttaattaaggtttatttatttatttttttytgagatggagtctcgctctgtcacccaggctggagtgcagtggcgcgatctcggctcactgcaagctccgcttcccgggttcaggccattctcctgcctcagcctcccgagtagctgggactacaggcgcctgtaaccacgcctggctaattttttgtatttttagtagagatggggtttcaccgtgttagccaggactgtctcgatctcctgacctggtgatccgcccaccttggcctcccaaagtgctgggattacaggcgtgagccaccacacccagcctaattaaggtttatatag

SEQ ID NO: 51123 - DNA, 601 bp, Human
gccttaggtgactgcatgggtggaagtgcacagagttcaccatctgaagcttaatctggggccagcagttctgatacctgttgtatttgcgttacaaatgaacttgagcaccgaggccctcatgcccactgtcctgtaagtgggcgctcggcctggattgcagctctgccctgtctgtagtgagggctgcctgctgctcctttacttctcttcctgtattcctaggattgacttttgcttcctgctgtaactactctgtttcttcttcccagctcgagccttgggcacagaagtgattcarctcttccccgagaaaggaaatatgggaaagatcctccccgaatacctcagcaactggaccatggaaaaagtcagacgaggtagagagactgtttctatatgctgccactctatttcctttgagtgtgacctaaggcaaacttcgcttctataggaacccccttgacataagccctatcacctggcctgtaaaatgtttccaccattctccagtcagctaagttcatctaggtgttctgaatcagatgccccaaattcctggaagtgctgaaaatgaaccatgggtgtaggttcttgcagc

SEQ ID NO: 51124 - DNA, 601 bp, Human
ggccaggcgtggtgactcatgcctgtaatcccagcactttggaaggctgaggcaggcacattgcttgagcccaggagttcaaaaccagcctgcgcaacatggcaacaccccatctctaccaaaaaaaaaaaaaaaatttagccaggcatggtggtgcattcctgtagtcccagctacttgggaggctgaggcgggaggatcatctgagcctggaggtccaggctgtggtgagccatgatcgcaccactgcactccagcccaggcaatagagtgagaccctgtctaaaagaaaaaaaaaaaatttaaatgggttatcagctgtttttgttagtttaagtacaactctggcctgtagatggaaaacatgaattagttaccattacaagtgttctttgagcccccaaagtttatattttgtctttaacttgctttttttttttttatcatgtgttcatgttatgtatttgtttccacaggcaggagatgctgcatgcttctacgatataaagttgggaaggaggcgggtagagcaccatgatcacgctgttgtgagtggaagattggctggagaaaatatgactggagctgctaagccgtactg

SEQ ID NO: 51125 - DNA, 601 bp, Human
aagcaactgcacaagacaaccccaaatctgccacagagcagtcaggtaagaaagtcctagcactcctcttggagagtgttgagaagcagtggtccagattctcctgaacaaggggtttctgtattggccagaggggcttgtcagtgaaagcctctcttcatgttgtgctttaaaagaaaccaaaccccaagtcctcactctttagtggtctgagatttggcaaaatcaggtatcctggtcaaagcatagattcaaatattgtgggtatctgtcctagacagtggacagtggctagctcaaygacactgctgttttgtgtgtctctgggaagacctttctaaggaagaaaacaagaaaacctgaactttttagattgcgtttttatttttctttctttcagttgtcatttttattattttgcttcaggcgaatctcaagaacacggcctgataggcttagcttaagactggctatcctccatgggtcctgcgcagggaggaactgggctgagtagttatttagctgcctcccattccatttggcagatcttagtgccaggttttctttagatgggaggcacctctcttggaatggacttctc

SEQ ID NO: 51126 - DNA, 601 bp, Human
ccatggtctaggccagacctcggactgtcacactggacttttctctctctcgcaaaggacgaagcccttggcagtcatctccaagcatggctttggcatgtattccttgaacaacttcaggctagccagagtgcgaggccaaatcttctcttatctagatcacgtgctagccgccaggctctgccatcttcccacagacatgctggtctctcgcctgccagcatggtcctgagattgcagcagctttacaagaagcagggtcaccatctccccactcccacacgccactctgagctccttyggaatctgccctcagaggactcctccatgagcagtgtcacaaggctttgtccccttgaaaatatcatcttccccaaaaaagcctgtattaagcacttatctgcacgtggtgttgtgctgagctctgtttctagtgagtcacactgtcacaggctctgccctctgggaaaaagtctggaatctttgccagagactgtaaagtccagtttggctaagtactggggtgttagaagagaaggaatagtttaaaaattccttcaaggccactgggtggtgactcttccactcgtgttcatctgtc

SEQ ID NO: 51127 - DNA, 601 bp, Human
cgccgggcgcggtggctcacgcctgtaatcccagcactttgggaggccgaggcaggtggatcacaaggtcaggagatcgagaccatcctggctaacgcggtgaaaccctgtctctactaaaaaatacaaaaaattagctgggcgtggtggtggacgcctgtagtcccagctactcgggaggctgagacaggagaatggcgtgaacctgggaggcggagcttgcagtgagtcgagatggcgccactgcactccagcctgggcgacagagcaagactctgtctcaaaaataaataaataaatwaattaattaattttaaaaaatcagacatggtctcgactcagtcacccaggttggagtgcagtggcatgatctcggctcattgcagcctcaacttccccagggctcaggtgatcctcccaccttggcctcccgagtagctgggactacaggcatgcaccaccacacccggctaatttttgtattttttgtagagatggggtttccccatgttgcccaggctggtctcaaattcctaggctcaagtgatctgcccacctgggcctcccaaagtgctgggactctaggtgtgagccaccacgc

SEQ ID NO: 51128 - DNA, 601 bp, Human
tttgttgcaggtgacacaactaaaaaaaaacaaaggtatttatggaattccactgagtggtaatggatgatgcagttcaaataactaaggtaagagaaataaaaccagaactgtgaggaggcttttgccagccaagtagtgtccttaaataaagctaacatcacatgctttcctgcttcatttcgtttctaagctgtaagagtagcttatttttttattattataaacattgtaattatcctttaagatacttcttaacctgattatgaatcagaatcacttgaagagctttttttttttwaaaaaaaagaccaaagtcaggctgggcatggtggatcacgcctgtaatcccagcactttgggaggccgaggcgggcagatcacttgaggtcaggagttcaagaccagcctggccaacatggtgaaaccccatctctaccaaaaatacaaaaattagccagatgtggtggcatgtgcctgtaatcccagctactcgggaggctgaagcaggaggatcccttgaacccaggagacagaggttgcagtgagctgagatcgcacactgcattccattctgggcaccaaagaatgaaactccttc

SEQ ID NO: 51129 - DNA, 601 bp, Human
aacacggcaaaaccctgtctctactaaaaatacaaaaattagccaggcgtggtggtgggtgcctgtaatcctagctagtcgggaggctgaggcaggagaattgcttgaacccgggtggtggaggttgcagtgagccaagatcataccattgcactgcagcctaggcgacagagtgagactccatctcagtcaatcaatcagtcaatcaatctatcttaccagagttcattctcaagtcacttactgagagaaaaggtacctggcagataaattttgactctttctggtatccgttttttgktgttgttgttgttgttgtttgtttgttttggagacggagtctcgctctgttgcccaggctggagtgcagtggcgcgatcttggctcactgcaagcttcgcctcccaggttcatgccattctcctgcctcagcctcctaagtagctgggactataggcgcctgtcaccacgcctggctaattttttgtatttttagtagagatggagtttcactgtgttagctgatctgccctccttggcctcccaaagtgctgggattacaggcgtgagccaccgtacccagcctctggtgtctgttttt

SEQ ID NO: 51130 - DNA, 601 bp, Human
ctgatctgccctccttggcctcccaaagtgctgggattacaggcgtgagccaccgtacccagcctctggtgtctgtttttaagaccctcatgttggagtgatggtttggttgactatagaattctaggttgcctattatttttcctcaaaactttgaagtcattgctccatttcttctgacatcccttgttgttcatgagaaatagaaagtttcatataggaaattaatttttcttcttttctggaagcttttatgttctatatagtctggaattccatagaggtgtacttggtgggcccyttaatagatctgcagactcatagctctccattttttggttcttttctgtcagcagctttctgatattgagcttcctgggttgttcatataatgttcttatctattctgtcctttttaaaaactctttgcttttggttgttttcctggagattgtcataactttatctcctaatctttttttctctctttttttttttttttttgagacagggtctcaccctgtggcccagactggagttcagtggtgccatcacagctcactgcagcctcgagctcccaggttcaagcaatcctcccacc

SEQ ID NO: 51131 - DNA, 601 bp, Human
aactttgaagtcattgctccatttcttctgacatcccttgttgttcatgagaaatagaaagtttcatataggaaattaatttttcttcttttctggaagcttttatgttctatatagtctggaattccatagaggtgtacttggtgggccccttaatagatctgcagactcatagctctccattttttggttcttttctgtcagcagctttctgatattgagcttcctgggttgttcatataatgttcttatctattctgtcctttttaaaaactctttgcttttggttgttttcctggarattgtcataactttatctcctaatctttttttctctctttttttttttttttttgagacagggtctcaccctgtggcccagactggagttcagtggtgccatcacagctcactgcagcctcgagctcccaggttcaagcaatcctcccacctcagctttccaagtagctggaactataggcatgcgctactacacccagctaattttttttatttttagtagtgacagggtctcactgtgttgccctggctggtctcaaactcctgagctcaagtgatccttctgcctctggggactaca

SEQ ID NO: 51132 - DNA, 601 bp, Human
cccgtggtcccagctattccagagcctgaagtgggaggattgcttgagcccaggagctcgaggctgcagtaagccatgtttgcaccactgcactccagcctgagtaacagaacaagaccctgtctcaaagaaaggaaaaaaaaattttaagtagttgattaaaagaggtctttagggtgggctctaatttgatgtgactggtgtccttgtaagaaaaggaaatttgtacacgcagacatcagaaacaaatacacagaggaatgaccaggtgaggatacagtaagatggtggccatctgcargccaaggagagaggtctcataggaaaccaaacttgctgacactttcatcttggacttctagcctgtacagctgtgagaaaataaatttctgttgttgaacccaccgagtctgtgatacttttatggcagccctaccaaatgaatatagacatttaagaaggcttggtgcattgcagcatttggtaaattattatgcatttcgttgtattgtgcatgtagtgccattactgagaatagcaggatggatgggaagcatcgagacaaagtaaaatacgagctggccactaacatatggtatga

SEQ ID NO: 51133 - DNA, 601 bp, Human
gttcttttccccttagcttatgaacatttaaattttgtcacttttataaatacatgcctatttgagaggtaagaaaagtaccatgttgctttaatttgcttttctttgttagcaaagatgaattttttcagttgtttatcattattttactttttatgaattgcctattcatagcttttatccatctttccatggttgtgtttgtacttactaatttgtaaatacctcatttaataaggttatttaaccttttgcctgtaacattttgcaaatgttttttctagcttgttttttggggttytttcttttggttggttggttggttggttggttggttgggttttttttttgagacagatcatcactctgttacccaggctggaatgcagtggtgccatctctgctcactgcaacctccaccttctggggtcaaatgattcttgtgtctcagcctcccaagtagctgggattacaggcgcacgccaccacgcccagctaatttttataatttttgtagagatggggtttcacgatgttggctagggtggtctcaaaactcctgacctcaagtgatttgcctccctcagcctcccaaagtgct

SEQ ID NO: 51134 - DNA, 601 bp, Human
aattttgtcacttttataaatacatgcctatttgagaggtaagaaaagtaccatgttgctttaatttgcttttctttgttagcaaagatgaattttttcagttgtttatcattattttactttttatgaattgcctattcatagcttttatccatctttccatggttgtgtttgtacttactaatttgtaaatacctcatttaataaggttatttaaccttttgcctgtaacattttgcaaatgttttttctagcttgttttttggggttttttcttttggttggttggttggttggttgkttggttgggttttttttttgagacagatcatcactctgttacccaggctggaatgcagtggtgccatctctgctcactgcaacctccaccttctggggtcaaatgattcttgtgtctcagcctcccaagtagctgggattacaggcgcacgccaccacgcccagctaatttttataatttttgtagagatggggtttcacgatgttggctagggtggtctcaaaactcctgacctcaagtgatttgcctccctcagcctcccaaagtgctgggattacagatgcagccaccatggccagc

SEQ ID NO: 51135 - DNA, 601 bp, Human
cacatattattgtattaatataatctcatagtgcaaatacttgttcattatttgttttaaataatgcctagactacactcacctatttgtatatgtgaactttttttaaaacattttattttttaataatttaagactcagaaagctgcagtagtacaggttcccaggtatgcttcacccaagggctttcaattagaacctttttttttttttttttttttgagatggagtctcgctctgtcaccaggctggagtgcagtggcgccatctcagcacactgcaacctctgactccctgattsgagcaattctcctgtctcagcctcccgagtagctggaattacaggcatacgccaccacacccagctaatttttgtatttttagtcaagacggtgtttcgccatgttggtcaggctgatctcaaactcctgacctcaggtgatctgcttgccttagcctcccaaagtgctgggattagagtggtgagccactgtgcccggcccctgaaatcaccttttctgtaatgctactttgttcaataaaaataacatattaatatcctttttaaaaatacatacaatatattgttattaactgtagt

SEQ ID NO: 51136 - DNA, 601 bp, Human
tgcagtagtacaggttcccaggtatgcttcacccaagggctttcaattagaacctttttttttttttttttttttgagatggagtctcgctctgtcaccaggctggagtgcagtggcgccatctcagcacactgcaacctctgactccctgattcgagcaattctcctgtctcagcctcccgagtagctggaattacaggcatacgccaccacacccagctaatttttgtatttttagtcaagacggtgtttcgccatgttggtcaggctgatctcaaactcctgacctcaggtgatctgyttgccttagcctcccaaagtgctgggattagagtggtgagccactgtgcccggcccctgaaatcaccttttctgtaatgctactttgttcaataaaaataacatattaatatcctttttaaaaatacatacaatatattgttattaactgtagtcaccatgatgtacaatagatctcttgaacttattcctcctaactgaattttgtgtcctttgttcagtatttccccaattcccctacccaccaacctctagtaaccaccattttactctctatttctatgaattcaactttttacat

SEQ ID NO: 51137 - DNA, 601 bp, Human
atttaatataattattgatactttggatttaaatttgccatttttgtttcattcattatttttgttcttctgtttcccctttcctgttttacagtgggttccttgaacattttttaatatttcattttgagtgtatctctttataaagttttttgtgtgattgctctaggaatatatatgtagataacttattacagtctattaatatcaactttttaccaccttaagtagaatgtagttagttttagtagaaggaatcttttagttccttctacctttcttcttctttttttttttttttgagacggagtcttgctctgtcatcaggttggagtgcagtggcgtgatctcagctcattgcaatctccacctcccgggttcaagccattctcctgcctcagcccctccgagtagctgggattacaggtgcatgccaccacacccagctaatttttgtatttttagtagagatgaggtttcaccatgttggccaggatggtctcgatttcctgacctcgtgatctgccggcctcagcctcccaaagtgctgggattacaggcatgagccattgtgcctggcacaccttccttctttatggta

SEQ ID NO: 51138 - DNA, 601 bp, Human
aatattacctctacatacaaggagaaccacttcagggactgctataatttttactttcaaccatcaaacataatctttaaaactcaagagaagaattgcttaattagtgtatgtatgtgtgtctgtatatgaataaacatatatatatgcataacatatatatggatatatgcatatatagacacacacacaccctttccattgctttttctttacttctatttgaggttttcttctgttatcatttacttcctttctgatagagtttctttagccattcttttcaaagctgatctgttgrtgacacatttttagttttgttcatctgccagtatttgtatttcatttttatttctgaaggatattttcactgtctatagaattttagcttgatagttattttctttcagcatttgaaaaatattgtatccatccttgtggtttccatggttcctgatgaaaaatctgttgtctttcaaattgttattctcctatgagtgatatgttgtttctctctaattgatttcaggacttttctttagtttttagaagtttgattctgtaagtttatatctaaatctgaggctgagtgtggtggctc

SEQ ID NO: 51139 - DNA, 601 bp, Human
tatgaaattcaaatttcagcgttttattagaatatgccatgttcatttgtttatatattgtctgtggctgccttcatggtacgacagcagagttgagtagttgaagcagagacttaattgccagccctttttccagatgatttgtaaatcctagaagtgaaaccattgtccctttcttgtcctgctttagtgatactgatatttcaagatacataattttcttgggtgaaagtttcttttgtttctggtttctaggtatttgtgagatatttctctcacaaaacgtgttcttttcttctgktttttttttgggggttttttttgtttctttggttttttgagacagtctcgctctgtcacccaggctggagttcagtggcgcgatctcaactcactgcaacctctgcctcctgggttcaagcagttctcctgcctcggcctccctagtagctgggattacaggtgcctgcaatcacgccaggctaatttttgtatttttagtagagatggggtttcaccatgttggccaggctggtcttgaactcctgacctcaggtgatctgccctccttggcctcccaaagtgctgggattacaggcat

SEQ ID NO: 51140 - DNA, 601 bp, Human
caaatttcagcgttttattagaatatgccatgttcatttgtttatatattgtctgtggctgccttcatggtacgacagcagagttgagtagttgaagcagagacttaattgccagccctttttccagatgatttgtaaatcctagaagtgaaaccattgtccctttcttgtcctgctttagtgatactgatatttcaagatacataattttcttgggtgaaagtttcttttgtttctggtttctaggtatttgtgagatatttctctcacaaaacgtgttcttttcttctgtttttttttkgggggttttttttgtttctttggttttttgagacagtctcgctctgtcacccaggctggagttcagtggcgcgatctcaactcactgcaacctctgcctcctgggttcaagcagttctcctgcctcggcctccctagtagctgggattacaggtgcctgcaatcacgccaggctaatttttgtatttttagtagagatggggtttcaccatgttggccaggctggtcttgaactcctgacctcaggtgatctgccctccttggcctcccaaagtgctgggattacaggcatgagccacta

SEQ ID NO: 51141 - DNA, 601 bp, Human
ttttaagattttgcagttaaagttattttcttttttgtgtgctttgtcagattttgacatcagtgttatactagtattttcatggcttattttattccattcttttattttcaacttttctatatccttaagcttaaaaatgtctcttttaaacagcatataattgagggcttttattattaggctttataatttttgtattttaattggaacatttagtttgtttaatatagttaatatattctttgctttctattttcctcaaagatttgaatagaacaaaaggctgacctcccccaarcaagagggaattctctggcagtctgcctttgcacttgaaatgcaactcctccctgaatctccagcctgccagcctcttctattatgagtcaattccttaaaataattctatatgatatatatttaatataattaatatataatgtggctactacctagtagaattaatgtatacttaatatgacatataatataattacagtagtaccttcttatctgggggaagcattatattccaagacccccagtggatgcctaaaaccacagatatatattttcctatacatacatagctgtgata

SEQ ID NO: 51142 - DNA, 601 bp, Human
tcctttctctaaaagaggatgcagattatttggttgatgtttactcttcttgatatcctgcaacttaaattctaaagtttaagaaaaagttaatacttaagtattatgatcagctgttaatctaattttttttgacgaaaatattttcgtatccattttctattgctgcctagcaaaacatccccaaatttaatattttaaagcaacaaccatcaaaaattggctcacaattctgtgaatatcaatcaatgctgggtagctgtttggttcctctactggtcttttttttttttttttttttagacagggtctcactctgccacccaggctggagtgcagtggcatgatctcggctcactgtaacctccgcctcccaggctcaagcaattgtcctgtctcaaccttctgagtagctgggattacagacacacaccactaccacctggctaatttttttatttttagtagatatagggtttcaccatgttggccaggctggtctcgaactcctcacctcaaatgatccacctgcctcggcctcccaaagtgctgggattacaggcgtgagccaccatgcctggcccctctgctggtcttgatt

SEQ ID NO: 51143 - DNA, 601 bp, Human
aattatttggttttcagaaatttcactattgtgtatctagacacagatttcctttttatttatctgtttggggggtgtttagggcttcttggatctgtggtttgatgtttttcctcagttttggagaattttcagccttcgtctgttcttcgaatatttcttctgttccatttctccctttccgcttttctgaaactgaaattacatgtaggttagatcatttcattgtatcctttatacctcttaccttctctttggtatttttttataaatctttttgcttctctctgcttcattctakatacttccttttgacctatttaccagctcactaattctctcttcaggtatattttacctgttcttaaatttatccattaagatctttttttcagatctgctattacatttttataccattcttgactaaaattcttaatgctacaggactgttcttcttgtctgtttcttactgattctcatgttgcctttttatggactagacactgtagttttaaaattatttatagaaatgacctgagacctatgatatatttttcaagagaggatttacgtttgtttctagctttgcctaggagtc

SEQ ID NO: 51144 - DNA, 601 bp, Human
gaaagagtaggccgggcatggtggctcacacctgtaatcccagcactttgggaggctgaggcaggcggatcacaaggtcaggagtttgacaccagcctgaccaacatggtgaaaccccatctctactaaaattacaaaaattagccgggcgtggtggcgcatgcctgtaatcccagctacttgggaggctgaggcaggagaatcgcttgaacccgggaggcagaggttgcagtgagccgagatcacgccactgcactccagcctgggcaacagagcgagactccttctcagaaaaaaaaawaataataataataaaataaataaaagaaagagtaaatgaatcaaaatgaagagaagccattttatctgcctcctggatgaagagtttcattgatgaacctgaaatgttttggttaacatgagaaaggagggtgagaagatgcctgagatgtgagctccttgaggacaggagctgctttctctctccagcctggcacaagacaaggaacttagttgaatgaatgagcaaataagtggttctctgctttgaaggaacttggactgtcattaccttgcaaatcaggtttaccagttatttgct

SEQ ID NO: 51145 - DNA, 601 bp, Human
gggtcatctgactttgcttttgtgctctacattcaccctgctcataaaaggtcctttcatgagttttctaggctttcatcactgccagcgtctccacaggcattgtgaaagtattaaacttcctaccctcccccatgcttgtctcatggactctttcgtagagtgcacagtggactgtgtttagctcagcaggaactctttgcaaacactgaatacatgaacaacccccctggaaagataagagatttcagtattgcttggtgtcatagccgcagaagttagtgtctgccagtatctgatraatatggtgacttgcagcctaatttttgtgaaattatgaggccaaagtttaagaagtgttcatgttaaagttacttatatataaaatttgcctatcgataatttctgtcaataggaggttgatgaatgcttcacataacctagatactcctaattaactgttttttatttctttttttctaggacacatgttcaaagagcataattaactttttaaaagaagctagtaagtactgaaatagttttttaagttttttctacaagaatagaggaagaaaggaaacatggaattctgaagggc

SEQ ID NO: 51146 - DNA, 601 bp, Human
ccattagtgcttagagcattttttcagaaaagaatcctggaaaaatggatcttatctcacctgggccctcaggactgctgggctgcctggtgtcagcacttcccgccattttctatagcaccagtattattcttaatactttaaaaaaccaccaggcacggtggctcacgcctggaatcccagcactttgggaggccaaggtgggcggatcacaaggtcaggagatcaagaccatcctggctaacacggtgaaaccctgtctgtactaaaaatagaaaaaaattagctgggcgtggtggcrtgcacctgtagtcccagctgctggggaggctgaggcaggagaatggcgtgaacccgggaggcggagcttgcagtgagccgagattgcaccactgcactccagcctgggtgacagagcgagactccgtctcaaaaaaaaaaagtaaataaaaataaaaaaccatatcccactatctcccccttctctctttgcctgtgatcttgctgcatacttatggggaaatctttaagatgtcagatttcagttctctcacttttctacaacttctcccacttttgcctttcttatgtaccttccctt

SEQ ID NO: 51147 - DNA, 601 bp, Human
cattagtgcttagagcattttttcagaaaagaatcctggaaaaatggatcttatctcacctgggccctcaggactgctgggctgcctggtgtcagcacttcccgccattttctatagcaccagtattattcttaatactttaaaaaaccaccaggcacggtggctcacgcctggaatcccagcactttgggaggccaaggtgggcggatcacaaggtcaggagatcaagaccatcctggctaacacggtgaaaccctgtctgtactaaaaatagaaaaaaattagctgggcgtggtggcakgcacctgtagtcccagctgctggggaggctgaggcaggagaatggcgtgaacccgggaggcggagcttgcagtgagccgagattgcaccactgcactccagcctgggtgacagagcgagactccgtctcaaaaaaaaaaagtaaataaaaataaaaaaccatatcccactatctcccccttctctctttgcctgtgatcttgctgcatacttatggggaaatctttaagatgtcagatttcagttctctcacttttctacaacttctcccacttttgcctttcttatgtaccttcccttc

SEQ ID NO: 51148 - DNA, 601 bp, Human
ctgtaaattatctgtttaggtccttcagatttttcaaaattggactgttatgttttcagtattgttatgagttcttgtttcaattatttatgacagttcattttcttttttaaaatagactttttttttcttagagaaataagaaaaaataaaaattaaaatagactttgtgttttagagagtttcaggttcacagcaaaattgatcaaaaagtatggagagttccggccaggcgcggtggctcacacctgtaatcccagcactttggaaggccaaggtgggcagatcacaaggtcaggartttaagaccagcctggccaatatgatgaaaccccatgtctactaacaatacacaaattagctgggtgtggtggtgcacacctgtaactgtacctactcaggaggctgaggcagaagaatctcttgaacctgggaggtggaggttacagtgagccacagtcatgcccctgcactccagcctgggcaacagagtgagactccgtcctaaaaaaagaaagaaagaaaatatagagcattcctaaataccacctgtccccaacacctgcacagcctcctcattatccacatcctacaccactgt

SEQ ID NO: 51149 - DNA, 601 bp, Human
actcctcactgaagcgtcgacctcccaggctcaagtgatcctcccacctcagcctcctaaatagctgagactacacacacacaccaccatgcccagctaagttttgtattttttatagaaatgtggtcttgctgtgttgtccaggctggtcttgaactcctgagctcaagcaatttgcctgccttggcctctcaaggtgttgggattacaggcatgagtcaccgcacctggccttttttattttctttttttttttttaaccagtgatcttttactgtctccatggtttttcacattggcytctgtcacttagtaatatatgtttaagtttcttctacgtattttcatgtttttagcttatttctttttagcagtgagtaatatttcattgtctggatgtgccatcacttatttatccattcgcctgctgaaggatatcttgattgctcccagtcgtggcaattataaataaagttgctgtaaacatccatgtgcaggttttttttaagtggcataagttttcatctcatttggttaaataccaaggagcacaattgctggatcatatggtaagagcttatttatttttttgagagactac

SEQ ID NO: 51150 - DNA, 601 bp, Human
atcctcccacctcagcctcctaaatagctgagactacacacacacaccaccatgcccagctaagttttgtattttttatagaaatgtggtcttgctgtgttgtccaggctggtcttgaactcctgagctcaagcaatttgcctgccttggcctctcaaggtgttgggattacaggcatgagtcaccgcacctggccttttttattttctttttttttttttaaccagtgatcttttactgtctccatggtttttcacattggcttctgtcacttagtaatatatgtttaagtttcttctaygtattttcatgtttttagcttatttctttttagcagtgagtaatatttcattgtctggatgtgccatcacttatttatccattcgcctgctgaaggatatcttgattgctcccagtcgtggcaattataaataaagttgctgtaaacatccatgtgcaggttttttttaagtggcataagttttcatctcatttggttaaataccaaggagcacaattgctggatcatatggtaagagcttatttatttttttgagagactaccaagctgccttccaaagtggatgtaccattttgcatt

SEQ ID NO: 51151 - DNA, 601 bp, Human
cgtggcaattataaataaagttgctgtaaacatccatgtgcaggttttttttaagtggcataagttttcatctcatttggttaaataccaaggagcacaattgctggatcatatggtaagagcttatttatttttttgagagactaccaagctgccttccaaagtggatgtaccattttgcattcccaccagcagtgaatgagagttcctactgctccatattcttacaaacatgtagtattgtcaaatgttttggattttaaaaccaaaatccattttcatagatgtgtagtggtatccmgttttaatttgcaattacctaatgacttgatgttctgtgtcttttcagatgcttatttgccgtactgtttatcttctttggtgaggtgtctattcaggtcttttgcccatttttaatctggttgttatttttcttgttgagtttaagaattctctgtcctttgtcagatctatcttttgcaaatattttctcctagtctgtggcttatcctctgattctcttggcattgtctttcacagagtagacattttatattttaatgaagtccagactatcaattatgttctcatggatcatgcc

SEQ ID NO: 51152 - DNA, 601 bp, Human
gagcacaattgctggatcatatggtaagagcttatttatttttttgagagactaccaagctgccttccaaagtggatgtaccattttgcattcccaccagcagtgaatgagagttcctactgctccatattcttacaaacatgtagtattgtcaaatgttttggattttaaaaccaaaatccattttcatagatgtgtagtggtatcccgttttaatttgcaattacctaatgacttgatgttctgtgtcttttcagatgcttatttgccgtactgtttatcttctttggtgaggtgtctmttcaggtcttttgcccatttttaatctggttgttatttttcttgttgagtttaagaattctctgtcctttgtcagatctatcttttgcaaatattttctcctagtctgtggcttatcctctgattctcttggcattgtctttcacagagtagacattttatattttaatgaagtccagactatcaattatgttctcatggatcatgcctttgatgttatatctaaaaagttctcgccatacccaaagtcatctagattttctcctgttatcttcttggcattttatagtcttatgattga

SEQ ID NO: 51153 - DNA, 601 bp, Human
tttagagccttgatcttgcatttctgaaaattttctcccatttctttgaaaccttctccccctcttccttttttttttttctcaaattcttaatatttggatattggatgtatcctgaattaattctttaatctttaaaatttttcctttctgttgatctttgctttgagtctttttctccttttaaaaataaacaaaggccagctaggcacagtggcttatatctgtaattccagcactttgggaggctgaagcaggaggatcgcttaagcccgggagtttgagaccagcctaagcatcrcagcaaaacctcatctctacaaatgatttagaaattagcagggcctaatggctcatgcctgtggtcccagctactcagggctgaggcaggaggattacttgaggcctggcagttgaggctgctgcagtgagctgtgatcgcaccaccgtactccagtctgggcaacagagggagacctcatctcaaaaataaataggcctggtgtggtggctcactcctgtaatcccagcactttgggaggccaaggcaggtggatcacttgaagccaggagctcaagaccagcctagccgacatggcaa

SEQ ID NO: 51154 - DNA, 601 bp, Human
actaaaaaatacaaaaaaaaattagctgggcgtggtggcaggtgcctgtagtcccagctactctggaggctgaggcaggagaatggcgtgaacccaggaggtggagcttgcagtgagccgagattgcgccactacactccagcctgggcaacagagcaagactctctctctaaataaataataaataaataaataaataactccttttacaaaagcatatatattcattttttccatttataatataaataatagatatgctgagttgatttctgcatattgctttttcagttaccctatyatacttgctctttgttttagtaaagagctgctgtattgaaggatataccttaatctctttatccagtttccccatcagtggacactaagattgttttcagagtactcttataaacaatacagtttgtcatttcagacacatatgagaatattagcaggatgaattattttaagtctgcatttataaatttatggatattgccacatttacctctgctaggaagtctattcctattaacaatatgtcaaagtgcctatttttctaaactctcttcagtgtggtgaattgttaaacttgggg

SEQ ID NO: 51155 - DNA, 601 bp, Human
agtagctgggattacaggtgtgttccaccatgcccagctaattttttgtatttttttgtagagatggggtttcgccatgttgcccaggctggtcttgaactcctgggctcacatgattctcctgtcttagcctcccaaagtgctaggattacaggtgtgagccaccacatctggccatttcattcatgttttcaaatgtatttgaatgaggaaaagttctcccttgtgattatttattataatagcctacagagctattaatttttaaattttgtttactttatgtctcctttttttttttgtttaggctgaataaccatttatttcataggtttattgccttttttcttccaaagaacttgctattgtgcatttatagtccttttatgtttacgttttctatttcattgatttttactttctaccttctttagatttattttgttctttttctatcttcttgaattgagtgtgctttaattgcattctttccagttaattaacatatttagtgctgtgaattttgaacaagcacagctttagccacatcccataggtgtttctataggcagttgtattaggatgcgctataagctgctct

SEQ ID NO: 51156 - DNA, 601 bp, Human
cccaaagtgctgggattaaagacgtgagccactgtgcccagcccattttggttttgatttttttttttctttgaaatagagtctcgctctgttacctaggctggagtacagtggcatgatctcggctcactgcaacctccccctcctgggttcaagtgattctcgtgcctcagcctcccaagtagctgggattataggcacccaccaccacgcccagctaatttgttttgtatttttagtagagacggggttttaccatgttggccaggctggtctcgaactcctgacctcaggtgatccrctgcacccggcctcattttggttttgatttttattttcaaatgttttcttactttgtcaatttctaattttattgcattgggacaaaagaatattgtactctttctactgttggggtttataagggctgtggatatttcactcgcctttgaaaagaaggttttctctgttagtctgtagagtttggtatgtaccaattagattttattacttatcattttggtcttttgtatccttacttaattttgtcctcttgaattttaatggagcaaaagacataaagtcctctaataacatgcgt

SEQ ID NO: 51157 - DNA, 601 bp, Human
ttttgttgtactctaattgaattgtaatgtgtttctttaacctgaatgaatgtttctattttttacttattacacaggtaattctgactcgaaggacagaagaggtgagctgctcaccttatatctgttgttccttttacacagtgtacagtattcatttatttcctctgctcacagtctgtggtaaccgtgtgcatctgtggctgtgttgtttgtttactttcccttaagttatttccatgttaatctcatggagaagagcaatagaaacaagtactgtattcagtatgttttttaatayagactatggattctaacagctatgatgtattttaacaagtaacaaaatatatcttactttgacatgtcactttgttaacattactttttggtgatattaggtcataatttctataccattagttacttctgatttctaggccacagttccctttaaatattctttgtgttgtttttcccctagtgtataaaatgtcaaccctttgtggctttatatggattttatggattttcagcccttaaatgtaaagtctctatggcctgagatgttgtgtctgtggtttaagctggactgctgagt

SEQ ID NO: 51158 - DNA, 601 bp, Human
ccaaagccaatctcttcccttcatgtcagacactttgcaaatgttacctcttttagatctcccattaactctaaaaggtggagggtgctattatgcttccatttcatacattgttctaagagattatcacactactagtaagttaggatagtaggaatttgaacttcaggtctgtcagaccctaaaaccccatgccctggaaatggttttctaaggctggcctgtggttcgttggttgatttcaattagaatttaagaattttttcagaatacatctaggtgtaaagatttttttgtcaayattactccacaaactagattatttcttttggcctgataactcaggaactttcttgtattacttctctcccttcttactggtttcttctttggactctcctgttgcacaggtattggatctcctggacctatccagttcctttcttttctatgctgtcatatttttcatctcttattgctctgtgttctgggagcttccaggacagttgctctttcacacaactaatttggttttcagttatatcagttctcctatttagcctttctttttttggaggcagggctggggcagactcatgct

SEQ ID NO: 51159 - DNA, 601 bp, Human
aagaattttttcagaatacatctaggtgtaaagatttttttgtcaatattactccacaaactagattatttcttttggcctgataactcaggaactttcttgtattacttctctcccttcttactggtttcttctttggactctcctgttgcacaggtattggatctcctggacctatccagttcctttcttttctatgctgtcatatttttcatctcttattgctctgtgttctgggagcttccaggacagttgctctttcacacaactaatttggttttcagttatatcagttctcctrtttagcctttctttttttggaggcagggctggggcagactcatgctctgtcgcccaggctggagtgcagtggcctgatcacagctcactgcagccttgacctctgggactcaagcgatcctccagcctcagcctcccgggtagctgggactataggcatatgccaccatgcccagctaatcaggtgtttgtttgtttgtttggtagagacagactaccagagtctcgctaagttgcccaggctggtctcaaactcctggcctcaagcagtcctcccaccctggcctcccaaagtgttggg

SEQ ID NO: 51160 - DNA, 601 bp, Human
gaggatcgctcgaaccaggaggccgttgcagtgaaccaagatcacgccagtgcacttcagcctgggtgacggagtgagactccgtctcgagaaaagaaaaaaaaacgcaatgcagcagtggctcacgcacataatcatagcattttgggaggccaaggcaagaagatcacttgagaccaagagttcaagaccagcctgggcaacaacaagaccccctccccccatctctacaaaaaatttaagaaaaaaaatttttttaaatcaatatggcatcctgttgcacaaattgcagtatattttraaagatttattctgtttcttttgtcacctccatttcccagggctactgttgctctgtttgagctatgccctggaccattgagtggcttagactgtgctcacaataggtgtcccttcatcccttcagaagacaaacatggacatacgtcctaaaccaggaaggggttcagtgatggctcaggaaaatcggggcagggtgcagttatcctctaggcgagctgccgttttctttttcctttcctctcttgtggttgcctagaattagcttgggcactactatggtttttttctgtctgcaggc

SEQ ID NO: 51161 - DNA, 601 bp, Human
caggccccaggagaccttctgtggacccaatatacttaacaatcatatgcagtgtagacctgctctggtgtcaattctaaccaaaacaaaaaaaaagcatttatgagacactcagggaaattcaagcagtaactgaataatattagatgatactaaggaattagtgttactttttaaattggataatagtattatgtttatgttaagaatcttgatctcttggtgatacatacctaagtaattgcatttgaaatgctaggtctcggatttgccttaaaagaattcagttagaatggcgtgrgtatagaccagtggttccttactgggggctatttcccccacaaaggcatttagcaatgcttggagatacttttggtcatcaaaattgggaatttgctacagacatctaataattagaggctagggatattgttaaatgtcctacagtgcacatgacagacccacataacagagaattgtatagcccaaaatgtcattagtgtgacgttgagaaaatatatatgcagcatatgttttgtaaaaaagaagcccttaccagtctctgtgacaaactctctactctgtgtagagcactgttttt

SEQ ID NO: 51162 - DNA, 601 bp, Human
ttatgagacactcagggaaattcaagcagtaactgaataatattagatgatactaaggaattagtgttactttttaaattggataatagtattatgtttatgttaagaatcttgatctcttggtgatacatacctaagtaattgcatttgaaatgctaggtctcggatttgccttaaaagaattcagttagaatggcgtgggtatagaccagtggttccttactgggggctatttcccccacaaaggcatttagcaatgcttggagatacttttggtcatcaaaattgggaatttgctacwgacatctaataattagaggctagggatattgttaaatgtcctacagtgcacatgacagacccacataacagagaattgtatagcccaaaatgtcattagtgtgacgttgagaaaatatatatgcagcatatgttttgtaaaaaagaagcccttaccagtctctgtgacaaactctctactctgtgtagagcactgtttttccagctgagtctagatgggaagccccgcttgtcatttgggctgtgggtgtactggtgctgggttggcaggcctttgcttaagtaccatcctggtacctca

SEQ ID NO: 51163 - DNA, 601 bp, Human
ggctatttcccccacaaaggcatttagcaatgcttggagatacttttggtcatcaaaattgggaatttgctacagacatctaataattagaggctagggatattgttaaatgtcctacagtgcacatgacagacccacataacagagaattgtatagcccaaaatgtcattagtgtgacgttgagaaaatatatatgcagcatatgttttgtaaaaaagaagcccttaccagtctctgtgacaaactctctactctgtgtagagcactgtttttccagctgagtctagatgggaagccccrcttgtcatttgggctgtgggtgtactggtgctgggttggcaggcctttgcttaagtaccatcctggtacctcaaggtccactttcaaccccagtcccaattccctctgagcttgaggtgtttccaggcccaaactggtagaactagtacttagttttcagctggaggctctttggctctgtttgatctcttggacatcgagtctggtctgttttgtcttccagaaatctctcaaagattctgatctacatatgccaccgtttgctgcctttcagatatgctgttgattcattagtatttt

SEQ ID NO: 51164 - DNA, 601 bp, Human
ccaggcccaaactggtagaactagtacttagttttcagctggaggctctttggctctgtttgatctcttggacatcgagtctggtctgttttgtcttccagaaatctctcaaagattctgatctacatatgccaccgtttgctgcctttcagatatgctgttgattcattagtatttttatatttcttctaccatgtcagtgtgctttgggggaagatgaagtaaattcatggatttagcccagtgtcttaagccaaaggtgcctaattactttcttcttcttctttttttttttttttttgaggcagagtctcgctccgtcacccaggctggagtgcagtggcacgatcttggctcactgaaacctccgcctcctgggtacaagcgattctcctgcctcagcctcctgagtagctgggaccagaggggtgtgccaccacacccgctaattttgtatttttagcagagacggggtttcaccatattggccaggctggtcttgaactcctgaccttgtgatccacccgcctcggcctcccaaagtgctgggatgtgcctaattactttcttataatacctgatatactgccccctgttgttg

SEQ ID NO: 51165 - DNA, 601 bp, Human
gatctcttggacatcgagtctggtctgttttgtcttccagaaatctctcaaagattctgatctacatatgccaccgtttgctgcctttcagatatgctgttgattcattagtatttttatatttcttctaccatgtcagtgtgctttgggggaagatgaagtaaattcatggatttagcccagtgtcttaagccaaaggtgcctaattactttcttcttcttctttttttttttttttttgaggcagagtctcgctccgtcacccaggctggagtgcagtggcacgatcttggctcactgmaacctccgcctcctgggtacaagcgattctcctgcctcagcctcctgagtagctgggaccagaggggtgtgccaccacacccgctaattttgtatttttagcagagacggggtttcaccatattggccaggctggtcttgaactcctgaccttgtgatccacccgcctcggcctcccaaagtgctgggatgtgcctaattactttcttataatacctgatatactgccccctgttgttggaatttaacaaagacatttagtgataaattactatttttttttgttctttggctcaacgta

SEQ ID NO: 51166 - DNA, 601 bp, Human
attcattagtatttttatatttcttctaccatgtcagtgtgctttgggggaagatgaagtaaattcatggatttagcccagtgtcttaagccaaaggtgcctaattactttcttcttcttctttttttttttttttttgaggcagagtctcgctccgtcacccaggctggagtgcagtggcacgatcttggctcactgaaacctccgcctcctgggtacaagcgattctcctgcctcagcctcctgagtagctgggaccagaggggtgtgccaccacacccgctaattttgtatttttagyagagacggggtttcaccatattggccaggctggtcttgaactcctgaccttgtgatccacccgcctcggcctcccaaagtgctgggatgtgcctaattactttcttataatacctgatatactgccccctgttgttggaatttaacaaagacatttagtgataaattactatttttttttgttctttggctcaacgtaatccattgtttgttttgtgcctgttatgtgtgagaccctgtgctaggttttaggtgtacagtgagaatgaagcagacatgtaatccttgctcttgtggaatt

SEQ ID NO: 51167 - DNA, 601 bp, Human
aataaaaaaaatgcaaaaaaaaaaaaaaaaaaggcagacagatttgaagttttagatatatctccaaaatatattatttgcagctgtgctagatatagaagataagtgtgaggaagaaatcaagggggtttccacatttcttacttgagcaacagggtgggttggagtactagctactgaatggtgagggaaaggttttaaacacagaaagcttgtgttgcctatgaaatttaaagtggaggtggcaaataggcagttgagaatctggaactcagaaaagaggtctgatcaagcaaagcamctgtgggaattgctagcatggcatttatatttacagtcatctctctgatcagattaactagatatagagaagagtgccaaggacagagccctgaggaattcccacatttagagatctggtgttggaagaggaacagatagtgagggaaactgagatgggcagacgagatagaaggaaaatcagaggagtgtttcgttgtggaaagctaagagaggaaagtgcttcagagaggaaggagtgatcagccagtctgaacactcattttaaggtgagagccacataccacagtatgtttgaaac

SEQ ID NO: 51168 - DNA, 601 bp, Human
tcagattaactagatatagagaagagtgccaaggacagagccctgaggaattcccacatttagagatctggtgttggaagaggaacagatagtgagggaaactgagatgggcagacgagatagaaggaaaatcagaggagtgtttcgttgtggaaagctaagagaggaaagtgcttcagagaggaaggagtgatcagccagtctgaacactcattttaaggtgagagccacataccacagtatgtttgaaacttaccattaacaaagaagcgtcatgtaatgtcttccatctctaaaaacraaaccaaaaaaaacccatctgtccacctcactcacatctccctccatctgtcattcctttcctctgcatcccttaatgttaaaagtccccacgaaaggacccagtgtctcactgtcctttttctatctttatttcactccatttaggctttctcacccatattcaactgaaaatactcttggaaaggtcaccagtagccaccgtcttgtcaaatctggtttcacttctctgtctcatccttcttaagtctgtaggcagtatttgattgaattgattgctccctccttgaaaaactctgct

SEQ ID NO: 51169 - DNA, 601 bp, Human
tgggattctgctgggcatgtccaaatctatggctaattgaatctcataatacctagtttacgagaccggcccggtggctcatgcctgtaatccctgcactttgagaggctgagttggacagatcacctgaggtcagaagttcaagaccagcctggccaacatggtgaaaccccgtctctactaaaaatacaaaaattagccaggcatggtggcaaatgcctgtaatcccagctactcgggaggttgaggcaggagaatcgcttgaacccgggaggcagaggttgcattgagccgagaccaygccattgcactgtagcctgggcgacaagagcgaaactccatctcaaaaaaacaaaacaaacaaaaaaacccctagtttacgatggggagttgaagtcatttggatacctgtctgtgatcaggcttgcagtctctaccctagagcccagtactaggctaggagcatggtcttaccaataggatcatggtcttatatccatatccaaatattacgattcttctgtttaccttactacaaacactctagagctccatacaatctaccagagcttatttctctgtggcctggatcagcaggagc

SEQ ID NO: 51170 - DNA, 601 bp, Human
atgcctgtaatccctgcactttgagaggctgagttggacagatcacctgaggtcagaagttcaagaccagcctggccaacatggtgaaaccccgtctctactaaaaatacaaaaattagccaggcatggtggcaaatgcctgtaatcccagctactcgggaggttgaggcaggagaatcgcttgaacccgggaggcagaggttgcattgagccgagaccacgccattgcactgtagcctgggcgacaagagcgaaactccatctcaaaaaaacaaaacaaacaaaaaaacccctagtttaygatggggagttgaagtcatttggatacctgtctgtgatcaggcttgcagtctctaccctagagcccagtactaggctaggagcatggtcttaccaataggatcatggtcttatatccatatccaaatattacgattcttctgtttaccttactacaaacactctagagctccatacaatctaccagagcttatttctctgtggcctggatcagcaggagcactttctcttttcagatcactcaataaattggtcagaggctgggcacagtggctcatgcctttaatcctcgcactttggg

SEQ ID NO: 51171 - DNA, 601 bp, Human
gaaactggcaatttacagaagaaatacagatggtctataaagatatgaaaagaagatcaactatatctagtaatcagggaaatacagattaaagctaaccattattttggacctatcagatttgaaaatttaaaaagctttatatcaaatgtggacaaaagtatggggctgcagagacttacaggtgggggagtttaaattggtattgcattggagggatgattctggcagtaccaatcattatttaaatgtttgagttttctgaccaagcttctgagattcttaacagaaaaagccatgwacaaagatgtttatgacagcattatttataatagcaaagaagataaaaacgcaaatatctgtcaaatagaatggccagatgatttcttatatccattatgatattctatactatcattaaaataaatgtgttcacatagatctctaagttatattgttatgtgagaaaacatatgtgggataatttcatttttgttttcaaaaatatgtatatctgtgtgtgtttgggtatgttaatgcttttttttttaagtctgaaagactacaaattgtcaacagtggctgcctacaagggggctgg

SEQ ID NO: 51172 - DNA, 601 bp, Human
tgtaaatcagttaacacaaagtctgacagtagcaaatgttgataagcatacggaactggaacactacattgctggtgggagtataaattagtacaacttctttgaaaaacaatttggccttatctggtaaggttaaagatacctatacctgaaattcttgcacatatgcacaagaaagatacaaaaatgtgtctcaaagcaggacctttaactgtaaacaacccaaatattcatcagtagtagaatggataagtaaattttaacaccgtctcaaatggagcactacaaagtagctgaagtwagcagccaggatgaatcttaggaacgtaatgttaagccaaagaaaaaagcaactcaccacttaatcatgattccattttcctcaaaaactagactagcaataataatacattgttttggatgtaaaaaatatgagatacaaataaaggaatgtaatgataattataaaacttcaggtttaccagtgagaggggaaggaagaggatataaggagaggagcccaaagagagcttctaagttaaattatgtgatggatactttttaaaaaataaatatcaacaaatgtgaaaaaaaaattttt

SEQ ID NO: 51173 - DNA, 601 bp, Human
aatgttgataagcatacggaactggaacactacattgctggtgggagtataaattagtacaacttctttgaaaaacaatttggccttatctggtaaggttaaagatacctatacctgaaattcttgcacatatgcacaagaaagatacaaaaatgtgtctcaaagcaggacctttaactgtaaacaacccaaatattcatcagtagtagaatggataagtaaattttaacaccgtctcaaatggagcactacaaagtagctgaagtaagcagccaggatgaatcttaggaacgtaatgttragccaaagaaaaaagcaactcaccacttaatcatgattccattttcctcaaaaactagactagcaataataatacattgttttggatgtaaaaaatatgagatacaaataaaggaatgtaatgataattataaaacttcaggtttaccagtgagaggggaaggaagaggatataaggagaggagcccaaagagagcttctaagttaaattatgtgatggatactttttaaaaaataaatatcaacaaatgtgaaaaaaaaatttttttttaaccgacatgtctttaaaaaatgaatgagt

SEQ ID NO: 51174 - DNA, 601 bp, Human
agcaataataatacattgttttggatgtaaaaaatatgagatacaaataaaggaatgtaatgataattataaaacttcaggtttaccagtgagaggggaaggaagaggatataaggagaggagcccaaagagagcttctaagttaaattatgtgatggatactttttaaaaaataaatatcaacaaatgtgaaaaaaaaatttttttttaaccgacatgtctttaaaaaatgaatgagtacttagccttggttccagttaaggcttaaacaagagatgaaacggtcttcgatgccacctartgtttctagagagtttaacattttatagacttctgctctagctgctccttcctagctctgtgagctaggtttttcagagtagaaaccaaaaggagtaggattcaccttgttttcatccgtgacgcaggctcttcattctgaacctttgcatctagcgctgtgttctccagggcaagccctttcttctctcttgttaaacaatggctcctgtttcttcctgactctttttaggagccttagtccacctggagacctagtttttctttatcatgactgagggagctagggatgctgataggg

SEQ ID NO: 51175 - DNA, 601 bp, Human
cctatcactgtcatgctggtttccagtaaatatatttgctcctttcttaaagctcttgcttcccagcctgggcaacatagcaagatccacctctacaaaaataaaaattaaaaaattagccaggcatggtggtgctgtgcctgtagtcccagttactcaggaggctgaggcagtaggatacctccagcccaggagttcaaggctgcaatgagctatgatggcgccactgcactccagcctgggtgacagagcgagaccctgtctccaaaaaaaaacaacaaaaaactcttgcttccatctracaaaaattggttccctttgggttggcatttcctttattcagtctttttttaaattattatcaaagacagaaacgttcattcttcatttctgcctcttgctcttcccagtccacttttgccttcattccatctccaaatgtagtaattttttttttttttttttttgagacagagttttgctctttctgcccaggctggagtgcaatggcgcagtcttggctcactgcaacctccatctcccgggttcaagcagttctcctacctcagcctcccaagtagctggggttacaggcatgtgc

SEQ ID NO: 51176 - DNA, 601 bp, Human
gctggtctcaaacttctggcctcaagtagtcctcccacctctacctcccaaagtgctgggattacaggcatgagccaccacacccagctccttttttcatccttaattttgaatatatgaaacatacaagaggagaacagatcaaataataaaatttagcttcccactctgataaaactcatttatttgaatacttattctttgctacacatgagattatttccttatgtggcagatgttgttgttccaattttatgtatttatttattatttatttttgagacggagtctcgctctgtcrcctaggctggagtacaatggcgtgatcttggctcactgcaacctccacctcccaggttcaagcgattctcctgcctcagcctcctgagtagctggggttacaggtgtgcaccaccatacccagctaattgttgtctttttagtagagacagggtttcgccttgttagccaggctggtctcgaactcctgacctcaggtgatccacccgcctcagcctcccaaagtgctgggattacaggcgtgagccacttcacccggccccaattttacagatgaggaaactggacctagaaattttaa

SEQ ID NO: 51177 - DNA, 601 bp, Human
ttggttttgtctttggcagtagcctgaaaaaacacataaagagttaagaatatgttttataggtttgggggaagcatcctgtagagagagtgaatttgaacagaaaaaagagagagggaaagctggcaaaagcaagtctgactcctgatgcaaaatgcatgagaagactggataaaatttccacttgcatgtttatagcagcattaatcctaaaagccaggtgggagcactccaagtgtccattgacggatgagtgaataaattaaatgtggtacatgcatacagtggaatgttattcagmctttaaaaggaaggaaattctaatacatgctacaacatggatgaacctggaagacatcatggtaagtgaaataagccagtcacaaaaggacaaatattgtatgattctacatatagaatataaactatatatacatatgtagagtagtcaaattcacagggacagaaagtagaatagtggttgctgggggagggaggaatgaggagtgggtacagagtttcatctggggaagatgaaaaagttctgtagacggatggtggtgatggttgcacgacagcgtgaatatacttaatgctacag

SEQ ID NO: 51178 - DNA, 601 bp, Human
tcacagggacagaaagtagaatagtggttgctgggggagggaggaatgaggagtgggtacagagtttcatctggggaagatgaaaaagttctgtagacggatggtggtgatggttgcacgacagcgtgaatatacttaatgctacagaactgtacacttaaaatggctaaaatcagccgggcacggtggcacacctgtaatctcagcactttgggaggccaaggcggtggatcacttgaggtcagaagtttgagaccagcctgaccaagatggtgaaacctcatctctactaaaaaaaaamaaaaaacaaaaaaaaaaaaaacaacttagccgggcgtggtggcaggcgcctgtaatcccagctacttgggagattgaggcagagaattgcttgaacccgggaggcggaggttgcagtgagccgagatggcgccactgcactccagcctgggcgacagggtgagactgtctcaaaaaaaaagaagagtcaaaatggctaaaatcgtaaattttatgttgtattttaccacaagaaaaaaaaaggacactgatggagagattagtgtgaacataagaagggctgtttcttcctctgagagtg

SEQ ID NO: 51179 - DNA, 601 bp, Human
agcgtgaatatacttaatgctacagaactgtacacttaaaatggctaaaatcagccgggcacggtggcacacctgtaatctcagcactttgggaggccaaggcggtggatcacttgaggtcagaagtttgagaccagcctgaccaagatggtgaaacctcatctctactaaaaaaaaaaaaaaaacaaaaaaaaaaaaaacaacttagccgggcgtggtggcaggcgcctgtaatcccagctacttgggagattgaggcagagaattgcttgaacccgggaggcggaggttgcagtgagcygagatggcgccactgcactccagcctgggcgacagggtgagactgtctcaaaaaaaaagaagagtcaaaatggctaaaatcgtaaattttatgttgtattttaccacaagaaaaaaaaaggacactgatggagagattagtgtgaacataagaagggctgtttcttcctctgagagtgaagataaaggagaggacagaatggatagagacgactcgtaggtgtgggtaaagcaagttgaggcaactcacccgtgtgctcatggttgtgtactgaacaaatgagatgggactgtgacatga

SEQ ID NO: 51180 - DNA, 601 bp, Human
agcattcctcataaacacagcatccagccgggtgcggtggctcacgcctgtaatcccagcactttgggaggccgaggcgggcggatcacaaggtcaggagatcgagaccatcctggctaacacggtgaaaccccgtctctactaaaaatacaaaaaattagtcgggcgtggtggcgggcacctgtagtcccagctacttgggaggctgaggcaggagaacggcgtgaacctgggaggcggagcttgcagtgagccgagatcacgccaccgcactccagcctgggcgacagagcgagactcygtctcaaaaaaaataaataaataaaaaataaaaaaaataaacacagcatccagcacagaagaggaacatatctgcctatgcttttctctctgttagggagcaaggcttttcacggaatcctccccaccaccctgtcctcaggaccagcaggccaggattggatcacatgttcacatccctctctaatcactggctaggacattgagaatgatcatgatttacccctctgagcctggggaatgggcaccttccaagccagtgaaaggttaatgtccaaacaaaattgtggctctaatggca

SEQ ID NO: 51181 - DNA, 601 bp, Human
cgacagagcgagactccgtctcaaaaaaaataaataaataaaaaataaaaaaaataaacacagcatccagcacagaagaggaacatatctgcctatgcttttctctctgttagggagcaaggcttttcacggaatcctccccaccaccctgtcctcaggaccagcaggccaggattggatcacatgttcacatccctctctaatcactggctaggacattgagaatgatcatgatttacccctctgagcctggggaatgggcaccttccaagccagtgaaaggttaatgtccaaacaaaaytgtggctctaatggcaaagaagaaagggaggaatggatttgagttagtaaccagcagcatctgccaccgtaaccagtttggtcccttcccacattgaaggtgaaaactgacaaaagttaattgtatgttaaggctgttaagcagctgagatggggatctcttcatggtaatggcacagtagaaagaaacagccttatcccttgaccatgtttatttagagcttacactagggcattccataatgccttgatggttattagacagttattagtaggcagagtttacatgaagagggttaaa

SEQ ID NO: 51182 - DNA, 601 bp, Human
cgagactccgtctcaaaaaaaataaataaataaaaaataaaaaaaataaacacagcatccagcacagaagaggaacatatctgcctatgcttttctctctgttagggagcaaggcttttcacggaatcctccccaccaccctgtcctcaggaccagcaggccaggattggatcacatgttcacatccctctctaatcactggctaggacattgagaatgatcatgatttacccctctgagcctggggaatgggcaccttccaagccagtgaaaggttaatgtccaaacaaaattgtggctytaatggcaaagaagaaagggaggaatggatttgagttagtaaccagcagcatctgccaccgtaaccagtttggtcccttcccacattgaaggtgaaaactgacaaaagttaattgtatgttaaggctgttaagcagctgagatggggatctcttcatggtaatggcacagtagaaagaaacagccttatcccttgaccatgtttatttagagcttacactagggcattccataatgccttgatggttattagacagttattagtaggcagagtttacatgaagagggttaaatgggggac

SEQ ID NO: 51183 - DNA, 601 bp, Human
aaaaacattcagcccagcctggtaacccagtagagctcattattgaagagtgagtcagagttcaggagaagaaagttgggcagaaacttcaaagcaaaggagaaacatgagcaaagtcacagagactagaaacagcagtcttaggttataaggtataagatgggaagtggtgggaaatgagacttgatcttgaaaggtagtggatgtcaagtgtgtccattggagttcttacttgcagactatagagtgtacttttcatccactcttttaagcagaaaggggtttattataagatactggktaccttaacaaaacctgtggaagagccagtgagccaagctcagatgctgctcagcaaagagcagagcagctatagatctatgcagcatgtgactgtcatagtgaaacctctgcacagtgctgcagaagaactggatgcttctactaccgtgcttgcccaaagaccagatttctagcacagtcgttatctcatgttgctcatttctaccccaagtcttgtgtgggagcatctgctaggaagaagctaggtctcgtggattgctgagctgctagggagtctgggaaatgtagctgtaagata

SEQ ID NO: 51184 - DNA, 601 bp, Human
ctggtaacccagtagagctcattattgaagagtgagtcagagttcaggagaagaaagttgggcagaaacttcaaagcaaaggagaaacatgagcaaagtcacagagactagaaacagcagtcttaggttataaggtataagatgggaagtggtgggaaatgagacttgatcttgaaaggtagtggatgtcaagtgtgtccattggagttcttacttgcagactatagagtgtacttttcatccactcttttaagcagaaaggggtttattataagatactgggtaccttaacaaaacctgkggaagagccagtgagccaagctcagatgctgctcagcaaagagcagagcagctatagatctatgcagcatgtgactgtcatagtgaaacctctgcacagtgctgcagaagaactggatgcttctactaccgtgcttgcccaaagaccagatttctagcacagtcgttatctcatgttgctcatttctaccccaagtcttgtgtgggagcatctgctaggaagaagctaggtctcgtggattgctgagctgctagggagtctgggaaatgtagctgtaagatagtcaagctagaagggagc

SEQ ID NO: 51185 - DNA, 601 bp, Human
atttctaccccaagtcttgtgtgggagcatctgctaggaagaagctaggtctcgtggattgctgagctgctagggagtctgggaaatgtagctgtaagatagtcaagctagaagggagcaggagtgggtactaagtgaaccacctaatagtgtctgccagttttcagtacagctgagcggttttgatgaatttatctaggccgtggggtaccattgaaaagtgttcaaggcagggagtagtgtgaccacatttacatattgatcactggggctatcatgtacaacatggatttaggagggkccaattgggggctattgcaatagcaggtagatcacaaatgatgagggttgacaaggaagcggcgacaaagtgaaaactacgtggaggtagaatttagcaggaattggtggttgatttatatatgagagagtagagggtgatatatccatgtagatgtatccagcatacagttggtcatatctagagctgtggacttggaagtaataaaggagtgggccaagaacagagcccttgggcccacagcccctgccaggcacattgaacaggtgctcatgggtgagatggaaggagaccaagaga

SEQ ID NO: 51186 - DNA, 601 bp, Human
gtagggcagcatcctttgctgaagcaaattcagaggccgtttgttgcatcctttttgtgggctgctagttaacacttatcaaaccctttttttcccctaacattgaggtataatatatataacataaaattcacccattttaagtgagaattcagtgattttttggtaagtttaccaagttatgcagccatcaccataaatgtcttagaacattttctaacaactttattgagatgtaattcaaataccatgtatttcacccagagtttacaattcagtgtttttttaagtatattcacakataactgcagcccatcaccaattttagaacattgtcatcccctcaaaagaagaaccttacactctagctgttgcccccttagttttagaacacattgctcaccccaaaaagaacctcagtgtctaaatacaattaatctccattctcaccccccggccatcacttaactttttgcgtagagaactgagaccacacacatggatcttgaagggaactaggcaccatggagtagtggtgaaaggcctaggaaagtggggtctgtagtttgggaaacacataggtcagctaacctaacactgt

SEQ ID NO: 51187 - DNA, 601 bp, Human
ggttgccgtgagccaagatcgcaccactgcactccagcctgggtgacagagcaagactccgtctcaaaaaaaaaaagaaagtggctcctcagatttaggccacttcttatatttggccactgccttgcagccttgtagttcacattgccaccctggtgttggtgtgacatggtgtcccatccctgaagctgcctcccttgttactcaccttattgctgtctgagaaaggaaatgggtgattcacaatccttaaatcaagtggctttctcttacctagaacttctgaattgaacatacatttaaacaatgacgttgaaaagatgtataactggagcaataaagactgaaaaagaaagctgcggccagttgttagtttttccgaggctccttatctgttgagtggcaccccaggctcccttgctcttgtcccccactgcctgtgatagagaagcctcttgttaaacactgggagctacttcaccacactcacaggctattcccagaaagattttgcacctgggtaaagcatccttgagaaaataacctgttttctttcccagagtgaacccagcttcatccctggaaccaccacatatgcttt

SEQ ID NO: 51188 - DNA, 601 bp, Human
ttgtattttagtagagatggggtttcaccatgttggccccatgctctccacactcttgaccttagatgatccgcccaccttggcctctcaaagttctgggattacaggtgtgagctaccacgcctggcctggatttcttattctagtatttattaataattcaatttgagaagactacctagactatttgagttttgtaatctctaattcctagctctaaagctaatcccttgtgaatatctagactggaaatccccgttaagtacctgcacattttcaggttttgttaactggttggagwcagactggagaatttcatttctattcatttttggttttctctttctttttctttccttccccacaccccagggctaccaagaaaagaacaaattcattgctgcacaaggtaaagtaatgacaacttttttctgttagatttaaccatgatcacataatgggtttggtttttttctcccaaatgctgagtggattaaccagaatgctgtagcttttctgtactttttaccacctgaaagaattataatccattatacaggtttacagctaacagccttcatcttgatgacttagtatccag

SEQ ID NO: 51189 - DNA, 601 bp, Human
ccaccttggcctctcaaagttctgggattacaggtgtgagctaccacgcctggcctggatttcttattctagtatttattaataattcaatttgagaagactacctagactatttgagttttgtaatctctaattcctagctctaaagctaatcccttgtgaatatctagactggaaatccccgttaagtacctgcacattttcaggttttgttaactggttggagtcagactggagaatttcatttctattcatttttggttttctctttctttttctttccttccccacaccccagggytaccaagaaaagaacaaattcattgctgcacaaggtaaagtaatgacaacttttttctgttagatttaaccatgatcacataatgggtttggtttttttctcccaaatgctgagtggattaaccagaatgctgtagcttttctgtactttttaccacctgaaagaattataatccattatacaggtttacagctaacagccttcatcttgatgacttagtatccagggatccattaaaagaagtctttttgtgtatgtatattaaaaagactggaaaaggctgtatacacaaaacacagt

SEQ ID NO: 51190 - DNA, 601 bp, Human
tgagaagactacctagactatttgagttttgtaatctctaattcctagctctaaagctaatcccttgtgaatatctagactggaaatccccgttaagtacctgcacattttcaggttttgttaactggttggagtcagactggagaatttcatttctattcatttttggttttctctttctttttctttccttccccacaccccagggctaccaagaaaagaacaaattcattgctgcacaaggtaaagtaatgacaacttttttctgttagatttaaccatgatcacataatgggtttgktttttttctcccaaatgctgagtggattaaccagaatgctgtagcttttctgtactttttaccacctgaaagaattataatccattatacaggtttacagctaacagccttcatcttgatgacttagtatccagggatccattaaaagaagtctttttgtgtatgtatattaaaaagactggaaaaggctgtatacacaaaacacagtctaataaggccctctgtccttggggctagttaaccttaggttccagccaggctgctcagagtttgaattaggaatcagtttccagagaggat

SEQ ID NO: 51191 - DNA, 601 bp, Human
taaattttgaattctagcctgaacaagtcatccaacctttctggggctgatgacacccacctcagagcataataggaaggagtaaatgccatatgaagcacttagctcactgtcaggtccataatgtaggtattctgtgagcagtcatgatttctaattcccaactgtaatatccttgggagacatcattcgtgttctgtttatatttttgacagccttccacccagccccatccttgtgcagtgcctggcacatacatggtagaaacatggaaaatactcaattagtaacggggtggatrgatacatgggttagatatttagctggggacatttgggcacaagcttccaaaagtcaggaatggatgttcccagcctcccagcatctttcttcttggtgtatattctcttcatttttgctgttggctactttaggaccaaaagaagaaacggtgaatgatttctggcggatgatctgggaacaaaacacagccaccatcgtcatggttaccaacctgaaggagagaaaggaggtaagtggaaaaattggatgtgaacagcagaaggatcactctgcatataagctctgagtttaagcctgg

SEQ ID NO: 51192 - DNA, 601 bp, Human
ccacagaggagcttttttcccctggtttctctagttccttatttccctggttttctgccccacctgctgaggcctttggtatatcctggatcagcagagggagctttatgaactgagaccctgcaagccaaagggaatttgaggccttggcctaatcctggaggcagcctcctaactgggccttttccttttgtggctaccaagtgcatgcctggcctaaccagctctatcactgggccacagccagagccaattctgggtcctggggtcgagccccagcgaggaatacctatttgttacygtctttctcaaggatggcccttgagtcaccttgatcctagggtatcgggtgtcatgatcaacagctccacagtggcatgggaagacagtgctagggctgggctttaggttagtttcctccaaccaaacctcttgctcttggaagctatccaaagctcaggcaacagaaaaagctctaggcctctcatggcaggtttacagtctgcatcagtctaccctggtggccccctcatagcagactgctggttcgaggggttcaaacaggctttctcctagagcatgacctgaaatgttgtgaaag

SEQ ID NO: 51193 - DNA, 601 bp, Human
cagaggagcttttttcccctggtttctctagttccttatttccctggttttctgccccacctgctgaggcctttggtatatcctggatcagcagagggagctttatgaactgagaccctgcaagccaaagggaatttgaggccttggcctaatcctggaggcagcctcctaactgggccttttccttttgtggctaccaagtgcatgcctggcctaaccagctctatcactgggccacagccagagccaattctgggtcctggggtcgagccccagcgaggaatacctatttgttaccgtstttctcaaggatggcccttgagtcaccttgatcctagggtatcgggtgtcatgatcaacagctccacagtggcatgggaagacagtgctagggctgggctttaggttagtttcctccaaccaaacctcttgctcttggaagctatccaaagctcaggcaacagaaaaagctctaggcctctcatggcaggtttacagtctgcatcagtctaccctggtggccccctcatagcagactgctggttcgaggggttcaaacaggctttctcctagagcatgacctgaaatgttgtgaaagtgc

SEQ ID NO: 51194 - DNA, 601 bp, Human
gtacacttacttttccattgtcactgacaaccacagctgtcaccttccctcccctggtactgcccacccttgggtatcagggccaacacacaggatctcctcacttcacaggtgggcgacatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcaggtcagtgtggcctgacccttgtmcccccacccccacatttcgcccccatggccagagcaggggaacagcacaagggccctggctgaggaggctggcacagagtagatgacctactggggcaccagcgcaacagccagagactccaagttctagtgcagggtggagaatatgacttgaggaaggagggtagggcagtcctccaagattaggagttgggagaccctgctatgaagccaaaagactgggtcaagtgctggccatgtatttttgcagccttcggacccttctagctggaggtcaggattcaggacatactggagttg

SEQ ID NO: 51195 - DNA, 601 bp, Human
aaccctgtgctcgcagaaacatgtgctgtattgactcaaggtttaatggatttagggctgtgcaggatgtgctttgttaaaaatgtgtttgcaggcagtatgcttggtaaaagtcatcgccgttctccagtctcaagcacccagggacacaatgcactgcggaaggccgcagggacctctgcccaagaaagcctgggtgttgtccaaagtttctccccactgagatagcctgagatatgccctcgtgggaagggaagggtctgtgctgaggaggattagtgaaagaggaaggcttctttgsagttaagataagaggaaggcatctgtctcctgctcgtccctgggaatggaatgtcttggtgtaaaacccgatcgtacattctatttactgagataggagaaaaccgccttatggctggaggtgagatatgctggcggcaatactgctctttactgcactgagatgtttgtgtaaagtcagacataaatctggcctacgtgcacatcaaggcacagcacctttccttaaacttatttatgacacagagtcctttgctcacatgtttttctgctgaccctctgcccaccattaccctatagt

SEQ ID NO: 51196 - DNA, 601 bp, Human
gcccaagaaagcctgggtgttgtccaaagtttctccccactgagatagcctgagatatgccctcgtgggaagggaagggtctgtgctgaggaggattagtgaaagaggaaggcttctttggagttaagataagaggaaggcatctgtctcctgctcgtccctgggaatggaatgtcttggtgtaaaacccgatcgtacattctatttactgagataggagaaaaccgccttatggctggaggtgagatatgctggcggcaatactgctctttactgcactgagatgtttgtgtaaagtcaracataaatctggcctacgtgcacatcaaggcacagcacctttccttaaacttatttatgacacagagtcctttgctcacatgtttttctgctgaccctctgcccaccattaccctatagtcctgccacatccccttagccgagatagtagagatagtgatcaataaatactgagggaactcagagacgagtgctggcgcatgtcctccgtatgctgagcaccggtcccctggcccactgttctttctctatactttgtctctgtgtcttctttctttcctcagtctctcgtcccacctga

SEQ ID NO: 51197 - DNA, 601 bp, Human
ttcagatgcagtatgtcttcatataccaagcccttctggagcattatctctatggagatacagaactggaagtgacctctctagaaacccacctgcagaaaatttacaacaaaatcccagggaccagcaacaatggattagaggaggagtttaaggtgagttggagctggataacctccttcagattgaaggatccttgtaatctggggaacatgggatgcctgactgtgcatttgccaacagtaaatccccttgtgaggcatgccagtggttaaggagatggtcctttcctcgtactctrgtaactctcaactcatcctgcacgttggaatcactttggttgtgttagagtagggagaagcaggcaacagtattttaaggcccctagccctccgaggtgattatgatacacagcaagagcagtttttttgtaagagccagataataaatattttaggctttgcagcccacatggtttctatccagctacttagtgctgtctttgtaacacaaaggcagccataaccaataggtaaatataatgagtgtggctgttttataaaactttatttgcaggcagcaggcagcaggccagatttgg

SEQ ID NO: 51198 - DNA, 601 bp, Human
taaggcatatgtcacactgtcatcagtaaaagtgctctcccaggctgggcacagtggctcacgcctgtaatcacagcactttgggaggctgagacaggtggatcatgaggtcaggagttccagaccagcctggccaatatggtgaaaccccgtctctactaaaaatacaaaaagtagccaggcatgatggcacatgcctgtagtcccagctactcaggaggctgaggcgagagaattgcttgaacccggaaggcagaggttgcagtgagccgaaatcatgccactgcactccagcctgggygacagagcgagactccatctcaaaaaaaaaaaaaaaaaaagtgctttctcagaagcaggagattctgggttggggtggggaggaccacttagagaagttcttctcaaatatagcatgtgcacagatttctttgggatcctgtcaagatgtgggttctgccaggcacggtggctaatgcctgtaatcccagcactttgggaggccaagtcaggcagatcacctgagctcaggagttcaagaccagcctgaccaacacggagaaactctgtctctattaaaaatacaaaattagccaggcat

SEQ ID NO: 51199 - DNA, 601 bp, Human
catttctaataaggtgaagccaacgctgctggtgtatgggctacactttgagtagcaaatgtcaagaaggagcctcaatcgggaagggaggatgcaattctgaataagtttttttgaagagccttaggcagcctctgggggtggaactgcagagtggacacactccctcctacgatgctggaatcccttgctccaggatcacaaaattccaagccaggagaatctcaagagagtccacaggagcctggaaggtagcatttcccaaacagtctcttggcttcagggttccagctgaacatawgggaacagaggtcagggccctggtgagaagagcaatatggagccagagtggcctggaggtgcaggccaagggacaggcataatcttgtcaagttcagttactgggatcagtaatgtttcccctccccttcccaattcagaagttaacatcaatcaaaatccagaatgacaagatgcggactggaaaccttccagccaacatgaagaagaaccgtgttttacagatcattccatgtaagagccctcccgccactccaaagccttattgccccatccctcaattccctccaccccttccact

SEQ ID NO: 51200 - DNA, 601 bp, Human
atgggctacactttgagtagcaaatgtcaagaaggagcctcaatcgggaagggaggatgcaattctgaataagtttttttgaagagccttaggcagcctctgggggtggaactgcagagtggacacactccctcctacgatgctggaatcccttgctccaggatcacaaaattccaagccaggagaatctcaagagagtccacaggagcctggaaggtagcatttcccaaacagtctcttggcttcagggttccagctgaacatatgggaacagaggtcagggccctggtgagaagagcartatggagccagagtggcctggaggtgcaggccaagggacaggcataatcttgtcaagttcagttactgggatcagtaatgtttcccctccccttcccaattcagaagttaacatcaatcaaaatccagaatgacaagatgcggactggaaaccttccagccaacatgaagaagaaccgtgttttacagatcattccatgtaagagccctcccgccactccaaagccttattgccccatccctcaattccctccaccccttccacttctcaggtactagttaatgattggcgtatagacaa

SEQ ID NO: 51201 - DNA, 601 bp, Human
atgggaacagaggtcagggccctggtgagaagagcaatatggagccagagtggcctggaggtgcaggccaagggacaggcataatcttgtcaagttcagttactgggatcagtaatgtttcccctccccttcccaattcagaagttaacatcaatcaaaatccagaatgacaagatgcggactggaaaccttccagccaacatgaagaagaaccgtgttttacagatcattccatgtaagagccctcccgccactccaaagccttattgccccatccctcaattccctccaccccttccayttctcaggtactagttaatgattggcgtatagacaagaatcatggcattgcctcttgttgcacccacttaacaacatggcgttgccttttgttgcaccttagtggcttctggaaataacgtaaaagccaaaggctttctccctaatgagctaggaacagacatgtccttgcccagctgggattctgtctgcccagggcctgaggtggtgggagcaatgcaaggagagggagaggacaaatgatattggctagccataagccgctattcttcttacagatgaattcaacagagtgatcatt

SEQ ID NO: 51202 - DNA, 601 bp, Human
tgtttgaatcagtcaacaaatagtgaattgatactcacccacccactcaccctgtgcattaggtctgtccagctccatagagcagaaggtgggggaaaacagatggcatgcagtagtataatacctggaagaaaaagttcacagagcagaccacagccaagaggaacctggctgccccctgatctttcccattcctgccctcttcatcctagctctaatccctgttccacttccctgtctcttacagaaagcaaccagcttgtcagatagggtttcgtccttggccacaggggagctctgyatgggctgagtttgcctccgagcagtccccattcccttctagtggtctgtcttctccactagtccctctgtgattaaaccatctcacccttgcaattaacctggcctgtgcagggctaccggcagaaggactcctatatcgccagccagggccctcttctccacacaattgaggacttctggcgaatgatctgggagtggaaatcctgctctatcgtgatgctaacagaactggaggagagaggccaggtgagttcaaaaggtcctgggtggtgagagacagagacagcatgaaaagatg

SEQ ID NO: 51203 - DNA, 601 bp, Human
ggggcaggaagcatttcatgtgtgtggcggtggggagaagagtcgtgcgcacacaaattctgctgcctgttgagtgaggcctctccctctgccttccactgtagcttatgctctgtcttcctaggccagtgaagcagacagtagtgcttgccctcaaaagcttctgagtggattggaacaggatgttagtgatgttctttacaaggcctcactggcccccaagttcactttctgttccattcatgttgtcaagtgtagctcccagaagtaattaacgcactaagcctaaatgatgcaatgraaggtgcctacatttatacagtgacactaccatcctcacctacaatattaagttcccagagaaaaaaattcgatcccataatataaattctgtacttacaaattaaaatctcgaaggaattaaaaatttttaattatctccctctgctttttttttttttttttttttttttttgagatggagtctcactctgtccaccagactggagtgcagtggcacaatctcagctcgctgcaacctccacctccagggttcaagtgattctcccacctcagcctcccgagtagctgggattacagg

SEQ ID NO: 51204 - DNA, 601 bp, Human
tttcatgtgtgtggcggtggggagaagagtcgtgcgcacacaaattctgctgcctgttgagtgaggcctctccctctgccttccactgtagcttatgctctgtcttcctaggccagtgaagcagacagtagtgcttgccctcaaaagcttctgagtggattggaacaggatgttagtgatgttctttacaaggcctcactggcccccaagttcactttctgttccattcatgttgtcaagtgtagctcccagaagtaattaacgcactaagcctaaatgatgcaatggaaggtgcctacayttatacagtgacactaccatcctcacctacaatattaagttcccagagaaaaaaattcgatcccataatataaattctgtacttacaaattaaaatctcgaaggaattaaaaatttttaattatctccctctgctttttttttttttttttttttttttttgagatggagtctcactctgtccaccagactggagtgcagtggcacaatctcagctcgctgcaacctccacctccagggttcaagtgattctcccacctcagcctcccgagtagctgggattacaggcatgcactaccat

SEQ ID NO: 51205 - DNA, 601 bp, Human
cttactttcatagcaaactctctagtaaaacccagttatatgcctctatctgatatagcaaacatcactgggcaaaaacacaaaacagtgccaaatgctctcacactgaactcatgaccacaaatctcatagaggtaattggtgccacctagcaatgctattgctctttcttttcttcctgaaacctccagcatctgctcttgcctgtcccatcatactcacaccttagcttgtgacctggcctcattcttctccaagaaatcagacaagaacactgtcatcctcccacccccaaacaacyagcctcttcaaatctgtaccaactctattctctcttgttacagtggaaaagggtttctgcatctctcaatccacctgtccactgtgctcttggccccattccgtcctgcctgctcagggatgttgctgctataaccatcttctctcccacctccatcagcagttcccctctttaaccactactctcatcagcctatacatgttacatttcctatcttttaaaaacaaaaaatctgctaatctcactttcccttccacctactatcctatttctctgcaccccttcccagcaaaactcctt

SEQ ID NO: 51206 - DNA, 601 bp, Human
atctcactttcccttccacctactatcctatttctctgcaccccttcccagcaaaactcctttaaagagttggctttcggccaggcgcggtggctcacgcctgtaatcccagcactttgggaggccaaggtgggcggatcacaaagtcaggagatcgagaccagcctggccaacatggcaaaaccccatctctactaaaaatacaaaaattagctgggcgcgatggtgcatgcctgtgatcccagctactcgggaggctgaggcaggagaatcgtttgaaccagggagctgaaggttgcartgagccaagatcgcgccactgcattccagcctggtggcagagtgagactccatctcaaaaaaaaaaaaaaaagagttggctttctccctgcaagttctctgttcgctctgttccttccaggcttggccccactgggactgctttagtcaagatcaccagtgactgtcctcttgccaaatccaaaggtcatttctcttttctgatttttttttttttgtccttacagcagcatttgaaagagtcagtacctccctcctcttcctcagaacacttacttccgtagcatcaccccactcacta

SEQ ID NO: 51207 - DNA, 601 bp, Human
atctaaataaatagtaccaccttctgcccagttgctcatgtctaaaatccgggagttaccttccttcctcccctctcctcacccctcacatccagtctgccactgagtcctgatacaggcagagcctccccacttttctccagcgtaactgctgtcatctgaacaagccctcgtctctcactgcttgcccgtgggactgtgggcatgactcatatgcgcagcctcgtctgcagtggcctggcaactggtcctcctgctctcatcctaacccacttttagtttttcaaatggcagctgctgktccttttgaaaatataaatcattgtcactccttgtcttacaaatcctgtttgaggccaggtgcggcagctcacgcctgtaatcccagcactttgggaggccgaggcgggtggatcacctgaggtcgggagttcgagaccagcctgaccaacatggagaaaccccgtctctactaaaaatacaaaattagcgggcatggtgatgcatgcctgtaatctcagctactggggaggctgaggcaggagaatcacttgaacccgggagccggaggttgcagtgagccaagatcgcgccattgcac

SEQ ID NO: 51208 - DNA, 601 bp, Human
tcaaaaaagaaaaaaaaaatgagactcttagtgttgatacctagtccctagacttgatatgtatttctgtctgagagatcatgctcaattcctccagcacacacacactgtggctcacacccatggggaccttatggttctgatggttttaaaggcccagtcttcatcccagctgagacactgtgtaaagcagtgttgagaaggcactgtggtagcaaaatccattccacccaccagtgccataaaaactaatataatgcctgatcgaggtgagccttaatgagaatttttttttttttttggctgttctggttgaagagaggcccagggcaccgatccctgaggcatccccagggcttctagagaacatgggtggaaaagcactagtccagggcatgttcttgattcaacactttaataatcatgattttatttggactgtgagactattcacaatttctttttctacttaatttttttccaaatctttcaatgacattatatgtatggttgagaatttttcaattgccagtagtgaagaatctcagatcttacccccaaattctctaaagaaatgggcagcataactgtgtgatgttat

SEQ ID NO: 51209 - DNA, 601 bp, Human
tcacccttgccctcagcgggagagagaaagcgaggaggggcagataggggaagctgatgaccatgggtcagactgaagaaagccatacaagagcaagatattggtgagcacatagtagttgagattgatgccaagacaggattggatgctaagagagaggaccttggagcttgaacttggcacaataagtgctaggggactaatgttcagatagtgggcaggagagcagcaggggagactggcagtggagaccccggttgtgctatgaacagagggtgaaagagaagaggagtcaagggtrtctcccaggtttgagcctgggttggtgtgaccagcagaagagagacagtaaagaggtttgtttgaggggaaaagttgaattttgtatggggcatgttgctggaggttacgttttagaaaaaatgcactcctttacttagaatcctaacaacagcttacaaggcccaatatgttctgaggggtccctggccagggccgggagaggatggtgtgcaccacgggctggctctgagcacactcctgccatgggcctgagatgccagtttcccaggcagccacagggctttgcccaagccttccc

SEQ ID NO: 51210 - DNA, 601 bp, Human
ccctcagcgggagagagaaagcgaggaggggcagataggggaagctgatgaccatgggtcagactgaagaaagccatacaagagcaagatattggtgagcacatagtagttgagattgatgccaagacaggattggatgctaagagagaggaccttggagcttgaacttggcacaataagtgctaggggactaatgttcagatagtgggcaggagagcagcaggggagactggcagtggagaccccggttgtgctatgaacagagggtgaaagagaagaggagtcaagggtgtctcccagstttgagcctgggttggtgtgaccagcagaagagagacagtaaagaggtttgtttgaggggaaaagttgaattttgtatggggcatgttgctggaggttacgttttagaaaaaatgcactcctttacttagaatcctaacaacagcttacaaggcccaatatgttctgaggggtccctggccagggccgggagaggatggtgtgcaccacgggctggctctgagcacactcctgccatgggcctgagatgccagtttcccaggcagccacagggctttgcccaagccttccctgagtaccc

SEQ ID NO: 51211 - DNA, 601 bp, Human
caggagagcagcaggggagactggcagtggagaccccggttgtgctatgaacagagggtgaaagagaagaggagtcaagggtgtctcccaggtttgagcctgggttggtgtgaccagcagaagagagacagtaaagaggtttgtttgaggggaaaagttgaattttgtatggggcatgttgctggaggttacgttttagaaaaaatgcactcctttacttagaatcctaacaacagcttacaaggcccaatatgttctgaggggtccctggccagggccgggagaggatggtgtgcaccaygggctggctctgagcacactcctgccatgggcctgagatgccagtttcccaggcagccacagggctttgcccaagccttccctgagtaccctgccagaactcccactcctcttttctctttccttaccacacatcttcttgtctggggacattgctaaaccccacagtccctgcctcagagtaggcactcagtgtctggtgagtgaatcagctgatgacattgaatagggggatattgtcaaggtcagagtctggattccgtggatttgggaagaaagtgaaagacatggaaaggaatca

SEQ ID NO: 51212 - DNA, 601 bp, Human
gtggatttgggaagaaagtgaaagacatggaaaggaatcagcagatacacaccagtgtagggagtggggtttgtcagaaaaagggaaagacaggactagagctagttctaactgagcgaacagcaggtcagaacaacctaggccagcatgtgcaggtggacagcaatggctctgtgctggtggggtgtgagtgaaggtcgtcccccacggtccaacaggtgagtccctccacagcacatggggccatgcaggaagggcacagggtacactgcctcccgacccagaacccctccaggctggkgggtccacagggcaaaggcgagcaccagctgcctgcccccacctcttctgccactcaccactgtcactcacccccttgcacagagggccatcacaggtgtggtaaatgtgtctgctctgttgcagcgccggggcaggaaggacggggaccttctgtgccctgagcaccgtcctggagcgtgtgaaagcagaggggattttggatgtcttccagactgtcaagagcctgcggctacagaggccacacatggtccagacactggtatgctgcccacatatttgtccctgccaccacaccacc

SEQ ID NO: 51213 - DNA, 601 bp, Human
gaaaagactgttctttccccattaaattttctcaccaccccattgaaattcagttgtccataatataaggatttatttctggattcttaaattgactccattgatctatctgtctgtccttttgccagtaccacaccatcttaattacttttcctttatagtaaattttaaaattaagacatataagtcatccaagtttgttcttctttttcaagattgtttggctgttctgggtgcttttaatatccatgtgaattttaaaatcagcttacttatttctgtctaaaagccagcttttatwcagctgagatcttttttaagctaaccttagatttaatgaactagttatttaggtccaaaagaaaaggctgggcatggtggcccacgcctgtaatcccagcactttgggaggccaaggtgggcggatcacaaggtcaagagatcgagaccatcctggccaacatggtgaaaccccatctttactaaaaatacaaaaattagctgggcgtgatggagcacgcctgtagtctcagctactcgggaggctgaggcaggagaatcacttgaacccggaggcgaaggttgtagtgagccgagatcg

SEQ ID NO: 51214 - DNA, 601 bp, Human
ggattcttaaattgactccattgatctatctgtctgtccttttgccagtaccacaccatcttaattacttttcctttatagtaaattttaaaattaagacatataagtcatccaagtttgttcttctttttcaagattgtttggctgttctgggtgcttttaatatccatgtgaattttaaaatcagcttacttatttctgtctaaaagccagcttttatacagctgagatcttttttaagctaaccttagatttaatgaactagttatttaggtccaaaagaaaaggctgggcatggtgrcccacgcctgtaatcccagcactttgggaggccaaggtgggcggatcacaaggtcaagagatcgagaccatcctggccaacatggtgaaaccccatctttactaaaaatacaaaaattagctgggcgtgatggagcacgcctgtagtctcagctactcgggaggctgaggcaggagaatcacttgaacccggaggcgaaggttgtagtgagccgagatcgcgccactgcactccagcctgggtgacagagtgagactcggtctcaaaaaaaaaaaaaaaaaaaaaaaaaatggaactcaa

SEQ ID NO: 51215 - DNA, 601 bp, Human
agcttttatacagctgagatcttttttaagctaaccttagatttaatgaactagttatttaggtccaaaagaaaaggctgggcatggtggcccacgcctgtaatcccagcactttgggaggccaaggtgggcggatcacaaggtcaagagatcgagaccatcctggccaacatggtgaaaccccatctttactaaaaatacaaaaattagctgggcgtgatggagcacgcctgtagtctcagctactcgggaggctgaggcaggagaatcacttgaacccggaggcgaaggttgtagtgarccgagatcgcgccactgcactccagcctgggtgacagagtgagactcggtctcaaaaaaaaaaaaaaaaaaaaaaaaaatggaactcaaatattgttgaggtagcaaatattctatcatctgaaacctcagtggtaaacacaatacccaaatttaacatatttttgttacttgttaaatacatgcgtgtaaatatattcacttaagtaaactaagtggacaaaattaggtaagtcttttttcatatccaacttatttaacttgatacactttccagctttcaacataattgcaaattttt

SEQ ID NO: 51216 - DNA, 601 bp, Human
ctggaccagcagtccagtctttcagccttcaggttgctttaggcttgaaggtgaggtttcgccggggactctaccctatctgcctaggtatttgtctgcctccagcctctatcaatatggtactacaaatagaaggaagaaaaaaaagtcaaatcacaccttaggaaattacagcctagtagcatcagtaaaaatggtactgttagtcatgtcatgaaatagacgtaaaattgaaggttgattttctttttttttttgagatgaggtctggcttcgtggcccaggccggagtgcagtggcrtgatcttaacttatcgcacttttcatctcctggtctcaagtcatcctcccacttgattccgcctcttgagtagctggtactacaagtgtgtgccaccatacctggctaacttttgtagtttttgtagagacagggcttcgtcatgtttcccaggctggtctcaaacttctgagctcaagtgatccatttgtcctggcctcccaaagtcctgggattacagttgtgagccaccatgctggcctgtttttcaattattgattgctttcaagttggaaagtgcattgtgaaacactcaaagat

SEQ ID NO: 51217 - DNA, 601 bp, Human
actagttactagttagcttcagttttgtttcttcaagaatgatggccggatgtggtggctaacacctgtaatcccagcactttgggaggctcaggtgggagaattgcttgaagccaggagtttgagaccagctggggcagcatcatgagagcctgtctctacaaaaaaaattttgaaaaattagctgagtgtggtcacacatgcctgtagtcccaactgtttgggaggctgaggagagagaatcgcttgagtccaagagtttgaggctgcagtgagctataatcttgtactgtactctatyctgggtgagatcctgtctttaaaaaaaaaaaaaaaaaggtattattacccacctgccacacaatggctgttcccctctgcccggagtgctctttcttacccaaataggcacatggtacgctctctcttccttatgagtctctgttcagatatcacttagctgtagcacctctccaacgttgccccagtcactttctattttccttacctgggtttattttcctcataacatttatcaccatctggcacgtacacatgcatgcatgcatacctacatatttgcttgtctacctctcccagt

SEQ ID NO: 51218 - DNA, 601 bp, Human
aatgatggccggatgtggtggctaacacctgtaatcccagcactttgggaggctcaggtgggagaattgcttgaagccaggagtttgagaccagctggggcagcatcatgagagcctgtctctacaaaaaaaattttgaaaaattagctgagtgtggtcacacatgcctgtagtcccaactgtttgggaggctgaggagagagaatcgcttgagtccaagagtttgaggctgcagtgagctataatcttgtactgtactctatcctgggtgagatcctgtctttaaaaaaaaaaaaaaaaaggtattattacccacctgccacacaatggctgttcccctctgcccggagtgctctttcttacccaaataggcacatggtacgctctctcttccttatgagtctctgttcagatatcacttagctgtagcacctctccaacgttgccccagtcactttctattttccttacctgggtttattttcctcataacatttatcaccatctggcacgtacacatgcatgcatgcatacctacatatttgcttgtctacctctcccagtgaacgtgtaggttgcacgagagcgggaacttaggccg

SEQ ID NO: 51219 - DNA, 601 bp, Human
tatgtgacttccttatgagcagttcttgaaactctagtaagttaaaaattgaagataaagtattttttagagggggtacagtgaagtgatgtgtagttggttgataatttggttaggtaataggtttaatatcttttaaccatttccagctactttgatccccaactggctttttttcctgtcagttacaaggaaaccgtcaactcttgaaggagagtccaaataactgcaactatggaatgaaaaactcagagctcctcttttactggagggccagagggatgttgcttaacctcctctrtatatggcccattaattttgccacttaaacaaatttcatacatcattttcctcaaaacatgaaggagatgccaagcaagttgatgtcagtaattcctagaaactaaaaacattttaactcgacaacagaatatgtaaatttcctcacgtttaaatagagtagttgtgtatcttgttttatctgaaaccatcctgatttatacttgttgctgtgacattaatagtgcccccttacagtctcaaaagtgccctagtttggatagttatgtggtcaccttatttttaagacatattccctatt

SEQ ID NO: 51220 - DNA, 601 bp, Human
agcctatggattgtaatttccaaaacattttatcataatgaagtttgcttttgtcatatttacatatctggcactgcctttttttttttctttttttttgagatggagtttcactcttgttgcccaggctggagtgcaatggtgccgtctcagctcaccgcaacgtccgccttctgggttcaagtgattgtcctggctcagcctcccgagtagttgggattacaggcatgcgccaccacgtccggctaattttgtgtttttagtagagacaaggtttctccatgttggtcaggctggtctygaactcccagcctcaggtgatccgcccacctcggcctcccaaagtgctgggattacaggcatgagccacagcgcccaaccagcacagctttttatggcactctgttcttgagtctgtttttgagaaatggggtagttatgagaaggtactgaaaacagtacatttttatgtgcaaaagttttctacttttctatctgcttatagattcatttttttgtctttgatatgctatttgaattcaaaggttggattctcttttagtctaagcatatatacagaagtcttatgtttcaggaagct

SEQ ID NO: 51221 - DNA, 601 bp, Human
atcaggccaccttactcacctgcttaataagacccggacttctttctacagtgcagttgaagcattgtgattttatgcttaatctctggaatgagtttgcctgggttcatattctagtcccattacttattagttacatgattttgaacaagttatatttactctacatctccatattctcatgtgtaaaatagggataataatagtaacagttttttacaggtatggtaagagtttaataagttaacacttgccgtgtccttagcatgtagtaagcactaataaaggttagttaccctcrttatcattatcatgattattacaactatccagatctcttgaatatttttactctgtggctcccctcagaataattttttcatagtgatcttcagttgcagagagaatggttaaatgaagccaggtgtactttactgaagaagacaggaatgtgtgtaattttgaaatatttctaaatagtgaaagtaaaacaagtcctagtgcttaaagaggttttcagtaggagacaagattaccacctgtaagtagagagaaggaagggtggaaggtgtgtgtgtacgtgtgtgtgtgtgtgtgtgtg

SEQ ID NO: 51222 - DNA, 601 bp, Human
atcagggttttaccaaaggccaagggtacacacagtgaatctaatgctataaaataataatttaaattcagaccaatacttaatcatctgtaaaaagtgatattatgccagtgtaccctttcttctttcttttttgaggcaagaaattacttaatgattcaccgaatatggtaaactagtattcttattcgctaagctgcttgaaaaataatgaacgtgatgaatgttggtgtatttctaggatatagtttctttggtcccacgcctgcggcacatcatcactgttgatggaaagccaccracctggtccgagttccccaagggcatcattgtgcataccatggctgcagtggaggccctgggagccaaggccagcatgggtatgttacacttttctaattccttacctgtgctttctggtgaccacattctccagaattatgccaaagttttgattctgaggttagctcaaatgacacatcagttttctaacatcagttaggaaaacaggtccctctaggtatactgtcatcttgtctttaaagaaagttttaaggaaaaatataaacattaattattaatgttttaaaggtagtattta

SEQ ID NO: 51223 - DNA, 601 bp, Human
agggtgctgtgcattgaaggagtgaagggctgatttggaagtaaagacttccaagtgtaaacattatttaagaaatgtatcttgactgacaggagaggaagggtattctattgggagtacatttaaataattttttcacactcatttagaagttcacatgtagagtagttctgggagtggttcagacatatcagcaatgccaaccatgacctatttctctttgttcttctgctgtgccacctctatagcttctcagctgttgtccttaggctggtactcttctgatttcaaatggttcacrtcgtgttttaatgcaggactctgagtgtaaccaagttagtcaccattctgaagcagtgaatagtttttagcaaacacctagatactctagtccaaagctacctttatttcttagttgaattactgggataatcttgtctccctgataccttttttccccttgtaaagttagttagccacacagcagccaaagtgatcttttttttcacagataataacatactcctgttcaaaacaacattgctttacatccagaacgtaatccagagttcttcccgtggcctttgaggtcctatgtgtg

SEQ ID NO: 51224 - DNA, 601 bp, Human
acaggagaggaagggtattctattgggagtacatttaaataattttttcacactcatttagaagttcacatgtagagtagttctgggagtggttcagacatatcagcaatgccaaccatgacctatttctctttgttcttctgctgtgccacctctatagcttctcagctgttgtccttaggctggtactcttctgatttcaaatggttcacatcgtgttttaatgcaggactctgagtgtaaccaagttagtcaccattctgaagcagtgaatagtttttagcaaacacctagatactcwagtccaaagctacctttatttcttagttgaattactgggataatcttgtctccctgataccttttttccccttgtaaagttagttagccacacagcagccaaagtgatcttttttttcacagataataacatactcctgttcaaaacaacattgctttacatccagaacgtaatccagagttcttcccgtggcctttgaggtcctatgtgtggtccctgatagccacttgaccattgtttcttgccactcttcctcttgctcactctgttccagccacactccttgctggtctttagata

SEQ ID NO: 51225 - DNA, 601 bp, Human
gttcacatcgtgttttaatgcaggactctgagtgtaaccaagttagtcaccattctgaagcagtgaatagtttttagcaaacacctagatactctagtccaaagctacctttatttcttagttgaattactgggataatcttgtctccctgataccttttttccccttgtaaagttagttagccacacagcagccaaagtgatcttttttttcacagataataacatactcctgttcaaaacaacattgctttacatccagaacgtaatccagagttcttcccgtggcctttgaggtcctrtgtgtggtccctgatagccacttgaccattgtttcttgccactcttcctcttgctcactctgttccagccacactccttgctggtctttagatatgctgagcacattcctacctttgggtctttgcatttgcttatttccttctaattagaacactcttctcccagttccagggtttccatggctcccttcctcactttattcaggcctttgctaaacgaaactctacagagacggtctccaggcttttccatccaaatagcatctattgtcatcttctcaccttgtcttgcttcagttt

SEQ ID NO: 51226 - DNA, 601 bp, Human
cgtaatccagagttcttcccgtggcctttgaggtcctatgtgtggtccctgatagccacttgaccattgtttcttgccactcttcctcttgctcactctgttccagccacactccttgctggtctttagatatgctgagcacattcctacctttgggtctttgcatttgcttatttccttctaattagaacactcttctcccagttccagggtttccatggctcccttcctcactttattcaggcctttgctaaacgaaactctacagagacggtctccaggcttttccatccaaatagcrtctattgtcatcttctcaccttgtcttgcttcagttttcttcataggttaatctgtttgtatatctcaatagaatatatctcccatacgtgcagggacttgatctattttgttgatctcagtataactaatatttgttgaattgagttaaattaactcaatttgattgagttatttatttgatgataatgaaaagaaattgttgatacagctgaatctcatgaaagtgtatgtgtgtgttttttctcttcaatgcagaaaaccaacctcatagcaaaccattgccctcagatattgcagt

SEQ ID NO: 51227 - DNA, 601 bp, Human
aggaatgtctcttacgtatgcatacatttcagaaaaaattaagtgcaacaattttcttacaggtttgcctcagttaccttctatattttggttatgggggcagctcttgaagtatatacaaatacttacacattttctgtatattaagatctaatttattacgtaatccaattcccacaacaagagtcttatctgtaaaatttctggcagatagttgtggattctactttaactcttctggttggcaacccactagatgtaaagaccatttcctccttggatgatttcttctgttcttcaraagaaccctgtattattatttgtttaagccactgtttcttgtgcctcagtactttgcttcagcaacgcttataattcctgagtgcttttaagtaggacgggaaacagcattccttcctgcaagtgtgcgcctccttgcttttgggttgagctgtaattctttttccctcccatccccagcatctgcctatcctctgttttcacctgtctctctctctctctctctcacaaacacatacacacttgaccagcaaattgatgccctggggcccttccatgtgccttcaagcttgctcccatt

SEQ ID NO: 51228 - DNA, 601 bp, Human
agttcgaagcttgctagggggaaatattcgtctcctgttgtgtggtggcgctccactttctgcaaccacgcagcgattcatgaacatctgtttctgctgtcctgttggtcagggatacgggctcactgaatctgctggggctggaacaatttccgaaggtagtgttctccatggtcagaggctggagtgtgatgccagacgtttttttggggtatgggatattttctgcaaatatataggagaagagtagtaaggtgtttgtgaggcagaataatggtggattccaagtactatgatcatygatatcaatttttagaatgtattagatgcatctggagtcaataatttatctggagaagtttttatatcaaactgataggtaatattaaaaaccacttagcattttggaagagaaactttagtaacaaacactgactgttttgtgtacatttattttctcacatcagtgattaaatttctttttatgtagaaaacttaaggtgcttttgtttatttgtgtaggtgagtatattaaggctcaggttcagaaatgtttatgaggatttctgtaagtgttagagaaggaactaagttctggtct

SEQ ID NO: 51229 - DNA, 601 bp, Human
ctttgaagaggaaacataatgcaatagtaattcataatagtggagggttctttcctcacatccttgaaagccaccagtcttattcttcagcctggctcttgagctattgctgtattaattttaaatagggtgtgatagcataagctgatggaagcctgcagagatctcactttgaaatggtgatacattacatgggaaaagattagagaggtgttttatactgcacatcggtgaggcctaataagaaagtagaatagacgtaaaccattgttttcatcatcctttaagacagggatttcaractcaagaaccaggcagctacctatttaaatgagtcaagtgggccctaatgtaagacaatgtgatgggtaaggattgattctgagggaacaggagcaggcatgccctctctaacagaggccgtcagttctgctgtacctgaaatgtgggcccattgttgctggcgattccacacttacatctaaaatttcctgattttttaagaatgacaataactaatttaaaaaaaaaaaaaaaacctcaatgtaggccaaaaaatacgactctacaggcctcacggcctgtgcttcaccaatatgtg

SEQ ID NO: 51230 - DNA, 601 bp, Human
ctaataagaaagtagaatagacgtaaaccattgttttcatcatcctttaagacagggatttcaaactcaagaaccaggcagctacctatttaaatgagtcaagtgggccctaatgtaagacaatgtgatgggtaaggattgattctgagggaacaggagcaggcatgccctctctaacagaggccgtcagttctgctgtacctgaaatgtgggcccattgttgctggcgattccacacttacatctaaaatttcctgattttttaagaatgacaataactaatttaaaaaaaaaaaaaaaacctcaatgtaggccaaaaaatacgactctacaggcctcacggcctgtgcttcaccaatatgtgacttctgcttttaaggaatagttggggatatctcagccttaggataaataatcatttttggtaatttagaaaaatgaagcagtgtattagctactgttctcaaatatcctttttttcatttaattcctagtgtgggactacaatactggcagagtgggagcaccattagtttgctgtgaaatcaaattaaaaaactgggaggaaggtaataaactattttaaccacagagcattaat

SEQ ID NO: 51231 - DNA, 601 bp, Human
ctatttaaatgagtcaagtgggccctaatgtaagacaatgtgatgggtaaggattgattctgagggaacaggagcaggcatgccctctctaacagaggccgtcagttctgctgtacctgaaatgtgggcccattgttgctggcgattccacacttacatctaaaatttcctgattttttaagaatgacaataactaatttaaaaaaaaaaaaaaaacctcaatgtaggccaaaaaatacgactctacaggcctcacggcctgtgcttcaccaatatgtgacttctgcttttaaggaatagytggggatatctcagccttaggataaataatcatttttggtaatttagaaaaatgaagcagtgtattagctactgttctcaaatatcctttttttcatttaattcctagtgtgggactacaatactggcagagtgggagcaccattagtttgctgtgaaatcaaattaaaaaactgggaggaaggtaataaactattttaaccacagagcattaatttttaaagtattaaacttgaaaattagtgcttcactttcttgctttagaatgtaaacacccataagtgctcatttttgtcctttg

SEQ ID NO: 51232 - DNA, 601 bp, Human
tagtttgctgtgaaatcaaattaaaaaactgggaggaaggtaataaactattttaaccacagagcattaatttttaaagtattaaacttgaaaattagtgcttcactttcttgctttagaatgtaaacacccataagtgctcatttttgtcctttgtgatagacgtgttttatctcgaactatatgaatgcatttatttttcttgtttcaaagatgtttctgaagaactattattgttttcattttacttattacgtagatgcaagtaagaattatggcaaaaacttgagaaatgtactawtaagtgaataatgtcaataaattaggagtgatcataactttattttgcagaagtaaaattataaaatttattttatgaaattgtggatttttgaatgatttttttcttttttttctgagggcttcaaccttgtattattagaaggaaattttcactgcaattccatagaagtctgtttattctcatgccatttaaaataatggtcacttaaaaatttatttgatcctgttaaaatatacaaattatctgtgttttattgggatgcacctttcctctacattaagtaaagataaagattct

SEQ ID NO: 51233 - DNA, 601 bp, Human
taaaaaaaaaaaaaaagttaatggcatttctatccctgtcttgctaactagaaacctgggaggagactcaagactgttctcttcagtcagcttcccatgcctattttatatcccactagtttattttatgagctatgtctcaaaatcatactcttctctctttgtctctcttacttgatcattggtcaggcctgtaccttctgccaccctctcccaataatttctctgttgccatgtttacccccttaaacacaccctctcactgccaccatgtaattactaaacatggatcttactggcsacaaccatttaatgtctcctagaagctcagttcagggtgcccctgttaacattgttcccctcttcaccttcatcgtcagttgttttcctcctcctccttgatgcagctgaaattagagctgatgttcttctggcttttgccagtgttgttgcacctgacctctcacttttcccttaggactcggctcaagcagctgagcatagtgactcaggcctgtaatcccagctactcgggaggctgaggtgggagtatcacaggagcccaggaggccgtgattgtgccactgcactccagtatgag

SEQ ID NO: 51234 - DNA, 601 bp, Human
gccagtgttgttgcacctgacctctcacttttcccttaggactcggctcaagcagctgagcatagtgactcaggcctgtaatcccagctactcgggaggctgaggtgggagtatcacaggagcccaggaggccgtgattgtgccactgcactccagtatgagcaacagagtgagaccctgtctcaaaatctcaaaaccaaccaaccaaccaaccctcagctcaggcctcacttgcaagaattttttccaaatccccaggttggagagtcttaacacttagcgctaccattgtagtaccaaygtattgaagtaatacgtttttgcattatgcatgtctccagataggttgtgaacttgcagatggcattgaatatcttcttcacctgcctggtactaatggataccagaaataaacctgttcagaagaacatacttgaagccctgctaatggagtccattaagtagaagttaattgtttttctttctttctttttttgagatgtagtcttgctctgtcgcccaggctggagtgcagtggcaccatctcagctcactgcaacctctgtctcctgggttcacgcaattctcctgcctcagcctc

SEQ ID NO: 51235 - DNA, 601 bp, Human
tttgcattatgcatgtctccagataggttgtgaacttgcagatggcattgaatatcttcttcacctgcctggtactaatggataccagaaataaacctgttcagaagaacatacttgaagccctgctaatggagtccattaagtagaagttaattgtttttctttctttctttttttgagatgtagtcttgctctgtcgcccaggctggagtgcagtggcaccatctcagctcactgcaacctctgtctcctgggttcacgcaattctcctgcctcagcctcctgagtagctgggattacrggtgtgcgccaccacgcccagctagttttcgtatttttagtagagtcggggtttcaccatgttggccaggctggtctcgaactcctgacctcaagtgatgtgcccgcctcggcctcccgaagtgctgggattacaggcatgagccactggacctggcctgtttttcttttaaaagcatgtatttagcagtacaaaaattagggcctaattttaatatgtgcttttaatttcagcataaccattaatgcttaattttgcaaagttttaaataatttgatagcaaattacttagagaatggc

SEQ ID NO: 51236 - DNA, 601 bp, Human
attactcattgttttcccctctccacctttctttgttttgcagatcgtaaaaaggaccttgtaaaactacaggcaggggaatatgtttctcttgggaaagtagaggcagctttgaagaatcttccactagtagataacatttgtgcatatgcaaacaggtaagaacgtggaattcatactacttttacttaaaatatttgatgtccatagacatttcctacctgtatggaccttctttgtaaaaatgttccgagaactcttcctatctgttacttgtgggaatggcctccttctcattgcmgccattagctgactcttttccttgtaaggcttcccctgatctttctctctgtccctgttttctgctttacgtctcactgcagtgtcccatggagggaggtgaagaaaataaaaccttccttcctgctgccttggtacccctacctacctgtccctcagcaggggaagcttcacagaactactccagaggaatggggagtaaagaagtggcagtgaggagtgtgctgcttacttactcctgctctacacttgagcctgctcggcactccaggcaggtcttggggctcctatgtaagctgtg

SEQ ID NO: 51237 - DNA, 601 bp, Human
tttgcagatcgtaaaaaggaccttgtaaaactacaggcaggggaatatgtttctcttgggaaagtagaggcagctttgaagaatcttccactagtagataacatttgtgcatatgcaaacaggtaagaacgtggaattcatactacttttacttaaaatatttgatgtccatagacatttcctacctgtatggaccttctttgtaaaaatgttccgagaactcttcctatctgttacttgtgggaatggcctccttctcattgcagccattagctgactcttttccttgtaaggcttcccctgatctttctctctgtccctgttttctgctttacgtctcactgcagtgtcccatggagggaggtgaagaaaataaaaccttccttcctgctgccttggtacccctacctacctgtccctcagcaggggaagcttcacagaactactccagaggaatggggagtaaagaagtggcagtgaggagtgtgctgcttacttactcctgctctacacttgagcctgctcggcactccaggcaggtcttggggctcctatgtaagctgtgttaagctgcagcctaaacacacagcctccccacctc

SEQ ID NO: 51238 - DNA, 601 bp, Human
ttctgctttacgtctcactgcagtgtcccatggagggaggtgaagaaaataaaaccttccttcctgctgccttggtacccctacctacctgtccctcagcaggggaagcttcacagaactactccagaggaatggggagtaaagaagtggcagtgaggagtgtgctgcttacttactcctgctctacacttgagcctgctcggcactccaggcaggtcttggggctcctatgtaagctgtgttaagctgcagcctaaacacacagcctccccacctcatgatgatgaagaggcagctgggracctgtctacgacagttgacatgaattattatgggaaaataaaatctgttatcaggaaaactaatttagaaacagatgttgggggtacagcccaagttagaaatgaattgcatttatttataaatgattctggtctttagccatttagtattttctttagtgatgatacagatctggatttattcatgtgatagtaaccagaagcatcttcttcctgatgttactattttatggccttcaaaaaagtatttgccttcgttgggcatagtcagagttcctctatcaatacaaattctgatg

SEQ ID NO: 51239 - DNA, 601 bp, Human
tttactacttgtcactgtaataataactgcagtcaacacagtttaccattttgttccttatctgttatcctttctatatttcagttatcattcttatgtcattggatttgttgtgccaaatcaaaaggaactaactgaactagctcgaaagaaaggacttaaagggacttgggaggagctgtgtaacagttgtgaaatggaaaatgaggtacttaaagtgctttccgaagctgctatttcaggtgagtattcggttaaactgatactaaaaactgagatgggaagagagtacttacatgcwttcaacctgttttaaggtttagggttcattactttctgctcagaaaccatttctaccgttagtatatggaagagtaaacttatcagtcccccattcaagccttgctacacaaattaaccactcccaccaaactgatgtacatgtatcttgaatgttcttgtctctgcaacctttgctttctgggttaccctttctcttatgtcagctgttcttcaaggccttgctcagttttctggccacactagcccatagtgatcaggccaaaactccttttgaaactttatacaatgttagagtact

SEQ ID NO: 51240 - DNA, 601 bp, Human
aaagggacttgggaggagctgtgtaacagttgtgaaatggaaaatgaggtacttaaagtgctttccgaagctgctatttcaggtgagtattcggttaaactgatactaaaaactgagatgggaagagagtacttacatgcattcaacctgttttaaggtttagggttcattactttctgctcagaaaccatttctaccgttagtatatggaagagtaaacttatcagtcccccattcaagccttgctacacaaattaaccactcccaccaaactgatgtacatgtatcttgaatgttcttktctctgcaacctttgctttctgggttaccctttctcttatgtcagctgttcttcaaggccttgctcagttttctggccacactagcccatagtgatcaggccaaaactccttttgaaactttatacaatgttagagtactggtagttggttgtactaatagtttcataaccatttttggtggggtgaggagtgcccaagactagtttaatattgttggtctaataaaaacatctgtgtcttttgagttgttgtgtcaagcataaaacaagcgtgaattattttttattttatttattttt

SEQ ID NO: 51241 - DNA, 601 bp, Human
ttacttttacaggttagagttaatacatctttttttactcccaaggcactttatgtctttaattttgcatatttctttcttttattgtagtaaaaatctcataacgttcaatttactatcttaacattttaagtgtacaattcagtaatgttaagtgtatttacattattgcacaactgatctttataactatttcatcttgcaaaacggagacactatacccattacactaattccccttccctctctcccccttccctccacctttttactttatgtttctaaaattttgattacttgwggtacttcatacatgtggaatcatacggtatttattcttttgtgactgtcttatttagtgtatcttcagggtttattcatattgtaccatgtgataggatttttcttttttaggttgcgtaatactccattgtatgtatattgcacattttctttatccattcatctgtgtttggacatttgggttgtttctaccttttgggtattgtgaataatgctgtgatgaacatagatgtgcaaatatggctttgagattctgctttgaattattttggatatatacccagaaatgagattgtta

SEQ ID NO: 51242 - DNA, 601 bp, Human
ctaattccccttccctctctcccccttccctccacctttttactttatgtttctaaaattttgattacttgaggtacttcatacatgtggaatcatacggtatttattcttttgtgactgtcttatttagtgtatcttcagggtttattcatattgtaccatgtgataggatttttcttttttaggttgcgtaatactccattgtatgtatattgcacattttctttatccattcatctgtgtttggacatttgggttgtttctaccttttgggtattgtgaataatgctgtgatgaacayagatgtgcaaatatggctttgagattctgctttgaattattttggatatatacccagaaatgagattgttagatcctatggcaattattaatactatatttaattttttcaggaaactccatactgtgttccttaatgactattgatttacattcccaccaacggtattaagggtttccatttctccacatcctcaccaacatttgtatatttttttctaatatccattctaacagatgtgaagtgatatctcattgtggttttgatttgcatttctctttttattagttatgttgggca

SEQ ID NO: 51243 - DNA, 601 bp, Human
ttctttatccattcatctgtgtttggacatttgggttgtttctaccttttgggtattgtgaataatgctgtgatgaacatagatgtgcaaatatggctttgagattctgctttgaattattttggatatatacccagaaatgagattgttagatcctatggcaattattaatactatatttaattttttcaggaaactccatactgtgttccttaatgactattgatttacattcccaccaacggtattaagggtttccatttctccacatcctcaccaacatttgtatatttttttctamtatccattctaacagatgtgaagtgatatctcattgtggttttgatttgcatttctctttttattagttatgttgggcatcttatatatacttgttggccatttacatatcttctgcagaaaattgtcgattcaagtcctttgcccattttaaaatcagaattctgcaccctcccccccccaccccacccccgtagttaagttgtacaagtttcttacaaattctgaacatgtattagtctgttctcacactgctataaagacatacctgagactgggtaatttataaaggaaagaggtt

SEQ ID NO: 51244 - DNA, 601 bp, Human
ttctgattgttctattcataaatgaaagtggagtattgaagtctcctactattattgtattgctttctatttcttcccctagttatgtcagtgtttgcttcatatatttagaaacactcaagttacgcgtatatttgtaattgttatatcatcctggagaattgactcttttatcattatattgtaattaatgtccttctttgtctattgtgacaatttttgtcttaaagtctgttttatttaagtatggccatcccctttaggttcttattttcatggaatatctatttccatccttcastttaggttacgcatgcccttggatctaatgtatgtttcttgtggatggcatatacttgagtcttgttttatattcagttggtcaatctgtatcttttaattgggcatttaatttacatttcaggtcattattgatatgaaagacttttcatacctatttccattttgttaactattttctgtatatcttgtagcttttcctctcttgctgccttcttttgttttgttgattttttgtgtgtataattacattctttgattcccttgtcttttatctttgtgtatgttctatagacatttt

SEQ ID NO: 51245 - DNA, 601 bp, Human
tttgttgggatgtcagcatttgaaaaatcagctacctttctctgtcttacagtctgcttttgtattgagaggactttgtccagtcagccctactacggattctagagccagccatcttaagccttttccgaggctgtgtcctttttgagtttgtggggtacaatctaattgaagaggtttgctggtttctactcaggagctccctctggtgtctgtctgtgatattgtggcctcactggtgctgtagttggccatggtactggagctctacctagtgtctgtgatactgcagcctctggtkcatgttaatctttgttcttgacagctcccaacctggtgccctgttcctgttatttagattcaggaaagacagaagcaagtttcttgcaccccagaagtcagaatattggatgtgtgttccactcctcttagggatttcttccctattactttgtactgtgctgaggggagggtctctggcaagcgaatgccttgcatttttctaccagcctttgatgcggttggtttccttctgtcccggagtgtaggaacttcttaagtggtttctgggtttcttacacaggcaataaataggcccata

SEQ ID NO: 51246 - DNA, 601 bp, Human
tctgtaggggaaggagggactgcgttttcctatattgtcatcttgctgacatcactccttaacacatttctttcatgtatcatatggctagctgtttacccatttccctttgttagattgcatgctacttgaaagcagaaacttgtcatttttttgcatttttaaaagaatgtttagtaaagcactttacatgtagtaatagttttttaatatttgttgaacgaatgcttagaaaaataagtcagtcctactgacgacatacggtttttcaaaactacatctgccccttaatctcctttamatgttttcctttcttcccttcctttctcccttcatttgctgctatcatgaatctccttagtattaggcaatatgttagtaacacaatagtgagcaagcattctgtatccacatagcttgtagggaatatcctggttcaatgacataatttgtcttaaactttattattttttaatttctgaagtaaatgtgctctgcataataaattcaaggaaaacaaataggcataaaggaaaaggtgaatttccccatttcctttctcctggataccaggctctagaggtgtggagtttatagcttg

SEQ ID NO: 51247 - DNA, 601 bp, Human
aggtgtggagtttatagcttggtatgtatccttctcctcacatctaggtgcatataagtttatgcagcctgtgctggaacttgtcttttttttttttttttttaacctaacaataggcatttatgcagcatataatgaagtttcagtcagtgacagacacagactgcatatatgacagtggtcacgtaagattataatgtatttttactgccttttctatgtttagatacacttaaatacacaaatacttaactattgtgttacaattacctatggtattcagtacaataacgtgctgtgygggtgtgtagcctaggagccgtaggctagataatgcagcctagatgtatatatagtaggctataccatcgacattcgtgtaagatatgctatgatgttcccatgatggcaaaactgccaagtgtgtgatgcatttctcagaacatatccctgtcattaagagatgcgtgactatattggataccctattagatacctgtctaaatgtaattttttttttttttaaatgagatggggtttcgctctgttgcccaggctggagtgcagtagcacgatcatagctcactgcatcttcagatct

SEQ ID NO: 51248 - DNA, 601 bp, Human
tttttttttttttttttaacctaacaataggcatttatgcagcatataatgaagtttcagtcagtgacagacacagactgcatatatgacagtggtcacgtaagattataatgtatttttactgccttttctatgtttagatacacttaaatacacaaatacttaactattgtgttacaattacctatggtattcagtacaataacgtgctgtgcgggtgtgtagcctaggagccgtaggctagataatgcagcctagatgtatatatagtaggctataccatcgacattcgtgtaagatrtgctatgatgttcccatgatggcaaaactgccaagtgtgtgatgcatttctcagaacatatccctgtcattaagagatgcgtgactatattggataccctattagatacctgtctaaatgtaattttttttttttttaaatgagatggggtttcgctctgttgcccaggctggagtgcagtagcacgatcatagctcactgcatcttcagatctcctgggctcaagtcatcctcccacctcagcctcctgagtaactggtactacaagcgtatgccactatacccagcttatatttttta

SEQ ID NO: 51249 - DNA, 601 bp, Human
agtagcacgatcatagctcactgcatcttcagatctcctgggctcaagtcatcctcccacctcagcctcctgagtaactggtactacaagcgtatgccactatacccagcttatattttttatttctattaaaaaatatttttaagttacttattttagagacaaggtctcgctatgttaccgaggctggccttgaattcctggcctcaagcgatcctcctgcctgagctttcagagttactgggattacaggcatgagccatcatgcctggctctaactcgttttcaatgacagaatatrtattctattttgttcctatatcatattttatttaactcattttcctcttgatggggacttgttaaatagtttattgttttacttatgtttgtattttgaggaatagattctttagaagtgacattcatggttcacttgttggttgtgcattttgatggatacgcaaaaagtggggaagttacaccatttgctaagaacttaaataccttttcttcttttttttttttttaatcatcttagcaagtctggaaaagtttgaaattccagtaaaaattcgtttgagtcctgaaccgtggaccc

SEQ ID NO: 51250 - DNA, 601 bp, Human
tttcagagttactgggattacaggcatgagccatcatgcctggctctaactcgttttcaatgacagaatatatattctattttgttcctatatcatattttatttaactcattttcctcttgatggggacttgttaaatagtttattgttttacttatgtttgtattttgaggaatagattctttagaagtgacattcatggttcacttgttggttgtgcattttgatggatacgcaaaaagtggggaagttacaccatttgctaagaacttaaataccttttcttcttttttttttttttaatcatcttagcaagtctggaaaagtttgaaattccagtaaaaattcgtttgagtcctgaaccgtggacccctgaaactggtctggtgacagatgccttcaagctgaaacgcaaagagcttaaaacacattaccaggcggacattgagcgaatgtatggaagaaaataattattctcttctggcatcagtttgctacagtgagctcagatcaaataggaaaatacttgaaatgcatgtctcaagctgcaaggcaaactccattcctcatattaaactattacttctcatgacgtcaccat

SEQ ID NO: 51251 - DNA, 601 bp, Human
gcagggtccccaggtccccacactttgtcttgtcctgactgagaaagaaacagactgccctgacctctctgacttggccagcgaggttgcccttaggctcaaacccaagccagggtttgaacattcccagacacttgtaagatgtttaggttgttaacataatgttcaggtttcaaaacattgaaagaaactagccccagccctgaacccagatcccccccggcttcaggcatgaccagtgaacacgcccttctctcactggtcacctgaggatgccgcactctgtcaacaggttcccctratacatgctctgatctgatcgccttggcatttagtgattctttccctggaattctccactggccccatcgcagggaactcccaagtgggaaactcccctaccaccacttttggggcaacttcagctaagggttcagctgggacaaaacagggagccactcgggaacctgggacaggaccagagagaaaacccgagggacagagtgggtaaggaaagctgctgaggaagggcccaaagggcactctggaaagaagtggcactggagggctggggtgggggtggtcctggccagggagtctt

SEQ ID NO: 51252 - DNA, 601 bp, Human
ggctacagtggcccccttaagtctccctcttccagtttcgccttaagagaggccctcaggaccttggaggaacccctctccaacgtggaagtgtgggtccacatagggctgcagctgtggccagtgcaggcatctctggccccactgtattcttgcttcatgttggagaacactgcaccagcagatggtctcattttggtttctgtgggacccactttggctgcaaagagccacactgccaggtcacacctgcccagggcagcccacactggggacccaccaggccatggtgtgaagtccyggccagcctggccccacatggcacagcatagccagttctcctccagggctccctgctgggccaaccacagctctgcggatcctgctgcctgagtcgacctctcctctcccgtcctccctgccttcctggtgccgacccccagtgtgcatcctgtacctcgacctgtctcagcatctgtgcctgagacaccggcctgtgacaagatcatcatcatctgtgtcactccccaagcatgctgcgcactggacacacaggccctgactcaacttgtcctgtctgacttcagtggtcctacaggat

SEQ ID NO: 51253 - DNA, 601 bp, Human
gcggctctgtggaggctgcagcaagcccagtgagagaatctccacgtggctcctggggcttctgagcagggtggcagaaggttcatgtgcaaccgggtcctggaccatgggaccacgtggccagagccacccatcacacctaccaggcacaaggtgcacagcccagcagggccgcagtggacgggagcgacacctcagggctgagtgcgggcaggacccagagccccacgccccagtggaggcgtcacagcagtggtcattgtggggtgccccacaaggagggggaagagggaggtgtccmagcgtggctcctggctggccagctgaccccagtggagcagtcagagggactgtgggtctgagtttttctccccagcagcaatgggagctccccaactgcaaagtgccagccagcctgagagactagtgttacagcaaagaacccaggagctgaggtcctggcacatgccacacatgtggacaccaacccagggtccagccccaggacgaggccaattcgcaatgacgcccctttctgtggtgctggctctgcacaaggatgcaggatacaggaaccagggtgggagcaggggcctccctt

SEQ ID NO: 51254 - DNA, 601 bp, Human
agtgagactccgtctgtacaaaagcttatggtaatgtgcgcctgcagtcctagctactcgggaggctgaggtgggaggatggcttgagcctgggaggttgaggctgtagtgagctctgatcacaccactgcactccagcctgggtgagaatgagagaccctgtctcaaaaaaaagatagggtttgggggctggaggaacctagaccacagcctggcccgttgagggagtgcacctgtggggctctgtgccagcacctcgcacagggagggagtgtggccatgcggataagactgaccagcrccatctacgaagcgagccttccctgccaggacagggccagagtcactgagctcagacctctgcagcctgggctggtcagtcctgggctcgctggcaacactcctgggcaagacagggcacagcccctgcagcctcaggtacaagtgctgagccctggaccagatgagtgcacctctatctcaatcagaaaaaaacacagcaaactccgcgtccacgtggagcagacaacagctcacatttgccactttgcctccaggctgtgccagctctcctgtccaggcatgagtgcccagagaccta

SEQ ID NO: 51255 - DNA, 601 bp, Human
tcagagctgactcccaccagggccccagcatcacttctttgagctctgagtttcacctgggtgtccccacagcttggccacacactcctgagacacggccgccctcctggggagaggtgccctgcatagcaggaagaggcctctgggcgcctgccctgaggtgggagaacctccagggctggcagcagcaggtctggagaggaaccaagcttgggaagctgctgggggcagggcaggccttgagaatggctctgtaccccctgggcagtcactgggcctggggtgtctgggtgcacacctrctccccttgctgtgggggaggctggggactcgggaagctgctgcgggaggcaggggtggggctcacctccacatcctgcttgttggccagcaccaagacggggacaccgcacagcgcctcgctggtcaccaccttctctggggagggcaggagaggcagcgcctcacacccagcatcctgcctctgactgcccaggggcccacaggcgtggacactgtgacagccactccctctgccccccccccccccgtcacccactaggcaggagcacttctgaccagacactgagcctgccccagg

SEQ ID NO: 51256 - DNA, 601 bp, Human
gaggactgaggcctcctgggcagtggcggaggcaggtcccaggggcccacacagccggggatgatggagaggtgggagccctgcatcagtgatgggggcagtctgcagtcatggtggcttctgctcacaaccacctgcccagtcttcaaaaagcagccctcccctccccttttcctccgaggggagacccctgccccgtaccagatgtccctcttgtcggctgagattgtaggggaggccagccttacaggctgggggcaacagagccaccccagagaaggcaggaagtgaagattcacctggccctctggacgccgggctgcttctgtgcaaagccactccaagagaacagctagaactcagcgtggccagtgctcccgggggcagtggcacctcagaggggtcttgaggggctgccctgggggtggggctggcacagatgccacctccaagggtagcaggaacaggtaagggtcagagctgactcccaccagggccccagcatcacttctttgagctctgagtttcacctgggtgtccccacagcttggccacacactcctgagacacggccgccctcctggggagaggtgccctgcat

SEQ ID NO: 51257 - DNA, 601 bp, Human
ccaaagcaaagcaaacccaccccccagatcagcagcatgggagccaacaggaggccactcctccagcaccaggggaccagccgtcccgacggcagcgcggctgcgcctacgtgatgtccctctgccgcggcggccggtgcacattccgcacgacacacttcaccatccactcgatgccctcgcgcacccctttgctgtgaagacagcgggtgtgaggcggggggtctcggtccccaaagcccccgcaggtgcagcccccactcaccctgtgagggccgagcaggcctgggtcaggcaatckcgcctgccgatcttgctggtgcagtcgctgaaggccgtcttgatgtcagggattgagaggcacgtctgggggaggtaaggccgtgaggagcagcccccacgtctggccctgtcctgcctgtgggcccgggactctcagaagggcgtatgcccttcaccccagggaaacagccagagctccaccagggtcccagtgtctcccacagagaccacagcagtgaggaccctgtgctcagcccgaggctgaacatggctggtagtgcctgagacaaactagacgtccacacggctccaaggagtc

SEQ ID NO: 51258 - DNA, 601 bp, Human; identical to SEQ ID NO: 22194

SEQ ID NO: 51259 - DNA, 601 bp, Human
attaaaaaaaaaacaaaaaagaggtggcgtctttaggaaatgacttaatcactctgccttcatgactgggattagtgcccctgtaactgaggttgaagggagctgccttgtccttccatcaggtgaggacacagcacttggcctttccaccatgtgaagatccagaaaggaggggccatcctggaagcagagatcaagcccctcaccagacaccaaattttctggtgccttgatctgggacttcctagcctccagagctgtgggcaataaattcatgttgtttttaaattacccagttgayggtattttgttacaacagcaaaaactaagacaaggatttttaatcctcttttgctagtccttttctttcttttttttttttttttttttttttttttttgagacggagtctcgctctgtcgcccaggctggagtgcagtggcgcaatctcagctcaccacaagctccgcctcccgggttcacgccattctcctgcctcagcctccccagtagctgggaatactggcgcccgccactacgcctggctaatttttttgtatttttagtagagacagggtttcaccatgttagccaggatggt

SEQ ID NO: 51260 - DNA, 601 bp, Human
ggctactgcaacataacctagtgaaagctgacagtgatcaaacaaatgcaagttaaaatactgagaaggtatttcacatacatttgattggtccaaattaataagtctggtaacaagaatcaccgatgacaatgtggcaaaatcaaacttaatggttgctggttgaaatgtaaatggtcaattttatcaatttcatttattattttggcaatatctggggaaactgaagaagtaaaactggattccatcaatctagcaattccgccactaggtatctaccctgaagaaactcttacacaasgaaacatgtcttaaaatgttcactaaagaactatttcttatagtatacaaagaaactgtgactcaggaggggaataaactagtttagtcaaagaaatactatacaacagtctaaatgaatagatttatatatcacaaaaagatacatgcaggacaagaaggaaaagatgagaatgagactttggcaatgtcttaaatgttctattttgttaaagatctaaaacactgtaatcccagcacttgggaggccaaggtgggcggatcacgaggtcaggtgatcgagaccatcctggccatggtg

SEQ ID NO: 51261 - DNA, 601 bp, Human
agaccagtccctcctcttcctcctcctcttcctcaggcaatatgaagacaattagaatggagaccttaatgataatccacttccacttaatgaatagtaaatatattttctctccttcttattttttaagaacatcttttctctaccttattgttaagaatacagtatataatacaacacacaaaattgtgttgactgtttacgttattggaaaggctccaggcaacaggagactgattattagtagttacatgtgggggcagtcaagagttatatgtaaaatttcaactgtgcagaaggytggtacccctaactccctccttgttcaagggtcaactgtatttcaaatttgtacaatcaatcagaggtacttcaagggaaaattagagctatgaaagcaatgttttaagtgttaagaaattagaaaaagcacagttatcccaaagaaaaagagcaaaacgagatgaaatgttacaaaatagagaagatacaatagaaatgataaaaccaagttgtttcctttgggaaaaaatatataatggtaaatctatagtaagaataattttaaaaaggcaaacgacactagaaataagaaataaaa

SEQ ID NO: 51262 - DNA, 601 bp, Human
tccgagacccgaactcaacacaagaaaggcaaaaagacctcgacacattctgctctctgagaaatacttttatcaacagaacactgatgaagagagcctacattgttagccttattcataactaagaaaaaacggtactgacattcctgtgtaggcagaaacaatgcccttgattctcagacaaaatcaacatgtgggaacaactttgagatgccagaggaaaatgtgagcaactctaactcagaatgcacattcactcaagcttccaaagtcttgcaggaactttcacacttatttgcaractttaaaacacatataccgacttatcagttgtagtaaaaccagctcaattctagaaatggaggaagcaaatattttcattctctttgcaatctgagaatagaagagaggaagtgactcccccaagatacccaaagagtaaaaagaaaagtaaacatagatcgcctgactttatatccatggcttcaactaaaccttattgtttttttcccccgcttagaggaaagagctctgctgttttaacacactgagtatgtaaatgaccttagcagcaacatcataaagagtgctagagtcaagt

SEQ ID NO: 51263 - DNA, 601 bp, Human
gttgttcaacacagcaatacaagagagtctttcacaaggcagtgcatgcttaattgccaaactaatggtgcaaacaagttccaaggaagaaaagaacattctgagagctggatttgagttggaaactaagataggcaggaatcatgtgatggggaaagcaaaatgtggagttggtagggtcagaaactggaaggaaggccaggcaactcagcatatgtctgattagaggaccaacttgacacaagggaagactcagaaaatcaagtggtaacagaggtcaaaagatagcctgaggttataygtgaccaagagtggaggagggaggggggccgaggtccagctaaggagtgacttgattatgaggccaggctctgctgctgtgagctccttgtgttcttcaagctggaccaaaatattctatcacttacatggcacggcagtcttttcccatttagtaaatacaaattaagttttgaatagaattaccaccctaaatcctgttttaagctaaaaggataaagacatgccaccttgaccaatgtcactggaattttaaattgcacataatacatgcccattaaattattcctagttcccaaaa

SEQ ID NO: 51264 - DNA, 601 bp, Human
atgtgttctcattgttcaactcccacttatgagtgagaacatgcggtgtttggttttctgttcctgttttgctgagaatgatggtttccagcttcatccatgtccctgcaaaggacacgaactgatgcttttttatggctgcatagtattctacggtgtatatgtgccacattttctttatccagtctatcattgatgggcatttgggttggttccaagtctttgctactgtgaatagtgctgcaataaacatacatgtgcatgtgtctttttggtagaatgattgataatcctttgggtrtatacccagtaatgggattgctgggtcaaatggtatttctggttctagatccttaaggatcttccacactgtcttccacaatggttgaactaattcatgctcccaccaacagtgtaaaagcgttcctatttctccacatcctctccagcatctgttgtctcctgactttttaatgatcgccattctaactggcgtgagtacatattttaaagtaacaaaaatgtgtccaaactgattttaaagcataaattttattctgaaaataacttttcccaacatttctaaccttactcgaccctg

SEQ ID NO: 51265 - DNA, 601 bp, Human
ctccaaatgctggcatattatgttatagtgctataaatactaatgataaattctgtccatgtttccacttggccacagagtatgtgctcctgctaagggaatggatgaatagaatgcacctaattccagcttttgtgtgataaattaaacaacattcacaggtggagacaagattctcaaatccctgtcccccatatcatgcctggcagctgggaaggtggaggtaggatgaggaaagcaaataattggtaaaatttcctgatagctgaaaaacaaaaactatgtcagtaacatcatcttwaatttgttcagaagaacaggaagcaatagaaaagaaatcaaagactagaaataaaacagtaatgatgacagaatgattctaaacacagtggatttaacaaaagatactgataattgttgttgcatgagagagtgtaattagattacatcccttcatttgatgaactctggcaaagattttttaaattttactgcctacatatatttttttaaattatacttttaagttctgggatatgtgtgcagaacgtgcaggtttgttacataggtatacatgtgccatggtggtttgctgcaccca

SEQ ID NO: 51266 - DNA, 601 bp, Human
tgaacaaatgtttctggtacattttttttatgtcatccttgatacgcaaggatatattaaaaccttttctttcttgtaacccccaatttttgcttggatgctactatttaagcagttttaaaatgaaaaatgtaataggttaggttagggtatagctgagtttttcctaaatatatcttttttttttttcttttgggagatggagtctcactctgtcgcccaggctgcactgcagtggcatgatcctggttcactgtagactctacctcctgggttcaagcaattcttgtgcctcagcctyccaagtagctgagactacaggtgccccctcaccatgctcagttaatttttgtatttttagtagagatggggtttcatcacattggccaggttagtctcaaattcctgacctcaagtgtgatctgcccgcctcggcctcccaaagtcctgggattacaagcataagccagcgtgctcagccctaaatatatcattctttgaaatccaaaagtttctcctcagtgaagacatgcataccgactccagcctatagtaacttggcacttctgtgcttttgtattacttttcagaactataaaca

SEQ ID NO: 51267 - DNA, 601 bp, Human
aagtggtttgccctgaacaaatgtttctggtacattttttttatgtcatccttgatacgcaaggatatattaaaaccttttctttcttgtaacccccaatttttgcttggatgctactatttaagcagttttaaaatgaaaaatgtaataggttaggttagggtatagctgagtttttcctaaatatatcttttttttttttcttttgggagatggagtctcactctgtcgcccaggctgcactgcagtggcatgatcctggttcactgtagactctacctcctgggttcaagcaattctygtgcctcagcctcccaagtagctgagactacaggtgccccctcaccatgctcagttaatttttgtatttttagtagagatggggtttcatcacattggccaggttagtctcaaattcctgacctcaagtgtgatctgcccgcctcggcctcccaaagtcctgggattacaagcataagccagcgtgctcagccctaaatatatcattctttgaaatccaaaagtttctcctcagtgaagacatgcataccgactccagcctatagtaacttggcacttctgtgcttttgtattacttttc

SEQ ID NO: 51268 - DNA, 601 bp, Human
ttcctagttaatgccaagccaaagaaagcctggatcaaaaatggcaacactagccctgtaaagccaggaaagtggtttgccctgaacaaatgtttctggtacattttttttatgtcatccttgatacgcaaggatatattaaaaccttttctttcttgtaacccccaatttttgcttggatgctactatttaagcagttttaaaatgaaaaatgtaataggttaggttagggtatagctgagtttttcctaaatatatcttttttttttttcttttgggagatggagtctcactctgtcgyccaggctgcactgcagtggcatgatcctggttcactgtagactctacctcctgggttcaagcaattcttgtgcctcagcctcccaagtagctgagactacaggtgccccctcaccatgctcagttaatttttgtatttttagtagagatggggtttcatcacattggccaggttagtctcaaattcctgacctcaagtgtgatctgcccgcctcggcctcccaaagtcctgggattacaagcataagccagcgtgctcagccctaaatatatcattctttgaaatccaaaagtttctcct

SEQ ID NO: 51269 - DNA, 601 bp, Human
ataaatacactggctttgcaagatgaagattcctagttaatgccaagccaaagaaagcctggatcaaaaatggcaacactagccctgtaaagccaggaaagtggtttgccctgaacaaatgtttctggtacattttttttatgtcatccttgatacgcaaggatatattaaaaccttttctttcttgtaacccccaatttttgcttggatgctactatttaagcagttttaaaatgaaaaatgtaataggttaggttagggtatagctgagtttttcctaaatatatcttttttttttttyttttgggagatggagtctcactctgtcgcccaggctgcactgcagtggcatgatcctggttcactgtagactctacctcctgggttcaagcaattcttgtgcctcagcctcccaagtagctgagactacaggtgccccctcaccatgctcagttaatttttgtatttttagtagagatggggtttcatcacattggccaggttagtctcaaattcctgacctcaagtgtgatctgcccgcctcggcctcccaaagtcctgggattacaagcataagccagcgtgctcagccctaaatata

SEQ ID NO: 51270 - DNA, 601 bp, Human
aaatttttaaaagcttaaccatgaggcagtcagcaaagaggatccctgtcccagcattcaactatctgcctgcatactccaaatccatcaattttcagttttcaatctggccaggctacatcccatggtgtatatgtgctccttttgtccctttcaaagacccagatagaaaagccaggataataaatcaaatgctcaattattcacttaaaatgctttaaaaaaaaaatgattggctgggcgcggtggctcatgcctgtaatcccagcactttgggaggccgaagcaggtggaccgtgasgtcaggagttcaagaccagcctggccaagatggtgaaaccatgtctctacagaaactacaaaaaattgccagttgcagtggcaggtggctgtaatcccagctactcgggaggctgaggcagaattgcttgaaccaggacagcaaaagttgcagtgagccaagatcgtgccactgccctccggcctgggtgacagagtgagactccatctcaaaaagaaaaaaaaaaaaaagattaacacagcctgctaaaataagatttatctgacaatcttcaatgacaactatatttgagtctacctt

SEQ ID NO: 51271 - DNA, 601 bp, Human
aaagccaacctctggaatgaagatgcagaaaacctcaaaaaagcccccagagcaatggatcttaaagcttgctaagaaaaccatatttgatgacatgtaaatacccacaaattttatacaaaaaaagtttttttgcttaaacaagacaataaacacctctgtcagttctagtatgtcagttgctcagccattcataaaatacagccctgcaggcattccataaatgccttcctttggtaataaaagtttaatggaatagtattctagcttatgaggaagaattatctaaatcttcatttgytctaagtaaacagctgctaaatagcctgctaaatttgcaacttcttatctgcaaaaaacaaatatttctactcttagagtttatttcagtgggaaataagttcacctttgacattctacatttttgtaacacaactggttatagccaatgtctctcttctgaccctccaacagaagggtaagtccttggacactagggattggtttattcaaaattacaagataaaatatactatttttaaatcttgtggggtttttcttacttgtaaaagtactaaatagggtttaatttttcagtcta

SEQ ID NO: 51272 - DNA, 601 bp, Human
ttcttacaacatatttttcttgtatactattccttagagaataaaccaaaaaaaggaagggagggagaaaggaaaacttctcacagttcattaaggattgccacatcttttccattccacaggattcaaaggattatgacagaatattgggggaattttgcagtgttgttgacaggaatgacacaaaataccattcaatgtagtttcagttgctaaaaattaaaattaaaaagctgctgcttagaaaaacacacactagactagaacagactgcaaagataccctccagtaactgtaacckgcaatcatttaaaaggaaatcctagtaaagctataagcacacaggttcacctttaataaaatcacatagatactttgactccttacttgcccttcttacatgttatataagtaaggcccttatttcatgagcacgatgcttccaagcccatcaagtctaagagcagtattcaatggaatgttcttccaccccagtctgctgggttttgaaatatttcagaattcttaactgagcatataattaatctcataagcaactcggtaagcttaaacaagatgcaaaaatatatttcatttttat

SEQ ID NO: 51273 - DNA, 601 bp, Human
ggccctccacactgcagttattgtgtgctgaggagacgatgatgggaagcgcacaatgcaatctatacattacagccctgaagctatgtattttgcactagctccaaacaacactatgcaaatataaaaggccaaggaaagaaaggtatgcacagagcaaacacaacaactgatacattgttgggggaggaggatgggaatccaataaaaccatacggaagaagagagagtgtctcaaatccaaggctgtgatttatcagataattattttcttaccaatctaagggagctgtcaacacayctctttcccaaagttcattcaaaccccaggaaaaagaaaccctggtcaattttgtgtgtgtgttaaaaacataattccagtagtaaatgagacattgatatagtaaaggaagattcttaagaaaagcttccctgatcattagtaagaattaagtttgaaaacgttttttccaaatactcaaaaaagatacatattatatataatatacaaacatatgcatgtagatacataaatatagaagacatatacataaatacatatttctcttttctaagagatggggtcttgctctgttgctga

SEQ ID NO: 51274 - DNA, 601 bp, Human
ttggcttattacatggattcattaaagccagctgaaattacaagacctttttgagctgctctaaaataataattgattttaaatatgattttaaagttttccattatctaatcaaactttcttatttcacaaataagaaaaataaggttatagaaagtttatctaatttttcagtctgatttctgaatttcttttaaaataattaaattattatgtatgctcttaatatacactaatattccacacttctatccaggaaagtaattttcttccattaacattgcttttaaaaaaaaaaaaatcaacaacttgaattctactgtataaaaaggactacaaatatacatttgttaaccaagcaaaatatacacataattttgcttcataactttcacctaagataccagtacacgtagttgcttcattagttgtcacagcaattttggggtattgccccagataaagagaaccacttactgacttatcaagacatattctaatttttttcctctgatttatttacaagtgtcaaaactacctctacttgtatacaaatctccaaaatatccttccctatgaagcctgttccaatctctcaata

SEQ ID NO: 51275 - DNA, 601 bp, Human
gcctacaagatagcctgatacaagagctctgcacaacaacaatcttttgctctggggatgaggaatagcagatagaatcacgacttccctcagggagattaaatacaagacagacagtcacacacacacacacacacacacacacacacacacacatacatgcacagtcataaagtggtataaacagtaggaaagacagcgagaaggcaattagcagaagccaaaggtatcacgaggccaacctatatttgccaaagttattttccactggtcccactcatcccatgagttatatacaccmctcattcccaaaaagagcagcagagtgagacaagaaaaattctccttgttgcatatgattactgagcaccaaaacacctatttgtataacagacaccctgaggagtcctgcaatgcaaaaaccctgtttcccattattcctttcacttgggaaacctgatgtttcccaaaactatttagcaaaagagcccactattttttaatacaacatttactaatgtattctacaacagaatttttgttttaaagaccacacctcactaaatgaggtaggaaagaattacaggttgagcatcccaaa

SEQ ID NO: 51276 - DNA, 601 bp, Human
caaacatggtctcaggaaatttatatgcaactggcagagaaagagaatgaatgggaagccaaaaataaagcattatgtatctaccaatttggacataattaggtacctggcccaattggctcaaagaaaagtgaccagtagcctacaagatagcctgatacaagagctctgcacaacaacaatcttttgctctggggatgaggaatagcagatagaatcacgacttccctcagggagattaaatacaagacagacagtcacacacacacacacacacacacacacacacacacacatacaygcacagtcataaagtggtataaacagtaggaaagacagcgagaaggcaattagcagaagccaaaggtatcacgaggccaacctatatttgccaaagttattttccactggtcccactcatcccatgagttatatacacccctcattcccaaaaagagcagcagagtgagacaagaaaaattctccttgttgcatatgattactgagcaccaaaacacctatttgtataacagacaccctgaggagtcctgcaatgcaaaaaccctgtttcccattattcctttcacttgggaaacctgat

SEQ ID NO: 51277 - DNA, 601 bp, Human
cacgacaaacatggtctcaggaaatttatatgcaactggcagagaaagagaatgaatgggaagccaaaaataaagcattatgtatctaccaatttggacataattaggtacctggcccaattggctcaaagaaaagtgaccagtagcctacaagatagcctgatacaagagctctgcacaacaacaatcttttgctctggggatgaggaatagcagatagaatcacgacttccctcagggagattaaatacaagacagacagtcacacacacacacacacacacacacacacacacacacctacatgcacagtcataaagtggtataaacagtaggaaagacagcgagaaggcaattagcagaagccaaaggtatcacgaggccaacctatatttgccaaagttattttccactggtcccactcatcccatgagttatatacacccctcattcccaaaaagagcagcagagtgagacaagaaaaattctccttgttgcatatgattactgagcaccaaaacacctatttgtataacagacaccctgaggagtcctgcaatgcaaaaaccctgtttcccattattcctttcacttgggaaac

SEQ ID NO: 51278 - DNA, 601 bp, Human
ataacaattggttatgatgctatttgaaattagggtaaaaaggatatttaagacaactgatgtctacaaaaatacacctcagttcaaggagaaaacacgttccaattccaacactagcttcaagtcaactcttactaataattcacatgttctcattggtttccatttcaaaaataggaacatgccctcatgggcagaatttccttacaagattaagaggaaaaaacatccacacagctcaccactacaatttggcagtacatgaggtatcagcatgatggctggaccagttcctctatcrgacctagttcctctatcattcaacattttgtaagcatttactattactgcaccgcaccagtgtgacaaagtaaaaccacttaagtctccctgtctgtaaaatgagggtaatagctacctcagagctcacgtgagaataaaattaacccagtgagatggaatatgcctcaaccaaccatagcagtactctactgtcaactattccttcactagtccacatctaacaaacaccaaaatgtttctagatgctaaagctgcttctctactattctttccttctctctccagggaacagatattc

SEQ ID NO: 51279 - DNA, 601 bp, Human
gtggcgtgtgcttgtagtctcagctactccggaggctggggtggaaggattgcttaagcctgggaggctgaggctgcagtgagctgtgttcacgccactgcaatccaggctgggtgacagtgagaccctgtctcaataaataaatacataaataataaaaaatttaaaaataaaacaatgtgtcacatacatattacaggtttgcaatgaggatttaatagtcaattaaattactgagcatgtttaagatagatatgtgcttgtttgtctacatattaaaagtatatacaaatacagcatrgagaataagagtattgggctctgtatgtcaaacaccaaagttctaaatacacttccactacttacaagctatgtgacccatggcaagacacttaacgtctgcttgccttaatctgctcatctgtgaaatggggataacagatagcagataccacaggaggtgcggtgagtactaaaagagttgcagtacataacaattggttatgatgctatttgaaattagggtaaaaaggatatttaagacaactgatgtctacaaaaatacacctcagttcaaggagaaaacacgttccaattccaa

SEQ ID NO: 51280 - DNA, 601 bp, Human
ccttgggataaattctaaaaatacaagataatggaagtgggacaagaaatcaactgcccctaaggacttaacatatttttaccttgaatatatatatataaatttaagaagctgctgtgaacagagatgtaagagcctttgacagccatagaagaaaagctcattgtctcttcaatggcaaaacataagcagagtggtgactcatctccaattaagatgcacacccctggaacaacccaactgtgaggtcaggtcagacacacgcctcctccccaggtgcactgataaaagccaccaatgsactgctagtgaaaaagaaaaagccatcagacttttccatcctcaaaacgaatgccctctcactatcaaaatgtgtactagctcatccagtgtgtgaaaattaatgttccccacacatgtatcttgaggaggagaatctggtatttttattattaagcctcttatggtaacatttctgaaaagaatagaattgcatcaaattgtaaagggaagaaggagaatgccacacagataacattatttcaacataataagcagtgtaaggcctggcatggtagctcacgcctgtaatcccagcact

SEQ ID NO: 51281 - DNA, 601 bp, Human
tgagataaactggttaataaaaaaatacaatatgttctaaaaagataaaaataaacttgaaatcacttactttctgctcagggctttcctgaaacaaaagtccaaagtagtctttctccaagagattgaggtgttcacacactttgtcaaataacacttgtcccttggcatgtttctggagaaaaaataataactttacttttcaagtactaaagattccaagactgctataaatttaagacatcatatcagatacatgatttattataaattaacattaaatatttgttttctcattttmtaacaatataaaagtgattaattttttaactttagccctcccaccctgcacacatatacaaagcataaaatctgaaacaaaagcataagcaagcaccgtctgctttactgctactcaatatagacataaaaaggacgaaaaaggcaaaatgttagctgttcattttcttatttcaaaaatgttcaaactgcttccatcaattcctcaaggtggctcatatctataaagtacactactccccaggaaaatcatttagccctattattcagtagatcctaacataatttatcctatcaacac

SEQ ID NO: 51282 - DNA, 601 bp, Human
gcccaccaccatgcccggctaatttttgtatttttagtaaagacggggtttcaccatgttggccaggctggtcttgaactcctgacctcaagtgatccgcccgcctcggcctcccaaagtgctgggattacaggcatgaaccaccacgcttagcccagatttcttaatgtagtatatcctatgcctactaagagaacatgttattctacatattgtacaacatactgaattgtccctctactttacaaagattatattatatgctcctatgaatctaccagtatgtgatctcaaaaaaagkaggtaatcctagccaaattcccaccactttctcttttgcagcttttaggacaaacagaagagcacataattggaaacattatcaagaccaccttataatttacagtctaaaaaacctagtttattcagtcaaatgtgctattacgtctgaaaacagtactctaaacagagttctattaagaatactcatgtagtattcagcaggcaggcatgtaatttaactgtctttagtctaaacaaagaattaaaccacaaattagatatcaagtatttaaagctaagcaagttgagaaaacttaaa

SEQ ID NO: 51283 - DNA, 601 bp, Human
gtaagtcatggcctctaccctcgaggaattcatagaataatggggagaaagagtaacaaacaaggtgtgtactaaatgtgtagatgacagacagagggaattgccaactcctacatccagtaggcaattaagaatatgagtctgagattcagtgaaagctgaattgacataaattgagagttgtcaaaataaaaaaacagtatatcctactatctaaataaatactactaaatactaccttttcttatgcaaaactagtatttcaaaaatatcagatttcttttcttttttttttttttttgagacagagtctcactctgtcatccaggctggagtgcagtggcgtgatcttggctcactgcaacctttgcctcctgggttcaagtgattctcctgcctcagcctcccgagtagctgagattacaggtgcccaccaccatgcccggctaatttttgtatttttagtaaagacggggtttcaccatgttggccaggctggtcttgaactcctgacctcaagtgatccgcccgcctcggcctcccaaagtgctgggattacaggcatgaaccaccacgcttagcccagatttcttaatgtagt

SEQ ID NO: 51284 - DNA, 601 bp, Human
tagttctatttttaattttctgtggaacttccacactgttttccagagtggttgtatcagtttaccttcctacccatagtacacagcatctccagtctctccacatccttgccaacacttgctattttctattttcatgagagtggagatccttataggtgtgatataacacacacgtaataaatagcagttaatgtctacatatacggaggctatacagataagtaagtcatggcctctaccctcgaggaattcatagaataatggggagaaagagtaacaaacaaggtgtgtactaaaygtgtagatgacagacagagggaattgccaactcctacatccagtaggcaattaagaatatgagtctgagattcagtgaaagctgaattgacataaattgagagttgtcaaaataaaaaaacagtatatcctactatctaaataaatactactaaatactaccttttcttatgcaaaactagtatttcaaaaatatcagatttcttttcttttttttttttttttgagacagagtctcactctgtcatccaggctggagtgcagtggcgtgatcttggctcactgcaacctttgcctcctg

SEQ ID NO: 51285 - DNA, 601 bp, Human
aaaagccacctctgatttttttaaaaacaagtaagttacaaagaagtactcctggttacaagcctccatatgaatatgatattcacatcaggaaataaagctaccccatgcaccctgcactgctaagacagattatacctagagtggagtatttgttccatgcaagctgtcattctttaagacacctccaaaactaaattcatttatttacttgctctttccgtaagttattgaacctaaaactcaatatgtcagaaactacactcatgatatcccctaccaaccccccagtcgagtcctyctacccttcttactgaacaactccaaccatccagaaacccaggccttaattcttggtatctgtcatccttcatgttcaatcattcatcagattgagtcagcctccttcctcattctctcttcaatcattcgcttttctacttccactgccaaaaccttactcaaggctacttttgtgctttgggtgtacagccctactcaagtcccctctcatcccatgccacccatcaaccaaagtgacctttttaaagacaaaactggtcatctcatatccttgcttcagcctatcaatggtttgcca

SEQ ID NO: 51286 - DNA, 601 bp, Human
gttttcatcacctctagactagactaccgcaactgtctcctgaccttcctgcctctggtctcagtcccctatcatctcgctccacaccatcaacaggttctttctgatatgcaaatctgaccacgttacttcctacttaaaatctagattcctcagcatgagatacaagatccaaagaatgatatttgcttatttttccagctgctttcccataaactccattagcactccccacaaagtcatcccaaattaacccatgatctaagttaaaacagtgtgctcatgagaaaacacgagtccytacctccccctgccagcttgcctacccctcacaggtctttcctattcagagaggctggaactgccacatcctccagccctccggacaaactttaaactccgcacccacatcatgatcattcatgctggaacgattacttttcttctgtgcaaaatgtcccttccctgcccacatccagaatactggccgtaattctcaatagctataatagaatgtcaacactaaactgctcatatgatttccaaaatttatagatctgctttaatataccaatataaaatattcataccacaggccctt

SEQ ID NO: 51287 - DNA, 601 bp, Human
ggtccctgtgtaaaagtctccatcaagctccccagctacccaaccctgaaacctaggacttttcctcaactctcccctcgctgtcatagctaacaggtggcagtcacaaagtgactgcagacattacctacacagaatctctgtcctttcctcttcactcctagtaccactgccctggttttcatcacctctagactagactaccgcaactgtctcctgaccttcctgcctctggtctcagtcccctatcatctcgctccacaccatcaacaggttctttctgatatgcaaatctgaccaygttacttcctacttaaaatctagattcctcagcatgagatacaagatccaaagaatgatatttgcttatttttccagctgctttcccataaactccattagcactccccacaaagtcatcccaaattaacccatgatctaagttaaaacagtgtgctcatgagaaaacacgagtccctacctccccctgccagcttgcctacccctcacaggtctttcctattcagagaggctggaactgccacatcctccagccctccggacaaactttaaactccgcacccacatcatgatcattcat

SEQ ID NO: 51288 - DNA, 601 bp, Human
tgctgccttgacctactgggctcaagtgatcctcccacctcagcacccctctcccctcctccgaatagctggaactaaaggtatatgccactatgcctggctaattttttaatttttttctagagacagagtctcactatgttgcccaggctggtctcaaattccagggctcaactgatcctcccgcctgggcctcttaaagtgctgggattacaggtatgagccaccatacctggcctctcaaattctttacttttaaatttcttcatccttcacctactccctgatccccaatctagcyaacagcttacaaacgtgtccaacttggcaaaataaaaattaagttccatctccgctccctagcatacctcaaactgctgctcttcctccaaggtccctgtgtaaaagtctccatcaagctccccagctacccaaccctgaaacctaggacttttcctcaactctcccctcgctgtcatagctaacaggtggcagtcacaaagtgactgcagacattacctacacagaatctctgtcctttcctcttcactcctagtaccactgccctggttttcatcacctctagactagactaccgcaa

SEQ ID NO: 51289 - DNA, 601 bp, Human
tgtcacctaggcgaaagtgcagtggtgcaatcacagctcattgctgccttgacctactgggctcaagtgatcctcccacctcagcacccctctcccctcctccgaatagctggaactaaaggtatatgccactatgcctggctaattttttaatttttttctagagacagagtctcactatgttgcccaggctggtctcaaattccagggctcaactgatcctcccgcctgggcctcttaaagtgctgggattacaggtatgagccaccatacctggcctctcaaattctttacttttaartttcttcatccttcacctactccctgatccccaatctagccaacagcttacaaacgtgtccaacttggcaaaataaaaattaagttccatctccgctccctagcatacctcaaactgctgctcttcctccaaggtccctgtgtaaaagtctccatcaagctccccagctacccaaccctgaaacctaggacttttcctcaactctcccctcgctgtcatagctaacaggtggcagtcacaaagtgactgcagacattacctacacagaatctctgtcctttcctcttcactcctagtacc

SEQ ID NO: 51290 - DNA, 601 bp, Human
tttctccacagccaaacacttctttaaacaacaatttacactcactgtcaaatttctctttttttctttcttctttttaggcaaggtcttgctctgtcacctaggcgaaagtgcagtggtgcaatcacagctcattgctgccttgacctactgggctcaagtgatcctcccacctcagcacccctctcccctcctccgaatagctggaactaaaggtatatgccactatgcctggctaattttttaatttttttctagagacagagtctcactatgttgcccaggctggtctcaaattccwgggctcaactgatcctcccgcctgggcctcttaaagtgctgggattacaggtatgagccaccatacctggcctctcaaattctttacttttaaatttcttcatccttcacctactccctgatccccaatctagccaacagcttacaaacgtgtccaacttggcaaaataaaaattaagttccatctccgctccctagcatacctcaaactgctgctcttcctccaaggtccctgtgtaaaagtctccatcaagctccccagctacccaaccctgaaacctaggacttttcctcaactctc

SEQ ID NO: 51291 - DNA, 601 bp, Human
aagaatcaaaatttcccataagtacagataatattcggcatggaaaggaaagatccttacatcattatattctgttgttaaaactgcatgggatttaaacaaagcaggactgattgagctgagttagtataatagtaataaatttatgtgggggaaaaaataggataccatacaaatctatagtggaagaataagagttgttttgcctagatgtcttgaggactggattttgtctacataagcagatagaaatttttaaaaattacacaacataaaagttatagcaaatcagattatataygaataattaaagatattgctaattgtatttaaatattcacacctgaaaagtgaatgtctcagaaaggacacctcattcttaagttcccaaagtttttgagttaaagtctatatacaaagcatgtgtctaattttatatgttcatcttacctttcataagagaaactaccacgtataataaggaattatgaattccttatttagcattagtgtctttctgtcaataagaacgctacagtagacccaaacaaatgtacctttatcttagtattttcttccttaatgaccttaatctgtctcc

SEQ ID NO: 51292 - DNA, 601 bp, Human
caaatctgaggatgaaagtcttgtcttatgacatttcccctacaacattttcattacgggttcccagaaaaagtgttaaacatgattctcaattatgctctagtgacagaaacatctagggggaaaaaaaaagcttaattatgaatcctaatactgtatttatattcatagaataccagtgttagaaagaacctcagaataatggtccaaatgtccatatttggggaacggcctaactcttgcctcagtggctacgaatatttgaacacttctgggaccatgaaccacatgggcccactargactcccctcctcccgtggctttcatgacatttcaaactcctgtaatgctctctgctacatcaaaagaacagtttatccctacatcaatgcttctcaaactttaaaggtgcgtatgaatcacctgaacatctagccaaaataaagtctatttcagcaggtctagggtgagcgctagagttcttcatttctaagaagcttctgcgtggagccaacgctgctggtccttggaccactctttgagtaggatagccctagagttctttttatgtagaaatttctttcttttcctgaaagctcaa

SEQ ID NO: 51293 - DNA, 601 bp, Human
tattagttaattagagaatctccttaatcttactctttatttgccacaaatctgaggatgaaagtcttgtcttatgacatttcccctacaacattttcattacgggttcccagaaaaagtgttaaacatgattctcaattatgctctagtgacagaaacatctagggggaaaaaaaaagcttaattatgaatcctaatactgtatttatattcatagaataccagtgttagaaagaacctcagaataatggtccaaatgtccatatttggggaacggcctaactcttgcctcagtggctaygaatatttgaacacttctgggaccatgaaccacatgggcccactaggactcccctcctcccgtggctttcatgacatttcaaactcctgtaatgctctctgctacatcaaaagaacagtttatccctacatcaatgcttctcaaactttaaaggtgcgtatgaatcacctgaacatctagccaaaataaagtctatttcagcaggtctagggtgagcgctagagttcttcatttctaagaagcttctgcgtggagccaacgctgctggtccttggaccactctttgagtaggatagccct

SEQ ID NO: 51294 - DNA, 601 bp, Human
tgttaaatcaccggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaragaatatcaagtattgttaaatcaccttcaaacatgaaattgggaggtaatgaactcaagtttggggaaatatgttccatctttatttttactaacttctaactgaaacttagcatcactgtcaattaggaacatagcagaaaaaaacctggttaatatcagcagaacctctttgtcacctgcagaaatcaaaaacatttccacatcacattgtagtagctgcagatcttaaaataccatttatgctagccaatattttgaagtcacagtagctactagatttgatactgatgattaata

SEQ ID NO: 51295 - DNA, 601 bp, Human
atatgactagtctaagagcttctatgtacatgttaaagtattatccagtttggccgatggtaaaaatccacccggcaaattttttaaaagacagctctttgtccatggacaactgcccagaacatcctaaaacattctccagggaaggaactcaggaaagtgacagcttcaggcaattcaagatcaggcaagacagggatcttctcagtgtttcccaaacattaaggtataagcaaccatgcaaaactcgagagctgacctatatcagatttcaataaaatttatcttgttttattaaaaraaataaaacaaggattttgccaactacttaagagcaggaacagtcacttactcaattcagtattctccttactttctcctctccattccctaatccaaacccaaaacatgaacacagtaaatatttatctcctaaatgaacatcaggtaaaataagagactaataataaaagttataaggaatcctaaaacaggcttccaacagaagtaaaataaaattaaaatgtggccttagaatatcaagtattgttaaatcaccggccgggcgcggtggctcacgcctgtaatcccagcactttgg

SEQ ID NO: 51296 - DNA, 601 bp, Human
cactgtattcacaggcgagatgacatgaaaaccaagccctttctatatgactagtctaagagcttctatgtacatgttaaagtattatccagtttggccgatggtaaaaatccacccggcaaattttttaaaagacagctctttgtccatggacaactgcccagaacatcctaaaacattctccagggaaggaactcaggaaagtgacagcttcaggcaattcaagatcaggcaagacagggatcttctcagtgtttcccaaacattaaggtataagcaaccatgcaaaactcgagagctkacctatatcagatttcaataaaatttatcttgttttattaaaaaaaataaaacaaggattttgccaactacttaagagcaggaacagtcacttactcaattcagtattctccttactttctcctctccattccctaatccaaacccaaaacatgaacacagtaaatatttatctcctaaatgaacatcaggtaaaataagagactaataataaaagttataaggaatcctaaaacaggcttccaacagaagtaaaataaaattaaaatgtggccttagaatatcaagtattgttaaatca

SEQ ID NO: 51297 - DNA, 601 bp, Human
atacagttttaggcaaccagtgagaactaaattaatacctgctgactgatatatgccccttgcttgcctccttcctctccacgctgtgatcatcttaaatgatcacgttatattacttttattacatttatttttacttgaatacatatctctaatgagtacttagatggtaagtggggtatagcatcataaattcctaagtaaaaaaaaaatgacttaaatgacttaaaagaaatacaagttaatgatctgcattaccagttacaaagaaataacaaacaaaacttttaaataaatacartaaataataaaaattaatttcttggtttgacacttaaggaggagggttgagcagaccaagaagcagacacaaaaagatggaaaatgccatcagagaatgagaaaaatgcatgagggtgtgtgtgcacaacatacaacaaccgccctcaccccatgatacactacagtattcattgccaggttttagacttaaagatttgtctgctgtggccacatatataaaccgtggaatcagaaatacacgcagtaaaattctggttttctatcaactctaacttgggcacattccttggcttcttta

SEQ ID NO: 51298 - DNA, 601 bp, Human
ctaattcaaataaatgagtctaattaagttttactcattctaagcagtgtccaaaataatataacaggggtcctcaacccccatcccacggactggtaccgatcgtggcctattaggaactgggctgcacagcaggacgtgaacagcaggtaagtgggcattaccacctgagcaccgcctcctgtcagatcaccacccgcgttagattctcagaggagcacaaaccctattgtgaactgcacaagagagggatctaggctgcacactccttatgagactctgactaacgcttgatgatctsaggtggagcagtttcatgccaaaaccattccctcacccccaccccggtatgtggaaaaattgtcttccacaaaaccggtccctgttgccaaacaggttggggaccactgtattacaacatctgtgcttaaacagaattttattcagatatataaagcaaacaattaaaatgcttattagtacacagaaaataacctgctgtcttaataccatattaaaatggtataacggaacattaactgacactattaaaaagtaaaacagtaagatgctgtgaaagcagagccgcatggcccctcgg

SEQ ID NO: 51299 - DNA, 601 bp, Human
aaatgctaggaaactgttacagcatcttaaagcaaaaaagaccaaatttaaaccactaggttcgaaccacccaaggacattaaatttttgtttttcgaagctacaagcaaaagtccaataaaaaatttagatttttttgtttatatttttatatttacatttttctaccctcaagttatcactaacataggagaagtgcaatttttgaggtacaataaactaattcaaataaatgagtctaattaagttttactcattctaagcagtgtccaaaataatataacaggggtcctcaacccccatcccacggactggtaccgatcgtggcctattaggaactgggctgcacagcaggacgtgaacagcaggtaagtgggcattaccacctgagcaccgcctcctgtcagatcaccacccgcgttagattctcagaggagcacaaaccctattgtgaactgcacaagagagggatctaggctgcacactccttatgagactctgactaacgcttgatgatctcaggtggagcagtttcatgccaaaaccattccctcacccccaccccggtatgtggaaaaattgtcttccacaaaaccggtcc

SEQ ID NO: 51300 - DNA, 601 bp, Human
taaagtacaataataataaaaaaaaagaaaacaagtcaatagttacatccaatggttaaataaactctccaactaaacaacaaaaaagaaagctttaaaaaaatgctaggaaactgttacagcatcttaaagcaaaaaagaccaaatttaaaccactaggttcgaaccacccaaggacattaaatttttgtttttcgaagctacaagcaaaagtccaataaaaaatttagatttttttgtttatatttttatatttacatttttctaccctcaagttatcactaacataggagaagtgcartttttgaggtacaataaactaattcaaataaatgagtctaattaagttttactcattctaagcagtgtccaaaataatataacaggggtcctcaacccccatcccacggactggtaccgatcgtggcctattaggaactgggctgcacagcaggacgtgaacagcaggtaagtgggcattaccacctgagcaccgcctcctgtcagatcaccacccgcgttagattctcagaggagcacaaaccctattgtgaactgcacaagagagggatctaggctgcacactccttatgagactctg

SEQ ID NO: 51301 - DNA, 601 bp, Human
acatatacaccacgaaatactatgcagccataaaaaaggatgagttcatgtcctttgcagggacatggatgaagctggaaaccatcattctcagcaaactaacacaggaacagaaaacctgcatattcgcactcataagtgggagctgaacaatgagaacacatggacacggagaggggaacatcacacaccagggcctgttggggtgtggggggctaggggagggacagcattaggagaaatacttaatgtagatgacgggggttgatgggtgcagcaaaccaccatggcacgtgtatamctatgtaacaaacctgcacgttctgcacatgtatcccagaacttaaagtacaataataataaaaaaaaagaaaacaagtcaatagttacatccaatggttaaataaactctccaactaaacaacaaaaaagaaagctttaaaaaaatgctaggaaactgttacagcatcttaaagcaaaaaagaccaaatttaaaccactaggttcgaaccacccaaggacattaaatttttgtttttcgaagctacaagcaaaagtccaataaaaaatttagatttttttgtttatatttttatattta

SEQ ID NO: 51302 - DNA, 601 bp, Human; identical to SEQ ID NO: 22195

SEQ ID NO: 51303 - DNA, 601 bp, Human; identical to SEQ ID NO: 22196

SEQ ID NO: 51304 - DNA, 601 bp, Human; identical to SEQ ID NO: 22197

SEQ ID NO: 51305 - DNA, 601 bp, Human; identical to SEQ ID NO: 22198

SEQ ID NO: 51306 - DNA, 601 bp, Human; identical to SEQ ID NO: 22199

SEQ ID NO: 51307 - DNA, 601 bp, Human; identical to SEQ ID NO: 22200

SEQ ID NO: 51308 - DNA, 601 bp, Human; identical to SEQ ID NO: 22201

SEQ ID NO: 51309 - DNA, 601 bp, Human; identical to SEQ ID NO: 22202

SEQ ID NO: 51310 - DNA, 601 bp, Human; identical to SEQ ID NO: 22203

SEQ ID NO: 51311 - DNA, 601 bp, Human; identical to SEQ ID NO: 22204

SEQ ID NO: 51312 - DNA, 601 bp, Human; identical to SEQ ID NO: 22205

SEQ ID NO: 51313 - DNA, 601 bp, Human; identical to SEQ ID NO: 22206

SEQ ID NO: 51314 - DNA, 601 bp, Human; identical to SEQ ID NO: 22207

SEQ ID NO: 51315 - DNA, 601 bp, Human; identical to SEQ ID NO: 22208

SEQ ID NO: 51316 - DNA, 601 bp, Human; identical to SEQ ID NO: 22209

SEQ ID NO: 51317 - DNA, 601 bp, Human; identical to SEQ ID NO: 22210

SEQ ID NO: 51318 - DNA, 601 bp, Human; identical to SEQ ID NO: 22211

SEQ ID NO: 51319 - DNA, 601 bp, Human; identical to SEQ ID NO: 22212

SEQ ID NO: 51320 - DNA, 601 bp, Human; identical to SEQ ID NO: 22213

SEQ ID NO: 51321 - DNA, 601 bp, Human; identical to SEQ ID NO: 22214

SEQ ID NO: 51322 - DNA, 601 bp, Human; identical to SEQ ID NO: 22215

SEQ ID NO: 51323 - DNA, 601 bp, Human; identical to SEQ ID NO: 22216

SEQ ID NO: 51324 - DNA, 601 bp, Human; identical to SEQ ID NO: 22217

SEQ ID NO: 51325 - DNA, 601 bp, Human; identical to SEQ ID NO: 22218

SEQ ID NO: 51326 - DNA, 601 bp, Human; identical to SEQ ID NO: 22219

SEQ ID NO: 51327 - DNA, 601 bp, Human; identical to SEQ ID NO: 22220

SEQ ID NO: 51328 - DNA, 601 bp, Human; identical to SEQ ID NO: 22221

SEQ ID NO: 51329 - DNA, 601 bp, Human; identical to SEQ ID NO: 22222

SEQ ID NO: 51330 - DNA, 601 bp, Human; identical to SEQ ID NO: 22223

SEQ ID NO: 51331 - DNA, 601 bp, Human; identical to SEQ ID NO: 22224

SEQ ID NO: 51332 - DNA, 601 bp, Human; identical to SEQ ID NO: 22225

SEQ ID NO: 51333 - DNA, 601 bp, Human; identical to SEQ ID NO: 22226

SEQ ID NO: 51334 - DNA, 601 bp, Human; identical to SEQ ID NO: 22227

SEQ ID NO: 51335 - DNA, 601 bp, Human; identical to SEQ ID NO: 22228

SEQ ID NO: 51336 - DNA, 601 bp, Human; identical to SEQ ID NO: 22229

SEQ ID NO: 51337 - DNA, 601 bp, Human; identical to SEQ ID NO: 22230

SEQ ID NO: 51338 - DNA, 601 bp, Human; identical to SEQ ID NO: 22231

SEQ ID NO: 51339 - DNA, 601 bp, Human; identical to SEQ ID NO: 22232

SEQ ID NO: 51340 - DNA, 601 bp, Human; identical to SEQ ID NO: 22233

SEQ ID NO: 51341 - DNA, 601 bp, Human; identical to SEQ ID NO: 22234

SEQ ID NO: 51342 - DNA, 601 bp, Human; identical to SEQ ID NO: 22235

SEQ ID NO: 51343 - DNA, 601 bp, Human; identical to SEQ ID NO: 22236

SEQ ID NO: 51344 - DNA, 601 bp, Human; identical to SEQ ID NO: 22237

SEQ ID NO: 51345 - DNA, 601 bp, Human; identical to SEQ ID NO: 22238

SEQ ID NO: 51346 - DNA, 601 bp, Human; identical to SEQ ID NO: 22239

SEQ ID NO: 51347 - DNA, 601 bp, Human; identical to SEQ ID NO: 22240

SEQ ID NO: 51348 - DNA, 601 bp, Human; identical to SEQ ID NO: 22241

SEQ ID NO: 51349 - DNA, 601 bp, Human; identical to SEQ ID NO: 22242

SEQ ID NO: 51350 - DNA, 601 bp, Human; identical to SEQ ID NO: 22243

SEQ ID NO: 51351 - DNA, 601 bp, Human; identical to SEQ ID NO: 22244

SEQ ID NO: 51352 - DNA, 601 bp, Human; identical to SEQ ID NO: 22245

SEQ ID NO: 51353 - DNA, 601 bp, Human; identical to SEQ ID NO: 22246

SEQ ID NO: 51354 - DNA, 601 bp, Human; identical to SEQ ID NO: 22247

SEQ ID NO: 51355 - DNA, 601 bp, Human; identical to SEQ ID NO: 22248

SEQ ID NO: 51356 - DNA, 601 bp, Human; identical to SEQ ID NO: 22249

SEQ ID NO: 51357 - DNA, 601 bp, Human; identical to SEQ ID NO: 22250

SEQ ID NO: 51358 - DNA, 601 bp, Human
cctcccaggttgaaatgattctcctgcctcaggctcccaagtatgggattacaggcgtgcaccaacatgcccatctcatttttgtgtttttagtagagataggtggaatcagctcatctccctcttatctctcctacaataaaaatctctcatccaaagaaggttaatagcatcttccagaaagggtcaatgtgaatattaattaatgtaacttacagtaatgtgcttgataaacagtaaagcaatatatgaatgtcaatcattagcagcccctcaataaatcagagttattgacaccacwtgaccatcagttcacagagattatatacacccgagcagatgcacctggggatgataacagtctagaaagtcaaatgtactataggaagaagacactgatatgaactttcatttcacatcctttcacaagttcaggagtacagagcagtcactagaaaggccacagacaatgagggctctcttaccttacttaatcttccccttcctcagccaactctgtttctttgtgtaccaccactcttgtgaccgacatgtcagggtgctgctctctggcttccctgatcgcctgagccagtgcctg

SEQ ID NO: 51359 - DNA, 601 bp, Human
aggatactattcctttctctgccaagcacattaaacttaatcatttattaatcctttgcttttgtttctattggcttaactgaagtatttatttccatttttacacagtcaaagaaatcttttcctttctggttcattctcagatgtatcttttttttttttttttttttttttgagatggagtctcacttctgttgcccaggatagagttcagtggcgcaatgttggctcactgcaacctccgcctcccaggttgaaatgattctcctgcctcaggctcccaagtatgggattacaggcrtgcaccaacatgcccatctcatttttgtgtttttagtagagataggtggaatcagctcatctccctcttatctctcctacaataaaaatctctcatccaaagaaggttaatagcatcttccagaaagggtcaatgtgaatattaattaatgtaacttacagtaatgtgcttgataaacagtaaagcaatatatgaatgtcaatcattagcagcccctcaataaatcagagttattgacaccacatgaccatcagttcacagagattatatacacccgagcagatgcacctggggatgata

SEQ ID NO: 51360 - DNA, 601 bp, Human
gaggctgcacattttttgtttattgatcttttagtttgcacatagtttactcatttaattctctgcccatttttctacaaaagtgtttaaattttcttaatgacacagtagagttcttaatatactcaggatactattcctttctctgccaagcacattaaacttaatcatttattaatcctttgcttttgtttctattggcttaactgaagtatttatttccatttttacacagtcaaagaaatcttttcctttctggttcattctcagatgtatcttttttttttttttttttttttttgagatggagtctcacttctgttgcccaggatagagttcagtggcgcaatgttggctcactgcaacctccgcctcccaggttgaaatgattctcctgcctcaggctcccaagtatgggattacaggcgtgcaccaacatgcccatctcatttttgtgtttttagtagagataggtggaatcagctcatctccctcttatctctcctacaataaaaatctctcatccaaagaaggttaatagcatcttccagaaagggtcaatgtgaatattaattaatgtaacttacagtaatgtgcttga

SEQ ID NO: 51361 - DNA, 601 bp, Human
tgtgacccagccattcctgtgggttacctatctattgactgttcaacatacagattattttaacaacagaaagtaatcttagtatgtgttattgtgtgataagacctgcttcttaaagccctaatagataattataaacatttacccacttcatcaagatttagttatcacatggaaacagcataatgtgttaactaatcccctactcttgaccatttagattatttcaattttttttttggctaatactagcaaatataatactctggtttctcttcagggtgtgtaaatcttttgcctrttactaatactagcaaatataaatttatacaaatataaatattaaaatgtgacaaatacccttgtaggtgaatatttgtatatatttctgattaagataaattcttataagtagtttaatggtagacatgtttaatgtggatattttttagatatatttgtgtcaaattgtcctccataaaatattactaatttatacagcagtatatatttcctgcagccttcccaacactattaaaaacataagttttgccaaatttataggtgaaaacttgtccactgagtttttagtatgcattga

SEQ ID NO: 51362 - DNA, 601 bp, Human
aaaaaacataagtcataaaggaaaagcttgataaattcaacaatattaaccctattcaactattttaataatgaaagacaaaccacaagcctgaagatatttgcaacatataaaattgacaaaggatcagtatgtagaatctatcaagaatcaattaacaatgaaagaaagaatgaaagcaaaagcaggcaagagaggtgaacaagcatttaaggttttgaagtttttggccatctgtattttcatagaagagaaaacaagaatggctaataaccatatgaaaatatattaatgaagaaartgagaattataatcacagttacacatatttaccaaactagcaaaaattaaaaagtcagagaggcagctgtaaaatggtaggaatccttgcctcctagtggatgcaacagcaggtggctgtgccacgcaaggtagaaaatgaaaatgtgtaacctgtgacccagccattcctgtgggttacctatctattgactgttcaacatacagattattttaacaacagaaagtaatcttagtatgtgttattgtgtgataagacctgcttcttaaagccctaatagataattataaacatttaccc

SEQ ID NO: 51363 - DNA, 601 bp, Human
cctaagtaagaatgcttttagccttccctatttaaaaccattaggagccaggcgtggtggtgagcgcctgtagtcccagctactcgggaggatgaaggagaagaattgcttgaaccgaggaggcagaggttgcagtgggttgagatcacaccactgcactccagcctgggagacagagggatactttgtctcaaataaataaataaataaaaccattagggggccaggcacagtggctcacgcctgtaaactcagcactttgggaagccgaggcaggcagatcacttgagaacaggagttkaagaccagcctggccaacatggcgaaaccctgtctctactaaaaaatacaaaaattagctgggcgtgatggtgggcgcctgtaattcaagctacttgggaggctgaggcaggcagaattgcttgaacctgggaggcggaggttgaagtgaaccgagattgcgccactgcactccagcctgggcgacagagcgagactccgtcacaaaaaaataaaaaataaataaaaccattagggaaatacatctcaaagataaaaagatcaatatccacatacagcacagtacatttactcaggccac

SEQ ID NO: 51364 - DNA, 601 bp, Human
aaaatgccacaagtgaaggtggagctactggtaacgcttagagtgtcaccaattttttgctagtattcctgattaagaagcaactgattcataaaatttagagaaaaaaaatccagtgctattaccttatgtttgtataacactcacttttctcattcattatcttattctatccttagaataagtcctatgagttaggaaaggtagatcataccattcactgacttgcctaatgtcaatatagttggatatctggcaagatgaaaacatagccttcagccttctgactcctaagtaagartgcttttagccttccctatttaaaaccattaggagccaggcgtggtggtgagcgcctgtagtcccagctactcgggaggatgaaggagaagaattgcttgaaccgaggaggcagaggttgcagtgggttgagatcacaccactgcactccagcctgggagacagagggatactttgtctcaaataaataaataaataaaaccattagggggccaggcacagtggctcacgcctgtaaactcagcactttgggaagccgaggcaggcagatcacttgagaacaggagtttaagaccagcct

SEQ ID NO: 51365 - DNA, 601 bp, Human
ctagtttgttcaccttatatgtaagtttatactttaacttcctaaatctgtttaacaaggcttctcataaaagttagcctctgagatgggcaaacttcaaaagttgtgtgtgtgtctgtgtgtgtccattgtaaaaatgaacataaggtgctaggaataagtgatacaatgaattcatttaaaaacttattaaaatgccacaagtgaaggtggagctactggtaacgcttagagtgtcaccaattttttgctagtattcctgattaagaagcaactgattcataaaatttagagaaaaaacatccagtgctattaccttatgtttgtataacactcacttttctcattcattatcttattctatccttagaataagtcctatgagttaggaaaggtagatcataccattcactgacttgcctaatgtcaatatagttggatatctggcaagatgaaaacatagccttcagccttctgactcctaagtaagaatgcttttagccttccctatttaaaaccattaggagccaggcgtggtggtgagcgcctgtagtcccagctactcgggaggatgaaggagaagaattgcttgaaccgagga

SEQ ID NO: 51366 - DNA, 601 bp, Human
caaggaccaataactataaagtactattaagtggaggaaaaagcaagaatcacaatatcagcctatatggaaagggggggtgtgtgtatgtgagtgtctacatgtgtgtatatttataagtacacacatacacactggaaagaaattctctatctctgggagcatgggacttatgggtcactgacatttcctactatctctcccttttaaaaagttataacccctcttttattaccagaaaaaaacaataaagatagtttcatttgaaaaaataatagtcagtaatggttatgtccaagakcaagccttggggaatgagtgactactgcctggtcttaatgtacgcattagagcagtggtacccagcacctcttgtgtggggggagttcaaatagattgtaactgactcattgataacacctggtagatttagcaatgttaaatgagaacattccacagcatttcagagtgaaaactggctatgcctaaaactcactaaaccaaaactagctttttatttctatgcagaagtcagtcctcatctgaggtgtgattaatctatattgaaaatgaagcagtaataagatgctaattttaggta

SEQ ID NO: 51367 - DNA, 601 bp, Human
gtatactctattagagctgagcttttgtcacttaggttcataagatgggtagtaatgagaaaacatttctctgtagcatcaaataagagcttaaaaatacaaactaacaaagctttcatcttttagaaaaaaggaaggttagtgggaatcaaaagaaatttctagacccaactttctcactttttatctgagggaacatgggaaaaaaatcacttttcctcaaagttaaataaagatagcttaaaacactattccctgccccctaacagtctctgtctctctctgtctctctctctctcttacacacacacacacacacacacacacacacacagaatctaaactgcatcgtgccatattagtttaaggttgtcctctcacttcatccctcctaccctccacagatcaacactgtccaagagaaatatactgcaagcaatgaatgtgagccacatatgtaaattttctagaagccacatttcaaaaaataaaaaggaacatgtatatgtaattttaatgtagttattaaacccaatatatccaaattattatttcaataagtaattaatttaaaaattagaaataatttacttttttctca

SEQ ID NO: 51368 - DNA, 601 bp, Human
gaagcacagtatctgttctacaaataattcagcaaaatgcttttgcttttcctggtttgctggaacatgttcatgctgtttggagaccccaccttcttaggaggctcttctgtgggtcctttaaggcccaagtcccatcttcaggccttttgggactgggttgaccttcctgagccctgtgtcctctgaatgaactgtattactctcaaaggcctacatgctaatataactttacttcaaatagtaataaagatactgagcttcatctgactgaaaagcaaaaaaatatcggatttaactkttatagatgttcctatgatattttactcctggctttgcttccaagttaaattcaatcttactcttagagatgtccagttcagtatccccattactaactgtctgaaccagtatcttgatttctttacagggtacttcatctaatctagaagcttttcagtcaatcatacacactactgataaattcatattactaaaggacatggcatgtaagaccatctgcaatttgccttcaacaaatgtttccagctgtgctgagaactctatacataaccacgatggaggtttgcttttcccgaca

SEQ ID NO: 51369 - DNA, 601 bp, Human
atggtgagtaaacctactggcagctcagcctacataagtcgaagcagaggaatcaaactatatttgaggtaaccttattcttttttttttagaggcagggtcttgctctgtcacccaggctggggtgcagtggtgcaatcatagctcactgcagccttgaactcctggactcaagggatcctcctgcctcagcctcccaagtagctaggactacaggcacataccatcacacccagctaatttttaaaaagttttttgtggacacaagctcttgctatactgcccagtctggtctcgaacyccaggcctcaagcaatcctctcacctcaacctcccaacgtgttcggattacaggcgtgagccaccaggcctggcctggcaccttattctttaccagtgtgcacttgcagtaaaatagagaagacagtttcacttaaggaagtccttgaggacacagaagaaatattaattttcctacatctcaagcctgagtgcatctttttaatattctgtgtgatgaaatgggaagtatgcacacgccattcccgctgcatacagaagtacaacaatgtctagaggaaaagcatctatgggaatgtct

SEQ ID NO: 51370 - DNA, 601 bp, Human
gctaaatttccatttggttaaacccagaaaaaagtcaattcttaaaatgtctgtattaccattaaaatatacacgaagtgtagcctgcagcccctgaggactgctgagtctctttaaggggaccatagagtcaaaactgttttcattatcatactaagacattatgtccttttcagtgtgttggcattttcaccaatggtgtaaacaaataatggtgagtaaacctactggcagctcagcctacataagtcgaagcagaggaatcaaactatatttgaggtaaccttattcttttttttttagaggcagggtcttgctctgtcacccaggctggggtgcagtggtgcaatcatagctcactgcagccttgaactcctggactcaagggatcctcctgcctcagcctcccaagtagctaggactacaggcacataccatcacacccagctaatttttaaaaagttttttgtggacacaagctcttgctatactgcccagtctggtctcgaactccaggcctcaagcaatcctctcacctcaacctcccaacgtgttcggattacaggcgtgagccaccaggcctggcctggcaccttattct

SEQ ID NO: 51371 - DNA, 601 bp, Human
tcttaagacactgcatttcctaagcaaaaatgaactctgtgcactcaggtgtaaaattaaattttaaatatgatactttatggatttgacagttatttcaaatgctgaacttttcattttattcttcttttatcctcaatttgcatatttgattttaatttctaaacagaatttccattgtttaaattataaaaatcagctgggcacggtggttcactcctgtaatcccagcactttgggaggtcgagaagggcagatcacctgagatcaggagtttgggaccagcctggccaacatggcraaacccaatctctactaaagacataaaaattagctgggcatggtggcacacgcctgtaatcccagctactggggggctgaggcaggagaatcgcttgaacccacgaggcagaagttgcagtgagctgagatcatgccactgcactccagcctggctgccagaacgagactgtctcaaataaacaaataaataaataaaataaaaatcccagagccaaaaatgcaagcatgctaaatttccatttggttaaacccagaaaaaagtcaattcttaaaatgtctgtattaccattaaaatata

SEQ ID NO: 51372 - DNA, 601 bp, Human
gttatttaccctctcagtgcacccaatgagcagtggtgaaaaaagtccatacatacaagttctatgatcttgcccgaaaagcacaatctttgagtttctagagacaaagggctcatgtattgatctcaatcttgagtgctctactccagaaattgactcagtaaactgatttcaaaaagcatttgacagaaaatactagcaatgctgcctttaagtggtacagcactcatctagagagaagtctcaataaaaatgcaaaaatgtggttttcccccagataatacaacaatgcaaataatasaagaaaacaacatttcttcagattaatgaacattcaattaccacagagcaataacataatcaaatattctgaaaacgggaatgaaatatttacttaaggctgggcatggtggctgacgcctgtaatcccagcattttgggaggctgaggcaggcagatcacgaggtcaggggtttcacatggtgaaaccatgtggccaacatggtgaaatcccgtctctactaaaaatacaaaaaaaaattagctgggcatggtggtgggcgcctgtagtcccagctactcaggaggctgaggcaggaga

SEQ ID NO: 51373 - DNA, 601 bp, Human
aaaataaaagcattcataccactgttctgtttccaagtgtcactgttccaccctggcctatacaatgtcagtaaacattctaactactatagtcacattccttagtctatgtccccctcttttggccaatgtgagaatagatcaatgtggctcaatttcatctaatcacaggagtaattctatgttcaagttcttcaaggatatatgttggttgcatgccttgtcttaagcactcacagagggatcagagagttatttaccctctcagtgcacccaatgagcagtggtgaaaaaagtccayacatacaagttctatgatcttgcccgaaaagcacaatctttgagtttctagagacaaagggctcatgtattgatctcaatcttgagtgctctactccagaaattgactcagtaaactgatttcaaaaagcatttgacagaaaatactagcaatgctgcctttaagtggtacagcactcatctagagagaagtctcaataaaaatgcaaaaatgtggttttcccccagataatacaacaatgcaaataatacaagaaaacaacatttcttcagattaatgaacattcaattaccacagagc

SEQ ID NO: 51374 - DNA, 601 bp, Human
catcccagttccttattggcgtggatgaacaagaagtaacttattgtacgaagactttatttacatatccacttatcttttttgactgtttcttgcacttaaacacatgtagaaatacgttcctaagtactaaacagttagcttttgagctagaaaagagaaaagataaagacagaatcaccaatgtcactgctacataagcatcagaaatactgtacttttctgtcctctggcaggtgtctgtgagaaataaacttaatatctgacaattttttacaggctagaatttgggactaaatgwtttattacatattccaaccaaactgaaaactaggcaatggctcttcatgtaaaagctgtaaaagtttcaagaacattcttttctttctctaagcttgaattctactcatattcatagaagtctgggcatctttgtcaatacaaattggcaggcattaattatagacattaattcaacctgctttcacttttacactatcacaggttcatcctgagtttgggtaagatcatagctgttaagcatatggattatactttatgtattagaattgtggtgaagtcaacaaaaataaaagcattc

SEQ ID NO: 51375 - DNA, 601 bp, Human
cattgttttctaccctgttgtctgccttaggttatttcattactcattagtacttctgtttgattctaggctgggggaaaaaaaaatcaatggagaaaatagaaagtctttttttaggttagtaattatgaaaagaaatgtgggggatgatgaagggaaatggatacaattaccaatcaaattggatttggcagttatatgacaccttcagtcatggaacctgttcttgttccttcagagctggtatttccatttgctttgtttagtaaatatgcatcatttgttgaacacagctgccatyttgcctagtttatgttattaaaaaaacaaacccctgatgctatcagggcctgaaaacctacagagagaacaatgtttaggattctagtctccattttctctaggccctatgtcactttattgctttgcatctgttttcatcaaaaataaaaatttcactttgtaatgagtcataaatttgtaaagaaaagctaaaattaaacttgtttcaaagttattacaggaaactaagcatatgttggaattgaagggatcttgatctcaaaaaacttcaacatttactgagctaaatatagagaaa

SEQ ID NO: 51376 - DNA, 601 bp, Human
attagaatgtacactcttttggttaggtaaaattaagtcttgctttaatgaaaaaagttcctaccatttagatttatcacagataatattaaagcctcttgattattcaggacagattgattaatcaacttcattgttttctaccctgttgtctgccttaggttatttcattactcattagtacttctgtttgattctaggctgggggaaaaaaaaatcaatggagaaaatagaaagtctttttttaggttagtaattatgaaaagaaatgtgggggatgatgaagggaaatggatacaaytaccaatcaaattggatttggcagttatatgacaccttcagtcatggaacctgttcttgttccttcagagctggtatttccatttgctttgtttagtaaatatgcatcatttgttgaacacagctgccattttgcctagtttatgttattaaaaaaacaaacccctgatgctatcagggcctgaaaacctacagagagaacaatgtttaggattctagtctccattttctctaggccctatgtcactttattgctttgcatctgttttcatcaaaaataaaaatttcactttgtaatgag

SEQ ID NO: 51377 - DNA, 601 bp, Human
gaataatcagagtgtggtggttaagaagtaagtataagacaggatgataaggtttggagtctgggacctcaaaaaaaggagagaatgaaggcttacagcctgggtgaagcattagacctagggatatagatttgggcatcagaacaagggataagtgaaaccaacagatagaactaagtctcatgtgagcataggaataaatgaaagccacagagtcttgcagaagtccacaatcaaaggtaagtggagaagactttttaaaaaacccatgatggtgcaatggccctgaaagagaaaaggkttttaaggtggcaattgtttcattttatatttgaacttggttggaagttttggcaaatgataggtaatcacaaaggacagtgcagagtggtaattaacgtcttttccaagagacactgctcccaaagtcaattagaatgtacactcttttggttaggtaaaattaagtcttgctttaatgaaaaaagttcctaccatttagatttatcacagataatattaaagcctcttgattattcaggacagattgattaatcaacttcattgttttctaccctgttgtctgccttaggttatttca

SEQ ID NO: 51378 - DNA, 601 bp, Human; identical to SEQ ID NO: 22251

SEQ ID NO: 51379 - DNA, 601 bp, Human; identical to SEQ ID NO: 22252

SEQ ID NO: 51380 - DNA, 601 bp, Human
gatagggggtggggggctgttgcaggaaacgtgagctgtactcgttagctcctcacgtgctcagccggatttataaacacacagagaagacgggatgtaaacaatcagtgggcagcagccagaggcagagctggggcgggggccgggctgggggccaggactggtggggagggggagagggggacctaggacacagccccagtggccggggtccacctgcacaacatgagcctgagggaggatggatgagggctccaggaagcccaccacgcactctcctcaggaggcaggcgagctgtgytgggttcccaagctcacgactaaaccgcaggtgttcaccccacgctgctttccctcctgctgcctgagacacgggcatggctttgcccagagtggaagctgtcatagcaggggcagagccctgtccttctaccccccctttcttttctcctaacctcttctccctctggattcctgagaacccttccctctttctggttctgtgggccgtcggatccttctgttctcccctgccccccacccgcagcctgcaacgacacagttacctcagaactgaaatattcctggaaacaccggcctc

SEQ ID NO: 51381 - DNA, 601 bp, Human
ctcccctgccccccacccgcagcctgcaacgacacagttacctcagaactgaaatattcctggaaacaccggcctcgtctggttaatttcatgagccgtttttttctgcccagatgacttagttcttgtctatccaaaggcttctccccctgctgtccctgtgtagggagctgatctcccctagggatgtcccacagggctcagaatgggagagggtaagttctgagctgggttcctgactgtacctcttggccatgacaaaggcagagcctagaactccggccagcatgtgggtaaagarggaagcctagctcccagctccggcttcagttgggacccttggtctcgccactaactttgagtgaagccagactcgatgctgaaagcgacctcaaggctgggagggccgctgcccaattcagcaggtctccaatctccaaaactaatgctactctgtacccataggatcctagaggtgactgccagatccctaggcttggagttgtgttgagatgtgaggaacagggaggagaaaggaactgagtcaggcaagagctggggatagaaaggaagagtgaggaaagcagcgtccaggaggaag

SEQ ID NO: 51382 - DNA, 601 bp, Human
atctgaaagagtccagactgaccaggtgggccactgccgaagtcctcactgacccctgtcctccataagagatgttttatacaaatggagtcttgcatccttcctagttattagccctctccaaaactgccccagcactgtgattagacctaacctagtcttcattctttcttgaatccaaatcccatcctaaccatgggcaaagcgttatacctatctaagttatttctgcctatcaaagcaacctatgtcattatagaaaaatctgagagtataaaatatgaactataggggtggtggraagagaaggtggcagcaaaaaaaaaaaaaaaaaaaaggaaaaaaaaagaactataggaaagaaaccactcatgacctcacacctattcaagctgaaaacccaaactagccctgctcttcataacatgacaagcagcgccccatctgatacctaaaccgaccaagtcacagccctccaactcaccctctgcctgcccagacctcaccacatccttgctggactcaaacctcaaccgcactaaatcaaccaaatcccaagtctaaactaatctgaaacttttaaagtaacccagtccttaaa

SEQ ID NO: 51383 - DNA, 601 bp, Human
actaatctgaaacttttaaagtaacccagtccttaaacctaacctagcccaatgccaattatatctaccctagccaaaccctaactgcctttgccagtccaaagtgtccactgaatcctcaccttggtcctcacttaaaatcccagaaaagcatatttccccactgcccacatccctccttacagcacccaaccctggcctctggactcctggtatcctgggatgtccaaactctgcagtgccatcagccaacaagcccgactcgtcaaatgcacctctctcccttcctgtccccaccctygcaggctgatggaaaggcctcattgaagtccaacttttccccacctaacaccaagaacggggtgaacctccacactgccaccgttccctgagagtgagcactaaatctccttcaatctaaccccaccctacacttcccacactcaggaatcacatcctagaatatacccaaaactaagccccataaggcagcccgaccctagtggtctaaccctataccttgcttcctatgggtgagtctgttcttggcggccgcctctctcctgcttcctcccttagggctgactgtgctcagcctgcc

SEQ ID NO: 51384 - DNA, 601 bp, Human
aacttttaaagtaacccagtccttaaacctaacctagcccaatgccaattatatctaccctagccaaaccctaactgcctttgccagtccaaagtgtccactgaatcctcaccttggtcctcacttaaaatcccagaaaagcatatttccccactgcccacatccctccttacagcacccaaccctggcctctggactcctggtatcctgggatgtccaaactctgcagtgccatcagccaacaagcccgactcgtcaaatgcacctctctcccttcctgtccccacccttgcaggctgayggaaaggcctcattgaagtccaacttttccccacctaacaccaagaacggggtgaacctccacactgccaccgttccctgagagtgagcactaaatctccttcaatctaaccccaccctacacttcccacactcaggaatcacatcctagaatatacccaaaactaagccccataaggcagcccgaccctagtggtctaaccctataccttgcttcctatgggtgagtctgttcttggcggccgcctctctcctgcttcctcccttagggctgactgtgctcagcctgccagctctgaca

SEQ ID NO: 51385 - DNA, 601 bp, Human
tggcctctggactcctggtatcctgggatgtccaaactctgcagtgccatcagccaacaagcccgactcgtcaaatgcacctctctcccttcctgtccccacccttgcaggctgatggaaaggcctcattgaagtccaacttttccccacctaacaccaagaacggggtgaacctccacactgccaccgttccctgagagtgagcactaaatctccttcaatctaaccccaccctacacttcccacactcaggaatcacatcctagaatatacccaaaactaagccccataaggcagcccraccctagtggtctaaccctataccttgcttcctatgggtgagtctgttcttggcggccgcctctctcctgcttcctcccttagggctgactgtgctcagcctgccagctctgacatgtgctgtctcccaccctctgactcccctcaagctgcagtgggactgaagactggcaggaagctagggtacaactggaacacaggcaggtcgacctgcagtccctaggcctggccccgtccctccatgtacacacatatacatgttggcacacacacagtggcacacatgccaaagactctctca

SEQ ID NO: 51386 - DNA, 601 bp, Human
caggctgatggaaaggcctcattgaagtccaacttttccccacctaacaccaagaacggggtgaacctccacactgccaccgttccctgagagtgagcactaaatctccttcaatctaaccccaccctacacttcccacactcaggaatcacatcctagaatatacccaaaactaagccccataaggcagcccgaccctagtggtctaaccctataccttgcttcctatgggtgagtctgttcttggcggccgcctctctcctgcttcctcccttagggctgactgtgctcagcctgccakctctgacatgtgctgtctcccaccctctgactcccctcaagctgcagtgggactgaagactggcaggaagctagggtacaactggaacacaggcaggtcgacctgcagtccctaggcctggccccgtccctccatgtacacacatatacatgttggcacacacacagtggcacacatgccaaagactctctcagctgacacacagatccattctcaagtatctactgatagacactcatgcgtgccaagtcctcatcctcaaacatacacatgcctctctttctctcccgtcttgccagg

SEQ ID NO: 51387 - DNA, 601 bp, Human
acggggtgaacctccacactgccaccgttccctgagagtgagcactaaatctccttcaatctaaccccaccctacacttcccacactcaggaatcacatcctagaatatacccaaaactaagccccataaggcagcccgaccctagtggtctaaccctataccttgcttcctatgggtgagtctgttcttggcggccgcctctctcctgcttcctcccttagggctgactgtgctcagcctgccagctctgacatgtgctgtctcccaccctctgactcccctcaagctgcagtgggactgaagactggcaggaagctagggtacaactggaacacaggcaggtcgacctgcagtccctaggcctggccccgtccctccatgtacacacatatacatgttggcacacacacagtggcacacatgccaaagactctctcagctgacacacagatccattctcaagtatctactgatagacactcatgcgtgccaagtcctcatcctcaaacatacacatgcctctctttctctcccgtcttgccaggagtgtttcccctcctccatcccctctgcctcccatctggtgtcccaccctcaccc

SEQ ID NO: 51388 - DNA, 601 bp, Human
agtcctcatcctcaaacatacacatgcctctctttctctcccgtcttgccaggagtgtttcccctcctccatcccctctgcctcccatctggtgtcccaccctcaccccccacccagcccaaggtggggacagacacctgaggggctgccagctgcttccccgtgtgggcccgggccgcgctcatgcttctcgtccatcctgcccacaggggactcgtgggggatgttagcgtgcctgtgcacggtgctctggcacctccctgcagtgccagctctcaatcgcacaggggacccagggccwggcccctccatccagaaaacctatgacctcacccgctacctggagcaccaactccgcagcttggctgggacctatgtgagtatccagcgtaggaatctgggagttggggaggagtgaggagttggggaaagacagtcctaaccgtggagggttctggtaaatgatggggtgaggaggggctctttggctcccaccagtccccctgtctggtctatctcctgcccttccctcttaggtggcccccccacttccccatccctggccccaggactaggcatgtgggcaggcctcgcacccgcc

SEQ ID NO: 51389 - DNA, 601 bp, Human
cccattgacatacagatgaaatcacatctggaaattgtttcaagtcaagtggggacgggagctgcgtctgcttttacatatatttgaaattattcatgagacagagtgcttgcttcggcagcacatacactaaaactgaagcatgcaaaagatgagcaaggcccctgcgcaaggatttaaaaaaaaacagtggctcatgcctgtaatcccagcactttgggaggccgaagcagtggatcacttgagttcaggagttcgagaccagcttggccaacatggtgaaacctcgtctctactaaamatatataaattagccgggcgtggtggtgcatgcctgtaatcccagctactcgggaggctgaggcaggagaatcgcttgaacccgggaggcagagattgcagtgagccaagattgcaccactgcactccagcctgggtgacagagcgagactctatctcaaaacaaaacgagagaaacaattgctcatttttaaaaaaagagactgagtgtggtggctgacgcctgtaatcccagtactttgggaggctgagacgggcagatcacctgaggtcgggagttcaagaccagcctgaccaacat

SEQ ID NO: 51390 - DNA, 601 bp, Human
tgccactggctggggcttcgtctagtccaaggcctctgggtacaggcttcaggttcttggttcagccttcaccctcactgtcttccgccagcacagggctggggccctggggggagcgtacaggggccaggatggagccgaagaacagtgagcggaactggaaagagaacaagtgagttctggaggctgctcccttccctacctcccacccctgcctccacctccagtccctaccttcttgggtgggggagtcccaggcactgtactgggctcagcctcatcttcctcctcggagtggggrccggggctcttggggggctgggggccaggtgaaagggaaatggagggcagcacccgcgagccctcattgcctatagtggtttccatggcgatcatgtaagagtcaatgtcgtcattggcaaagtcgtccgggtggggtgtgctgtaggcagaatcggagtatcagggaggggactgggggagcagaggcagggccccaccttggagggctcgaagggagctctggggcccccgaccactggagatctcttggttttatgacttcctgatttggctggagaggagaggatgcaggggttaa

SEQ ID NO: 51391 - DNA, 601 bp, Human
tcagcgccaaagagtatcaggaaagcaaggaaaacttgtcagctccacgggggtcccagatgcatgcccaggacttcaggaaggaacaggtcatgattggcagagaagctggatcaccaggggccagcagcacctactatgacattttccttaggaaggtgagcctgagggagacaggtttccagccttggccagctggagtatagcctgaggctcaatgagaaataagaggtaggaacgtcagtagttcagggccaagtctggaaagtcctgattggctgggggttgtggggagataacggcccaggcccgaccgctgtgggacagctttacagtgacagccagctggggcctgcgagaggcagtgaaacagctcagctccagcaagcccacctttctgatccccagggctgagagacccagttctgccactggctggggcttcgtctagtccaaggcctctgggtacaggcttcaggttcttggttcagccttcaccctcactgtcttccgccagcacagggctggggccctggggggagcgtacaggggccaggatggagccgaagaacagtgagcggaactggaaagagaacaagtg

SEQ ID NO: 51392 - DNA, 601 bp, Human
caggcctgtccccggacctgcagtctatggagcagattcggcggatcatgcggcccacagatgtgcctgaccagggcctgctgtgtgacctgctgtggtctgaccctgacaaggacgtgcagggctggggcgagaacgaccgtggcgtctcttttacctttggagccgaggtggtggccaagttcctccacaagcacgacttggacctcatctgccgagcacaccaggtgggctggtggctccggcctgcggcaggggaaggggagggccgtgcctgcgctcgggactgactgctcccatyctcgcccaggtggtagaagacggctacgagttctttgccaagcggcagctggtgacacttttctcagctcccaactactgtggcgagtttgacaatgctggcgccatgatgagtgtggacgagaccctcatgtgctctttccaggtgagtgtggggaagaaaggagccgctaggccctgtggctcagccccatgagcctgaccaacactgtctcttttagatcctcaagcccgccgacaagaacaaggggaagtacgggcagttcagtggcctgaaccctggaggccgacccatcacccc

SEQ ID NO: 51393 - DNA, 601 bp, Human
actccttccaggaagtgtcccccataccccactgtgctgggctgcactcacttccttgatgtgtgtcctacatggagtgggcttgtctcctttctcccgggagctctgtgctcctgagggcagggatgcctttgtgcctgtttgggaacttgaaaaagctgaggggaaggggatgacttctgcctgtctaggcgcccaggagaccagtggcgggaccaggagggtggtgggaaaggtggggttcattggccaaggcttcctggagggaggatgtccttgtttgaggaagtgaccttccccyggccccccaggcctgtccccggacctgcagtctatggagcagattcggcggatcatgcggcccacagatgtgcctgaccagggcctgctgtgtgacctgctgtggtctgaccctgacaaggacgtgcagggctggggcgagaacgaccgtggcgtctcttttacctttggagccgaggtggtggccaagttcctccacaagcacgacttggacctcatctgccgagcacaccaggtgggctggtggctccggcctgcggcaggggaaggggagggccgtgcctgcgctcgggactgactg

SEQ ID NO: 51394 - DNA, 601 bp, Human
tggctggggcagtcagaggagaggtggggccaccaagtggcccaaccccaggggaagaccatctccaaggcgggtggatcacctgaggtcaggagttcaagaccagcctggccaatgtggcaaaaccccgtctctactaaaaatacaaaaattagctggccatgatggcgggtgcctgtaatcccagctacttgggaggctgaggcaggagaatcacttgaacccagaaggtggaggttgcagtgaaccgagatcatgccactgcactccagcttgggcaatagagcaagactccgtctcaaaaaaaaaaaaaaaaaaggcgtttgaaaccagcttggccaacatggtaaaagcccatctctactaaaaacatttttaaaaattagccgggcctggtgtcaggcacatgtaatctcagctacttgggaggctgaggcaggagaattgcttgaacctgggaggcagagattgtgccattgcactccagcctgggcaacaagagtgaaactccatctcagaaaaaaaaaataaaataaaaaataaaaaaaaatttgcaatcattctccaagcccacaagtgatctaattctccagtactccag

SEQ ID NO: 51395 - DNA, 601 bp, Human
catggtcctgttaaataatttggaaggggagaagggaagtgctgggtagaggagggcgtggtccctgggtagggttccacccccacagacctaggtgagaacaggcatttcctgcccaaatgttgcatttcccaagaccaccctggcctgccacacccctatcctgtgcctataaaaacccaacacccctagggggtagacccacaggcagccagatgtcagaggagcccatcagcagaagacgagctcctggtcattgagaggatgtcaggggagcaagaagcagaagatcacactgacrggcacctgcacgctggcaggtcatcaactggcaggaagaggcggagtttggctggggcagtcagaggagaggtggggccaccaagtggcccaaccccaggggaagaccatctccaaggcgggtggatcacctgaggtcaggagttcaagaccagcctggccaatgtggcaaaaccccgtctctactaaaaatacaaaaattagctggccatgatggcgggtgcctgtaatcccagctacttgggaggctgaggcaggagaatcacttgaacccagaaggtggaggttgcagtgaaccgag

SEQ ID NO: 51396 - DNA, 601 bp, Human
ccagcctgggcgacagagcaagactccatctcaaaaaaaaaaagaaagcgggtggcagtctagcagagggtggagggaggaggagccctggggatagggaataggaatagggcttggctggacagccaccgcagacaggtacaggacagacaccttgatgtcacagaggaactgggcaatctccccttctcgcatggtgcacacgatggtctcccacacaggcagcttgaacttcttgccaatgatgagctccatgggcttgccacgagcccggctgtcgtccagcacggtgccctcgtcrtcactgtgcagcgtccggtagtggaacgtggcctgtgggccacatgcgaggtcaggcaaaggcacaaaccctcaccctgacccccaaggagaagtccagtccccggcctgcagacggcataagggacggggcttccccggggacaccacctgaccttacacctggcttcatcctcccacgctggtgagaaaacaaagccacaaggaggggaggaataggcccaagccacacggctagtgggtggctgagtgggaacaagagtccaagcagtctgactccagtcattcctcaacagatatt

SEQ ID NO: 51397 - DNA, 601 bp, Human
tcatcaatgttctaacaaaattttgctgagagaaatgacggtggctgagaaaaaacctgatgtatgttttttctcttagtcacagtttccaagaatgtatcagcaacatgaagtgaggaccccctgtgctctatccttacagtgaccaggagtcatagaggtttgaaacaaagggatgtacaggtcgtttgcatttgagaacgagtcccctggcctcagtctggctaataggggaaggcggaatggaggccaggacgccatcagcaggctggtgtggtggtctggaaagagtgggtgggcygggcgcggtggcacacgcctataatcccagcactttgggaggccaaggcgggtggatcacctgaggtcaggtgttcaagaccagcctggccaacatggtgaaaccctgtctctactaaaaatacaaaaattagccaggcatcatggcgggtgtttgtaatcccagctactcgggaggctgaggcagaagaatcgcttgaacccaggaggtggagggtgcagtgagctgagatcgtaccactgcactccagcctgggcgacagagcaagactccatctcaaaaaaaaaaagaaagcgggtg

SEQ ID NO: 51398 - DNA, 601 bp, Human
ctgaccaacatggtgaaaccgcgtctctgctaaaatacaaaaattagccgggcacgatggcaggtgcctgtaatcccagctactcaggcagctaaggcagagaatcagttgaacccaggagatggtggttgcagtgagccaagatcacgccactgcactccagcctgggcaacagagtgagacttagtcaaaaaaaaaaaaaccccacagggagacaggcataggggacctagcctctaatctcttgcttggcaaagctgctaggctggtgggaaccagataaccagattcctcctacccrggtcctccccactcctcccactgccctgttgtctggacaggggctgactgccgggctgccatcagcgggcatttcctgagtcttggctctggactggctcgcgctgggcatcccaaagctagaagtaaacaggccagatccctgctctgcaatagcctaggacaaggcagaagagcagatcctggccatgcagggcatgagggttggaggacccaaacgtgggagttgagccaaccactagcagtcagggagggcttcctagaggtggtgacccaggaataagctttgaaggaagaggga

SEQ ID NO: 51399 - DNA, 601 bp, Human
aggtcaggagttcaagaccagcctgaccaacatggtgaaaccgcgtctctgctaaaatacaaaaattagccgggcacgatggcaggtgcctgtaatcccagctactcaggcagctaaggcagagaatcagttgaacccaggagatggtggttgcagtgagccaagatcacgccactgcactccagcctgggcaacagagtgagacttagtcaaaaaaaaaaaaaccccacagggagacaggcataggggacctagcctctaatctcttgcttggcaaagctgctaggctggtgggaaccarataaccagattcctcctacccgggtcctccccactcctcccactgccctgttgtctggacaggggctgactgccgggctgccatcagcgggcatttcctgagtcttggctctggactggctcgcgctgggcatcccaaagctagaagtaaacaggccagatccctgctctgcaatagcctaggacaaggcagaagagcagatcctggccatgcagggcatgagggttggaggacccaaacgtgggagttgagccaaccactagcagtcagggagggcttcctagaggtggtgacccagga

SEQ ID NO: 51400 - DNA, 601 bp, Human
cctcagggaggcgggatgtggtggctcacgcctgtaatcctagcacttcgggaggccaaggcaggcggatcacctgaggtcaggagttcaagaccagcctgaccaacatggtgaaaccgcgtctctgctaaaatacaaaaattagccgggcacgatggcaggtgcctgtaatcccagctactcaggcagctaaggcagagaatcagttgaacccaggagatggtggttgcagtgagccaagatcacgccactgcactccagcctgggcaacagagtgagacttagtcaaaaaaaaaaaaamcccacagggagacaggcataggggacctagcctctaatctcttgcttggcaaagctgctaggctggtgggaaccagataaccagattcctcctacccgggtcctccccactcctcccactgccctgttgtctggacaggggctgactgccgggctgccatcagcgggcatttcctgagtcttggctctggactggctcgcgctgggcatcccaaagctagaagtaaacaggccagatccctgctctgcaatagcctaggacaaggcagaagagcagatcctggccatgcagggcatgagg

SEQ ID NO: 51401 - DNA, 601 bp, Human
ggctgcctcacccggctgcccgggtgctggcaccttcatcagccaagcaggggacaggcaaaggagcatgtttcctgtgggcagagaaggcaagtggctggccagggaaggcttgatgccctatgcccgggcccccgggtagcggagtggaagcagctgatcccagaacccatccccattcagcatggcagctgctccggtggaatgcaggcagttgccagggttggcgggtattttgggatgtggctgggccagggcagggctgccctttctgtagaaggggatggggaaacttgagcayacactcacccgggctctggaccccaccctccagcagcacaggcagaaaggtgctgggggagcccagaacgcacaaggtcacctccgccccaggacagcctcgggaaagagaacatggcccagctcaccaggggcgcccttgctgtctctctgcccaccttccaccacctccacacccacggccccaccctgagcccccagagttttcccaggaatcggatgagacaggggacaggcagggaatggaggtgcccgccagtcctgccccgtgaagctggtttcccctttctgcagctgttcc

SEQ ID NO: 51402 - DNA, 601 bp, Human
gaaagagaacatggcccagctcaccaggggcgcccttgctgtctctctgcccaccttccaccacctccacacccacggccccaccctgagcccccagagttttcccaggaatcggatgagacaggggacaggcagggaatggaggtgcccgccagtcctgccccgtgaagctggtttcccctttctgcagctgttccagaggtgctgtgggctaggtgactggagacctgagttctagcccgagctctgactttctgtgtaaccttggaggagtcagtgttcctccaagcctcagtttccmagtttgtacaatgggaccaagtctgtgattctcaggtattctgcctgtgaaccctctgtccacacaaagtctgatatatgtaacaggcgtggaggggcagaaggggaggagtctggggggtctcagctgctgagctgcctccaccacagctcccaagacctttctctagaagcttcggtgccacacaacgtggtttcccaatcccagggctgggtctttttggggagggggtgagggcagggagcccaatccttgacctcactggtgccagatgcccttgcaaacaatgtccgcctaccc

SEQ ID NO: 51403 - DNA, 601 bp, Human
tgcagtccaggcccacgtcctggcgccaggagccagggaagcagcctgtgggcggcaggccagagccccctccccaggggccctcttcctccaggtccttggagcccagtgggcaatcccactcgggacccgatggatccagggagagctgagagggcagaagtggtaggtcttgggcagggtgggccagtgggcacattaagtcacccaagggtgtaagccccccactctcccagcctgggctatgttcagggctgacaccgtcccggggactaggagaggaaaggcttgtgttgggggygaaggcttgttaatgggaacgcaaccgtgggagtgctttgtaaactgttctgtgtggtgcccctggggggagggcaggaagcaatgtcttgccagccagcccctcccgcccctgccatgctgggctccgccttagcttgcttcacagcagcagagttttctgcttgttttgttcatggaggcaaccccagcacctaaagcgtgcctggcacacagccacttctcagtaagtgtttgttgactgaagagtagatgaatgaacgaacccagccatcactctgaggtggcttatttctgtctc

SEQ ID NO: 51404 - DNA, 601 bp, Human
cacagaagcataccccaggagacctgggtctcagccacaattcacccacagaagcacaaccagagattcaccccctctcctggagtgtgtcccaccagtgggtttcaatcctagctctggctgtgggacctgggcccctcccctttgtgatctgaagctcactctccccagcctagaatggggctggtttccctctcctaggcagggcagcctatggctctaactcctccctctcacagtccccagtcagcccttctccctgcctgtctcgcaactggacacatattgagccctggctgtmcttgagagcctcctggcctgggggagaatactgaggggcccacacatgtcagggacagagatgacagctgttggaccctttctgcaactatatacagggcagtctgtgcagacccatccctgtctaccactggagagggtcggcagagaggggaaatggcttctccaggatgcccagtccagcccacattccccacacaacttccaggcccacgtgcagccctccctacagctggtccaggctccaggaatgaggaaccagccccattctaggctggggagagtgagcttcagatcacta

SEQ ID NO: 51405 - DNA, 601 bp, Human
tggggtgaggagaggcagtgctttggctgctgtcccgctggactgaacagtcatcatcatcatcatcatgagctggtagagccctcttgaggctggggtgggggctattataatcccattatccgcaggagaatactgaggctcagaggagaagaaagggcctttcccatgcaggtgagtccaagtctgacccctctgggagcctggaacagtgtgggaattcagggaacctcaagtgggtggcagggcaagatggagaccgtgggtcctccccgccgatccatggcaggcacccatttgycctgctccactcctttgcatgcccccactcgtgtccactctgaggcaggctgacagacatcccaggggccctcccagcttcagtccccacacactgagtcctctcagatgcatcacttcccttctctgagcccccttccaggcagatctgtagggactttctaggttcactgagcatgtttgtgtaggttgctcactgcacaaaggcacctgggagagagatcacaccccactctgctacaccgtgcactctggtgaggctgcatgttgcctggaggagagacgtctttccctagctggc

SEQ ID NO: 51406 - DNA, 601 bp, Human
aggggccctcccagcttcagtccccacacactgagtcctctcagatgcatcacttcccttctctgagcccccttccaggcagatctgtagggactttctaggttcactgagcatgtttgtgtaggttgctcactgcacaaaggcacctgggagagagatcacaccccactctgctacaccgtgcactctggtgaggctgcatgttgcctggaggagagacgtctttccctagctggcaaaaaggtgctgtgggggccggtgcagccctgcggaggagagcctgtgagaacgcatgtgtgcragggttcacacccggagggcactgggcctcttctgtccagcctgtgagttagggctcccatgcaggtgactgataaggaaacctacagaagagctgcccagaaaacagtctcctgagtaggaaaggcaatgactgagccccagctggagggacgctgctggagaccaccggctcctagggtctgtgtccagggtgagccactgccaccgcgcccccgcaggctcatgacagaccctcggcccagggctgaggctgctgcaccttgctcctctattctcccaggcaaagagctgaactgtg

SEQ ID NO: 51407 - DNA, 601 bp, Human
actgacaccccacccaatggccacccctggagcctgggcctgcagatgcctcccatccatatggagtcctgccgtgttccccatcgaagggagggcacttgggaatggacactgcgggacacacgcctgtgtcggaaccagccctgttgccctggcgatggctcaggtcctgggcacccacgggggctattagtgagtgtgggagggggtttccatggtggcggtcccgagggggcagacgcagggcccagggaggggtgagggctggcgggacctttctcctttgtccgaggcacactargcctttgttcttgcctggatccctttgacagatgtgactagaaccatgggtgcggggaggacttgggttagagtcccccatcccagcgagtactgaaccaccctggagggaggggaaggagggcagaagagggggtagagcccctggactcgccatccactggggcgccctcctcctgcaggtgcaaaagccactcctgtccccagaggctgggcagggcaactttcaattggctcttattactgtaaacaccttccccagcggccagtgggcagcctcggtgtgtccccagggcaggac

SEQ ID NO: 51408 - DNA, 601 bp, Human
ggagcctcgttggggcctggggggcccctcgatgggggggccccgggcccgagtcaggagcccatggaaagtcttgccgcgggtctggggtttccgccgcggtggtctgggctcctccgggggctgcaccacaatccgaggcacctcaggcttggcgcctcgtcgcactcctgccagctgctgggcctcaaagatggcttgggccccggcgaggcggacctgtggccggggcgggggtcccggcgcggaatcgggcagctgggccagctgggccttgatctcccgctgcaggtcccgctcygacagcaccacgctgtgcacctgtggggagcagttggtgctgcgtttgcccggcctcaaggcaggaacaggaaactgtgaggtccccagcccaggaagtggctgaggactgaggggctgacagcctcactggggagccacagaaagccactggaggcctcaggtttttgtgttctctgaagctcaggggacaggaactaagtccccattctcgctttggcttcctgctctgggactcagtttcccccgtgcagcaggggctgggcaagtccaaggagaggtgggggtacccacctgtgac

SEQ ID NO: 51409 - DNA, 601 bp, Human
agggccatcaccttcagcacacctggtcccatgactcgaggctccaaaagggaaccctggagctggtgagctagctccctgtccacaccccaaggctccagtcccctccaagccaccagcttcctgccaggagcccagggctactgatgccttcacaccaagccctccctgggcctcagcttgctcatctccatgatgaaaggtcaggtggagccctttaagggcctttccaacttggatctgtgaccctctgattctagaaagatcctaggcagaactgctcttccctaagccaggagcrtagcactcagtgcacactccccacagtgtgagtttgggctagtcctggagcctcaaaattccttcctggcagcctctgatctgagaagagccaccaggggaccagcgaggttgagtgatgatggtaggaacaatcactattcatactatcgtccttctgataaagggagcctgtgtagtgtttgcccccaggtgggcaggtcaggccctgcccagctctgcccagccctgctctcgaggtctaaggctggttggaaggtgaccgcatggatagcgacttggacacctgtggccagaactc

SEQ ID NO: 51410 - DNA, 601 bp, Human
tcctggagcctcaaaattccttcctggcagcctctgatctgagaagagccaccaggggaccagcgaggttgagtgatgatggtaggaacaatcactattcatactatcgtccttctgataaagggagcctgtgtagtgtttgcccccaggtgggcaggtcaggccctgcccagctctgcccagccctgctctcgaggtctaaggctggttggaaggtgaccgcatggatagcgacttggacacctgtggccagaactctaagtcagccagtggtcctccgctgtgcggagggcaggaagcyggctgagcacacgacaggcattcagtatgcacagtatgcatatgctgactgatttctaccacgttttaaggtgcaacctccagacctcacatatagaacagaatgcaggtgggttaccgatggcagtatcaaggcagagtcccaaagacacagggagtccagcttggctctgctccgactcccctcctgttcttggcctggcccccagcctccacctctctggcttcatggctccaagccctccctgcttcgtagactgtagcctggcccctggggacagtggcctctctggccccaggc

SEQ ID NO: 51411 - DNA, 601 bp, Human
tgaatttggttactgtcgccacccatccccacccccgccagaattgaaggtctcgatcacttgattcccagctgcagatccacgtctggagccagtgagcacccagcaggtgcctgcgggctctggggaggaacgcctcctactgtccctgagaagctcaggcctccatgtgctgtgatcaccctgctcctgccccatctgcctcctctggaagcctccctggcccagctctgcaccaggcggtgcctgggtgatgggtgatgggtgatgtagcgccaggcaccaggccatcaccttcggyacacccagtcctgtgatttgaggctcaaaaagggaaccctggagctggtgagctacctccccacccacaccccaaggctcctgccccagccactggctgccccactcaccctcactgaggaaggcatcccagacacgcagcactgtggggaagggcagggagcgggcgaagaggcacaggaaccactcgggcaggtacagcaggggtccgacgcccacctgctgcaggtgcttgtgcacgtgcggaagcagccgccgcagcagggccatgaacacctcggcgtccagccgcacagcctcc

SEQ ID NO: 51412 - DNA, 601 bp, Human
ttccctgggcctaggtcactagggttcccagagcagggtcaaggtcactcacctctgggggcaggtgcatgagcagcacagcagccacgggcccctgggcctggcagtagccctgctccggtcgatacagggtgtaggccttgagcacctgcaggagcccctgctgcctgtgccggaagaccccataaggggccagtcctgcaggcacccccttctccaccctctgggggcctctgcccaggcctcagcctccctgggccttcctgggtcccctgagatgcaagactgtagagctgggctrgggaaagtgggctggagcacctggggcttgtggggctgggggtccctgggcatcaccggcctcgtacccgtggccctgaggcgacacaaacatctcgtgcagagggaattgacggtgcaggtccctgccaatggtctccatccactgtgggtctccaggggcctctgccagctcctgtgggtagccaggaaggtgggtgtgagggttcagtgtggtgaggggctctgggtaggggaattggggcccctgcccactccctcacctgataggtgccagggctgttcttctggcacacatggg

SEQ ID NO: 51413 - DNA, 601 bp, Human
tgtggggctgggggtccctgggcatcaccggcctcgtacccgtggccctgaggcgacacaaacatctcgtgcagagggaattgacggtgcaggtccctgccaatggtctccatccactgtgggtctccaggggcctctgccagctcctgtgggtagccaggaaggtgggtgtgagggttcagtgtggtgaggggctctgggtaggggaattggggcccctgcccactccctcacctgataggtgccagggctgttcttctggcacacatgggccccacacaacaggggccagcatcgggcrcgcagggcagacgggatgcctttccggcactgcatctttacctgtgggtgaggccaagggctccactaggcagcctccatagctcctgctggcaggccccaggcacagctcatcagcaggcaggggcccactttgggtggcagggagcaaaggccggaggtgctgggacacagggtgggtacattttgccaagatgtgggctgaggcagagaggaatgagccatggaagccaagtggggcccctgcccccctcaccttcttgtaccgccgggacatggttttctcccagtgcgaggtcat

SEQ ID NO: 51414 - DNA, 601 bp, Human
tggcaggccccaggcacagctcatcagcaggcaggggcccactttgggtggcagggagcaaaggccggaggtgctgggacacagggtgggtacattttgccaagatgtgggctgaggcagagaggaatgagccatggaagccaagtggggcccctgcccccctcaccttcttgtaccgccgggacatggttttctcccagtgcgaggtcatctccacccacttcatctcccgttggcggatgaggtctgcaggtgggtggcccggcctgggggtgcatggcacaggtatccagacgctggrcagctgttacccaaggcccacactgccaccctccaggctacccaggtgaacccagctcctggccctagggatctctgggagccctgtggggtgacctgtgacccaggagctgccaatgcttgtcacggggacaggaaaggatgtggctccgacgtgggcagaagcaggagactgaaggggtgagtgggtgtgtattgggggagggactggttggctgtcacccaggacagggacacagacaattcataggggaagctggctggagagagccctggactggaagcccagagtcctgagttt

SEQ ID NO: 51415 - DNA, 601 bp, Human; identical to SEQ ID NO: 51393

SEQ ID NO: 51416 - DNA, 601 bp, Human; identical to SEQ ID NO: 51392

SEQ ID NO: 51417 - DNA, 601 bp, Human
tttttcctgatcaggtaactccctgctagcccattccaggaaacacagagcaaagcctcagacagccttgacttgtctaacctgttcccaagccggctgtgcagtgtggtccctgggggcagggccctggaagaacagggcagacaccgagcagctataggtcctggcagtgagacaagggtaggcatgggaattgggaggtgcagccctgccccacgcctgttgggtaacactgagcatcaccccattgattaccccattgccaggcgtgggcacgggagttggtttgggagctgccagkctcctgggaggatcgcagtcagcagagcagggctgaggcctgggggtaggagcagagcctgcgcatctggaggcagcatgtccaagaaagggagtggaggtgcagcgaaggacccaggggcagagcccacgctggggtatgtggggccacaggggtgaggggcgggcagagggagctcagggtaaaggacactggtgggaaccaggggcatggagggaaggggatgtgtgcccgtggcccgtgggtcagggggcaagcccaccaaggggcctatggctgcaggggccatgggtacggggc

SEQ ID NO: 51418 - DNA, 601 bp, Human
gagcatcaccccattgattaccccattgccaggcgtgggcacgggagttggtttgggagctgccaggctcctgggaggatcgcagtcagcagagcagggctgaggcctgggggtaggagcagagcctgcgcatctggaggcagcatgtccaagaaagggagtggaggtgcagcgaaggacccaggggcagagcccacgctggggtatgtggggccacaggggtgaggggcgggcagagggagctcagggtaaaggacactggtgggaaccaggggcatggagggaaggggatgtgtgcccrtggcccgtgggtcagggggcaagcccaccaaggggcctatggctgcaggggccatgggtacggggcttgctcaggagagggaggtgggtgctggtgtcttctgagcctcactttgccctttggcaggctcctgggaagcagccacagaaatgaagcctgttccccaggagccccagggatggggacagaccccgtcctccctttgaggagctcccaggttagaggagaaggcagctctgtggacagacaaggattcggtcgggggcaccagggctgtgatcaggaggtgccggagaatcg

SEQ ID NO: 51419 - DNA, 601 bp, Human
caccccgaccgtcactgagagggtgctgtccccagaagatgcttagagcggagattattgcccgttagagggtggaggggcaggtgaggatgaggctcacctccgctgtggaatgtgcggggctcaagccctcttctcatgactagagcccaacacccaccttctcactccctggcaggttgtgaaccagatgctggagcggaccagcagcggcagctttggaggcaatgagggcttcacctacatatctctgctgtccgtgccattcgggggagtcggtgggtccctgcccatttccacycctagggaagcttggctttggtaccccagacccaggaagtcccttcactcactgttcaaccttgatccacatcctgggcctctcaaggcctcagtttccctatctgtaaaatggctctgtgagtggcctggctctctctgagctccctgccagctgtgtgccctggccggggcagtgggctgctgctggggctccatgggctgcctggtctcaggcccttgttctctgtgcccacacaggccacagtgggatgggccggtaccacggcaagttcaccttcgacaccttctcccaccaccg

SEQ ID NO: 51420 - DNA, 601 bp, Human
tggaggggcaggtgaggatgaggctcacctccgctgtggaatgtgcggggctcaagccctcttctcatgactagagcccaacacccaccttctcactccctggcaggttgtgaaccagatgctggagcggaccagcagcggcagctttggaggcaatgagggcttcacctacatatctctgctgtccgtgccattcgggggagtcggtgggtccctgcccatttccactcctagggaagcttggctttggtaccccagacccaggaagtcccttcactcactgttcaaccttgatccacaycctgggcctctcaaggcctcagtttccctatctgtaaaatggctctgtgagtggcctggctctctctgagctccctgccagctgtgtgccctggccggggcagtgggctgctgctggggctccatgggctgcctggtctcaggcccttgttctctgtgcccacacaggccacagtgggatgggccggtaccacggcaagttcaccttcgacaccttctcccaccaccgcacctgcctgctcgccccctccggcctggagaaattaaaggagatccgctacccaccctataccgactggaa

SEQ ID NO: 51421 - DNA, 601 bp, Human
ggggtgagcagtgttggagtcggcagcagccccttcaccccgcctgtattgttcaggcgtgactctggttggggaagccctcaccacctcgctgtgctccccaggtatgccttccacagctcggcctggctggtggcgggcaaggcagacccagccacacctggccgcgtgcacttccaccccgactcgccagccaagggtgcccagtggatgcgccagattgtgtcctttgacaagctcaagctgaccaacaacctgctggatgacaatggccacgtgaggccggggccacggtggggasggaagggcctggggtcagggctggtagggactttggtgtccaatggccttggtgcccagcacctctgcctgctgctgatggtcaaggcagggcggggagccggggtggcgagctcacctggctgggggtggcacagcaggaagggctgtccaggcaggtggaaaagggggtgggggcgggggaatgttccagcatacgttgtcccccgcaaggagagggaggacaaggtatggaacgcccagcctaggccgggcccgctttatgtgtggacacagcatcattaacacttggtcaaacagc

SEQ ID NO: 51422 - DNA, 601 bp, Human
cacgtggtcttcgtggacccacgcaaggacagtgagcgctatgcccaggagaacttcaagtccttcatcttcacagagacccagttcacagcagtgacagcctatcagaaccacagggtgggtgaaccagctcgggagcacccgctgcaggcccatttcacaggggtggagactgagccctgaggcttgcagccctcactggcacagactactgccctcccaacttgccctgagtatctgccatcagtcaaggccctgcccgcactcctatcagctcagagttcctgggccaagaggcccrggtgccagggcctcctgactgccggttcccgggaggacaaggtggctgagcctggctcatggccagcccacaactgcactttgtctcctgcagatcacccagctgaaaatcgccagcaacccttttgccaaaggctttagagagagtgacctggactcctggtactgtctgaccctgaccctagcccctcacccccaccccaggcatatcctaaggcctcagttcctgacccttgtttcagggtcacaccctctgacccatcctggggccccaccatctgaagctggccatgatccctgg

SEQ ID NO: 51423 - DNA, 601 bp, Human
tctcgcttgctctttcaggcctgtggccccacggcccctgctcagtgtcccagcccggagtcacagcagcctcagtccctgtgtgctgaagggtgccacagacagggagaaaggtaaggccccaggcctgcagacatagtgggactaaggtgtacacagtgggcgggaggcaaagggacaggacctccaggaaggggcttcagcagctcagcgaacccacagggcccctgtgtggacacacggagggggaagcagacatgcctaagacaatatggggctcagggcaaagagcacaggcagsgggtgccaggcaggcttcctgcaggaggtggctctcaagctgggccttggaggactgggaagggtttggacagagggagaaggtgaagaagaaattccaggcagagggaaaagcaaaggcgaaggctgagaggtaggtaacttgggaaggaggagcaggaagggaccagggcaggcctgggatgagggatgaggatgcgatgggaggcccagagtccactcatttcctccctcagaccccaacaaagcttcagcttccacctccaagacccctgcttggctccatcatcagctgctgccc

SEQ ID NO: 51424 - DNA, 601 bp, Human
gaccctccatgatcaggtccaccttctagaatgtgcctggctagagatcctgatgattggtctcgtctggcgctccatggagcacccagggaagctactgtttgctcctaacttgctcttggacaggtaagtgacctggctgtagcttaggagtagcatgttctttacgatcatagttcattcatgaaactattttattcatctctcggtgaagcttcagagaactttattaggtatgtttacttaacaaaagagtgcattgggggtgatgaagcctagtcaaattcacagaaagctaagrataactttctgctagacattacctcagaagaattctattatttctaatacacacacacacacacacacacacacacacacacacacactcacactctctctctctctctctctgtcattatgaatggtaattttctaactccatcttcaacttgtatcatataaaaattataataacctctctttaattaaaatctgttgttgcttcttgtacatccataccacaatagcctattcattttcttctccaattttcccatccgtaaaatgaagaaatttgaccagagttctgaaggtcaca

SEQ ID NO: 51425 - DNA, 601 bp, Human
tttatgcatgtatgcatatatgaattcattcttgacattgccatgcagagtatttagtataactagacttattatccatttatcctgcctagaagcatactgtaatatatataactctaaaagcaagatcattccttatgttggttcttttgagctggcagggggaaagcagagtatgttggcaggggtctatcaaggtagatgagcccagtttgtacatctttgaaatattaccaatgccaatgtgttagtactgcttggatctcttctatgacaacagttcttattttttccttttttytgtttgtttgttttttgagacaggatcttgctctgtcacctagacaggagcgcagtggtgtgatctcggctcacttcaatttccgcctcctgggttcaagcaattcttgtgcctcagcctacagagtagttgggattacacgcatgcgccatcatgcctggctaatttttgcatttttagtagagatggggttttgccacgttggccaggctggtctggaactcctggcctcaagtgatctacccgccttggcctcccaaattgctgggattacaggtgtgagccaccacacctggccca

SEQ ID NO: 51426 - DNA, 601 bp, Human
tcattaagtcatttaatattcttatttgctatttcccagtgtgatggttaagactgagtgtcaacttgattggattgaaggatacaaagtattaatcctgggtgtgtctgtgagggtgttaccaaaggagattaatatttgagtcagtgggctgtggaaggcacacccacccttaatctggtgggcacgatctagtcagctgccagcgaatataaggcaggcagaaaaacgtgaaaggggaaactggcctagcctcccagcctacatctttctaccatgctgaatgcttcctgcccttgarcattggactccaaaatattcagttttgggactcggactggctctccttgctgctcagcttgcagacagtctattgtgggaccttccgatcatgtaagttaatgcttaataaactcccctttatatatatcctattagttctgtccctctagagaaccctgactaatacacccagtgtgttcttttatcaaatagaaaggagatatagaaaacacactgtccatgtctttgattgttacaccacagcagagaatcaatttcttaacctgcttacttatttaccattctccaatggtgccaa

SEQ ID NO: 51427 - DNA, 601 bp, Human
gcttgcagacagtctattgtgggaccttccgatcatgtaagttaatgcttaataaactcccctttatatatatcctattagttctgtccctctagagaaccctgactaatacacccagtgtgttcttttatcaaatagaaaggagatatagaaaacacactgtccatgtctttgattgttacaccacagcagagaatcaatttcttaacctgcttacttatttaccattctccaatggtgccaattctgagatccatcatgactttatcattagaaaaggggatgtaacaaacatgatgasatgttacgggaatactgcttactgcatgatatggtttggctgtgtcctcacccaaatctcatcctgaattttagcctcccatacttcccacgtgttgtgggagggacccggtgggaggtaattgactcatgggggtggtttctcccatactcttctcctggtagtgaataagtctcacaagatctgatggttttataaggggttttccctttcacttggctctcattctctcttgcctgctgccatgcaagacatccctttgctcctccttcatcttctgccatgattgtgaggcctccc

SEQ ID NO: 51428 - DNA, 601 bp, Human
aatacacccagtgtgttcttttatcaaatagaaaggagatatagaaaacacactgtccatgtctttgattgttacaccacagcagagaatcaatttcttaacctgcttacttatttaccattctccaatggtgccaattctgagatccatcatgactttatcattagaaaaggggatgtaacaaacatgatgacatgttacgggaatactgcttactgcatgatatggtttggctgtgtcctcacccaaatctcatcctgaattttagcctcccatacttcccacgtgttgtgggagggasccggtgggaggtaattgactcatgggggtggtttctcccatactcttctcctggtagtgaataagtctcacaagatctgatggttttataaggggttttccctttcacttggctctcattctctcttgcctgctgccatgcaagacatccctttgctcctccttcatcttctgccatgattgtgaggcctccccagccatgtggaactgtaagtcctttaaacctcttttctttataaattgcccagtctcatgtatgtctttatcagcagcatgaaaacggactaatacactgcatgct

SEQ ID NO: 51429 - DNA, 601 bp, Human
gaggtagatgttgagcaactccgaggagtttttcctcatacatgttgggtttaaagtgcagggaagatatcctgaaggttattccaggcagaaatttggagctcagaagagacatcagagctgaagataaaaaatttgagagccatctccgtagctaaaagtgtggaacgaatgtgatgactagacaagataatagagaaaaggtatccaaaggcctgaggtcaagacctcttaaaaggctgacttttcagggttttaggtagaaaaagagtcccagcctggggttaaggcagttttttgrgaagtagaggtacaaagttccttgttccaaaggaagggtgtctttcaaaagaaaaaggatgggccgggtgcagtggcttacgcatgtaatctcagcactttgggaggccgaggctggcagatcacctgaggttgggagttcgagaccaacctgaccaacatggagaaaccctgtctctactaaaaataaaaattaaaaattagccgggcttggtggtgcatgcctgtaatcccagctactcaggaggctgaggcaggagaatcacttgaacctgggaggcagaggttgcagtgagccaag

SEQ ID NO: 51430 - DNA, 601 bp, Human
tccaggcagaaatttggagctcagaagagacatcagagctgaagataaaaaatttgagagccatctccgtagctaaaagtgtggaacgaatgtgatgactagacaagataatagagaaaaggtatccaaaggcctgaggtcaagacctcttaaaaggctgacttttcagggttttaggtagaaaaagagtcccagcctggggttaaggcagttttttgagaagtagaggtacaaagttccttgttccaaaggaagggtgtctttcaaaagaaaaaggatgggccgggtgcagtggcttacrcatgtaatctcagcactttgggaggccgaggctggcagatcacctgaggttgggagttcgagaccaacctgaccaacatggagaaaccctgtctctactaaaaataaaaattaaaaattagccgggcttggtggtgcatgcctgtaatcccagctactcaggaggctgaggcaggagaatcacttgaacctgggaggcagaggttgcagtgagccaagttctcaccattgcactccagcctgggcaacaagagtgaaactctgtctcaaaaaaaaaaaaaagagagaaaaagaaaaagga

SEQ ID NO: 51431 - DNA, 601 bp, Human
agagaaaaggtatccaaaggcctgaggtcaagacctcttaaaaggctgacttttcagggttttaggtagaaaaagagtcccagcctggggttaaggcagttttttgagaagtagaggtacaaagttccttgttccaaaggaagggtgtctttcaaaagaaaaaggatgggccgggtgcagtggcttacgcatgtaatctcagcactttgggaggccgaggctggcagatcacctgaggttgggagttcgagaccaacctgaccaacatggagaaaccctgtctctactaaaaataaaaatwaaaaattagccgggcttggtggtgcatgcctgtaatcccagctactcaggaggctgaggcaggagaatcacttgaacctgggaggcagaggttgcagtgagccaagttctcaccattgcactccagcctgggcaacaagagtgaaactctgtctcaaaaaaaaaaaaaagagagaaaaagaaaaaggatggtgaattgggccaaataccagagagatggacaggagtaagaagaaaaagactaaagatttgttcatcaggagctcattgtttctaaagggagcatttttagtaaagagga

SEQ ID NO: 51432 - DNA, 601 bp, Human
gtatttgtcagtgaggaaaacagtggggctctagttcttgatagcaacagcatcaaagggaactttttaaactaaaatattatgaatttttcaaactgaaataatgagagaataatacaaagaaatctcatctgcccataatccaaattcagtagttattaaaattttgccccattgcttaatccattaatctcatttcattttgtcctttttctttgtttatttttggctaaaacattttaaagacaaatcctaaatatcatacatcagtaggcatttacaaaaaaatttcttgataatsacaatgccattctcataccaaataaacttataataattctgtgatatcatctaaaaaacagttcttttctacatcaaaaatgtctgtttatagttgatttattcaatttagagtccaaacaagttccatatattagacattaggtcattaatgtctgtctatttgaatttataacaatttccacttaatttattttctccagcttctgtggagactaggtaagttgttttgtagctgtctggatatatctgattgcttccttgcagtgtcatttaacttgttcctctatcctcagtgttt

SEQ ID NO: 51433 - DNA, 601 bp, Human
ttctacatcaaaaatgtctgtttatagttgatttattcaatttagagtccaaacaagttccatatattagacattaggtcattaatgtctgtctatttgaatttataacaatttccacttaatttattttctccagcttctgtggagactaggtaagttgttttgtagctgtctggatatatctgattgcttccttgcagtgtcatttaacttgttcctctatcctcagtgtttctgcacatggaagttagcctcatagcaggggttggcatactttagcctgcttaccaaatacgactcscttacatttttgtaaataaaatgttactggaacactgtcacatatgttggggtcatagaaagagtttccgtgtccccaagttataattgcattcacttatattttcttctagtaatttttacccttacatattaggggtcaatttggaatttctcttcatatacagtatgcaataaagaatggcttttatatttttccaaatgtatattcagttgtctcaacaccatttattaaaaagtcagtatttctcaagtgatttgagatctacccttaattacacagtaaatttctctgtagtct

SEQ ID NO: 51434 - DNA, 601 bp, Human
tccagcttctgtggagactaggtaagttgttttgtagctgtctggatatatctgattgcttccttgcagtgtcatttaacttgttcctctatcctcagtgtttctgcacatggaagttagcctcatagcaggggttggcatactttagcctgcttaccaaatacgactcccttacatttttgtaaataaaatgttactggaacactgtcacatatgttggggtcatagaaagagtttccgtgtccccaagttataattgcattcacttatattttcttctagtaatttttacccttacatrttaggggtcaatttggaatttctcttcatatacagtatgcaataaagaatggcttttatatttttccaaatgtatattcagttgtctcaacaccatttattaaaaagtcagtatttctcaagtgatttgagatctacccttaattacacagtaaatttctctgtagtcttgtctttttctaatatgttaattctgtaccaagatttgttcatctgttaatggatcaatatcacatagctttgtttatagaaggtgcacattgttttaattctggccatgctatcccaccaaatattgccc

SEQ ID NO: 51435 - DNA, 601 bp, Human
caaggggtgccttttcatttgttaaatattctttgtgtctttcagaagtgttttcaagtatccttatgtgtattttgcacaaatttttatatttgtgcctattggatgccacgtgcagggttaaaaaatattatacctattttatatagatatatatgtatataaaaatatatattatatatagttataatacataaatatattttaatatattatataatatatacatgtattgtatttatatatgtatttatatgtgtatctataaatatacatatgtatgtatctataaatatacatrtatgtgtacatatacacatatatacacattatatgtatgtttatacacatataaatacatatataaatatactagaaagtccatggggtttcctagtatacaatcatattgtctgcaaatagagattgttataccttttcctttctattccaaagtgtctaaaagattttttcttagctagtggcattggatgacacctataatgtcttctaaaaatagtagcagtcataggcaccatttccttattcttgaatattcattcatgttacaaagtttataggaatttctgaattattaagt

SEQ ID NO: 51436 - DNA, 601 bp, Human
atggttactttgaccgtataatttattttgtgtatttatgcttcttttagaaacttaggtcagctagtggttcctctattttgttgatttttttcctcaaagaactagcttaagtttattttattagttctactagttttctgctttctaactcattaagttatgcctttagctttattaaatccttcattctgctatcagttaatgttttagttcattttctagctttttgagttgatacttaatttattttcatttcatgatataggtaactgatgctcagaattttctcaaagcatcmgttttcgctgggccccatagattctaatatatcttactttcattattattatttcctaaaaattcagcaatttcatgttttattttgtctctcattcaagagttgtttaatagacagtttaatttccaggttggatgggcattttgttttgttttttgttttactgtttataaatacttttggccttgggatcagagaatactgcttgtattacaattattactgaatatttttgtggtctaatataatttcagctttcaaaaatgttccatgtatacttgaaatgaaggtttatttacc

SEQ ID NO: 51437 - DNA, 601 bp, Human
tagaaacttaggtcagctagtggttcctctattttgttgatttttttcctcaaagaactagcttaagtttattttattagttctactagttttctgctttctaactcattaagttatgcctttagctttattaaatccttcattctgctatcagttaatgttttagttcattttctagctttttgagttgatacttaatttattttcatttcatgatataggtaactgatgctcagaattttctcaaagcatcagttttcgctgggccccatagattctaatatatcttactttcattatyattatttcctaaaaattcagcaatttcatgttttattttgtctctcattcaagagttgtttaatagacagtttaatttccaggttggatgggcattttgttttgttttttgttttactgtttataaatacttttggccttgggatcagagaatactgcttgtattacaattattactgaatatttttgtggtctaatataatttcagctttcaaaaatgttccatgtatacttgaaatgaaggtttatttacccttataaagatagaaggtaaaatattagctatgcccatgtctattta

SEQ ID NO: 51438 - DNA, 601 bp, Human
attttattagttctactagttttctgctttctaactcattaagttatgcctttagctttattaaatccttcattctgctatcagttaatgttttagttcattttctagctttttgagttgatacttaatttattttcatttcatgatataggtaactgatgctcagaattttctcaaagcatcagttttcgctgggccccatagattctaatatatcttactttcattattattatttcctaaaaattcagcaatttcatgttttattttgtctctcattcaagagttgtttaatagacartttaatttccaggttggatgggcattttgttttgttttttgttttactgtttataaatacttttggccttgggatcagagaatactgcttgtattacaattattactgaatatttttgtggtctaatataatttcagctttcaaaaatgttccatgtatacttgaaatgaaggtttatttacccttataaagatagaaggtaaaatattagctatgcccatgtctatttatcttcttataatttttgcttaatgaaaactaatgatccattatctgctgcataagtatttatgtttgctt

SEQ ID NO: 51439 - DNA, 601 bp, Human
atagattctaatatatcttactttcattattattatttcctaaaaattcagcaatttcatgttttattttgtctctcattcaagagttgtttaatagacagtttaatttccaggttggatgggcattttgttttgttttttgttttactgtttataaatacttttggccttgggatcagagaatactgcttgtattacaattattactgaatatttttgtggtctaatataatttcagctttcaaaaatgttccatgtatacttgaaatgaaggtttatttacccttataaagatagaagktaaaatattagctatgcccatgtctatttatcttcttataatttttgcttaatgaaaactaatgatccattatctgctgcataagtatttatgtttgctttctctttattatgccttatggcttttgtgttaaaaagctattgatttatttaatattttggaaggattgaattttaccctatctaatatcaagatcatgactcttgattcctttttgttttcacttgtttaatatatctttcttctatctttattttaaacacaagaagagctttgctttcagtttctattttacatagt

SEQ ID NO: 51440 - DNA, 601 bp, Human
tgcaacttctgcctcccgggttccagcgattctcctgcctcagcctcccaagtacctgggattacaggcatcagccaccccacctggctaattttgtatttttagtagagacagggtttccccatgttggccaggctggtcacgaattcctgacctcaagtgatccaccccatcagtctcccacagtgctgggattacaggtgtaagccaccgcacccagcctctcatcttatttttattacttatatttttctacattattagaagttataatacttatatgcacatttctttagcccctaccccattttttgatattagctctattattaagatatttaatgtccaccttcagattatatgctgatgattctctaatcgtttttggttgtctggagcttttttactgtttattttcaggaagagctcatgataactcttttttctttggtttaaaaatgtttataattatttttctctggactttatgctgagaaatttggctgcatacaaaatctctggcttacattttttctcaagtatttttaagtgattgcttcattattttgtagtataaaatgttgctcacaagaagctggat

SEQ ID NO: 51441 - DNA, 601 bp, Human
atgcacatttctttagccccaaccccattttttgatattagctctattattaagatatttaatgtccaccttcagattatatgctgatgattctctaatcgtttttggttgtctggagcttttttactgtttattttcaggaagagctcatgataactcttttttctttggtttaaaaatgtttataattatttttctctggactttatgctgagaaatttggctgcatacaaaatctctggcttacattttttctcaagtatttttaagtgattgcttcattattttgtagtataaaatrttgctcacaagaagctggatgccagtctgattttctttccctcattagtgatttggactttttgtctgaatgttgaatttttaaatataaacataaattgcaatacttttattaagatatgtctctgcattgaacattttaggtccgttttcctaggtacatagaatgtcttttgaatatgtagactcaaatcagacttcttgattctcttgatttatagttttaaatatttgtttgggggcgggtgcggtggctcatgcctgtaatcccagcactttgggaggccgaggcgggtagatc

SEQ ID NO: 51442 - DNA, 601 bp, Human
atacttttattaagatatgtctctgcattgaacattttaggtccgttttcctaggtacatagaatgtcttttgaatatgtagactcaaatcagacttcttgattctcttgatttatagttttaaatatttgtttgggggcgggtgcggtggctcatgcctgtaatcccagcactttgggaggccgaggcgggtagatcataaggttagcagattgagaccatcctggataacatggtgaaaccccgtctctactaaaaatacaaaaaatatagccaggtgtggtggcaggcacctgtagtmccagctactcgggaggctgaggcaggagaatggcctgaatccgggaggcagagcttgcagtgagccaagatcacgccattgcactccagccttggcgacagagtgagactttgtctcaaaaaaaaataaatagggggcggttccaagatggcagaataggaacagctccagtctgcagctcccagcatgagtgatgcagaagacaaatgatttttgcatttccaaatgaggtaccaggttcatctcactggggactattggacagtgggtgcaggacagtgggtgcagcgcaccaagcat

SEQ ID NO: 51443 - DNA, 601 bp, Human
gcacctgtagtcccagctactcgggaggctgaggcaggagaatggcctgaatccgggaggcagagcttgcagtgagccaagatcacgccattgcactccagccttggcgacagagtgagactttgtctcaaaaaaaaataaatagggggcggttccaagatggcagaataggaacagctccagtctgcagctcccagcatgagtgatgcagaagacaaatgatttttgcatttccaaatgaggtaccaggttcatctcactggggactattggacagtgggtgcaggacagtgggtgcagygcaccaagcatgagccgaagcagagcgaggcatcgcctcacctgggaagtgcaaggggtcagggaattccctttcctagccaaggaaaggggtgacagacggcacctggaaaatcgggtcactcccaccctaatactgggcttttccgatggtcttagcaaacggcacaccaggagattatatcctgtgcctggctcagagggtcctacacccacagagcctcgctcattgctagcacagcagtctgagatcaaactgcaaggtgcaagcgaggctaggggacgggcgcctgccattgct

SEQ ID NO: 51444 - DNA, 601 bp, Human
ctattggacagtgggtgcaggacagtgggtgcagcgcaccaagcatgagccgaagcagagcgaggcatcgcctcacctgggaagtgcaaggggtcagggaattccctttcctagccaaggaaaggggtgacagacggcacctggaaaatcgggtcactcccaccctaatactgggcttttccgatggtcttagcaaacggcacaccaggagattatatcctgtgcctggctcagagggtcctacacccacagagcctcgctcattgctagcacagcagtctgagatcaaactgcaaggtgsaagcgaggctaggggacgggcgcctgccattgctgaggcttgagtaggtaaacaaagtggctgggaagctggaactgggtggagcccaccgcagctcaaggaggcctgcctgtctctgtagactccacctctgggggcagggcatagccaaacagaaggcagcagaaacctctgcagactgaaatgtccctgtctgacagctttgaagacagtagtggttctcccagcatgcagcttgagatctgagaacgggcagactgcctcctcaagtgggtccctgacccccgagtagcctaactg

SEQ ID NO: 51445 - DNA, 601 bp, Human
tggaattcagtgtggcgattcctcagggatctagaactagaaataccatttgacccagccatcccattactgggtatatacccaaaggattataaatcatgctgctataaagacacatgcacacgtatgtttattgcagcactattcacaatagcaaagacttggaaccaacccaaatgtccaacaatgatctggattaagaaaatgtggcacatatataccatggaatactatgcagccataaaaaaggatgagttcatgtcctttgtaaggacatggatgaaactggaaaccatcattstgagcgaactatcacaaggacaaaaaaccaaacaccacatgttctcactcataggtgggagttgaacaatgagaacacgtggacacaggaaggggaacatcacacaccggggccttttgtgtggttggggaggggggagggatgcattaggagatacacctaatgtaaatgacgagttaatgggtgcagcacaccaacatggcacatgtatgcatatgtaacaaacctgcccattgtgcacatgtaccctaaaacttaaagtacaataaaaataaataaataaataaataaatactagtt

SEQ ID NO: 51446 - DNA, 601 bp, Human
gcgattcctcagggatctagaactagaaataccatttgacccagccatcccattactgggtatatacccaaaggattataaatcatgctgctataaagacacatgcacacgtatgtttattgcagcactattcacaatagcaaagacttggaaccaacccaaatgtccaacaatgatctggattaagaaaatgtggcacatatataccatggaatactatgcagccataaaaaaggatgagttcatgtcctttgtaaggacatggatgaaactggaaaccatcattgtgagcgaactatcrcaaggacaaaaaaccaaacaccacatgttctcactcataggtgggagttgaacaatgagaacacgtggacacaggaaggggaacatcacacaccggggccttttgtgtggttggggaggggggagggatgcattaggagatacacctaatgtaaatgacgagttaatgggtgcagcacaccaacatggcacatgtatgcatatgtaacaaacctgcccattgtgcacatgtaccctaaaacttaaagtacaataaaaataaataaataaataaataaatactagtttggctgcattgctt

SEQ ID NO: 51447 - DNA, 601 bp, Human
taatatacaatcccaccaaatgtctacaagaagggctagttaatcaatataccaaagatcaaatctatttatatgaaccacaaatacaaaacataattatacatatataattttatataatttaatttataattatatacattttatagcagcaatcaaaactatcatgtattttgggatgaatttaataaagaaatagcaggagctctgtagaaacaagtatgaacttctattggaagacagtaatatcataaaacattaaaaagaaagctataccatgtttatggttaggaagattcaytattgaaaatacatcaattcttgacaaatcggtctataaattcagtgcgtgtccaatcaatatatttagctcatttaaaatgtatatggaaaaggctaagtaccaaagataatcaaatgctcttggaagatgaaaattaaagttgagagatggggtaaaaaactataattcagttctaaagtcataaagctataataattaatacagtatggcattggcatagaaataagcacattgactaaataaatagaaaatacagttcagaaaccaaactctacatttatgaaaaactgacctata

SEQ ID NO: 51448 - DNA, 601 bp, Human
aagggctagttaatcaatataccaaagatcaaatctatttatatgaaccacaaatacaaaacataattatacatatataattttatataatttaatttataattatatacattttatagcagcaatcaaaactatcatgtattttgggatgaatttaataaagaaatagcaggagctctgtagaaacaagtatgaacttctattggaagacagtaatatcataaaacattaaaaagaaagctataccatgtttatggttaggaagattcactattgaaaatacatcaattcttgacaaatyggtctataaattcagtgcgtgtccaatcaatatatttagctcatttaaaatgtatatggaaaaggctaagtaccaaagataatcaaatgctcttggaagatgaaaattaaagttgagagatggggtaaaaaactataattcagttctaaagtcataaagctataataattaatacagtatggcattggcatagaaataagcacattgactaaataaatagaaaatacagttcagaaaccaaactctacatttatgaaaaactgacctatatcagaacgagcattgagactacaggagaac

SEQ ID NO: 51449 - DNA, 601 bp, Human
taatatcataaaacattaaaaagaaagctataccatgtttatggttaggaagattcactattgaaaatacatcaattcttgacaaatcggtctataaattcagtgcgtgtccaatcaatatatttagctcatttaaaatgtatatggaaaaggctaagtaccaaagataatcaaatgctcttggaagatgaaaattaaagttgagagatggggtaaaaaactataattcagttctaaagtcataaagctataataattaatacagtatggcattggcatagaaataagcacattgactaartaaatagaaaatacagttcagaaaccaaactctacatttatgaaaaactgacctatatcagaacgagcattgagactacaggagaacagaggaactagtaagttaatggtcctgacacaattgatatctacatagaaaaaaaaacttaatccttctttactctatgtaaaaacaataattccagatgaatgtaggacttaatggagagccaaaactaaaacttttataggaaaacatagaaaaatacctatctcagggtcgggaattaggtcttcaacatggcaccaaaagtactaacca

SEQ ID NO: 51450 - DNA, 601 bp, Human
ataccatgtttatggttaggaagattcactattgaaaatacatcaattcttgacaaatcggtctataaattcagtgcgtgtccaatcaatatatttagctcatttaaaatgtatatggaaaaggctaagtaccaaagataatcaaatgctcttggaagatgaaaattaaagttgagagatggggtaaaaaactataattcagttctaaagtcataaagctataataattaatacagtatggcattggcatagaaataagcacattgactaaataaatagaaaatacagttcagaaaccaamctctacatttatgaaaaactgacctatatcagaacgagcattgagactacaggagaacagaggaactagtaagttaatggtcctgacacaattgatatctacatagaaaaaaaaacttaatccttctttactctatgtaaaaacaataattccagatgaatgtaggacttaatggagagccaaaactaaaacttttataggaaaacatagaaaaatacctatctcagggtcgggaattaggtcttcaacatggcaccaaaagtactaaccataaaagaaacattaataaagtcaaccttt

SEQ ID NO: 51451 - DNA, 601 bp, Human
agatgaaaattaaagttgagagatggggtaaaaaactataattcagttctaaagtcataaagctataataattaatacagtatggcattggcatagaaataagcacattgactaaataaatagaaaatacagttcagaaaccaaactctacatttatgaaaaactgacctatatcagaacgagcattgagactacaggagaacagaggaactagtaagttaatggtcctgacacaattgatatctacatagaaaaaaaaacttaatccttctttactctatgtaaaaacaataattccagrtgaatgtaggacttaatggagagccaaaactaaaacttttataggaaaacatagaaaaatacctatctcagggtcgggaattaggtcttcaacatggcaccaaaagtactaaccataaaagaaacattaataaagtcaacctttttaaaatcaacaactttaattaaaaaaccagggccaggcacggtggctcacgcctgtaatcccaggaggccaaggcaggcagatcacgaggtcaggagatcgagaccagcctggccaacatggcaaaacctcgtctctactaaaaatataaaaatt

SEQ ID NO: 51452 - DNA, 601 bp, Human
attgagactacaggagaacagaggaactagtaagttaatggtcctgacacaattgatatctacatagaaaaaaaaacttaatccttctttactctatgtaaaaacaataattccagatgaatgtaggacttaatggagagccaaaactaaaacttttataggaaaacatagaaaaatacctatctcagggtcgggaattaggtcttcaacatggcaccaaaagtactaaccataaaagaaacattaataaagtcaacctttttaaaatcaacaactttaattaaaaaaccagggccaggcrcggtggctcacgcctgtaatcccaggaggccaaggcaggcagatcacgaggtcaggagatcgagaccagcctggccaacatggcaaaacctcgtctctactaaaaatataaaaattagctgggcgtggtggcgggtgcctgtagtcccagctacttgggaggctgaggcaggagaatggtgtgaacctgggaggcggagcttgcagtgagctgaaatcgtgccactgcactccagcctgggcaacagtgcgagactccatctcaaaaaacaaaaacaaaaacaaaatcaaaacaaaaaac

SEQ ID NO: 51453 - DNA, 601 bp, Human
tcctgacacaattgatatctacatagaaaaaaaaacttaatccttctttactctatgtaaaaacaataattccagatgaatgtaggacttaatggagagccaaaactaaaacttttataggaaaacatagaaaaatacctatctcagggtcgggaattaggtcttcaacatggcaccaaaagtactaaccataaaagaaacattaataaagtcaacctttttaaaatcaacaactttaattaaaaaaccagggccaggcacggtggctcacgcctgtaatcccaggaggccaaggcaggcagatcacgaggtcaggagatcgagaccagcctggccaacatggcaaaacctcgtctctactaaaaatataaaaattagctgggcgtggtggcgggtgcctgtagtcccagctacttgggaggctgaggcaggagaatggtgtgaacctgggaggcggagcttgcagtgagctgaaatcgtgccactgcactccagcctgggcaacagtgcgagactccatctcaaaaaacaaaaacaaaaacaaaatcaaaacaaaaaacaaaacacaggttgctggaaaaatggttacttatttttatta

SEQ ID NO: 51454 - DNA, 601 bp, Human
ctctatgtaaaaacaataattccagatgaatgtaggacttaatggagagccaaaactaaaacttttataggaaaacatagaaaaatacctatctcagggtcgggaattaggtcttcaacatggcaccaaaagtactaaccataaaagaaacattaataaagtcaacctttttaaaatcaacaactttaattaaaaaaccagggccaggcacggtggctcacgcctgtaatcccaggaggccaaggcaggcagatcacgaggtcaggagatcgagaccagcctggccaacatggcaaaaccycgtctctactaaaaatataaaaattagctgggcgtggtggcgggtgcctgtagtcccagctacttgggaggctgaggcaggagaatggtgtgaacctgggaggcggagcttgcagtgagctgaaatcgtgccactgcactccagcctgggcaacagtgcgagactccatctcaaaaaacaaaaacaaaaacaaaatcaaaacaaaaaacaaaacacaggttgctggaaaaatggttacttatttttattatgctttataaaatatacagttatattatcaaacttcttttgtaagaatca

SEQ ID NO: 51455 - DNA, 601 bp, Human
agtcaacctttttaaaatcaacaactttaattaaaaaaccagggccaggcacggtggctcacgcctgtaatcccaggaggccaaggcaggcagatcacgaggtcaggagatcgagaccagcctggccaacatggcaaaacctcgtctctactaaaaatataaaaattagctgggcgtggtggcgggtgcctgtagtcccagctacttgggaggctgaggcaggagaatggtgtgaacctgggaggcggagcttgcagtgagctgaaatcgtgccactgcactccagcctgggcaacagtgygagactccatctcaaaaaacaaaaacaaaaacaaaatcaaaacaaaaaacaaaacacaggttgctggaaaaatggttacttatttttattatgctttataaaatatacagttatattatcaaacttcttttgtaagaatcaaatattatgctgagaatatggcaagaaaaaagaaaacaacctccaccactcataatggcattccctttacccaccatcaactaagtcaggaacctgcgtcactttcaagttttctgaaatgtggactgaaaatacttgtggagggccctcacagatgca

SEQ ID NO: 51456 - DNA, 601 bp, Human
ttatgctgagaatatggcaagaaaaaagaaaacaacctccaccactcataatggcattccctttacccaccatcaactaagtcaggaacctgcgtcactttcaagttttctgaaatgtggactgaaaatacttgtggagggccctcacagatgcatttagaaatggtatgttctggaaaatggaactgaaatgttttagcgagagtcatgggcccaaaccttgaaatagaggttggtggagttttctatagtatgtaattacaacacaataagactcaaaagcatttcaataaagtgtggrtggaagacaagatactgcttcaagggcttcattagctttctgcagactggagctctccaaggcatggggaggaaccctgtttacctttggttcagaatcagttttaaccatcattgagggctaggtcagagtgcagcattaagtccttgggaatacactgggtggggaaagaaaagagagcaatgtttttctaaaagcccagaaatgggcttactgtgtttaccagttgtttccaggataatgtattgcagtgccaattgctgatgagatggtaggattatacttcagtccctgctttac

SEQ ID NO: 51457 - DNA, 601 bp, Human
atgtaattacaacacaataagactcaaaagcatttcaataaagtgtggatggaagacaagatactgcttcaagggcttcattagctttctgcagactggagctctccaaggcatggggaggaaccctgtttacctttggttcagaatcagttttaaccatcattgagggctaggtcagagtgcagcattaagtccttgggaatacactgggtggggaaagaaaagagagcaatgtttttctaaaagcccagaaatgggcttactgtgtttaccagttgtttccaggataatgtattgcagygccaattgctgatgagatggtaggattatacttcagtccctgctttacatttatttcttaaagaagcttctggtaaattagagcaatagcatcggcttagtttagtgttgttctgttggactaaggatatcagttctatccgtatggtcgggcctaaagcctgggaaatatttaatgaagggagagagggggagagagtgagcatgcaaaagagagagagaaaaacaaataacaaaacaaaaaccaagacatttccctttatagtaagaatgatgaggaaaacatgtttagccatacaag

SEQ ID NO: 51458 - DNA, 601 bp, Human
agttttaaccatcattgagggctaggtcagagtgcagcattaagtccttgggaatacactgggtggggaaagaaaagagagcaatgtttttctaaaagcccagaaatgggcttactgtgtttaccagttgtttccaggataatgtattgcagtgccaattgctgatgagatggtaggattatacttcagtccctgctttacatttatttcttaaagaagcttctggtaaattagagcaatagcatcggcttagtttagtgttgttctgttggactaaggatatcagttctatccgtatggkcgggcctaaagcctgggaaatatttaatgaagggagagagggggagagagtgagcatgcaaaagagagagagaaaaacaaataacaaaacaaaaaccaagacatttccctttatagtaagaatgatgaggaaaacatgtttagccatacaagatatcaagataatctcttatttctttcttgaaaatgcaagtacaaatgcctgcaaagataaaatatcctctggatggagtggaaaggttcaccaggcctctgaaatcacgtgaatgatgttgcgctttgctgttaatgaagctcggtg

SEQ ID NO: 51459 - DNA, 601 bp, Human
tttccaccccttgattcctggacccatgaatcctggctatgggagaaacagtaccaaatactggacactgatccggagcatacacagccttctggaaaactttgccccagccctgcaaagtattgtcgcctagttggcattgtaattgtgacttcaaaaggccattccaccgttctatcaatccggctgcttcaggatgatggggaacagggtaagaccagtgaattccatgagcatgagcccactgctgcacttctttagccataaagtgagtgccttgttcagaggcaatgctgtgtgkaatgccatgacagtgggtaaagcattccataagtccatggatggtagtcttggcagaagcattgcctgcaggataggcaaacccatatctagagtaagtgcccattccagtgaagacaaaccactgttctttctgtgatggaagaggttcagtataatcaacctgccaccaagtagctggctgatcaccccgaggaatggtgccatatcgcggcctcagtgtttgtctctgctgctggcaaattgggcactcagttgtggctgtagccaggtcagccttggtacgtggaagtccatgttg

SEQ ID NO: 51460 - DNA, 601 bp, Human
aaatactggacactgatccggagcatacacagccttctggaaaactttgccccagccctgcaaagtattgtcgcctagttggcattgtaattgtgacttcaaaaggccattccaccgttctatcaatccggctgcttcaggatgatggggaacagggtaagaccagtgaattccatgagcatgagcccactgctgcacttctttagccataaagtgagtgccttgttcagaggcaatgctgtgtgtaatgccatgacagtgggtaaagcattccataagtccatggatggtagtcttggcrgaagcattgcctgcaggataggcaaacccatatctagagtaagtgcccattccagtgaagacaaaccactgttctttctgtgatggaagaggttcagtataatcaacctgccaccaagtagctggctgatcaccccgaggaatggtgccatatcgcggcctcagtgtttgtctctgctgctggcaaattgggcactcagttgtggctgtagccaggtcagccttggtacgtggaagtccatgttgctgagcccgtgcgtaacctccatccctgccaccacagccactttgttcatgggcc

SEQ ID NO: 51461 - DNA, 601 bp, Human
accgttctatcaatccggctgcttcaggatgatggggaacagggtaagaccagtgaattccatgagcatgagcccactgctgcacttctttagccataaagtgagtgccttgttcagaggcaatgctgtgtgtaatgccatgacagtgggtaaagcattccataagtccatggatggtagtcttggcagaagcattgcctgcaggataggcaaacccatatctagagtaagtgcccattccagtgaagacaaaccactgttctttctgtgatggaagaggttcagtataatcaacctgccrccaagtagctggctgatcaccccgaggaatggtgccatatcgcggcctcagtgtttgtctctgctgctggcaaattgggcactcagttgtggctgtagccaggtcagccttggtacgtggaagtccatgttgctgagcccgtgcgtaacctccatccctgccaccacagccactttgttcatgggcctattgggcgatgacaatggtggctggggaaagaggctgagtggtatccacagaacgagtcatccaatccacttgattattaaaatcctcctctgctgaggtcatcttttggtg

SEQ ID NO: 51462 - DNA, 601 bp, Human
gggtaagaccagtgaattccatgagcatgagcccactgctgcacttctttagccataaagtgagtgccttgttcagaggcaatgctgtgtgtaatgccatgacagtgggtaaagcattccataagtccatggatggtagtcttggcagaagcattgcctgcaggataggcaaacccatatctagagtaagtgcccattccagtgaagacaaaccactgttctttctgtgatggaagaggttcagtataatcaacctgccaccaagtagctggctgatcaccccgaggaatggtgccatatygcggcctcagtgtttgtctctgctgctggcaaattgggcactcagttgtggctgtagccaggtcagccttggtacgtggaagtccatgttgctgagcccgtgcgtaacctccatccctgccaccacagccactttgttcatgggcctattgggcgatgacaatggtggctggggaaagaggctgagtggtatccacagaacgagtcatccaatccacttgattattaaaatcctcctctgctgaggtcatcttttggtgagcactcacatgagatacaaatatcttcacagtttttgacc

SEQ ID NO: 51463 - DNA, 601 bp, Human
agtgggtaaagcattccataagtccatggatggtagtcttggcagaagcattgcctgcaggataggcaaacccatatctagagtaagtgcccattccagtgaagacaaaccactgttctttctgtgatggaagaggttcagtataatcaacctgccaccaagtagctggctgatcaccccgaggaatggtgccatatcgcggcctcagtgtttgtctctgctgctggcaaattgggcactcagttgtggctgtagccaggtcagccttggtacgtggaagtccatgttgctgagcccgtgygtaacctccatccctgccaccacagccactttgttcatgggcctattgggcgatgacaatggtggctggggaaagaggctgagtggtatccacagaacgagtcatccaatccacttgattattaaaatcctcctctgctgaggtcatcttttggtgagcactcacatgagatacaaatatcttcacagtttttgaccactcagagaggtccatccatccacatacctcttccccaaatttcattgtcatcagttttccaatcatgcttctttcaagtccctgaccatccagccaaaccat

SEQ ID NO: 51464 - DNA, 601 bp, Human
ttgcctccgctgacctttacggtaattgcacccaccttgccttgatgcttgagtgccaccacttggcccatgccacctcaggatccaattattaccattgtatttaaattttgtagttgaatgactgtggttcccactataatatctagcatgcagagaagagcaatcacagagctcttcaaggatgcagctgctgccctcacaaatctatttcacaatgtgctggtcaaaggtatatcttctgtactctcccagctgggatgagtaggactaaagtgacgaattcactccaccatcccartctccataagcctttggatcccttcctctacattaaaccaagggagatcaggcatttccagctcactcacagtgggccaccttttgatctatatttcagctaaccaagcaaataaactattagaaccttttttaactctccaagctgcaacattaaatgcagaattcctgcttagtgggcccaaatcaatcaattcagcctgatccaactttatgttccttctaccattagcccacacccttaatatccattcccatgcctgttctccagatttctgcttatataaattagaaaactcaa

SEQ ID NO: 51465 - DNA, 601 bp, Human
tttggcgtctaatcatatttagcagccaactccagaaaccccaaaaccatctaaagaaatccatccgtaaaattctgttcctctagaaccactcctggtaccaaaatctgtattagtcaggattcgctagagggacaggactcacaggtgagatgtatatataaaaggcagtttattaaggagaattgactcacacaatcacaaggtgaagtcccacaatagtctgcaagctgaggagcaaggaagccagtccaagtcccaaaacctcaaaactagggaagccgacagtgcggccttcagcctggctgacagcctgagggcccctggcaaaccactggtgtaggtctaagagttcaaaagctgaagaacttgtagtccaatgttcgaggccaggaagcatccagcacaggagaaagatggaagccggaagacttagccagtctagtccttccgtgttcctctgcctgtttttgtcctagccatgctggcagctgattagatggtgcccacccagattgaggatgggtctccatcttccagtccactgactcaaatgttaatctcctttgacaacaccctcacagactcactcaggaacaat

SEQ ID NO: 51466 - DNA, 601 bp, Human
atgtatatataaaaggcagtttattaaggagaattgactcacacaatcacaaggtgaagtcccacaatagtctgcaagctgaggagcaaggaagccagtccaagtcccaaaacctcaaaactagggaagccgacagtgcggccttcagtctggctgacagcctgagggcccctggcaaaccactggtgtaggtctaagagttcaaaagctgaagaacttgtagtccaatgttcgaggccaggaagcatccagcacaggagaaagatggaagccggaagacttagccagtctagtccttccrtgttcctctgcctgtttttgtcctagccatgctggcagctgattagatggtgcccacccagattgaggatgggtctccatcttccagtccactgactcaaatgttaatctcctttgacaacaccctcacagactcactcaggaacaatactttgcatccttcaattcaatcacattgacactcagtattaaccatcaccctaggctttagggatatagggaaaaacatgactcattgctgttatctgagagtacataatctattggaagaaaggaaaacagttacatgtaaggcttatat

SEQ ID NO: 51467 - DNA, 601 bp, Human
ctgaggagcaaggaagccagtccaagtcccaaaacctcaaaactagggaagccgacagtgcggccttcagtctggctgacagcctgagggcccctggcaaaccactggtgtaggtctaagagttcaaaagctgaagaacttgtagtccaatgttcgaggccaggaagcatccagcacaggagaaagatggaagccggaagacttagccagtctagtccttccgtgttcctctgcctgtttttgtcctagccatgctggcagctgattagatggtgcccacccagattgaggatgggtctcyatcttccagtccactgactcaaatgttaatctcctttgacaacaccctcacagactcactcaggaacaatactttgcatccttcaattcaatcacattgacactcagtattaaccatcaccctaggctttagggatatagggaaaaacatgactcattgctgttatctgagagtacataatctattggaagaaaggaaaacagttacatgtaaggcttatatcagtataaattagataactgccaagtgagagaggtagaggtagcaagtgctgtctgtgggtgcatgttaactcagtct

SEQ ID NO: 51468 - DNA, 601 bp, Human
actccacactgtgttcagatccactggtgttaggggagtcccagagaggcctcttagagggttgaggaggatgggatcaggcatagcagagactagggacacgaggctctgcggccagactgcaggtctgctaccaactacagtgtgattttgcctagtcacataatctctgtgggcctcagttttttgttttttgtttttttctattacaacagtacctttctcgtggagttgtagtgattagatatctagtaccaagactatgcttgttagcactgagtaagaactcaatgaaggttasctttcattggtactatattactattgttagtgttggtggtggagctgaatcgcctaacctatgaggttggtgctgaaatgaagaaaagaataacagtgttttaagaagtttggtcactagaagtggagcttagtaattaaagaaaaagagtgaacacttttaccttcttgtggaagttagtaagtctacaaaatgttaattctgcatttgaatgatcatttgggagactcttattgtcctatttgcactgaaaaagtcactgaatcattattttagaactggaataacgcctgagatcta

SEQ ID NO: 51469 - DNA, 601 bp, Human
aatgaaggttagctttcattggtactatattactattgttagtgttggtggtggagctgaatcgcctaacctatgaggttggtgctgaaatgaagaaaagaataacagtgttttaagaagtttggtcactagaagtggagcttagtaattaaagaaaaagagtgaacacttttaccttcttgtggaagttagtaagtctacaaaatgttaattctgcatttgaatgatcatttgggagactcttattgtcctatttgcactgaaaaagtcactgaatcattattttagaactggaataacrcctgagatctaggccagcactttgcaagttgtgctctatgggacttttcatggaagtggctgaggagttgccttgaaggaaggcagagggagtgggtcttgggacacccttccagttataaaacaggacgttgattctgttttgtagttgcagcatcacatataatttcatttattaagaggatcccacttctaaaaataagttgaaaaccagtgatttaatccagcctctctgtttgcatatgaggaaatggaattccggaaaggttaggtgatttgtccaaggttgcagactagacta

SEQ ID NO: 51470 - DNA, 601 bp, Human
gaagttacaaagtagaaactatatggtgaactcaaggcaaagattgtccatagtaaaagaagacaaaataagaatgaaagagacaaaagaattgccaatgagttgtaatcttaaaagaaagatatatttaataaaataggattgattgttttgaatgtgggctgagaagtcctgccatcttccattgactctgctcacaggccttgtttgtgaactggcttccatggatagcattactctcctgacagctgcagctccaaattcagcatgaaaaggctggcaattctaagaggaagggagkgtttaggccacttttaattctactttgtcattgcaagtttcttgcattgtttggcatttgttggtcttccttactggatttcaaaactagaacactttttcctagccttggaaccaaccacgaaaataaccacctcttaccctcatgaagaacactttaagtttttctcttttaaaaatgaagtctggaatatctccaaacatcttgtcactcacgccttcatttaaatgtcaccctctcaaccacaaggaaactaaaattgccccctacttgctactccctgttttattttctagtaga

SEQ ID NO: 51471 - DNA, 601 bp, Human
ctgagaagtcctgccatcttccattgactctgctcacaggccttgtttgtgaactggcttccatggatagcattactctcctgacagctgcagctccaaattcagcatgaaaaggctggcaattctaagaggaagggagggtttaggccacttttaattctactttgtcattgcaagtttcttgcattgtttggcatttgttggtcttccttactggatttcaaaactagaacactttttcctagccttggaaccaaccacgaaaataaccacctcttaccctcatgaagaacactttaartttttctcttttaaaaatgaagtctggaatatctccaaacatcttgtcactcacgccttcatttaaatgtcaccctctcaaccacaaggaaactaaaattgccccctacttgctactccctgttttattttctagtagaacatactacagttggagatcatctcatccatgtcttttattcttgtctcttatttgcctctgcttgactgtaagctcatggaaagtaagggaccttcaccaactagcaaagtgcttaggacctagtaagaacctggtcaattctaactgagtgaatgactg

SEQ ID NO: 51472 - DNA, 601 bp, Human
cttcaccaactagcaaagtgcttaggacctagtaagaacctggtcaattctaactgagtgaatgactgaattcctgtgagaagtcaacatgaaaattcctaggtcattagtttagttattggaactccaacactgtattggaaaagtgtcatggaaaggatagttagtggattaaggttttttataagaggaagagggaaagaaaggcattgtctttacttcaggcatttcaatggccatgatggagcctaaatattgtatgttgcattttgttttggttttgtgtgcacaagagctttgmcagtggaatgaacgggttaagaaatgtgagttttcttttcgtcctgctatagagacttaaggaattgccccgtgtgagttccttgagggcagagaaaaatacaaatccatgaatacctgaaagccctgatttggcccctaagcaatctatgcatgtaacaacattgcatttgtaccctgtacatttataaacattttaagaaaagtataagagaaacacaaattttggttactcctctctgaaaactgctctgatgtcgcttggccgggggaattaagacctcttcctgtggcctgtggc

SEQ ID NO: 51473 - DNA, 601 bp, Human
tcctgtgagaagtcaacatgaaaattcctaggtcattagtttagttattggaactccaacactgtattggaaaagtgtcatggaaaggatagttagtggattaaggttttttataagaggaagagggaaagaaaggcattgtctttacttcaggcatttcaatggccatgatggagcctaaatattgtatgttgcattttgttttggttttgtgtgcacaagagctttgccagtggaatgaacgggttaagaaatgtgagttttcttttcgtcctgctatagagacttaaggaattgcccygtgtgagttccttgagggcagagaaaaatacaaatccatgaatacctgaaagccctgatttggcccctaagcaatctatgcatgtaacaacattgcatttgtaccctgtacatttataaacattttaagaaaagtataagagaaacacaaattttggttactcctctctgaaaactgctctgatgtcgcttggccgggggaattaagacctcttcctgtggcctgtggccactatgtgctcccggctctccaggctcatccagggccactgtgcctggggtcacagggttccaggatgtc

SEQ ID NO: 51474 - DNA, 601 bp, Human
gtcagtgtatcaaaaatagagaccctgctctcagatatataacatagaactctcttcattcatttgccttcattttagttaacagaatctgttcatctaagtagagcagagaaaaacttcataattgctgtgtctgtgttattccaaaacatttaaacaaaaggtgaataactgaggtattcttccctgtggtacatacttgatgtgggcattttaaaagattgatcaaatctcctttcagctggatatttgagtaggcacaaccattacagaattttcctctagggacttactttagctsttaaactatgtaaactgaacaagcaaactcaagtggatcattatctatagaagtatagaattccatctccctttggcaaaccattcaaacccagaagtgtgttttacacattctgacagaagcatctgtaataaccaactctaacctcctttcttaccactttagcacccaaaagtataagaaaagaggacatgttaaggcttgttctatttattagaaaatatataaagagttcttggcttaagaactcttctggctatcagctccctgatgtgaaaaaagtaaatagcaaggggtagc

SEQ ID NO: 51475 - DNA, 601 bp, Human
tgacagacagcttaagaaagacaattggacatcatgtgactacatgattcaagctaaagtccagacacatcttttccataggccaattgaacattttctctgtaatttccacaataaccatttgcaccagcatgaatggagagggtctgagttcttctgggtgagtaaagggtgtgtcagttatctgtcctctgtcaccaggatttagaggcaggctcatagtgactcttgtaaagttgaggttcgcctgtggaggctgcaaaaaagagggaggaagagagagtgaggttcctcttggctytgtgccagggatgtgattagaggaccctgggagggccttcatcctacgaggggttggaagtggaaatggatgtgtgtggatgacctggtaacgtgtcacagccccttccaccccatagtagtcagggatttaatgcctcaacaaggcaggtctctgaaggagactgacttttctctctctctctgaatgatactgcctgagagaaatactcacttcctgctttgttttcaacaagtatggacttccttacacaaaaagaatcttttttgcttttgtccccccatttcactggaaatctat

SEQ ID NO: 51476 - DNA, 601 bp, Human
atcttttccataggccaattgaacattttctctgtaatttccacaataaccatttgcaccagcatgaatggagagggtctgagttcttctgggtgagtaaagggtgtgtcagttatctgtcctctgtcaccaggatttagaggcaggctcatagtgactcttgtaaagttgaggttcgcctgtggaggctgcaaaaaagagggaggaagagagagtgaggttcctcttggctctgtgccagggatgtgattagaggaccctgggagggccttcatcctacgaggggttggaagtggaaatrgatgtgtgtggatgacctggtaacgtgtcacagccccttccaccccatagtagtcagggatttaatgcctcaacaaggcaggtctctgaaggagactgacttttctctctctctctgaatgatactgcctgagagaaatactcacttcctgctttgttttcaacaagtatggacttccttacacaaaaagaatcttttttgcttttgtccccccatttcactggaaatctatccactgggcaccactgttggtcggcttcctttcatagattcctttatgtttcaaattttaaaaagaca

SEQ ID NO: 51477 - DNA, 601 bp, Human
tgttttcaacaagtatggacttccttacacaaaaagaatcttttttgcttttgtccccccatttcactggaaatctatccactgggcaccactgttggtcggcttcctttcatagattcctttatgtttcaaattttaaaaagacaataatagcaacaaagtgaaatatggatttaagctaggaaaagcagagaactgaaacttttttcctgcaatcatacttcccagcttcttcagcaagatctgcttggctgggaacatgccttctgagaactttacatttctaaactgctgctaaatygctccatgcatttattcctcaaactctcagggaagatagcactggctttcagtctcataccaaccattcttaaggtaatggaccaaaagtcatttccacttgaaatataatccttctaaatgaatcatgcaacatggtttttacctccattttttcagaataactctaagatgatgatcctctggccatattttaaaaatttctcttatttgttttaattttcttccattttttctttaattttgtatccagacactgccttctctaagaggaatgacatttttgcgggttatcatgata

SEQ ID NO: 51478 - DNA, 601 bp, Human
aatctatccactgggcaccactgttggtcggcttcctttcatagattcctttatgtttcaaattttaaaaagacaataatagcaacaaagtgaaatatggatttaagctaggaaaagcagagaactgaaacttttttcctgcaatcatacttcccagcttcttcagcaagatctgcttggctgggaacatgccttctgagaactttacatttctaaactgctgctaaattgctccatgcatttattcctcaaactctcagggaagatagcactggctttcagtctcataccaaccattctyaaggtaatggaccaaaagtcatttccacttgaaatataatccttctaaatgaatcatgcaacatggtttttacctccattttttcagaataactctaagatgatgatcctctggccatattttaaaaatttctcttatttgttttaattttcttccattttttctttaattttgtatccagacactgccttctctaagaggaatgacatttttgcgggttatcatgatatatttttagcccatttgccttgacccatagcttacaacagttaaagaacactaacatataaacatagagtt

SEQ ID NO: 51479 - DNA, 601 bp, Human
tgggaacatgccttctgagaactttacatttctaaactgctgctaaattgctccatgcatttattcctcaaactctcagggaagatagcactggctttcagtctcataccaaccattcttaaggtaatggaccaaaagtcatttccacttgaaatataatccttctaaatgaatcatgcaacatggtttttacctccattttttcagaataactctaagatgatgatcctctggccatattttaaaaatttctcttatttgttttaattttcttccattttttctttaattttgtatccaracactgccttctctaagaggaatgacatttttgcgggttatcatgatatatttttagcccatttgccttgacccatagcttacaacagttaaagaacactaacatataaacatagagttttgcccaaggccattagctttgcatgttaacaagtgggcagaaggaaggctgggcatgagagagacatgctgtccttctggtgagatcatcaatcccattcttgtaaccttcagatcattgcatttgttcagaatcgtctgcagaggaaaacatctcaaagttgggaggttgttgaagagt

SEQ ID NO: 51480 - DNA, 601 bp, Human
ttatttcttctgagcctacttggtctttgatacttactataatactttctattctcttatcataaacagttttctgatttcattttcctctggtttcatactaagccccataatcagtcactgcaagattaccttctagaatttctgtgccctcaagttttctccatatctagagagtcagtcatctgccttgagccacatccactgtctactttcttcacttccatccccaggctgcccagcactgatgaaaacaaaacaaaaacaaacaagcaaacaaaaacaaaaacaaaaaactgamtaggatctcaatctggtttgcaaatccatgcttctctttcttgacttctttagacatcaacagaattgacgcctcctcttgacctgggacacccctcctccttggtgctttcttctacctccccctgcttctctgtatgtcttttgcaggctcatctttctcttaggctgtcttcccccatctctcctctccctctgtgcactcaggcagtctcccttgtcaacccccaaaactgcttctccagaccccagtgtttctctgagctccaggtccacaattctctaaggtccatgtggatgt

SEQ ID NO: 51481 - DNA, 601 bp, Human
accttctagaatttctgtgccctcaagttttctccatatctagagagtcagtcatctgccttgagccacatccactgtctactttcttcacttccatccccaggctgcccagcactgatgaaaacaaaacaaaaacaaacaagcaaacaaaaacaaaaacaaaaaactgactaggatctcaatctggtttgcaaatccatgcttctctttcttgacttctttagacatcaacagaattgacgcctcctcttgacctgggacacccctcctccttggtgctttcttctacctccccctgctyctctgtatgtcttttgcaggctcatctttctcttaggctgtcttcccccatctctcctctccctctgtgcactcaggcagtctcccttgtcaacccccaaaactgcttctccagaccccagtgtttctctgagctccaggtccacaattctctaaggtccatgtggatgtccctcaccatttcaaacttctcttccacagggagtccctggttttcactaccatagcatattaaaataccatgcatttcccttcataccactaattacaactttgtttcttttttttaaattttatgttt

SEQ ID NO: 51482 - DNA, 601 bp, Human
aggcctgaagcagcttttactcatggtggaaggcaaagagagagcaggcgtttcacacagcaaaggagagagcaagagagatgccaggctccttaaacgacctgctctcccataaactgaaagagcaagaactcactcattacggtaggatggcaccaaaacagttgtgagggatccaccccgaacacctcccaccatgccccacctccaacactgggatcaaatttcaatgtgagatttggagggaacacacatctaccctttatcagtgctcaataagctcgctgaatgtagaacagtratataaggcaggggtgggccaagtataggcgacaggacaaatttggcctgctactgcttttgtaaataaagttttatttatttacaaaataaataaataaatacagtcataatcattggttacattttgttcaaagctgcttttgcattaaaacatcagagttgagtagctgccacagagactgtaatggccccacaaagcctaaaatagttaccccgtggtcttttacagaaaaagtctgatataaaggacagtctcacagcacagaggaaaagcatataacccaaaggaggaaagagt

SEQ ID NO: 51483 - DNA, 601 bp, Human
aaagttttatttatttacaaaataaataaataaatacagtcataatcattggttacattttgttcaaagctgcttttgcattaaaacatcagagttgagtagctgccacagagactgtaatggccccacaaagcctaaaatagttaccccgtggtcttttacagaaaaagtctgatataaaggacagtctcacagcacagaggaaaagcatataacccaaaggaggaaagagtagagcatagtggactgcagagaagtttccctggacccaatctgtgccttgaaagatgagaaggacacmtccaaaggcaggatgggggtgaggtggggtgggcggtggtgatccaagcagacagcacgggcaagtgttctggaaaacttgcctttgttcacaagtatcctgcagtataaattgcaaggtgggcagtaagaaatggacttgaagagattgaacaagggccagaaacccaaggacattgctaaggagtttgtgccttagcccatccagggccctagcagccttgactgatgcttctgaggtcctggaggctccaggctcaggctaccttcccatattctctgaaaataatatcacatttgt

SEQ ID NO: 51484 - DNA, 601 bp, Human
ataaatacagtcataatcattggttacattttgttcaaagctgcttttgcattaaaacatcagagttgagtagctgccacagagactgtaatggccccacaaagcctaaaatagttaccccgtggtcttttacagaaaaagtctgatataaaggacagtctcacagcacagaggaaaagcatataacccaaaggaggaaagagtagagcatagtggactgcagagaagtttccctggacccaatctgtgccttgaaagatgagaaggacacctccaaaggcaggatgggggtgaggtgggrtgggcggtggtgatccaagcagacagcacgggcaagtgttctggaaaacttgcctttgttcacaagtatcctgcagtataaattgcaaggtgggcagtaagaaatggacttgaagagattgaacaagggccagaaacccaaggacattgctaaggagtttgtgccttagcccatccagggccctagcagccttgactgatgcttctgaggtcctggaggctccaggctcaggctaccttcccatattctctgaaaataatatcacatttgtttagtaaaaaaattgtttactaaaaaatt

SEQ ID NO: 51485 - DNA, 601 bp, Human
tattcagatatctccaaaatttgtatttccggatattttatgctttcatggaggccgtgtaaattggtataacctttttggaaggcgttttggcaatacttagtaaaaggttaaatgtttacaccccttgattctgctattgtatgtgtaaggattttttcctgcatacttttgtaagtgtagaaaatatatgtataggaataattgcacattgtttgttgtagctgaaaattacaaataatataaatgcctataatcagagcagttaaatacatatgaacacagtgaaataccaggcacycatttaaaagatgaggtatattttaacaagcctatttgaaaagatacccaatcttagcaagtgaaaaaaaaactcatcaaattgatatatttagcgctgtccctctctcaagtttcagacccacattttcaattttctgttgtcatcttgacttagtctcgtgaaattttaaactaatcatttttaagggaagatattttcttcccttaaaaatgaaattcagacaaacctctgaatttccctctttctgctaatttcttgctttcttttatcatctttccatccatcctaacatacagt

SEQ ID NO: 51486 - DNA, 601 bp, Human
tctcccacctcttggcctttccagtaccattcaatcttcctggaaattcctgaaatttctttcctcctcactcagtcaatgttttgagacccacatcaaatgctacatactatttgttcctttactgatcatgccagttggaaatgattcgaatctgtaaagcagggtgctatggaatgacatttcttatagccctttggtcatttgggagcaatgtctaacataatatcctccaggtccatccatgttgttgcaagcgacaggatttccttcttgttaaagggtgagtagcattccattstacatatattccatattttatttttttttgctcatctgttgatggtcacccaggttgattccatatcttggctattgtgaataatgctacagtgaacttgggagtgcagatatctcttcaacatattgatttcatctcctttggatatatacccagtagtgggattattggatcaaatggtaattatatttctaattttgggcagggtcctctgtagtagctccataatggttgtagtaatttacatatccaaccaagcacgccagggttcacttttcctcatgtcctcgccgacaagcc

SEQ ID NO: 51487 - DNA, 601 bp, Human
ttccattgtacatatattccatattttatttttttttgctcatctgttgatggtcacccaggttgattccatatcttggctattgtgaataatgctacagtgaacttgggagtgcagatatctcttcaacatattgatttcatctcctttggatatatacccagtagtgggattattggatcaaatggtaattatatttctaattttgggcagggtcctctgtagtagctccataatggttgtagtaatttacatatccaaccaagcacgccagggttcacttttcctcatgtcctcgccracaagcctgatattcttatttgcctcttagcgcttcagcctttccctcgtgacttaacggtgactcccttgagactacttgaaataataagtttggatggcaaggaaatacccttctgctgtcaccctttgccataagactgagttactttgtaaacaaagaagatttacttggtcttccatgcccaagacccttttacttttcatcgcttaatatttcatggccaaaaactgttggttcttccaatcttgtaaggccatttatctttgatcttgctccattcccttccatttttgcttg

SEQ ID NO: 51488 - DNA, 601 bp, Human
atggtcacccaggttgattccatatcttggctattgtgaataatgctacagtgaacttgggagtgcagatatctcttcaacatattgatttcatctcctttggatatatacccagtagtgggattattggatcaaatggtaattatatttctaattttgggcagggtcctctgtagtagctccataatggttgtagtaatttacatatccaaccaagcacgccagggttcacttttcctcatgtcctcgccgacaagcctgatattcttatttgcctcttagcgcttcagcctttccctcrtgacttaacggtgactcccttgagactacttgaaataataagtttggatggcaaggaaatacccttctgctgtcaccctttgccataagactgagttactttgtaaacaaagaagatttacttggtcttccatgcccaagacccttttacttttcatcgcttaatatttcatggccaaaaactgttggttcttccaatcttgtaaggccatttatctttgatcttgctccattcccttccatttttgcttgagaatcattcagttcttgcctgatctcacgtctttctcgcaacacctta

SEQ ID NO: 51489 - DNA, 601 bp, Human
ctaattttgggcagggtcctctgtagtagctccataatggttgtagtaatttacatatccaaccaagcacgccagggttcacttttcctcatgtcctcgccgacaagcctgatattcttatttgcctcttagcgcttcagcctttccctcgtgacttaacggtgactcccttgagactacttgaaataataagtttggatggcaaggaaatacccttctgctgtcaccctttgccataagactgagttactttgtaaacaaagaagatttacttggtcttccatgcccaagacccttttamttttcatcgcttaatatttcatggccaaaaactgttggttcttccaatcttgtaaggccatttatctttgatcttgctccattcccttccatttttgcttgagaatcattcagttcttgcctgatctcacgtctttctcgcaacaccttactaatgactgccagagtgtccactacacactatcggtctcatttgaccacttccccaggcatgtagcctacctgccaagttctttcacagcagatattttgcagtgttgtaagagggctccctagcttgctatgttttcttactacctgg

SEQ ID NO: 51490 - DNA, 601 bp, Human
tcacgtctttctcgcaacaccttactaatgactgccagagtgtccactacacactatcggtctcatttgaccacttccccaggcatgtagcctacctgccaagttctttcacagcagatattttgcagtgttgtaagagggctccctagcttgctatgttttcttactacctggcattaggaagtaaacatttttcatggcagtattcacttctagtaccaatttcttttttaatctacatgggctaactgctgtatcaaacagccatcaaatcccaatgttaattgcaacttacagtacrttgtgatgtttctgtctgtatactcattcagacacacagagtttaagtaatttgttcaagatcacaaagttagtaaatggtggcatcaagatttgaacccaggcagctggactcaagagtctaaacaactttcattttaaaattttcatctttcaagatatatcacttacaatttccatcttcatcactttcttccatacttcagagctgcatatgtaaacctcttgatcatataaatatttatggagtctcagcattttgagcacatgctgagagattttgtagcattgaagataaaga

SEQ ID NO: 51491 - DNA, 601 bp, Human
caggcatgtagcctacctgccaagttctttcacagcagatattttgcagtgttgtaagagggctccctagcttgctatgttttcttactacctggcattaggaagtaaacatttttcatggcagtattcacttctagtaccaatttcttttttaatctacatgggctaactgctgtatcaaacagccatcaaatcccaatgttaattgcaacttacagtacgttgtgatgtttctgtctgtatactcattcagacacacagagtttaagtaatttgttcaagatcacaaagttagtaaatrgtggcatcaagatttgaacccaggcagctggactcaagagtctaaacaactttcattttaaaattttcatctttcaagatatatcacttacaatttccatcttcatcactttcttccatacttcagagctgcatatgtaaacctcttgatcatataaatatttatggagtctcagcattttgagcacatgctgagagattttgtagcattgaagataaagaagctctttcaatacatctaatcttgccactattgattttgaacagcatcttaatttgttacctttttaaaaccatattg

SEQ ID NO: 51492 - DNA, 601 bp, Human
cagtagacactgaagagttcctttgcatcaggcaagtgacaagtatctatctcatcttcaaagtccacatagatatgtgccagattgtaggttgacaaatcactttttcactagctcacgtggcaagccttttcaccttgtaataatgctagtgagagacccataggtaccacataattggccagtcattgagattcaagcaacatttggataatttagcaaaactatcatcagaatcatcaaagtacataatttttatttattatgcaaatagtggattcactaaagtgcttagaccaaytaagttgctcccattgaaaaacagggtgattttattcttaagaatatatcaggataaacttcttgtagcctctaaacagtactgcttagaaaagtgcagcttcactgcattgcatatccccccagaagccctcaaagttcagatgtacaccacaaaaacatgaagcacatgtgtttgcatggaaggtaggctctggggtcttcctatcataatatgtctatgattaatagtcaacatatgccccctccacattccctaaaggaacatacacatgcatacacacacacacacacacacaca

SEQ ID NO: 51493 - DNA, 601 bp, Human
cagattgtaggttgacaaatcactttttcactagctcacgtggcaagccttttcaccttgtaataatgctagtgagagacccataggtaccacataattggccagtcattgagattcaagcaacatttggataatttagcaaaactatcatcagaatcatcaaagtacataatttttatttattatgcaaatagtggattcactaaagtgcttagaccaattaagttgctcccattgaaaaacagggtgattttattcttaagaatatatcaggataaacttcttgtagcctctaaacagyactgcttagaaaagtgcagcttcactgcattgcatatccccccagaagccctcaaagttcagatgtacaccacaaaaacatgaagcacatgtgtttgcatggaaggtaggctctggggtcttcctatcataatatgtctatgattaatagtcaacatatgccccctccacattccctaaaggaacatacacatgcatacacacacacacacacacacacacacacacacgtgagaactgaattgagagtttggggtatacaccatccctgagggcacagtctacagctcctaatgtgtgc

SEQ ID NO: 51494 - DNA, 601 bp, Human
ccacataattggccagtcattgagattcaagcaacatttggataatttagcaaaactatcatcagaatcatcaaagtacataatttttatttattatgcaaatagtggattcactaaagtgcttagaccaattaagttgctcccattgaaaaacagggtgattttattcttaagaatatatcaggataaacttcttgtagcctctaaacagtactgcttagaaaagtgcagcttcactgcattgcatatccccccagaagccctcaaagttcagatgtacaccacaaaaacatgaagcacmtgtgtttgcatggaaggtaggctctggggtcttcctatcataatatgtctatgattaatagtcaacatatgccccctccacattccctaaaggaacatacacatgcatacacacacacacacacacacacacacacacacgtgagaactgaattgagagtttggggtatacaccatccctgagggcacagtctacagctcctaatgtgtgctgtagagcaagcattatattgttgacaggtaataattcctggttaggaataacaggataccagtgagaagaggctgagaaaaatacact

SEQ ID NO: 51495 - DNA, 601 bp, Human
atgcaaatagtggattcactaaagtgcttagaccaattaagttgctcccattgaaaaacagggtgattttattcttaagaatatatcaggataaacttcttgtagcctctaaacagtactgcttagaaaagtgcagcttcactgcattgcatatccccccagaagccctcaaagttcagatgtacaccacaaaaacatgaagcacatgtgtttgcatggaaggtaggctctggggtcttcctatcataatatgtctatgattaatagtcaacatatgccccctccacattccctaaaggarcatacacatgcatacacacacacacacacacacacacacacacacgtgagaactgaattgagagtttggggtatacaccatccctgagggcacagtctacagctcctaatgtgtgctgtagagcaagcattatattgttgacaggtaataattcctggttaggaataacaggataccagtgagaagaggctgagaaaaatacactcttgctggaagagtcaagaacgagctcttcgtgggaaactatgggagacgattgaaaaaggacaagaagaaaggagaattgttaagtctccactt

SEQ ID NO: 51496 - DNA, 601 bp, Human
cacagcaggtgaacacaggctccctcccacactgagacttcctcccctgccggtgtgcagtctgttaagtaaacagagacgttatactgagaaaggaacatttctctattttggctatgagttgttatttttaaagattcatcctccaaacattttcccctatccttgtttattttttcactagaaagaagatgaactgcttaaaaaaaaaattcaactccatgacaagaaaaacccacttctagtatgttctccccactcaatgccaatggagcctttggtgtgagcactctgccagccrcacattgggcagcatacctcttgaaattcctgctgtgcttctatagagcttccatgcatccagattttcaaagtcaaagcaaaatgcgcatggcagtttttttctgactccttcaagttaaaaggccaacctctcccttgacatatccatgtatttatcagtatatctataggtaatacttaaaggtgatccttactgtgtgccacactccattctaagcactttacataaaaaacctcatttcactttatttgggaataggatgacaatttcttcaatattgagatgggttgaatctgg

SEQ ID NO: 51497 - DNA, 601 bp, Human
gcaggtgaacacaggctccctcccacactgagacttcctcccctgccggtgtgcagtctgttaagtaaacagagacgttatactgagaaaggaacatttctctattttggctatgagttgttatttttaaagattcatcctccaaacattttcccctatccttgtttattttttcactagaaagaagatgaactgcttaaaaaaaaaattcaactccatgacaagaaaaacccacttctagtatgttctccccactcaatgccaatggagcctttggtgtgagcactctgccagccacacrttgggcagcatacctcttgaaattcctgctgtgcttctatagagcttccatgcatccagattttcaaagtcaaagcaaaatgcgcatggcagtttttttctgactccttcaagttaaaaggccaacctctcccttgacatatccatgtatttatcagtatatctataggtaatacttaaaggtgatccttactgtgtgccacactccattctaagcactttacataaaaaacctcatttcactttatttgggaataggatgacaatttcttcaatattgagatgggttgaatctggggag

SEQ ID NO: 51498 - DNA, 601 bp, Human
aggaacatttctctattttggctatgagttgttatttttaaagattcatcctccaaacattttcccctatccttgtttattttttcactagaaagaagatgaactgcttaaaaaaaaaattcaactccatgacaagaaaaacccacttctagtatgttctccccactcaatgccaatggagcctttggtgtgagcactctgccagccacacattgggcagcatacctcttgaaattcctgctgtgcttctatagagcttccatgcatccagattttcaaagtcaaagcaaaatgcgcatgrcagtttttttctgactccttcaagttaaaaggccaacctctcccttgacatatccatgtatttatcagtatatctataggtaatacttaaaggtgatccttactgtgtgccacactccattctaagcactttacataaaaaacctcatttcactttatttgggaataggatgacaatttcttcaatattgagatgggttgaatctggggagactgatgttagatgcaaaaagctttctttctagaacttttcctgtgtcttgcacctggctttctccctgtcttgttcccattctagatc

SEQ ID NO: 51499 - DNA, 601 bp, Human
agtcaaagcaaaatgcgcatggcagtttttttctgactccttcaagttaaaaggccaacctctcccttgacatatccatgtatttatcagtatatctataggtaatacttaaaggtgatccttactgtgtgccacactccattctaagcactttacataaaaaacctcatttcactttatttgggaataggatgacaatttcttcaatattgagatgggttgaatctggggagactgatgttagatgcaaaaagctttctttctagaacttttcctgtgtcttgcacctggctttctccccgtcttgttcccattctagatctctttactgacagtgcccatggctttcttcttggtactctagtgttgagcataagaactagtatgtaataggctctcagtaaatcttgttgaatgaattaaagtagagcaagaattaaagacagagaagaagatcttcttgttggagttctttcttttggttgataagcaatgtgatttgacgtaacaatcttgagtcctaatcccctcatttggaaaatggaaataataatgctaatcttagaggtcacttctaagaagtatatgaatatatcagaag

SEQ ID NO: 51500 - DNA, 601 bp, Human
atgtatttatcagtatatctataggtaatacttaaaggtgatccttactgtgtgccacactccattctaagcactttacataaaaaacctcatttcactttatttgggaataggatgacaatttcttcaatattgagatgggttgaatctggggagactgatgttagatgcaaaaagctttctttctagaacttttcctgtgtcttgcacctggctttctccctgtcttgttcccattctagatctctttactgacagtgcccatggctttcttcttggtactctagtgttgagcataagractagtatgtaataggctctcagtaaatcttgttgaatgaattaaagtagagcaagaattaaagacagagaagaagatcttcttgttggagttctttcttttggttgataagcaatgtgatttgacgtaacaatcttgagtcctaatcccctcatttggaaaatggaaataataatgctaatcttagaggtcacttctaagaagtatatgaatatatcagaagtaatcaacatttttaagtcaaagaaaagaacgtctgtgaaaaagaaaactaatgagctagttgaaaaaatattaatt

SEQ ID NO: 51501 - DNA, 601 bp, Human
ttaaagatttagaaccagtggatttttatgaatgtgaaccctttcatgtcttgtggaagattttctgttttttaatctttttatttatttatttatttttgctatgttttcataggaaccagggaaaatgtgtagagggcatggtggagatcttcgacatgctgctggctacatcatctcggttccgcatgatgaatctgcagggagaggagtttgtgtgcctcaaatctattattttgcttaattctggtgagttgataacacaagataactcaatgctggatgaaatgtttatttgtakttttcaaccagatacgatctacccactccaaaggcataatgtcataaatagaaagaaactactgacacacgttttaaaataacctaccaacattgcagattccttataaaggtagaaccatgctagccaaatagacacatgaaaaattgtaatttggcattgaatcaaatggcctttgagctaaaatttttgtatgctttcacagataggatgtttttattcaaatggtacatgtatatagacatatgttagttgatagttatattatgtctgaaaataagtagaccaagtaattctgtt

SEQ ID NO: 51502 - DNA, 601 bp, Human
ttaatctttttatttatttatttatttttgctatgttttcataggaaccagggaaaatgtgtagagggcatggtggagatcttcgacatgctgctggctacatcatctcggttccgcatgatgaatctgcagggagaggagtttgtgtgcctcaaatctattattttgcttaattctggtgagttgataacacaagataactcaatgctggatgaaatgtttatttgtagttttcaaccagatacgatctacccactccaaaggcataatgtcataaatagaaagaaactactgacacacrttttaaaataacctaccaacattgcagattccttataaaggtagaaccatgctagccaaatagacacatgaaaaattgtaatttggcattgaatcaaatggcctttgagctaaaatttttgtatgctttcacagataggatgtttttattcaaatggtacatgtatatagacatatgttagttgatagttatattatgtctgaaaataagtagaccaagtaattctgttaagaaattgtgaccaattccaggctccagatagtaaagaaagagggttatttgagacagaccatgtttctg

SEQ ID NO: 51503 - DNA, 601 bp, Human
tcataggaaccagggaaaatgtgtagagggcatggtggagatcttcgacatgctgctggctacatcatctcggttccgcatgatgaatctgcagggagaggagtttgtgtgcctcaaatctattattttgcttaattctggtgagttgataacacaagataactcaatgctggatgaaatgtttatttgtagttttcaaccagatacgatctacccactccaaaggcataatgtcataaatagaaagaaactactgacacacgttttaaaataacctaccaacattgcagattccttataraggtagaaccatgctagccaaatagacacatgaaaaattgtaatttggcattgaatcaaatggcctttgagctaaaatttttgtatgctttcacagataggatgtttttattcaaatggtacatgtatatagacatatgttagttgatagttatattatgtctgaaaataagtagaccaagtaattctgttaagaaattgtgaccaattccaggctccagatagtaaagaaagagggttatttgagacagaccatgtttctggtcaaaactgactagctaaaaatatagttggcttagag

SEQ ID NO: 51504 - DNA, 601 bp, Human
gatgtttttattcaaatggtacatgtatatagacatatgttagttgatagttatattatgtctgaaaataagtagaccaagtaattctgttaagaaattgtgaccaattccaggctccagatagtaaagaaagagggttatttgagacagaccatgtttctggtcaaaactgactagctaaaaatatagttggcttagagatagaaaaacctgtttctaaaacagaagaatgtggaatgcaataaattgtccagctgaaagaacattttccatttgctctatgaagtctgattctactgcyccttcgtatttatttgtttgagaaagcttagctaagagcaacatctgttttttgtttttgtttttgtttttgttttgtttttgttttcaatgtagtgaggctggctgttgtataaagagttactctatgtcaccaagatggaaactatggttcagcctgaattagtgccctgactcctcctagcctcttggtatttggatctaagctctagctctacagcctctgggacctaaagctcacattgggtatcagcggtacagcagctccccttaagctccacctttccccctggctctaacc

SEQ ID NO: 51505 - DNA, 601 bp, Human
attgtgaccaattccaggctccagatagtaaagaaagagggttatttgagacagaccatgtttctggtcaaaactgactagctaaaaatatagttggcttagagatagaaaaacctgtttctaaaacagaagaatgtggaatgcaataaattgtccagctgaaagaacattttccatttgctctatgaagtctgattctactgccccttcgtatttatttgtttgagaaagcttagctaagagcaacatctgttttttgtttttgtttttgtttttgttttgtttttgttttcaatgtagygaggctggctgttgtataaagagttactctatgtcaccaagatggaaactatggttcagcctgaattagtgccctgactcctcctagcctcttggtatttggatctaagctctagctctacagcctctgggacctaaagctcacattgggtatcagcggtacagcagctccccttaagctccacctttccccctggctctaaccccactttgtgcctcatccctcattctcacatagaaatcatagctatttcgaatctctgggcctgacttagtttcttatgccattagacatagtctc

SEQ ID NO: 51506 - DNA, 601 bp, Human
tttttgtttttgtttttgtttttgttttgtttttgttttcaatgtagtgaggctggctgttgtataaagagttactctatgtcaccaagatggaaactatggttcagcctgaattagtgccctgactcctcctagcctcttggtatttggatctaagctctagctctacagcctctgggacctaaagctcacattgggtatcagcggtacagcagctccccttaagctccacctttccccctggctctaaccccactttgtgcctcatccctcattctcacatagaaatcatagctatttygaatctctgggcctgacttagtttcttatgccattagacatagtctcaaattcctcaatagctgaattgcagcttgtattgatcacatacatagagaatccgcacttccttctctttccacgtgtttttgtctctttctgatgagtgctgatcccttcccgcttcccctaacaattttttacttttcttccccaccactgctaggaacctgtgttgcttaatggaatcagcccttccttctcttttcttgtgtttttgtctctttctgatgaatgccaatcccttcccacctcccatgac

SEQ ID NO: 51507 - DNA, 601 bp, Human
gatctaagctctagctctacagcctctgggacctaaagctcacattgggtatcagcggtacagcagctccccttaagctccacctttccccctggctctaaccccactttgtgcctcatccctcattctcacatagaaatcatagctatttcgaatctctgggcctgacttagtttcttatgccattagacatagtctcaaattcctcaatagctgaattgcagcttgtattgatcacatacatagagaatccgcacttccttctctttccacgtgtttttgtctctttctgatgagtgcygatcccttcccgcttcccctaacaattttttacttttcttccccaccactgctaggaacctgtgttgcttaatggaatcagcccttccttctcttttcttgtgtttttgtctctttctgatgaatgccaatcccttcccacctcccatgacaattttccacttctcttccccaccaccactagtaacctgtgttgcctaatggttatcacagtaatcattctcacttatcaactaataaatggaaatctgtactattacactaggcaaggactgaattacagaatgaagtcccatgataa

SEQ ID NO: 51508 - DNA, 601 bp, Human
atctaagctctagctctacagcctctgggacctaaagctcacattgggtatcagcggtacagcagctccccttaagctccacctttccccctggctctaaccccactttgtgcctcatccctcattctcacatagaaatcatagctatttcgaatctctgggcctgacttagtttcttatgccattagacatagtctcaaattcctcaatagctgaattgcagcttgtattgatcacatacatagagaatccgcacttccttctctttccacgtgtttttgtctctttctgatgagtgctratcccttcccgcttcccctaacaattttttacttttcttccccaccactgctaggaacctgtgttgcttaatggaatcagcccttccttctcttttcttgtgtttttgtctctttctgatgaatgccaatcccttcccacctcccatgacaattttccacttctcttccccaccaccactagtaacctgtgttgcctaatggttatcacagtaatcattctcacttatcaactaataaatggaaatctgtactattacactaggcaaggactgaattacagaatgaagtcccatgataaa

SEQ ID NO: 51509 - DNA, 601 bp, Human
agctccccttaagctccacctttccccctggctctaaccccactttgtgcctcatccctcattctcacatagaaatcatagctatttcgaatctctgggcctgacttagtttcttatgccattagacatagtctcaaattcctcaatagctgaattgcagcttgtattgatcacatacatagagaatccgcacttccttctctttccacgtgtttttgtctctttctgatgagtgctgatcccttcccgcttcccctaacaattttttacttttcttccccaccactgctaggaacctgtrttgcttaatggaatcagcccttccttctcttttcttgtgtttttgtctctttctgatgaatgccaatcccttcccacctcccatgacaattttccacttctcttccccaccaccactagtaacctgtgttgcctaatggttatcacagtaatcattctcacttatcaactaataaatggaaatctgtactattacactaggcaaggactgaattacagaatgaagtcccatgataaatgatgtgatccacactaaggaagtgattaccactccattcaggtttctgtttccactcacgtg

SEQ ID NO: 51510 - DNA, 601 bp, Human
tggttatcacagtaatcattctcacttatcaactaataaatggaaatctgtactattacactaggcaaggactgaattacagaatgaagtcccatgataaatgatgtgatccacactaaggaagtgattaccactccattcaggtttctgtttccactcacgtgcattgtgcttttcatttcagtcgtttgtcctgtacattgtagggtccagatcccacaatggctctttattggatgagagttctgggagcagtgccactcagctacatggtgccaggtcctgaacctgtgccttcttyggtggagggctggcacgtgctgacagctttcatgtgggcaatctgggaacttcagagaaggcaggcctattaagtgttaagactccccaccccgaacttttactgagaaaaagtaccccagacaggaagtaaaattagccagagttgtatgatccacacagtggatgctctgatctcagtaataaaaaatatttcctccagatccatatagacttttcctgcattattgttttgtttctgttcctatggcagagtgagtttttaaaactattatgcaagaaatatcaggatttttgccac

SEQ ID NO: 51511 - DNA, 601 bp, Human
atgaagtcccatgataaatgatgtgatccacactaaggaagtgattaccactccattcaggtttctgtttccactcacgtgcattgtgcttttcatttcagtcgtttgtcctgtacattgtagggtccagatcccacaatggctctttattggatgagagttctgggagcagtgccactcagctacatggtgccaggtcctgaacctgtgccttctttggtggagggctggcacgtgctgacagctttcatgtgggcaatctgggaacttcagagaaggcaggcctattaagtgttaagaytccccaccccgaacttttactgagaaaaagtaccccagacaggaagtaaaattagccagagttgtatgatccacacagtggatgctctgatctcagtaataaaaaatatttcctccagatccatatagacttttcctgcattattgttttgtttctgttcctatggcagagtgagtttttaaaactattatgcaagaaatatcaggatttttgccaccaaaaagttggattcatagacccagggtttttacaacccagggggaaaaaactttcagccctcacaagaaagtattttattaa

SEQ ID NO: 51512 - DNA, 601 bp, Human
atgataaatgatgtgatccacactaaggaagtgattaccactccattcaggtttctgtttccactcacgtgcattgtgcttttcatttcagtcgtttgtcctgtacattgtagggtccagatcccacaatggctctttattggatgagagttctgggagcagtgccactcagctacatggtgccaggtcctgaacctgtgccttctttggtggagggctggcacgtgctgacagctttcatgtgggcaatctgggaacttcagagaaggcaggcctattaagtgttaagactccccacccygaacttttactgagaaaaagtaccccagacaggaagtaaaattagccagagttgtatgatccacacagtggatgctctgatctcagtaataaaaaatatttcctccagatccatatagacttttcctgcattattgttttgtttctgttcctatggcagagtgagtttttaaaactattatgcaagaaatatcaggatttttgccaccaaaaagttggattcatagacccagggtttttacaacccagggggaaaaaactttcagccctcacaagaaagtattttattaaagactggcac

SEQ ID NO: 51513 - DNA, 601 bp, Human
tcttttctatcaaggacagtactgctggctcaggagagcagtaagcaaacagaagctgtctctcaaccctgtacaaagcgaaaccactcttttccctacaaaagtgagctgtgccccagaaaagcggatctgctgctgagcagggctcctcatgtctcctattgttcctgaaaaacagcatcaaagagggcaagactgacacacaatgttgtagcattaggagcctttttcagaataaaaaagcaatcagtcatatgaagcatgtggtcataccacaatcaacaatttttctccacaactrgagatatgggtttttctaaaagtccaactgattcatggccctgatacggggcagctctacctctcatgagaccaatgaccaagtgactctgactccaggaatctctgacagaagccaagctggaaacggctcaggaaacctgagctagaagatgcctttctgacacctgggaaacaaaacctcagtgtatggaggaacccaaggttttgtgttgagccccagtcgccaaggtctgaggaggctgggtttatattggccccgattttgtggccgaggcacaaggggaattgaaaggttgtt

SEQ ID NO: 51514 - DNA, 601 bp, Human
caaggacagtactgctggctcaggagagcagtaagcaaacagaagctgtctctcaaccctgtacaaagcgaaaccactcttttccctacaaaagtgagctgtgccccagaaaagcggatctgctgctgagcagggctcctcatgtctcctattgttcctgaaaaacagcatcaaagagggcaagactgacacacaatgttgtagcattaggagcctttttcagaataaaaaagcaatcagtcatatgaagcatgtggtcataccacaatcaacaatttttctccacaactagagatatggrtttttctaaaagtccaactgattcatggccctgatacggggcagctctacctctcatgagaccaatgaccaagtgactctgactccaggaatctctgacagaagccaagctggaaacggctcaggaaacctgagctagaagatgcctttctgacacctgggaaacaaaacctcagtgtatggaggaacccaaggttttgtgttgagccccagtcgccaaggtctgaggaggctgggtttatattggccccgattttgtggccgaggcacaaggggaattgaaaggttgttgtgaggacct

SEQ ID NO: 51515 - DNA, 601 bp, Human
tcaggagagcagtaagcaaacagaagctgtctctcaaccctgtacaaagcgaaaccactcttttccctacaaaagtgagctgtgccccagaaaagcggatctgctgctgagcagggctcctcatgtctcctattgttcctgaaaaacagcatcaaagagggcaagactgacacacaatgttgtagcattaggagcctttttcagaataaaaaagcaatcagtcatatgaagcatgtggtcataccacaatcaacaatttttctccacaactagagatatgggtttttctaaaagtccaacygattcatggccctgatacggggcagctctacctctcatgagaccaatgaccaagtgactctgactccaggaatctctgacagaagccaagctggaaacggctcaggaaacctgagctagaagatgcctttctgacacctgggaaacaaaacctcagtgtatggaggaacccaaggttttgtgttgagccccagtcgccaaggtctgaggaggctgggtttatattggccccgattttgtggccgaggcacaaggggaattgaaaggttgttgtgaggacctgctcggaatgtctttctgg

SEQ ID NO: 51516 - DNA, 601 bp, Human
acctgggaaacaaaacctcagtgtatggaggaacccaaggttttgtgttgagccccagtcgccaaggtctgaggaggctgggtttatattggccccgattttgtggccgaggcacaaggggaattgaaaggttgttgtgaggacctgctcggaatgtctttctggaagtttggagagggtctctcaaatgccaaaatttccatgggaagccattttcacagctgcttgggagtgggagatattcgtcatcatttctgccccatttagaataatttattactttgcttgcaaaaacccggamtcatccataggacacacgttgtttgtttttccactccacaccaaaggacagaggcattcctggttaatccaagatgccaacttcaagacattctgagaactagctggacagagctgaagtgtagggcaaatcagaacagaagtgatgggcccagggcaaaagcccgtgaagcagcagctgcggaggaaggatgggagctggagctgcaaagggggccatggtggagactctgggcctgcccacagtatcccctctgcccaatgggaattcagttttcctgcatatcattcaattatttct

SEQ ID NO: 51517 - DNA, 601 bp, Human
tcaaagctttatatgtaaaaacctatactctctaataaatgtttggtttggccttcacattcaatttaataattatttctacctcttttctaaaccgctcttaaccacagttctatatatttaattctgaagagcctcatgcacctccctccctggtaactttatctacttctctccctggagaaccagccagaccatgattccagccctctgtcctctcttcaaccgtaggtcctctttttctctcctgactcctcaaaccttctccagttacccggatgccttctgtgtgctgctggcytctgcatcactgttcacagggccacttgttcccctggaaatgtcttatgctcttgaaatgctatagccttgttcacctgttcatccaaaactgatcctcagacaacatttctctttcaattggtggaataataaagaggaatatgggtcaaaattcatagacatttaaatacccaaggtgcaaagttaagagaaaacaagataggagaaagaattatggcaacatctctaaaatgtgtactttagtgtttagcaaaaaagggactatggaatgtcaaacaggaacatatatgttaaacat

SEQ ID NO: 51518 - DNA, 601 bp, Human
ataacaagttctcatcacaaagattattttctttctccagatctggattgtttgcactcactttatattattagacaattactcagattgtttatgtttttatgtttagaaataagacagtgattcagagagtccctgtatttagatgaaagaacattttttaaacatattgactgtaaacactgaaaatcattaattctcaacagttgaaggtttctgacaggaacggcccttggaaattgtaaatgggcacattgtcaggtatgcccattgttgtcacattggagaagattggattctrttctctctggagtcctttgtaatgccaagcttcctctccagggagctggcttattgtcattattttgagataaatggcacttcatagtattaagtggttcattgtctcttctctggctgactgtattctgtaggcagccactcaactttggagcctttctctgctaccaacttttggtgttgccttaagcaagcctcatggctcctgttagtttcctgacaacatggtatagcatggactttgtcatcagagaggactgaattcaggagaagcaactctgccacttccttggcggaaggg

SEQ ID NO: 51519 - DNA, 601 bp, Human
tggcacttcatagtattaagtggttcattgtctcttctctggctgactgtattctgtaggcagccactcaactttggagcctttctctgctaccaacttttggtgttgccttaagcaagcctcatggctcctgttagtttcctgacaacatggtatagcatggactttgtcatcagagaggactgaattcaggagaagcaactctgccacttccttggcggaagggggatgactgatgtcctttgataagctgcttccctgagcctaataaaaaaatagaaataatgatacttaaactcayggaattgttgtgacaattgaaagaatgaccagttagtaaagcatcttgcaccatgactagcacacagtagatgcacatgagtgttactaagctttagttatgccctccaaatacaaagccttagttttgtcactatgaaagaaattactctgttcttcttagcaggtaataaataaatccctgcctggaaattctgcaggagaatttcacccctgcgctttcaggttaaaagattgcattcccatgatgaagatgttctgtgaatagaatcatctcaagtcccaaatggtgtggatttgc

SEQ ID NO: 51520 - DNA, 601 bp, Human
gctaccaacttttggtgttgccttaagcaagcctcatggctcctgttagtttcctgacaacatggtatagcatggactttgtcatcagagaggactgaattcaggagaagcaactctgccacttccttggcggaagggggatgactgatgtcctttgataagctgcttccctgagcctaataaaaaaatagaaataatgatacttaaactcatggaattgttgtgacaattgaaagaatgaccagttagtaaagcatcttgcaccatgactagcacacagtagatgcacatgagtgttackaagctttagttatgccctccaaatacaaagccttagttttgtcactatgaaagaaattactctgttcttcttagcaggtaataaataaatccctgcctggaaattctgcaggagaatttcacccctgcgctttcaggttaaaagattgcattcccatgatgaagatgttctgtgaatagaatcatctcaagtcccaaatggtgtggatttgctcctgcatcttgttgcagagattctcttggagcttctgagaactggggaaaccaacaaaatgcctgtagcctggggaaaatgtaggga

SEQ ID NO: 51521 - DNA, 601 bp, Human
ctccaaatacaaagccttagttttgtcactatgaaagaaattactctgttcttcttagcaggtaataaataaatccctgcctggaaattctgcaggagaatttcacccctgcgctttcaggttaaaagattgcattcccatgatgaagatgttctgtgaatagaatcatctcaagtcccaaatggtgtggatttgctcctgcatcttgttgcagagattctcttggagcttctgagaactggggaaaccaacaaaatgcctgtagcctggggaaaatgtagggagttttagcatgaatttrtgggaggtgagaaaaggcagcaggtgtcgaaagacgggaaatccttgcactgttctagatgttaggagccattttccattcacattcagcacctcaggaggagaagctgcctatcactttgtgtcctcaagagaaccaacaaaggagaatgccatctcccagatactcaatttgattaccattttatcctaccttctctagggtccagacattatgtaaattggcattaagtttgaataatgtatggacccagtttaaaaggaaaaaatgctttgggaggctgaggcaggtgcattgcct

SEQ ID NO: 51522 - DNA, 601 bp, Human
agcaggtgtcgaaagacgggaaatccttgcactgttctagatgttaggagccattttccattcacattcagcacctcaggaggagaagctgcctatcactttgtgtcctcaagagaaccaacaaaggagaatgccatctcccagatactcaatttgattaccattttatcctaccttctctagggtccagacattatgtaaattggcattaagtttgaataatgtatggacccagtttaaaaggaaaaaatgctttgggaggctgaggcaggtgcattgcctgaggtcaggagttccagamcagcctggccaacacagtgaaaccccatctctactaaaaatacaaaaagttagctgggcacggtggcgggcacctgtaatcccagctactcaggaggctaatgcaggagaatcacttgaacctgggaggcagaggttgcagtgagccaagatcgtgccattgcactccagcctgggtgatgagagcaaaactccatctcaaaaaatttttaaaacaaaaggaaaaaatgctcccctgattcccgcagtgctgacttaaaatgttcttagtatgccaatgttgcttaaatatgaatgactg

SEQ ID NO: 51523 - DNA, 601 bp, Human
aagagaaccaacaaaggagaatgccatctcccagatactcaatttgattaccattttatcctaccttctctagggtccagacattatgtaaattggcattaagtttgaataatgtatggacccagtttaaaaggaaaaaatgctttgggaggctgaggcaggtgcattgcctgaggtcaggagttccagaacagcctggccaacacagtgaaaccccatctctactaaaaatacaaaaagttagctgggcacggtggcgggcacctgtaatcccagctactcaggaggctaatgcaggagratcacttgaacctgggaggcagaggttgcagtgagccaagatcgtgccattgcactccagcctgggtgatgagagcaaaactccatctcaaaaaatttttaaaacaaaaggaaaaaatgctcccctgattcccgcagtgctgacttaaaatgttcttagtatgccaatgttgcttaaatatgaatgactgtagcttctacttaaattggcaaccgcaccaaatataaactgcaaatgtttatagctcttatggaagtataaaagcaaaacaaattcttaaattaaatacaaactaagagg

SEQ ID NO: 51524 - DNA, 601 bp, Human
tgtagcttctacttaaattggcaaccgcaccaaatataaactgcaaatgtttatagctcttatggaagtataaaagcaaaacaaattcttaaattaaatacaaactaagagggaaactgataataacaatgttttgtgtaattaagttgctgtttgcaacatgcctggggcagactcctggcctctttgcatctgacatgagaggctaccaaggatgtggccacaactgggctctcccagcacttgcttgcgctcagaactgtgccaaaacctttgctcgcccagtgttctgcaacgtccrtcatttggatttggcaggaacacatcatttatgcattttgtttgcttctgtatttagttgagatacttaaaatataactgctagattctaaggcattcataagcatctgtgaaaaatgtgttacttaggaaacagttcagggttccatggattatctagattggtgagtcttaagactgaccacacaattcatctgggggtgtggaggaggggagctttgagaaaaatctctgtatgagcacccacacccagagattcctatgcaattatcccagagtggtgccttaatatcaacatttg

SEQ ID NO: 51525 - DNA, 601 bp, Human
tttggatttggcaggaacacatcatttatgcattttgtttgcttctgtatttagttgagatacttaaaatataactgctagattctaaggcattcataagcatctgtgaaaaatgtgttacttaggaaacagttcagggttccatggattatctagattggtgagtcttaagactgaccacacaattcatctgggggtgtggaggaggggagctttgagaaaaatctctgtatgagcacccacacccagagattcctatgcaattatcccagagtggtgccttaatatcaacatttgtttaaaccatcccccaagactaaaatttgtgaccgggatttagaaccattgacttaattgatgcagaacactctgatattaatgtcttcatgtcttttggaatgtcattaagacaaaagcataaaattttaaaattcttaaagacaatttaaagacctatgagaatccatctttaattctcaggagcgtgtggaacctagtttgaaaactactggcatcgacaattgaatttccactaaaataaaatagctctctagtatattacaaaactacccattctgcaaactgcaggggagctactgat

SEQ ID NO: 51526 - DNA, 601 bp, Human
ggttgattcagctccatttcctctgagtttttactttagatgtgctttttaggttgcatttttcttctggcatataagaaagacagcaatattccatggaacagagtgatgtctgtggctttgtcaaccgttgtttgttagcttgatcaccatttattgagtgtttactactttccaggcattgtgctaagtggtagaaatacaaagttgcctttacttgattcatctgtaaaatagagagagtagtagttcctacagtgtggtttatgtgaggcatagggactgctccctgaaacctagkgacaactccctagcagcgacccagtgctcatatcaatagtggtaacaattaggaaggcagctcctacctcaaagacctcatgatctgatggtaaagacagatataacaagaaaattattctttttaaatataaaattgtgatataaaaatagttttcactaaattggatttttatgaaatttacagaaacaaaataataaattaaggaaatataaaaccacctgacattagccaaccatgttgatgttctgattatgttactgcaaaggagtgtagggttaagaacgagggactttgatt

SEQ ID NO: 51527 - DNA, 601 bp, Human
tatacatgtactttctttaaaaataagattttaaataactatataatcagtcatgatgatacaacatgatttattcaacaaatctgatgctgttaaacacgtaagtgatttctctttcaggattataaataacatttgttttgcatttttttcatacatcttttgctcacttttcattgttactttgtatatgttgctagaaattgatttgctggtgaaaagggtataaacatttttaaggctcttgctacatattgcctgctcttcatacatattgcctactgccccaggaaactatcarttacacttttaccaagagtgtatgaaagcattcacatgaatgtaaccttatcatgcaatgtgggccatgagacagaggagagttatggagggtagacggcttccccgctgctcagccactgccctctcctctaaaagagccacagtcaggaatttctacatagatcctattataaacatctccttttgaaacaaattatcttctctcagagcattttcttcattttagtatctatataggtccttgttatgttcattttaagttttgtgacctgcactgacacaatgctgatgaactgct

SEQ ID NO: 51528 - DNA, 601 bp, Human
agtcatgatgatacaacatgatttattcaacaaatctgatgctgttaaacacgtaagtgatttctctttcaggattataaataacatttgttttgcatttttttcatacatcttttgctcacttttcattgttactttgtatatgttgctagaaattgatttgctggtgaaaagggtataaacatttttaaggctcttgctacatattgcctgctcttcatacatattgcctactgccccaggaaactatcaattacacttttaccaagagtgtatgaaagcattcacatgaatgtaaccktatcatgcaatgtgggccatgagacagaggagagttatggagggtagacggcttccccgctgctcagccactgccctctcctctaaaagagccacagtcaggaatttctacatagatcctattataaacatctccttttgaaacaaattatcttctctcagagcattttcttcattttagtatctatataggtccttgttatgttcattttaagttttgtgacctgcactgacacaatgctgatgaactgcttattccaggcagtctgagttctcaaagcatttgcattttatgtcttat

SEQ ID NO: 51529 - DNA, 601 bp, Human
caacatgatttattcaacaaatctgatgctgttaaacacgtaagtgatttctctttcaggattataaataacatttgttttgcatttttttcatacatcttttgctcacttttcattgttactttgtatatgttgctagaaattgatttgctggtgaaaagggtataaacatttttaaggctcttgctacatattgcctgctcttcatacatattgcctactgccccaggaaactatcaattacacttttaccaagagtgtatgaaagcattcacatgaatgtaaccttatcatgcaatgygggccatgagacagaggagagttatggagggtagacggcttccccgctgctcagccactgccctctcctctaaaagagccacagtcaggaatttctacatagatcctattataaacatctccttttgaaacaaattatcttctctcagagcattttcttcattttagtatctatataggtccttgttatgttcattttaagttttgtgacctgcactgacacaatgctgatgaactgcttattccaggcagtctgagttctcaaagcatttgcattttatgtcttatcctctgttttggg

SEQ ID NO: 51530 - DNA, 601 bp, Human
tgcctgctcttcatacatattgcctactgccccaggaaactatcaattacacttttaccaagagtgtatgaaagcattcacatgaatgtaaccttatcatgcaatgtgggccatgagacagaggagagttatggagggtagacggcttccccgctgctcagccactgccctctcctctaaaagagccacagtcaggaatttctacatagatcctattataaacatctccttttgaaacaaattatcttctctcagagcattttcttcattttagtatctatataggtccttgttatgttcwttttaagttttgtgacctgcactgacacaatgctgatgaactgcttattccaggcagtctgagttctcaaagcatttgcattttatgtcttatcctctgttttgggctctttgccactgatttttttttaagtgatattttaagaaagaggagggttgatttgttgtgagtgtatctctctttaaaaacttttctagggaaggacaacctcttccaaagactttgtttgctttgtgtgattggcatgtccttccctggtcagtaatgagcttgaaggaagctactggacacgggactgaa

SEQ ID NO: 51531 - DNA, 601 bp, Human
aggtccttgttatgttcattttaagttttgtgacctgcactgacacaatgctgatgaactgcttattccaggcagtctgagttctcaaagcatttgcattttatgtcttatcctctgttttgggctctttgccactgatttttttttaagtgatattttaagaaagaggagggttgatttgttgtgagtgtatctctctttaaaaacttttctagggaaggacaacctcttccaaagactttgtttgctttgtgtgattggcatgtccttccctggtcagtaatgagcttgaaggaagctrctggacacgggactgaacatggggttttgctatcactctagctgtgcctttctctagtgatcaaggagatgttggttcagaaagtgccctgtctaatcccactaaggcccgaaggaccaagtgctgtctactctccagattctctgcaacagaaagcagatgcttaggcttcatggtccaggttggaacaggtagttagctctgaggacagttatgcatgaatgtcaggaggggactggcaggggaacatttatttattctttaaaattggaatcaacagttatggatgaaacccagaat

SEQ ID NO: 51532 - DNA, 601 bp, Human
atgaaacccagaatgcaaaattcactttcatcttgacacgcaacacatctgtcctttctccttgaatagcaagtattaatcattgagttagacaatgtaaccttcacattcagtgaaagccaaacactcagcaccttctagaaaaatcttagtgccatgctttcttagcatattgcaagtcctctgaggatgatgtgttgttcagctttgaagctgatcttttgtacttgcttatgtagctcaggctagtgataacatgccagaggcatttccaactaagaaaattattcacagaagcttyaattacaaatttgttagccccacttcctgctaaaatggccagccttgaagagtttcggaaatgtgagcagccttaaggatgatagaaatattatgaaatagtaataagtaatacccatacagcaaactcctttttctttggagtatccgttcatcagccagatttccctctcaacagtccaggtgttgacgaagatcatgaaataataggaatgaaagggacttcgattttgtatttttaatagcattttcctccaccaaattacgaaagtaatgcatgaccaaggcagagaacttggaa

SEQ ID NO: 51533 - DNA, 601 bp, Human
tagcatattgcaagtcctctgaggatgatgtgttgttcagctttgaagctgatcttttgtacttgcttatgtagctcaggctagtgataacatgccagaggcatttccaactaagaaaattattcacagaagctttaattacaaatttgttagccccacttcctgctaaaatggccagccttgaagagtttcggaaatgtgagcagccttaaggatgatagaaatattatgaaatagtaataagtaatacccatacagcaaactcctttttctttggagtatccgttcatcagccagattkccctctcaacagtccaggtgttgacgaagatcatgaaataataggaatgaaagggacttcgattttgtatttttaatagcattttcctccaccaaattacgaaagtaatgcatgaccaaggcagagaacttggaaaatacagaaaagccaccaagcaaaataatctcccaagaaatcataatttcaccacacaaaagtaaccattgtcaacattttggtgaaaatccttaattaaagagactcttaaaagatgccagttcgctgccacttcttcctttctccacaccatcctgcaccctg

SEQ ID NO: 51534 - DNA, 601 bp, Human
tcacagaagctttaattacaaatttgttagccccacttcctgctaaaatggccagccttgaagagtttcggaaatgtgagcagccttaaggatgatagaaatattatgaaatagtaataagtaatacccatacagcaaactcctttttctttggagtatccgttcatcagccagatttccctctcaacagtccaggtgttgacgaagatcatgaaataataggaatgaaagggacttcgattttgtatttttaatagcattttcctccaccaaattacgaaagtaatgcatgaccaaggcrgagaacttggaaaatacagaaaagccaccaagcaaaataatctcccaagaaatcataatttcaccacacaaaagtaaccattgtcaacattttggtgaaaatccttaattaaagagactcttaaaagatgccagttcgctgccacttcttcctttctccacaccatcctgcaccctgttttgaaatgcagaattgtttctaaatcattccaggaaaattattagttttctcaaatatctctggaggcgagtctgttggcagtcatttctagtttctcacaaaccttgaagttaggaaatt

SEQ ID NO: 51535 - DNA, 601 bp, Human
tagcattttcctccaccaaattacgaaagtaatgcatgaccaaggcagagaacttggaaaatacagaaaagccaccaagcaaaataatctcccaagaaatcataatttcaccacacaaaagtaaccattgtcaacattttggtgaaaatccttaattaaagagactcttaaaagatgccagttcgctgccacttcttcctttctccacaccatcctgcaccctgttttgaaatgcagaattgtttctaaatcattccaggaaaattattagttttctcaaatatctctggaggcgagtctrttggcagtcatttctagtttctcacaaaccttgaagttaggaaattatttgtgtagcttttgagcactgggccagaagtgagggatgtttgggttctagttccagctctaccacttatttaccaactggccgacctcaggcaagtccaggctagcggccccgcctcaagcccctccagatgcagcatctgcaaccccacttccttcacttcctttcgcctcagtttcccaacaatttcctagtaattgtactgaatcattgtttttcattttttacattaaaatttatttattttatttt

SEQ ID NO: 51536 - DNA, 601 bp, Human
ttaaagagactcttaaaagatgccagttcgctgccacttcttcctttctccacaccatcctgcaccctgttttgaaatgcagaattgtttctaaatcattccaggaaaattattagttttctcaaatatctctggaggcgagtctgttggcagtcatttctagtttctcacaaaccttgaagttaggaaattatttgtgtagcttttgagcactgggccagaagtgagggatgtttgggttctagttccagctctaccacttatttaccaactggccgacctcaggcaagtccaggctagyggccccgcctcaagcccctccagatgcagcatctgcaaccccacttccttcacttcctttcgcctcagtttcccaacaatttcctagtaattgtactgaatcattgtttttcattttttacattaaaatttatttattttattttatttttaaagactttattttttagaacagatttagatttgcagcaaaactgagtggcaagtacagaaagttcccatatattccctgcccccgcacatacacagtctccctcactatcagcatccccaaccagagaggtacattggttacagctga

SEQ ID NO: 51537 - DNA, 601 bp, Human
ttgagcactgggccagaagtgagggatgtttgggttctagttccagctctaccacttatttaccaactggccgacctcaggcaagtccaggctagcggccccgcctcaagcccctccagatgcagcatctgcaaccccacttccttcacttcctttcgcctcagtttcccaacaatttcctagtaattgtactgaatcattgtttttcattttttacattaaaatttatttattttattttatttttaaagactttattttttagaacagatttagatttgcagcaaaactgagtggcaartacagaaagttcccatatattccctgcccccgcacatacacagtctccctcactatcagcatccccaaccagagaggtacattggttacagctgatgaatctacatcgacacgtcattatcacccaaagtgcatagtttgcattggcgttgggcattttagggcttttgacacatgtatgcactattgtaatatacagaataatttcactgccctaaaaatcctctgtgctcctcctattcattcctccctccaccccattcctggcaactactgatctttttactgtctccacagtttt

SEQ ID NO: 51538 - DNA, 601 bp, Human
ctaccacttatttaccaactggccgacctcaggcaagtccaggctagcggccccgcctcaagcccctccagatgcagcatctgcaaccccacttccttcacttcctttcgcctcagtttcccaacaatttcctagtaattgtactgaatcattgtttttcattttttacattaaaatttatttattttattttatttttaaagactttattttttagaacagatttagatttgcagcaaaactgagtggcaagtacagaaagttcccatatattccctgcccccgcacatacacagtctcyctcactatcagcatccccaaccagagaggtacattggttacagctgatgaatctacatcgacacgtcattatcacccaaagtgcatagtttgcattggcgttgggcattttagggcttttgacacatgtatgcactattgtaatatacagaataatttcactgccctaaaaatcctctgtgctcctcctattcattcctccctccaccccattcctggcaactactgatctttttactgtctccacagttttgccttctccagaatgtcatatacttggaatcataaggtttgtagcctt

SEQ ID NO: 51539 - DNA, 601 bp, Human
gcaaccccacttccttcacttcctttcgcctcagtttcccaacaatttcctagtaattgtactgaatcattgtttttcattttttacattaaaatttatttattttattttatttttaaagactttattttttagaacagatttagatttgcagcaaaactgagtggcaagtacagaaagttcccatatattccctgcccccgcacatacacagtctccctcactatcagcatccccaaccagagaggtacattggttacagctgatgaatctacatcgacacgtcattatcacccaaagygcatagtttgcattggcgttgggcattttagggcttttgacacatgtatgcactattgtaatatacagaataatttcactgccctaaaaatcctctgtgctcctcctattcattcctccctccaccccattcctggcaactactgatctttttactgtctccacagttttgccttctccagaatgtcatatacttggaatcataaggtttgtagccttttcagattggcttctttcactcagtgatatgcatttaaggttcttccatgtctttttatggcttgatagctcatttcttttt

SEQ ID NO: 51540 - DNA, 601 bp, Human
ttttttacattaaaatttatttattttattttatttttaaagactttattttttagaacagatttagatttgcagcaaaactgagtggcaagtacagaaagttcccatatattccctgcccccgcacatacacagtctccctcactatcagcatccccaaccagagaggtacattggttacagctgatgaatctacatcgacacgtcattatcacccaaagtgcatagtttgcattggcgttgggcattttagggcttttgacacatgtatgcactattgtaatatacagaataatttcaytgccctaaaaatcctctgtgctcctcctattcattcctccctccaccccattcctggcaactactgatctttttactgtctccacagttttgccttctccagaatgtcatatacttggaatcataaggtttgtagccttttcagattggcttctttcactcagtgatatgcatttaaggttcttccatgtctttttatggcttgatagctcatttctttttatcattgaatactactactccattgtctggattatacacactttatttatacattcacctactgaaggatgtgttggtt

SEQ ID NO: 51541 - DNA, 601 bp, Human
tacacctaaagaatatgcaccattcacttgcccactcatctctcaaagagaggaactttcaacactagttatctttttaaaaataatcagagagaattctcagccacttcaattctagcccaggaaaaagagggaaaatacatttgaaggtttctggctcatgtgatacatttgcaaaccagaaccaagatgatatgactctcatttattagtgactattgcaaagctttgcaggctattaagcaggctgttcaatttagggtgatatggacatgtgcatattggccaattatatatgctyagatcgtatgtcattttttttctgcattttagtctaagtgtcagataggtgtttcatgatgttttataaacacttctgttcacattaacattgttcattgatttggcaaggaatgaaggggtgtcattttcatgattttatttgtatattatgtattccacagaggatttgaaatgccttaccaaattttatgtaatgtaaaggggtaaaccaatatttgacacatcattataaattgaggataatctgaagaaaataataaatccaggagacagattatcacactgatatggtttggct

SEQ ID NO: 51542 - DNA, 601 bp, Human
ctaaagaatatgcaccattcacttgcccactcatctctcaaagagaggaactttcaacactagttatctttttaaaaataatcagagagaattctcagccacttcaattctagcccaggaaaaagagggaaaatacatttgaaggtttctggctcatgtgatacatttgcaaaccagaaccaagatgatatgactctcatttattagtgactattgcaaagctttgcaggctattaagcaggctgttcaatttagggtgatatggacatgtgcatattggccaattatatatgctcagatygtatgtcattttttttctgcattttagtctaagtgtcagataggtgtttcatgatgttttataaacacttctgttcacattaacattgttcattgatttggcaaggaatgaaggggtgtcattttcatgattttatttgtatattatgtattccacagaggatttgaaatgccttaccaaattttatgtaatgtaaaggggtaaaccaatatttgacacatcattataaattgaggataatctgaagaaaataataaatccaggagacagattatcacactgatatggtttggctctgtg

SEQ ID NO: 51543 - DNA, 601 bp, Human
gaatatgcaccattcacttgcccactcatctctcaaagagaggaactttcaacactagttatctttttaaaaataatcagagagaattctcagccacttcaattctagcccaggaaaaagagggaaaatacatttgaaggtttctggctcatgtgatacatttgcaaaccagaaccaagatgatatgactctcatttattagtgactattgcaaagctttgcaggctattaagcaggctgttcaatttagggtgatatggacatgtgcatattggccaattatatatgctcagatcgtatrtcattttttttctgcattttagtctaagtgtcagataggtgtttcatgatgttttataaacacttctgttcacattaacattgttcattgatttggcaaggaatgaaggggtgtcattttcatgattttatttgtatattatgtattccacagaggatttgaaatgccttaccaaattttatgtaatgtaaaggggtaaaccaatatttgacacatcattataaattgaggataatctgaagaaaataataaatccaggagacagattatcacactgatatggtttggctctgtgtcccc

SEQ ID NO: 51544 - DNA, 601 bp, Human
tctggctcatgtgatacatttgcaaaccagaaccaagatgatatgactctcatttattagtgactattgcaaagctttgcaggctattaagcaggctgttcaatttagggtgatatggacatgtgcatattggccaattatatatgctcagatcgtatgtcattttttttctgcattttagtctaagtgtcagataggtgtttcatgatgttttataaacacttctgttcacattaacattgttcattgatttggcaaggaatgaaggggtgtcattttcatgattttatttgtatattaygtattccacagaggatttgaaatgccttaccaaattttatgtaatgtaaaggggtaaaccaatatttgacacatcattataaattgaggataatctgaagaaaataataaatccaggagacagattatcacactgatatggtttggctctgtgtccccacccaaatttcatcttgaattttactcacataatttccatgtgttgtgggagggacccagtgggagatcatttgaatcataggagtggtttcctccatgctgttctcattgtagtgaataagtctcatgagatctgatggtt

SEQ ID NO: 51545 - DNA, 601 bp, Human
atgactctcatttattagtgactattgcaaagctttgcaggctattaagcaggctgttcaatttagggtgatatggacatgtgcatattggccaattatatatgctcagatcgtatgtcattttttttctgcattttagtctaagtgtcagataggtgtttcatgatgttttataaacacttctgttcacattaacattgttcattgatttggcaaggaatgaaggggtgtcattttcatgattttatttgtatattatgtattccacagaggatttgaaatgccttaccaaattttatgyaatgtaaaggggtaaaccaatatttgacacatcattataaattgaggataatctgaagaaaataataaatccaggagacagattatcacactgatatggtttggctctgtgtccccacccaaatttcatcttgaattttactcacataatttccatgtgttgtgggagggacccagtgggagatcatttgaatcataggagtggtttcctccatgctgttctcattgtagtgaataagtctcatgagatctgatggttttatcaggggtttccacttttatatcttcctcattttttctc

SEQ ID NO: 51546 - DNA, 601 bp, Human
gtgtcagataggtgtttcatgatgttttataaacacttctgttcacattaacattgttcattgatttggcaaggaatgaaggggtgtcattttcatgattttatttgtatattatgtattccacagaggatttgaaatgccttaccaaattttatgtaatgtaaaggggtaaaccaatatttgacacatcattataaattgaggataatctgaagaaaataataaatccaggagacagattatcacactgatatggtttggctctgtgtccccacccaaatttcatcttgaattttactcrcataatttccatgtgttgtgggagggacccagtgggagatcatttgaatcataggagtggtttcctccatgctgttctcattgtagtgaataagtctcatgagatctgatggttttatcaggggtttccacttttatatcttcctcattttttctcttgccaccaccatgtaagaagtgcctttcgcctcccaccatgattctgaattctgaaccctccccagccatgtggaactgtaaatccaattaaacctctttttcttcccagtcttgggtatgtctttatcagcagcacgaaaat

SEQ ID NO: 51547 - DNA, 601 bp, Human
acatcattataaattgaggataatctgaagaaaataataaatccaggagacagattatcacactgatatggtttggctctgtgtccccacccaaatttcatcttgaattttactcacataatttccatgtgttgtgggagggacccagtgggagatcatttgaatcataggagtggtttcctccatgctgttctcattgtagtgaataagtctcatgagatctgatggttttatcaggggtttccacttttatatcttcctcattttttctcttgccaccaccatgtaagaagtgcctttygcctcccaccatgattctgaattctgaaccctccccagccatgtggaactgtaaatccaattaaacctctttttcttcccagtcttgggtatgtctttatcagcagcacgaaaatggactaatacagtaaattggtacaaggagtggggtgttgctgaaaagatagccgaaaatgtggaagcaatcttggaactggatatcagggagaggttggagcagtttggagggctcaaaaaagacaggaaaatgtgggaaagtttgaaacttcctagagacttgttgaatggccttgacaagaat

SEQ ID NO: 51548 - DNA, 601 bp, Human
tttccatgtgttgtgggagggacccagtgggagatcatttgaatcataggagtggtttcctccatgctgttctcattgtagtgaataagtctcatgagatctgatggttttatcaggggtttccacttttatatcttcctcattttttctcttgccaccaccatgtaagaagtgcctttcgcctcccaccatgattctgaattctgaaccctccccagccatgtggaactgtaaatccaattaaacctctttttcttcccagtcttgggtatgtctttatcagcagcacgaaaatggactratacagtaaattggtacaaggagtggggtgttgctgaaaagatagccgaaaatgtggaagcaatcttggaactggatatcagggagaggttggagcagtttggagggctcaaaaaagacaggaaaatgtgggaaagtttgaaacttcctagagacttgttgaatggccttgacaagaatactgatagtgatatgaacaataaagtccaggctgaggtggtctcagatggggatgaagaaactgttgggaagtggagcaaaggtgactcttgttatatcttagcaaagagactggtggcat

SEQ ID NO: 51549 - DNA, 601 bp, Human
gggacccagtgggagatcatttgaatcataggagtggtttcctccatgctgttctcattgtagtgaataagtctcatgagatctgatggttttatcaggggtttccacttttatatcttcctcattttttctcttgccaccaccatgtaagaagtgcctttcgcctcccaccatgattctgaattctgaaccctccccagccatgtggaactgtaaatccaattaaacctctttttcttcccagtcttgggtatgtctttatcagcagcacgaaaatggactaatacagtaaattggtacraggagtggggtgttgctgaaaagatagccgaaaatgtggaagcaatcttggaactggatatcagggagaggttggagcagtttggagggctcaaaaaagacaggaaaatgtgggaaagtttgaaacttcctagagacttgttgaatggccttgacaagaatactgatagtgatatgaacaataaagtccaggctgaggtggtctcagatggggatgaagaaactgttgggaagtggagcaaaggtgactcttgttatatcttagcaaagagactggtggcattttacccctgctgtagag

SEQ ID NO: 51550 - DNA, 601 bp, Human
tgttgctgaaaagatagccgaaaatgtggaagcaatcttggaactggatatcagggagaggttggagcagtttggagggctcaaaaaagacaggaaaatgtgggaaagtttgaaacttcctagagacttgttgaatggccttgacaagaatactgatagtgatatgaacaataaagtccaggctgaggtggtctcagatggggatgaagaaactgttgggaagtggagcaaaggtgactcttgttatatcttagcaaagagactggtggcattttacccctgctgtagagatttgtggaacttgaacttgagagaaatgatttggggtacctggtaaaagaaatttctaagcagcaaaacattcaaaaggtgacttgggtgttgttaaaagcattctgttttaaaagagaaacagcataaaagttcagaaaatttgcagcctgatgatgcagtaggaaagaaaaacccatttttttgaggagaaattcaagctggctgcagaaatttgcataagtaacaaggagccaaatgttaatccccaagacaatggggaaaatgtctccagagcatgtcataggtcttcatggcagcccctcccatc

SEQ ID NO: 51551 - DNA, 601 bp, Human
caggaaaatgtgggaaagtttgaaacttcctagagacttgttgaatggccttgacaagaatactgatagtgatatgaacaataaagtccaggctgaggtggtctcagatggggatgaagaaactgttgggaagtggagcaaaggtgactcttgttatatcttagcaaagagactggtggcattttacccctgctgtagagatttgtggaatttgaacttgagagaaatgatttggggtacctggtaaaagaaatttctaagcagcaaaacattcaaaaggtgacttgggtgttgttaaaascattctgttttaaaagagaaacagcataaaagttcagaaaatttgcagcctgatgatgcagtaggaaagaaaaacccatttttttgaggagaaattcaagctggctgcagaaatttgcataagtaacaaggagccaaatgttaatccccaagacaatggggaaaatgtctccagagcatgtcataggtcttcatggcagcccctcccatcacagacccggaagcctaggaggaaaaaaacagttttgtgggccagtcccagggtccccatgctgtgtgcagcctaggaacttggtgccct

SEQ ID NO: 51552 - DNA, 601 bp, Human
ggccttgacaagaatactgatagtgatatgaacaataaagtccaggctgaggtggtctcagatggggatgaagaaactgttgggaagtggagcaaaggtgactcttgttatatcttagcaaagagactggtggcattttacccctgctgtagagatttgtggaatttgaacttgagagaaatgatttggggtacctggtaaaagaaatttctaagcagcaaaacattcaaaaggtgacttgggtgttgttaaaagcattctgttttaaaagagaaacagcataaaagttcagaaaatttgcagcctgatgatgcagtaggaaagaaaaacccatttttttgaggagaaattcaagctggctgcagaaatttgcataagtaacaaggagccaaatgttaatccccaagacaatggggaaaatgtctccagagcatgtcataggtcttcatggcagcccctcccatcacagacccggaagcctaggaggaaaaaaacagttttgtgggccagtcccagggtccccatgctgtgtgcagcctaggaacttggtgccctgcatctcagctgctccagctattgctaaaaggggctgaggtaccac

SEQ ID NO: 51553 - DNA, 601 bp, Human
ccttgacaagaatactgatagtgatatgaacaataaagtccaggctgaggtggtctcagatggggatgaagaaactgttgggaagtggagcaaaggtgactcttgttatatcttagcaaagagactggtggcattttacccctgctgtagagatttgtggaatttgaacttgagagaaatgatttggggtacctggtaaaagaaatttctaagcagcaaaacattcaaaaggtgacttgggtgttgttaaaagcattctgttttaaaagagaaacagcataaaagttcagaaaatttgcagcctgatgatgcagtaggaaagaaaaacccatttttttgaggagaaattcaagctggctgcagaaatttgcataagtaacaaggagccaaatgttaatccccaagacaatggggaaaatgtctccagagcatgtcataggtcttcatggcagcccctcccatcacagacccggaagcctaggaggaaaaaaacagttttgtgggccagtcccagggtccccatgctgtgtgcagcctaggaacttggtgccctgcatctcagctgctccagctattgctaaaaggggctgaggtaccacgg

SEQ ID NO: 51554 - DNA, 601 bp, Human
aacaataaagtccaggctgaggtggtctcagatggggatgaagaaactgttgggaagtggagcaaaggtgactcttgttatatcttagcaaagagactggtggcattttacccctgctgtagagatttgtggaatttgaacttgagagaaatgatttggggtacctggtaaaagaaatttctaagcagcaaaacattcaaaaggtgacttgggtgttgttaaaagcattctgttttaaaagagaaacagcataaaagttcagaaaatttgcagcctgatgatgcagtaggaaagaaaaacycatttttttgaggagaaattcaagctggctgcagaaatttgcataagtaacaaggagccaaatgttaatccccaagacaatggggaaaatgtctccagagcatgtcataggtcttcatggcagcccctcccatcacagacccggaagcctaggaggaaaaaaacagttttgtgggccagtcccagggtccccatgctgtgtgcagcctaggaacttggtgccctgcatctcagctgctccagctattgctaaaaggggctgaggtaccacggtttcagaggttgcaagccccaaaccttg

SEQ ID NO: 51555 - DNA, 601 bp, Human
tgagagaaatgatttggggtacctggtaaaagaaatttctaagcagcaaaacattcaaaaggtgacttgggtgttgttaaaagcattctgttttaaaagagaaacagcataaaagttcagaaaatttgcagcctgatgatgcagtaggaaagaaaaacccatttttttgaggagaaattcaagctggctgcagaaatttgcataagtaacaaggagccaaatgttaatccccaagacaatggggaaaatgtctccagagcatgtcataggtcttcatggcagcccctcccatcacagaccyggaagcctaggaggaaaaaaacagttttgtgggccagtcccagggtccccatgctgtgtgcagcctaggaacttggtgccctgcatctcagctgctccagctattgctaaaaggggctgaggtaccacggtttcagaggttgcaagccccaaaccttggcagctttcatgtggtgttgagcctgtgtgtacacagaagttaagaattgaggtttgggaacctccacttatatttcagaagatacgtggaaatgcctggatacccaggcaaacatttgctgcagaggtggggccctcatgg

SEQ ID NO: 51556 - DNA, 601 bp, Human
aaatttgcataagtaacaaggagccaaatgttaatccccaagacaatggggaaaatgtctccagagcatgtcataggtcttcatggcagcccctcccatcacagacccggaagcctaggaggaaaaaaacagttttgtgggccagtcccagggtccccatgctgtgtgcagcctaggaacttggtgccctgcatctcagctgctccagctattgctaaaaggggctgaggtaccacggtttcagaggttgcaagccccaaaccttggcagctttcatgtggtgttgagcctgtgtgtacayagaagttaagaattgaggtttgggaacctccacttatatttcagaagatacgtggaaatgcctggatacccaggcaaacatttgctgcagaggtggggccctcatggagggcctctgctagggcaatgaggaagggaaatgtggggttggaacccccacacagagtccccactggggcactgcctagtggagctgtaagaggaggaccactgtcctccagaccgcagaatagtagatccactgacagcttgcaccatgtgcctggaaaagccacagacactcaacgccagcctgtgaaag

SEQ ID NO: 51557 - DNA, 601 bp, Human
cctcccatcacagacccggaagcctaggaggaaaaaaacagttttgtgggccagtcccagggtccccatgctgtgtgcagcctaggaacttggtgccctgcatctcagctgctccagctattgctaaaaggggctgaggtaccacggtttcagaggttgcaagccccaaaccttggcagctttcatgtggtgttgagcctgtgtgtacacagaagttaagaattgaggtttgggaacctccacttatatttcagaagatacgtggaaatgcctggatacccaggcaaacatttgctgcagrggtggggccctcatggagggcctctgctagggcaatgaggaagggaaatgtggggttggaacccccacacagagtccccactggggcactgcctagtggagctgtaagaggaggaccactgtcctccagaccgcagaatagtagatccactgacagcttgcaccatgtgcctggaaaagccacagacactcaacgccagcctgtgaaagcagtcagggttggaggtggtggtggctataccctataaagccacaggggcagagctgcccaagactatgggaacctacctcttgcatcagc

SEQ ID NO: 51558 - DNA, 601 bp, Human
cccaaaccttggcagctttcatgtggtgttgagcctgtgtgtacacagaagttaagaattgaggtttgggaacctccacttatatttcagaagatacgtggaaatgcctggatacccaggcaaacatttgctgcagaggtggggccctcatggagggcctctgctagggcaatgaggaagggaaatgtggggttggaacccccacacagagtccccactggggcactgcctagtggagctgtaagaggaggaccactgtcctccagaccgcagaatagtagatccactgacagcttgcacyatgtgcctggaaaagccacagacactcaacgccagcctgtgaaagcagtcagggttggaggtggtggtggctataccctataaagccacaggggcagagctgcccaagactatgggaacctacctcttgcatcagcatgacctggatgtgagacattcagtcaaaggagatattttgaagctttagaatttgactgccctggtggattttagacttgtgtgggccctgtaacccctttgttttggccaatttctcccatttggagctgctgtatttacccaatgcctaaacccgcattgt

SEQ ID NO: 51559 - DNA, 601 bp, Human
ccaaaccttggcagctttcatgtggtgttgagcctgtgtgtacacagaagttaagaattgaggtttgggaacctccacttatatttcagaagatacgtggaaatgcctggatacccaggcaaacatttgctgcagaggtggggccctcatggagggcctctgctagggcaatgaggaagggaaatgtggggttggaacccccacacagagtccccactggggcactgcctagtggagctgtaagaggaggaccactgtcctccagaccgcagaatagtagatccactgacagcttgcaccrtgtgcctggaaaagccacagacactcaacgccagcctgtgaaagcagtcagggttggaggtggtggtggctataccctataaagccacaggggcagagctgcccaagactatgggaacctacctcttgcatcagcatgacctggatgtgagacattcagtcaaaggagatattttgaagctttagaatttgactgccctggtggattttagacttgtgtgggccctgtaacccctttgttttggccaatttctcccatttggagctgctgtatttacccaatgcctaaacccgcattgta

SEQ ID NO: 51560 - DNA, 601 bp, Human
cctcatggagggcctctgctagggcaatgaggaagggaaatgtggggttggaacccccacacagagtccccactggggcactgcctagtggagctgtaagaggaggaccactgtcctccagaccgcagaatagtagatccactgacagcttgcaccatgtgcctggaaaagccacagacactcaacgccagcctgtgaaagcagtcagggttggaggtggtggtggctataccctataaagccacaggggcagagctgcccaagactatgggaacctacctcttgcatcagcatgacctgsatgtgagacattcagtcaaaggagatattttgaagctttagaatttgactgccctggtggattttagacttgtgtgggccctgtaacccctttgttttggccaatttctcccatttggagctgctgtatttacccaatgcctaaacccgcattgtatctaagaagtaactagcttgattttgattttacaggctcataggcaaaagggacttgccttgtctcagatgagactttggactgtggacttttggttaattctgaaatgagttaagactttgggggactgttgggaaggcatga

SEQ ID NO: 51561 - DNA, 601 bp, Human
gaccgcagaatagtagatccactgacagcttgcaccatgtgcctggaaaagccacagacactcaacgccagcctgtgaaagcagtcagggttggaggtggtggtggctataccctataaagccacaggggcagagctgcccaagactatgggaacctacctcttgcatcagcatgacctggatgtgagacattcagtcaaaggagatattttgaagctttagaatttgactgccctggtggattttagacttgtgtgggccctgtaacccctttgttttggccaatttctcccatttggarctgctgtatttacccaatgcctaaacccgcattgtatctaagaagtaactagcttgattttgattttacaggctcataggcaaaagggacttgccttgtctcagatgagactttggactgtggacttttggttaattctgaaatgagttaagactttgggggactgttgggaaggcatgattgcttttgaaatgtgaggacatgagatttggagaggccaggggtggaatgttatggtttggctctgtgtccccacccaaatctcatcttgaattatactcccataattccaaagtgttg

SEQ ID NO: 51562 - DNA, 601 bp, Human
ttgcaccatgtgcctggaaaagccacagacactcaacgccagcctgtgaaagcagtcagggttggaggtggtggtggctataccctataaagccacaggggcagagctgcccaagactatgggaacctacctcttgcatcagcatgacctggatgtgagacattcagtcaaaggagatattttgaagctttagaatttgactgccctggtggattttagacttgtgtgggccctgtaacccctttgttttggccaatttctcccatttggagctgctgtatttacccaatgcctaaacccscattgtatctaagaagtaactagcttgattttgattttacaggctcataggcaaaagggacttgccttgtctcagatgagactttggactgtggacttttggttaattctgaaatgagttaagactttgggggactgttgggaaggcatgattgcttttgaaatgtgaggacatgagatttggagaggccaggggtggaatgttatggtttggctctgtgtccccacccaaatctcatcttgaattatactcccataattccaaagtgttgtgagagggacctggtgggaaacaatttga

SEQ ID NO: 51563 - DNA, 601 bp, Human
cttgcatcagcatgacctggatgtgagacattcagtcaaaggagatattttgaagctttagaatttgactgccctggtggattttagacttgtgtgggccctgtaacccctttgttttggccaatttctcccatttggagctgctgtatttacccaatgcctaaacccgcattgtatctaagaagtaactagcttgattttgattttacaggctcataggcaaaagggacttgccttgtctcagatgagactttggactgtggacttttggttaattctgaaatgagttaagactttgggsgactgttgggaaggcatgattgcttttgaaatgtgaggacatgagatttggagaggccaggggtggaatgttatggtttggctctgtgtccccacccaaatctcatcttgaattatactcccataattccaaagtgttgtgagagggacctggtgggaaacaatttgaatcatgaggccagtttcccctatactgttcttgtggtagtgagtaagtctcacgagatctcatggttttatcagggtttccgcttttgcatcttcctcattttctcttgctgctgccatgtaagaagtgcct

SEQ ID NO: 51564 - DNA, 601 bp, Human
gtgaaaagaaacgaacaaagcctccaagaaatatgggactatgtgaaacaaacaaatatatgtttcattggtgtactgggaagtgatggggagaatggaaccaagttagaaaacactcttcaggatattatccaggacaacttccccaacctagcaaggcaggccaacattcaaattcaggaaatacagagaacactacaaagatactcctcaagaagagcaaccccaagacacataattttcagatttaaaaagtatgaaatgaaggaaaaaatgttaagggcagccagagagaaaagtygggttacccacaaagggaagcccatcagactaatgggatctctcagcagaaaccctacaagccagaagagagtgggggccaatattcaacattcttaaaaattcttaaaaaaagaagaattttcaacccagaatctcatatccagccaaactaagcttcataagtgaaggagaaataaaatcctttacagacaagcaaatgctgagagattttgtcaccaccaggcctgccttagaagagctcctgaaggaagcactaaacatggaaaggaacaaacagtaccagccactgcaaaaacat

SEQ ID NO: 51565 - DNA, 601 bp, Human
ggaaaaaatgttaagggcagccagagagaaaagtcgggttacccacaaagggaagcccatcagactaatgggatctctcagcagaaaccctacaagccagaagagagtgggggccaatattcaacattcttaaaaattcttaaaaaaagaagaattttcaacccagaatctcatatccagccaaactaagcttcataagtgaaggagaaataaaatcctttacagacaagcaaatgctgagagattttgtcaccaccaggcctgccttagaagagctcctgaaggaagcactaaacatggraaggaacaaacagtaccagccactgcaaaaacattccaaattgtaaagaccatcgacgctatgaagaaactgcatcaattaacgggcaaaataaccagctaacatcagaatgacaggatcaaattcaaacataacaatattaaccttaaatgtaaatgggctaaatgctccaattaaaagacacagactggcaaattggataaagagtcaagactgtgctgtattcaggagacccatctcacgtgcaaaaatgcacataggctcaaaataaagggtcgaaggaaaatctactgagcaaat

SEQ ID NO: 51566 - DNA, 601 bp, Human
aaacaagaaatggggaaaggattccctatttaataaatggtgctaggaaaactggctagccatatgtagaaagctgaaactggatcccttccttacactgtatacaaaaattcgctcaagaaggattaaagacttaaatgtaagacctaacacctagaagaaaacctacacaataccattcaggacataggcatgggcaaagactttatgactaaaacaccaaaagcaatggcatcaaaagccaaaatagacaaattggatctaattaaactaaagagcttctgcacagcaaaggaaactrtcatcagagtgaacaggcaacctacagagtgggagaaaatttttgcaatccacccatctgacaaagggctaatatctttgtagaatctgcaaagaacttaaacaaatttacaagaaaaaaacaaacccatcaaaaaagttggcaaaggatatgaacacctttacactgttggtgggagtgtaaattagttcaaccattgtggaagacagtgtggtgattcctcaaggatctagaactagaaataccatttgacccagtgatctcattagtgggtatatacccaaaggattataaatcatg

SEQ ID NO: 51567 - DNA, 601 bp, Human
tcccttccttacactgtatacaaaaattcgctcaagaaggattaaagacttaaatgtaagacctaacacctagaagaaaacctacacaataccattcaggacataggcatgggcaaagactttatgactaaaacaccaaaagcaatggcatcaaaagccaaaatagacaaattggatctaattaaactaaagagcttctgcacagcaaaggaaactatcatcagagtgaacaggcaacctacagagtgggagaaaatttttgcaatccacccatctgacaaagggctaatatctttgtagmatctgcaaagaacttaaacaaatttacaagaaaaaaacaaacccatcaaaaaagttggcaaaggatatgaacacctttacactgttggtgggagtgtaaattagttcaaccattgtggaagacagtgtggtgattcctcaaggatctagaactagaaataccatttgacccagtgatctcattagtgggtatatacccaaaggattataaatcatgctactataaagacacatgcacacatatgtttattgcagcactattcacaataccaaagacttggaaccaacccaaatgtccatc

SEQ ID NO: 51568 - DNA, 601 bp, Human
taagacctaacacctagaagaaaacctacacaataccattcaggacataggcatgggcaaagactttatgactaaaacaccaaaagcaatggcatcaaaagccaaaatagacaaattggatctaattaaactaaagagcttctgcacagcaaaggaaactatcatcagagtgaacaggcaacctacagagtgggagaaaatttttgcaatccacccatctgacaaagggctaatatctttgtagaatctgcaaagaacttaaacaaatttacaagaaaaaaacaaacccatcaaaaaagtkggcaaaggatatgaacacctttacactgttggtgggagtgtaaattagttcaaccattgtggaagacagtgtggtgattcctcaaggatctagaactagaaataccatttgacccagtgatctcattagtgggtatatacccaaaggattataaatcatgctactataaagacacatgcacacatatgtttattgcagcactattcacaataccaaagacttggaaccaacccaaatgtccatcaacgatagactggataaagaaaatgtggcacatatacaccatggaatactatgcag

SEQ ID NO: 51569 - DNA, 601 bp, Human
gaacttaaagtataataaaaaaaaaagaaagaaaagaaaagaaaaaaagaagtggcttttacctcccaccacgattctaaggcctctcagccatgtggaactgtaagtccagttaaacctctttttcttcccagtctcgagtatgtctttatcagcagcgtgaaaatgaactcatacacacacacagaagtatatctttacagttcccaggatggactgcaagtttggctctaaatttcctttgcctggccaaaacaaaaagaacacattttattataaggttcacaggcttttaattgaaaaaaaaaaaaaaacagttattcaacatgaaaactctttttcagacaaagttctacaaagtctatttctcacaagtaggactttggcaaggattgtgcaactgacaattcaaagtcatttattccgtggtgagaaaccggagtacagatctttaccagttaggggatgatccatgtgttttgataatcaccttggtggtgatcagactaaaggtctcctatgaaaaccattaacttcacactatagctgataggatgcactgaagcccttaccgctgactgcatggatgagagctaggcca

SEQ ID NO: 51570 - DNA, 601 bp, Human
cacgattctaaggcctctcagccatgtggaactgtaagtccagttaaacctctttttcttcccagtctcgagtatgtctttatcagcagcgtgaaaatgaactcatacacacacacagaagtatatctttacagttcccaggatggactgcaagtttggctctaaatttcctttgcctggccaaaacaaaaagaacacattttattataaggttcacaggcttttaattgaaaaaaaaaaaaaaacagttattcaacatgaaaactctttttcagacaaagttctacaaagtctatttctyacaagtaggactttggcaaggattgtgcaactgacaattcaaagtcatttattccgtggtgagaaaccggagtacagatctttaccagttaggggatgatccatgtgttttgataatcaccttggtggtgatcagactaaaggtctcctatgaaaaccattaacttcacactatagctgataggatgcactgaagcccttaccgctgactgcatggatgagagctaggccagagcattggcaggcagagtttataacatggggcaggaagcattgaaattctattccacctcttggtgta

SEQ ID NO: 51571 - DNA, 601 bp, Human
ttcttcccagtctcgagtatgtctttatcagcagcgtgaaaatgaactcatacacacacacagaagtatatctttacagttcccaggatggactgcaagtttggctctaaatttcctttgcctggccaaaacaaaaagaacacattttattataaggttcacaggcttttaattgaaaaaaaaaaaaaaacagttattcaacatgaaaactctttttcagacaaagttctacaaagtctatttctcacaagtaggactttggcaaggattgtgcaactgacaattcaaagtcatttattcygtggtgagaaaccggagtacagatctttaccagttaggggatgatccatgtgttttgataatcaccttggtggtgatcagactaaaggtctcctatgaaaaccattaacttcacactatagctgataggatgcactgaagcccttaccgctgactgcatggatgagagctaggccagagcattggcaggcagagtttataacatggggcaggaagcattgaaattctattccacctcttggtgtatcaggtcaggagtcaaatctcctatcttcctcttctggatcgctttcctcctgaa

SEQ ID NO: 51572 - DNA, 601 bp, Human
tagctgataggatgcactgaagcccttaccgctgactgcatggatgagagctaggccagagcattggcaggcagagtttataacatggggcaggaagcattgaaattctattccacctcttggtgtatcaggtcaggagtcaaatctcctatcttcctcttctggatcgctttcctcctgaagtgtctggcatagatgtctaggtatagcttggcatggtggtgtgtgcctatagacccagctacttgagaggctgaggtgggaggattgcttgagcgcaggagtttgaggctgcagtgarccatgaccacaccactgtactccaccctgggtgacagagcaagaccctgtctctctttctaaaaaaacaaaacaaaacaaaacaaaacaaaaagaaaaaaagatgtccaagtgtgttctggttactgctgctgactgctaaatttaacagctagaaaaaaaaagtttggactctatggatcataaatttggataagacacagagggaatggcttgtctcatgttcacaatgtctaaagtcttaaatggggagagtcgtcaaccaggggtaatttgagagttatgggctggaaccaccttg

SEQ ID NO: 51573 - DNA, 601 bp, Human
cctcttctggatcgctttcctcctgaagtgtctggcatagatgtctaggtatagcttggcatggtggtgtgtgcctatagacccagctacttgagaggctgaggtgggaggattgcttgagcgcaggagtttgaggctgcagtgagccatgaccacaccactgtactccaccctgggtgacagagcaagaccctgtctctctttctaaaaaaacaaaacaaaacaaaacaaaacaaaaagaaaaaaagatgtccaagtgtgttctggttactgctgctgactgctaaatttaacagctagaaaaaaaaagtttggactctatggatcataaatttggataagacacagagggaatggcttgtctcatgttcacaatgtctaaagtcttaaatggggagagtcgtcaaccaggggtaatttgagagttatgggctggaaccaccttgaggcatctttattcataggctagcaattgatgttggctgttggctgggacgtcagctggagctgtcaactgggagacctgtctgatatcccagcataggacactagacctctcacaaagtggcgagggctccagaagcaagtgtcccagctgaca

SEQ ID NO: 51574 - DNA, 601 bp, Human
cttgagaggctgaggtgggaggattgcttgagcgcaggagtttgaggctgcagtgagccatgaccacaccactgtactccaccctgggtgacagagcaagaccctgtctctctttctaaaaaaacaaaacaaaacaaaacaaaacaaaaagaaaaaaagatgtccaagtgtgttctggttactgctgctgactgctaaatttaacagctagaaaaaaaaagtttggactctatggatcataaatttggataagacacagagggaatggcttgtctcatgttcacaatgtctaaagtcttaratggggagagtcgtcaaccaggggtaatttgagagttatgggctggaaccaccttgaggcatctttattcataggctagcaattgatgttggctgttggctgggacgtcagctggagctgtcaactgggagacctgtctgatatcccagcataggacactagacctctcacaaagtggcgagggctccagaagcaagtgtcccagctgacaaaaaaaaaaagtttcatagccttctacgacatgcacttagaagtggtaatgtgtcacttccagccctttctgttgattacaagtgagtc

SEQ ID NO: 51575 - DNA, 601 bp, Human
acaaaggctatatttattacaaaatgtatttaaataaatacttaatatttatttaaataaataatatttattttattattaataattaatatttaaataaatataatatttcttacaaaaattaaaaactgggactttatatttaaaggtgagacattaaattctttttaaaaagtgcacatgtaagatttttttctcaagtcaactgaaccagttcatcagtttcactatgaatgtgttgatgcaccaagtatttactttctagaacatctagtagacgtcactaaaaaattataccaasttgaaaaatgtcactgaatcagaggcatgtggttggttatgtagtcatctgtgccagctgggaatatagcaataccaaatgaacagcactgccatgttcccttgctgggttccagcaaaaacactcatcttcactgtcgtctctctttgagacctcttagagaggactttgatgagtgtatggtcttatacacactagtctaacaatacacatttgctcaaggattgggttacgagcaggctcttcacctttcaggtgaacaattacacatcaggagaaggatggaagtttcctatctat

SEQ ID NO: 51576 - DNA, 601 bp, Human
taaataatatttattttattattaataattaatatttaaataaatataatatttcttacaaaaattaaaaactgggactttatatttaaaggtgagacattaaattctttttaaaaagtgcacatgtaagatttttttctcaagtcaactgaaccagttcatcagtttcactatgaatgtgttgatgcaccaagtatttactttctagaacatctagtagacgtcactaaaaaattataccaagttgaaaaatgtcactgaatcagaggcatgtggttggttatgtagtcatctgtgccarctgggaatatagcaataccaaatgaacagcactgccatgttcccttgctgggttccagcaaaaacactcatcttcactgtcgtctctctttgagacctcttagagaggactttgatgagtgtatggtcttatacacactagtctaacaatacacatttgctcaaggattgggttacgagcaggctcttcacctttcaggtgaacaattacacatcaggagaaggatggaagtttcctatctatgaacaaatatttcccaaagcaataatctctttattcaactcacataatgagaagtca

SEQ ID NO: 51577 - DNA, 601 bp, Human
ccaagtatttactttctagaacatctagtagacgtcactaaaaaattataccaagttgaaaaatgtcactgaatcagaggcatgtggttggttatgtagtcatctgtgccagctgggaatatagcaataccaaatgaacagcactgccatgttcccttgctgggttccagcaaaaacactcatcttcactgtcgtctctctttgagacctcttagagaggactttgatgagtgtatggtcttatacacactagtctaacaatacacatttgctcaaggattgggttacgagcaggctcttyacctttcaggtgaacaattacacatcaggagaaggatggaagtttcctatctatgaacaaatatttcccaaagcaataatctctttattcaactcacataatgagaagtcagttcctctgtgccataaagcaatctctttgaagtcttcagtaatgttgagggttttaatgttgagggctttatcaaactaaacattcaagtgtcttaggctttccccttagttctttgagcaaattggttgctatgaagtatgttagtgttccgaatgaatggatagcatgatgggggatgtctaggtg

SEQ ID NO: 51578 - DNA, 601 bp, Human
gtcatctgtgccagctgggaatatagcaataccaaatgaacagcactgccatgttcccttgctgggttccagcaaaaacactcatcttcactgtcgtctctctttgagacctcttagagaggactttgatgagtgtatggtcttatacacactagtctaacaatacacatttgctcaaggattgggttacgagcaggctcttcacctttcaggtgaacaattacacatcaggagaaggatggaagtttcctatctatgaacaaatatttcccaaagcaataatctctttattcaactcacrtaatgagaagtcagttcctctgtgccataaagcaatctctttgaagtcttcagtaatgttgagggttttaatgttgagggctttatcaaactaaacattcaagtgtcttaggctttccccttagttctttgagcaaattggttgctatgaagtatgttagtgttccgaatgaatggatagcatgatgggggatgtctaggtggttccagaatttagattgtggtttccataacaaagtgtggcagtattggcattagggaagagaaatgacttctaaataacttctcaaagtttactaaa

SEQ ID NO: 51579 - DNA, 601 bp, Human
cacactagtctaacaatacacatttgctcaaggattgggttacgagcaggctcttcacctttcaggtgaacaattacacatcaggagaaggatggaagtttcctatctatgaacaaatatttcccaaagcaataatctctttattcaactcacataatgagaagtcagttcctctgtgccataaagcaatctctttgaagtcttcagtaatgttgagggttttaatgttgagggctttatcaaactaaacattcaagtgtcttaggctttccccttagttctttgagcaaattggttgctrtgaagtatgttagtgttccgaatgaatggatagcatgatgggggatgtctaggtggttccagaatttagattgtggtttccataacaaagtgtggcagtattggcattagggaagagaaatgacttctaaataacttctcaaagtttactaaagccttaagaatgtaggaaatggccacaaaaggaggtatacaaaacattcctctgtctttattcctctttatacaaacgtattcactttcccatcagcaagtcataaaatacttctcatcttgcattacagtaggacacctactataa

SEQ ID NO: 51580 - DNA, 601 bp, Human
gtttccataacaaagtgtggcagtattggcattagggaagagaaatgacttctaaataacttctcaaagtttactaaagccttaagaatgtaggaaatggccacaaaaggaggtatacaaaacattcctctgtctttattcctctttatacaaacgtattcactttcccatcagcaagtcataaaatacttctcatcttgcattacagtaggacacctactataacaataggctacaaaatgtataatggctcaaacacctagcagtttatttcttatttacttaacaatgctgggtccaygaacatgttgatatcataaccctcttttatgtggtcactcagggactcaggctgttgagggctctgtcatcatgaatgggtggcttccaaggtcatcctaagagttatctccattctaaccagtccagccagaaaggcagaacaggcttggaggagcaaagatatccatggatagatcatcctcttaaagtcattgtagcattgtgatagggctcttttcacaaaacaaggatacagtccatgttttcaagattttacattttagtagccacaatacaaagaagctaagatagtcttgtg

SEQ ID NO: 51581 - DNA, 601 bp, Human
caaagtgtggcagtattggcattagggaagagaaatgacttctaaataacttctcaaagtttactaaagccttaagaatgtaggaaatggccacaaaaggaggtatacaaaacattcctctgtctttattcctctttatacaaacgtattcactttcccatcagcaagtcataaaatacttctcatcttgcattacagtaggacacctactataacaataggctacaaaatgtataatggctcaaacacctagcagtttatttcttatttacttaacaatgctgggtccacgaacatgttratatcataaccctcttttatgtggtcactcagggactcaggctgttgagggctctgtcatcatgaatgggtggcttccaaggtcatcctaagagttatctccattctaaccagtccagccagaaaggcagaacaggcttggaggagcaaagatatccatggatagatcatcctcttaaagtcattgtagcattgtgatagggctcttttcacaaaacaaggatacagtccatgttttcaagattttacattttagtagccacaatacaaagaagctaagatagtcttgtgatttgtcatc

SEQ ID NO: 51582 - DNA, 601 bp, Human
aagatagtcttgtgatttgtcatcatggctgttaatggagagtgttttaaaagcactgatatcagggctccaccctcagcttccaatcatcaggtttggatggaacctgacagctgcatcttgtaaaactccacgggagattctgagagacagccaagtttgagattcacaaaccttaagagaaaaaatctccttgaattgccataacaaactaccagtctaataaaacatacatattcctttgactactcttaaatgaaacaaataggtaataatttacctgtacatataattaaaaatktaatgtattttataaccatcatataaaggagaaattatattaaactatattaaaataaaatgatatatatttcaatgcagatgcccaagcttgactaaagtaggaaacataataaagtaataaaatgcttatatgtacttataatgaatgtttggctatgagaagatgatcagaggctttttgtccaagaagtacaggcatatgaaaaagtagagcaagagatggacaccagactgagaaaactaaaaactaaccaacctatttgtgtatgataaaaggagagaaaaaaaattgattagt

SEQ ID NO: 51583 - DNA, 601 bp, Human
gctgttaatggagagtgttttaaaagcactgatatcagggctccaccctcagcttccaatcatcaggtttggatggaacctgacagctgcatcttgtaaaactccacgggagattctgagagacagccaagtttgagattcacaaaccttaagagaaaaaatctccttgaattgccataacaaactaccagtctaataaaacatacatattcctttgactactcttaaatgaaacaaataggtaataatttacctgtacatataattaaaaatgtaatgtattttataaccatcatataarggagaaattatattaaactatattaaaataaaatgatatatatttcaatgcagatgcccaagcttgactaaagtaggaaacataataaagtaataaaatgcttatatgtacttataatgaatgtttggctatgagaagatgatcagaggctttttgtccaagaagtacaggcatatgaaaaagtagagcaagagatggacaccagactgagaaaactaaaaactaaccaacctatttgtgtatgataaaaggagagaaaaaaaattgattagtaaaaatatgctaccgtgtggtctgaat

SEQ ID NO: 51584 - DNA, 601 bp, Human
aggagtgggactggtagctttataagagaaggaagagagacctgcgctagcacactcagcctccttgccatgtgagccatctcgggaccccgcagagtccccagcagaaagaaggccctcacccaatgtgtccccttgacctaggatttctcaacctccataactgtaggaaatgaattccttttctttgtaaattatccagtttcaggtattctgttataaacaacagaaaatgggctaaaacacacgccaagaaaattgaaagactgtggaagtgaaagaagaataaaaaatgaagtawttttgcaaatgagtctggctttattataagtgtattgtcaaagtgattccctttgttataagatgaaaaagagccaaaatggatagaaacatttatcctatcttaatatcccactacattcaaggcaaatattcagtcagtctctagaacttaacaaggccttggagatgatatcctttggatgagcaatggagaagacaagatggattggaaaaagaaacaaacaaacaaaaaaacatgtaagaggctatcaggaaaactctggagacgatgtcaatgtaaaacagatacaaacctcaa

SEQ ID NO: 51585 - DNA, 601 bp, Human
ttgccaaattgcataaagtgaataagctatttaataatttggagaaaatatattccatttaaacttccttctctataaccagttcatacactggaccttttgggcacagccatgtgaaagcttttcaaaacttttcactacttttttttgagacggagtctcactctgtcacccaggctagagtgcagtggtgcgatctcggctcactgcaacctccacctcccaggtccaagtgattctcctgcctcagcctcccgagtagctgggattacaggcacctgacaccacacctgactaattkttgtaattttagtagagacaggatttcaccatgttggccaggatggtcttgaactcctcatctcaagtgttccgcctgccttggcctcccaaagtggtgggttacaggcatgagtcattgcacccagccactatagatttttatttgtagtagatttagttcagtagggcatttgagaggcataggaactggaacaaatccttcattgtttgggactgccttgcacattgtaggacatccagtacagtcccttccacgaagtggcagcagcagcctcgggctgtccaaacaccctgttag

SEQ ID NO: 51586 - DNA, 601 bp, Human
gagacaggatttcaccatgttggccaggatggtcttgaactcctcatctcaagtgttccgcctgccttggcctcccaaagtggtgggttacaggcatgagtcattgcacccagccactatagatttttatttgtagtagatttagttcagtagggcatttgagaggcataggaactggaacaaatccttcattgtttgggactgccttgcacattgtaggacatccagtacagtcccttccacgaagtggcagcagcagcctcgggctgtccaaacaccctgttagggacagtgccactcycggaaccacagaagaaccacaatcataggagaagcatacaacaaacatggtgttcatcggacggtcagcttcagtggcacttttgagcaagcacactatttggttgtagaatgagtccctggcagggcacccgaaaggctgatgtgtgactcatccctagtacctctgagaatgctgaaatctcctccttctccaagctgagtggcagctttctggtccagactacttaaattgtgacttgaggaattttcttcactttttcctttgagtcattctgtttttgatcaagatgcgatagaa

SEQ ID NO: 51587 - DNA, 601 bp, Human
gaaaagtgctgagaaatggagaagggggttcctctggggtggagatggaaagaggaaaaggaagggagaatgtccaagcaaaatgagagaaggtgagggacagcagaattgagagtgagggagagggagagagcaagagactgggttgagatgtcttgtacatgggggtgtcctcgtggcttcactcccctttcgtttgtaccactccgtttccccagactcttcctaaatatccccttattggctacaagatccagattgcctagaagctcagatttgctgacagcacctcaagactggwtaatgacatatagattttttcttgtttccatctttgggatttggagcaatctccagagttgcaaaagcctaccttgttgcaataatatttttgagggtccacactgtctgctcacttgctctatgctgctgggcacagtggtgtggccatccagggtgggagagaccacctgggatatggaaattaccagcagccctgttttgctcttgcagtggttgccaaagcacacgaagcattctgggaatctgaatttctgttgtttctcccaaatggcccctgaagggcaacaggcagcacaca

SEQ ID NO: 51588 - DNA, 601 bp, Human; identical to SEQ ID NO: 18012

SEQ ID NO: 51589 - DNA, 601 bp, Human; identical to SEQ ID NO: 18013

SEQ ID NO: 51590 - DNA, 601 bp, Human; identical to SEQ ID NO: 18014

SEQ ID NO: 51591 - DNA, 601 bp, Human; identical to SEQ ID NO: 18015

SEQ ID NO: 51592 - DNA, 601 bp, Human; identical to SEQ ID NO: 18016

SEQ ID NO: 51593 - DNA, 601 bp, Human; identical to SEQ ID NO: 18017

SEQ ID NO: 51594 - DNA, 601 bp, Human; identical to SEQ ID NO: 18096

SEQ ID NO: 51595 - DNA, 601 bp, Human; identical to SEQ ID NO: 18097

SEQ ID NO: 51596 - DNA, 601 bp, Human; identical to SEQ ID NO: 18098

SEQ ID NO: 51597 - DNA, 601 bp, Human; identical to SEQ ID NO: 18099

SEQ ID NO: 51598 - DNA, 601 bp, Human; identical to SEQ ID NO: 18100

SEQ ID NO: 51599 - DNA, 601 bp, Human; identical to SEQ ID NO: 18101

SEQ ID NO: 51600 - DNA, 601 bp, Human; identical to SEQ ID NO: 18102

SEQ ID NO: 51601 - DNA, 601 bp, Human; identical to SEQ ID NO: 18103

SEQ ID NO: 51602 - DNA, 601 bp, Human; identical to SEQ ID NO: 18104

SEQ ID NO: 51603 - DNA, 601 bp, Human; identical to SEQ ID NO: 18105

SEQ ID NO: 51604 - DNA, 601 bp, Human; identical to SEQ ID NO: 18106

SEQ ID NO: 51605 - DNA, 601 bp, Human
tcttgcttctcccatgggaacttagttgccagaaatccttcttcacaaagccctgctgactatatgcacttcctattctgtctacctccttcttgttggaacttcattgacctctttgggaagcttgagatctccccacactggcacctctcagacttcttcttctctccactggcttctgcttctgcttccatgttttttcaccttcattctttcattcagttcccttgaatccttgatatgtctgctttcaagcccctacctcctcccatgcctctgtccacctgtcagacctattccyttcctactcaagcccctcaatcacttgaattttaagctcgttgctctcaacagacttaaggtctccccaaaacaacctgaggatgaaaaaggaaaaagccacagcctccatatacatatcagggcaagggaaggtcgtgaaggtcgtctccacaaatattggtacacaggtaaccttaattttatcccaactgccaggaacaaagtggagaaaagatgagagccaactattttgtacaaatcagtgagttgtgtgctatgttttacgactcatggctaaaattttttaaatgaaagccat

SEQ ID NO: 51606 - DNA, 601 bp, Human
gacataaaaggcttattggtttgtgttgtgagtcacttaatagacacctttggtttgaaaaggtcaatactgccaggaatatttactgtttgtcctggctcaaacctgatagtaggatatttgaaagaatttgttttttaagagtctatggtcaggagttggccaaactgtaggctgacattcagaacctgatatgatacacacacacacacacacacacacacacacacacacaccatttttttaaggctactctgttctctgttttggatcttgcttctcccatgggaacttagttgcyagaaatccttcttcacaaagccctgctgactatatgcacttcctattctgtctacctccttcttgttggaacttcattgacctctttgggaagcttgagatctccccacactggcacctctcagacttcttcttctctccactggcttctgcttctgcttccatgttttttcaccttcattctttcattcagttcccttgaatccttgatatgtctgctttcaagcccctacctcctcccatgcctctgtccacctgtcagacctattcccttcctactcaagcccctcaatcacttgaa

SEQ ID NO: 51607 - DNA, 601 bp, Human
ttgctatccaattttcccagaaccatttattaaataggatgtcctttccccaaatttatatttttgaatgctttgtcaaagatcagttggttttaagtatttggctttatttttgggttctgtattctgctctgttgatacatgactgctagatctgataaatgaattcagtaaagtttcaagttacaaaatcaatgtacacaaataatgtatataaatcagcagcactgctatataccaataatgacaaaactgagaatcaaaccaataactcaatctcttttagaatagctacaaaaayatataagaatatacttaaccaagaaccaatagttctaaaaggagaactattatacaaaacatggctgaaagaaataatagatgatgcaaacacatggaaatacatcccatgctcatggattggaagaatcaatattgtgaaaatgagaccacaaagcccaaagcaatctacatattcagtgtaattcctatcaaaataccaacatcatctttcacagaattagaaaaaacaatcctaaaattcatatggaaccaaaaaagagtccaaacagccaaagcaatcctaaacaaaaagaacaat

SEQ ID NO: 51608 - DNA, 601 bp, Human
aaataaataaacaacaacaagcctcaagggggagaggatcaatgcccagagttgatagcatatattatatacgagttgctaccatatattatatataaggtccagtttccaacaacacacacaaaaaatgagacattcaaagaaataggcattatttcattctttctatgctgaagagtatttcatgatgtgtgtgtgtatatgtatatacatacaccatatatatatacacgcaccatatatatatatatacacacacaccatatatatatacacacacacacacacacacacacacacyatatatatatggtatatatatatttcctttatccactcatcagttgatgggcacttaggttgattccatatgtttcaattgtgaattgtgctacataaacatatgtgtgcaggtgactttctgatacagtgacttcttttcttttgggtagatatccagtagtaggattgcaggaatgaatggcagatcaatcaatttagttctttgataaatctccacattgttttccatataggttgtactaacttcattctcaccagcagtggataagcattctcttttcaccacatgtatgccaac

SEQ ID NO: 51609 - DNA, 601 bp, Human
taaataaataaacaacaacaagcctcaagggggagaggatcaatgcccagagttgatagcatatattatatacgagttgctaccatatattatatataaggtccagtttccaacaacacacacaaaaaatgagacattcaaagaaataggcattatttcattctttctatgctgaagagtatttcatgatgtgtgtgtgtatatgtatatacatacaccatatatatatacacgcaccatatatatatatatacacacacaccatatatatatacacacacacacacacacacacacacaccatatatatatggtatatatatatttcctttatccactcatcagttgatgggcacttaggttgattccatatgtttcaattgtgaattgtgctacataaacatatgtgtgcaggtgactttctgatacagtgacttcttttcttttgggtagatatccagtagtaggattgcaggaatgaatggcagatcaatcaatttagttctttgataaatctccacattgttttccatataggttgtactaacttcattctcaccagcagtggataagcattctcttttcaccacatgtatgccaa

SEQ ID NO: 51610 - DNA, 601 bp, Human
agtaaataaataaacaacaacaagcctcaagggggagaggatcaatgcccagagttgatagcatatattatatacgagttgctaccatatattatatataaggtccagtttccaacaacacacacaaaaaatgagacattcaaagaaataggcattatttcattctttctatgctgaagagtatttcatgatgtgtgtgtgtatatgtatatacatacaccatatatatatacacgcaccatatatatatatatacacacacaccatatatatatacacacacacacacacacacacacayaccatatatatatggtatatatatatttcctttatccactcatcagttgatgggcacttaggttgattccatatgtttcaattgtgaattgtgctacataaacatatgtgtgcaggtgactttctgatacagtgacttcttttcttttgggtagatatccagtagtaggattgcaggaatgaatggcagatcaatcaatttagttctttgataaatctccacattgttttccatataggttgtactaacttcattctcaccagcagtggataagcattctcttttcaccacatgtatgcc

SEQ ID NO: 51611 - DNA, 601 bp, Human
aagtaaataaataaacaacaacaagcctcaagggggagaggatcaatgcccagagttgatagcatatattatatacgagttgctaccatatattatatataaggtccagtttccaacaacacacacaaaaaatgagacattcaaagaaataggcattatttcattctttctatgctgaagagtatttcatgatgtgtgtgtgtatatgtatatacatacaccatatatatatacacgcaccatatatatatatatacacacacaccatatatatatacacacacacacacacacacacacacaccatatatatatggtatatatatatttcctttatccactcatcagttgatgggcacttaggttgattccatatgtttcaattgtgaattgtgctacataaacatatgtgtgcaggtgactttctgatacagtgacttcttttcttttgggtagatatccagtagtaggattgcaggaatgaatggcagatcaatcaatttagttctttgataaatctccacattgttttccatataggttgtactaacttcattctcaccagcagtggataagcattctcttttcaccacatgtatgc

SEQ ID NO: 51612 - DNA, 601 bp, Human
ctaaaatactccagcaaatcactaagtaaataaataaacaacaacaagcctcaagggggagaggatcaatgcccagagttgatagcatatattatatacgagttgctaccatatattatatataaggtccagtttccaacaacacacacaaaaaatgagacattcaaagaaataggcattatttcattctttctatgctgaagagtatttcatgatgtgtgtgtgtatatgtatatacatacaccatatatatatacacgcaccatatatatatatatacacacacaccatatatatatayacacacacacacacacacacacacaccatatatatatggtatatatatatttcctttatccactcatcagttgatgggcacttaggttgattccatatgtttcaattgtgaattgtgctacataaacatatgtgtgcaggtgactttctgatacagtgacttcttttcttttgggtagatatccagtagtaggattgcaggaatgaatggcagatcaatcaatttagttctttgataaatctccacattgttttccatataggttgtactaacttcattctcaccagcagtggataagca

SEQ ID NO: 51613 - DNA, 601 bp, Human
gggaagaaggagggaacagagttaactaaaatactccagcaaatcactaagtaaataaataaacaacaacaagcctcaagggggagaggatcaatgcccagagttgatagcatatattatatacgagttgctaccatatattatatataaggtccagtttccaacaacacacacaaaaaatgagacattcaaagaaataggcattatttcattctttctatgctgaagagtatttcatgatgtgtgtgtgtatatgtatatacatacaccatatatatatacacgcaccatatatatatayatacacacacaccatatatatatacacacacacacacacacacacacacaccatatatatatggtatatatatatttcctttatccactcatcagttgatgggcacttaggttgattccatatgtttcaattgtgaattgtgctacataaacatatgtgtgcaggtgactttctgatacagtgacttcttttcttttgggtagatatccagtagtaggattgcaggaatgaatggcagatcaatcaatttagttctttgataaatctccacattgttttccatataggttgtactaactt

SEQ ID NO: 51614 - DNA, 601 bp, Human
aaggaattgatatttgacacagagcatagagaggtttaagactaatgttgttctaaaaaataatggaggttttggtgaaaagaaaaaagaaaccagtggcttcactataggcataagctaaaccacaaccctgcctaatatcctgttgagaaccacccagcctagtatcctgttgctccactaaaaatgacagtatcacaacacacagtttctttaatgtccgttgctgacccccggaaaaaaattcagcttttatacagtcaacattctttatatctgaaggatgaaaaacagcacaaawatcttgaaaactatgaagtcccagaatctattggtctccagatcttagtggtcatttcttacttagcaaactgtatgaatagacatgttcatgtgaaagattactttgtacattctgtttctgaaacacagaatatagaatcccagaagattcactcctctagactgagtgaggtaacgagctctaatatgcaaatatgtggatttgaaagcatagttctgcatttaactgaaaagtatcaaaagcttctcagtgaaaataaaattatagatgaacagcctaaacatcagtcagatatct

SEQ ID NO: 51615 - DNA, 601 bp, Human
tatagtatatatagatatcaaatacacactaaggtcagctaaatatatgtaacatagttctcacattgccatcactgtttactaaatagtcacaactatgggctgggatcaaaagaagtatgagacataatccctactttaagagattccacagtcacagaatacttatagtacacagttctatttcaggctttgcagaccattaaaaaattactttcataatcagagatttcaatatccatctcttagtaattgatagtacaactagatggacaatcagcaaggatataagagatttgawcaacactaccaaacaacatgccatctataaatgcctccatctagcaacagcaggatgcacattcttttcaagcgcacatggaacactgaccaaactacaccatactctgatccataaagcaagtcctcataaatacaggaagattcaagtcacacaaagtacttttttaaccactatagaattaaatcagaaatgaataactgaaaaccttctggaaaagtcaaaaatatttacaaactatcaaatttctaaataatcaatagatcaaaggaaaaataaaaagagaaattagaattttca

SEQ ID NO: 51616 - DNA, 601 bp, Human
tatttcacatttttaaagacttttttataatataatatttactgaatgtgtattgtatgttcctagtcaaatgcaaaggtcaatggcgtttcaactggatcaaattttgaattcgtagctaaactgtagagacatatatggcatacagattaattttttgttataactgttttccaactaaaatacatcaaataaaaagcaaaagtaaggatgttttcactgaaaagacatctcatctaaatataactttcgttctcatgtaagaagtaaaaaatatatatatatatgtatgggtgtgtgyatatatagtatatatagatatcaaatacacactaaggtcagctaaatatatgtaacatagttctcacattgccatcactgtttactaaatagtcacaactatgggctgggatcaaaagaagtatgagacataatccctactttaagagattccacagtcacagaatacttatagtacacagttctatttcaggctttgcagaccattaaaaaattactttcataatcagagatttcaatatccatctcttagtaattgatagtacaactagatggacaatcagcaaggatataagagatt

SEQ ID NO: 51617 - DNA, 601 bp, Human; identical to SEQ ID NO: 18107

SEQ ID NO: 51618 - DNA, 601 bp, Human; identical to SEQ ID NO: 18108

SEQ ID NO: 51619 - DNA, 601 bp, Human; identical to SEQ ID NO: 18109

SEQ ID NO: 51620 - DNA, 601 bp, Human; identical to SEQ ID NO: 18110

SEQ ID NO: 51621 - DNA, 601 bp, Human; identical to SEQ ID NO: 18111

SEQ ID NO: 51622 - DNA, 601 bp, Human; identical to SEQ ID NO: 18112

SEQ ID NO: 51623 - DNA, 601 bp, Human; identical to SEQ ID NO: 18113

SEQ ID NO: 51624 - DNA, 601 bp, Human; identical to SEQ ID NO: 18114

SEQ ID NO: 51625 - DNA, 601 bp, Human; identical to SEQ ID NO: 18115

SEQ ID NO: 51626 - DNA, 601 bp, Human; identical to SEQ ID NO: 18116

SEQ ID NO: 51627 - DNA, 601 bp, Human; identical to SEQ ID NO: 18117

SEQ ID NO: 51628 - DNA, 601 bp, Human; identical to SEQ ID NO: 18118

SEQ ID NO: 51629 - DNA, 601 bp, Human; identical to SEQ ID NO: 18119

SEQ ID NO: 51630 - DNA, 601 bp, Human; identical to SEQ ID NO: 18120

SEQ ID NO: 51631 - DNA, 601 bp, Human; identical to SEQ ID NO: 18121

SEQ ID NO: 51632 - DNA, 601 bp, Human; identical to SEQ ID NO: 18122

SEQ ID NO: 51633 - DNA, 601 bp, Human; identical to SEQ ID NO: 40229

SEQ ID NO: 51634 - DNA, 601 bp, Human; identical to SEQ ID NO: 40230

SEQ ID NO: 51635 - DNA, 601 bp, Human
ctgagtagtgatgaccttccccagaatggcaacagcaggatggttataaggggagggttggggatggggaggtgggggtagactctattagggcagggagcaggatcagtgtctagtgctcctggtctgccttgaagacttgcactagtcattggcccttgggatgatctctctgcttaatcactggatgccgccccctcctttcttttccccacctccaacctctggagctttctctcacctccactttcattctcctttctcagaatgtagacaaaagcaagttacccgcccccccccmaaaaaaaatccaccaaaattaggtaaataaatcccagtaccgtttcccaaaacgtgtctgaaatcaaacacaactcctcctcaactgcgtatttggagtggactgcatggagtggggatggagggagacctccctcccaagaaaacttagccctttgggctactgcaatccccctccatccccttcggttctaccctttggttatttacaagctggacttcacttacccaaggaaagaaagaagtctgtgtagagaaaaaacatccaagaaagatgccgcgccaagcggttctgtctccc

SEQ ID NO: 51636 - DNA, 601 bp, Human
ctaaatacgatattttccaagcctccaggccctcctcctttgcaaaatgaactgacctatggttgtgttctggggtctgcattggggaattagttcactgtccaaggcaaattcctgtggcaggaactgcacccttaggatgcaacatcattcggccaatcaacaaacatttattgagcatcacttgtgtacaagacaggttgcaggtccccattaaaagttatttggggccctgagtagtgatgaccttccccagaatggcaacagcaggatggttataaggggagggttggggatgggsaggtgggggtagactctattagggcagggagcaggatcagtgtctagtgctcctggtctgccttgaagacttgcactagtcattggcccttgggatgatctctctgcttaatcactggatgccgccccctcctttcttttccccacctccaacctctggagctttctctcacctccactttcattctcctttctcagaatgtagacaaaagcaagttacccgcccccccccaaaaaaaaatccaccaaaattaggtaaataaatcccagtaccgtttcccaaaacgtgtctgaaatcaaa

SEQ ID NO: 51637 - DNA, 601 bp, Human
cattcaacatatatattgaaccccttccaagtgccatcactgtgctatgtgctggccatatggcagagaacaagacagagatcttgccttcatggggcttactatctagtgccataaggtcctgttagattgttgttgcctttacttacgcatagaaattgcccagctcattcctatgcctgccagctggggtcctaaaatcccacactagcagctgatctctaagttgcatgctactctacggcaccttgaggcttctggggagccctatgtcagcagcatctttctcaccatccatccstcactatcacatcaaggtttctgagtccaagagcaagacctacagaggtccgctgtggtctgtgggaaaggtgagtgctttgtcactgggctgtcacaggcaccccaggctggagccctgaattctctgcaaaccccgttcaggcaaaactggtaccaatctgatggtgctactctgactcttcagccctttaggcaggttcccgggtgcttcagaaccatcttccctggactctgtaaccacactttgcctctctctactaggactgggaggatggctaagacatagaaatcaaacaaa

SEQ ID NO: 51638 - DNA, 601 bp, Human
cttccagataaggttactaaaatttgttgttcattcaacatatatattgaaccccttccaagtgccatcactgtgctatgtgctggccatatggcagagaacaagacagagatcttgccttcatggggcttactatctagtgccataaggtcctgttagattgttgttgcctttacttacgcatagaaattgcccagctcattcctatgcctgccagctggggtcctaaaatcccacactagcagctgatctctaagttgcatgctactctacggcaccttgaggcttctggggagccctrtgtcagcagcatctttctcaccatccatccgtcactatcacatcaaggtttctgagtccaagagcaagacctacagaggtccgctgtggtctgtgggaaaggtgagtgctttgtcactgggctgtcacaggcaccccaggctggagccctgaattctctgcaaaccccgttcaggcaaaactggtaccaatctgatggtgctactctgactcttcagccctttaggcaggttcccgggtgcttcagaaccatcttccctggactctgtaaccacactttgcctctctctactaggactgg

SEQ ID NO: 51639 - DNA, 601 bp, Human
cacaccattgcttgggcgggcacacttcgtgcccctcccctatgccttgccagccccacccttctcacaaaccacccctcctcctgcttctactctgacctgagcctaactagctgctaggtttggtaataagattgaacgaagactcaggaggccctgtgggctccattattctgcatgccctgcgagaacggcccacccctagggacggctgctgcaactcgagccccacttgctgccaggaaacctttcccactgaggacacccgggcatgcggcgcagctccaggtccagggggaarcaccccacccatctgccagagagacaaagatcaccagaaacaaaggacacacacacacacacacacacacacacacactcgcacactcaaagtcaaaagcaaataccgacacttgcaatttcaaaccaaacagtcggcttggtctatctaaatagatctggagacaatctaggagggacaatgattatgtggtaatgacaggcactatctgggttcggaacccacgctgcctccgccctcctcccacccgcgctgcagttcccaggcgcatttcccagcctcaggacacacgctgccaga

SEQ ID NO: 51640 - DNA, 601 bp, Human
tacaaatgagatcattcctaaaaagtgttctgtaaactgaaaggtgctatgcacataaggtatgggcttctccagaattttgcattaaagtgtgcactaaaagtgtagcatttaaaaaaaaatccacctccactcctagagctttgcttctttcttaagtggattaaagtgcctaaaaatagccacactccaatagctaatatgagccaaattatttattggacactgaccatatcttcagcaggctagatcagtccacccatccaccctcactgcacttctattcagccttcttacttckggtcaaagacgagaaaagaaggaaaacagcgcactggaggtttagagcgagctggagcttgcaaggaagtgggaatatcagcgtcctttctgatatgccactatttggggatattcttcctttctccttatttgtactttgccatttatagctgagaggcgtcctgcaatttccatgaggcataaagccttcagtcctctccagtccatcctgccaaccttccattcattcagcaaagggttattgagtgccaggcactttccagggcactggggttatggcaataaacaagacagagaa

SEQ ID NO: 51641 - DNA, 601 bp, Human
agtaaatatgaggtctttatttccccattgtaggtgatggtaatgagccagacatagataaactgtaaagtctccgctgagagtacccctaggaccagaccccagaagtggaaggtccctttgacctccatgattcttatggagagaaatcacccaggtgggtggaaccaacagggtgaccacactcctagtgccatggttaggtagattctgtaaacatgccatgcagagctaagcccctaactcactctaacctcatctggatcatccagtaggtgccctttataagaatcagagtacwgaaaaagattgtcatttttatccacctttctgcatcagccaagggagctgtccaaactgaaacttcctaactggctatcagtagaatggcttctttccattttatcattaaactcttcctctaatttcctgtagactaaaagtcaaaaggaaatcactagctcactgtgcctatattaaatatacttcacaccatatctcagttgtggttgaagtttcctaatgaggggaaagactatattatattttttaaatgcatcagatttaaggtggggttcatatggagccaaagtacagatgt

SEQ ID NO: 51642 - DNA, 601 bp, Human
agtcctagacactcacagggagaaaaaaaaaactcttaaactgtggctgcaaatgacaaatagatgttctagcaagtaaatatgaggtctttatttccccattgtaggtgatggtaatgagccagacatagataaactgtaaagtctccgctgagagtacccctaggaccagaccccagaagtggaaggtccctttgacctccatgattcttatggagagaaatcacccaggtgggtggaaccaacagggtgaccacactcctagtgccatggttaggtagattctgtaaacatgccatgyagagctaagcccctaactcactctaacctcatctggatcatccagtaggtgccctttataagaatcagagtactgaaaaagattgtcatttttatccacctttctgcatcagccaagggagctgtccaaactgaaacttcctaactggctatcagtagaatggcttctttccattttatcattaaactcttcctctaatttcctgtagactaaaagtcaaaaggaaatcactagctcactgtgcctatattaaatatacttcacaccatatctcagttgtggttgaagtttcctaatgag

SEQ ID NO: 51643 - DNA, 601 bp, Human
gtcaggtttcattttcaattcagagtactcagtcctagacactcacagggagaaaaaaaaaactcttaaactgtggctgcaaatgacaaatagatgttctagcaagtaaatatgaggtctttatttccccattgtaggtgatggtaatgagccagacatagataaactgtaaagtctccgctgagagtacccctaggaccagaccccagaagtggaaggtccctttgacctccatgattcttatggagagaaatcacccaggtgggtggaaccaacagggtgaccacactcctagtgccayggttaggtagattctgtaaacatgccatgcagagctaagcccctaactcactctaacctcatctggatcatccagtaggtgccctttataagaatcagagtactgaaaaagattgtcatttttatccacctttctgcatcagccaagggagctgtccaaactgaaacttcctaactggctatcagtagaatggcttctttccattttatcattaaactcttcctctaatttcctgtagactaaaagtcaaaaggaaatcactagctcactgtgcctatattaaatatacttcacaccata

SEQ ID NO: 51644 - DNA, 601 bp, Human
ctttttaaactgtaaataccaccagccccaccacactgggtagttgagtaagggagaaaggaccctttgcacaagcgagagcaattgagatcaagactctgcaggatttggggggatggcggtggggagggaacaagggaatgaagaaaagaaggacgggaggaatgaaggaaaagttccctgtgatcacctggcttatgtatggcagtaaatcctatgttttcctttctaatcttgtttccccaccattccactctgcttcaaagttacttccatggaaagggtaagtgatgagactagmagttattggtaatacaaaacctaaaatctcctgaaatcccatccatctcccagcctcatccccactacctccaatgcccacccctccccatctccctggctctgggaatggcaaaggaaaagaatgcaatgctccctcatgaccgtgccctcccctgccagtgattatgacccttactccctcccttcaaccctaaatggaggattaggaagtcaggtttcattttcaattcagagtactcagtcctagacactcacagggagaaaaaaaaaactcttaaactgtggctgcaaatgacaa

SEQ ID NO: 51645 - DNA, 601 bp, Human
ttaccgtgacttccaggctctccatcacccgaccaaattttcattttctattcaagcaactctttttaaactgtaaataccaccagccccaccacactgggtagttgagtaagggagaaaggaccctttgcacaagcgagagcaattgagatcaagactctgcaggatttggggggatggcggtggggagggaacaagggaatgaagaaaagaaggacgggaggaatgaaggaaaagttccctgtgatcacctggcttatgtatggcagtaaatcctatgttttcctttctaatcttgttyccccaccattccactctgcttcaaagttacttccatggaaagggtaagtgatgagactagcagttattggtaatacaaaacctaaaatctcctgaaatcccatccatctcccagcctcatccccactacctccaatgcccacccctccccatctccctggctctgggaatggcaaaggaaaagaatgcaatgctccctcatgaccgtgccctcccctgccagtgattatgacccttactccctcccttcaaccctaaatggaggattaggaagtcaggtttcattttcaattcagagtac

SEQ ID NO: 51646 - DNA, 601 bp, Human
ttgttgctagcttgcatgtcaaaattatgaatattggtgttttaggcgtctgcaaaggttaccgtgacttccaggctctccatcacccgaccaaattttcattttctattcaagcaactctttttaaactgtaaataccaccagccccaccacactgggtagttgagtaagggagaaaggaccctttgcacaagcgagagcaattgagatcaagactctgcaggatttggggggatggcggtggggagggaacaagggaatgaagaaaagaaggacgggaggaatgaaggaaaagttccckgtgatcacctggcttatgtatggcagtaaatcctatgttttcctttctaatcttgtttccccaccattccactctgcttcaaagttacttccatggaaagggtaagtgatgagactagcagttattggtaatacaaaacctaaaatctcctgaaatcccatccatctcccagcctcatccccactacctccaatgcccacccctccccatctccctggctctgggaatggcaaaggaaaagaatgcaatgctccctcatgaccgtgccctcccctgccagtgattatgacccttactccc

SEQ ID NO: 51647 - DNA, 601 bp, Human
gagggtgacattttgcctggagtctaggttaaatgactataacatgtatttaatctcctttcaggttattgtaagaatgtagaggccgaaacagatctatcataatcacctcccatatggcctcaaattccaccatgagggataaattcctttggcctaaagcaacattcttagccagtagaatccaggagctggcccaggttagtccacagttaacatgggtaacaacactccccagttctcagaggaaaatataaattaataaatagactttattcatctctaagcttttcctcccatyaatttttcttaaacacttggtgcctgacttttgtctcagaggacgaagtaagtgaatgttggatgtcaaaccttttatcacacctaatatcaagcatctctattctgcctgtcaggctcatatcacattaaatttagtaagctatactatttatctttatcatgctaaatatttggtgtgtgattatttaggggatctcgagttctgcttgcacataagaaactcattttcttggtagtaaaattgttgctagcttgcatgtcaaaattatgaatattggtgttttaggcgtctgcaaag

SEQ ID NO: 51648 - DNA, 601 bp, Human
tctaccgtgtaaggacacagcaagaaggcaccatctatgagctgaaaagtgggccctcaccagatgccaaatctaccagtgccttgatcttggacctcccagcctccagaacagtgagaaataaatttctgttgtctataatctatctagtttatggaattttattaaagcagccgaaatcaactatgatacactgctaataaaatgggtacattaactcagactcaaatattgtgattccaagccatgttctttcactggtcttttctctgagttaaccaggacagcctaggttgtttamatctgaactaagaatactaagagtcttccagagtatcaggagggttgtgctctgctatggaccacttcctggatgatccagacagtgaaccagatgcttccaagaggctgagctggaggctaccctgacttcacaggctgcctcctgcaactgtgagaacagcacaaggcaggtaccactcatggagccttcatgatgatccggcattcttctaagagctttgcatgtatcactttatgtaatccacataacaaaccaaagaagtaatggctgtaattatccctatcttgcagatgaaga

SEQ ID NO: 51649 - DNA, 601 bp, Human
tcatctcagcaactgtgaagtggttgttattgtgatctttattttacccaaaagaaaactaatgctaggaaaggttaggtgacttggccaagttcacacagtgttatggtctgaatgtgtccccccagaattcatatgttgaaatcctaaccccaaaggtaatgttattaggagatggggcctttggaaggtaattaggtcatgggcatggagccttcatgattaggattagtgcacttatcaaagaagcccaagaaagacccatcactttttctaccgtgtaaggacacagcaagaaggmaccatctatgagctgaaaagtgggccctcaccagatgccaaatctaccagtgccttgatcttggacctcccagcctccagaacagtgagaaataaatttctgttgtctataatctatctagtttatggaattttattaaagcagccgaaatcaactatgatacactgctaataaaatgggtacattaactcagactcaaatattgtgattccaagccatgttctttcactggtcttttctctgagttaaccaggacagcctaggttgtttaaatctgaactaagaatactaagagtcttc

SEQ ID NO: 51650 - DNA, 601 bp, Human
ttttgggaaatgttggtctggaatttaacagtttatgaagtttattcacatttgtctcatttgatcatctcagcaactgtgaagtggttgttattgtgatctttattttacccaaaagaaaactaatgctaggaaaggttaggtgacttggccaagttcacacagtgttatggtctgaatgtgtccccccagaattcatatgttgaaatcctaaccccaaaggtaatgttattaggagatggggcctttggaaggtaattaggtcatgggcatggagccttcatgattaggattagtgcasttatcaaagaagcccaagaaagacccatcactttttctaccgtgtaaggacacagcaagaaggcaccatctatgagctgaaaagtgggccctcaccagatgccaaatctaccagtgccttgatcttggacctcccagcctccagaacagtgagaaataaatttctgttgtctataatctatctagtttatggaattttattaaagcagccgaaatcaactatgatacactgctaataaaatgggtacattaactcagactcaaatattgtgattccaagccatgttctttcactggtctt

SEQ ID NO: 51651 - DNA, 601 bp, Human
aacacattttgggaaatgttggtctggaatttaacagtttatgaagtttattcacatttgtctcatttgatcatctcagcaactgtgaagtggttgttattgtgatctttattttacccaaaagaaaactaatgctaggaaaggttaggtgacttggccaagttcacacagtgttatggtctgaatgtgtccccccagaattcatatgttgaaatcctaaccccaaaggtaatgttattaggagatggggcctttggaaggtaattaggtcatgggcatggagccttcatgattaggattmgtgcacttatcaaagaagcccaagaaagacccatcactttttctaccgtgtaaggacacagcaagaaggcaccatctatgagctgaaaagtgggccctcaccagatgccaaatctaccagtgccttgatcttggacctcccagcctccagaacagtgagaaataaatttctgttgtctataatctatctagtttatggaattttattaaagcagccgaaatcaactatgatacactgctaataaaatgggtacattaactcagactcaaatattgtgattccaagccatgttctttcact

SEQ ID NO: 51652 - DNA, 601 bp, Human
tagcttatgtctcacagaacacattttgggaaatgttggtctggaatttaacagtttatgaagtttattcacatttgtctcatttgatcatctcagcaactgtgaagtggttgttattgtgatctttattttacccaaaagaaaactaatgctaggaaaggttaggtgacttggccaagttcacacagtgttatggtctgaatgtgtccccccagaattcatatgttgaaatcctaaccccaaaggtaatgttattaggagatggggcctttggaaggtaattaggtcatgggcatggagscttcatgattaggattagtgcacttatcaaagaagcccaagaaagacccatcactttttctaccgtgtaaggacacagcaagaaggcaccatctatgagctgaaaagtgggccctcaccagatgccaaatctaccagtgccttgatcttggacctcccagcctccagaacagtgagaaataaatttctgttgtctataatctatctagtttatggaattttattaaagcagccgaaatcaactatgatacactgctaataaaatgggtacattaactcagactcaaatattgtgattcca

SEQ ID NO: 51653 - DNA, 601 bp, Human
taagccactaaatgttggggttatttgttacacaataatacagtaacatgctaacgtgcatgatgactctctaggaatgactgagcacgtatcatcctgcaaactgactttaccatgacaccacttttcttctcagagtatctgatgagtctagcttatgtctcacagaacacattttgggaaatgttggtctggaatttaacagtttatgaagtttattcacatttgtctcatttgatcatctcagcaactgtgaagtggttgttattgtgatctttattttacccaaaagaaaactaakgctaggaaaggttaggtgacttggccaagttcacacagtgttatggtctgaatgtgtccccccagaattcatatgttgaaatcctaaccccaaaggtaatgttattaggagatggggcctttggaaggtaattaggtcatgggcatggagccttcatgattaggattagtgcacttatcaaagaagcccaagaaagacccatcactttttctaccgtgtaaggacacagcaagaaggcaccatctatgagctgaaaagtgggccctcaccagatgccaaatctaccagtgccttgatctt

SEQ ID NO: 51654 - DNA, 601 bp, Human
ccatggacaggcccacattggcaggaaatgagccctctccccaacaaccagcagcaatttgcaagtcacatgagcacaccagcttggaaacagatcctcctgccccagtcaagccatcagatgacagcagcccggacaacatctgaccacaatcaatgacagactcctagtcagaccacccaattaaactatccctgaattattgatccacagaacttatgagataataaatgtttatattgatttaagccactaaatgttggggttatttgttacacaataatacagtaacatgctaacrtgcatgatgactctctaggaatgactgagcacgtatcatcctgcaaactgactttaccatgacaccacttttcttctcagagtatctgatgagtctagcttatgtctcacagaacacattttgggaaatgttggtctggaatttaacagtttatgaagtttattcacatttgtctcatttgatcatctcagcaactgtgaagtggttgttattgtgatctttattttacccaaaagaaaactaatgctaggaaaggttaggtgacttggccaagttcacacagtgttatggtctgaatgt

SEQ ID NO: 51655 - DNA, 601 bp, Human
tacacataagcatcccatggacaggcccacattggcaggaaatgagccctctccccaacaaccagcagcaatttgcaagtcacatgagcacaccagcttggaaacagatcctcctgccccagtcaagccatcagatgacagcagcccggacaacatctgaccacaatcaatgacagactcctagtcagaccacccaattaaactatccctgaattattgatccacagaacttatgagataataaatgtttatattgatttaagccactaaatgttggggttatttgttacacaataatacrgtaacatgctaacgtgcatgatgactctctaggaatgactgagcacgtatcatcctgcaaactgactttaccatgacaccacttttcttctcagagtatctgatgagtctagcttatgtctcacagaacacattttgggaaatgttggtctggaatttaacagtttatgaagtttattcacatttgtctcatttgatcatctcagcaactgtgaagtggttgttattgtgatctttattttacccaaaagaaaactaatgctaggaaaggttaggtgacttggccaagttcacacagtgt

SEQ ID NO: 51656 - DNA, 601 bp, Human
gtctcccttccaacgtgaatgtgatcacccccaccactccccagatgtggactaactttagtgactggcgtctaatgaaaagaacgtggtggtggtaacaatatgtgatttttgaagttaagtcataaaaagtgttgccaattccaccttgttctctcttgaatcacttgttcttggggaagccagccaccatgtcacatatgagtacacataagcatcccatggacaggcccacattggcaggaaatgagccctctccccaacaaccagcagcaatttgcaagtcacatgagcacaccakcttggaaacagatcctcctgccccagtcaagccatcagatgacagcagcccggacaacatctgaccacaatcaatgacagactcctagtcagaccacccaattaaactatccctgaattattgatccacagaacttatgagataataaatgtttatattgatttaagccactaaatgttggggttatttgttacacaataatacagtaacatgctaacgtgcatgatgactctctaggaatgactgagcacgtatcatcctgcaaactgactttaccatgacaccacttttcttctcaga

SEQ ID NO: 51657 - DNA, 601 bp, Human
tcaaattctttgacatgtctcccttccaacgtgaatgtgatcacccccaccactccccagatgtggactaactttagtgactggcgtctaatgaaaagaacgtggtggtggtaacaatatgtgatttttgaagttaagtcataaaaagtgttgccaattccaccttgttctctcttgaatcacttgttcttggggaagccagccaccatgtcacatatgagtacacataagcatcccatggacaggcccacattggcaggaaatgagccctctccccaacaaccagcagcaatttgcaagycacatgagcacaccagcttggaaacagatcctcctgccccagtcaagccatcagatgacagcagcccggacaacatctgaccacaatcaatgacagactcctagtcagaccacccaattaaactatccctgaattattgatccacagaacttatgagataataaatgtttatattgatttaagccactaaatgttggggttatttgttacacaataatacagtaacatgctaacgtgcatgatgactctctaggaatgactgagcacgtatcatcctgcaaactgactttaccatgacac

SEQ ID NO: 51658 - DNA, 601 bp, Human
cactctcaccctgtcccagaccctgtctttgccattttgtgcagtaagtgacatattcaacaatgtccagctcctgatcattctcaagtccacggtgctactcaaaagaaaccatattcactcgcctctgcccagaacacagaagctccaaaacttccttcagaatacaaaactgcctcaggaataagccaggcatgtaatgtttggaaacatgggaacctctaagtcattggatgcatcctgcttcctggaaatcattttctcaagactgtacagaaaaagcaacaagattgtaaaaaaatgtttactcaaaatatgacaaggagtgctaacggtcctccctccatcagcagcttctcactgtgtgtttgccgtcacccccaggcacacggtccctgccatcctggctggatgccgacttgcgtttcagtcaccatacagacacatggcctgcaggcactgcaggaacacaccagacacacaccagacaccccattccccagcatttctactgctcggcctggaggccatcctgttttttctggctttacccaagaaagttaagttgtcagtcactgaatctgtaaaagaagggacattg

SEQ ID NO: 51659 - DNA, 601 bp, Human
tagtctggatcataatgaatccttgtggatctcagaactgaaaaaggggctacaggaagtgttgagttagtaggaagttaaaatcaccagtgtagaaaccaccctgaaagtcagtcccttgtcagggtggttgggggcagggatgggggaatttctggatgaaagaatagaggggaaaacaacagaaccagaaggggggcacagtggcgtcttggcatcctgagactttttccactcttggttactatggttacagatgccatcagtgctggctcctgaatgtgactggggccccaggcakctccattcaacacactctcaccctgtcccagaccctgtctttgccattttgtgcagtaagtgacatattcaacaatgtccagctcctgatcattctcaagtccacggtgctactcaaaagaaaccatattcactcgcctctgcccagaacacagaagctccaaaacttccttcagaatacaaaactgcctcaggaataagccaggcatgtaatgtttggaaacatgggaacctctaagtcattggatgcatcctgcttcctggaaatcattttctcaagactgtacagaaaaagcaacaa

SEQ ID NO: 51660 - DNA, 601 bp, Human
tccaaacaagagaccacggctctctttcctgtgcctcattgcctttctctgttcatttaaaacacatctaaaaaaatctcatgatctataccagactgtgagtgcaggagtgttactggaaactttgagtgccatgagccaccgttgttatgcccagctgtaaataagtctagagtatgtatactacaggacttaggaccaattttcacagtaaaaatggaaaagcggaagaaattaggtgcatgaggcttagtctggatcataatgaatccttgtggatctcagaactgaaaaaggggcyacaggaagtgttgagttagtaggaagttaaaatcaccagtgtagaaaccaccctgaaagtcagtcccttgtcagggtggttgggggcagggatgggggaatttctggatgaaagaatagaggggaaaacaacagaaccagaaggggggcacagtggcgtcttggcatcctgagactttttccactcttggttactatggttacagatgccatcagtgctggctcctgaatgtgactggggccccaggcatctccattcaacacactctcaccctgtcccagaccctgtctttgccatttt

SEQ ID NO: 51661 - DNA, 601 bp, Human
acctgagcatcacccacctctccccaccctcatgcgccatgccacacctcactttccaaccagtagcaaaacccacatctccaaacaagagaccacggctctctttcctgtgcctcattgcctttctctgttcatttaaaacacatctaaaaaaatctcatgatctataccagactgtgagtgcaggagtgttactggaaactttgagtgccatgagccaccgttgttatgcccagctgtaaataagtctagagtatgtatactacaggacttaggaccaattttcacagtaaaaatggaraagcggaagaaattaggtgcatgaggcttagtctggatcataatgaatccttgtggatctcagaactgaaaaaggggctacaggaagtgttgagttagtaggaagttaaaatcaccagtgtagaaaccaccctgaaagtcagtcccttgtcagggtggttgggggcagggatgggggaatttctggatgaaagaatagaggggaaaacaacagaaccagaaggggggcacagtggcgtcttggcatcctgagactttttccactcttggttactatggttacagatgccatcagtgctgg

SEQ ID NO: 51662 - DNA, 601 bp, Human
ggactttatagggctcctcaaatcccaccccctgtggctgtctgctctgcctgtctttagtactgaggctgaatgcagagattattgcctgagcagcaggcattcacgctcctatagaaactgcgttctcaccctgccagagaaagggatcggcacatcagaagctttcattaattcaggcttttgggaggccttccaagctgaggccacaagaacacaactagcagggggtcccattagagtcaaaggagaaataccccaatgttacaatacctctggacacaccaggaacaaagtgacrgcgggtatggagggggcaattttatcaggagcattatgctgaactgagagccacatgcttccaaaaggcgtctgaagtataacagaatatgagcgagcgcaccacagttttgcatgtattgattcatcgactctagatatgcaaattatcacagaatcaagggtcatgtaacaaagccagggaaaatatcattttaatgaacagaaattgaaaatgcaatcgccattgctttaagatacacctcccatttgcaaccagaagtttggaattggttgtcataattcaaagatgtcaagaaaa

SEQ ID NO: 51663 - DNA, 601 bp, Human
actaaaattaaaaattaataaaaggccccaacacccgttggcattgccataagcatcactgttgaataatgaaggttagcattacgggttcatagatatgctttgtcctctttttgctgtctgggcaagcacaagtcacttcaccaatctagattcagtattgccctaagaagcctcaatggacttggatatcttaaaagttccttccactttataaagtgagtttaacatgagcagagcaacctctgacaacatttgcacaaatgaaaagttgctttcagtgaccttcctggcactcctkccctccagagctctcagtctgctccctacacagcacctgacttccccccttcccacttgacaccagcctatcaatacatatcagtccctagttctgttctctcttggtccagttctctcataggaactattaatttggctgtacccacgggtaattggaaattagtttgttaccctgaggaactacattcgcatgttaacaagatgtgttctggagctgatgttttaatccatatctctctcatataccatatcatatggtatatgatataccatatgatatggtatatgatataccata

SEQ ID NO: 51664 - DNA, 601 bp, Human
ctgcactccagctcgggcgacaaatcaagatcttgtctcaaaaacataaaaaactaaaattaaaaattaataaaaggccccaacacccgttggcattgccataagcatcactgttgaataatgaaggttagcattacgggttcatagatatgctttgtcctctttttgctgtctgggcaagcacaagtcacttcaccaatctagattcagtattgccctaagaagcctcaatggacttggatatcttaaaagttccttccactttataaagtgagtttaacatgagcagagcaacctctgacaacatttgcacaaatgaaaagttgctttcagtgaccttcctggcactcctgccctccagagctctcagtctgctccctacacagcacctgacttccccccttcccacttgacaccagcctatcaatacatatcagtccctagttctgttctctcttggtccagttctctcataggaactattaatttggctgtacccacgggtaattggaaattagtttgttaccctgaggaactacattcgcatgttaacaagatgtgttctggagctgatgttttaatccatatctctctcatatac

SEQ ID NO: 51665 - DNA, 601 bp, Human
atattcactgaagaaatggatagatgtcttcttcaagaggctgaatatacactcacatttgtacttgctgcagacatagagaatttaatctgaaatctcagaaccgatatgctccagactctagtagagcctactgctctttctcgattctttttcccataggagggagaatagcaaaaaggctcaagcaggcagggcacggtggctcacaccggtaattccagcactttgggaagccgaggtaggcggattgcttgagctcaggagttcgagaccagcctgggcaacatggcaaaatccygtctctacaaaaaatgcataaatttgccaagtctgggggcacatgcctatagtcccagctactcaggaggctgaggtgggaggattgattgagcccaggagatcgaggctgcagtgagctgtgattgcaccgctgcactccagctcgggcgacaaatcaagatcttgtctcaaaaacataaaaaactaaaattaaaaattaataaaaggccccaacacccgttggcattgccataagcatcactgttgaataatgaaggttagcattacgggttcatagatatgctttgtcctctttttg

SEQ ID NO: 51666 - DNA, 601 bp, Human
tttacatgccatcatcatgggagagacacaaactccagtctcgtcccagtatacatgcacaagccacagagtcctaattaacacagattcttcaaaatatctaattacaaactaggcagctctgaggccttctttgaaatcactgaattttctaacagaatgtcaccacctttgacagcatcagcacccattccatattaaattcccatattaagcatttttgccaagcaatggaatatcagaatggcctcattttcatccttattaatgtatttttggaacctctttacttgtcaaatgygtgcctgaaacagatttctaaaatgcagaagttgacctgagtgtgagagatgctaagccttggctaaacggttagtttcaggagggcagagacttcgtcttgtttattgctgtacctccagggcctacaacagtgcctgtcacgaagaagactccgggcaaatattcactgaagaaatggatagatgtcttcttcaagaggctgaatatacactcacatttgtacttgctgcagacatagagaatttaatctgaaatctcagaaccgatatgctccagactctagtagagcctactgctc

SEQ ID NO: 51667 - DNA, 601 bp, Human
tctgctcttcgtgtgcatggtctcatttaagaggtctcatttaaccatacctactccctagggagcaggtacttttatcatttccggttctcaagttgggaagcagacacagagaggtaagttagtgcctaagttcggcagcttgggagtggcagagctggtggggcacacctgagctcttgctcatcttctcatcaaacacttcatctccacctgcagccgtgggagtatggccactgttaataatcatcagcacccccagtcaaggttccctcgatcactaggacgagcttaaaacagwgcagaaacctctgatagatactggaaggatggctcctacaggtctcttccagccactcagctgagagtcctggcaatggaagtgcggcctcaaactccaggtaagactctcactacccctggattcttaatggacaccccagtcagtccaaccatctgctgcttccttaagcccttgtgacccagactggcatccgtggttctctgttggcctcattctgccccagcagcccagagaaggccaagagactgcaaggcatataacagacaaaagtcctaatttcctcctactcaaaagaca

SEQ ID NO: 51668 - DNA, 601 bp, Human
ataggcaactccatagagacagaaagtaaattcatgcttgccagggactgggagagataaaatggggagtgactgctaatggatatggagtttctttttggagtcatgaaaattttctacaattagatagtgatgatgattgcacaactctgtgaatatactaaaaaccactgaattgtacattttaaataggtaattttatggtatgtaaattatatcttaataaagctcttattttttaaaaatagatatggagtccttgttacatgaagatcctttggaagtcatgagcatctaagtyggtgagctaaacattaggatattaaccagaagaacaagcaagtgactcaggctactgtgaagaataaattacatattatatgttaagcactgagtactgtgcctgagccactgaagaccctcagcaaatgggtgttaccagcagcagcatcattgatgtttattaggtgcctcctgtgtgccaggcactgtgctctgctcttcgtgtgcatggtctcatttaagaggtctcatttaaccatacctactccctagggagcaggtacttttatcatttccggttctcaagttgggaagcaga

SEQ ID NO: 51669 - DNA, 601 bp, Human
caggtctaactatttgggcattccaccaattagaggtagagcaatgagaaaggagtcaacaggaaacaggagtggccagaaaagttaaaagaaaacccagagcggccaggcgcggtggcttatgactgtaatcccagcactttgggaggccgaggcgggtggatcacctgaggtcaggagttcaagaccagtctggccaacatggtgaaaccctgtctctactaaaaatacaaaaattagctaggtgtggtggcacatgcctgttatcccagctacttgggaggctgaggcaggaaaatcrcttgaacccgggaggcagaggttgcagtgaattgagatcgtgccactgcactccagcctgggcaacagagagagattttgtctcaaataaataaaaaaataaataaataaataaaacccagaggaaatgatgtcacaaagcatgtgatggaaatgaagtgcttcaagaaggatggggtggctggctgtcaaaattgctaggaagggtcagggaaaatgtggcagacactgcctggcactttcaccttaggcgctcccccttcctttaacagatccaattttggttaaatgacaacatttc

SEQ ID NO: 51670 - DNA, 601 bp, Human
tactttaagcaactatacagatagatggcggtgcccatcaatgagatgggaaactcattcaatgagatgacaaactcttgagagaagcaagtttaggatatactcggcatatagatgatacaaagggactgctgagatcactcaggagaacctacagatcctgacaagaaggacctcaggtctaactatttgggcattccaccaattagaggtagagcaatgagaaaggagtcaacaggaaacaggagtggccagaaaagttaaaagaaaacccagagcggccaggcgcggtggcttatgmctgtaatcccagcactttgggaggccgaggcgggtggatcacctgaggtcaggagttcaagaccagtctggccaacatggtgaaaccctgtctctactaaaaatacaaaaattagctaggtgtggtggcacatgcctgttatcccagctacttgggaggctgaggcaggaaaatcacttgaacccgggaggcagaggttgcagtgaattgagatcgtgccactgcactccagcctgggcaacagagagagattttgtctcaaataaataaaaaaataaataaataaataaaacccagagg

SEQ ID NO: 51671 - DNA, 601 bp, Human
gttccacggaggatcaattattgggagcaagggtagaagaaaggaggccgataaaaaggctgtcagctctccacacaggaagatgcgtggaatgagggtggcaggagcagaaatggagagaaacaaacagattctggatgtgttctagatatcgtatcaggcaggacttgctggtgagtggagaacaaaatggcaggggtgggaaacagaggactcatgcaacatgcccgtactttaagcaactatacagatagatggcggtgcccatcaatgagatgggaaactcattcaatgagatgayaaactcttgagagaagcaagtttaggatatactcggcatatagatgatacaaagggactgctgagatcactcaggagaacctacagatcctgacaagaaggacctcaggtctaactatttgggcattccaccaattagaggtagagcaatgagaaaggagtcaacaggaaacaggagtggccagaaaagttaaaagaaaacccagagcggccaggcgcggtggcttatgactgtaatcccagcactttgggaggccgaggcgggtggatcacctgaggtcaggagttcaagaccagtctg

SEQ ID NO: 51672 - DNA, 601 bp, Human
ttaaaactctctcctcccttgacttcacagagatatcattgtactgtttttagtttattaatttttaaaattttgaaatttggtttataaattttttagttttagtttattaaactaacaaatagaactttttttcaaagagttagaggcatgatgcagagactcctaacagtatgctacaacagagggtgcccagcaggagtgggcggttagagaaagattcttggaggacatgacatttggactgagatttcagaggcgaggagaagccagtcctatgaaaattgggcagaagataatyctaggagaaaaaaaaaaaaagaggtcccgtaaaggccctcagatcaggaggagcttgttttattcaaggaaagcagaaagaagtgcagcataggttagaggaagacggctcaagaccagccttggaaaggaggtcagcacagccagcactcagggtgctgcaggccagcaccagaaagcagattttatgccgagtggaaagaggaaccgatagagaattttaagctgcgggtcaagagaaatcagattcatatttttaaaagatcattgtggctgttccacggaggatcaattattggga

SEQ ID NO: 51673 - DNA, 601 bp, Human
aatgtacgcaaaatgcctggcactcttccaggttcatagtaacaataaatgttagttatcactgtcattatcaccatcatcatcatcatcattatcattatcttgagtcgttgtagagcctttagtgctgctaattaagttccccttcttaaaactctctcctcccttgacttcacagagatatcattgtactgtttttagtttattaatttttaaaattttgaaatttggtttataaattttttagttttagtttattaaactaacaaatagaactttttttcaaagagttagaggcatratgcagagactcctaacagtatgctacaacagagggtgcccagcaggagtgggcggttagagaaagattcttggaggacatgacatttggactgagatttcagaggcgaggagaagccagtcctatgaaaattgggcagaagataatcctaggagaaaaaaaaaaaaagaggtcccgtaaaggccctcagatcaggaggagcttgttttattcaaggaaagcagaaagaagtgcagcataggttagaggaagacggctcaagaccagccttggaaaggaggtcagcacagccagcactca

SEQ ID NO: 51674 - DNA, 601 bp, Human
accattcaccagctccaggaccttgtggaaatttatttactcacatagcaaacattaatcgaaagctaccatgtgccaggcactttgactgacctccctaagtctcagtgttctgagaatgagaataacattccttgacagtagaggcattgtcaggacttttaatctgtcagaattaaatatgataatgtacgcaaaatgcctggcactcttccaggttcatagtaacaataaatgttagttatcactgtcattatcaccatcatcatcatcatcattatcattatcttgagtcgttgtrgagcctttagtgctgctaattaagttccccttcttaaaactctctcctcccttgacttcacagagatatcattgtactgtttttagtttattaatttttaaaattttgaaatttggtttataaattttttagttttagtttattaaactaacaaatagaactttttttcaaagagttagaggcatgatgcagagactcctaacagtatgctacaacagagggtgcccagcaggagtgggcggttagagaaagattcttggaggacatgacatttggactgagatttcagaggcgaggaga

SEQ ID NO: 51675 - DNA, 601 bp, Human
gctcatcataagaatgcatctttagggtattttaataagaaaattgttcaatctggattcattcctaatgcttcttttaaagaactcacctatgccttcaaatgaattgaatgaatggagtccagaattccaaaattcagaaggttttggactgaaaattagttttatttatcatatgttttaaataaataagaaatcatttatcctatattaggcttccttttctcaatctgttaaggggttctctgtcttcatctgagcaaatatagaccagtggttacaaatacggactttggattcrgtcagatctaagttagactctcaactctaccattcaccagctccaggaccttgtggaaatttatttactcacatagcaaacattaatcgaaagctaccatgtgccaggcactttgactgacctccctaagtctcagtgttctgagaatgagaataacattccttgacagtagaggcattgtcaggacttttaatctgtcagaattaaatatgataatgtacgcaaaatgcctggcactcttccaggttcatagtaacaataaatgttagttatcactgtcattatcaccatcatcatcat

SEQ ID NO: 51676 - DNA, 601 bp, Human
taacactgggttctctcctagcttgtcaaacatgaaacttggtttaggaagcacctgctcactacgtaattcaagtggggttcttactgcactcatcacaaagactgagttttaatagctttcctggacaatgaacctggctcatcataagaatgcatctttagggtattttaataagaaaattgttcaatctggattcattcctaatgcttcttttaaagaactcacctatgccttcaaatgaattgaatgaatggagtccagaattccaaaattcagaaggttttggactgaaaattarttttatttatcatatgttttaaataaataagaaatcatttatcctatattaggcttccttttctcaatctgttaaggggttctctgtcttcatctgagcaaatatagaccagtggttacaaatacggactttggattcagtcagatctaagttagactctcaactctaccattcaccagctccaggaccttgtggaaatttatttactcacatagcaaacattaatcgaaagctaccatgtgccaggcactttgactgacctccctaagtctcagtgttctgagaatgagaataacattc

SEQ ID NO: 51677 - DNA, 601 bp, Human
ccatcttaccagtgcttaaaaccatcttcctcccctctcttctccaccaatccacatacattcccttccctgagtaacgaaagttcaaaaccacctacttcttctacttctcattcttatccatcttgtgccacacgtccttcatcaatcacattaactgtctttacttgtgactttgcatttattcacatgtatgtttcatcactccaattacactctgaactcagcaaaggcaaagactatgtccttgatgttgtgtgaggtctcagtcatcctacaagagtaggctaagcatataccmcaagcactaaacatatgtcccataatatgagaaaccaaaggccaacatgccagaaaacatttaacactgggttctctcctagcttgtcaaacatgaaacttggtttaggaagcacctgctcactacgtaattcaagtggggttcttactgcactcatcacaaagactgagttttaatagctttcctggacaatgaacctggctcatcataagaatgcatctttagggtattttaataagaaaattgttcaatctggattcattcctaatgcttcttttaaagaactcacctatgccttca

SEQ ID NO: 51678 - DNA, 601 bp, Human
caagtcaaaattaatatcgtccacgttcagtgcaacctctgcacctctccagcatgaaaagccaaacagaaattgtatggctatttatccttgagtatacttaaagacaaaaataaaaggaattaactacagtgtggactgcctctgttctttcccagtgaataatctgtaaaacgccttcccctcctcatccatcacctactggaactgcgatcattatcttctttcccctaccatacaatcaccatcctccactgctccacgccttagagatgccccacctctcctcctcgtaatttcrgagaaatgattgactccactatgccagtggctagtgggtcctcagccctctcagtgactatttaaacctttctttttcactcctccagtgcccccctagcccagacctttgctatggtgactactcacaaattcattgtttctcacccagattgctgcagtttctccctaagagtatttagcttgcagttatttgtccctctgacttaaattatgtacgcccagctagtgtagccttccatggctcctgatcatctgtgaaaataaatccatgttcaacctagcatgtaaggtatccata

SEQ ID NO: 51679 - DNA, 601 bp, Human
aaaacgtaacgtgcctattgagaaacatctggcagcattctcagggcacagttttggttcctattagctaggagacagcgttggtggttttgataacagagaatacagatccctttaacagtaacttctcctttcatttgtaccctaaattgtctgtcgacttccagctgtttcctggcacttaaccaatcccagtgatgatggggatgaaggccagtgagtcacgatccccaaaaaattttcctttaaaagaattcagcctccacttcctgcccagagcagctcccaagaattgctttgycctattcattgcagtcaggattggcgcatttcatcccaggtactacagagatagacattatataaaatagataaattaaaaaacaacagatgaaagaactatgcatgaaaatgaatggatgtgggagatgcagacttagacgtttctctgaggaaatttccagtgggccacccttctcttcgttctgcagtgggaataccaaatctcaaagctgctcgttatgcgttcatctgctctttgcctaaaggtatgcccaggagagtcatttctgtgtaaaggcagaattgcatccacagccac

SEQ ID NO: 51680 - DNA, 601 bp, Human
tcactttaccatcattaggtatacacaccgagcctaatctctcttggtatgagtcctatctcccatgctgcagctgtttctctttcctcctgctctattctgatatctggcagagttgcactgcaatgaatttatgtggcaggccagaaagggagagaagatgcatagacatgaggcatcggaaaatgtctctccattctgctattattgtctacatggcttgaacccactgggctctgcattcaccttctgattcttctctcttagacctggacatctgggcatttgagtcctagtgtcsctggaccaacatcaacgcctaaaactagaggcttaacattagtagtgaactccaaataggaccattacatcggccaaagcatggtaccaatatagtattgtacaaatatcttctatcaaatcaagacattgtcaattacaaaacacatcattatcttatgtgcctcttgaaaatttaaattgccaattaaattatgacatattgctagtaagacacattctgatttcagaagggtaaataattcaaaaatgcatctaagaattaatgtagtacaatagaacatttctcttggagaaacat

SEQ ID NO: 51681 - DNA, 601 bp, Human
acgaatcaagaaatgaagaactatgcagtcctggatgcatgatctgagccctagattgagctttgcctggactgttcagttttgaaaatcaacaattctcttttgggctggatcccacttgggctgatttcttgggtacaatgtatccagagcaatgtgtcaagcaacagatacatgggttgatccaatgactctgcctatgcccatgacactcaggcctcaagcaatccaaatatacaaacgtcctcatagggctacatgggcaaaggaccacaagagattctggctggtctttaaaatrcaaattccagcagcaaagtattgccttaaggatcagttccagacttgaaatattgccagctttctctttcctctcttaaatttaatatgctacttcaagggcacggtcccaaccttcccctctcaggtattctaataatgttgcgttctacccttagaaaatatttaaatgaagtcaactatgaccctgtataggttaagaatttctcactgtacattcatgaatattctaattctcttcaatgtatttcttatatgtgtttgctcatctatttgttcttatactggaaactctaaaaga

SEQ ID NO: 51682 - DNA, 601 bp, Human
caacagtaccgattttgtttagggaaaccactacagcccactctcagcccttgagttgggcttcactgggcttctctcttaggttccatgagtgaagcacacaacccaggcaaagccaattagcacattcgattcccccaatcaccaccatgataattaaagaatgagtatctgaccctagacaggccaatcaggaccaaaaagatgccattgcaagacttttgtttcagccttagggaactgagctttcgctctcctgaaggatgtaaatctggaagacagaggagggtctgcagccttyggcagccaccttaggatttccaagatggaacttgcctaagaatagagcaatgcaaagaagacgaatcaagaaatgaagaactatgcagtcctggatgcatgatctgagccctagattgagctttgcctggactgttcagttttgaaaatcaacaattctcttttgggctggatcccacttgggctgatttcttgggtacaatgtatccagagcaatgtgtcaagcaacagatacatgggttgatccaatgactctgcctatgcccatgacactcaggcctcaagcaatccaaatatacaa

SEQ ID NO: 51683 - DNA, 601 bp, Human
ttctcctcctccttcttcttttttatggacagagtcttgctctgtttacccaggctagtgtgcagtggtgcaatcatagctcaccgtaactttgaactcctgggctgaagcgatcctcctacctcagtctcccaagcagctgggactataggcatgcaccaccacacttggctaatttaaaaataaatttttttagagatagggtctcactatgttgctcaggctggtcactaactcctggccacaagcgatcctcctgcctcagcctcccaagtagctgaagttacaagtgtgaaccacygtgcctagtcctgcttccattctcatccaccctttctctacatcattctctcagcatccatgaccatgccatattatgtcaacagtaccgattttgtttagggaaaccactacagcccactctcagcccttgagttgggcttcactgggcttctctcttaggttccatgagtgaagcacacaacccaggcaaagccaattagcacattcgattcccccaatcaccaccatgataattaaagaatgagtatctgaccctagacaggccaatcaggaccaaaaagatgccattgcaagactt

SEQ ID NO: 51684 - DNA, 601 bp, Human
tccatctcagcagtcactctgcttgtccaagccaccatgattctttgcctggacttcaatacctccaaactagcatacccacttcctttcttcttagcctccttctcctcctccttcttcttttttatggacagagtcttgctctgtttacccaggctagtgtgcagtggtgcaatcatagctcaccgtaactttgaactcctgggctgaagcgatcctcctacctcagtctcccaagcagctgggactataggcatgcaccaccacacttggctaatttaaaaataaatttttttagagrtagggtctcactatgttgctcaggctggtcactaactcctggccacaagcgatcctcctgcctcagcctcccaagtagctgaagttacaagtgtgaaccactgtgcctagtcctgcttccattctcatccaccctttctctacatcattctctcagcatccatgaccatgccatattatgtcaacagtaccgattttgtttagggaaaccactacagcccactctcagcccttgagttgggcttcactgggcttctctcttaggttccatgagtgaagcacacaacccaggcaaagccaa

SEQ ID NO: 51685 - DNA, 601 bp, Human
atccaccactctccatctcagcagtcactctgcttgtccaagccaccatgattctttgcctggacttcaatacctccaaactagcatacccacttcctttcttcttagcctccttctcctcctccttcttcttttttatggacagagtcttgctctgtttacccaggctagtgtgcagtggtgcaatcatagctcaccgtaactttgaactcctgggctgaagcgatcctcctacctcagtctcccaagcagctgggactataggcatgcaccaccacacttggctaatttaaaaataaawttttttagagatagggtctcactatgttgctcaggctggtcactaactcctggccacaagcgatcctcctgcctcagcctcccaagtagctgaagttacaagtgtgaaccactgtgcctagtcctgcttccattctcatccaccctttctctacatcattctctcagcatccatgaccatgccatattatgtcaacagtaccgattttgtttagggaaaccactacagcccactctcagcccttgagttgggcttcactgggcttctctcttaggttccatgagtgaagcacacaaccca

SEQ ID NO: 51686 - DNA, 601 bp, Human
gtggattccatctccaaactagaaatcaaacccatccaccactctccatctcagcagtcactctgcttgtccaagccaccatgattctttgcctggacttcaatacctccaaactagcatacccacttcctttcttcttagcctccttctcctcctccttcttcttttttatggacagagtcttgctctgtttacccaggctagtgtgcagtggtgcaatcatagctcaccgtaactttgaactcctgggctgaagcgatcctcctacctcagtctcccaagcagctgggactataggcaygcaccaccacacttggctaatttaaaaataaatttttttagagatagggtctcactatgttgctcaggctggtcactaactcctggccacaagcgatcctcctgcctcagcctcccaagtagctgaagttacaagtgtgaaccactgtgcctagtcctgcttccattctcatccaccctttctctacatcattctctcagcatccatgaccatgccatattatgtcaacagtaccgattttgtttagggaaaccactacagcccactctcagcccttgagttgggcttcactgggcttct

SEQ ID NO: 51687 - DNA, 601 bp, Human
tagaatagcatagttgattttaaaataataaaaaccctccattcttacctatctcaagaaatgctaccaccatcctcccaagttactcagtccacaagcctaggaatcatttttaattattttccttaccatcttcaacatgtatttcatcagcaaatgctgtggattccatctccaaactagaaatcaaacccatccaccactctccatctcagcagtcactctgcttgtccaagccaccatgattctttgcctggacttcaatacctccaaactagcatacccacttcctttcttcttmgcctccttctcctcctccttcttcttttttatggacagagtcttgctctgtttacccaggctagtgtgcagtggtgcaatcatagctcaccgtaactttgaactcctgggctgaagcgatcctcctacctcagtctcccaagcagctgggactataggcatgcaccaccacacttggctaatttaaaaataaatttttttagagatagggtctcactatgttgctcaggctggtcactaactcctggccacaagcgatcctcctgcctcagcctcccaagtagctgaagttacaagtgtg

SEQ ID NO: 51688 - DNA, 601 bp, Human
cttctcaaatcccacagagctagaatagcatagttgattttaaaataataaaaaccctccattcttacctatctcaagaaatgctaccaccatcctcccaagttactcagtccacaagcctaggaatcatttttaattattttccttaccatcttcaacatgtatttcatcagcaaatgctgtggattccatctccaaactagaaatcaaacccatccaccactctccatctcagcagtcactctgcttgtccaagccaccatgattctttgcctggacttcaatacctccaaactagcayacccacttcctttcttcttagcctccttctcctcctccttcttcttttttatggacagagtcttgctctgtttacccaggctagtgtgcagtggtgcaatcatagctcaccgtaactttgaactcctgggctgaagcgatcctcctacctcagtctcccaagcagctgggactataggcatgcaccaccacacttggctaatttaaaaataaatttttttagagatagggtctcactatgttgctcaggctggtcactaactcctggccacaagcgatcctcctgcctcagcctcccaag

SEQ ID NO: 51689 - DNA, 601 bp, Human
tttctggtgtatcatccagggttggcctcacagggcaagagtgaaggtaggagttgaagataaatgaagtgatttatggtttgtactctcaagaaggcccgccaatttaataaactagttaaatggctttaaaagtaaaaataaaaactgctatagccaccccttctcattatggattcatatatccatgaatatatatttccagctctaccctctaaattccagactcctgtctccaactgtccaattgacattcccactcagatattaacaggcttctcaaatcccacagagctagaayagcatagttgattttaaaataataaaaaccctccattcttacctatctcaagaaatgctaccaccatcctcccaagttactcagtccacaagcctaggaatcatttttaattattttccttaccatcttcaacatgtatttcatcagcaaatgctgtggattccatctccaaactagaaatcaaacccatccaccactctccatctcagcagtcactctgcttgtccaagccaccatgattctttgcctggacttcaatacctccaaactagcatacccacttcctttcttcttagcctc

SEQ ID NO: 51690 - DNA, 601 bp, Human
tatttctattttacttgatttgatttttaaagtgcctggaaaagctgtgaggtatttctggtgtatcatccagggttggcctcacagggcaagagtgaaggtaggagttgaagataaatgaagtgatttatggtttgtactctcaagaaggcccgccaatttaataaactagttaaatggctttaaaagtaaaaataaaaactgctatagccaccccttctcattatggattcatatatccatgaatatatatttccagctctaccctctaaattccagactcctgtctccaactgtccarttgacattcccactcagatattaacaggcttctcaaatcccacagagctagaatagcatagttgattttaaaataataaaaaccctccattcttacctatctcaagaaatgctaccaccatcctcccaagttactcagtccacaagcctaggaatcatttttaattattttccttaccatcttcaacatgtatttcatcagcaaatgctgtggattccatctccaaactagaaatcaaacccatccaccactctccatctcagcagtcactctgcttgtccaagccaccatgattctttg

SEQ ID NO: 51691 - DNA, 601 bp, Human
ggacttttgaatatctgaaaaaaaaagtacaatttttatttctattttacttgatttgatttttaaagtgcctggaaaagctgtgaggtatttctggtgtatcatccagggttggcctcacagggcaagagtgaaggtaggagttgaagataaatgaagtgatttatggtttgtactctcaagaaggcccgccaatttaataaactagttaaatggctttaaaagtaaaaataaaaactgctatagccaccccttctcattatggattcatatatccatgaatatatatttccagctctaycctctaaattccagactcctgtctccaactgtccaattgacattcccactcagatattaacaggcttctcaaatcccacagagctagaatagcatagttgattttaaaataataaaaaccctccattcttacctatctcaagaaatgctaccaccatcctcccaagttactcagtccacaagcctaggaatcatttttaattattttccttaccatcttcaacatgtatttcatcagcaaatgctgtggattccatctccaaactagaaatcaaacccatccaccactctccatctcagc

SEQ ID NO: 51692 - DNA, 601 bp, Human
cagagtgctgggattacaggtttttttgtttggttttgttttggacagggactggctctgtcacccaggctggggtgcagtggcacgatctctgctcactgcaaagccctccccacttgttcaagcgactcttgtgcctcagcctcccgagtagctgggactacaggcacacaccaccacgcccagctagtttttgtattttcagtagagacagggtttcaccaggctggtctcaagctcctgggctcaagcgatggcctgcctcggcctcccataagtgctgggattacaggcacaagcyacctcacccggctgaaagagagctttgaattggatgagaggttgatgttttgattcatgtaaaactggacttttgaatatctgaaaaaaaaagtacaatttttatttctattttacttgatttgatttttaaagtgcctggaaaagctgtgaggtatttctggtgtatcatccagggttggcctcacagggcaagagtgaaggtaggagttgaagataaatgaagtgatttatggtttgtactctcaagaaggcccgccaatttaataaactagttaaatggctttaaaagtaaaaataa

SEQ ID NO: 51693 - DNA, 601 bp, Human
ggcctcccagagtgctgggattacaggtttttttgtttggttttgttttggacagggactggctctgtcacccaggctggggtgcagtggcacgatctctgctcactgcaaagccctccccacttgttcaagcgactcttgtgcctcagcctcccgagtagctgggactacaggcacacaccaccacgcccagctagtttttgtattttcagtagagacagggtttcaccaggctggtctcaagctcctgggctcaagcgatggcctgcctcggcctcccataagtgctgggattacaggmacaagctacctcacccggctgaaagagagctttgaattggatgagaggttgatgttttgattcatgtaaaactggacttttgaatatctgaaaaaaaaagtacaatttttatttctattttacttgatttgatttttaaagtgcctggaaaagctgtgaggtatttctggtgtatcatccagggttggcctcacagggcaagagtgaaggtaggagttgaagataaatgaagtgatttatggtttgtactctcaagaaggcccgccaatttaataaactagttaaatggctttaaaagta

SEQ ID NO: 51694 - DNA, 601 bp, Human
ctcggctcaatataaactctgcctcccgggttcaagcgattctcctgcctcagcatcctgagtatctgggattataggcacccgccacaatgcccagccaattttttgtattttcagtagagacggggttttaccattttggccaggcaggtcttgaactgccgacctgaggtgatgtacccacctcggcctcccagagtgctgggattacaggtttttttgtttggttttgttttggacagggactggctctgtcacccaggctggggtgcagtggcacgatctctgctcactgcaaagycctccccacttgttcaagcgactcttgtgcctcagcctcccgagtagctgggactacaggcacacaccaccacgcccagctagtttttgtattttcagtagagacagggtttcaccaggctggtctcaagctcctgggctcaagcgatggcctgcctcggcctcccataagtgctgggattacaggcacaagctacctcacccggctgaaagagagctttgaattggatgagaggttgatgttttgattcatgtaaaactggacttttgaatatctgaaaaaaaaagtacaatttttatt

SEQ ID NO: 51695 - DNA, 601 bp, Human
agagctttgtgattttgttttgttgttgttgctgttgttgtttgagatggagtctccctctgtcacccaggctggagtgcaatggcgcgatctcggctcaatataaactctgcctcccgggttcaagcgattctcctgcctcagcatcctgagtatctgggattataggcacccgccacaatgcccagccaattttttgtattttcagtagagacggggttttaccattttggccaggcaggtcttgaactgccgacctgaggtgatgtacccacctcggcctcccagagtgctgggattrcaggtttttttgtttggttttgttttggacagggactggctctgtcacccaggctggggtgcagtggcacgatctctgctcactgcaaagccctccccacttgttcaagcgactcttgtgcctcagcctcccgagtagctgggactacaggcacacaccaccacgcccagctagtttttgtattttcagtagagacagggtttcaccaggctggtctcaagctcctgggctcaagcgatggcctgcctcggcctcccataagtgctgggattacaggcacaagctacctcacccggctga

SEQ ID NO: 51696 - DNA, 601 bp, Human
atctgcagtgtctcaggccaggcctggcctacagggaaaggagagctttgtgattttgttttgttgttgttgctgttgttgtttgagatggagtctccctctgtcacccaggctggagtgcaatggcgcgatctcggctcaatataaactctgcctcccgggttcaagcgattctcctgcctcagcatcctgagtatctgggattataggcacccgccacaatgcccagccaattttttgtattttcagtagagacggggttttaccattttggccaggcaggtcttgaactgccgacctsaggtgatgtacccacctcggcctcccagagtgctgggattacaggtttttttgtttggttttgttttggacagggactggctctgtcacccaggctggggtgcagtggcacgatctctgctcactgcaaagccctccccacttgttcaagcgactcttgtgcctcagcctcccgagtagctgggactacaggcacacaccaccacgcccagctagtttttgtattttcagtagagacagggtttcaccaggctggtctcaagctcctgggctcaagcgatggcctgcctcggcctcccat

SEQ ID NO: 51697 - DNA, 601 bp, Human
ccccttgactgtggtggagccaaaagcagcaaagccagcaggaaaggagtgtgcacaaggagggaaaaggaacagccacggcccccgccttccctttcccatggctgatctgcagtgtctcaggccaggcctggcctacagggaaaggagagctttgtgattttgttttgttgttgttgctgttgttgtttgagatggagtctccctctgtcacccaggctggagtgcaatggcgcgatctcggctcaatataaactctgcctcccgggttcaagcgattctcctgcctcagcatcctgartatctgggattataggcacccgccacaatgcccagccaattttttgtattttcagtagagacggggttttaccattttggccaggcaggtcttgaactgccgacctgaggtgatgtacccacctcggcctcccagagtgctgggattacaggtttttttgtttggttttgttttggacagggactggctctgtcacccaggctggggtgcagtggcacgatctctgctcactgcaaagccctccccacttgttcaagcgactcttgtgcctcagcctcccgagtagctgggactacaggc

SEQ ID NO: 51698 - DNA, 601 bp, Human
tgctttctagtcaccttctccctgccccttgactgtggtggagccaaaagcagcaaagccagcaggaaaggagtgtgcacaaggagggaaaaggaacagccacggcccccgccttccctttcccatggctgatctgcagtgtctcaggccaggcctggcctacagggaaaggagagctttgtgattttgttttgttgttgttgctgttgttgtttgagatggagtctccctctgtcacccaggctggagtgcaatggcgcgatctcggctcaatataaactctgcctcccgggttcaagcrattctcctgcctcagcatcctgagtatctgggattataggcacccgccacaatgcccagccaattttttgtattttcagtagagacggggttttaccattttggccaggcaggtcttgaactgccgacctgaggtgatgtacccacctcggcctcccagagtgctgggattacaggtttttttgtttggttttgttttggacagggactggctctgtcacccaggctggggtgcagtggcacgatctctgctcactgcaaagccctccccacttgttcaagcgactcttgtgcctcagcc

SEQ ID NO: 51699 - DNA, 601 bp, Human
tttggcctgtaatgcaggctgaggagggtaggcaacagtggagtcacgtgctttccccatatatggcagcacaaagatgcctaatggtttctcctgggccaagtaggcactggatggggtcagaagctacatcaaagccttcagaaaaaagccttccccaagaagtccatccacttgagaaaaaaagttcagggtacactcaaggcagaagctgagaggccgggggtgtcataagagaccagccagggagggcatcatccatgtctgtagaggaaagtctgggggtcttcacagggtggcsaagaactcacaaaagctggacacctgcaagacagagactatttcatgactagaaagaaccataagaagcaccagctaagtaaaacacccttgctttctagtcaccttctccctgccccttgactgtggtggagccaaaagcagcaaagccagcaggaaaggagtgtgcacaaggagggaaaaggaacagccacggcccccgccttccctttcccatggctgatctgcagtgtctcaggccaggcctggcctacagggaaaggagagctttgtgattttgttttgttgttgttgctgttgt

SEQ ID NO: 51700 - DNA, 601 bp, Human
atttcttagcagaaaagaacacatagcattgcagcactatggcaaatgaaggagcagaaagagaactgctcagagatcagaggggttggcagaagggggtctcagcatctggaaccccagctgggtgcctgctgaactgcatacttcatagaatgcactgctacaggtaggggcatgagagatttgtctgaactcagggctgccacattaactgtgcaattctaggagaacacatgtgaatgatgccctctggaggtgtgcaatgagacggccctgggaaaatcagacatgggtgcgcagygtttggcctgtaatgcaggctgaggagggtaggcaacagtggagtcacgtgctttccccatatatggcagcacaaagatgcctaatggtttctcctgggccaagtaggcactggatggggtcagaagctacatcaaagccttcagaaaaaagccttccccaagaagtccatccacttgagaaaaaaagttcagggtacactcaaggcagaagctgagaggccgggggtgtcataagagaccagccagggagggcatcatccatgtctgtagaggaaagtctgggggtcttcacagggtgg

SEQ ID NO: 51701 - DNA, 601 bp, Human
gagaaaaagcatttcttagcagaaaagaacacatagcattgcagcactatggcaaatgaaggagcagaaagagaactgctcagagatcagaggggttggcagaagggggtctcagcatctggaaccccagctgggtgcctgctgaactgcatacttcatagaatgcactgctacaggtaggggcatgagagatttgtctgaactcagggctgccacattaactgtgcaattctaggagaacacatgtgaatgatgccctctggaggtgtgcaatgagacggccctgggaaaatcagacatrggtgcgcagtgtttggcctgtaatgcaggctgaggagggtaggcaacagtggagtcacgtgctttccccatatatggcagcacaaagatgcctaatggtttctcctgggccaagtaggcactggatggggtcagaagctacatcaaagccttcagaaaaaagccttccccaagaagtccatccacttgagaaaaaaagttcagggtacactcaaggcagaagctgagaggccgggggtgtcataagagaccagccagggagggcatcatccatgtctgtagaggaaagtctgggggtctt

SEQ ID NO: 51702 - DNA, 601 bp, Human
agccttgagcaccccgcccctcgttccccaccaccccaatggagcaccatgtcacctgctttatatactgagcttccctgacagctttcattcaaagagagggtttctctgttacaaggcaatgttaagtgagccctttcctgttgtcttggggtttatactgagatctctcaaaactgaagactgaggatccatcaatgcagagcttgcatatgatctctaagccatataagagaattcgctggagaaaaagcatttcttagcagaaaagaacacatagcattgcagcactatggcaaakgaaggagcagaaagagaactgctcagagatcagaggggttggcagaagggggtctcagcatctggaaccccagctgggtgcctgctgaactgcatacttcatagaatgcactgctacaggtaggggcatgagagatttgtctgaactcagggctgccacattaactgtgcaattctaggagaacacatgtgaatgatgccctctggaggtgtgcaatgagacggccctgggaaaatcagacatgggtgcgcagtgtttggcctgtaatgcaggctgaggagggtaggcaacagtggagtc

SEQ ID NO: 51703 - DNA, 601 bp, Human
aagtgctttacatgcattaactcatttaaatgtaaaaataactttacaagcaaggtattattattactccattttacagataagcaagcaaagcatagaacatgccactaacaggcagggccaggacttgaaccttagcaatctgcctccagaatgcataatctgacacaggacactagatgcttctcaagccttacaccctgtgaaaaacaatacatgtgaagcagctagcatagtgtttggcattgtttccttccttccccaacatggatgctaccatcaattatcatcaattagattrccacaagttcttttttattattatttctgtaggtttttggggaagaggtggtgtttggttacatgactaagctctttagtggtgacttgtgaaattttggtgcacccatcacccgagcagtgtacactgtacccaatttgctgtcttttatccctcactgcccccacccttttcaccaagtccccaaagtccaatgaggatgcctttgcatcctcatagcttagctcccacttataagtaagaacacacaatgtttggtttttccattcctgagttacttcacttagaatgttggtctcc

SEQ ID NO: 51704 - DNA, 601 bp, Human
ctcccctaaccccacagacacctgtagatttcccaggtgaggctcatcttcccaggtgaggccccagacgttgcagaatagagacaaaccatcgcctctgtgtcctgcatgaatccctgaagcacattatctgagcataataaaatgcttgttttatgccaataagttgggatggctatgcagcaatcccaacttattgctgcatctatattgtgatagaggcattcatctatattgtgatagaggaactgctcataaaatggaaacatggcaaaaaccaggacagaacccaagcatcctrcacactgactaatacacaagttaaaacaagattctgaagtaacactcttgttataacacattgtattagtctgttttgacactgctgataaagacatacctgagactgggtaattaatttataaagaaaaagaggcttaatggactcacagttccatgtggctgggaagtcctcacaattatggcagaaggtgaaaggcacgtctttcttggcagcaggcaagagagaatgagaatcaagtgaaagggaaaaccccttataaaaccattagatttcatgagacttattcactaccacgag

SEQ ID NO: 51705 - DNA, 601 bp, Human
tagtaagcacttaaataactgctagttgtaattaatgaagtctacaaaatggaacatgtgttcctgaacattaaatgcaatgctaactaaataagtttgcattaaactcactttgtgtcttgttttaaatagtgtttgtttgtttgtttgtttttgaggtggagtctcactctgtggcccaggctggagtgcagtggcaccatcttagttcactgcaacctctgcctcccggattcaagcgactctcatgcctcagcctcccaagtagctgggattacaggcgcgcaccaccatgcctggytaatttctgtatttttagtagagatggggtttcgccatgttggccggggtagtctagaactcctgacctcaagtgatccgcccacctcagcctcccaaagtgctgggattataggcctgagccactgtgcctggcctgaataagttttattttaactatcattagaggttgtgagtggcctctgtctctccagagactagttaattgaaagccatctgtatttgtcttcaccttttagcatgccaacttcttgtggcatctcaatatgctcccacagccattagcacaggatcttgcaca

SEQ ID NO: 51706 - DNA, 601 bp, Human
tgaattaaacaaaattcaaactttaagcagaaaatgtaaacacagatataaaattccatttgaaggaaggggctcacgcctgtaatcccagtactttgggaggccaaggcaggtggatcacgaggtcaagagatcgagaccatcctggccaacatggtgaaaccccgtctctaccaaaaatacaaaaaaaaattagccaggcatggtggtgggcacctgtagtcccagctactcaggaggctgaggcaggagaattgcttgaaccagggaggcagaggttgcagtgagctgagattgcacyaccacactccagcctggtgacagagcgagactgtctcaaaaaaaaaagtctgaacaccttttggtgttccatactgctcttggatattgtattttgtatgttacaaatatattaaatatatattaagtattgcattatactatgtatcatatattaagtttaacacaatataatttacctcaaagcatgctacttggttggactttggagtaagggcctagagtcacatgagctttgcttcttctcaacccctgcagcaggtcccaagacttttttaggacccaaaagattcaggaacac

SEQ ID NO: 51707 - DNA, 601 bp, Human
tctctgcaatttagacatgagctagaaatgtccttgcaccagaaaattcacatttcttttcatcacaagtaaacaactgctgtatgcatctattaaactccactgtctactaaagaagagagtgattatcacactttaagggtttttttaaatcactttccatcaggaaaacttgatgtggaaaaggaaaactgggaacaaagatcacgatatgatcactctttctgggacacatttatgtaaaaaatcagtcaagaaaacccaagagatataagatctaaatcaaactgaacttttaaamagtggaataaactctttctcttttttctttgacttttagttttatggatttgtgcttacatgggcactttagaggttatcttccacagtagatggtaatacagatttgccggtagaaaagactttaactagtgactgagaccttgagcctgaagttagaataatgataccgatacagcttacaggccaaatctttaaactaaaaatatccaacagcaatgtggaatatgtcagaggtgtgggtttcaaaagtttacattttaagtggaaattcaattgaattaaacaaaattcaaacttt

SEQ ID NO: 51708 - DNA, 601 bp, Human
tgtaataccttcttattcctagtactttgaggcttggtatcaagctctcccatgcacaaaaatcaacagaggctggaatccacgacctcctgacagtgcttccgcatagacaattccagaagacaccattcacagtcgcatagtgcacaacctgtgcagacatacattgtacccctacctcttacaacctgcttcagcactatgtcaaactgtggtctctctgcaatttagacatgagctagaaatgtccttgcaccagaaaattcacatttcttttcatcacaagtaaacaactgctgtrtgcatctattaaactccactgtctactaaagaagagagtgattatcacactttaagggtttttttaaatcactttccatcaggaaaacttgatgtggaaaaggaaaactgggaacaaagatcacgatatgatcactctttctgggacacatttatgtaaaaaatcagtcaagaaaacccaagagatataagatctaaatcaaactgaacttttaaacagtggaataaactctttctcttttttctttgacttttagttttatggatttgtgcttacatgggcactttagaggttatcttc

SEQ ID NO: 51709 - DNA, 601 bp, Human
ctcacattcctccttgctcaaacttttcagtgcctctcatcactgcatctagaataaaatgcaagccccttatcatggcttccaaggtgctcaaactcagtgcctctcatcgttgcatctagaataaaatgcaagccccttatcatggcttccaaggtctgacagtaaagcctctgtcccctctctaatttcatctcacaacatgccccttttccctctggactccagtttccattcagtttccactcggttaccactcagtttctttctgcctggaaggcctgtcccccattcttccacrgctggctccttcccattctttgggtctcagtttaaatgttaccatgtcagagaggtatcttctgactactctaagtagcctaggatagttcattttatgtgacaacttgactgtgtcagaggatgcttagatatttggtcaaacattattctgggtacttctgtgagggtgctttctgatgggattcatatttaagttagcagagtgagtaaagcagatttctcccacgacataggtggtccacatcctatcggttggaggcctgaatagaacaaaatggctgaccttcccctgagtaag

SEQ ID NO: 51710 - DNA, 601 bp, Human
accatcaccagacataatttcctttgaggtcagattttcttattgacccttgtggctaaacctagaaatagactgcatcgcatggtagcttctacatggtagtttagttaagggagaattgccagatacgtgtgtgtgtgtgtgtgtgtgtgtgtgtgtgtgtgtgtgttacaatgcacataacataaaattccctattctagccattttaaagggtgcaattcaatgtgtgctaccagattcaggaaacaaaaatacaggacacccagtgaaatttgaattgcagataaacaatagcaayaaaatttttaaagggtaagtatatcccatgcaatatttgggatatacttatacttttttaaaaagttttctgaaattcaaatttaactggatatctggtattttatctgccagctctaaggtaagggacaggaggagcacaaccatcccctacccaacataattggccaaaaacatagtgaagtactaaactgggtgatatgatttggctgtgttcccacccaagtctcaacttgaactgtatctcccagaattcccatgtgttgtgggaggaacccagggggaggtaattgaatcatgg

SEQ ID NO: 51711 - DNA, 601 bp, Human
gcatcctatgctctaagggaatttagtagaagcattaaccatcaccagacataatttcctttgaggtcagattttcttattgacccttgtggctaaacctagaaatagactgcatcgcatggtagcttctacatggtagtttagttaagggagaattgccagatacgtgtgtgtgtgtgtgtgtgtgtgtgtgtgtgtgtgtgtgttacaatgcacataacataaaattccctattctagccattttaaagggtgcaattcaatgtgtgctaccagattcaggaaacaaaaatacaggacrcccagtgaaatttgaattgcagataaacaatagcaacaaaatttttaaagggtaagtatatcccatgcaatatttgggatatacttatacttttttaaaaagttttctgaaattcaaatttaactggatatctggtattttatctgccagctctaaggtaagggacaggaggagcacaaccatcccctacccaacataattggccaaaaacatagtgaagtactaaactgggtgatatgatttggctgtgttcccacccaagtctcaacttgaactgtatctcccagaattcccatgtgt

SEQ ID NO: 51712 - DNA, 601 bp, Human
aatggcccctcagaaaccagttgcacttgggctgccatgagaggtgccaaactcacaggcacatggagtaagtacttggttccaaaagcatgcccaaaagtgccacgccactgaattcattgagaacctcccatgaggcccatttcatggtgttctttaagttgtaccacaggtaccagggtagttcatttctttccattcagttatcaacagctgctaattttccccaaatgcaatttctatcaaaccagcatttgatgaggtcctactatgggctcagcatcctatgctctaagggaayttagtagaagcattaaccatcaccagacataatttcctttgaggtcagattttcttattgacccttgtggctaaacctagaaatagactgcatcgcatggtagcttctacatggtagtttagttaagggagaattgccagatacgtgtgtgtgtgtgtgtgtgtgtgtgtgtgtgtgtgtgtgttacaatgcacataacataaaattccctattctagccattttaaagggtgcaattcaatgtgtgctaccagattcaggaaacaaaaatacaggacacccagtgaaatttgaattgca

SEQ ID NO: 51713 - DNA, 601 bp, Human
ataaccaattaaagtagcagatgatcagcctggctgtcttggaatttgcaggcatgtctgagagttgtctgccattgggagatttttaatggcccctcagaaaccagttgcacttgggctgccatgagaggtgccaaactcacaggcacatggagtaagtacttggttccaaaagcatgcccaaaagtgccacgccactgaattcattgagaacctcccatgaggcccatttcatggtgttctttaagttgtaccacaggtaccagggtagttcatttctttccattcagttatcaacagytgctaattttccccaaatgcaatttctatcaaaccagcatttgatgaggtcctactatgggctcagcatcctatgctctaagggaatttagtagaagcattaaccatcaccagacataatttcctttgaggtcagattttcttattgacccttgtggctaaacctagaaatagactgcatcgcatggtagcttctacatggtagtttagttaagggagaattgccagatacgtgtgtgtgtgtgtgtgtgtgtgtgtgtgtgtgtgtgtgttacaatgcacataacataaaattccctat

SEQ ID NO: 51714 - DNA, 601 bp, Human
tcaaatctattaccaaagcagtctctatgtgatgggttagtcacaattaagcagccactgtgaacatatttccattcaaggaactccccagttataaaattgtgggacactattcgaaaatctaagacaaattggatattgaatgctggcacatagtagagttccctaaattaatgtggaatgaaagtaccacatgcaagcttgccatgtgagtgaatgctaagtgttgatgcaagatcttcgtaaacagcaaagcctgcaggaaaacacaagagaaaaaccgttttcctagatagttcawtctaacctttgagttcaggtgtcagccaaggaacagaatcttcagccaaggaacagaatttaattcatcaatacactttggattcaacccatacttaattgcttggaaattgcctctgaagaggtcactggaaacagtcttgtggttatgtttcctccacctcacagaaaggaggagaaacaaaggcataaaaactggtataaccaattaaagtagcagatgatcagcctggctgtcttggaatttgcaggcatgtctgagagttgtctgccattgggagatttttaatggcccctcaga

SEQ ID NO: 51715 - DNA, 601 bp, Human
tctcctagaccctcagaatcaaatctattaccaaagcagtctctatgtgatgggttagtcacaattaagcagccactgtgaacatatttccattcaaggaactccccagttataaaattgtgggacactattcgaaaatctaagacaaattggatattgaatgctggcacatagtagagttccctaaattaatgtggaatgaaagtaccacatgcaagcttgccatgtgagtgaatgctaagtgttgatgcaagatcttcgtaaacagcaaagcctgcaggaaaacacaagagaaaaaccrttttcctagatagttcaatctaacctttgagttcaggtgtcagccaaggaacagaatcttcagccaaggaacagaatttaattcatcaatacactttggattcaacccatacttaattgcttggaaattgcctctgaagaggtcactggaaacagtcttgtggttatgtttcctccacctcacagaaaggaggagaaacaaaggcataaaaactggtataaccaattaaagtagcagatgatcagcctggctgtcttggaatttgcaggcatgtctgagagttgtctgccattgggagat

SEQ ID NO: 51716 - DNA, 601 bp, Human
attttcaaggattaatcccgtcttccccatatgagaagtgtcccttctcctagaccctcagaatcaaatctattaccaaagcagtctctatgtgatgggttagtcacaattaagcagccactgtgaacatatttccattcaaggaactccccagttataaaattgtgggacactattcgaaaatctaagacaaattggatattgaatgctggcacatagtagagttccctaaattaatgtggaatgaaagtaccacatgcaagcttgccatgtgagtgaatgctaagtgttgatgcaagawcttcgtaaacagcaaagcctgcaggaaaacacaagagaaaaaccgttttcctagatagttcaatctaacctttgagttcaggtgtcagccaaggaacagaatcttcagccaaggaacagaatttaattcatcaatacactttggattcaacccatacttaattgcttggaaattgcctctgaagaggtcactggaaacagtcttgtggttatgtttcctccacctcacagaaaggaggagaaacaaaggcataaaaactggtataaccaattaaagtagcagatgatcagcctggctgtc

SEQ ID NO: 51717 - DNA, 601 bp, Human
cctgccagctagaccaacacctcactccactccccaaaataccttttctcattagcaatttctcctgctagaggataagttcctctagatgccccttgaaggtggaccttttcctctctaaattttccatggtcccaatcccagtgcacagtgtataaaaagggctcgattaatgttcatggcatgaattcaacaaatgtttgctgagggcctattgtgcttcaggcatcggaggcaccaaggtgatgagcagaatccctgctgtccagggatggatgagttgggtgagagctggcggtaycttcacctccacccctatggaattcagaagaagcccagcactcaggggctagagaaggcacccaaaatctcagagagcaaacagacccttacatggatcatatagaagtctgctaagctgctatactggtacagaagttggcttcagtatcattttcaaggattaatcccgtcttccccatatgagaagtgtcccttctcctagaccctcagaatcaaatctattaccaaagcagtctctatgtgatgggttagtcacaattaagcagccactgtgaacatatttccattcaaggaactc

SEQ ID NO: 51718 - DNA, 601 bp, Human
ataccagagagccactgagcataggctgaacctgccagctagaccaacacctcactccactccccaaaataccttttctcattagcaatttctcctgctagaggataagttcctctagatgccccttgaaggtggaccttttcctctctaaattttccatggtcccaatcccagtgcacagtgtataaaaagggctcgattaatgttcatggcatgaattcaacaaatgtttgctgagggcctattgtgcttcaggcatcggaggcaccaaggtgatgagcagaatccctgctgtccaggratggatgagttgggtgagagctggcggtaccttcacctccacccctatggaattcagaagaagcccagcactcaggggctagagaaggcacccaaaatctcagagagcaaacagacccttacatggatcatatagaagtctgctaagctgctatactggtacagaagttggcttcagtatcattttcaaggattaatcccgtcttccccatatgagaagtgtcccttctcctagaccctcagaatcaaatctattaccaaagcagtctctatgtgatgggttagtcacaattaagcagcc

SEQ ID NO: 51719 - DNA, 601 bp, Human
cgcaggttagaggaagagagaaacctaaaagggaaaaggatacccacattattcctcatggggctagggagacagcaatgtagaaaacctacaaatccattcatctgaagactgggaagtgtttttgaaatattcataactctgattagtgaagtcttcgaggaatcaacagacttacttaaaaactgggaaagtcaattatcttcaataaaacagctcagtctcttcccagtaacacctaggtttggggaataaaatgtggccgaaggaaggcaagagtcagtgctgccagagaaatctwtggctgaatcaacattctgaggaattttccataccagagagccactgagcataggctgaacctgccagctagaccaacacctcactccactccccaaaataccttttctcattagcaatttctcctgctagaggataagttcctctagatgccccttgaaggtggaccttttcctctctaaattttccatggtcccaatcccagtgcacagtgtataaaaagggctcgattaatgttcatggcatgaattcaacaaatgtttgctgagggcctattgtgcttcaggcatcggaggcacca

SEQ ID NO: 51720 - DNA, 601 bp, Human
ctctgcaagatagacgtgtactttacaaaaggattttccatcgaaagcatttaaacagcacagtctgtgtgcatcaaaagtggggtatcatatgtatatttttaaaccatttctgtagaatgaggtgtgccctcactgttgcctttccccaggtcactgacatggaggctccacaccccaacacactgctttgcaagcagcctcagccatctccatttgtcagtgtagctgctcagtgctcctggttcatttcaaagtcaccaaaacctcctatacaaaacttaaatggaaaaaaaaaaaacatttggatggttattccttcactgtgcctactaagtcaaaaaaaaataaacaagatccatcaaagggagaaaacagtttctacaaaataccctaccaaacagctttgcatttcagcatcaccctctgagtaatttcctctgaagtggctcctctaatgcatatcagtgctgctgacatcagcaacatttctgtgatttactgcaaatgcatctatcagaggctgggagtgggcgcaggttagaggaagagagaaacctaaaagggaaaaggatacccacattattcctcatggggctag

SEQ ID NO: 51721 - DNA, 601 bp, Human
ctgaaatctaaccctcaatgtgatgggattaggaggtgggggctttggggggtgattagatggtgagggctgagccctcatgaattggattcatgcccttataaaagagaacccagagagatctcttggtccttccaccgagtgaggacacagcaggaagacagctgtctgtcaatcaggtaccagatccttgccagacactgaatctgccttgatatcttgatcttcccagcctccagaaccatgagaaataaatttctgttgtgcaaaagctactcagtctatggtatttcattatagyagccctaaggcacactaagacattgactagatcatcctctctttccagcttgctaccctcatcgctcccacatcataccctgcctctactttctcctgtcatcctaccctccctgtgttctctttctcttctccacccaacttggatcccatattcaacactgctctttagctaacagactcaacttcctccccttttgtcttttcctggagctacctggaaatatccctgtataatattccttctctctgctcagagtcacaggctgctgaacactgctacagaaaccaggcagcctca

SEQ ID NO: 51722 - DNA, 601 bp, Human
agtgagctgagattgtgccgctgcactccagcctgggcgacagagggagactccatctcaaaaaactcctaggaacatcctgaaaataggctccggtagaccaaggagagtcctctgaaaaaggctgtaggtacaggccagaaagagagaagcccccagaagctaaaggacaggtgcacagaacaaaacggatctgggtgaccttggcacagccccaacagctccactacagctgagtctccctatggccacaccctaaaccttgttaccacaagaactgtctcaatactcagttgaagcsattactgctacggtctgaatttttgtgtcccccaaaattcacacactgaaatctaaccctcaatgtgatgggattaggaggtgggggctttggggggtgattagatggtgagggctgagccctcatgaattggattcatgcccttataaaagagaacccagagagatctcttggtccttccaccgagtgaggacacagcaggaagacagctgtctgtcaatcaggtaccagatccttgccagacactgaatctgccttgatatcttgatcttcccagcctccagaaccatgagaaataaa

SEQ ID NO: 51723 - DNA, 601 bp, Human
ccattccatctcaaccactaactcagggcaggtatcccagaagcagatcccggatgagaatttgtttgtgagttatttatttaggagatccctccagacaaaccgtgaaggagtgggtgatacaaactcctaggatggccaggcgcagtggctcatgcttgtcatcccagcactttgtgaggccgaggcaggggatcacctgaggtcaggagtttgagaccagcctggccaacatggcgaagtcccagctctgctaaaaatacaaaaaaaaaaaaaaaaaaaaaaattagccaggcatagyggtgcatgcttgtaatctaagctacttgggaggctgaggctggagaatggcttgaacctaggaggtggaggttggagtgagctgagattgtgccgctgcactccagcctgggcgacagagggagactccatctcaaaaaactcctaggaacatcctgaaaataggctccggtagaccaaggagagtcctctgaaaaaggctgtaggtacaggccagaaagagagaagcccccagaagctaaaggacaggtgcacagaacaaaacggatctgggtgaccttggcacagccccaacagctcc

SEQ ID NO: 51724 - DNA, 601 bp, Human
aggttgcagtgagtcgacattgcaccactgcactttagcctgggtgacagagtgagactctatctaaaaaaaaaaaaaaaaaaaaaaaaaaaaaaaaagatcttatggcttaagtccgtaacatgtcctattgcataattccctagctttaagaaatctgttcgctgtgtcccacccaataatggtgataacaaatagctagaggtacttcgattaattccatatttatcagaccataaaatacatggaagtgacaatggttcagaatgatgaaaaggtggggcatctacaaacttgatgkgtcattcatttgtttattcaaccaatgcatgccccctgtgtgccaggagtagtaccaatctccacaccccacatccaggctgccaagccacccaccaccgggtctgaagggaccaattctgagaagtgtgaggccagtgaggccacttggtgtagctttgttctctcttctgctctcagcctcctcccctctgatccaaccttcccctcacccctaccccaaaccattccaaagatgcctcaggggcccctgctgaagatctgaagactccctcatgcccccagcctcttcagggcccct

SEQ ID NO: 51725 - DNA, 601 bp, Human
atttgaggacccaaaagactaaagggcttttctttcaccccacaagctggggagagaacaaggggttcacatgagacttaaaggagcagtgacttccttctcgggacttgtaagctcgacagtttcccctgattttcccccaaatctcttcttgtatttataaaccaaaggtatggcaaaaaaaaaaaaaaagtcagaagcctctccactagcagacaggccccagagaacaaggttatcagggttagaggaagaagggggaaggttggacttcaacagccacccagcttacccctaccayaggtctgtcttccacgatggccccaccctccacaggaaacactgggcagggctcctaaaagacagtcccttctccaagcctccttcctcctccctggaaagggacagaagcagtagcactattgggaagatttaacataaaatgtacggcatgttgctcaatgccttgttcaaagcaagtcctcaatcaacgtgagctgtccacattattaggaggtgaagaaaactacgtgttctatgcaagcaaatgcaacaaagcgtgcagatgctgtgtttgacagaggtgtgggggacagaaaga

SEQ ID NO: 51726 - DNA, 601 bp, Human
aaacagtccaaagagagttcttcatggtttgtacaagcgctagagtggacagacaagagacagggcagtattttacttcactgggctccaaacactcagttcgggcctttcttgttccttcatgaagagctacaagcctctcttttactcaggggtacaaaatacttgtgagattttaaaaattctattgaatggcatgagtcacacttggtgagtcccctctctggtggaagacaggcagaatttaccctgagtctgccttcctggggtccctctgactggggccaaactgcataaactrtgatttgaggacccaaaagactaaagggcttttctttcaccccacaagctggggagagaacaaggggttcacatgagacttaaaggagcagtgacttccttctcgggacttgtaagctcgacagtttcccctgattttcccccaaatctcttcttgtatttataaaccaaaggtatggcaaaaaaaaaaaaaaagtcagaagcctctccactagcagacaggccccagagaacaaggttatcagggttagaggaagaagggggaaggttggacttcaacagccacccagcttacccctac

SEQ ID NO: 51727 - DNA, 601 bp, Human
ttctcaaacatcaaaacccaccttacgtgtccccacctccaagctgactgctcatcccccaacattatattataagatgcccttcctttgtgtctcaatatgaagtttagcagagaacctacaactaggagacccctggttacagtttgtttcattcctgaatttgttcattcatccattctcccatttgctttgggccagcatttatgatatcaagttcacacacctgcccaacagaaactttgactgcagagttaatcctgcatatggaagcacccctggcactattgtggttttttcycataggcagaaatccagagtcaaggtgttaacattctcaaaaagcaaacagtccaaagagagttcttcatggtttgtacaagcgctagagtggacagacaagagacagggcagtattttacttcactgggctccaaacactcagttcgggcctttcttgttccttcatgaagagctacaagcctctcttttactcaggggtacaaaatacttgtgagattttaaaaattctattgaatggcatgagtcacacttggtgagtcccctctctggtggaagacaggcagaatttaccctgagt

SEQ ID NO: 51728 - DNA, 601 bp, Human
gccttcagtcctgtcccccttaaatccatcctccatataccagccatgtacatggtgtgtcactctctcaggtgtcagtgtgatcacatggacccctgctaacaatgctctgaaggcgccaccaacattcagagtaaagtgcaggctccatgccttgctccctgactctcccttccaggacctggcgcctgcctatctcacaggcctcacccactgccacgcccccacaagcaacctttgccccagccaaacccagcagcacccagacccgctcacacctgtcccagagaaacaggtctcrcttcccagattcttctcacctcttgactctttttttggtcaattccttctcaaacatcaaaacccaccttacgtgtccccacctccaagctgactgctcatcccccaacattatattataagatgcccttcctttgtgtctcaatatgaagtttagcagagaacctacaactaggagacccctggttacagtttgtttcattcctgaatttgttcattcatccattctcccatttgctttgggccagcatttatgatatcaagttcacacacctgcccaacagaaactttgactgcagag

SEQ ID NO: 51729 - DNA, 601 bp, Human
gccgacctcccacccctactctaggtctggaatcattccggggccacctgcactgatggctcagagcttccaaagagtcccaggttacagctcagcctgcataggcataggcagacttcaggccgctggggagggagggtgttaggaagagggcaggaaagatgaggagcgcaggattccacctcgggtgctccacccacaccggcctccagttgtcccagcagctcttagagcagtatctgtgctgcctctggttccagatacccaaacaaccaaatcatgttttccctgtttccatgggacagccctaccttaaaggcaatcaagctgatcccagtaagaatggcagtaacactaagtctgtatgcactaagagagcaagccatggtcccaaaacgccacccgaggctctccctttgggtgaagcattgctccctgctgtcttcaaaatttcaggctgcacttccagatggaagagatcaagctatgatgaaatgactgagaccctatggagccatgagaagaggaaaacaaggcagactggggggaagagggagctagaactgcctgccacctcatctcacatctgtgctttcctgtc

SEQ ID NO: 51730 - DNA, 601 bp, Human
gagccactgcacccagccagtgaacctgtttttatcttcgccaaaccttctgtgtaaggtgatgattattatctgcccccattgatagatgaggaaactacgggccagagaggggacactgagcaacctatgacaagctaacaagcaggggcatccttgaatccatcttcagacacttaacccgagtgcctccattcctccatgtcacctgaaacaaatggcattccaagggttcagagtctcttggaaacctgaaatgcagctgcctcagtgccactgtcacacagcagcgtgactctgytactgacccaggcaaagtgcaactgtgactgcagactcccgggcaagagggaaaggacagcctcctctcacctccccccgccccgcagccgacctcccacccctactctaggtctggaatcattccggggccacctgcactgatggctcagagcttccaaagagtcccaggttacagctcagcctgcataggcataggcagacttcaggccgctggggagggagggtgttaggaagagggcaggaaagatgaggagcgcaggattccacctcgggtgctccacccacaccggcctccagt

SEQ ID NO: 51731 - DNA, 601 bp, Human
taaagtgctgggattacaagtatgagccactgcacccagccagtgaacctgtttttatcttcgccaaaccttctgtgtaaggtgatgattattatctgcccccattgatagatgaggaaactacgggccagagaggggacactgagcaacctatgacaagctaacaagcaggggcatccttgaatccatcttcagacacttaacccgagtgcctccattcctccatgtcacctgaaacaaatggcattccaagggttcagagtctcttggaaacctgaaatgcagctgcctcagtgccackgtcacacagcagcgtgactctgctactgacccaggcaaagtgcaactgtgactgcagactcccgggcaagagggaaaggacagcctcctctcacctccccccgccccgcagccgacctcccacccctactctaggtctggaatcattccggggccacctgcactgatggctcagagcttccaaagagtcccaggttacagctcagcctgcataggcataggcagacttcaggccgctggggagggagggtgttaggaagagggcaggaaagatgaggagcgcaggattccacctcgggtg

SEQ ID NO: 51732 - DNA, 601 bp, Human
gagttggggaggctagaacagccactagactctaagtaagtctgacccctggaaaaggaaggaaagaaggaaggaggaggtaagcatcttccagcctaaggaagtttagcaagcccatcaaggagttcttgagctgaagttagctgtctgaggagtcctgtgtctcccagaaacaatcctgccgtggtatccttgctgcgcacagacactggctgggagcagcccgggagcaacgtacccgcagtgcaagcccagctgtggagatcagggcagcagccagggccctgatcaccaacacccmctccagttagaggcctgtaggcgcatgctcatgcccaacacagccccacttcacagacaaagaaactgagacccagacaggttcaatggctaagtcaaggttaagcggcccaaaagcgagaagccagattaaaaagggaatcatctgacttcaaagtcagttctgcagagtgtaggaacaggaaaagaggaaacatagcaattccagggggaaagggcccttttatcccaaaaaataggaacgacatttgtttcaaataggcattaaaaatattttccagtctatgagattgactacttc

SEQ ID NO: 51733 - DNA, 601 bp, Human
acaaagaagcaaacttggccagatggtgatgaggatggtggtgctgatggtggtgaaggtgacaggagccctgatggcctactgggcacttactcatgctgtcactctgacaaacactctgcttacatcactacattcggtcctcactacaaggaattatcacactgcatgagtccaggtaggacccccagaagcagatgccaagaagggattaaatgtgcatggattttattagggggaacgcatgtgtgagagaaaatgatagggagttggggaggctagaacagccactagactctawgtaagtctgacccctggaaaaggaaggaaagaaggaaggaggaggtaagcatcttccagcctaaggaagtttagcaagcccatcaaggagttcttgagctgaagttagctgtctgaggagtcctgtgtctcccagaaacaatcctgccgtggtatccttgctgcgcacagacactggctgggagcagcccgggagcaacgtacccgcagtgcaagcccagctgtggagatcagggcagcagccagggccctgatcaccaacaccccctccagttagaggcctgtaggcgcatgctcatgc

SEQ ID NO: 51734 - DNA, 601 bp, Human
aagcaggagggccagagagagaagggatgtgaggacagatacacaggttggagtgatgcagccatgagcccaggaatgtggtccctctagaagctggaaaaggcaagggaaggatcctcccctagagcctcccgaaggaacctgtactgcttactctttgattttggccaagtgaggctgattttgaacttctgacttccagaaccatacaataataaattagtgctgctttaagccactacatgtgtggcaatttgctacggaagccccaggaaatgaatctgccctccattagttcagrtttcctgatatggtttggctgtgtccccacccaaatctcaccttaaattgtattcccataatccttacatcttgggggagtgaccccgtgggaggtaattgaagcatgggggcaggtttttccccgtgctgttctcgtgatagtgaataagtctcacaagatctgatggttttataaaggtgggttcccttgcacatgctctcttgcctgctgccatgtaagatgtgactttgctcctcatttaccctccaccatgattgtgaggcctccctagccatatggaactgtgagtccattaaa

SEQ ID NO: 51735 - DNA, 601 bp, Human
ataaacctaattacctaagtggggtaaacagtcccactccagcagggagttaaactgctcaatcactgttggaaaagtcaaagagcaggctatgtcactgcctgttcaaaacacctggctgtagaggtgatggcttagaagaatctaagtttgtaaacatctgcctctcctcctaggccctcggaatcagtttctgtctttggaaaccgagctgaacgtcagtcttttatggcatattatccaatccaataaaatcactccatgttaaatttccctcagatttacacaaacgcaaaattgyctggaatcttgattgaaagatctatatgttagaatcagcaacctgggcattatgttcttgctaacctttccctaaagacgctgcattcactttcccccttgctcctgttgatgccgagaaggtgagccttgcctaaggtggctttcttttaccactgcccacatctcccattcattctgcctcatcactgtatttcatcccttgggcctttccctacccctgtggccagcagcctcatccaggccactgtcacatcttgcctggaccagcccagcagcctcccaaggggcctccctgctt

SEQ ID NO: 51736 - DNA, 601 bp, Human
tggctgctctcaaagggctgctccaatgcccggaagacaagaccgccagtgacaaggtagaccaccacaaccacaaagatggcaaccaccgtcttccacttcatgacggtctgcaagcccccttgggaggtgccttccatcctggctaccactgtggctcgggaggaaatggacaggcgcggagttggagtcggagccggagccgggggttgcccgttagtggcgctcttgggctggcacaccggtgctgctgcgggaacggccactgaggagtcagggtgggggacaaagaagaagagaktttgtttataaataaatacaaaacgtgtcagaaacaaagcacagatgtcttctttgagccagctttcaaatgtgaggatgaaacgctggttcaccaagcctgcagttagggaatttgatcagttgctaggtacccatttgagttctaaaaaataagcaccaggggtcccagtttaaaaaaaaaaaaagtataaactgagtttgaaatacttacatttttctacgagggtccaaattgaaagctatctctctgccatttataattcacctcctcccttagcttccttgttgaaacaatgtg

SEQ ID NO: 51737 - DNA, 601 bp, Human
ccattagaatttaatgtgcatcttccagagccagaaggaattgtaaaagctgtcttttccatccctccaccttccaaactttagagcccccagaaagatgagactctccctcacctccataaatgtcaccgccttccaccaaaacccactctttgtagttcaggagggtgtctgggatagaaagtggaacttcagcctcagaggcagccttcctccttcacgtccaaggtgaagccctccaacagggctctccaccatttccctttcttcctcgtgggaactgcttttctctctggcttcycagacttcacaaccctcctgatccagtccctcgcaccgcagccccacagatgactctctggctttcctatagctccttaccgccacagtccacccctgccaagtccacatctgtcgcccagaagtgttgccttgcttctttaggctgcagttcaagttctctgcttccattttcctaagaatcttttttccttaatatccagggtatgtaaaggccttagtacagtgcctgatacacagtaagtattcaaaaacagcaaacctgatgattactactactgtgatccatattatttcatcc

SEQ ID NO: 51738 - DNA, 601 bp, Human
atgggcgtggtgactcacacctgtaatcccagcactttaggaggccaaggcgggttgattgcttgagcctaggaattcaagaccagcctgggcaacatggtgaaaacctgtctctacaaaaaaatgcaaaaagtagccaggcatggtggcacatgcctgtagtcccagctactcaggagactgaggcagaaggatcagctgatacctcgatcaggaagttgaacctgcaatgagccatgatcacaccactgcactccagcctaagtgacagaatgagaccctgtctcaaaaaagaaaaagaaaaaaaaaaaagacaaagccatttggagaactgacttcctatgaaacacttatatgaaatgctgcccttggatttttaacattttatttttttgagaagaattatagggcatagctatgaaatcatatttactcccaggaagggaagaatttgtatttctatttatttaagagtcaagtcattattaaaactaactgacaagaatatgattgctatgaaggtgccagatcataagcagcatcagaattcccctactctattggtatggtaagaaataaataaataagaaaacagcgcaga

SEQ ID NO: 51739 - DNA, 601 bp, Human
aatctggcactgattagtacaaaaatctcatcaccacaaatgtggtagcattttcccatgaaagaagaaaagggatgggcgtggtgactcacacctgtaatcccagcactttaggaggccaaggcgggttgattgcttgagcctaggaattcaagaccagcctgggcaacatggtgaaaacctgtctctacaaaaaaatgcaaaaagtagccaggcatggtggcacatgcctgtagtcccagctactcaggagactgaggcagaaggatcagctgatacctcgatcaggaagttgaacctrcaatgagccatgatcacaccactgcactccagcctaagtgacagaatgagaccctgtctcaaaaaagaaaaagaaaaaaaaaaaagacaaagccatttggagaactgacttcctatgaaacacttatatgaaatgctgcccttggatttttaacattttatttttttgagaagaattatagggcatagctatgaaatcatatttactcccaggaagggaagaatttgtatttctatttatttaagagtcaagtcattattaaaactaactgacaagaatatgattgctatgaaggtgcca
